United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 198

SEQ ID NO: 8231933 - DNA, 22 bp, Homo sapiens
gtctggctctggaaggcaaagg

SEQ ID NO: 8231934 - DNA, 22 bp, Homo sapiens
gtctggctaattttggtaattt

SEQ ID NO: 8231935 - DNA, 22 bp, Homo sapiens
gtctggctccaggatctcatga

SEQ ID NO: 8231936 - DNA, 22 bp, Homo sapiens
gtctggcagatcgagcagccca

SEQ ID NO: 8231937 - DNA, 22 bp, Homo sapiens
gtctggcagatcgagcagccca

SEQ ID NO: 8231938 - DNA, 22 bp, Homo sapiens
gtctggcattcttcctggagaa

SEQ ID NO: 8231939 - DNA, 22 bp, Homo sapiens
gtctggcattcttcctggagaa

SEQ ID NO: 8231940 - DNA, 22 bp, Homo sapiens
gtctggccatttgcccattgtg

SEQ ID NO: 8231941 - DNA, 22 bp, Homo sapiens
gtctggggcagcaaggcgcgcg

SEQ ID NO: 8231942 - DNA, 17 bp, Homo sapiens
gtctgggctttagagac

SEQ ID NO: 8231943 - DNA, 22 bp, Homo sapiens
gtctggggaagtcagggcatca

SEQ ID NO: 8231944 - DNA, 22 bp, Homo sapiens
gtctggggaagtcagggcatca

SEQ ID NO: 8231945 - DNA, 22 bp, Homo sapiens
gtctgggccaggcgagccgagg

SEQ ID NO: 8231946 - DNA, 22 bp, Homo sapiens
gtctgggctcccagggtcggcg

SEQ ID NO: 8231947 - DNA, 22 bp, Homo sapiens
gtctgggctcccagggtcggcg

SEQ ID NO: 8231948 - DNA, 22 bp, Homo sapiens
gtctgggcttagggacatggca

SEQ ID NO: 8231949 - DNA, 22 bp, Homo sapiens
gtctgggctcctggcaggcagc

SEQ ID NO: 8231950 - DNA, 22 bp, Homo sapiens
gtctgggctcctggcaggcagc

SEQ ID NO: 8231951 - DNA, 22 bp, Homo sapiens
gtctgggccaggcgagccgagg

SEQ ID NO: 8231952 - DNA, 22 bp, Homo sapiens
gtctgggcacctggcctgggaa

SEQ ID NO: 8231953 - DNA, 22 bp, Homo sapiens
gtctgggcaagggagatggcgc

SEQ ID NO: 8231954 - DNA, 22 bp, Homo sapiens
gtctgggcaagggagatggcgc

SEQ ID NO: 8231955 - DNA, 22 bp, Homo sapiens
gtctgggcaagggagatggcgc

SEQ ID NO: 8231956 - DNA, 22 bp, Homo sapiens
gtctgggagtttggtgctgccg

SEQ ID NO: 8231957 - DNA, 22 bp, Homo sapiens
gtctggctttcatggctctgca

SEQ ID NO: 8231958 - DNA, 22 bp, Homo sapiens
gtctggctttgctcagatgctg

SEQ ID NO: 8231959 - DNA, 22 bp, Homo sapiens
gtctggctttatatttgctatt

SEQ ID NO: 8231960 - DNA, 20 bp, Homo sapiens
gtctggcttcgtgattctgg

SEQ ID NO: 8231961 - DNA, 22 bp, Homo sapiens
gtctggctttatatttgctatt

SEQ ID NO: 8231962 - DNA, 22 bp, Homo sapiens
gtcaggagatagggcaagcttc

SEQ ID NO: 8231963 - DNA, 22 bp, Homo sapiens
gtcaggagagatcaggacagca

SEQ ID NO: 8231964 - DNA, 22 bp, Homo sapiens
gtcaggactctgacccgtcccg

SEQ ID NO: 8231965 - DNA, 22 bp, Homo sapiens
gtcaggagagatcaggacagca

SEQ ID NO: 8231966 - DNA, 22 bp, Homo sapiens
gtcaggagaggccatcagcttt

SEQ ID NO: 8231967 - DNA, 22 bp, Homo sapiens
gtcaggagatagggcaagcttc

SEQ ID NO: 8231968 - DNA, 22 bp, Homo sapiens
gtcaggacaggctctggactga

SEQ ID NO: 8231969 - DNA, 22 bp, Homo sapiens
gtcaggaagtggcattggagaa

SEQ ID NO: 8231970 - DNA, 19 bp, Homo sapiens
gtcaggaagtactttccgg

SEQ ID NO: 8231971 - DNA, 22 bp, Homo sapiens
gtcaggaagcaaggttgggcat

SEQ ID NO: 8231972 - DNA, 22 bp, Homo sapiens
gtcaggaaaacccgggttgact

SEQ ID NO: 8231973 - DNA, 21 bp, Homo sapiens
gtcaggcccatagcagtgcct

SEQ ID NO: 8231974 - DNA, 21 bp, Homo sapiens
gtcaggcccatagcagtgcct

SEQ ID NO: 8231975 - DNA, 22 bp, Homo sapiens
gtccagggaaatagcgacaggg

SEQ ID NO: 8231976 - DNA, 22 bp, Homo sapiens
gtccagggaaatagcgacaggg

SEQ ID NO: 8231977 - DNA, 22 bp, Homo sapiens
gtccagggaaatagcgacaggg

SEQ ID NO: 8231978 - DNA, 22 bp, Homo sapiens
gtcaggctgctggagcttgggt

SEQ ID NO: 8231979 - DNA, 22 bp, Homo sapiens
gtatgtctatttcaaatagctg

SEQ ID NO: 8231980 - DNA, 22 bp, Homo sapiens
gtatgtctgagtaataatgtgt

SEQ ID NO: 8231981 - DNA, 22 bp, Homo sapiens
gtatgtcaaaatctgcatgata

SEQ ID NO: 8231982 - DNA, 22 bp, Homo sapiens
gtatgtgtaagtatgccacctt

SEQ ID NO: 8231983 - DNA, 22 bp, Homo sapiens
gtatgtgtaagtatgccacctt

SEQ ID NO: 8231984 - DNA, 22 bp, Homo sapiens
gtatgtgtgcaaatgtaaatat

SEQ ID NO: 8231985 - DNA, 22 bp, Homo sapiens
gtatgtgtgcaaatgtaaatat

SEQ ID NO: 8231986 - DNA, 22 bp, Homo sapiens
gtatgtgaggttggtttccagg

SEQ ID NO: 8231987 - DNA, 22 bp, Homo sapiens
gtatgtgaggttggtttccagg

SEQ ID NO: 8231988 - DNA, 22 bp, Homo sapiens
gtcagaggggacaagacacaga

SEQ ID NO: 8231989 - DNA, 22 bp, Homo sapiens
gtcagaggggacaagacacaga

SEQ ID NO: 8231990 - DNA, 22 bp, Homo sapiens
gtattacatttagtaattaggc

SEQ ID NO: 8231991 - DNA, 22 bp, Homo sapiens
gtattacatttagtaattaggc

SEQ ID NO: 8231992 - DNA, 22 bp, Homo sapiens
gtattacatttagtaattaggc

SEQ ID NO: 8231993 - DNA, 22 bp, Homo sapiens
gtattacaaataaatgttactg

SEQ ID NO: 8231994 - DNA, 22 bp, Homo sapiens
gtattacaaataaatgttactg

SEQ ID NO: 8231995 - DNA, 20 bp, Homo sapiens
gtattacaggcttagaacca

SEQ ID NO: 8231996 - DNA, 20 bp, Homo sapiens
gtattacaggcttagaacca

SEQ ID NO: 8231997 - DNA, 22 bp, Homo sapiens
gtcagctgcagtgggcacagcc

SEQ ID NO: 8231998 - DNA, 22 bp, Homo sapiens
gtcagctgcacaggtgggagct

SEQ ID NO: 8231999 - DNA, 19 bp, Homo sapiens
gtcagctggaactctgaaa

SEQ ID NO: 8232000 - DNA, 21 bp, Homo sapiens
gtcagctgtgtgtgaggaccc

SEQ ID NO: 8232001 - DNA, 22 bp, Homo sapiens
gtcagctgtctccccagagtgg

SEQ ID NO: 8232002 - DNA, 22 bp, Homo sapiens
gtcccagggaagaaggcagcac

SEQ ID NO: 8232003 - DNA, 22 bp, Homo sapiens
gtcccagaaacatattgctggt

SEQ ID NO: 8232004 - DNA, 22 bp, Homo sapiens
gtcccagaaacatattgctggt

SEQ ID NO: 8232005 - DNA, 22 bp, Homo sapiens
gtcccacaccttgaggggtctt

SEQ ID NO: 8232006 - DNA, 22 bp, Homo sapiens
gtcccacaggaactcggtggag

SEQ ID NO: 8232007 - DNA, 22 bp, Homo sapiens
gtccattttattcagagacttt

SEQ ID NO: 8232008 - DNA, 22 bp, Homo sapiens
gtccatctgtaggagggacaca

SEQ ID NO: 8232009 - DNA, 22 bp, Homo sapiens
gtccatctcttattgatcctaa

SEQ ID NO: 8232010 - DNA, 22 bp, Homo sapiens
gtccatctgtaggagggacaca

SEQ ID NO: 8232011 - DNA, 22 bp, Homo sapiens
gtccatctaagtatccagcctg

SEQ ID NO: 8232012 - DNA, 22 bp, Homo sapiens
gtccagggccccgagcaccagg

SEQ ID NO: 8232013 - DNA, 22 bp, Homo sapiens
gtccagggccccgagcaccagg

SEQ ID NO: 8232014 - DNA, 22 bp, Homo sapiens
gtccaggtctggaccctgagcc

SEQ ID NO: 8232015 - DNA, 22 bp, Homo sapiens
gtccagtgacaagtagctggcc

SEQ ID NO: 8232016 - DNA, 22 bp, Homo sapiens
gtccagtcactgtcaatgttcc

SEQ ID NO: 8232017 - DNA, 22 bp, Homo sapiens
gtccagtgacaagtagctggcc

SEQ ID NO: 8232018 - DNA, 22 bp, Homo sapiens
gtccagtgtgtttatcttggat

SEQ ID NO: 8232019 - DNA, 22 bp, Homo sapiens
gtccatccagggtcaccatgac

SEQ ID NO: 8232020 - DNA, 22 bp, Homo sapiens
gtccatccagaggccaccatgg

SEQ ID NO: 8232021 - DNA, 22 bp, Homo sapiens
gtccatccgtggtagcatggat

SEQ ID NO: 8232022 - DNA, 22 bp, Homo sapiens
gtcctgggtccccgcaggtcag

SEQ ID NO: 8232023 - DNA, 22 bp, Homo sapiens
gtcctgggtccccgcaggtcag

SEQ ID NO: 8232024 - DNA, 22 bp, Homo sapiens
gtcctgggtccccgcaggtcag

SEQ ID NO: 8232025 - DNA, 22 bp, Homo sapiens
gtcctgggtccccgcaggtcag

SEQ ID NO: 8232026 - DNA, 22 bp, Homo sapiens
gtcctgtgtcccagagaaagag

SEQ ID NO: 8232027 - DNA, 22 bp, Homo sapiens
gtccttcaaggtccttggtgtg

SEQ ID NO: 8232028 - DNA, 22 bp, Homo sapiens
gtcctgtgtgttgccggctgaa

SEQ ID NO: 8232029 - DNA, 22 bp, Homo sapiens
gtcctgtgtgttgccggctgaa

SEQ ID NO: 8232030 - DNA, 22 bp, Homo sapiens
gtcctgtgtgagtgcaccacct

SEQ ID NO: 8232031 - DNA, 22 bp, Homo sapiens
gtcccagggcaaggctgtttct

SEQ ID NO: 8232032 - DNA, 22 bp, Homo sapiens
gtcccagggatgcagacatgag

SEQ ID NO: 8232033 - DNA, 22 bp, Homo sapiens
gtcccagggatgcagacatgag

SEQ ID NO: 8232034 - DNA, 22 bp, Homo sapiens
gtcccagggatgcagacatgag

SEQ ID NO: 8232035 - DNA, 22 bp, Homo sapiens
gtcccagggatgcagacatgag

SEQ ID NO: 8232036 - DNA, 22 bp, Homo sapiens
gtcccagggatgcagacatgag

SEQ ID NO: 8232037 - DNA, 22 bp, Homo sapiens
gtcccagggaggttcagggctt

SEQ ID NO: 8232038 - DNA, 22 bp, Homo sapiens
gtcccagggaggttcagggctt

SEQ ID NO: 8232039 - DNA, 22 bp, Homo sapiens
gtcccaggtcccagcacatctg

SEQ ID NO: 8232040 - DNA, 22 bp, Homo sapiens
gtcccaggtgcccagtgggcag

SEQ ID NO: 8232041 - DNA, 22 bp, Homo sapiens
gtcccaggtgggctccacctct

SEQ ID NO: 8232042 - DNA, 22 bp, Homo sapiens
gtacatctttaaattgttcagt

SEQ ID NO: 8232043 - DNA, 22 bp, Homo sapiens
gtacatctgtcttgttctgttg

SEQ ID NO: 8232044 - DNA, 22 bp, Homo sapiens
gtacatctgtcttgttctgttg

SEQ ID NO: 8232045 - DNA, 22 bp, Homo sapiens
gtacatattataaaatacagct

SEQ ID NO: 8232046 - DNA, 22 bp, Homo sapiens
gtacatattataaaatacagct

SEQ ID NO: 8232047 - DNA, 22 bp, Homo sapiens
gtacatgcagattatagctaat

SEQ ID NO: 8232048 - DNA, 22 bp, Homo sapiens
gtacatgtatgagatatgtgta

SEQ ID NO: 8232049 - DNA, 22 bp, Homo sapiens
gtacatgtgcacaatgtgcagg

SEQ ID NO: 8232050 - DNA, 22 bp, Homo sapiens
gtacatttaggattcattgaaa

SEQ ID NO: 8232051 - DNA, 22 bp, Homo sapiens
gtacatttactgatgaaaagta

SEQ ID NO: 8232052 - DNA, 22 bp, Homo sapiens
gtacatgttggttgtttccagt

SEQ ID NO: 8232053 - DNA, 22 bp, Homo sapiens
gtacattggcaactctcttaga

SEQ ID NO: 8232054 - DNA, 22 bp, Homo sapiens
gtacagggcccctcagcagggc

SEQ ID NO: 8232055 - DNA, 22 bp, Homo sapiens
gtacagtaatcccgttcttctg

SEQ ID NO: 8232056 - DNA, 22 bp, Homo sapiens
gtacagtggaggtctgtgttca

SEQ ID NO: 8232057 - DNA, 22 bp, Homo sapiens
gtacagtgtgactttggagtga

SEQ ID NO: 8232058 - DNA, 19 bp, Homo sapiens
gtacagtggtaagctatga

SEQ ID NO: 8232059 - DNA, 22 bp, Homo sapiens
gtacataagaaattactacaga

SEQ ID NO: 8232060 - DNA, 22 bp, Homo sapiens
gtacataagaaattactacaga

SEQ ID NO: 8232061 - DNA, 22 bp, Homo sapiens
gtacatattacagacaaagctt

SEQ ID NO: 8232062 - DNA, 22 bp, Homo sapiens
gtacatattaaaggtctataaa

SEQ ID NO: 8232063 - DNA, 22 bp, Homo sapiens
gtacatattaaaggtctataaa

SEQ ID NO: 8232064 - DNA, 22 bp, Homo sapiens
gtacatatggcacatgctattt

SEQ ID NO: 8232065 - DNA, 22 bp, Homo sapiens
gtacatatggcacatgctattt

SEQ ID NO: 8232066 - DNA, 22 bp, Homo sapiens
gtatatctcttacatacacaca

SEQ ID NO: 8232067 - DNA, 22 bp, Homo sapiens
gtatatattggataaaccagag

SEQ ID NO: 8232068 - DNA, 22 bp, Homo sapiens
gtatatattggataaaccagag

SEQ ID NO: 8232069 - DNA, 22 bp, Homo sapiens
gtatatatgtgtgaacatgtat

SEQ ID NO: 8232070 - DNA, 22 bp, Homo sapiens
gtatatatgtgtgaacatgtat

SEQ ID NO: 8232071 - DNA, 22 bp, Homo sapiens
gtatggcactatcctctctgat

SEQ ID NO: 8232072 - DNA, 22 bp, Homo sapiens
gtatggaagtataagttttgaa

SEQ ID NO: 8232073 - DNA, 18 bp, Homo sapiens
gtatatctgcacatatac

SEQ ID NO: 8232074 - DNA, 22 bp, Homo sapiens
gtatatcttcagaaattatagg

SEQ ID NO: 8232075 - DNA, 21 bp, Homo sapiens
gtatggcattgattagttact

SEQ ID NO: 8232076 - DNA, 22 bp, Homo sapiens
gtatgtatacattgtggaatgg

SEQ ID NO: 8232077 - DNA, 22 bp, Homo sapiens
gtatgtatatatgtgtacacac

SEQ ID NO: 8232078 - DNA, 22 bp, Homo sapiens
gtatgtatacattgtggaatgg

SEQ ID NO: 8232079 - DNA, 22 bp, Homo sapiens
gtatgtatatatgtgtacacac

SEQ ID NO: 8232080 - DNA, 22 bp, Homo sapiens
gtatgtatgtatatgtttaaga

SEQ ID NO: 8232081 - DNA, 22 bp, Homo sapiens
gtatgtatgtatatgtttaaga

SEQ ID NO: 8232082 - DNA, 21 bp, Homo sapiens
gtatgtatggataatgagagg

SEQ ID NO: 8232083 - DNA, 22 bp, Homo sapiens
gtatataaggtaaagcgattgt

SEQ ID NO: 8232084 - DNA, 20 bp, Homo sapiens
gtatataaccatagtgacta

SEQ ID NO: 8232085 - DNA, 22 bp, Homo sapiens
gtatataaggtaaagcgattgt

SEQ ID NO: 8232086 - DNA, 22 bp, Homo sapiens
gtatataaggtaaagcgattgt

SEQ ID NO: 8232087 - DNA, 22 bp, Homo sapiens
gtatataaggtaaagcgattgt

SEQ ID NO: 8232088 - DNA, 22 bp, Homo sapiens
gtatatatcggcactattttaa

SEQ ID NO: 8232089 - DNA, 22 bp, Homo sapiens
gtatatatcggcactattttaa

SEQ ID NO: 8232090 - DNA, 22 bp, Homo sapiens
gtatatatcggcactattttaa

SEQ ID NO: 8232091 - DNA, 20 bp, Homo sapiens
gtatataaccatagtgacta

SEQ ID NO: 8232092 - DNA, 20 bp, Homo sapiens
gtatataaccatagtgacta

SEQ ID NO: 8232093 - DNA, 22 bp, Homo sapiens
gtataggtttggctctctccag

SEQ ID NO: 8232094 - DNA, 22 bp, Homo sapiens
gtatactagatagacagtatca

SEQ ID NO: 8232095 - DNA, 22 bp, Homo sapiens
ggtgtcctcatgattttctaga

SEQ ID NO: 8232096 - DNA, 22 bp, Homo sapiens
ggtgtcctcatgattttctaga

SEQ ID NO: 8232097 - DNA, 22 bp, Homo sapiens
ggtgtcctcactatagcaagtc

SEQ ID NO: 8232098 - DNA, 22 bp, Homo sapiens
ggtgtcctcactatagcaagtc

SEQ ID NO: 8232099 - DNA, 22 bp, Homo sapiens
ggtgtcctactgcttggttgct

SEQ ID NO: 8232100 - DNA, 19 bp, Homo sapiens
ggtgtcctagagataagag

SEQ ID NO: 8232101 - DNA, 21 bp, Homo sapiens
ggtgtcctgagggataggtag

SEQ ID NO: 8232102 - DNA, 22 bp, Homo sapiens
ggtgtcctcggattcagggcag

SEQ ID NO: 8232103 - DNA, 21 bp, Homo sapiens
ggtgtcctgagggataggtag

SEQ ID NO: 8232104 - DNA, 22 bp, Homo sapiens
ggtgtcctcggattcagggcag

SEQ ID NO: 8232105 - DNA, 22 bp, Homo sapiens
ggtgtcctcatgattttctaga

SEQ ID NO: 8232106 - DNA, 23 bp, Homo sapiens
gtaaaatacgcagtgcagtgtga

SEQ ID NO: 8232107 - DNA, 23 bp, Homo sapiens
gtaaaatacgcagtgcagtgtga

SEQ ID NO: 8232108 - DNA, 23 bp, Homo sapiens
gtaaaatacgcagtgcagtgtga

SEQ ID NO: 8232109 - DNA, 23 bp, Homo sapiens
gtaaaatacgcagtgcagtgtga

SEQ ID NO: 8232110 - DNA, 22 bp, Homo sapiens
ggtgtcctgtcagctagagtga

SEQ ID NO: 8232111 - DNA, 22 bp, Homo sapiens
ggtgtcctgtcagctagagtga

SEQ ID NO: 8232112 - DNA, 22 bp, Homo sapiens
ggtgtcctgggcaggcagctga

SEQ ID NO: 8232113 - DNA, 22 bp, Homo sapiens
ggtgtcctgggcaggcagctga

SEQ ID NO: 8232114 - DNA, 22 bp, Homo sapiens
gtaaacattttcatctgtgccc

SEQ ID NO: 8232115 - DNA, 22 bp, Homo sapiens
gtaaacattttcatctgtgccc

SEQ ID NO: 8232116 - DNA, 22 bp, Homo sapiens
gtaaacattactgtgctgtata

SEQ ID NO: 8232117 - DNA, 22 bp, Homo sapiens
gtaaacattactgtgctgtata

SEQ ID NO: 8232118 - DNA, 22 bp, Homo sapiens
gtaaacatgctgtgtactcagc

SEQ ID NO: 8232119 - DNA, 23 bp, Homo sapiens
gtaaaatacgcagtgcagtgtga

SEQ ID NO: 8232120 - DNA, 23 bp, Homo sapiens
gtaaaatacgcagtgcagtgtga

SEQ ID NO: 8232121 - DNA, 22 bp, Homo sapiens
gtaaagaagtttttgaatgcat

SEQ ID NO: 8232122 - DNA, 22 bp, Homo sapiens
gtaaagaagtttttgaatgcat

SEQ ID NO: 8232123 - DNA, 22 bp, Homo sapiens
gtaaactgattgttggagttac

SEQ ID NO: 8232124 - DNA, 22 bp, Homo sapiens
gtaaagaaggcaacctggttat

SEQ ID NO: 8232125 - DNA, 22 bp, Homo sapiens
gtaaataactggtaattggggt

SEQ ID NO: 8232126 - DNA, 20 bp, Homo sapiens
gtaaagcattcttggcatac

SEQ ID NO: 8232127 - DNA, 22 bp, Homo sapiens
gtacagaggttgctggaggctc

SEQ ID NO: 8232128 - DNA, 22 bp, Homo sapiens
gtacagattaataatatactga

SEQ ID NO: 8232129 - DNA, 22 bp, Homo sapiens
gtacagattaataatatactga

SEQ ID NO: 8232130 - DNA, 22 bp, Homo sapiens
gtacagcatttgaaattactgg

SEQ ID NO: 8232131 - DNA, 22 bp, Homo sapiens
gtacagcatttgaaattactgg

SEQ ID NO: 8232132 - DNA, 22 bp, Homo sapiens
gtacaggaaggagggagtttca

SEQ ID NO: 8232133 - DNA, 22 bp, Homo sapiens
gtacaggcagcaaacaccataa

SEQ ID NO: 8232134 - DNA, 22 bp, Homo sapiens
gtacacacaatctctggtcagt

SEQ ID NO: 8232135 - DNA, 22 bp, Homo sapiens
gtacacacaatctctggtcagt

SEQ ID NO: 8232136 - DNA, 21 bp, Homo sapiens
gtacacacaggtggatgggct

SEQ ID NO: 8232137 - DNA, 21 bp, Homo sapiens
gtacacacaggtggatgggct

SEQ ID NO: 8232138 - DNA, 22 bp, Homo sapiens
gtacagaatgcttggtaaggca

SEQ ID NO: 8232139 - DNA, 22 bp, Homo sapiens
gtacagagaaggttacatatga

SEQ ID NO: 8232140 - DNA, 22 bp, Homo sapiens
gtacacaaataataaagttaca

SEQ ID NO: 8232141 - DNA, 22 bp, Homo sapiens
gtacacaaagtgagacttgata

SEQ ID NO: 8232142 - DNA, 18 bp, Homo sapiens
gtacacaaagtcaaagta

SEQ ID NO: 8232143 - DNA, 22 bp, Homo sapiens
gtaaatattaaaggctgctaga

SEQ ID NO: 8232144 - DNA, 22 bp, Homo sapiens
gtaaatattccctcggttccta

SEQ ID NO: 8232145 - DNA, 22 bp, Homo sapiens
gtacacaaaagaggaaaccgga

SEQ ID NO: 8232146 - DNA, 22 bp, Homo sapiens
gtaaatattaaaggctgctaga

SEQ ID NO: 8232147 - DNA, 22 bp, Homo sapiens
gtaaatattaaaggctgctaga

SEQ ID NO: 8232148 - DNA, 22 bp, Homo sapiens
gtaaatataaatgctagctgcc

SEQ ID NO: 8232149 - DNA, 22 bp, Homo sapiens
gtaaatattaaaggctgctaga

SEQ ID NO: 8232150 - DNA, 22 bp, Homo sapiens
gtaaataactggtaattggggt

SEQ ID NO: 8232151 - DNA, 22 bp, Homo sapiens
gtaaataactggtaattggggt

SEQ ID NO: 8232152 - DNA, 22 bp, Homo sapiens
gtaaataactggtaattggggt

SEQ ID NO: 8232153 - DNA, 22 bp, Homo sapiens
gtaaataactggtaattggggt

SEQ ID NO: 8232154 - DNA, 22 bp, Homo sapiens
gtaaatataaatgctagctgcc

SEQ ID NO: 8232155 - DNA, 22 bp, Homo sapiens
gtaaatataaatgctagctgcc

SEQ ID NO: 8232156 - DNA, 22 bp, Homo sapiens
gtaaatataaatgctagctgcc

SEQ ID NO: 8232157 - DNA, 22 bp, Homo sapiens
gtaaatataaatgctagctgcc

SEQ ID NO: 8232158 - DNA, 22 bp, Homo sapiens
gggtggggccaggcaatttgca

SEQ ID NO: 8232159 - DNA, 22 bp, Homo sapiens
gggtggggccaggcaatttgca

SEQ ID NO: 8232160 - DNA, 22 bp, Homo sapiens
gggtggggccaggcaatttgca

SEQ ID NO: 8232161 - DNA, 22 bp, Homo sapiens
gggtggggcccaggaaatctat

SEQ ID NO: 8232162 - DNA, 22 bp, Homo sapiens
gggtggggtgtatcggatccta

SEQ ID NO: 8232163 - DNA, 22 bp, Homo sapiens
gggtggggcccaggaaatctat

SEQ ID NO: 8232164 - DNA, 22 bp, Homo sapiens
gggtggggtgtatcggatccta

SEQ ID NO: 8232165 - DNA, 22 bp, Homo sapiens
gggtggggcccaggaaatctat

SEQ ID NO: 8232166 - DNA, 22 bp, Homo sapiens
gggtggggtgtatcggatccta

SEQ ID NO: 8232167 - DNA, 22 bp, Homo sapiens
gggtggggtgtatcggatccta

SEQ ID NO: 8232168 - DNA, 22 bp, Homo sapiens
gggtggggttcaggaatcttca

SEQ ID NO: 8232169 - DNA, 21 bp, Homo sapiens
gggtggggttccagccttttc

SEQ ID NO: 8232170 - DNA, 22 bp, Homo sapiens
gggtggggttcaggaatcttca

SEQ ID NO: 8232171 - DNA, 22 bp, Homo sapiens
gggtggggttcaggaatcttca

SEQ ID NO: 8232172 - DNA, 22 bp, Homo sapiens
ggtgagggtaaatataggcaaa

SEQ ID NO: 8232173 - DNA, 22 bp, Homo sapiens
ggtgagggtaaatataggcaaa

SEQ ID NO: 8232174 - DNA, 22 bp, Homo sapiens
ggtgagggtaaatataggcaaa

SEQ ID NO: 8232175 - DNA, 22 bp, Homo sapiens
ggtgagggtaaatataggcaaa

SEQ ID NO: 8232176 - DNA, 22 bp, Homo sapiens
ggtgaggggctcctctgcccgg

SEQ ID NO: 8232177 - DNA, 22 bp, Homo sapiens
ggtgaggggcgcctctgcccgg

SEQ ID NO: 8232178 - DNA, 22 bp, Homo sapiens
ggtgagggtaaactaaaacatc

SEQ ID NO: 8232179 - DNA, 22 bp, Homo sapiens
ggtgaggggctcctctgcccgg

SEQ ID NO: 8232180 - DNA, 22 bp, Homo sapiens
ggtgaggggcacctctgcccgg

SEQ ID NO: 8232181 - DNA, 22 bp, Homo sapiens
ggtgaggggagagtgaaagaaa

SEQ ID NO: 8232182 - DNA, 22 bp, Homo sapiens
ggtgaggggcgcctctgcccag

SEQ ID NO: 8232183 - DNA, 22 bp, Homo sapiens
ggtgaggggcacctctgcccgg

SEQ ID NO: 8232184 - DNA, 22 bp, Homo sapiens
ggtgaggggcgcctctgcccgg

SEQ ID NO: 8232185 - DNA, 22 bp, Homo sapiens
ggtgaggggcgcctctgcccag

SEQ ID NO: 8232186 - DNA, 22 bp, Homo sapiens
ggtgatcagccttctgatttct

SEQ ID NO: 8232187 - DNA, 22 bp, Homo sapiens
ggtgcaaaaatctatcaccagc

SEQ ID NO: 8232188 - DNA, 21 bp, Homo sapiens
ggtgattttagagaattgctg

SEQ ID NO: 8232189 - DNA, 22 bp, Homo sapiens
ggtgatttccttttgcaaagtc

SEQ ID NO: 8232190 - DNA, 22 bp, Homo sapiens
ggtgattttcgagtttcatgtt

SEQ ID NO: 8232191 - DNA, 22 bp, Homo sapiens
ggtgatttatccattttctggt

SEQ ID NO: 8232192 - DNA, 22 bp, Homo sapiens
ggtgatttccttttgcaaagtc

SEQ ID NO: 8232193 - DNA, 22 bp, Homo sapiens
ggtgatttatccattttctggt

SEQ ID NO: 8232194 - DNA, 22 bp, Homo sapiens
ggtgagtgcctggcctggccac

SEQ ID NO: 8232195 - DNA, 17 bp, Homo sapiens
ggtgagtgtccaggtgg

SEQ ID NO: 8232196 - DNA, 22 bp, Homo sapiens
ggtgagttctcagcttattgca

SEQ ID NO: 8232197 - DNA, 22 bp, Homo sapiens
ggtgcaaaagtaatttggtttt

SEQ ID NO: 8232198 - DNA, 22 bp, Homo sapiens
ggtgcaggaaaattacctggag

SEQ ID NO: 8232199 - DNA, 22 bp, Homo sapiens
ggtgcaggaaaattacctggag

SEQ ID NO: 8232200 - DNA, 22 bp, Homo sapiens
ggtgcaggaaaattacctggag

SEQ ID NO: 8232201 - DNA, 22 bp, Homo sapiens
ggtgcaggaatctgcaattgaa

SEQ ID NO: 8232202 - DNA, 22 bp, Homo sapiens
ggtgcaggaatctgcaattgaa

SEQ ID NO: 8232203 - DNA, 22 bp, Homo sapiens
ggtgcaggaatctgcaattgaa

SEQ ID NO: 8232204 - DNA, 22 bp, Homo sapiens
ggtgcaggagcggggtgctcgg

SEQ ID NO: 8232205 - DNA, 22 bp, Homo sapiens
ggtgcaggagcggggtgctcgg

SEQ ID NO: 8232206 - DNA, 22 bp, Homo sapiens
ggtgcaggacgaagtgggggtt

SEQ ID NO: 8232207 - DNA, 22 bp, Homo sapiens
ggtgcaggacgaagtgggggtt

SEQ ID NO: 8232208 - DNA, 22 bp, Homo sapiens
ggtgcaggacgaagtgggggtt

SEQ ID NO: 8232209 - DNA, 22 bp, Homo sapiens
ggtggcagaggtgcatcagccc

SEQ ID NO: 8232210 - DNA, 22 bp, Homo sapiens
ggtggcagaggtgcatcagccc

SEQ ID NO: 8232211 - DNA, 22 bp, Homo sapiens
ggtggcagagaggaggtagttt

SEQ ID NO: 8232212 - DNA, 22 bp, Homo sapiens
ggtggcagagaggaggtagttt

SEQ ID NO: 8232213 - DNA, 22 bp, Homo sapiens
ggtggcagcatggtcccagtgt

SEQ ID NO: 8232214 - DNA, 22 bp, Homo sapiens
ggtggcagcatggtcccagtgt

SEQ ID NO: 8232215 - DNA, 22 bp, Homo sapiens
ggtggcagaggtgcatcagccc

SEQ ID NO: 8232216 - DNA, 22 bp, Homo sapiens
ggtggcagaggtgcatcagccc

SEQ ID NO: 8232217 - DNA, 22 bp, Homo sapiens
ggtggcagaggtgcatcagccc

SEQ ID NO: 8232218 - DNA, 22 bp, Homo sapiens
ggtggcagaggtgcatcagccc

SEQ ID NO: 8232219 - DNA, 22 bp, Homo sapiens
ggtgcaggcggtggggcaagta

SEQ ID NO: 8232220 - DNA, 22 bp, Homo sapiens
ggtgcaggcggtggggcaagta

SEQ ID NO: 8232221 - DNA, 22 bp, Homo sapiens
ggtgcaggagcggggtgctcgg

SEQ ID NO: 8232222 - DNA, 22 bp, Homo sapiens
ggtgcaggagcggggtgctcgg

SEQ ID NO: 8232223 - DNA, 22 bp, Homo sapiens
ggtgcaggcggtggggcaagta

SEQ ID NO: 8232224 - DNA, 22 bp, Homo sapiens
ggtgtccgcgctgtagaaggtc

SEQ ID NO: 8232225 - DNA, 22 bp, Homo sapiens
ggtgtcccaggccagctgtgtg

SEQ ID NO: 8232226 - DNA, 22 bp, Homo sapiens
ggtgtcccaggccagctgtgtg

SEQ ID NO: 8232227 - DNA, 22 bp, Homo sapiens
ggtgtcctacagggccgcaggc

SEQ ID NO: 8232228 - DNA, 22 bp, Homo sapiens
ggtgtcctacagggccgcaggc

SEQ ID NO: 8232229 - DNA, 19 bp, Homo sapiens
ggtgtcctagagataagag

SEQ ID NO: 8232230 - DNA, 22 bp, Homo sapiens
ggtgtcctactgcttggttgct

SEQ ID NO: 8232231 - DNA, 22 bp, Homo sapiens
ggtgtccatcaggctgtgcttc

SEQ ID NO: 8232232 - DNA, 22 bp, Homo sapiens
ggtgtccatcaggctgtgcttc

SEQ ID NO: 8232233 - DNA, 21 bp, Homo sapiens
ggtgtccagaggagtccccag

SEQ ID NO: 8232234 - DNA, 22 bp, Homo sapiens
ggtgtccatcaggctgtgcttc

SEQ ID NO: 8232235 - DNA, 22 bp, Homo sapiens
ggtgtcatccaacaggacaggg

SEQ ID NO: 8232236 - DNA, 22 bp, Homo sapiens
ggtgtccacattccctggcagg

SEQ ID NO: 8232237 - DNA, 20 bp, Homo sapiens
ggtgtcagggccatgcctgg

SEQ ID NO: 8232238 - DNA, 20 bp, Homo sapiens
ggtgtcagggccatgcctgg

SEQ ID NO: 8232239 - DNA, 22 bp, Homo sapiens
ggtgtcagttgctcatcagagt

SEQ ID NO: 8232240 - DNA, 22 bp, Homo sapiens
ggtgtcagttgctcatcagagt

SEQ ID NO: 8232241 - DNA, 22 bp, Homo sapiens
ggtgtcagtgagagcacagtac

SEQ ID NO: 8232242 - DNA, 22 bp, Homo sapiens
ggtgtcagtgagagcacagtac

SEQ ID NO: 8232243 - DNA, 22 bp, Homo sapiens
ggtgtcagatacataggaagta

SEQ ID NO: 8232244 - DNA, 22 bp, Homo sapiens
ggtgtcagatttgacatccaga

SEQ ID NO: 8232245 - DNA, 16 bp, Homo sapiens
ggtgtcagatgtccag

SEQ ID NO: 8232246 - DNA, 22 bp, Homo sapiens
ggtgtcagcctgggagcctagc

SEQ ID NO: 8232247 - DNA, 19 bp, Homo sapiens
ggtgtcaggcctctctcct

SEQ ID NO: 8232248 - DNA, 20 bp, Homo sapiens
ggtgtcagggccatgcctgg

SEQ ID NO: 8232249 - DNA, 20 bp, Homo sapiens
ggtgtcagggccatgcctgg

SEQ ID NO: 8232250 - DNA, 20 bp, Homo sapiens
ggtgtcagggccatgcctgg

SEQ ID NO: 8232251 - DNA, 20 bp, Homo sapiens
ggtgtcagggccatgcctgg

SEQ ID NO: 8232252 - DNA, 22 bp, Homo sapiens
ggtgtcaggaaaatctcagtgt

SEQ ID NO: 8232253 - DNA, 22 bp, Homo sapiens
ggtgtcaggaaaatctcagtgt

SEQ ID NO: 8232254 - DNA, 22 bp, Homo sapiens
ggtgtcagcctgggagcctagc

SEQ ID NO: 8232255 - DNA, 22 bp, Homo sapiens
ggtgtcagcctgggagcctagc

SEQ ID NO: 8232256 - DNA, 22 bp, Homo sapiens
ggtggccatggtcaggtagcgg

SEQ ID NO: 8232257 - DNA, 22 bp, Homo sapiens
ggtggccattctaccgccttct

SEQ ID NO: 8232258 - DNA, 22 bp, Homo sapiens
ggtggccctaaccgcagcctcc

SEQ ID NO: 8232259 - DNA, 22 bp, Homo sapiens
ggtggcccagtgctttctgaag

SEQ ID NO: 8232260 - DNA, 22 bp, Homo sapiens
ggtggccctaaccgcagcctcc

SEQ ID NO: 8232261 - DNA, 22 bp, Homo sapiens
ggtggtgggagagctttctgga

SEQ ID NO: 8232262 - DNA, 22 bp, Homo sapiens
ggtggccatggtcaggtagcgg

SEQ ID NO: 8232263 - DNA, 22 bp, Homo sapiens
ggtggtggtcccgacttgggag

SEQ ID NO: 8232264 - DNA, 22 bp, Homo sapiens
ggtggtggtcccgacttgggag

SEQ ID NO: 8232265 - DNA, 23 bp, Homo sapiens
ggtggtggtgagtcacgggctca

SEQ ID NO: 8232266 - DNA, 23 bp, Homo sapiens
ggtggtggtgagtcacgggctca

SEQ ID NO: 8232267 - DNA, 22 bp, Homo sapiens
ggtggttcacgcctataatccc

SEQ ID NO: 8232268 - DNA, 22 bp, Homo sapiens
ggtgtagctctgtgtcccactg

SEQ ID NO: 8232269 - DNA, 22 bp, Homo sapiens
ggtgtagctctgtgtcccactg

SEQ ID NO: 8232270 - DNA, 22 bp, Homo sapiens
ggtgtcagactttgcatatcct

SEQ ID NO: 8232271 - DNA, 22 bp, Homo sapiens
ggtggttgcataggccagcagc

SEQ ID NO: 8232272 - DNA, 22 bp, Homo sapiens
ggtggttcatgcctggaatccc

SEQ ID NO: 8232273 - DNA, 18 bp, Homo sapiens
ggtggtttggaagcaggt

SEQ ID NO: 8232274 - DNA, 18 bp, Homo sapiens
ggtggtttggaagcaggt

SEQ ID NO: 8232275 - DNA, 22 bp, Homo sapiens
ggtggccaggccagctctggcc

SEQ ID NO: 8232276 - DNA, 22 bp, Homo sapiens
ggtggccataggaccagcctgg

SEQ ID NO: 8232277 - DNA, 22 bp, Homo sapiens
ggtggccataggaccagcctgg

SEQ ID NO: 8232278 - DNA, 22 bp, Homo sapiens
ggtggccaggccagctctggcc

SEQ ID NO: 8232279 - DNA, 22 bp, Homo sapiens
ggtggccaggccagctctggcc

SEQ ID NO: 8232280 - DNA, 22 bp, Homo sapiens
ggtggccaggagacatttgtca

SEQ ID NO: 8232281 - DNA, 22 bp, Homo sapiens
ggtggcattcagaagagctggc

SEQ ID NO: 8232282 - DNA, 22 bp, Homo sapiens
ggtggcagttacaggggcaaat

SEQ ID NO: 8232283 - DNA, 22 bp, Homo sapiens
ggtggcatggcagttgatgtaa

SEQ ID NO: 8232284 - DNA, 22 bp, Homo sapiens
ggtggcatctctttccagattt

SEQ ID NO: 8232285 - DNA, 22 bp, Homo sapiens
ggtggcatctcagttcatgggc

SEQ ID NO: 8232286 - DNA, 22 bp, Homo sapiens
ggtggcatcacagtactggggg

SEQ ID NO: 8232287 - DNA, 22 bp, Homo sapiens
ggtggcatacatttctgtcttg

SEQ ID NO: 8232288 - DNA, 22 bp, Homo sapiens
ggtggcaggccctgagcatccc

SEQ ID NO: 8232289 - DNA, 22 bp, Homo sapiens
ggtggcaggccctgagcatccc

SEQ ID NO: 8232290 - DNA, 22 bp, Homo sapiens
ggtggcaggccctgagcatccc

SEQ ID NO: 8232291 - DNA, 22 bp, Homo sapiens
ggtggcaggccctgagcatccc

SEQ ID NO: 8232292 - DNA, 22 bp, Homo sapiens
ggtggcaggccctgagcatccc

SEQ ID NO: 8232293 - DNA, 22 bp, Homo sapiens
ggtggcaggctggcattggcaa

SEQ ID NO: 8232294 - DNA, 22 bp, Homo sapiens
ggtggcaggctggcattggcaa

SEQ ID NO: 8232295 - DNA, 22 bp, Homo sapiens
ggtggcaggctggcattggcaa

SEQ ID NO: 8232296 - DNA, 22 bp, Homo sapiens
ggtggcaggctggcattggcaa

SEQ ID NO: 8232297 - DNA, 22 bp, Homo sapiens
ggtggcaggctggcattggcaa

SEQ ID NO: 8232298 - DNA, 22 bp, Homo sapiens
ggtggcaggctggcattggcaa

SEQ ID NO: 8232299 - DNA, 22 bp, Homo sapiens
ggtggcagcgtctatctgacat

SEQ ID NO: 8232300 - DNA, 22 bp, Homo sapiens
ggtggcagcgtctatctgacat

SEQ ID NO: 8232301 - DNA, 22 bp, Homo sapiens
ggtggcagcgtctatctgacat

SEQ ID NO: 8232302 - DNA, 19 bp, Homo sapiens
ggtggcaggaataaaggtc

SEQ ID NO: 8232303 - DNA, 22 bp, Homo sapiens
ggtggcagcgtctatctgacat

SEQ ID NO: 8232304 - DNA, 23 bp, Homo sapiens
ggtggcaggagtggatgctgagc

SEQ ID NO: 8232305 - DNA, 23 bp, Homo sapiens
ggtggcaggagtggatgctgagc

SEQ ID NO: 8232306 - DNA, 23 bp, Homo sapiens
ggtggcaggagtggatgctgagc

SEQ ID NO: 8232307 - DNA, 23 bp, Homo sapiens
ggtggcaggagtggatgctgagc

SEQ ID NO: 8232308 - DNA, 23 bp, Homo sapiens
ggtggcaggagtggatgctgagc

SEQ ID NO: 8232309 - DNA, 22 bp, Homo sapiens
ggtggcaggccctgagcatccc

SEQ ID NO: 8232310 - DNA, 23 bp, Homo sapiens
ggtggcaggagtggatgctgagc

SEQ ID NO: 8232311 - DNA, 23 bp, Homo sapiens
ggtggcaggagtggatgctgagc

SEQ ID NO: 8232312 - DNA, 22 bp, Homo sapiens
gttctcctcttgtcccaggctg

SEQ ID NO: 8232313 - DNA, 22 bp, Homo sapiens
gttctccttgtggctgcagcag

SEQ ID NO: 8232314 - DNA, 22 bp, Homo sapiens
gttctctcaaactttgtgtttg

SEQ ID NO: 8232315 - DNA, 22 bp, Homo sapiens
gttctctcagcctttgttatta

SEQ ID NO: 8232316 - DNA, 22 bp, Homo sapiens
gttctctcagcctttgttatta

SEQ ID NO: 8232317 - DNA, 22 bp, Homo sapiens
gttctccttgtggctgcagcag

SEQ ID NO: 8232318 - DNA, 22 bp, Homo sapiens
gttctctagggctgtagactgg

SEQ ID NO: 8232319 - DNA, 22 bp, Homo sapiens
gttctctcaaactttgtgtttg

SEQ ID NO: 8232320 - DNA, 22 bp, Homo sapiens
gttctctctcttgcctgggtgg

SEQ ID NO: 8232321 - DNA, 22 bp, Homo sapiens
gttctctcagcgatagtgatgg

SEQ ID NO: 8232322 - DNA, 22 bp, Homo sapiens
gttctctcagcgatagtgatgg

SEQ ID NO: 8232323 - DNA, 22 bp, Homo sapiens
gttctctctcttgcctgggtgg

SEQ ID NO: 8232324 - DNA, 22 bp, Homo sapiens
gttctgagtcctcctttgaagg

SEQ ID NO: 8232325 - DNA, 22 bp, Homo sapiens
gttctctgagtcctggcaaaat

SEQ ID NO: 8232326 - DNA, 22 bp, Homo sapiens
gttctcctcttagctgtgccac

SEQ ID NO: 8232327 - DNA, 22 bp, Homo sapiens
gttctccctgtcccctgagctt

SEQ ID NO: 8232328 - DNA, 22 bp, Homo sapiens
gttctccactgcagagtctctc

SEQ ID NO: 8232329 - DNA, 22 bp, Homo sapiens
gttctatttcagtaagcaggca

SEQ ID NO: 8232330 - DNA, 22 bp, Homo sapiens
gttctattccccttatctgtga

SEQ ID NO: 8232331 - DNA, 22 bp, Homo sapiens
gttctattctccagttacatat

SEQ ID NO: 8232332 - DNA, 22 bp, Homo sapiens
gttctcagggataacttccccc

SEQ ID NO: 8232333 - DNA, 20 bp, Homo sapiens
gttctcactgatctgcaggg

SEQ ID NO: 8232334 - DNA, 22 bp, Homo sapiens
gttgtgcaaacactggggtctg

SEQ ID NO: 8232335 - DNA, 22 bp, Homo sapiens
gttgtgcaaccatcaccaccat

SEQ ID NO: 8232336 - DNA, 22 bp, Homo sapiens
gttgtgcaccactgttgattga

SEQ ID NO: 8232337 - DNA, 22 bp, Homo sapiens
gttgtgcagaagtgcctcagta

SEQ ID NO: 8232338 - DNA, 22 bp, Homo sapiens
gttgtgcagggcgaggacctga

SEQ ID NO: 8232339 - DNA, 22 bp, Homo sapiens
gttgtgcatttatgaagaagtt

SEQ ID NO: 8232340 - DNA, 22 bp, Homo sapiens
gttgtgcagtcagactgcctgg

SEQ ID NO: 8232341 - DNA, 21 bp, Homo sapiens
gttgtggttggggctgcagct

SEQ ID NO: 8232342 - DNA, 22 bp, Homo sapiens
gttgtccttcttatttgtagtg

SEQ ID NO: 8232343 - DNA, 22 bp, Homo sapiens
gttgtcttagtcagaaatatgc

SEQ ID NO: 8232344 - DNA, 22 bp, Homo sapiens
gttgtcatcaccgttgttatca

SEQ ID NO: 8232345 - DNA, 22 bp, Homo sapiens
gttgtcctgaatttggagactt

SEQ ID NO: 8232346 - DNA, 22 bp, Homo sapiens
gttgtcttagtcagaaatatgc

SEQ ID NO: 8232347 - DNA, 22 bp, Homo sapiens
gttgtctgtgtcagttagcgtc

SEQ ID NO: 8232348 - DNA, 22 bp, Homo sapiens
gttgtgaatagtgccgcaataa

SEQ ID NO: 8232349 - DNA, 22 bp, Homo sapiens
gttgttgctatgttattgttat

SEQ ID NO: 8232350 - DNA, 22 bp, Homo sapiens
gttgttcttctcatccagcttg

SEQ ID NO: 8232351 - DNA, 22 bp, Homo sapiens
gttgttcttctcatccagcttg

SEQ ID NO: 8232352 - DNA, 22 bp, Homo sapiens
gttgtttgtaatgacaggagac

SEQ ID NO: 8232353 - DNA, 22 bp, Homo sapiens
gttgtataaggaatgttgttta

SEQ ID NO: 8232354 - DNA, 22 bp, Homo sapiens
gttgtattcttcaatatcagag

SEQ ID NO: 8232355 - DNA, 22 bp, Homo sapiens
gttgtattcttcaatatcagag

SEQ ID NO: 8232356 - DNA, 22 bp, Homo sapiens
gttgtcaggtaaaacagtatgg

SEQ ID NO: 8232357 - DNA, 22 bp, Homo sapiens
gttgtacatgttggggtacctt

SEQ ID NO: 8232358 - DNA, 22 bp, Homo sapiens
gttgtacatatgaggataagtt

SEQ ID NO: 8232359 - DNA, 22 bp, Homo sapiens
gttgtacatatgaggataagtt

SEQ ID NO: 8232360 - DNA, 22 bp, Homo sapiens
gttctgcagacttggaaggtgg

SEQ ID NO: 8232361 - DNA, 22 bp, Homo sapiens
gttctgcctgtggcttctgtgg

SEQ ID NO: 8232362 - DNA, 22 bp, Homo sapiens
gttgtacaggcagggaaactga

SEQ ID NO: 8232363 - DNA, 22 bp, Homo sapiens
gttattttcattggctcagact

SEQ ID NO: 8232364 - DNA, 22 bp, Homo sapiens
gttcaaaattcaaatggtatac

SEQ ID NO: 8232365 - DNA, 22 bp, Homo sapiens
gttcaaaattcaaatggtatac

SEQ ID NO: 8232366 - DNA, 22 bp, Homo sapiens
gttcaaaggcctgtggaaaggg

SEQ ID NO: 8232367 - DNA, 22 bp, Homo sapiens
gttcaaagctcctggtacagta

SEQ ID NO: 8232368 - DNA, 22 bp, Homo sapiens
gttattttcattggctcagact

SEQ ID NO: 8232369 - DNA, 22 bp, Homo sapiens
gttattttcattggctcagact

SEQ ID NO: 8232370 - DNA, 22 bp, Homo sapiens
gttattttcattggctcagact

SEQ ID NO: 8232371 - DNA, 22 bp, Homo sapiens
gttattttcattggctcagact

SEQ ID NO: 8232372 - DNA, 21 bp, Homo sapiens
gttattttaagtgagctttgc

SEQ ID NO: 8232373 - DNA, 21 bp, Homo sapiens
gttattttaagtgagctttgc

SEQ ID NO: 8232374 - DNA, 21 bp, Homo sapiens
gttattttaagtgagctttgc

SEQ ID NO: 8232375 - DNA, 22 bp, Homo sapiens
gttattttatctctgagaggtt

SEQ ID NO: 8232376 - DNA, 22 bp, Homo sapiens
gttattttatctctgagaggtt

SEQ ID NO: 8232377 - DNA, 22 bp, Homo sapiens
gttattttcattggctcagact

SEQ ID NO: 8232378 - DNA, 22 bp, Homo sapiens
gttattttatctctgagaggtt

SEQ ID NO: 8232379 - DNA, 22 bp, Homo sapiens
gttattttatctctgagaggtt

SEQ ID NO: 8232380 - DNA, 22 bp, Homo sapiens
gttattttaacttctcagtaat

SEQ ID NO: 8232381 - DNA, 22 bp, Homo sapiens
gttattttaacttctcagtaat

SEQ ID NO: 8232382 - DNA, 21 bp, Homo sapiens
gttattttaagtgagctttgc

SEQ ID NO: 8232383 - DNA, 21 bp, Homo sapiens
gttattttaagtgagctttgc

SEQ ID NO: 8232384 - DNA, 22 bp, Homo sapiens
gttattttaacttctcagtaat

SEQ ID NO: 8232385 - DNA, 22 bp, Homo sapiens
gttattttaacttctcagtaat

SEQ ID NO: 8232386 - DNA, 22 bp, Homo sapiens
gtgtgtcctcagtagtggcatg

SEQ ID NO: 8232387 - DNA, 22 bp, Homo sapiens
gtgtgtcctcagtagtggcatg

SEQ ID NO: 8232388 - DNA, 22 bp, Homo sapiens
gtgtgtcctcagtagtggcatg

SEQ ID NO: 8232389 - DNA, 22 bp, Homo sapiens
gtgtgtcccttggaacctcagc

SEQ ID NO: 8232390 - DNA, 22 bp, Homo sapiens
gtgtgtccctcctctcctgagt

SEQ ID NO: 8232391 - DNA, 22 bp, Homo sapiens
gtgtgtccctacaacagcttca

SEQ ID NO: 8232392 - DNA, 22 bp, Homo sapiens
gtgtgtccctacaacagcttca

SEQ ID NO: 8232393 - DNA, 22 bp, Homo sapiens
gtgtgtccaggcgggagtcaag

SEQ ID NO: 8232394 - DNA, 22 bp, Homo sapiens
gtgtgtccaggcgggagtcaag

SEQ ID NO: 8232395 - DNA, 23 bp, Homo sapiens
gtgtgtccattcgcactcttagg

SEQ ID NO: 8232396 - DNA, 22 bp, Homo sapiens
gtgtgtccaaggccacaatagc

SEQ ID NO: 8232397 - DNA, 22 bp, Homo sapiens
gtgtgtccacacatacatacat

SEQ ID NO: 8232398 - DNA, 22 bp, Homo sapiens
gtgtgtccaaggccacaatagc

SEQ ID NO: 8232399 - DNA, 22 bp, Homo sapiens
gtgtgtccaaggcacggatgac

SEQ ID NO: 8232400 - DNA, 22 bp, Homo sapiens
gtgtgtcaggtactgtgctagg

SEQ ID NO: 8232401 - DNA, 22 bp, Homo sapiens
gttcaaggttttacagagtgta

SEQ ID NO: 8232402 - DNA, 21 bp, Homo sapiens
gttcaagtatttttttcgctg

SEQ ID NO: 8232403 - DNA, 18 bp, Homo sapiens
gttcaaggtcaagagaga

SEQ ID NO: 8232404 - DNA, 22 bp, Homo sapiens
gttcaaggaagggaggaaagcc

SEQ ID NO: 8232405 - DNA, 22 bp, Homo sapiens
gttcaagaccagcctggccaac

SEQ ID NO: 8232406 - DNA, 22 bp, Homo sapiens
gttctacatgacactcaacatt

SEQ ID NO: 8232407 - DNA, 21 bp, Homo sapiens
gttctacagttttagaattcc

SEQ ID NO: 8232408 - DNA, 22 bp, Homo sapiens
gttctacagttcctattactta

SEQ ID NO: 8232409 - DNA, 22 bp, Homo sapiens
gttcaagaccagcctggccaac

SEQ ID NO: 8232410 - DNA, 22 bp, Homo sapiens
gttcaagaccagcctggccaac

SEQ ID NO: 8232411 - DNA, 22 bp, Homo sapiens
gttcaagaccagcctggccaac

SEQ ID NO: 8232412 - DNA, 22 bp, Homo sapiens
gttcaagaccagcctggccaac

SEQ ID NO: 8232413 - DNA, 22 bp, Homo sapiens
gttcaagaccagcctggccaac

SEQ ID NO: 8232414 - DNA, 22 bp, Homo sapiens
gttcaagaccagcctggccaac

SEQ ID NO: 8232415 - DNA, 22 bp, Homo sapiens
gttcaagaccagcctggccaac

SEQ ID NO: 8232416 - DNA, 21 bp, Homo sapiens
gttcaaatcctgacactacac

SEQ ID NO: 8232417 - DNA, 22 bp, Homo sapiens
gttcaaatggctgcagttacca

SEQ ID NO: 8232418 - DNA, 22 bp, Homo sapiens
gttcaaattctatgaaatatgt

SEQ ID NO: 8232419 - DNA, 21 bp, Homo sapiens
gttcaaatgggtagattcaca

SEQ ID NO: 8232420 - DNA, 22 bp, Homo sapiens
gtgtgggctgcagaggcacagc

SEQ ID NO: 8232421 - DNA, 22 bp, Homo sapiens
gtgtgcagtctgctaggcaggg

SEQ ID NO: 8232422 - DNA, 22 bp, Homo sapiens
gtgtgggaggaaggtgaacaga

SEQ ID NO: 8232423 - DNA, 22 bp, Homo sapiens
gtgtgggaggaaggtgaacaga

SEQ ID NO: 8232424 - DNA, 22 bp, Homo sapiens
gtgtgggaggaaggtgaacaga

SEQ ID NO: 8232425 - DNA, 22 bp, Homo sapiens
gtgtggggagctgcagccacat

SEQ ID NO: 8232426 - DNA, 22 bp, Homo sapiens
gtgtggggaggagagagccctt

SEQ ID NO: 8232427 - DNA, 22 bp, Homo sapiens
gtgtggggctcagtgggaatgt

SEQ ID NO: 8232428 - DNA, 22 bp, Homo sapiens
gtgtggggccaggatcagggct

SEQ ID NO: 8232429 - DNA, 22 bp, Homo sapiens
gtgtggggccaggatcagggct

SEQ ID NO: 8232430 - DNA, 22 bp, Homo sapiens
gtgtggtcgaagttctcccgga

SEQ ID NO: 8232431 - DNA, 22 bp, Homo sapiens
gtgtgtatgtagaactatgtat

SEQ ID NO: 8232432 - DNA, 22 bp, Homo sapiens
gtgtgtatgtagaactatgtat

SEQ ID NO: 8232433 - DNA, 22 bp, Homo sapiens
gtgtgtatgtagaactatgtat

SEQ ID NO: 8232434 - DNA, 22 bp, Homo sapiens
gtgtgtattattgcatacacat

SEQ ID NO: 8232435 - DNA, 22 bp, Homo sapiens
gtgtgtatttaaaggatagttg

SEQ ID NO: 8232436 - DNA, 22 bp, Homo sapiens
gtgtgtcagagctcagagaagt

SEQ ID NO: 8232437 - DNA, 22 bp, Homo sapiens
gtgtggggtcttctcttggcct

SEQ ID NO: 8232438 - DNA, 22 bp, Homo sapiens
gtgtggggtcttctcttggcct

SEQ ID NO: 8232439 - DNA, 22 bp, Homo sapiens
gtgtggggtcttctcttggcct

SEQ ID NO: 8232440 - DNA, 22 bp, Homo sapiens
gtgtgggggcagctctgatatg

SEQ ID NO: 8232441 - DNA, 22 bp, Homo sapiens
gtgtgggggcagctctgatatg

SEQ ID NO: 8232442 - DNA, 22 bp, Homo sapiens
gtgtggggctcagtgggaatgt

SEQ ID NO: 8232443 - DNA, 22 bp, Homo sapiens
gtgtggggctcagtgggaatgt

SEQ ID NO: 8232444 - DNA, 22 bp, Homo sapiens
gtgtggggctcagtgggaatgt

SEQ ID NO: 8232445 - DNA, 22 bp, Homo sapiens
gtgtggggctcagtgggaatgt

SEQ ID NO: 8232446 - DNA, 22 bp, Homo sapiens
gtgtgagtgaaagtagtttgat

SEQ ID NO: 8232447 - DNA, 22 bp, Homo sapiens
gtgtgagctcagccttgggaga

SEQ ID NO: 8232448 - DNA, 21 bp, Homo sapiens
gtgtgagtagcatgtgtctca

SEQ ID NO: 8232449 - DNA, 22 bp, Homo sapiens
gtgtgagggcaacacagcaaac

SEQ ID NO: 8232450 - DNA, 22 bp, Homo sapiens
gtgtgcagcagagacaggactc

SEQ ID NO: 8232451 - DNA, 22 bp, Homo sapiens
gtgtgcagcagagacaggactc

SEQ ID NO: 8232452 - DNA, 22 bp, Homo sapiens
gtgtgcagaagacacaagacat

SEQ ID NO: 8232453 - DNA, 22 bp, Homo sapiens
gtgtgcagggggccagcgcagc

SEQ ID NO: 8232454 - DNA, 22 bp, Homo sapiens
gtgtgcaggggcttggtggagc

SEQ ID NO: 8232455 - DNA, 22 bp, Homo sapiens
gtgtgcagggctgcctgtgccg

SEQ ID NO: 8232456 - DNA, 22 bp, Homo sapiens
gtgtgcagggggccagcgcagc

SEQ ID NO: 8232457 - DNA, 22 bp, Homo sapiens
gtgtgcagggggccagcgcagc

SEQ ID NO: 8232458 - DNA, 22 bp, Homo sapiens
gtgtgcaggtgtcagtgcagct

SEQ ID NO: 8232459 - DNA, 22 bp, Homo sapiens
gtgtgcaggtgtcagtgcagct

SEQ ID NO: 8232460 - DNA, 22 bp, Homo sapiens
gtgtgcaggccacaggccaggg

SEQ ID NO: 8232461 - DNA, 22 bp, Homo sapiens
gtgtgcaggccacaggccaggg

SEQ ID NO: 8232462 - DNA, 22 bp, Homo sapiens
gtgtgcaggcttgaggattagg

SEQ ID NO: 8232463 - DNA, 22 bp, Homo sapiens
gtgtgcagggatgagtgcaggt

SEQ ID NO: 8232464 - DNA, 22 bp, Homo sapiens
gtgtgcagggctgcctgtgccg

SEQ ID NO: 8232465 - DNA, 22 bp, Homo sapiens
gtgtgcagggatgagtgcaggt

SEQ ID NO: 8232466 - DNA, 22 bp, Homo sapiens
gtgtccttttgagggtccacag

SEQ ID NO: 8232467 - DNA, 22 bp, Homo sapiens
gtgtctctatctatgcctgaag

SEQ ID NO: 8232468 - DNA, 22 bp, Homo sapiens
gtgtctcttcctttcaagtggg

SEQ ID NO: 8232469 - DNA, 22 bp, Homo sapiens
gtgtctcttttcagactcttca

SEQ ID NO: 8232470 - DNA, 22 bp, Homo sapiens
gtgtcctgggggacttcaggtt

SEQ ID NO: 8232471 - DNA, 22 bp, Homo sapiens
gtgtcctgggctggtagagctg

SEQ ID NO: 8232472 - DNA, 22 bp, Homo sapiens
gtgtcctgggtctctgattctt

SEQ ID NO: 8232473 - DNA, 22 bp, Homo sapiens
gtgtcctggttccttgtggctg

SEQ ID NO: 8232474 - DNA, 22 bp, Homo sapiens
gtgtcctgttcagaagcttggg

SEQ ID NO: 8232475 - DNA, 22 bp, Homo sapiens
gtgtcctgtttccctgtctata

SEQ ID NO: 8232476 - DNA, 22 bp, Homo sapiens
gtgtccttatgcataccagagt

SEQ ID NO: 8232477 - DNA, 22 bp, Homo sapiens
gtgtccttatgcataccagagt

SEQ ID NO: 8232478 - DNA, 22 bp, Homo sapiens
gtgtcctgtttccctgtctata

SEQ ID NO: 8232479 - DNA, 22 bp, Homo sapiens
gtgtcctgcaggccaggaatgg

SEQ ID NO: 8232480 - DNA, 22 bp, Homo sapiens
gtgtcctgcacagcaccttgca

SEQ ID NO: 8232481 - DNA, 22 bp, Homo sapiens
gtgtcctgatcaattgagctgg

SEQ ID NO: 8232482 - DNA, 22 bp, Homo sapiens
gtgtcctgcacagcaccttgca

SEQ ID NO: 8232483 - DNA, 22 bp, Homo sapiens
gtgtcctgcattggctctgccc

SEQ ID NO: 8232484 - DNA, 22 bp, Homo sapiens
gtgtcctgccaccctgggcttt

SEQ ID NO: 8232485 - DNA, 22 bp, Homo sapiens
gtgtcctgcaggccaggaatgg

SEQ ID NO: 8232486 - DNA, 22 bp, Homo sapiens
gtgtcctgcattggctctgccc

SEQ ID NO: 8232487 - DNA, 22 bp, Homo sapiens
gtgtcctggagcccccagttca

SEQ ID NO: 8232488 - DNA, 18 bp, Homo sapiens
gtgtcctggctgcggcgc

SEQ ID NO: 8232489 - DNA, 22 bp, Homo sapiens
gtgtcctgccaccctgggcttt

SEQ ID NO: 8232490 - DNA, 22 bp, Homo sapiens
gtgtcctgggcattaggcttag

SEQ ID NO: 8232491 - DNA, 18 bp, Homo sapiens
gtgtcctggctgcggcgc

SEQ ID NO: 8232492 - DNA, 18 bp, Homo sapiens
gtgtcctggctgcggcgc

SEQ ID NO: 8232493 - DNA, 22 bp, Homo sapiens
gtgtcctcttattgctcttggc

SEQ ID NO: 8232494 - DNA, 22 bp, Homo sapiens
gtgtcctcttattgctcttggc

SEQ ID NO: 8232495 - DNA, 22 bp, Homo sapiens
gtgtcctgatcaattgagctgg

SEQ ID NO: 8232496 - DNA, 22 bp, Homo sapiens
gtgtcctgagtgaggcctggcc

SEQ ID NO: 8232497 - DNA, 22 bp, Homo sapiens
gtgtcctgagtgaggcctggcc

SEQ ID NO: 8232498 - DNA, 22 bp, Homo sapiens
gtgtcccaggagaggagacaat

SEQ ID NO: 8232499 - DNA, 22 bp, Homo sapiens
gtgtcccaggagaggagacaat

SEQ ID NO: 8232500 - DNA, 22 bp, Homo sapiens
gtgtcccagcagcacattggct

SEQ ID NO: 8232501 - DNA, 22 bp, Homo sapiens
gtgtcccagcagcacattggct

SEQ ID NO: 8232502 - DNA, 22 bp, Homo sapiens
gtgtcccagccccacaggcctg

SEQ ID NO: 8232503 - DNA, 22 bp, Homo sapiens
gtgtcccagccccacaggcctg

SEQ ID NO: 8232504 - DNA, 22 bp, Homo sapiens
gtgtcccagccccacaggcctg

SEQ ID NO: 8232505 - DNA, 19 bp, Homo sapiens
gtgtcaggatgtgcagggg

SEQ ID NO: 8232506 - DNA, 19 bp, Homo sapiens
gtgtcaggatgtgcagggg

SEQ ID NO: 8232507 - DNA, 19 bp, Homo sapiens
gtgtcaggatgtgcagggg

SEQ ID NO: 8232508 - DNA, 22 bp, Homo sapiens
gtgtcaggggcagccaggaaat

SEQ ID NO: 8232509 - DNA, 22 bp, Homo sapiens
gtgtcaggggcagccaggaaat

SEQ ID NO: 8232510 - DNA, 20 bp, Homo sapiens
gtgtcagtaaatattatgtg

SEQ ID NO: 8232511 - DNA, 22 bp, Homo sapiens
gtgtcaggcagtcagcatggag

SEQ ID NO: 8232512 - DNA, 22 bp, Homo sapiens
gtgtcaggccctgcattatgtg

SEQ ID NO: 8232513 - DNA, 22 bp, Homo sapiens
gtgtcaggcagtcagcatggag

SEQ ID NO: 8232514 - DNA, 22 bp, Homo sapiens
gtgtcagatgtccagggcagca

SEQ ID NO: 8232515 - DNA, 22 bp, Homo sapiens
gtgtcagatgtccagggcagca

SEQ ID NO: 8232516 - DNA, 22 bp, Homo sapiens
gtgtcaggagaattagggcttt

SEQ ID NO: 8232517 - DNA, 22 bp, Homo sapiens
gtgtcaggagaattagggcttt

SEQ ID NO: 8232518 - DNA, 22 bp, Homo sapiens
gtgtcaggagccttccatgggc

SEQ ID NO: 8232519 - DNA, 22 bp, Homo sapiens
gtgtcaggagccttccatgggc

SEQ ID NO: 8232520 - DNA, 22 bp, Homo sapiens
gtgtccagagaaactcacagct

SEQ ID NO: 8232521 - DNA, 22 bp, Homo sapiens
gtgtccagagaaactcacagct

SEQ ID NO: 8232522 - DNA, 22 bp, Homo sapiens
gtgtcattaaccaccatgcaaa

SEQ ID NO: 8232523 - DNA, 23 bp, Homo sapiens
gtgtcattactgtaattattgtg

SEQ ID NO: 8232524 - DNA, 22 bp, Homo sapiens
gtgtccacggctgagaatgatt

SEQ ID NO: 8232525 - DNA, 22 bp, Homo sapiens
gtgtcatggggtttgttataca

SEQ ID NO: 8232526 - DNA, 22 bp, Homo sapiens
gtgtcatgtagaaattgatgaa

SEQ ID NO: 8232527 - DNA, 22 bp, Homo sapiens
gtgtcatggaaaattgcaatgg

SEQ ID NO: 8232528 - DNA, 22 bp, Homo sapiens
gtgtcatggggtttgttataca

SEQ ID NO: 8232529 - DNA, 22 bp, Homo sapiens
gtgtcatgcacactcagtgttg

SEQ ID NO: 8232530 - DNA, 22 bp, Homo sapiens
gtgtccatctctgtatgctgct

SEQ ID NO: 8232531 - DNA, 22 bp, Homo sapiens
gtgtccagttttttctctgctg

SEQ ID NO: 8232532 - DNA, 22 bp, Homo sapiens
gtgtcccaaagattagaaatca

SEQ ID NO: 8232533 - DNA, 22 bp, Homo sapiens
gtgtcccaaagattagaaatca

SEQ ID NO: 8232534 - DNA, 22 bp, Homo sapiens
gtgtcccaatctacttttccct

SEQ ID NO: 8232535 - DNA, 22 bp, Homo sapiens
gtgtcccaatgttcaggacggc

SEQ ID NO: 8232536 - DNA, 22 bp, Homo sapiens
gtgtcccaatgttcaggacggc

SEQ ID NO: 8232537 - DNA, 22 bp, Homo sapiens
gtgtcccactctggaggtgaag

SEQ ID NO: 8232538 - DNA, 22 bp, Homo sapiens
gtgtcccactctggaggtgaag

SEQ ID NO: 8232539 - DNA, 22 bp, Homo sapiens
gtgtccagagaaactcacagct

SEQ ID NO: 8232540 - DNA, 22 bp, Homo sapiens
gtgtccagggccgtgttgtctt

SEQ ID NO: 8232541 - DNA, 22 bp, Homo sapiens
gtgtccagtcatagcccagggc

SEQ ID NO: 8232542 - DNA, 22 bp, Homo sapiens
gtggtgtaggtcacagttagga

SEQ ID NO: 8232543 - DNA, 22 bp, Homo sapiens
gtggtgtaggtcacagttagga

SEQ ID NO: 8232544 - DNA, 22 bp, Homo sapiens
gtggtgtaggtcacagttagga

SEQ ID NO: 8232545 - DNA, 22 bp, Homo sapiens
gtggtgcatgcatgcatatgta

SEQ ID NO: 8232546 - DNA, 22 bp, Homo sapiens
gtggtgcatccttgagtaagct

SEQ ID NO: 8232547 - DNA, 22 bp, Homo sapiens
gtggtgcaggaagcatctggct

SEQ ID NO: 8232548 - DNA, 22 bp, Homo sapiens
gtggttgtttccaggtttgaaa

SEQ ID NO: 8232549 - DNA, 22 bp, Homo sapiens
gtggttgggatcatgggctatg

SEQ ID NO: 8232550 - DNA, 22 bp, Homo sapiens
gtggttgtatagttaaggttca

SEQ ID NO: 8232551 - DNA, 22 bp, Homo sapiens
gtggttagcgccccattcttct

SEQ ID NO: 8232552 - DNA, 22 bp, Homo sapiens
gtggtgaagccccatctctgct

SEQ ID NO: 8232553 - DNA, 22 bp, Homo sapiens
gtggtgaagccccatctctgct

SEQ ID NO: 8232554 - DNA, 22 bp, Homo sapiens
gtggtgaagcattgagaagtca

SEQ ID NO: 8232555 - DNA, 22 bp, Homo sapiens
gtggtgagattgctggatcaaa

SEQ ID NO: 8232556 - DNA, 22 bp, Homo sapiens
gtggtgagttcaggctggggtg

SEQ ID NO: 8232557 - DNA, 22 bp, Homo sapiens
gtggtgagttcaggctggggtg

SEQ ID NO: 8232558 - DNA, 22 bp, Homo sapiens
gtggtcctttagaggatgtaat

SEQ ID NO: 8232559 - DNA, 22 bp, Homo sapiens
gtggtctggggtcaggcctgag

SEQ ID NO: 8232560 - DNA, 22 bp, Homo sapiens
gtggtccatcatgcagagctcc

SEQ ID NO: 8232561 - DNA, 22 bp, Homo sapiens
gtggtccccagagctgtgtaca

SEQ ID NO: 8232562 - DNA, 22 bp, Homo sapiens
gtggtccatcatgcagagctcc

SEQ ID NO: 8232563 - DNA, 22 bp, Homo sapiens
gtggtccaaggagtttccagca

SEQ ID NO: 8232564 - DNA, 22 bp, Homo sapiens
gtgtcacatggtttactgcagc

SEQ ID NO: 8232565 - DNA, 22 bp, Homo sapiens
gtgtcacaggcccagctcttca

SEQ ID NO: 8232566 - DNA, 22 bp, Homo sapiens
gtgtcacaagagcccaggaaac

SEQ ID NO: 8232567 - DNA, 22 bp, Homo sapiens
gtgtcactggaatactgtctgt

SEQ ID NO: 8232568 - DNA, 22 bp, Homo sapiens
gtgtcacatggtttactgcagc

SEQ ID NO: 8232569 - DNA, 22 bp, Homo sapiens
gtgtcacaggcccagctcttca

SEQ ID NO: 8232570 - DNA, 22 bp, Homo sapiens
gtgtcacaagagcccaggaaac

SEQ ID NO: 8232571 - DNA, 19 bp, Homo sapiens
gtgtacagctcagtgaatt

SEQ ID NO: 8232572 - DNA, 22 bp, Homo sapiens
gtgtcaataaatagcggtgtgg

SEQ ID NO: 8232573 - DNA, 22 bp, Homo sapiens
gtgtaagtatctttgtatcttt

SEQ ID NO: 8232574 - DNA, 22 bp, Homo sapiens
gtgtaagtatctttgtatcttt

SEQ ID NO: 8232575 - DNA, 22 bp, Homo sapiens
gtgtaagtatctttgtatcttt

SEQ ID NO: 8232576 - DNA, 22 bp, Homo sapiens
gtgtacaaaatgtctccatgga

SEQ ID NO: 8232577 - DNA, 22 bp, Homo sapiens
gtggttttacaaagagaaagat

SEQ ID NO: 8232578 - DNA, 22 bp, Homo sapiens
gtggtttgttttattcctggaa

SEQ ID NO: 8232579 - DNA, 22 bp, Homo sapiens
gtggtttaggggaaagaactgt

SEQ ID NO: 8232580 - DNA, 22 bp, Homo sapiens
gtggtttgtgcatagctcctat

SEQ ID NO: 8232581 - DNA, 22 bp, Homo sapiens
gtggttttctccaacccagaac

SEQ ID NO: 8232582 - DNA, 19 bp, Homo sapiens
gtggttttctgaggagtct

SEQ ID NO: 8232583 - DNA, 22 bp, Homo sapiens
gtggttttattcgttcctctgt

SEQ ID NO: 8232584 - DNA, 22 bp, Homo sapiens
gtggttttctccaacccagaac

SEQ ID NO: 8232585 - DNA, 22 bp, Homo sapiens
gtggttttggaggccactgttt

SEQ ID NO: 8232586 - DNA, 22 bp, Homo sapiens
gtggttttgccattacaagtaa

SEQ ID NO: 8232587 - DNA, 22 bp, Homo sapiens
gtgtaaaaacatactatttcta

SEQ ID NO: 8232588 - DNA, 22 bp, Homo sapiens
gtgtaaaaacatactatttcta

SEQ ID NO: 8232589 - DNA, 22 bp, Homo sapiens
gtgtaaatgccccattcattga

SEQ ID NO: 8232590 - DNA, 22 bp, Homo sapiens
gtgtaaatgccccattcattga

SEQ ID NO: 8232591 - DNA, 17 bp, Homo sapiens
gtgtaaatgctagaaac

SEQ ID NO: 8232592 - DNA, 22 bp, Homo sapiens
gtgtaacttttattcatgctct

SEQ ID NO: 8232593 - DNA, 22 bp, Homo sapiens
gtgggggtggaaaggcaagttg

SEQ ID NO: 8232594 - DNA, 22 bp, Homo sapiens
gtgggggtggaaaggcaagttg

SEQ ID NO: 8232595 - DNA, 22 bp, Homo sapiens
gtggggtagatctttctcagga

SEQ ID NO: 8232596 - DNA, 22 bp, Homo sapiens
gtggggtagatctttctcagga

SEQ ID NO: 8232597 - DNA, 22 bp, Homo sapiens
gtggggtagatctttctcagga

SEQ ID NO: 8232598 - DNA, 22 bp, Homo sapiens
gtggggggagctgcaagctgga

SEQ ID NO: 8232599 - DNA, 22 bp, Homo sapiens
gtggggggagctgcaagctgga

SEQ ID NO: 8232600 - DNA, 22 bp, Homo sapiens
gtggggggacgttggtcacttt

SEQ ID NO: 8232601 - DNA, 22 bp, Homo sapiens
gtggggggagctgcaagctgga

SEQ ID NO: 8232602 - DNA, 22 bp, Homo sapiens
gtgggggctggctcgtcctgtg

SEQ ID NO: 8232603 - DNA, 22 bp, Homo sapiens
gtggggggacgttggtcacttt

SEQ ID NO: 8232604 - DNA, 18 bp, Homo sapiens
gtggggtgttgtgaggat

SEQ ID NO: 8232605 - DNA, 22 bp, Homo sapiens
gtggggtgtccagcagcgagct

SEQ ID NO: 8232606 - DNA, 22 bp, Homo sapiens
gtggggtgtccagcagcgagct

SEQ ID NO: 8232607 - DNA, 18 bp, Homo sapiens
gtggggtgttgtgaggat

SEQ ID NO: 8232608 - DNA, 18 bp, Homo sapiens
gtggggtgttgtgaggat

SEQ ID NO: 8232609 - DNA, 18 bp, Homo sapiens
gtggggtgttgtgaggat

SEQ ID NO: 8232610 - DNA, 18 bp, Homo sapiens
gtggggtgttgtgaggat

SEQ ID NO: 8232611 - DNA, 18 bp, Homo sapiens
gtggggtgttgtgaggat

SEQ ID NO: 8232612 - DNA, 22 bp, Homo sapiens
gtggggtgggctgagttaggcc

SEQ ID NO: 8232613 - DNA, 22 bp, Homo sapiens
gtggggtgggctgagttaggcc

SEQ ID NO: 8232614 - DNA, 22 bp, Homo sapiens
gtggggtgtccagcagcgagct

SEQ ID NO: 8232615 - DNA, 22 bp, Homo sapiens
gtggggtgggctgagttaggcc

SEQ ID NO: 8232616 - DNA, 22 bp, Homo sapiens
gtggggtgggctgagttaggcc

SEQ ID NO: 8232617 - DNA, 22 bp, Homo sapiens
gtggggtgggctgagttaggcc

SEQ ID NO: 8232618 - DNA, 22 bp, Homo sapiens
gtggggtctctctgtacctccc

SEQ ID NO: 8232619 - DNA, 22 bp, Homo sapiens
gtggggtgcagcagtactgtgt

SEQ ID NO: 8232620 - DNA, 22 bp, Homo sapiens
gtggggtgcagcagtactgtgt

SEQ ID NO: 8232621 - DNA, 22 bp, Homo sapiens
gtgggtaattggagggctgcct

SEQ ID NO: 8232622 - DNA, 18 bp, Homo sapiens
gtggggtgttgtgaggat

SEQ ID NO: 8232623 - DNA, 22 bp, Homo sapiens
gtgggtctggctttgagggtca

SEQ ID NO: 8232624 - DNA, 22 bp, Homo sapiens
gtgggtcagcaagccaggagta

SEQ ID NO: 8232625 - DNA, 22 bp, Homo sapiens
gtgggtgatgtactggaggcca

SEQ ID NO: 8232626 - DNA, 22 bp, Homo sapiens
gtgggtgatgtactggaggcca

SEQ ID NO: 8232627 - DNA, 22 bp, Homo sapiens
gtgggtgatgtactggaggcca

SEQ ID NO: 8232628 - DNA, 22 bp, Homo sapiens
gtgggtgcggggagccgaggcg

SEQ ID NO: 8232629 - DNA, 22 bp, Homo sapiens
gtgggtgcggggagccgaggcg

SEQ ID NO: 8232630 - DNA, 22 bp, Homo sapiens
gtgggtggacggtgcttttgtt

SEQ ID NO: 8232631 - DNA, 22 bp, Homo sapiens
gtgggtggaggcgtcgagggca

SEQ ID NO: 8232632 - DNA, 22 bp, Homo sapiens
gtgggtggagactgggtgcaag

SEQ ID NO: 8232633 - DNA, 22 bp, Homo sapiens
gtgggtggaggcgtcgagggca

SEQ ID NO: 8232634 - DNA, 22 bp, Homo sapiens
gtgggtggacggtgcttttgtt

SEQ ID NO: 8232635 - DNA, 22 bp, Homo sapiens
gtgggtggacggtgcttttgtt

SEQ ID NO: 8232636 - DNA, 22 bp, Homo sapiens
gtgggtggagactgggtgcaag

SEQ ID NO: 8232637 - DNA, 22 bp, Homo sapiens
gtgggtggagactgggtgcaag

SEQ ID NO: 8232638 - DNA, 22 bp, Homo sapiens
gtggtcagccccggtgagccct

SEQ ID NO: 8232639 - DNA, 22 bp, Homo sapiens
gtggtcaggttatcagatcata

SEQ ID NO: 8232640 - DNA, 22 bp, Homo sapiens
gtggtcagttaggcaatcatgt

SEQ ID NO: 8232641 - DNA, 22 bp, Homo sapiens
gtggtcaaagcatcagagacct

SEQ ID NO: 8232642 - DNA, 22 bp, Homo sapiens
gtggtatctgtctcccccactg

SEQ ID NO: 8232643 - DNA, 22 bp, Homo sapiens
gtggtcagaatggagcccagga

SEQ ID NO: 8232644 - DNA, 22 bp, Homo sapiens
gtgggcagtggtttgcgcggtc

SEQ ID NO: 8232645 - DNA, 22 bp, Homo sapiens
gtgggcagttcaattctgggag

SEQ ID NO: 8232646 - DNA, 22 bp, Homo sapiens
gtgggcagttcaattctgggag

SEQ ID NO: 8232647 - DNA, 22 bp, Homo sapiens
gtgggcagttcaattctgggag

SEQ ID NO: 8232648 - DNA, 22 bp, Homo sapiens
gtgggcagcctcctttattttc

SEQ ID NO: 8232649 - DNA, 22 bp, Homo sapiens
gtgggcagccccttcaaggcca

SEQ ID NO: 8232650 - DNA, 22 bp, Homo sapiens
gtgggcaggaggccctgccctg

SEQ ID NO: 8232651 - DNA, 22 bp, Homo sapiens
gtgggcaggaggccctgccctg

SEQ ID NO: 8232652 - DNA, 22 bp, Homo sapiens
gtgggcagcctgtccggagacc

SEQ ID NO: 8232653 - DNA, 22 bp, Homo sapiens
gtgggcagcctgtccggagacc

SEQ ID NO: 8232654 - DNA, 22 bp, Homo sapiens
gtgggccaggacccgctgtccg

SEQ ID NO: 8232655 - DNA, 22 bp, Homo sapiens
gtgggccagcttttctcctggg

SEQ ID NO: 8232656 - DNA, 22 bp, Homo sapiens
gtgggccacatcccagggctct

SEQ ID NO: 8232657 - DNA, 22 bp, Homo sapiens
gtgggccaggccggagtgcaga

SEQ ID NO: 8232658 - DNA, 22 bp, Homo sapiens
gtgggccaggccggagtgcaga

SEQ ID NO: 8232659 - DNA, 22 bp, Homo sapiens
gtgggcagttggtgattctcgt

SEQ ID NO: 8232660 - DNA, 22 bp, Homo sapiens
gtgggcagttggtgattctcgt

SEQ ID NO: 8232661 - DNA, 22 bp, Homo sapiens
gtgggccactgggaggcaaggg

SEQ ID NO: 8232662 - DNA, 22 bp, Homo sapiens
gtgggccacatcccagggctct

SEQ ID NO: 8232663 - DNA, 22 bp, Homo sapiens
gtgggcagccccttcaaggcca

SEQ ID NO: 8232664 - DNA, 20 bp, Homo sapiens
gtgggcagcaggcatactgg

SEQ ID NO: 8232665 - DNA, 20 bp, Homo sapiens
gtgggcagcaggcatactgg

SEQ ID NO: 8232666 - DNA, 20 bp, Homo sapiens
gtgggcagcaggcatactgg

SEQ ID NO: 8232667 - DNA, 22 bp, Homo sapiens
gtgggcagcaccagggaagtgt

SEQ ID NO: 8232668 - DNA, 20 bp, Homo sapiens
gtgggcagatgtgtgcatgg

SEQ ID NO: 8232669 - DNA, 20 bp, Homo sapiens
gtgggcagatgtgtgcatgg

SEQ ID NO: 8232670 - DNA, 22 bp, Homo sapiens
gtgggcagattaatttctcaat

SEQ ID NO: 8232671 - DNA, 22 bp, Homo sapiens
gtgggcagattatagatgatgc

SEQ ID NO: 8232672 - DNA, 22 bp, Homo sapiens
gtgggcagcaccagggaagtgt

SEQ ID NO: 8232673 - DNA, 20 bp, Homo sapiens
gtgggcagagcaccacctgg

SEQ ID NO: 8232674 - DNA, 22 bp, Homo sapiens
gtgggcagacatgatagaagga

SEQ ID NO: 8232675 - DNA, 22 bp, Homo sapiens
gtgggcagagcaagggaactca

SEQ ID NO: 8232676 - DNA, 22 bp, Homo sapiens
gtgggcagagcaagggaactca

SEQ ID NO: 8232677 - DNA, 22 bp, Homo sapiens
gtgggcagagcaagggaactca

SEQ ID NO: 8232678 - DNA, 22 bp, Homo sapiens
gtgggcagagcaagggaactca

SEQ ID NO: 8232679 - DNA, 22 bp, Homo sapiens
gtgggcagacagtgctttgcag

SEQ ID NO: 8232680 - DNA, 22 bp, Homo sapiens
gtgggcagacatgatagaagga

SEQ ID NO: 8232681 - DNA, 22 bp, Homo sapiens
gtgggcagaacatttgtaggct

SEQ ID NO: 8232682 - DNA, 22 bp, Homo sapiens
gtgggcagacagtgctttgcag

SEQ ID NO: 8232683 - DNA, 22 bp, Homo sapiens
gtgggcagaacatttgtaggct

SEQ ID NO: 8232684 - DNA, 22 bp, Homo sapiens
gtgggcaaggtccctgccagct

SEQ ID NO: 8232685 - DNA, 22 bp, Homo sapiens
gtgggggcagtgggcttcgagc

SEQ ID NO: 8232686 - DNA, 22 bp, Homo sapiens
gtgggggctggaaatcttgcca

SEQ ID NO: 8232687 - DNA, 22 bp, Homo sapiens
gtggggcttcctggggcaagtt

SEQ ID NO: 8232688 - DNA, 22 bp, Homo sapiens
gtggggcttcctggggcaagtt

SEQ ID NO: 8232689 - DNA, 22 bp, Homo sapiens
gtggggcttcctggggcaagtt

SEQ ID NO: 8232690 - DNA, 22 bp, Homo sapiens
gtgggggacccaggtgctgtcc

SEQ ID NO: 8232691 - DNA, 22 bp, Homo sapiens
gtgggggacccaggtgctgtcc

SEQ ID NO: 8232692 - DNA, 22 bp, Homo sapiens
gtgggggatgctgagttggaaa

SEQ ID NO: 8232693 - DNA, 22 bp, Homo sapiens
gtgggggatgctgagttggaaa

SEQ ID NO: 8232694 - DNA, 22 bp, Homo sapiens
gtgggggagatgcttaggtccg

SEQ ID NO: 8232695 - DNA, 22 bp, Homo sapiens
gtgggggagatgcttaggtccg

SEQ ID NO: 8232696 - DNA, 22 bp, Homo sapiens
gtgggggacccaggtgctgtcc

SEQ ID NO: 8232697 - DNA, 22 bp, Homo sapiens
gtggggaaaggagtggggctca

SEQ ID NO: 8232698 - DNA, 22 bp, Homo sapiens
gtggggaaaggagtggggctca

SEQ ID NO: 8232699 - DNA, 22 bp, Homo sapiens
gtgggcttttgacagtgcctgg

SEQ ID NO: 8232700 - DNA, 22 bp, Homo sapiens
gtggggaaaggagtggggctca

SEQ ID NO: 8232701 - DNA, 22 bp, Homo sapiens
gtggggagcagccttagcccct

SEQ ID NO: 8232702 - DNA, 22 bp, Homo sapiens
gtggggaggcattcttctccct

SEQ ID NO: 8232703 - DNA, 22 bp, Homo sapiens
gtggggaggcctaagcaagttg

SEQ ID NO: 8232704 - DNA, 22 bp, Homo sapiens
gtggggaggcctaagcaagttg

SEQ ID NO: 8232705 - DNA, 22 bp, Homo sapiens
gtggggaggcctaagcaagttg

SEQ ID NO: 8232706 - DNA, 22 bp, Homo sapiens
gtggggctggaagatgggtact

SEQ ID NO: 8232707 - DNA, 22 bp, Homo sapiens
gtgggctggaccctcctgctcc

SEQ ID NO: 8232708 - DNA, 22 bp, Homo sapiens
gtgggctgcttcctccttccac

SEQ ID NO: 8232709 - DNA, 22 bp, Homo sapiens
gtgggctggaccctcctgctcc

SEQ ID NO: 8232710 - DNA, 22 bp, Homo sapiens
gtgggctgcccttgaggtcagc

SEQ ID NO: 8232711 - DNA, 22 bp, Homo sapiens
gtgggctgcccttgaggtcagc

SEQ ID NO: 8232712 - DNA, 22 bp, Homo sapiens
gtgggctgcttcctccttccac

SEQ ID NO: 8232713 - DNA, 22 bp, Homo sapiens
gtgggctggagcaatgatttca

SEQ ID NO: 8232714 - DNA, 22 bp, Homo sapiens
gtgggctttgctggatccttcc

SEQ ID NO: 8232715 - DNA, 22 bp, Homo sapiens
gtgggctttggcctctttctcc

SEQ ID NO: 8232716 - DNA, 22 bp, Homo sapiens
gtgggcttctgttagggaggct

SEQ ID NO: 8232717 - DNA, 22 bp, Homo sapiens
gtgggcttgttttgatgagatc

SEQ ID NO: 8232718 - DNA, 22 bp, Homo sapiens
gtgggcttcccttaagccagag

SEQ ID NO: 8232719 - DNA, 22 bp, Homo sapiens
gtgggccaggcgtctaggccct

SEQ ID NO: 8232720 - DNA, 22 bp, Homo sapiens
gtgggccaggcgtctaggccct

SEQ ID NO: 8232721 - DNA, 22 bp, Homo sapiens
gtgggccaggccggagtgcaga

SEQ ID NO: 8232722 - DNA, 22 bp, Homo sapiens
gtgggccagttcctcacaggta

SEQ ID NO: 8232723 - DNA, 22 bp, Homo sapiens
gtgggccagttcctcacaggta

SEQ ID NO: 8232724 - DNA, 22 bp, Homo sapiens
gtgggcctcttgagggtggcta

SEQ ID NO: 8232725 - DNA, 22 bp, Homo sapiens
gtgggccagttcctcacaggta

SEQ ID NO: 8232726 - DNA, 22 bp, Homo sapiens
gtgggccttgcagggtgcaggg

SEQ ID NO: 8232727 - DNA, 22 bp, Homo sapiens
gtgggccttgcagggtgcaggg

SEQ ID NO: 8232728 - DNA, 22 bp, Homo sapiens
gtgggcctgatgctgccatgag

SEQ ID NO: 8232729 - DNA, 22 bp, Homo sapiens
gtgggcctgatgctgccatgag

SEQ ID NO: 8232730 - DNA, 22 bp, Homo sapiens
gtgggctcccctggcatgtcca

SEQ ID NO: 8232731 - DNA, 22 bp, Homo sapiens
gtgggctcaggcctctgtgggg

SEQ ID NO: 8232732 - DNA, 22 bp, Homo sapiens
gtgggcggggcctctcaagctg

SEQ ID NO: 8232733 - DNA, 22 bp, Homo sapiens
gtgggccttgcagggtgcaggg

SEQ ID NO: 8232734 - DNA, 22 bp, Homo sapiens
gtgggccttgcagggtgcaggg

SEQ ID NO: 8232735 - DNA, 22 bp, Homo sapiens
gtgggctgcccttgaggtcagc

SEQ ID NO: 8232736 - DNA, 22 bp, Homo sapiens
gtgggctgcccttgaggtcagc

SEQ ID NO: 8232737 - DNA, 22 bp, Homo sapiens
gtttttctttgtgtgaagacaa

SEQ ID NO: 8232738 - DNA, 20 bp, Homo sapiens
gtttttcttgggcgagctat

SEQ ID NO: 8232739 - DNA, 22 bp, Homo sapiens
gttttttcatgagtagttatct

SEQ ID NO: 8232740 - DNA, 22 bp, Homo sapiens
gtttttgtccatggaggcaaac

SEQ ID NO: 8232741 - DNA, 22 bp, Homo sapiens
gtttttctttgtgtgaagacaa

SEQ ID NO: 8232742 - DNA, 22 bp, Homo sapiens
taaaacacataaactctctatt

SEQ ID NO: 8232743 - DNA, 22 bp, Homo sapiens
taaaacacataaactctctatt

SEQ ID NO: 8232744 - DNA, 22 bp, Homo sapiens
taaaacacctgtagtgtctgcc

SEQ ID NO: 8232745 - DNA, 22 bp, Homo sapiens
gttttttgggtgtatatcttct

SEQ ID NO: 8232746 - DNA, 22 bp, Homo sapiens
gtttttctaggaccatgtgatt

SEQ ID NO: 8232747 - DNA, 22 bp, Homo sapiens
gtttttctaggaccatgtgatt

SEQ ID NO: 8232748 - DNA, 22 bp, Homo sapiens
gtttttctagactgggagtttg

SEQ ID NO: 8232749 - DNA, 22 bp, Homo sapiens
gtttttctagactgggagtttg

SEQ ID NO: 8232750 - DNA, 22 bp, Homo sapiens
gtttttctagaaatctcctcct

SEQ ID NO: 8232751 - DNA, 22 bp, Homo sapiens
gtttttctctgaaatagttgac

SEQ ID NO: 8232752 - DNA, 20 bp, Homo sapiens
gtttttctctcttgccacta

SEQ ID NO: 8232753 - DNA, 20 bp, Homo sapiens
gtttttctctcttgccacta

SEQ ID NO: 8232754 - DNA, 22 bp, Homo sapiens
gtttttctgtgagcggtaaagg

SEQ ID NO: 8232755 - DNA, 22 bp, Homo sapiens
gtttttctctgaaatagttgac

SEQ ID NO: 8232756 - DNA, 22 bp, Homo sapiens
gtttttctctgaaatagttgac

SEQ ID NO: 8232757 - DNA, 22 bp, Homo sapiens
gttgttttgcaggatccttaca

SEQ ID NO: 8232758 - DNA, 22 bp, Homo sapiens
gttgttttcagcagtttatgac

SEQ ID NO: 8232759 - DNA, 22 bp, Homo sapiens
gttgtttttgaacggtggtggc

SEQ ID NO: 8232760 - DNA, 19 bp, Homo sapiens
gttgtttttcttattatgg

SEQ ID NO: 8232761 - DNA, 22 bp, Homo sapiens
gtttaaagtcttggaaggagga

SEQ ID NO: 8232762 - DNA, 22 bp, Homo sapiens
gttgtttttgttctctatagct

SEQ ID NO: 8232763 - DNA, 22 bp, Homo sapiens
gttgtttttgttctctatagct

SEQ ID NO: 8232764 - DNA, 22 bp, Homo sapiens
gtttaaagtagcttccttttgg

SEQ ID NO: 8232765 - DNA, 22 bp, Homo sapiens
gtttaaataattaggggcctgt

SEQ ID NO: 8232766 - DNA, 22 bp, Homo sapiens
gtttaaataattaggggcctgt

SEQ ID NO: 8232767 - DNA, 22 bp, Homo sapiens
gtttaaataattaggggcctgt

SEQ ID NO: 8232768 - DNA, 22 bp, Homo sapiens
gtttaaataattaggggcctgt

SEQ ID NO: 8232769 - DNA, 22 bp, Homo sapiens
gtttaataatgttgaattacta

SEQ ID NO: 8232770 - DNA, 22 bp, Homo sapiens
gtttaagaaaattcatgttgtt

SEQ ID NO: 8232771 - DNA, 22 bp, Homo sapiens
gtttaagaaaattcatgttgtt

SEQ ID NO: 8232772 - DNA, 19 bp, Homo sapiens
gtttttcccagacgaggca

SEQ ID NO: 8232773 - DNA, 19 bp, Homo sapiens
gtttttcccagacgaggca

SEQ ID NO: 8232774 - DNA, 22 bp, Homo sapiens
gtttttcctgctgacttgggtc

SEQ ID NO: 8232775 - DNA, 22 bp, Homo sapiens
gtttttcctgctgacttgggtc

SEQ ID NO: 8232776 - DNA, 22 bp, Homo sapiens
gtttttctaagtagcgatattt

SEQ ID NO: 8232777 - DNA, 22 bp, Homo sapiens
gtttttccttgctgaggacccg

SEQ ID NO: 8232778 - DNA, 22 bp, Homo sapiens
gtttttccttgctgaggacccg

SEQ ID NO: 8232779 - DNA, 22 bp, Homo sapiens
taaaactagaccgtgagtctaa

SEQ ID NO: 8232780 - DNA, 22 bp, Homo sapiens
taaaactagtggttgggactaa

SEQ ID NO: 8232781 - DNA, 22 bp, Homo sapiens
taaaactgaatacatactgagg

SEQ ID NO: 8232782 - DNA, 22 bp, Homo sapiens
taaaaccataaggctggaagga

SEQ ID NO: 8232783 - DNA, 22 bp, Homo sapiens
taaaaccataaggctggaagga

SEQ ID NO: 8232784 - DNA, 22 bp, Homo sapiens
taaaaccattcctgctttcatg

SEQ ID NO: 8232785 - DNA, 22 bp, Homo sapiens
taaaacagcagggcagagaagt

SEQ ID NO: 8232786 - DNA, 22 bp, Homo sapiens
taaaaccaggtcttgggattta

SEQ ID NO: 8232787 - DNA, 22 bp, Homo sapiens
taaaacagcagggcagagaagt

SEQ ID NO: 8232788 - DNA, 22 bp, Homo sapiens
taaaggaacagaggactcattt

SEQ ID NO: 8232789 - DNA, 22 bp, Homo sapiens
taaagctgttagagtagtaaga

SEQ ID NO: 8232790 - DNA, 22 bp, Homo sapiens
taaagcagtatgatggaaggat

SEQ ID NO: 8232791 - DNA, 22 bp, Homo sapiens
taaagcagtgcaaaagcgtttt

SEQ ID NO: 8232792 - DNA, 21 bp, Homo sapiens
taaagctagaaccttagcttt

SEQ ID NO: 8232793 - DNA, 22 bp, Homo sapiens
taaagctagaaggtgctgtaca

SEQ ID NO: 8232794 - DNA, 22 bp, Homo sapiens
taaagctagaattgttccagca

SEQ ID NO: 8232795 - DNA, 22 bp, Homo sapiens
taaatactttacaggatgtctc

SEQ ID NO: 8232796 - DNA, 22 bp, Homo sapiens
taaaggaggagttaatgagact

SEQ ID NO: 8232797 - DNA, 22 bp, Homo sapiens
taaaggaggagttaatgagact

SEQ ID NO: 8232798 - DNA, 22 bp, Homo sapiens
taaaggaggagttaatgagact

SEQ ID NO: 8232799 - DNA, 22 bp, Homo sapiens
taaaggaatcagttttagagat

SEQ ID NO: 8232800 - DNA, 18 bp, Homo sapiens
taaaggaagtgggagagg

SEQ ID NO: 8232801 - DNA, 22 bp, Homo sapiens
taaaggattttgtataatataa

SEQ ID NO: 8232802 - DNA, 22 bp, Homo sapiens
taaaggataactttcaagaatt

SEQ ID NO: 8232803 - DNA, 22 bp, Homo sapiens
taaaggagtgtgatgaaaggga

SEQ ID NO: 8232804 - DNA, 22 bp, Homo sapiens
taaaggcacggagttgttatgg

SEQ ID NO: 8232805 - DNA, 22 bp, Homo sapiens
taaatgaagaaatggagattgt

SEQ ID NO: 8232806 - DNA, 22 bp, Homo sapiens
taaatgagatgtacataactca

SEQ ID NO: 8232807 - DNA, 22 bp, Homo sapiens
taaatgacattcttaagtcttg

SEQ ID NO: 8232808 - DNA, 22 bp, Homo sapiens
taaatgacattcttaagtcttg

SEQ ID NO: 8232809 - DNA, 22 bp, Homo sapiens
taaatgagatgtacataactca

SEQ ID NO: 8232810 - DNA, 22 bp, Homo sapiens
taaatgagatgtacataactca

SEQ ID NO: 8232811 - DNA, 22 bp, Homo sapiens
taaatgagatttgttcttttgt

SEQ ID NO: 8232812 - DNA, 22 bp, Homo sapiens
taaatgagggctgacatgattg

SEQ ID NO: 8232813 - DNA, 22 bp, Homo sapiens
taaatgataataatgctagtgt

SEQ ID NO: 8232814 - DNA, 22 bp, Homo sapiens
taaatgataataatgctagtgt

SEQ ID NO: 8232815 - DNA, 22 bp, Homo sapiens
taacactgaaaatgatgcatgt

SEQ ID NO: 8232816 - DNA, 22 bp, Homo sapiens
taacactgaaaatgatgcatgt

SEQ ID NO: 8232817 - DNA, 22 bp, Homo sapiens
taaatgagggctgacatgattg

SEQ ID NO: 8232818 - DNA, 22 bp, Homo sapiens
taaatgagtaatatagctgttt

SEQ ID NO: 8232819 - DNA, 22 bp, Homo sapiens
taaatgagggctgacatgattg

SEQ ID NO: 8232820 - DNA, 22 bp, Homo sapiens
taaatgagggctgacatgattg

SEQ ID NO: 8232821 - DNA, 22 bp, Homo sapiens
taaatgagggctgacatgattg

SEQ ID NO: 8232822 - DNA, 22 bp, Homo sapiens
taacactggtatttcatttagt

SEQ ID NO: 8232823 - DNA, 22 bp, Homo sapiens
taacactgtaaacctagatgtt

SEQ ID NO: 8232824 - DNA, 22 bp, Homo sapiens
taacactggttatccctgtgca

SEQ ID NO: 8232825 - DNA, 22 bp, Homo sapiens
taacactggcttttgctgaggc

SEQ ID NO: 8232826 - DNA, 22 bp, Homo sapiens
taacactggcttttgctgaggc

SEQ ID NO: 8232827 - DNA, 22 bp, Homo sapiens
taacactgcttcattttggaga

SEQ ID NO: 8232828 - DNA, 22 bp, Homo sapiens
taacactgccatgctggagtca

SEQ ID NO: 8232829 - DNA, 22 bp, Homo sapiens
taacactgccatgctggagtca

SEQ ID NO: 8232830 - DNA, 22 bp, Homo sapiens
taacactggagagttggttgtg

SEQ ID NO: 8232831 - DNA, 22 bp, Homo sapiens
taacactgatttgttctcaggg

SEQ ID NO: 8232832 - DNA, 22 bp, Homo sapiens
taacactgatttgttctcaggg

SEQ ID NO: 8232833 - DNA, 22 bp, Homo sapiens
taacactgatttgttctcaggg

SEQ ID NO: 8232834 - DNA, 22 bp, Homo sapiens
taaatcactgttcattccacac

SEQ ID NO: 8232835 - DNA, 22 bp, Homo sapiens
taaatcactcctaataatcagt

SEQ ID NO: 8232836 - DNA, 22 bp, Homo sapiens
taaatcagtaaggcatattctc

SEQ ID NO: 8232837 - DNA, 22 bp, Homo sapiens
taaatcagcctttgctatttta

SEQ ID NO: 8232838 - DNA, 22 bp, Homo sapiens
taaatcaggaaggaaacttgga

SEQ ID NO: 8232839 - DNA, 22 bp, Homo sapiens
taaatcagggagtcatctgcga

SEQ ID NO: 8232840 - DNA, 22 bp, Homo sapiens
taaatgaaagggtttaatttat

SEQ ID NO: 8232841 - DNA, 22 bp, Homo sapiens
taaatcttctacatcatcataa

SEQ ID NO: 8232842 - DNA, 22 bp, Homo sapiens
taaatctttaggaagctcaaac

SEQ ID NO: 8232843 - DNA, 22 bp, Homo sapiens
taagaacaagatgttcctgttt

SEQ ID NO: 8232844 - DNA, 20 bp, Homo sapiens
taagaacaagactaggaagc

SEQ ID NO: 8232845 - DNA, 22 bp, Homo sapiens
taacagcagggttacaggcatt

SEQ ID NO: 8232846 - DNA, 22 bp, Homo sapiens
taagaaatttagttatagaatg

SEQ ID NO: 8232847 - DNA, 22 bp, Homo sapiens
taagaaatttagttatagaatg

SEQ ID NO: 8232848 - DNA, 22 bp, Homo sapiens
taagaaatttagttatagaatg

SEQ ID NO: 8232849 - DNA, 22 bp, Homo sapiens
taacagaatttgctaaactccg

SEQ ID NO: 8232850 - DNA, 22 bp, Homo sapiens
taacagaatttgctaaactccg

SEQ ID NO: 8232851 - DNA, 22 bp, Homo sapiens
taacagagatagaaatgtaaag

SEQ ID NO: 8232852 - DNA, 22 bp, Homo sapiens
taacagcactggcaggcactgt

SEQ ID NO: 8232853 - DNA, 22 bp, Homo sapiens
taacagcaaccacagtgctggt

SEQ ID NO: 8232854 - DNA, 22 bp, Homo sapiens
taacagagtaacaggtatgtaa

SEQ ID NO: 8232855 - DNA, 22 bp, Homo sapiens
taacactgtgcccagagtccca

SEQ ID NO: 8232856 - DNA, 22 bp, Homo sapiens
taacactgtggtgttctttgtc

SEQ ID NO: 8232857 - DNA, 22 bp, Homo sapiens
taacactgtaaacctagatgtt

SEQ ID NO: 8232858 - DNA, 22 bp, Homo sapiens
taacactgtaaacctagatgtt

SEQ ID NO: 8232859 - DNA, 22 bp, Homo sapiens
taacactgtaaacctagatgtt

SEQ ID NO: 8232860 - DNA, 22 bp, Homo sapiens
taacactgtccaaagaattcca

SEQ ID NO: 8232861 - DNA, 22 bp, Homo sapiens
taacactgtccaaagaattcca

SEQ ID NO: 8232862 - DNA, 22 bp, Homo sapiens
taacactgtgtctgccatatcc

SEQ ID NO: 8232863 - DNA, 22 bp, Homo sapiens
taacagaatagcagaaacagaa

SEQ ID NO: 8232864 - DNA, 22 bp, Homo sapiens
taacagaatcctgttattgcca

SEQ ID NO: 8232865 - DNA, 22 bp, Homo sapiens
ggagacacccacattgctgggt

SEQ ID NO: 8232866 - DNA, 22 bp, Homo sapiens
ggagaaggtggctcagcaaagg

SEQ ID NO: 8232867 - DNA, 17 bp, Homo sapiens
ggagacagggtctttaa

SEQ ID NO: 8232868 - DNA, 22 bp, Homo sapiens
ggagacagcaggaagaaatatc

SEQ ID NO: 8232869 - DNA, 17 bp, Homo sapiens
ggagacagggtctttaa

SEQ ID NO: 8232870 - DNA, 22 bp, Homo sapiens
ggagaaggaatattggagtagg

SEQ ID NO: 8232871 - DNA, 22 bp, Homo sapiens
ggagaaggaagaaagctactat

SEQ ID NO: 8232872 - DNA, 22 bp, Homo sapiens
ggagaaggaagaaagctactat

SEQ ID NO: 8232873 - DNA, 21 bp, Homo sapiens
ggagaaggacaatgttgagta

SEQ ID NO: 8232874 - DNA, 21 bp, Homo sapiens
ggagaaggacaatgttgagta

SEQ ID NO: 8232875 - DNA, 22 bp, Homo sapiens
ggagaaggaatattggagtagg

SEQ ID NO: 8232876 - DNA, 22 bp, Homo sapiens
ggagaaggaatattggagtagg

SEQ ID NO: 8232877 - DNA, 22 bp, Homo sapiens
ggagaaggaatattggagtagg

SEQ ID NO: 8232878 - DNA, 22 bp, Homo sapiens
ggagaaggtggctcagcaaagg

SEQ ID NO: 8232879 - DNA, 22 bp, Homo sapiens
ggaagtcctggccatctgccgg

SEQ ID NO: 8232880 - DNA, 22 bp, Homo sapiens
ggaagtgtagtccgaagttgcg

SEQ ID NO: 8232881 - DNA, 22 bp, Homo sapiens
ggaagtgtttgtgcagatggcc

SEQ ID NO: 8232882 - DNA, 22 bp, Homo sapiens
ggaagtgtttccttgggcagca

SEQ ID NO: 8232883 - DNA, 22 bp, Homo sapiens
ggaagtgtgcaatattgggctg

SEQ ID NO: 8232884 - DNA, 18 bp, Homo sapiens
ggaaggtgctggagtgca

SEQ ID NO: 8232885 - DNA, 18 bp, Homo sapiens
ggaaggtgctggagtgca

SEQ ID NO: 8232886 - DNA, 18 bp, Homo sapiens
ggaagtaggaagaggaag

SEQ ID NO: 8232887 - DNA, 22 bp, Homo sapiens
ggaagtcctcatacctgattct

SEQ ID NO: 8232888 - DNA, 22 bp, Homo sapiens
ggaagtaatgtcttaagattct

SEQ ID NO: 8232889 - DNA, 22 bp, Homo sapiens
ggaagtagaggtcattctgaat

SEQ ID NO: 8232890 - DNA, 22 bp, Homo sapiens
ggaatagtttatgtagctgaat

SEQ ID NO: 8232891 - DNA, 21 bp, Homo sapiens
ggaatagcttaaagtgagggg

SEQ ID NO: 8232892 - DNA, 22 bp, Homo sapiens
ggaagtttgtagatgtttctta

SEQ ID NO: 8232893 - DNA, 22 bp, Homo sapiens
ggaataaagaatctggttcccc

SEQ ID NO: 8232894 - DNA, 22 bp, Homo sapiens
ggaagtttgggagctggtaatc

SEQ ID NO: 8232895 - DNA, 19 bp, Homo sapiens
ggagaagcccaggaatcct

SEQ ID NO: 8232896 - DNA, 19 bp, Homo sapiens
ggagaagcccaggaatcct

SEQ ID NO: 8232897 - DNA, 22 bp, Homo sapiens
ggagaagccaggtgataagcaa

SEQ ID NO: 8232898 - DNA, 22 bp, Homo sapiens
ggagaagccacacattgggtgt

SEQ ID NO: 8232899 - DNA, 19 bp, Homo sapiens
ggagaagcccaggaatcct

SEQ ID NO: 8232900 - DNA, 19 bp, Homo sapiens
ggagaagcccaggaatcct

SEQ ID NO: 8232901 - DNA, 19 bp, Homo sapiens
ggagaagcccaggaatcct

SEQ ID NO: 8232902 - DNA, 22 bp, Homo sapiens
ggagaagccacacattgggtgt

SEQ ID NO: 8232903 - DNA, 22 bp, Homo sapiens
ggagaagcaggtgctttgggtc

SEQ ID NO: 8232904 - DNA, 19 bp, Homo sapiens
ggagaagcatctagaaata

SEQ ID NO: 8232905 - DNA, 19 bp, Homo sapiens
ggagaagcatctagaaata

SEQ ID NO: 8232906 - DNA, 22 bp, Homo sapiens
ggagaagcaggtgctttgggtc

SEQ ID NO: 8232907 - DNA, 22 bp, Homo sapiens
ggagaagcaggtgctttgggtc

SEQ ID NO: 8232908 - DNA, 22 bp, Homo sapiens
ggaatatagccagtaacagtca

SEQ ID NO: 8232909 - DNA, 22 bp, Homo sapiens
ggagcgtgcactccaggccctt

SEQ ID NO: 8232910 - DNA, 22 bp, Homo sapiens
ggagcgtgcagcatgagctcat

SEQ ID NO: 8232911 - DNA, 22 bp, Homo sapiens
ggagcgtgcactccaggccctt

SEQ ID NO: 8232912 - DNA, 22 bp, Homo sapiens
ggagctagtagtttcatgagtt

SEQ ID NO: 8232913 - DNA, 22 bp, Homo sapiens
ggagctagcctgtctctgttta

SEQ ID NO: 8232914 - DNA, 22 bp, Homo sapiens
ggagcctgtgggatgagatgtg

SEQ ID NO: 8232915 - DNA, 22 bp, Homo sapiens
ggagcctgtgggatgagatgtg

SEQ ID NO: 8232916 - DNA, 22 bp, Homo sapiens
ggagcctgtgggatgagatgtg

SEQ ID NO: 8232917 - DNA, 22 bp, Homo sapiens
ggagcctgttagttgagtgctc

SEQ ID NO: 8232918 - DNA, 22 bp, Homo sapiens
ggagcctgtgggatgagatgtg

SEQ ID NO: 8232919 - DNA, 22 bp, Homo sapiens
ggagcctgttagttgagtgctc

SEQ ID NO: 8232920 - DNA, 22 bp, Homo sapiens
ggagcctgtgggatgagatgtg

SEQ ID NO: 8232921 - DNA, 22 bp, Homo sapiens
ggagcctgtgggatgagatgtg

SEQ ID NO: 8232922 - DNA, 22 bp, Homo sapiens
ggagcctgtgggatgagatgtg

SEQ ID NO: 8232923 - DNA, 22 bp, Homo sapiens
ggagcctgtggccgtcacgact

SEQ ID NO: 8232924 - DNA, 22 bp, Homo sapiens
ggagcctgtgcccaagcccaga

SEQ ID NO: 8232925 - DNA, 22 bp, Homo sapiens
ggagcctgtggccgtcacgact

SEQ ID NO: 8232926 - DNA, 22 bp, Homo sapiens
ggagcctgtggccgtcacgact

SEQ ID NO: 8232927 - DNA, 22 bp, Homo sapiens
ggagcctgtggctgcttgaagc

SEQ ID NO: 8232928 - DNA, 22 bp, Homo sapiens
ggagcctgtggctgcttgaagc

SEQ ID NO: 8232929 - DNA, 22 bp, Homo sapiens
ggagatctttgttatcttttga

SEQ ID NO: 8232930 - DNA, 22 bp, Homo sapiens
ggagatctttaggagttggact

SEQ ID NO: 8232931 - DNA, 22 bp, Homo sapiens
ggagatgcaatgtagaatctgg

SEQ ID NO: 8232932 - DNA, 22 bp, Homo sapiens
ggagatgccagaattgcaaatt

SEQ ID NO: 8232933 - DNA, 20 bp, Homo sapiens
ggagatgcagcccaggtgcc

SEQ ID NO: 8232934 - DNA, 22 bp, Homo sapiens
ggagatgctatgtagtttggtt

SEQ ID NO: 8232935 - DNA, 23 bp, Homo sapiens
ggagatgcttaagagtggttgag

SEQ ID NO: 8232936 - DNA, 22 bp, Homo sapiens
ggagatgctatgtagtttggtt

SEQ ID NO: 8232937 - DNA, 22 bp, Homo sapiens
ggagatgccagaattgcaaatt

SEQ ID NO: 8232938 - DNA, 22 bp, Homo sapiens
ggagatgccagaattgcaaatt

SEQ ID NO: 8232939 - DNA, 22 bp, Homo sapiens
ggagatgctttccagtggggat

SEQ ID NO: 8232940 - DNA, 22 bp, Homo sapiens
ggagatgctttccagtggggat

SEQ ID NO: 8232941 - DNA, 22 bp, Homo sapiens
ggagatggaatagattctgact

SEQ ID NO: 8232942 - DNA, 22 bp, Homo sapiens
ggagatggaatagattctgact

SEQ ID NO: 8232943 - DNA, 22 bp, Homo sapiens
ggagatggagtggattcagcag

SEQ ID NO: 8232944 - DNA, 22 bp, Homo sapiens
ggagcctggtcaggttggctcc

SEQ ID NO: 8232945 - DNA, 22 bp, Homo sapiens
ggagcctggtcaggttggctcc

SEQ ID NO: 8232946 - DNA, 22 bp, Homo sapiens
ggagcctggttactagagcctg

SEQ ID NO: 8232947 - DNA, 22 bp, Homo sapiens
ggagcctggttactagagcctg

SEQ ID NO: 8232948 - DNA, 22 bp, Homo sapiens
ggagcctgtgcccaagcccaga

SEQ ID NO: 8232949 - DNA, 22 bp, Homo sapiens
ggagcctgtgcccaagcccaga

SEQ ID NO: 8232950 - DNA, 22 bp, Homo sapiens
ggagaggtgagaggtacaagtt

SEQ ID NO: 8232951 - DNA, 22 bp, Homo sapiens
ggagaggtgagaggtacaagtt

SEQ ID NO: 8232952 - DNA, 22 bp, Homo sapiens
ggagaggtgcaggtcagtggca

SEQ ID NO: 8232953 - DNA, 22 bp, Homo sapiens
ggagaggtgtattcagtgggtc

SEQ ID NO: 8232954 - DNA, 22 bp, Homo sapiens
ggagaggtgtattcagtgggtc

SEQ ID NO: 8232955 - DNA, 17 bp, Homo sapiens
ggagatctggcagaggg

SEQ ID NO: 8232956 - DNA, 17 bp, Homo sapiens
ggagatctggcagaggg

SEQ ID NO: 8232957 - DNA, 22 bp, Homo sapiens
ggagatctttaggagttggact

SEQ ID NO: 8232958 - DNA, 22 bp, Homo sapiens
ggagatcttgcttgaaggcatg

SEQ ID NO: 8232959 - DNA, 22 bp, Homo sapiens
ggagagggtgtggaaagttatc

SEQ ID NO: 8232960 - DNA, 22 bp, Homo sapiens
ggagagggtaggggtcctgccc

SEQ ID NO: 8232961 - DNA, 22 bp, Homo sapiens
ggagagggtaggggtcctgccc

SEQ ID NO: 8232962 - DNA, 22 bp, Homo sapiens
ggagaggggaacttgttgcttg

SEQ ID NO: 8232963 - DNA, 22 bp, Homo sapiens
ggagaggggcaagtttatctag

SEQ ID NO: 8232964 - DNA, 22 bp, Homo sapiens
ggagaggggcaagtttatctag

SEQ ID NO: 8232965 - DNA, 22 bp, Homo sapiens
ggagaggcttggcccagcctgg

SEQ ID NO: 8232966 - DNA, 22 bp, Homo sapiens
ggagaggggaacttgttgcttg

SEQ ID NO: 8232967 - DNA, 22 bp, Homo sapiens
ggagaggggaacttgttgcttg

SEQ ID NO: 8232968 - DNA, 22 bp, Homo sapiens
ggagagggtaggggtcctgccc

SEQ ID NO: 8232969 - DNA, 23 bp, Homo sapiens
ggagaggggtgtgggcatcttta

SEQ ID NO: 8232970 - DNA, 23 bp, Homo sapiens
ggagaggggtgtgggcatcttta

SEQ ID NO: 8232971 - DNA, 23 bp, Homo sapiens
ggagaggggtgtgggcatcttta

SEQ ID NO: 8232972 - DNA, 22 bp, Homo sapiens
ggagagggggctccctgcttgg

SEQ ID NO: 8232973 - DNA, 22 bp, Homo sapiens
ggagagggggctccctgcttgg

SEQ ID NO: 8232974 - DNA, 22 bp, Homo sapiens
ggagagggggctccctgcttgg

SEQ ID NO: 8232975 - DNA, 22 bp, Homo sapiens
ggaggccaggaaggctcggaga

SEQ ID NO: 8232976 - DNA, 22 bp, Homo sapiens
ggaggccaggatgggaactcaa

SEQ ID NO: 8232977 - DNA, 22 bp, Homo sapiens
ggaggccagcctgaggctgagg

SEQ ID NO: 8232978 - DNA, 22 bp, Homo sapiens
ggaggccagcctgaggctgagg

SEQ ID NO: 8232979 - DNA, 22 bp, Homo sapiens
ggaggccagcctgaggctgagg

SEQ ID NO: 8232980 - DNA, 22 bp, Homo sapiens
ggaggccaggaagagccgccct

SEQ ID NO: 8232981 - DNA, 22 bp, Homo sapiens
ggaggccaggaagagccgccct

SEQ ID NO: 8232982 - DNA, 22 bp, Homo sapiens
ggaggccaggaagagccgccct

SEQ ID NO: 8232983 - DNA, 22 bp, Homo sapiens
ggaggccaggaagagccgccct

SEQ ID NO: 8232984 - DNA, 22 bp, Homo sapiens
ggaggccagggacccagtcagc

SEQ ID NO: 8232985 - DNA, 22 bp, Homo sapiens
ggaggccaggatgggaactcaa

SEQ ID NO: 8232986 - DNA, 22 bp, Homo sapiens
ggaggccagggacccagtcagc

SEQ ID NO: 8232987 - DNA, 22 bp, Homo sapiens
ggaggccagggtgggtggatcg

SEQ ID NO: 8232988 - DNA, 22 bp, Homo sapiens
ggaggccaggtgggagtcatct

SEQ ID NO: 8232989 - DNA, 22 bp, Homo sapiens
ggaggccagggtgggtggatcg

SEQ ID NO: 8232990 - DNA, 22 bp, Homo sapiens
ggaggccaggtgggagtcatct

SEQ ID NO: 8232991 - DNA, 22 bp, Homo sapiens
ggaggccaggtgggagtcatct

SEQ ID NO: 8232992 - DNA, 22 bp, Homo sapiens
ggaggccagtcctggccgggct

SEQ ID NO: 8232993 - DNA, 22 bp, Homo sapiens
ggaggccatgaggctctaggtg

SEQ ID NO: 8232994 - DNA, 22 bp, Homo sapiens
ggaggccatgaggctctaggtg

SEQ ID NO: 8232995 - DNA, 22 bp, Homo sapiens
ggaggccatgaggctctaggtg

SEQ ID NO: 8232996 - DNA, 22 bp, Homo sapiens
ggaggccatctggctggaggct

SEQ ID NO: 8232997 - DNA, 22 bp, Homo sapiens
ggaggccatctggctggaggct

SEQ ID NO: 8232998 - DNA, 22 bp, Homo sapiens
ggaggccatctggctggaggct

SEQ ID NO: 8232999 - DNA, 22 bp, Homo sapiens
ggaggccatctggctggaggct

SEQ ID NO: 8233000 - DNA, 22 bp, Homo sapiens
ggaggccatctggctggaggct

SEQ ID NO: 8233001 - DNA, 22 bp, Homo sapiens
ggaggccatcagggagggcatt

SEQ ID NO: 8233002 - DNA, 22 bp, Homo sapiens
ggaggccatcagggagggcatt

SEQ ID NO: 8233003 - DNA, 22 bp, Homo sapiens
ggaggccatcagggagggcatt

SEQ ID NO: 8233004 - DNA, 22 bp, Homo sapiens
ggaggccatcagggagggcatt

SEQ ID NO: 8233005 - DNA, 22 bp, Homo sapiens
ggaggccatcagggagggcatt

SEQ ID NO: 8233006 - DNA, 22 bp, Homo sapiens
ggaggccatcagggagggcatt

SEQ ID NO: 8233007 - DNA, 22 bp, Homo sapiens
ggaggccatagtttgggagtca

SEQ ID NO: 8233008 - DNA, 22 bp, Homo sapiens
ggaggccatagtttgggagtca

SEQ ID NO: 8233009 - DNA, 22 bp, Homo sapiens
ggaggccatagtttgggagtca

SEQ ID NO: 8233010 - DNA, 22 bp, Homo sapiens
ggaggccatagtttgggagtca

SEQ ID NO: 8233011 - DNA, 22 bp, Homo sapiens
ggaggccagtcctggccgggct

SEQ ID NO: 8233012 - DNA, 22 bp, Homo sapiens
ggaggccagtcctggccgggct

SEQ ID NO: 8233013 - DNA, 22 bp, Homo sapiens
ggaggaggcggcagaagttcct

SEQ ID NO: 8233014 - DNA, 22 bp, Homo sapiens
ggaggaggcaagtaccagatgc

SEQ ID NO: 8233015 - DNA, 22 bp, Homo sapiens
ggaggaggcaagtaccagatgc

SEQ ID NO: 8233016 - DNA, 22 bp, Homo sapiens
ggaggaggcaagtaccagatgc

SEQ ID NO: 8233017 - DNA, 22 bp, Homo sapiens
ggaggaggcaagtaccagatgc

SEQ ID NO: 8233018 - DNA, 22 bp, Homo sapiens
ggaggagctgctgtgggggccc

SEQ ID NO: 8233019 - DNA, 22 bp, Homo sapiens
ggaggaggcaagtaccagatgc

SEQ ID NO: 8233020 - DNA, 22 bp, Homo sapiens
ggaggcagaatagagtgtgggt

SEQ ID NO: 8233021 - DNA, 22 bp, Homo sapiens
ggaggaggcggcagaagttcct

SEQ ID NO: 8233022 - DNA, 22 bp, Homo sapiens
ggaggaggcggcagaagttcct

SEQ ID NO: 8233023 - DNA, 22 bp, Homo sapiens
ggaggcagaatagagtgtgggt

SEQ ID NO: 8233024 - DNA, 22 bp, Homo sapiens
ggaggccacggtttagcaccga

SEQ ID NO: 8233025 - DNA, 22 bp, Homo sapiens
ggaggccacggtttagcaccga

SEQ ID NO: 8233026 - DNA, 22 bp, Homo sapiens
ggaggccacctgacctgctgtt

SEQ ID NO: 8233027 - DNA, 22 bp, Homo sapiens
ggaggccacctgacctgctgtt

SEQ ID NO: 8233028 - DNA, 22 bp, Homo sapiens
ggaggccacctgacctgctgtt

SEQ ID NO: 8233029 - DNA, 22 bp, Homo sapiens
ggaggccacctgacctgctgtt

SEQ ID NO: 8233030 - DNA, 22 bp, Homo sapiens
ggaggccagaatctgtgttgga

SEQ ID NO: 8233031 - DNA, 22 bp, Homo sapiens
ggaggccagcctgaggctgagg

SEQ ID NO: 8233032 - DNA, 22 bp, Homo sapiens
ggaggccagcctgaggctgagg

SEQ ID NO: 8233033 - DNA, 22 bp, Homo sapiens
ggaggccagcctgaggctgagg

SEQ ID NO: 8233034 - DNA, 22 bp, Homo sapiens
ggaggccaccatggagtcactt

SEQ ID NO: 8233035 - DNA, 22 bp, Homo sapiens
ggaggccaccatggagtcactt

SEQ ID NO: 8233036 - DNA, 22 bp, Homo sapiens
ggaggccaccatggagtcactt

SEQ ID NO: 8233037 - DNA, 22 bp, Homo sapiens
ggaggccaccatggagtcactt

SEQ ID NO: 8233038 - DNA, 22 bp, Homo sapiens
ggaggccaattttctaactgca

SEQ ID NO: 8233039 - DNA, 22 bp, Homo sapiens
ggaggccaagtcactgacctgg

SEQ ID NO: 8233040 - DNA, 22 bp, Homo sapiens
ggaggccaagtcactgacctgg

SEQ ID NO: 8233041 - DNA, 22 bp, Homo sapiens
ggaggccaagtcactgacctgg

SEQ ID NO: 8233042 - DNA, 22 bp, Homo sapiens
ggaggccaaggtgggcggatca

SEQ ID NO: 8233043 - DNA, 22 bp, Homo sapiens
ggaggagcccactcaaagggga

SEQ ID NO: 8233044 - DNA, 22 bp, Homo sapiens
ggaggagcccactcaaagggga

SEQ ID NO: 8233045 - DNA, 22 bp, Homo sapiens
ggaggagcccactcaaagggga

SEQ ID NO: 8233046 - DNA, 22 bp, Homo sapiens
ggaggagctgctgtgggggccc

SEQ ID NO: 8233047 - DNA, 22 bp, Homo sapiens
ggaggagcatgagagggtagtg

SEQ ID NO: 8233048 - DNA, 22 bp, Homo sapiens
ggaggagcatgagagggtagtg

SEQ ID NO: 8233049 - DNA, 22 bp, Homo sapiens
ggaggagcatgagagggtagtg

SEQ ID NO: 8233050 - DNA, 22 bp, Homo sapiens
ggaggagcatgagagggtagtg

SEQ ID NO: 8233051 - DNA, 22 bp, Homo sapiens
ggaggacctgctggccctgcaa

SEQ ID NO: 8233052 - DNA, 22 bp, Homo sapiens
ggaggaccccagcagctcccca

SEQ ID NO: 8233053 - DNA, 22 bp, Homo sapiens
ggaggaccatcctggtttcacc

SEQ ID NO: 8233054 - DNA, 22 bp, Homo sapiens
ggaggacaggggctgcagcaca

SEQ ID NO: 8233055 - DNA, 22 bp, Homo sapiens
ggaggacaggggctgcagcaca

SEQ ID NO: 8233056 - DNA, 22 bp, Homo sapiens
ggaggacactggctctgccttc

SEQ ID NO: 8233057 - DNA, 22 bp, Homo sapiens
ggaggacactggctctgccttc

SEQ ID NO: 8233058 - DNA, 22 bp, Homo sapiens
ggaggaagtgcagttctactac

SEQ ID NO: 8233059 - DNA, 22 bp, Homo sapiens
ggaggaagtgcagttctactac

SEQ ID NO: 8233060 - DNA, 22 bp, Homo sapiens
ggaggaagggtagcataatgta

SEQ ID NO: 8233061 - DNA, 22 bp, Homo sapiens
ggaggaagggtagcataatgta

SEQ ID NO: 8233062 - DNA, 22 bp, Homo sapiens
ggaggaagggcccaggctttat

SEQ ID NO: 8233063 - DNA, 22 bp, Homo sapiens
ggaggaagggcccaggctttat

SEQ ID NO: 8233064 - DNA, 22 bp, Homo sapiens
ggaggaagccctcggtgcccca

SEQ ID NO: 8233065 - DNA, 22 bp, Homo sapiens
ggaggaagaggttgttctctca

SEQ ID NO: 8233066 - DNA, 22 bp, Homo sapiens
ggaggaaatgaaaggagggttt

SEQ ID NO: 8233067 - DNA, 22 bp, Homo sapiens
ggaggaaatgaaaggagggttt

SEQ ID NO: 8233068 - DNA, 22 bp, Homo sapiens
ggaggaagcacacggcttgtat

SEQ ID NO: 8233069 - DNA, 22 bp, Homo sapiens
ggaggaagcacacggcttgtat

SEQ ID NO: 8233070 - DNA, 22 bp, Homo sapiens
ggagctgcaagtgttgagagct

SEQ ID NO: 8233071 - DNA, 22 bp, Homo sapiens
ggagctgcacgctctgaagcct

SEQ ID NO: 8233072 - DNA, 22 bp, Homo sapiens
ggagctgcacgctctgaagcct

SEQ ID NO: 8233073 - DNA, 22 bp, Homo sapiens
ggagctgatgacgtcaccatgg

SEQ ID NO: 8233074 - DNA, 22 bp, Homo sapiens
ggaggaaaggctccctccctct

SEQ ID NO: 8233075 - DNA, 21 bp, Homo sapiens
ggaggaaaaaggaatgacttg

SEQ ID NO: 8233076 - DNA, 21 bp, Homo sapiens
ggaggaaaaaggaatgacttg

SEQ ID NO: 8233077 - DNA, 22 bp, Homo sapiens
ggaggaaatccttagtaaggca

SEQ ID NO: 8233078 - DNA, 22 bp, Homo sapiens
ggaggaaatccttagtaaggca

SEQ ID NO: 8233079 - DNA, 22 bp, Homo sapiens
ggagctgaggctgaggcctcac

SEQ ID NO: 8233080 - DNA, 22 bp, Homo sapiens
ggagctgaggtaacagtgagtg

SEQ ID NO: 8233081 - DNA, 22 bp, Homo sapiens
ggagctcaccttggagtctctg

SEQ ID NO: 8233082 - DNA, 22 bp, Homo sapiens
ggagctcaccttggagtctctg

SEQ ID NO: 8233083 - DNA, 22 bp, Homo sapiens
ggagctcagaagtgagtgagtt

SEQ ID NO: 8233084 - DNA, 22 bp, Homo sapiens
ggagctcagtggggggactgtg

SEQ ID NO: 8233085 - DNA, 22 bp, Homo sapiens
ggagctcctggcagtgacagag

SEQ ID NO: 8233086 - DNA, 22 bp, Homo sapiens
ggagctctatctgggagttctt

SEQ ID NO: 8233087 - DNA, 22 bp, Homo sapiens
ggagctctatctgggagttctt

SEQ ID NO: 8233088 - DNA, 17 bp, Homo sapiens
ggagctccagctactgc

SEQ ID NO: 8233089 - DNA, 22 bp, Homo sapiens
ggagctcaggcccagcaaggcc

SEQ ID NO: 8233090 - DNA, 22 bp, Homo sapiens
ggagctcataacaaggtagcca

SEQ ID NO: 8233091 - DNA, 22 bp, Homo sapiens
ggagctcataacaaggtagcca

SEQ ID NO: 8233092 - DNA, 22 bp, Homo sapiens
ggagctgagacccagtggctga

SEQ ID NO: 8233093 - DNA, 22 bp, Homo sapiens
ggagctgaaggggtgggctcag

SEQ ID NO: 8233094 - DNA, 22 bp, Homo sapiens
ggagctcttccagcttgttgct

SEQ ID NO: 8233095 - DNA, 22 bp, Homo sapiens
ggagctctgtgtctctcctgcc

SEQ ID NO: 8233096 - DNA, 22 bp, Homo sapiens
ggagctctgtgtctctcctgcc

SEQ ID NO: 8233097 - DNA, 20 bp, Homo sapiens
ggagctctgcatttatcttc

SEQ ID NO: 8233098 - DNA, 22 bp, Homo sapiens
ggagctctcctgatgtgaagat

SEQ ID NO: 8233099 - DNA, 22 bp, Homo sapiens
ggagctctctcagggggtccaa

SEQ ID NO: 8233100 - DNA, 22 bp, Homo sapiens
ggagctctcctgatgtgaagat

SEQ ID NO: 8233101 - DNA, 22 bp, Homo sapiens
ggagctctcctgatgtgaagat

SEQ ID NO: 8233102 - DNA, 22 bp, Homo sapiens
ggagctctgaggatgcattggt

SEQ ID NO: 8233103 - DNA, 18 bp, Homo sapiens
ggaagaaaaggaactcag

SEQ ID NO: 8233104 - DNA, 18 bp, Homo sapiens
ggaagaaaaggaactcag

SEQ ID NO: 8233105 - DNA, 17 bp, Homo sapiens
ggaagaaaaggatcatc

SEQ ID NO: 8233106 - DNA, 17 bp, Homo sapiens
ggaagaaaaggatcatc

SEQ ID NO: 8233107 - DNA, 17 bp, Homo sapiens
ggaagaaaaggatcatc

SEQ ID NO: 8233108 - DNA, 22 bp, Homo sapiens
ggaactgattaagtcatgagaa

SEQ ID NO: 8233109 - DNA, 22 bp, Homo sapiens
ggaactgattaagtcatgagaa

SEQ ID NO: 8233110 - DNA, 22 bp, Homo sapiens
ggaactggagaatgccctcttt

SEQ ID NO: 8233111 - DNA, 22 bp, Homo sapiens
ggaactgaggaacgaactggga

SEQ ID NO: 8233112 - DNA, 22 bp, Homo sapiens
ggaactgagcaatggcatgaaa

SEQ ID NO: 8233113 - DNA, 22 bp, Homo sapiens
ggaactgagcaatggcatgaaa

SEQ ID NO: 8233114 - DNA, 22 bp, Homo sapiens
ggaactgggttagggtctcttc

SEQ ID NO: 8233115 - DNA, 22 bp, Homo sapiens
ggaagaaaggtggacaacaggt

SEQ ID NO: 8233116 - DNA, 22 bp, Homo sapiens
ggaagaaaggtggacaacaggt

SEQ ID NO: 8233117 - DNA, 22 bp, Homo sapiens
ggaagaaaggtggacaacaggt

SEQ ID NO: 8233118 - DNA, 22 bp, Homo sapiens
ggaagaaatctggttaagagat

SEQ ID NO: 8233119 - DNA, 22 bp, Homo sapiens
ggaagaaaggtggacaacaggt

SEQ ID NO: 8233120 - DNA, 22 bp, Homo sapiens
ggaagaaagacatttattttga

SEQ ID NO: 8233121 - DNA, 22 bp, Homo sapiens
ggaagaaaatgggcaacaggtg

SEQ ID NO: 8233122 - DNA, 22 bp, Homo sapiens
ggaagaaaatgggcaacaggtg

SEQ ID NO: 8233123 - DNA, 22 bp, Homo sapiens
ggaagaaaatgggcaacaggtg

SEQ ID NO: 8233124 - DNA, 22 bp, Homo sapiens
ggaagaaaatgggcaacaggtg

SEQ ID NO: 8233125 - DNA, 18 bp, Homo sapiens
ggaaggtgatgtgaaaag

SEQ ID NO: 8233126 - DNA, 22 bp, Homo sapiens
ggaaggtgctccctggacagag

SEQ ID NO: 8233127 - DNA, 22 bp, Homo sapiens
ggaaggtgctccctggacagag

SEQ ID NO: 8233128 - DNA, 22 bp, Homo sapiens
ggaaggtgctccctggacagag

SEQ ID NO: 8233129 - DNA, 22 bp, Homo sapiens
ggaaggtgctccctggacagag

SEQ ID NO: 8233130 - DNA, 19 bp, Homo sapiens
ggaaggtgacagtggtgaa

SEQ ID NO: 8233131 - DNA, 22 bp, Homo sapiens
ggaaggtgaggtaaggtcttgt

SEQ ID NO: 8233132 - DNA, 22 bp, Homo sapiens
ggaaggtcgagctgcatctggc

SEQ ID NO: 8233133 - DNA, 22 bp, Homo sapiens
ggaaggtcgagctgcatctggc

SEQ ID NO: 8233134 - DNA, 22 bp, Homo sapiens
ggaagggtttaagcaggagagt

SEQ ID NO: 8233135 - DNA, 22 bp, Homo sapiens
ggaaggtcacagatgagggaag

SEQ ID NO: 8233136 - DNA, 22 bp, Homo sapiens
ggaaggggtgtcgcccatggat

SEQ ID NO: 8233137 - DNA, 22 bp, Homo sapiens
ggaagaaatgctcttctatgcg

SEQ ID NO: 8233138 - DNA, 22 bp, Homo sapiens
ggaagaaatgctcttctatgcg

SEQ ID NO: 8233139 - DNA, 22 bp, Homo sapiens
ggaagaaatctggttaagagat

SEQ ID NO: 8233140 - DNA, 22 bp, Homo sapiens
ggaagggagtagttggaatgca

SEQ ID NO: 8233141 - DNA, 22 bp, Homo sapiens
ggaagggagtagttggaatgca

SEQ ID NO: 8233142 - DNA, 21 bp, Homo sapiens
ggaaggggtcctcccaacagt

SEQ ID NO: 8233143 - DNA, 22 bp, Homo sapiens
ggaagggcaataaaatctcagg

SEQ ID NO: 8233144 - DNA, 22 bp, Homo sapiens
ggaagggcaaaagagatgaact

SEQ ID NO: 8233145 - DNA, 22 bp, Homo sapiens
ggaagggcaaaagagatgaact

SEQ ID NO: 8233146 - DNA, 22 bp, Homo sapiens
ggaaggggtgggtgagcctcag

SEQ ID NO: 8233147 - DNA, 22 bp, Homo sapiens
ggaaagccaggtgctctggtgt

SEQ ID NO: 8233148 - DNA, 22 bp, Homo sapiens
ggaaagccaggtgctctggtgt

SEQ ID NO: 8233149 - DNA, 22 bp, Homo sapiens
ggaactgaatgtctcggtataa

SEQ ID NO: 8233150 - DNA, 22 bp, Homo sapiens
ggaactcctgctccaagcagct

SEQ ID NO: 8233151 - DNA, 22 bp, Homo sapiens
ggaactcagtatcagactccag

SEQ ID NO: 8233152 - DNA, 22 bp, Homo sapiens
ggaactcctgctccaagcagct

SEQ ID NO: 8233153 - DNA, 22 bp, Homo sapiens
ggaaagagctaaaagggtgaga

SEQ ID NO: 8233154 - DNA, 22 bp, Homo sapiens
ggaaagagctaaaagggtgaga

SEQ ID NO: 8233155 - DNA, 22 bp, Homo sapiens
ggaaagagctaaaagggtgaga

SEQ ID NO: 8233156 - DNA, 22 bp, Homo sapiens
ggaaagagctaaaagggtgaga

SEQ ID NO: 8233157 - DNA, 22 bp, Homo sapiens
ggaaagaggatagtgggtaggt

SEQ ID NO: 8233158 - DNA, 22 bp, Homo sapiens
ggaaagaggatagtgggtaggt

SEQ ID NO: 8233159 - DNA, 22 bp, Homo sapiens
ggaaagagggacccagcttggt

SEQ ID NO: 8233160 - DNA, 22 bp, Homo sapiens
ggaaagaatagagactttatca

SEQ ID NO: 8233161 - DNA, 21 bp, Homo sapiens
ggaaagaaggcaaggctcagg

SEQ ID NO: 8233162 - DNA, 21 bp, Homo sapiens
ggaaagaaggcaaggctcagg

SEQ ID NO: 8233163 - DNA, 22 bp, Homo sapiens
ggaaagaaagtgtgaacaactt

SEQ ID NO: 8233164 - DNA, 22 bp, Homo sapiens
ggaaagaaccctggatggctgg

SEQ ID NO: 8233165 - DNA, 22 bp, Homo sapiens
ggaaagaaccctggatggctgg

SEQ ID NO: 8233166 - DNA, 22 bp, Homo sapiens
ggaaagagcccagcagtgcttg

SEQ ID NO: 8233167 - DNA, 22 bp, Homo sapiens
ggaaagagcccagcagtgcttg

SEQ ID NO: 8233168 - DNA, 23 bp, Homo sapiens
ggaaagagaggagttgtgcatag

SEQ ID NO: 8233169 - DNA, 23 bp, Homo sapiens
ggaaagagaggagttgtgcatag

SEQ ID NO: 8233170 - DNA, 19 bp, Homo sapiens
ggaaacaggggccagagga

SEQ ID NO: 8233171 - DNA, 22 bp, Homo sapiens
ggaaacattccaagagttgaaa

SEQ ID NO: 8233172 - DNA, 20 bp, Homo sapiens
ggaaacatttttatttccat

SEQ ID NO: 8233173 - DNA, 22 bp, Homo sapiens
ggaaactgtagtttgctgacat

SEQ ID NO: 8233174 - DNA, 22 bp, Homo sapiens
ggaaactgcttacactagaggg

SEQ ID NO: 8233175 - DNA, 22 bp, Homo sapiens
ggaaactgtagtttgctgacat

SEQ ID NO: 8233176 - DNA, 22 bp, Homo sapiens
ggaaactgtagtttgctgacat

SEQ ID NO: 8233177 - DNA, 18 bp, Homo sapiens
ggaaaccacagggttctg

SEQ ID NO: 8233178 - DNA, 22 bp, Homo sapiens
ggaaaccattcccgactctcct

SEQ ID NO: 8233179 - DNA, 22 bp, Homo sapiens
ggaaactaaagaggtgtttttg

SEQ ID NO: 8233180 - DNA, 22 bp, Homo sapiens
ggaaactaaatcaagctggctt

SEQ ID NO: 8233181 - DNA, 22 bp, Homo sapiens
ggaaactgcttacactagaggg

SEQ ID NO: 8233182 - DNA, 22 bp, Homo sapiens
ggaaactgagtgacactccctc

SEQ ID NO: 8233183 - DNA, 22 bp, Homo sapiens
gcttctggagtcttcagaggaa

SEQ ID NO: 8233184 - DNA, 22 bp, Homo sapiens
gcttctggcagtgcagccacca

SEQ ID NO: 8233185 - DNA, 22 bp, Homo sapiens
gcttctggcagtgcagccacca

SEQ ID NO: 8233186 - DNA, 22 bp, Homo sapiens
gcttctggggttctggcatgct

SEQ ID NO: 8233187 - DNA, 22 bp, Homo sapiens
gcttctggtagaattcaataga

SEQ ID NO: 8233188 - DNA, 22 bp, Homo sapiens
gcttctgggcacctgaacagga

SEQ ID NO: 8233189 - DNA, 22 bp, Homo sapiens
gcttctggaggagctgggctga

SEQ ID NO: 8233190 - DNA, 22 bp, Homo sapiens
ggaaaacaagagaatgatgttt

SEQ ID NO: 8233191 - DNA, 22 bp, Homo sapiens
ggaaaacaagagaatgatgttt

SEQ ID NO: 8233192 - DNA, 22 bp, Homo sapiens
ggaaaacagcgattggtatcat

SEQ ID NO: 8233193 - DNA, 22 bp, Homo sapiens
ggaaaacagcgattggtatcat

SEQ ID NO: 8233194 - DNA, 22 bp, Homo sapiens
gcttacaagatcgtgctccagt

SEQ ID NO: 8233195 - DNA, 22 bp, Homo sapiens
gcttaattctggctcagtttcc

SEQ ID NO: 8233196 - DNA, 22 bp, Homo sapiens
gcttaattctggctcagtttcc

SEQ ID NO: 8233197 - DNA, 22 bp, Homo sapiens
gctgggctggaaggccaaggca

SEQ ID NO: 8233198 - DNA, 22 bp, Homo sapiens
gctgggctgcgtcggggaagcc

SEQ ID NO: 8233199 - DNA, 22 bp, Homo sapiens
gctgggctgcgtcggggaagcc

SEQ ID NO: 8233200 - DNA, 22 bp, Homo sapiens
gctgggctgcccaacctctgac

SEQ ID NO: 8233201 - DNA, 22 bp, Homo sapiens
gctgggctgcgtcggggaagcc

SEQ ID NO: 8233202 - DNA, 22 bp, Homo sapiens
gctgggctgcgtcggggaagcc

SEQ ID NO: 8233203 - DNA, 22 bp, Homo sapiens
gctgggctgcccaacctctgac

SEQ ID NO: 8233204 - DNA, 22 bp, Homo sapiens
gctgggctgcccaacctctgac

SEQ ID NO: 8233205 - DNA, 22 bp, Homo sapiens
gctgggctgagctagacttggc

SEQ ID NO: 8233206 - DNA, 22 bp, Homo sapiens
gctgggctgagctagacttggc

SEQ ID NO: 8233207 - DNA, 22 bp, Homo sapiens
gctgggctgagctagacttggc

SEQ ID NO: 8233208 - DNA, 22 bp, Homo sapiens
gctgggctgagctagacttggc

SEQ ID NO: 8233209 - DNA, 22 bp, Homo sapiens
gcttagctgcatgcatgttctt

SEQ ID NO: 8233210 - DNA, 22 bp, Homo sapiens
gcttagtcaattataaataggc

SEQ ID NO: 8233211 - DNA, 22 bp, Homo sapiens
gcttaggatgaatgctgtagaa

SEQ ID NO: 8233212 - DNA, 22 bp, Homo sapiens
gcttaggagtttcaggctctca

SEQ ID NO: 8233213 - DNA, 22 bp, Homo sapiens
gcttattttatcctattcacta

SEQ ID NO: 8233214 - DNA, 22 bp, Homo sapiens
gcttattaggttatttcaagga

SEQ ID NO: 8233215 - DNA, 22 bp, Homo sapiens
gcttattttcaccttctctcag

SEQ ID NO: 8233216 - DNA, 22 bp, Homo sapiens
gcttagaagtacacatgccttt

SEQ ID NO: 8233217 - DNA, 22 bp, Homo sapiens
gctgggctgagaagttaagcaa

SEQ ID NO: 8233218 - DNA, 22 bp, Homo sapiens
gctgggctgagaagttaagcaa

SEQ ID NO: 8233219 - DNA, 22 bp, Homo sapiens
gctgggctgagctagacttggc

SEQ ID NO: 8233220 - DNA, 22 bp, Homo sapiens
gctgggctgagaagttaagcaa

SEQ ID NO: 8233221 - DNA, 22 bp, Homo sapiens
gctgggctctttacccctgtac

SEQ ID NO: 8233222 - DNA, 22 bp, Homo sapiens
gctgggctcttatcacctgtac

SEQ ID NO: 8233223 - DNA, 22 bp, Homo sapiens
gctgggctcttatcacctgtac

SEQ ID NO: 8233224 - DNA, 21 bp, Homo sapiens
gctgggctccagtctgccgct

SEQ ID NO: 8233225 - DNA, 21 bp, Homo sapiens
gctgggctccagtctgccgct

SEQ ID NO: 8233226 - DNA, 21 bp, Homo sapiens
gctgggctccagtctgccgct

SEQ ID NO: 8233227 - DNA, 21 bp, Homo sapiens
gctgggctccagtctgccgct

SEQ ID NO: 8233228 - DNA, 22 bp, Homo sapiens
gctgggctctgtcatgccttcc

SEQ ID NO: 8233229 - DNA, 22 bp, Homo sapiens
gctgggctctgtcatgccttcc

SEQ ID NO: 8233230 - DNA, 22 bp, Homo sapiens
gctgggctcgttcccacacgcg

SEQ ID NO: 8233231 - DNA, 22 bp, Homo sapiens
gctgggctctgtcatgccttcc

SEQ ID NO: 8233232 - DNA, 22 bp, Homo sapiens
gctgggctctgtcatgccttcc

SEQ ID NO: 8233233 - DNA, 22 bp, Homo sapiens
gctgggctccaggccagggtga

SEQ ID NO: 8233234 - DNA, 22 bp, Homo sapiens
gctgggctccaggccagggtga

SEQ ID NO: 8233235 - DNA, 22 bp, Homo sapiens
gctgggctccaccctcaactgt

SEQ ID NO: 8233236 - DNA, 22 bp, Homo sapiens
gctgggctccaccctcaactgt

SEQ ID NO: 8233237 - DNA, 22 bp, Homo sapiens
gctgggctccaggccagggtga

SEQ ID NO: 8233238 - DNA, 22 bp, Homo sapiens
gctgggctccaggccagggtga

SEQ ID NO: 8233239 - DNA, 22 bp, Homo sapiens
gctgggctcatttgtgtgtctg

SEQ ID NO: 8233240 - DNA, 22 bp, Homo sapiens
gctgggctcatttgtgtgtctg

SEQ ID NO: 8233241 - DNA, 22 bp, Homo sapiens
gctgggctcatttgtgtgtctg

SEQ ID NO: 8233242 - DNA, 22 bp, Homo sapiens
gctgggctccaccctcaactgt

SEQ ID NO: 8233243 - DNA, 22 bp, Homo sapiens
gctgggctcatttgtgtgtctg

SEQ ID NO: 8233244 - DNA, 22 bp, Homo sapiens
gctgggctccaccctcaactgt

SEQ ID NO: 8233245 - DNA, 22 bp, Homo sapiens
gctgggcatgtgaccaacagaa

SEQ ID NO: 8233246 - DNA, 22 bp, Homo sapiens
gctgggccagactttcaatgtc

SEQ ID NO: 8233247 - DNA, 22 bp, Homo sapiens
gctgggccagagcagcagcact

SEQ ID NO: 8233248 - DNA, 22 bp, Homo sapiens
gctgggctcagacctagtgaac

SEQ ID NO: 8233249 - DNA, 22 bp, Homo sapiens
gctgggctcagacctagtgaac

SEQ ID NO: 8233250 - DNA, 22 bp, Homo sapiens
gcttctgcagggtcctcgctgt

SEQ ID NO: 8233251 - DNA, 23 bp, Homo sapiens
gcttctgccatttgctagctgtg

SEQ ID NO: 8233252 - DNA, 22 bp, Homo sapiens
gcttctgcagggtcctcgctgt

SEQ ID NO: 8233253 - DNA, 23 bp, Homo sapiens
gcttctgccatttgctagctgtg

SEQ ID NO: 8233254 - DNA, 22 bp, Homo sapiens
gcttctgcagagccgtcctgag

SEQ ID NO: 8233255 - DNA, 22 bp, Homo sapiens
gcttctgcagagccgtcctgag

SEQ ID NO: 8233256 - DNA, 22 bp, Homo sapiens
gcttctgcgcacgcttcttccc

SEQ ID NO: 8233257 - DNA, 22 bp, Homo sapiens
gcttctgcgcctagcctcaggt

SEQ ID NO: 8233258 - DNA, 22 bp, Homo sapiens
gcttctgctgttgaagccacca

SEQ ID NO: 8233259 - DNA, 22 bp, Homo sapiens
gcttctgcctcttccactttgc

SEQ ID NO: 8233260 - DNA, 22 bp, Homo sapiens
gcttctgccttgcactttgtca

SEQ ID NO: 8233261 - DNA, 23 bp, Homo sapiens
gcttctgccatttgctagctgtg

SEQ ID NO: 8233262 - DNA, 22 bp, Homo sapiens
gcttctgcgcctagcctcaggt

SEQ ID NO: 8233263 - DNA, 22 bp, Homo sapiens
gcttctatccctccactgcact

SEQ ID NO: 8233264 - DNA, 23 bp, Homo sapiens
gcttctagtcaatttcaccagga

SEQ ID NO: 8233265 - DNA, 22 bp, Homo sapiens
gcttctaattttttacagaata

SEQ ID NO: 8233266 - DNA, 22 bp, Homo sapiens
gcttctaatttcctttgagatt

SEQ ID NO: 8233267 - DNA, 17 bp, Homo sapiens
gcttcctgtgctgggga

SEQ ID NO: 8233268 - DNA, 17 bp, Homo sapiens
gcttcctgtgctgggga

SEQ ID NO: 8233269 - DNA, 22 bp, Homo sapiens
gcttcctgtccaggccccacat

SEQ ID NO: 8233270 - DNA, 22 bp, Homo sapiens
gcttcctgtccctcagccatga

SEQ ID NO: 8233271 - DNA, 22 bp, Homo sapiens
gcttcctgtaggcaggtccaag

SEQ ID NO: 8233272 - DNA, 22 bp, Homo sapiens
gcttcctgtaggcaggtccaag

SEQ ID NO: 8233273 - DNA, 22 bp, Homo sapiens
gcttcctgtaggcaggtccaag

SEQ ID NO: 8233274 - DNA, 22 bp, Homo sapiens
gcttcctgtaggcaggtccaag

SEQ ID NO: 8233275 - DNA, 22 bp, Homo sapiens
gcttccttccttacattggtgg

SEQ ID NO: 8233276 - DNA, 22 bp, Homo sapiens
gcttccttctaccacatcatgc

SEQ ID NO: 8233277 - DNA, 22 bp, Homo sapiens
gcttccttattgttgccatagt

SEQ ID NO: 8233278 - DNA, 17 bp, Homo sapiens
gcttcctgtgctgggga

SEQ ID NO: 8233279 - DNA, 22 bp, Homo sapiens
gcttccttgggaaaattagatg

SEQ ID NO: 8233280 - DNA, 22 bp, Homo sapiens
gcttcagattcttttcatgtct

SEQ ID NO: 8233281 - DNA, 22 bp, Homo sapiens
gcttcagacctgaaaggaaaaa

SEQ ID NO: 8233282 - DNA, 22 bp, Homo sapiens
gcttcagactggagcagaggaa

SEQ ID NO: 8233283 - DNA, 22 bp, Homo sapiens
gcttcagactgtgcttctgttg

SEQ ID NO: 8233284 - DNA, 22 bp, Homo sapiens
gcttcagattcctcttctgtaa

SEQ ID NO: 8233285 - DNA, 22 bp, Homo sapiens
gcttcagaagttgggctctgac

SEQ ID NO: 8233286 - DNA, 22 bp, Homo sapiens
gcttcagaagttgggctctgac

SEQ ID NO: 8233287 - DNA, 22 bp, Homo sapiens
gcttattttatcctattcacta

SEQ ID NO: 8233288 - DNA, 22 bp, Homo sapiens
gcttcatgggtgtgcaacctgt

SEQ ID NO: 8233289 - DNA, 22 bp, Homo sapiens
gcttcattaatagaattagtat

SEQ ID NO: 8233290 - DNA, 22 bp, Homo sapiens
gcttcattaactcagagttttg

SEQ ID NO: 8233291 - DNA, 22 bp, Homo sapiens
gcttcagcctcacactgatatc

SEQ ID NO: 8233292 - DNA, 22 bp, Homo sapiens
gcttcagctttgtctccttggg

SEQ ID NO: 8233293 - DNA, 22 bp, Homo sapiens
gcttcaggaggtcggtctcctt

SEQ ID NO: 8233294 - DNA, 22 bp, Homo sapiens
gcttcaggaggtcggtctcctt

SEQ ID NO: 8233295 - DNA, 22 bp, Homo sapiens
gcttcaggctgaattcctccta

SEQ ID NO: 8233296 - DNA, 20 bp, Homo sapiens
gcttcagtttcctcactggt

SEQ ID NO: 8233297 - DNA, 22 bp, Homo sapiens
gcttcattactgacagtctgtg

SEQ ID NO: 8233298 - DNA, 22 bp, Homo sapiens
gcttcattactgacagtctgtg

SEQ ID NO: 8233299 - DNA, 22 bp, Homo sapiens
gcttcatttctctctgtagacc

SEQ ID NO: 8233300 - DNA, 22 bp, Homo sapiens
gcttcatttgagaacctctgtg

SEQ ID NO: 8233301 - DNA, 22 bp, Homo sapiens
gcttcatttgagaacctctgtg

SEQ ID NO: 8233302 - DNA, 22 bp, Homo sapiens
gcttcctggaacaactgttgct

SEQ ID NO: 8233303 - DNA, 22 bp, Homo sapiens
gcttcctggagggagagagctg

SEQ ID NO: 8233304 - DNA, 22 bp, Homo sapiens
gcttcctggagggagagagctg

SEQ ID NO: 8233305 - DNA, 22 bp, Homo sapiens
gcttcctgggacaggctatgtg

SEQ ID NO: 8233306 - DNA, 22 bp, Homo sapiens
gcttcctgggacaggctatgtg

SEQ ID NO: 8233307 - DNA, 22 bp, Homo sapiens
gcttcctgggacaggctatgtg

SEQ ID NO: 8233308 - DNA, 22 bp, Homo sapiens
ggaggctgagaggtcgcagtgg

SEQ ID NO: 8233309 - DNA, 22 bp, Homo sapiens
ggaggctcttgagaggggagta

SEQ ID NO: 8233310 - DNA, 22 bp, Homo sapiens
ggaggctcttgagaggggagta

SEQ ID NO: 8233311 - DNA, 22 bp, Homo sapiens
ggaggctgagaagtccaagatc

SEQ ID NO: 8233312 - DNA, 22 bp, Homo sapiens
ggaggctcgctggtcgcacagc

SEQ ID NO: 8233313 - DNA, 22 bp, Homo sapiens
ggaggctctcctggccttgtct

SEQ ID NO: 8233314 - DNA, 19 bp, Homo sapiens
ggaggcttcttggggtcgg

SEQ ID NO: 8233315 - DNA, 22 bp, Homo sapiens
ggaggctgctgcctcacgtggg

SEQ ID NO: 8233316 - DNA, 22 bp, Homo sapiens
ggaggctgctgcctcacgtggg

SEQ ID NO: 8233317 - DNA, 22 bp, Homo sapiens
ggaggctgctgcctcacgtggg

SEQ ID NO: 8233318 - DNA, 22 bp, Homo sapiens
ggaggctgctgcctcacgtggg

SEQ ID NO: 8233319 - DNA, 22 bp, Homo sapiens
ggaggctgctgcctcacgtggg

SEQ ID NO: 8233320 - DNA, 22 bp, Homo sapiens
ggaggctgctgcctcacgtggg

SEQ ID NO: 8233321 - DNA, 22 bp, Homo sapiens
ggaggctgaggcccctcacagg

SEQ ID NO: 8233322 - DNA, 22 bp, Homo sapiens
ggaggctgaggcaggcggatca

SEQ ID NO: 8233323 - DNA, 22 bp, Homo sapiens
ggaggctgaggcccctcacagg

SEQ ID NO: 8233324 - DNA, 22 bp, Homo sapiens
ggaggctgaggcccctcacagg

SEQ ID NO: 8233325 - DNA, 22 bp, Homo sapiens
ggaggctgaggcccctcacagg

SEQ ID NO: 8233326 - DNA, 22 bp, Homo sapiens
ggaggctgagaggtcgcagtgg

SEQ ID NO: 8233327 - DNA, 22 bp, Homo sapiens
ggaggctgagaggtcgcagtgg

SEQ ID NO: 8233328 - DNA, 22 bp, Homo sapiens
ggaggctgagaggtcgcagtgg

SEQ ID NO: 8233329 - DNA, 22 bp, Homo sapiens
ggaggctgaggcaggcggatca

SEQ ID NO: 8233330 - DNA, 22 bp, Homo sapiens
ggaggctgaggcaggcggatca

SEQ ID NO: 8233331 - DNA, 22 bp, Homo sapiens
ggaggctgaggcaggcggatca

SEQ ID NO: 8233332 - DNA, 22 bp, Homo sapiens
ggaggcggaggttgcagtgagc

SEQ ID NO: 8233333 - DNA, 22 bp, Homo sapiens
ggaggccttgaggccaggagct

SEQ ID NO: 8233334 - DNA, 22 bp, Homo sapiens
ggaggcggaggttgcagtgagc

SEQ ID NO: 8233335 - DNA, 22 bp, Homo sapiens
ggaggccttgaggccaggagct

SEQ ID NO: 8233336 - DNA, 22 bp, Homo sapiens
ggaggcctggacttcctgatgg

SEQ ID NO: 8233337 - DNA, 22 bp, Homo sapiens
ggaggcccagaaggaagcccag

SEQ ID NO: 8233338 - DNA, 22 bp, Homo sapiens
ggaggcccagaaggaagcccag

SEQ ID NO: 8233339 - DNA, 22 bp, Homo sapiens
ggaggccatgggcagaatcttt

SEQ ID NO: 8233340 - DNA, 22 bp, Homo sapiens
ggaggccatgggcagaatcttt

SEQ ID NO: 8233341 - DNA, 22 bp, Homo sapiens
ggaggcctagccagctccagtt

SEQ ID NO: 8233342 - DNA, 22 bp, Homo sapiens
ggaggctcagtgaggaaatgga

SEQ ID NO: 8233343 - DNA, 22 bp, Homo sapiens
ggaggctccatgagctcctgca

SEQ ID NO: 8233344 - DNA, 22 bp, Homo sapiens
ggaggctcagtgaggaaatgga

SEQ ID NO: 8233345 - DNA, 22 bp, Homo sapiens
ggaggcggaggttgcagtgagc

SEQ ID NO: 8233346 - DNA, 22 bp, Homo sapiens
ggaggcggaggttgcagtgagt

SEQ ID NO: 8233347 - DNA, 22 bp, Homo sapiens
ggaggcggaggttgcagtgagt

SEQ ID NO: 8233348 - DNA, 22 bp, Homo sapiens
ggaggcggaggttgcagtgagt

SEQ ID NO: 8233349 - DNA, 22 bp, Homo sapiens
ggaggcggaggttgcagtgagt

SEQ ID NO: 8233350 - DNA, 22 bp, Homo sapiens
ggagggctgagactggggtctg

SEQ ID NO: 8233351 - DNA, 22 bp, Homo sapiens
ggagggctgccacccgctcacg

SEQ ID NO: 8233352 - DNA, 22 bp, Homo sapiens
ggagggctgccaggtggagcgg

SEQ ID NO: 8233353 - DNA, 22 bp, Homo sapiens
ggagggctgagactggggtctg

SEQ ID NO: 8233354 - DNA, 22 bp, Homo sapiens
ggagggctgagactggggtctg

SEQ ID NO: 8233355 - DNA, 22 bp, Homo sapiens
ggagggctgagactggggtctg

SEQ ID NO: 8233356 - DNA, 22 bp, Homo sapiens
ggagggctgagactggggtctg

SEQ ID NO: 8233357 - DNA, 22 bp, Homo sapiens
ggagggctcgtcatccaccact

SEQ ID NO: 8233358 - DNA, 22 bp, Homo sapiens
ggagggctccctgggagtggat

SEQ ID NO: 8233359 - DNA, 22 bp, Homo sapiens
ggagggctccctgggagtggat

SEQ ID NO: 8233360 - DNA, 22 bp, Homo sapiens
ggagggctccctgggagtggat

SEQ ID NO: 8233361 - DNA, 22 bp, Homo sapiens
ggagggctcaattgactcctga

SEQ ID NO: 8233362 - DNA, 22 bp, Homo sapiens
ggagggctccctgggagtggat

SEQ ID NO: 8233363 - DNA, 22 bp, Homo sapiens
ggagggctcaattgactcctga

SEQ ID NO: 8233364 - DNA, 22 bp, Homo sapiens
ggagggccctgggtgcagctct

SEQ ID NO: 8233365 - DNA, 22 bp, Homo sapiens
ggagggctcaattgactcctga

SEQ ID NO: 8233366 - DNA, 22 bp, Homo sapiens
ggagggctcaattgactcctga

SEQ ID NO: 8233367 - DNA, 22 bp, Homo sapiens
ggagggctgccaggtggagcgg

SEQ ID NO: 8233368 - DNA, 22 bp, Homo sapiens
ggagggctgccaggtggagcgg

SEQ ID NO: 8233369 - DNA, 22 bp, Homo sapiens
ggagggctgccaggtggagcgg

SEQ ID NO: 8233370 - DNA, 22 bp, Homo sapiens
ggagggctgccaggtggagcgg

SEQ ID NO: 8233371 - DNA, 22 bp, Homo sapiens
ggagggctgccaggtggagcgg

SEQ ID NO: 8233372 - DNA, 23 bp, Homo sapiens
ggagggcttcatcagacccccag

SEQ ID NO: 8233373 - DNA, 22 bp, Homo sapiens
ggagggctgtagaggagacctg

SEQ ID NO: 8233374 - DNA, 18 bp, Homo sapiens
ggagggctttggggactg

SEQ ID NO: 8233375 - DNA, 18 bp, Homo sapiens
ggagggctttggggactg

SEQ ID NO: 8233376 - DNA, 18 bp, Homo sapiens
ggagggctttggggactg

SEQ ID NO: 8233377 - DNA, 22 bp, Homo sapiens
ggaggggaactaatcccgtgac

SEQ ID NO: 8233378 - DNA, 22 bp, Homo sapiens
ggagggcccctccagtgggcag

SEQ ID NO: 8233379 - DNA, 22 bp, Homo sapiens
ggagggcccctccagtgggcag

SEQ ID NO: 8233380 - DNA, 22 bp, Homo sapiens
ggagggccatcttgggtgtgat

SEQ ID NO: 8233381 - DNA, 22 bp, Homo sapiens
ggagggccatcttgggtgtgat

SEQ ID NO: 8233382 - DNA, 22 bp, Homo sapiens
ggagggcccctccagtgggcag

SEQ ID NO: 8233383 - DNA, 22 bp, Homo sapiens
ggagggcatcaatcaggcctgg

SEQ ID NO: 8233384 - DNA, 20 bp, Homo sapiens
ggagggcagctgagagttgg

SEQ ID NO: 8233385 - DNA, 20 bp, Homo sapiens
ggagggcagctgagagttgg

SEQ ID NO: 8233386 - DNA, 20 bp, Homo sapiens
ggagggcagctgagagttgg

SEQ ID NO: 8233387 - DNA, 21 bp, Homo sapiens
ggagggcagcccagactggct

SEQ ID NO: 8233388 - DNA, 21 bp, Homo sapiens
ggagggcagcccagactggct

SEQ ID NO: 8233389 - DNA, 21 bp, Homo sapiens
ggagggcagcccagactggct

SEQ ID NO: 8233390 - DNA, 21 bp, Homo sapiens
ggagggcagcccagactggct

SEQ ID NO: 8233391 - DNA, 21 bp, Homo sapiens
ggagggcagcccagactggct

SEQ ID NO: 8233392 - DNA, 22 bp, Homo sapiens
ggagggagagtgaccctaccaa

SEQ ID NO: 8233393 - DNA, 22 bp, Homo sapiens
ggagggcacaggaccagaaatc

SEQ ID NO: 8233394 - DNA, 22 bp, Homo sapiens
ggagggagagtgaccctaccaa

SEQ ID NO: 8233395 - DNA, 22 bp, Homo sapiens
ggagggacccactctagaggtg

SEQ ID NO: 8233396 - DNA, 22 bp, Homo sapiens
ggagggacccactctagaggtg

SEQ ID NO: 8233397 - DNA, 22 bp, Homo sapiens
ggagggacccactctagaggtg

SEQ ID NO: 8233398 - DNA, 22 bp, Homo sapiens
ggagggaaccttggctggattg

SEQ ID NO: 8233399 - DNA, 22 bp, Homo sapiens
ggagggaaccttggctggattg

SEQ ID NO: 8233400 - DNA, 22 bp, Homo sapiens
ggagggaagtgagttctcagct

SEQ ID NO: 8233401 - DNA, 22 bp, Homo sapiens
ggagggaatgtctagcattctt

SEQ ID NO: 8233402 - DNA, 22 bp, Homo sapiens
ggagggaatgtctagcattctt

SEQ ID NO: 8233403 - DNA, 22 bp, Homo sapiens
ggagggaatgtctagcattctt

SEQ ID NO: 8233404 - DNA, 22 bp, Homo sapiens
ggaggtgggagcctccagtggt

SEQ ID NO: 8233405 - DNA, 22 bp, Homo sapiens
ggaggtgggattaggacctaaa

SEQ ID NO: 8233406 - DNA, 22 bp, Homo sapiens
ggaggtgggagacataggcggc

SEQ ID NO: 8233407 - DNA, 22 bp, Homo sapiens
ggaggtggcctgaaaatgtggc

SEQ ID NO: 8233408 - DNA, 22 bp, Homo sapiens
ggaggtggcctgaaaatgtggc

SEQ ID NO: 8233409 - DNA, 22 bp, Homo sapiens
ggaggtggtggcagtgacaatt

SEQ ID NO: 8233410 - DNA, 22 bp, Homo sapiens
ggaggtggtggcagtgacaatt

SEQ ID NO: 8233411 - DNA, 22 bp, Homo sapiens
ggagtagctgcattccgagcac

SEQ ID NO: 8233412 - DNA, 22 bp, Homo sapiens
ggagtagctgcattccgagcac

SEQ ID NO: 8233413 - DNA, 22 bp, Homo sapiens
ggaggtgggctaaggactctct

SEQ ID NO: 8233414 - DNA, 22 bp, Homo sapiens
ggaggtgggctaaggactctct

SEQ ID NO: 8233415 - DNA, 22 bp, Homo sapiens
ggaggtgggctaaggactctct

SEQ ID NO: 8233416 - DNA, 22 bp, Homo sapiens
ggaggtggcagagggacattct

SEQ ID NO: 8233417 - DNA, 22 bp, Homo sapiens
ggaggtggcagagggacattct

SEQ ID NO: 8233418 - DNA, 22 bp, Homo sapiens
ggaggtggcagagggacattct

SEQ ID NO: 8233419 - DNA, 22 bp, Homo sapiens
ggaggtggaggttgcagtgagc

SEQ ID NO: 8233420 - DNA, 22 bp, Homo sapiens
ggaggtggaggttgcagtgagc

SEQ ID NO: 8233421 - DNA, 22 bp, Homo sapiens
ggaggtggaggttgcagtgagc

SEQ ID NO: 8233422 - DNA, 22 bp, Homo sapiens
ggaggtggaggttgcagtgagc

SEQ ID NO: 8233423 - DNA, 22 bp, Homo sapiens
ggaggtcataagtgtatagatg

SEQ ID NO: 8233424 - DNA, 22 bp, Homo sapiens
ggaggtcatagctgtgcaggta

SEQ ID NO: 8233425 - DNA, 22 bp, Homo sapiens
ggaggtcatagctgtgcaggta

SEQ ID NO: 8233426 - DNA, 22 bp, Homo sapiens
ggaggtcaaatggagggctggg

SEQ ID NO: 8233427 - DNA, 22 bp, Homo sapiens
ggaggtcacgactgggatgcct

SEQ ID NO: 8233428 - DNA, 22 bp, Homo sapiens
ggaggtcatagctgtgcaggta

SEQ ID NO: 8233429 - DNA, 20 bp, Homo sapiens
ggagggtggaagaaagcaag

SEQ ID NO: 8233430 - DNA, 20 bp, Homo sapiens
ggagggtggaagaaagcaag

SEQ ID NO: 8233431 - DNA, 20 bp, Homo sapiens
ggagggtggaagaaagcaag

SEQ ID NO: 8233432 - DNA, 22 bp, Homo sapiens
ggagggtggcagcgtcctgggc

SEQ ID NO: 8233433 - DNA, 22 bp, Homo sapiens
ggagggtggcagcgtcctgggc

SEQ ID NO: 8233434 - DNA, 22 bp, Homo sapiens
ggagggtggcagcgtcctgggc

SEQ ID NO: 8233435 - DNA, 22 bp, Homo sapiens
ggagggtggcagcgtcctgggc

SEQ ID NO: 8233436 - DNA, 22 bp, Homo sapiens
ggagggtggcagcgtcctgggc

SEQ ID NO: 8233437 - DNA, 22 bp, Homo sapiens
ggaggtcaaatggagggctggg

SEQ ID NO: 8233438 - DNA, 22 bp, Homo sapiens
ggaggtcaaatggagggctggg

SEQ ID NO: 8233439 - DNA, 20 bp, Homo sapiens
ggaggtcaaatgatgagaag

SEQ ID NO: 8233440 - DNA, 22 bp, Homo sapiens
ggagggggaaactttggctgcc

SEQ ID NO: 8233441 - DNA, 22 bp, Homo sapiens
ggagggggaaactttggctgcc

SEQ ID NO: 8233442 - DNA, 22 bp, Homo sapiens
ggagggggaaactttggctgcc

SEQ ID NO: 8233443 - DNA, 22 bp, Homo sapiens
ggagggggaaactttggctgcc

SEQ ID NO: 8233444 - DNA, 22 bp, Homo sapiens
ggagggggaagaagctaaagac

SEQ ID NO: 8233445 - DNA, 22 bp, Homo sapiens
ggagggggaagaagctaaagac

SEQ ID NO: 8233446 - DNA, 22 bp, Homo sapiens
ggagggggaattcagccccagc

SEQ ID NO: 8233447 - DNA, 22 bp, Homo sapiens
ggagggggaattcagccccagc

SEQ ID NO: 8233448 - DNA, 22 bp, Homo sapiens
ggagggggaattcagccccagc

SEQ ID NO: 8233449 - DNA, 22 bp, Homo sapiens
ggaggggaggattaatgacaaa

SEQ ID NO: 8233450 - DNA, 22 bp, Homo sapiens
ggaggggagatgtttgggctca

SEQ ID NO: 8233451 - DNA, 22 bp, Homo sapiens
ggaggggagatgtttgggctca

SEQ ID NO: 8233452 - DNA, 22 bp, Homo sapiens
ggaggggagatgtttgggctca

SEQ ID NO: 8233453 - DNA, 22 bp, Homo sapiens
ggaggggagatgtttgggctca

SEQ ID NO: 8233454 - DNA, 22 bp, Homo sapiens
ggaggggagatgtttgggctca

SEQ ID NO: 8233455 - DNA, 22 bp, Homo sapiens
ggaggggagtctcccaaagccg

SEQ ID NO: 8233456 - DNA, 22 bp, Homo sapiens
ggaggggaggtccagctgatct

SEQ ID NO: 8233457 - DNA, 22 bp, Homo sapiens
ggaggggaggtccagctgatct

SEQ ID NO: 8233458 - DNA, 22 bp, Homo sapiens
ggaggggaggtccagctgatct

SEQ ID NO: 8233459 - DNA, 22 bp, Homo sapiens
ggaggggaggtccagctgatct

SEQ ID NO: 8233460 - DNA, 22 bp, Homo sapiens
ggaggggaggtccagctgatct

SEQ ID NO: 8233461 - DNA, 22 bp, Homo sapiens
ggagggtgcttaagttgtgttt

SEQ ID NO: 8233462 - DNA, 22 bp, Homo sapiens
ggagggtgcttaagttgtgttt

SEQ ID NO: 8233463 - DNA, 22 bp, Homo sapiens
ggagggtgcattttaccctgtg

SEQ ID NO: 8233464 - DNA, 22 bp, Homo sapiens
ggagggtgcattttaccctgtg

SEQ ID NO: 8233465 - DNA, 22 bp, Homo sapiens
ggagggtgcattttaccctgtg

SEQ ID NO: 8233466 - DNA, 22 bp, Homo sapiens
ggagggtccccagcagcatgaa

SEQ ID NO: 8233467 - DNA, 22 bp, Homo sapiens
ggaggggtggtcgcgaagagca

SEQ ID NO: 8233468 - DNA, 22 bp, Homo sapiens
ggaggggtggtcgcgaagagca

SEQ ID NO: 8233469 - DNA, 22 bp, Homo sapiens
ggagggtccactgtgaggcaga

SEQ ID NO: 8233470 - DNA, 22 bp, Homo sapiens
ggaggggtggtcacctggcagg

SEQ ID NO: 8233471 - DNA, 22 bp, Homo sapiens
ggaggggtggtcacctggcagg

SEQ ID NO: 8233472 - DNA, 22 bp, Homo sapiens
ggaggggtggtcacctggcagg

SEQ ID NO: 8233473 - DNA, 22 bp, Homo sapiens
ggaggggtggaaggagtgcctg

SEQ ID NO: 8233474 - DNA, 22 bp, Homo sapiens
ggaggggtggaaggagtgcctg

SEQ ID NO: 8233475 - DNA, 22 bp, Homo sapiens
ggaggggtggaaggagtgcctg

SEQ ID NO: 8233476 - DNA, 22 bp, Homo sapiens
ggaggggtgagaatggctgcct

SEQ ID NO: 8233477 - DNA, 22 bp, Homo sapiens
ggaggggtgagaatggctgcct

SEQ ID NO: 8233478 - DNA, 22 bp, Homo sapiens
ggaggggtgagaatggctgcct

SEQ ID NO: 8233479 - DNA, 22 bp, Homo sapiens
ggaggggtgagaatggctgcct

SEQ ID NO: 8233480 - DNA, 22 bp, Homo sapiens
ggaggggtgctcagctgtcacg

SEQ ID NO: 8233481 - DNA, 22 bp, Homo sapiens
ggaggggtgctcagctgtcacg

SEQ ID NO: 8233482 - DNA, 22 bp, Homo sapiens
ggaggggtctctagcgaggaga

SEQ ID NO: 8233483 - DNA, 22 bp, Homo sapiens
ggaggggtctctagcgaggaga

SEQ ID NO: 8233484 - DNA, 22 bp, Homo sapiens
ggaggggtctctagcgaggaga

SEQ ID NO: 8233485 - DNA, 22 bp, Homo sapiens
ggaggggtctctagcgaggaga

SEQ ID NO: 8233486 - DNA, 22 bp, Homo sapiens
ggaggggtctctagcgaggaga

SEQ ID NO: 8233487 - DNA, 22 bp, Homo sapiens
ggagggggactgacactgattt

SEQ ID NO: 8233488 - DNA, 22 bp, Homo sapiens
ggagggggactgacactgattt

SEQ ID NO: 8233489 - DNA, 22 bp, Homo sapiens
ggcaggctccagagccctctcc

SEQ ID NO: 8233490 - DNA, 22 bp, Homo sapiens
ggcaggctccaagcatcctatg

SEQ ID NO: 8233491 - DNA, 22 bp, Homo sapiens
ggcaggctcagcagccaaggag

SEQ ID NO: 8233492 - DNA, 22 bp, Homo sapiens
ggcaggctcttggccttatgag

SEQ ID NO: 8233493 - DNA, 22 bp, Homo sapiens
ggcaggctgcttgggtcatgtc

SEQ ID NO: 8233494 - DNA, 22 bp, Homo sapiens
ggcaggctgcttgggtcatgtc

SEQ ID NO: 8233495 - DNA, 22 bp, Homo sapiens
ggcaggctgcttgggtcatgtc

SEQ ID NO: 8233496 - DNA, 22 bp, Homo sapiens
ggcaggctgcttgggtcatgtc

SEQ ID NO: 8233497 - DNA, 22 bp, Homo sapiens
ggcaggctgcttgggtcatgtc

SEQ ID NO: 8233498 - DNA, 22 bp, Homo sapiens
ggcaggctcagcagccaaggag

SEQ ID NO: 8233499 - DNA, 22 bp, Homo sapiens
ggcaggctagcactgatgtcct

SEQ ID NO: 8233500 - DNA, 22 bp, Homo sapiens
ggcaggctagcactgatgtcct

SEQ ID NO: 8233501 - DNA, 22 bp, Homo sapiens
ggcaggcgtggtggcctcagaa

SEQ ID NO: 8233502 - DNA, 22 bp, Homo sapiens
ggcaggcgtggtggcctcagaa

SEQ ID NO: 8233503 - DNA, 22 bp, Homo sapiens
ggcaggcctgagaggcagggct

SEQ ID NO: 8233504 - DNA, 22 bp, Homo sapiens
ggcaggcctgagaggcagggct

SEQ ID NO: 8233505 - DNA, 22 bp, Homo sapiens
ggcaggcctgagaggcagggct

SEQ ID NO: 8233506 - DNA, 22 bp, Homo sapiens
ggcaggcctgagaggcagggct

SEQ ID NO: 8233507 - DNA, 22 bp, Homo sapiens
ggcaggcctgagaggcagggct

SEQ ID NO: 8233508 - DNA, 22 bp, Homo sapiens
ggcaggcaggagcgtgcttggg

SEQ ID NO: 8233509 - DNA, 22 bp, Homo sapiens
ggcaggcagcctccatccacag

SEQ ID NO: 8233510 - DNA, 22 bp, Homo sapiens
ggcaggcaggagcgtgcttggg

SEQ ID NO: 8233511 - DNA, 22 bp, Homo sapiens
ggcaggcaggagcgtgcttggg

SEQ ID NO: 8233512 - DNA, 22 bp, Homo sapiens
ggcaggcagcctccatccacag

SEQ ID NO: 8233513 - DNA, 22 bp, Homo sapiens
ggcaggcagcctccatccacag

SEQ ID NO: 8233514 - DNA, 22 bp, Homo sapiens
ggcaggcagcctccatccacag

SEQ ID NO: 8233515 - DNA, 22 bp, Homo sapiens
ggcaggcattgcaacatgtaca

SEQ ID NO: 8233516 - DNA, 22 bp, Homo sapiens
ggcaggcattagagattcccag

SEQ ID NO: 8233517 - DNA, 22 bp, Homo sapiens
ggcaggtgagttcattatctgc

SEQ ID NO: 8233518 - DNA, 22 bp, Homo sapiens
ggcaggtgagttcattatctgc

SEQ ID NO: 8233519 - DNA, 22 bp, Homo sapiens
ggcaggtgaggcatgtgcctgg

SEQ ID NO: 8233520 - DNA, 22 bp, Homo sapiens
ggcaggtgaggcatgtgcctgg

SEQ ID NO: 8233521 - DNA, 22 bp, Homo sapiens
ggcaggtgaggcatgtgcctgg

SEQ ID NO: 8233522 - DNA, 22 bp, Homo sapiens
ggcaggtgaggcatgtgcctgg

SEQ ID NO: 8233523 - DNA, 22 bp, Homo sapiens
ggcaggtgaggcatgtgcctgg

SEQ ID NO: 8233524 - DNA, 22 bp, Homo sapiens
ggcaggctgggtgtcatggagt

SEQ ID NO: 8233525 - DNA, 22 bp, Homo sapiens
ggcaggctgggtgtcatggagt

SEQ ID NO: 8233526 - DNA, 22 bp, Homo sapiens
ggcaggctgggtgtcatggagt

SEQ ID NO: 8233527 - DNA, 22 bp, Homo sapiens
ggcaggctgggagtcatcagag

SEQ ID NO: 8233528 - DNA, 22 bp, Homo sapiens
ggcaggctgcttgggtcatgtc

SEQ ID NO: 8233529 - DNA, 22 bp, Homo sapiens
ggcaggctgcttgggtcatgtc

SEQ ID NO: 8233530 - DNA, 17 bp, Homo sapiens
ggcaggtgcggggccgc

SEQ ID NO: 8233531 - DNA, 17 bp, Homo sapiens
ggcaggtgcggggccgc

SEQ ID NO: 8233532 - DNA, 17 bp, Homo sapiens
ggcaggtgcggggccgc

SEQ ID NO: 8233533 - DNA, 17 bp, Homo sapiens
ggcaggtgcggggccgc

SEQ ID NO: 8233534 - DNA, 22 bp, Homo sapiens
ggcaggtgctaagagaggtaaa

SEQ ID NO: 8233535 - DNA, 22 bp, Homo sapiens
ggcaggtgctaagagaggtaaa

SEQ ID NO: 8233536 - DNA, 17 bp, Homo sapiens
ggcaggtgcggggccgc

SEQ ID NO: 8233537 - DNA, 17 bp, Homo sapiens
ggcaggtgcggggccgc

SEQ ID NO: 8233538 - DNA, 17 bp, Homo sapiens
ggcaggtgcggggccgc

SEQ ID NO: 8233539 - DNA, 22 bp, Homo sapiens
ggcaggtgcgcatgttgcatta

SEQ ID NO: 8233540 - DNA, 22 bp, Homo sapiens
ggcaggtgcgcatgttgcatta

SEQ ID NO: 8233541 - DNA, 20 bp, Homo sapiens
ggcaggtgctcgcttggtct

SEQ ID NO: 8233542 - DNA, 20 bp, Homo sapiens
ggcaggtgctcgcttggtct

SEQ ID NO: 8233543 - DNA, 20 bp, Homo sapiens
ggcaggtgctcgcttggtct

SEQ ID NO: 8233544 - DNA, 20 bp, Homo sapiens
ggcaggtgctcgcttggtct

SEQ ID NO: 8233545 - DNA, 20 bp, Homo sapiens
ggcaggtgctcgcttggtct

SEQ ID NO: 8233546 - DNA, 22 bp, Homo sapiens
ggcaggtgctctgtgggcctgg

SEQ ID NO: 8233547 - DNA, 22 bp, Homo sapiens
ggcaggtgctctgtgggcctgg

SEQ ID NO: 8233548 - DNA, 20 bp, Homo sapiens
ggcaggtgctcgcttggtct

SEQ ID NO: 8233549 - DNA, 20 bp, Homo sapiens
ggcaggtgctcgcttggtct

SEQ ID NO: 8233550 - DNA, 22 bp, Homo sapiens
ggcaggtgctcaaaaatatttg

SEQ ID NO: 8233551 - DNA, 22 bp, Homo sapiens
ggcaggtgctcaaaaatatttg

SEQ ID NO: 8233552 - DNA, 22 bp, Homo sapiens
ggcaggtgctaagagaggtaaa

SEQ ID NO: 8233553 - DNA, 22 bp, Homo sapiens
ggcaggtgctaagagaggtaaa

SEQ ID NO: 8233554 - DNA, 22 bp, Homo sapiens
ggcaggtgctaagagaggtaaa

SEQ ID NO: 8233555 - DNA, 22 bp, Homo sapiens
ggcaggtgctaagagaggtaaa

SEQ ID NO: 8233556 - DNA, 22 bp, Homo sapiens
ggcagctgggtcacaccgatct

SEQ ID NO: 8233557 - DNA, 22 bp, Homo sapiens
ggcagctggggcagtgccctgt

SEQ ID NO: 8233558 - DNA, 22 bp, Homo sapiens
ggcagctggggcagtgccctgt

SEQ ID NO: 8233559 - DNA, 22 bp, Homo sapiens
ggcagctggggcagtgccctgt

SEQ ID NO: 8233560 - DNA, 22 bp, Homo sapiens
ggcagctggggcagtgccctgt

SEQ ID NO: 8233561 - DNA, 23 bp, Homo sapiens
ggcagctgggcagcactcatggg

SEQ ID NO: 8233562 - DNA, 22 bp, Homo sapiens
ggcagctgggttggccagaaac

SEQ ID NO: 8233563 - DNA, 22 bp, Homo sapiens
ggcagctgggttggccagaaac

SEQ ID NO: 8233564 - DNA, 22 bp, Homo sapiens
ggcagctggttctttccattaa

SEQ ID NO: 8233565 - DNA, 22 bp, Homo sapiens
ggcagctgggttggccagaaac

SEQ ID NO: 8233566 - DNA, 22 bp, Homo sapiens
ggcagctgggtcacaccgatct

SEQ ID NO: 8233567 - DNA, 22 bp, Homo sapiens
ggcagctgggtcacaccgatct

SEQ ID NO: 8233568 - DNA, 22 bp, Homo sapiens
ggcagctgggttggccagaaac

SEQ ID NO: 8233569 - DNA, 22 bp, Homo sapiens
ggcagctgggttggccagaaac

SEQ ID NO: 8233570 - DNA, 22 bp, Homo sapiens
ggcagctgtaagatgagtgaat

SEQ ID NO: 8233571 - DNA, 22 bp, Homo sapiens
ggcagctgtaagatgagtgaat

SEQ ID NO: 8233572 - DNA, 22 bp, Homo sapiens
ggcagctggttctttccattaa

SEQ ID NO: 8233573 - DNA, 22 bp, Homo sapiens
ggcagctgtaagatgagtgaat

SEQ ID NO: 8233574 - DNA, 22 bp, Homo sapiens
ggcagctgtctcattcacacct

SEQ ID NO: 8233575 - DNA, 22 bp, Homo sapiens
ggcagctgtctcattcacacct

SEQ ID NO: 8233576 - DNA, 22 bp, Homo sapiens
ggcagctgtctcattcacacct

SEQ ID NO: 8233577 - DNA, 22 bp, Homo sapiens
ggcaggcagatggctgcaccaa

SEQ ID NO: 8233578 - DNA, 22 bp, Homo sapiens
ggcagctgtgaagtgcctcaca

SEQ ID NO: 8233579 - DNA, 22 bp, Homo sapiens
ggcaggcagatggctgcaccaa

SEQ ID NO: 8233580 - DNA, 22 bp, Homo sapiens
ggcagctgtgaagtgcctcaca

SEQ ID NO: 8233581 - DNA, 22 bp, Homo sapiens
ggcagctgtgaagtgcctcaca

SEQ ID NO: 8233582 - DNA, 22 bp, Homo sapiens
ggcagctgtgaagtgcctcaca

SEQ ID NO: 8233583 - DNA, 22 bp, Homo sapiens
ggcagctgtctctgagttagca

SEQ ID NO: 8233584 - DNA, 22 bp, Homo sapiens
ggcagctgtctctgagttagca

SEQ ID NO: 8233585 - DNA, 22 bp, Homo sapiens
ggcagctgcacgttgtcccgtc

SEQ ID NO: 8233586 - DNA, 22 bp, Homo sapiens
ggcagctgcacgttgtcccgtc

SEQ ID NO: 8233587 - DNA, 22 bp, Homo sapiens
ggcagctgcaaatctgctctgt

SEQ ID NO: 8233588 - DNA, 22 bp, Homo sapiens
ggcagctgcaaatctgctctgt

SEQ ID NO: 8233589 - DNA, 19 bp, Homo sapiens
ggcagctggacgctgttca

SEQ ID NO: 8233590 - DNA, 19 bp, Homo sapiens
ggcagctggacgctgttca

SEQ ID NO: 8233591 - DNA, 22 bp, Homo sapiens
ggcagctggcctcctcgcccac

SEQ ID NO: 8233592 - DNA, 23 bp, Homo sapiens
ggcagctgggcagcactcatggg

SEQ ID NO: 8233593 - DNA, 22 bp, Homo sapiens
ggcagctggcctcctcgcccac

SEQ ID NO: 8233594 - DNA, 22 bp, Homo sapiens
ggcagctggcctcctcgcccac

SEQ ID NO: 8233595 - DNA, 22 bp, Homo sapiens
ggcagctggcctcctcgcccac

SEQ ID NO: 8233596 - DNA, 22 bp, Homo sapiens
ggcagctggcctcctcgcccac

SEQ ID NO: 8233597 - DNA, 22 bp, Homo sapiens
ggcagaggaagctggaagtggg

SEQ ID NO: 8233598 - DNA, 22 bp, Homo sapiens
ggcagaggaagctggaagtggg

SEQ ID NO: 8233599 - DNA, 22 bp, Homo sapiens
ggcagaggaagctggaagtggg

SEQ ID NO: 8233600 - DNA, 22 bp, Homo sapiens
ggcagaggaagctggaagtggg

SEQ ID NO: 8233601 - DNA, 22 bp, Homo sapiens
ggcagaggaagctggaagtggg

SEQ ID NO: 8233602 - DNA, 22 bp, Homo sapiens
ggcagaggaagctggaagtggg

SEQ ID NO: 8233603 - DNA, 22 bp, Homo sapiens
ggcagaggaagctggaagtggg

SEQ ID NO: 8233604 - DNA, 22 bp, Homo sapiens
ggcagaggaagctggaagtggg

SEQ ID NO: 8233605 - DNA, 22 bp, Homo sapiens
ggcagaggaagctggaagtggg

SEQ ID NO: 8233606 - DNA, 22 bp, Homo sapiens
ggcagaggaagctggaagtggg

SEQ ID NO: 8233607 - DNA, 22 bp, Homo sapiens
ggcacagagcccagcttcctag

SEQ ID NO: 8233608 - DNA, 22 bp, Homo sapiens
ggcacagagaggccctggaagg

SEQ ID NO: 8233609 - DNA, 22 bp, Homo sapiens
ggcacagacttttgcttgcgtt

SEQ ID NO: 8233610 - DNA, 22 bp, Homo sapiens
ggcacactcacttctgccctga

SEQ ID NO: 8233611 - DNA, 22 bp, Homo sapiens
ggcacacatagatctgcactgg

SEQ ID NO: 8233612 - DNA, 22 bp, Homo sapiens
ggcacactcaccacgtggaggg

SEQ ID NO: 8233613 - DNA, 22 bp, Homo sapiens
ggcacacatagatctgcactgg

SEQ ID NO: 8233614 - DNA, 22 bp, Homo sapiens
ggcacacatagatctgcactgg

SEQ ID NO: 8233615 - DNA, 22 bp, Homo sapiens
ggcacacatagatctgcactgg

SEQ ID NO: 8233616 - DNA, 22 bp, Homo sapiens
ggcacacagcttggcaggagat

SEQ ID NO: 8233617 - DNA, 22 bp, Homo sapiens
ggcacacagcttggcaggagat

SEQ ID NO: 8233618 - DNA, 22 bp, Homo sapiens
ggcacacagatggagcactagc

SEQ ID NO: 8233619 - DNA, 22 bp, Homo sapiens
ggcaaggccttgcccagcattc

SEQ ID NO: 8233620 - DNA, 22 bp, Homo sapiens
ggcacacagatggagcactagc

SEQ ID NO: 8233621 - DNA, 22 bp, Homo sapiens
ggagtgtcccgattttccaggt

SEQ ID NO: 8233622 - DNA, 22 bp, Homo sapiens
ggagtgtggagaggacatgggt

SEQ ID NO: 8233623 - DNA, 22 bp, Homo sapiens
ggagtggtgtcactgagaggaa

SEQ ID NO: 8233624 - DNA, 22 bp, Homo sapiens
ggagtggtgtcactgagaggaa

SEQ ID NO: 8233625 - DNA, 22 bp, Homo sapiens
ggagtggtgtcactgagaggaa

SEQ ID NO: 8233626 - DNA, 22 bp, Homo sapiens
ggagttcaaatcttttggatct

SEQ ID NO: 8233627 - DNA, 22 bp, Homo sapiens
ggagttcaccaaggttatgcag

SEQ ID NO: 8233628 - DNA, 22 bp, Homo sapiens
ggagttcaggaaaggagccaga

SEQ ID NO: 8233629 - DNA, 22 bp, Homo sapiens
ggagttcactgtgcaggctctg

SEQ ID NO: 8233630 - DNA, 22 bp, Homo sapiens
ggagttcacgatgttggccagg

SEQ ID NO: 8233631 - DNA, 22 bp, Homo sapiens
ggcaaggaagaagccatgatgt

SEQ ID NO: 8233632 - DNA, 22 bp, Homo sapiens
ggcaaggcctgcagctcagtgt

SEQ ID NO: 8233633 - DNA, 22 bp, Homo sapiens
ggcaaggccaggcctccaagac

SEQ ID NO: 8233634 - DNA, 22 bp, Homo sapiens
ggagttgatcagagtaggaggt

SEQ ID NO: 8233635 - DNA, 22 bp, Homo sapiens
ggagttgacagtttagaagctt

SEQ ID NO: 8233636 - DNA, 22 bp, Homo sapiens
ggagttcaggaatgaaaatgtt

SEQ ID NO: 8233637 - DNA, 17 bp, Homo sapiens
ggagttctgcagtcagg

SEQ ID NO: 8233638 - DNA, 22 bp, Homo sapiens
ggagtggctatttgtgctggtt

SEQ ID NO: 8233639 - DNA, 22 bp, Homo sapiens
ggagtggctatttgtgctggtt

SEQ ID NO: 8233640 - DNA, 22 bp, Homo sapiens
ggagtggctgtttctgccccca

SEQ ID NO: 8233641 - DNA, 22 bp, Homo sapiens
ggagtgggaacaatgacatggt

SEQ ID NO: 8233642 - DNA, 22 bp, Homo sapiens
ggagtgggaacaatgacatggt

SEQ ID NO: 8233643 - DNA, 22 bp, Homo sapiens
ggagtgggaacaatgacatggt

SEQ ID NO: 8233644 - DNA, 22 bp, Homo sapiens
ggagtgggaacaatgacatggt

SEQ ID NO: 8233645 - DNA, 22 bp, Homo sapiens
ggagtgggcagcactgccctgt

SEQ ID NO: 8233646 - DNA, 22 bp, Homo sapiens
ggagtgggcagcactgccctgt

SEQ ID NO: 8233647 - DNA, 19 bp, Homo sapiens
ggagtgggtagttagtggt

SEQ ID NO: 8233648 - DNA, 22 bp, Homo sapiens
ggagtggtggtcaggccatggc

SEQ ID NO: 8233649 - DNA, 22 bp, Homo sapiens
ggagtggcagctaggctgtcag

SEQ ID NO: 8233650 - DNA, 22 bp, Homo sapiens
ggagtggcaggccacagtgctg

SEQ ID NO: 8233651 - DNA, 22 bp, Homo sapiens
ggagtggcaggccacagtgctg

SEQ ID NO: 8233652 - DNA, 22 bp, Homo sapiens
ggagtggccacgactgggagat

SEQ ID NO: 8233653 - DNA, 22 bp, Homo sapiens
ggagtggccacgactgggagat

SEQ ID NO: 8233654 - DNA, 22 bp, Homo sapiens
ggagtggccacgactgggagat

SEQ ID NO: 8233655 - DNA, 22 bp, Homo sapiens
ggagtggcctctcctgtgcagg

SEQ ID NO: 8233656 - DNA, 22 bp, Homo sapiens
ggagtggcctctcctgtgcagg

SEQ ID NO: 8233657 - DNA, 22 bp, Homo sapiens
ggagtggcctctcctgtgcagg

SEQ ID NO: 8233658 - DNA, 22 bp, Homo sapiens
ggagtggcctctcctgtgcagg

SEQ ID NO: 8233659 - DNA, 22 bp, Homo sapiens
ggagtggctatttgtgctggtt

SEQ ID NO: 8233660 - DNA, 22 bp, Homo sapiens
ggagtggctatttgtgctggtt

SEQ ID NO: 8233661 - DNA, 22 bp, Homo sapiens
ggagtggcagctaggctgtcag

SEQ ID NO: 8233662 - DNA, 22 bp, Homo sapiens
ggagtggcagcgaggatcagat

SEQ ID NO: 8233663 - DNA, 22 bp, Homo sapiens
ggagtggcagcgaggatcagat

SEQ ID NO: 8233664 - DNA, 22 bp, Homo sapiens
ggagtggcactctgaggcgggg

SEQ ID NO: 8233665 - DNA, 22 bp, Homo sapiens
ggagtggcagagagggtatact

SEQ ID NO: 8233666 - DNA, 22 bp, Homo sapiens
ggagtggcactctgaggcgggg

SEQ ID NO: 8233667 - DNA, 22 bp, Homo sapiens
ggagtgctttgaagccttcatt

SEQ ID NO: 8233668 - DNA, 20 bp, Homo sapiens
ggcagacctgctgagagccc

SEQ ID NO: 8233669 - DNA, 21 bp, Homo sapiens
ggcagagaagctggaagttgg

SEQ ID NO: 8233670 - DNA, 22 bp, Homo sapiens
ggcagagaatctggctgtttac

SEQ ID NO: 8233671 - DNA, 22 bp, Homo sapiens
ggcagacctctccagccccaca

SEQ ID NO: 8233672 - DNA, 22 bp, Homo sapiens
ggcagacctctccagccccaca

SEQ ID NO: 8233673 - DNA, 22 bp, Homo sapiens
ggcagacctctccagccccaca

SEQ ID NO: 8233674 - DNA, 22 bp, Homo sapiens
ggcagacctctccagccccaca

SEQ ID NO: 8233675 - DNA, 19 bp, Homo sapiens
ggcagacacagttgacatg

SEQ ID NO: 8233676 - DNA, 22 bp, Homo sapiens
ggcagacactcaaaagctggga

SEQ ID NO: 8233677 - DNA, 22 bp, Homo sapiens
ggcagacacctttatgtctaat

SEQ ID NO: 8233678 - DNA, 22 bp, Homo sapiens
ggcagagactgggttggcagag

SEQ ID NO: 8233679 - DNA, 22 bp, Homo sapiens
ggcagagacaccgaatgactct

SEQ ID NO: 8233680 - DNA, 23 bp, Homo sapiens
ggcagagagcatggctggggccc

SEQ ID NO: 8233681 - DNA, 23 bp, Homo sapiens
ggcagagagcatggctggggccc

SEQ ID NO: 8233682 - DNA, 22 bp, Homo sapiens
ggcagagactgggttggcagag

SEQ ID NO: 8233683 - DNA, 22 bp, Homo sapiens
ggcagagcttgttccttctgtt

SEQ ID NO: 8233684 - DNA, 22 bp, Homo sapiens
ggcagaggaagctggaagtggg

SEQ ID NO: 8233685 - DNA, 22 bp, Homo sapiens
ggcagaggaagctggaagtggg

SEQ ID NO: 8233686 - DNA, 22 bp, Homo sapiens
ggcagagcttgttccttctgtt

SEQ ID NO: 8233687 - DNA, 22 bp, Homo sapiens
ggcagagcttgcagtgagccga

SEQ ID NO: 8233688 - DNA, 22 bp, Homo sapiens
ggcagagcttgttccttctgtt

SEQ ID NO: 8233689 - DNA, 22 bp, Homo sapiens
ggcagagcttgttccttctgtt

SEQ ID NO: 8233690 - DNA, 23 bp, Homo sapiens
ggcagagagcatggctggggccc

SEQ ID NO: 8233691 - DNA, 22 bp, Homo sapiens
ggcagacaatctgtctgttagg

SEQ ID NO: 8233692 - DNA, 22 bp, Homo sapiens
ggcacagcactgtaggcctggg

SEQ ID NO: 8233693 - DNA, 22 bp, Homo sapiens
ggcacagcactgtaggcctggg

SEQ ID NO: 8233694 - DNA, 22 bp, Homo sapiens
ggcacagcacagagcacatgta

SEQ ID NO: 8233695 - DNA, 22 bp, Homo sapiens
ggcacagcacagagcacatgta

SEQ ID NO: 8233696 - DNA, 22 bp, Homo sapiens
ggcacagcacagagcacatgta

SEQ ID NO: 8233697 - DNA, 22 bp, Homo sapiens
ggcacagcacagtggacccagg

SEQ ID NO: 8233698 - DNA, 22 bp, Homo sapiens
ggcacagagctccagccttggc

SEQ ID NO: 8233699 - DNA, 22 bp, Homo sapiens
ggcacagagctccagccttggc

SEQ ID NO: 8233700 - DNA, 22 bp, Homo sapiens
ggcacagagctccagccttggc

SEQ ID NO: 8233701 - DNA, 22 bp, Homo sapiens
ggcacagagttggcagagctgc

SEQ ID NO: 8233702 - DNA, 22 bp, Homo sapiens
ggcacagaggttgcctccagat

SEQ ID NO: 8233703 - DNA, 22 bp, Homo sapiens
ggcacagagctttgtcccagtt

SEQ ID NO: 8233704 - DNA, 22 bp, Homo sapiens
ggcacagagctttgtcccagtt

SEQ ID NO: 8233705 - DNA, 22 bp, Homo sapiens
ggcacagagttggcagagctgc

SEQ ID NO: 8233706 - DNA, 22 bp, Homo sapiens
ggcacagagttggcagagctgc

SEQ ID NO: 8233707 - DNA, 23 bp, Homo sapiens
ggcacagatgctgagcatgtgca

SEQ ID NO: 8233708 - DNA, 23 bp, Homo sapiens
ggcacagatgctgagcatgtgca

SEQ ID NO: 8233709 - DNA, 22 bp, Homo sapiens
ggcacagatagatcaagtgtct

SEQ ID NO: 8233710 - DNA, 22 bp, Homo sapiens
ggctcaggtttaaagtgcttta

SEQ ID NO: 8233711 - DNA, 22 bp, Homo sapiens
ggctcaggcctgtaatcctagc

SEQ ID NO: 8233712 - DNA, 22 bp, Homo sapiens
ggctcaggcctgtaatcctagc

SEQ ID NO: 8233713 - DNA, 22 bp, Homo sapiens
ggctcaggtttccttcccagct

SEQ ID NO: 8233714 - DNA, 22 bp, Homo sapiens
ggctcaggtttaaagtgcttta

SEQ ID NO: 8233715 - DNA, 22 bp, Homo sapiens
ggctcaggtttaaagtgcttta

SEQ ID NO: 8233716 - DNA, 22 bp, Homo sapiens
ggctcaggtttccttcccagct

SEQ ID NO: 8233717 - DNA, 22 bp, Homo sapiens
ggctcaggtttccttcccagct

SEQ ID NO: 8233718 - DNA, 22 bp, Homo sapiens
ggctcaggtttccttcccagct

SEQ ID NO: 8233719 - DNA, 22 bp, Homo sapiens
ggctcatgtatgaaagggtgtg

SEQ ID NO: 8233720 - DNA, 22 bp, Homo sapiens
ggctcatgtatgaaagggtgtg

SEQ ID NO: 8233721 - DNA, 20 bp, Homo sapiens
ggctcatcttgtctgctgac

SEQ ID NO: 8233722 - DNA, 19 bp, Homo sapiens
ggctcagtgacataggtgc

SEQ ID NO: 8233723 - DNA, 22 bp, Homo sapiens
ggctcctggaaagccctcgctc

SEQ ID NO: 8233724 - DNA, 23 bp, Homo sapiens
ggctcctgcttcatgtcccacct

SEQ ID NO: 8233725 - DNA, 23 bp, Homo sapiens
ggctcctgcttcatgtcccacct

SEQ ID NO: 8233726 - DNA, 22 bp, Homo sapiens
ggctccaagtctcagagtgaag

SEQ ID NO: 8233727 - DNA, 22 bp, Homo sapiens
ggctcctgatgctcagatttca

SEQ ID NO: 8233728 - DNA, 22 bp, Homo sapiens
ggctccaccctgcttccagaag

SEQ ID NO: 8233729 - DNA, 22 bp, Homo sapiens
ggctcctgcacctgtccctctg

SEQ ID NO: 8233730 - DNA, 22 bp, Homo sapiens
ggctcctgcacctgtccctctg

SEQ ID NO: 8233731 - DNA, 22 bp, Homo sapiens
ggctcctgatttgagggggctg

SEQ ID NO: 8233732 - DNA, 22 bp, Homo sapiens
ggctcctgcacctgtccctctg

SEQ ID NO: 8233733 - DNA, 22 bp, Homo sapiens
ggctcaggccagaccacgactc

SEQ ID NO: 8233734 - DNA, 22 bp, Homo sapiens
ggctcaggccagaccacgactc

SEQ ID NO: 8233735 - DNA, 22 bp, Homo sapiens
ggctcaggccagaccacgactc

SEQ ID NO: 8233736 - DNA, 22 bp, Homo sapiens
ggctcaggatgagccttctcat

SEQ ID NO: 8233737 - DNA, 22 bp, Homo sapiens
ggctcaggatgagccttctcat

SEQ ID NO: 8233738 - DNA, 22 bp, Homo sapiens
ggctcaggactgcagcgtagag

SEQ ID NO: 8233739 - DNA, 22 bp, Homo sapiens
ggctcaggactgcagcgtagag

SEQ ID NO: 8233740 - DNA, 22 bp, Homo sapiens
ggctcaggactgcagcgtagag

SEQ ID NO: 8233741 - DNA, 22 bp, Homo sapiens
ggctcaggatgagccttctcat

SEQ ID NO: 8233742 - DNA, 22 bp, Homo sapiens
ggctcaggagaggggctaaaag

SEQ ID NO: 8233743 - DNA, 22 bp, Homo sapiens
ggctcaggagaggggctaaaag

SEQ ID NO: 8233744 - DNA, 22 bp, Homo sapiens
ggctcaggacacagtggtttag

SEQ ID NO: 8233745 - DNA, 22 bp, Homo sapiens
ggctcagcttggtgcgcagaaa

SEQ ID NO: 8233746 - DNA, 22 bp, Homo sapiens
ggctcagcttggtgcgcagaaa

SEQ ID NO: 8233747 - DNA, 22 bp, Homo sapiens
ggctcagcttggtgcgcagaaa

SEQ ID NO: 8233748 - DNA, 22 bp, Homo sapiens
ggctcaggactgcagcgtagag

SEQ ID NO: 8233749 - DNA, 22 bp, Homo sapiens
ggctcaggactgcagcgtagag

SEQ ID NO: 8233750 - DNA, 22 bp, Homo sapiens
ggctcaggactgcagcgtagag

SEQ ID NO: 8233751 - DNA, 22 bp, Homo sapiens
ggctcaggactgcagcgtagag

SEQ ID NO: 8233752 - DNA, 22 bp, Homo sapiens
ggctcaggacctgggattgcca

SEQ ID NO: 8233753 - DNA, 22 bp, Homo sapiens
ggctcaggacacagtggtttag

SEQ ID NO: 8233754 - DNA, 22 bp, Homo sapiens
ggctcaggacctgggattgcca

SEQ ID NO: 8233755 - DNA, 22 bp, Homo sapiens
ggctcagcccccacgcttcttc

SEQ ID NO: 8233756 - DNA, 18 bp, Homo sapiens
ggctcagcaggctctctc

SEQ ID NO: 8233757 - DNA, 18 bp, Homo sapiens
ggctcagcaggctctctc

SEQ ID NO: 8233758 - DNA, 18 bp, Homo sapiens
ggctcagcaggctctctc

SEQ ID NO: 8233759 - DNA, 22 bp, Homo sapiens
ggccttgggatgtggctgcagc

SEQ ID NO: 8233760 - DNA, 22 bp, Homo sapiens
ggctcagccccgtaacacagca

SEQ ID NO: 8233761 - DNA, 22 bp, Homo sapiens
ggctcagccccgtaacacagca

SEQ ID NO: 8233762 - DNA, 22 bp, Homo sapiens
ggctcagcgcgctgggagggag

SEQ ID NO: 8233763 - DNA, 22 bp, Homo sapiens
ggctcagcgcgctgggagggag

SEQ ID NO: 8233764 - DNA, 22 bp, Homo sapiens
ggctcagcttatctgggcaggc

SEQ ID NO: 8233765 - DNA, 22 bp, Homo sapiens
ggctcagcttatctgggcaggc

SEQ ID NO: 8233766 - DNA, 22 bp, Homo sapiens
ggctcagcttatctgggcaggc

SEQ ID NO: 8233767 - DNA, 22 bp, Homo sapiens
ggccttgggaggagggtcagaa

SEQ ID NO: 8233768 - DNA, 22 bp, Homo sapiens
ggccttgggaggagggtcagaa

SEQ ID NO: 8233769 - DNA, 22 bp, Homo sapiens
ggccttggatccaagctgcggc

SEQ ID NO: 8233770 - DNA, 21 bp, Homo sapiens
ggccttggcgggggccgaatt

SEQ ID NO: 8233771 - DNA, 21 bp, Homo sapiens
ggccttggcgggggccgaatt

SEQ ID NO: 8233772 - DNA, 22 bp, Homo sapiens
ggccctgcaaggtacccaggcc

SEQ ID NO: 8233773 - DNA, 22 bp, Homo sapiens
ggccctgcaaggtacccaggcc

SEQ ID NO: 8233774 - DNA, 22 bp, Homo sapiens
ggccctgagtctagctgctctt

SEQ ID NO: 8233775 - DNA, 22 bp, Homo sapiens
ggccctgagctgaagtactgtg

SEQ ID NO: 8233776 - DNA, 22 bp, Homo sapiens
ggccctgcgattaggtggcagg

SEQ ID NO: 8233777 - DNA, 22 bp, Homo sapiens
ggccctgcatgagattaaggtt

SEQ ID NO: 8233778 - DNA, 22 bp, Homo sapiens
ggccctgcgattaggtggcagg

SEQ ID NO: 8233779 - DNA, 22 bp, Homo sapiens
ggcctgggcccactgtcaagag

SEQ ID NO: 8233780 - DNA, 22 bp, Homo sapiens
ggcctgggcctttgtgttttga

SEQ ID NO: 8233781 - DNA, 23 bp, Homo sapiens
ggcctgtgttttgtctgaagtac

SEQ ID NO: 8233782 - DNA, 23 bp, Homo sapiens
ggcctgtgttttgtctgaagtac

SEQ ID NO: 8233783 - DNA, 23 bp, Homo sapiens
ggcctgtgttttgtctgaagtac

SEQ ID NO: 8233784 - DNA, 22 bp, Homo sapiens
ggcctgggcccactgtcaagag

SEQ ID NO: 8233785 - DNA, 22 bp, Homo sapiens
ggcctgggcccactgtcaagag

SEQ ID NO: 8233786 - DNA, 22 bp, Homo sapiens
ggcccctggcaccaggctgatt

SEQ ID NO: 8233787 - DNA, 22 bp, Homo sapiens
ggcccctgtaaaatgtacatgt

SEQ ID NO: 8233788 - DNA, 22 bp, Homo sapiens
ggccctccctgagccaggtggg

SEQ ID NO: 8233789 - DNA, 22 bp, Homo sapiens
ggccctccctgagccaggtggg

SEQ ID NO: 8233790 - DNA, 17 bp, Homo sapiens
ggcccggtgacgtcact

SEQ ID NO: 8233791 - DNA, 22 bp, Homo sapiens
ggccctcccggtgatgaagagc

SEQ ID NO: 8233792 - DNA, 22 bp, Homo sapiens
ggccctcttttatccatcataa

SEQ ID NO: 8233793 - DNA, 22 bp, Homo sapiens
ggccctcttttggtttggatgt

SEQ ID NO: 8233794 - DNA, 22 bp, Homo sapiens
ggccctctgtggctgccatgga

SEQ ID NO: 8233795 - DNA, 22 bp, Homo sapiens
ggccctcttgatatccagcggc

SEQ ID NO: 8233796 - DNA, 22 bp, Homo sapiens
ggccctctggcttccgcatggg

SEQ ID NO: 8233797 - DNA, 22 bp, Homo sapiens
ggccctctggcttccgcatggg

SEQ ID NO: 8233798 - DNA, 22 bp, Homo sapiens
ggccctctgctctgagatgaag

SEQ ID NO: 8233799 - DNA, 22 bp, Homo sapiens
ggccctctggtgagtatcacat

SEQ ID NO: 8233800 - DNA, 22 bp, Homo sapiens
ggccctctgtggctgccatgga

SEQ ID NO: 8233801 - DNA, 22 bp, Homo sapiens
ggccctctggtgagtatcacat

SEQ ID NO: 8233802 - DNA, 22 bp, Homo sapiens
ggccttccatctgcctctgttt

SEQ ID NO: 8233803 - DNA, 22 bp, Homo sapiens
ggccttccatctgcctctgttt

SEQ ID NO: 8233804 - DNA, 22 bp, Homo sapiens
ggccttccagggaagacagggc

SEQ ID NO: 8233805 - DNA, 22 bp, Homo sapiens
ggccttccagggaagacagggc

SEQ ID NO: 8233806 - DNA, 21 bp, Homo sapiens
ggccttcccctgcagtctccg

SEQ ID NO: 8233807 - DNA, 22 bp, Homo sapiens
ggccttccattgctcttttcta

SEQ ID NO: 8233808 - DNA, 22 bp, Homo sapiens
ggccttccttcccagcctactg

SEQ ID NO: 8233809 - DNA, 22 bp, Homo sapiens
ggccttccttcccagcctactg

SEQ ID NO: 8233810 - DNA, 22 bp, Homo sapiens
ggccttccttcccagcctactg

SEQ ID NO: 8233811 - DNA, 22 bp, Homo sapiens
ggccttcctgttgtgtccaccg

SEQ ID NO: 8233812 - DNA, 22 bp, Homo sapiens
ggccttcctgttgtgtccaccg

SEQ ID NO: 8233813 - DNA, 22 bp, Homo sapiens
ggccttcctggcggctcagggt

SEQ ID NO: 8233814 - DNA, 22 bp, Homo sapiens
ggccttcctgttgtgtccaccg

SEQ ID NO: 8233815 - DNA, 22 bp, Homo sapiens
ggccttcctggcggctcagggt

SEQ ID NO: 8233816 - DNA, 22 bp, Homo sapiens
ggccttcctggcggctcagggt

SEQ ID NO: 8233817 - DNA, 22 bp, Homo sapiens
ggccttcctgctgctccgggcc

SEQ ID NO: 8233818 - DNA, 22 bp, Homo sapiens
ggccttcctgctgctccgggcc

SEQ ID NO: 8233819 - DNA, 21 bp, Homo sapiens
ggccttcccctgcagtctccg

SEQ ID NO: 8233820 - DNA, 22 bp, Homo sapiens
ggccttggaaagatacccagct

SEQ ID NO: 8233821 - DNA, 20 bp, Homo sapiens
ggccttggaatagcacagct

SEQ ID NO: 8233822 - DNA, 22 bp, Homo sapiens
ggccttggagtcctccactgga

SEQ ID NO: 8233823 - DNA, 22 bp, Homo sapiens
ggccttggagtcctccactgga

SEQ ID NO: 8233824 - DNA, 22 bp, Homo sapiens
ggccttgcggaacgctcaggcg

SEQ ID NO: 8233825 - DNA, 22 bp, Homo sapiens
ggcccagccggcgagtctcgcg

SEQ ID NO: 8233826 - DNA, 22 bp, Homo sapiens
ggcccagccggcgagtctcgcg

SEQ ID NO: 8233827 - DNA, 22 bp, Homo sapiens
ggcccagaagccagaagcctcc

SEQ ID NO: 8233828 - DNA, 22 bp, Homo sapiens
ggcccacatggaagcatcgagg

SEQ ID NO: 8233829 - DNA, 22 bp, Homo sapiens
ggcccacactgacagctgagct

SEQ ID NO: 8233830 - DNA, 22 bp, Homo sapiens
ggcccacttgaaatggagctca

SEQ ID NO: 8233831 - DNA, 22 bp, Homo sapiens
ggcccacatggaagcatcgagg

SEQ ID NO: 8233832 - DNA, 22 bp, Homo sapiens
ggcccaaggtgccaaggcctcc

SEQ ID NO: 8233833 - DNA, 22 bp, Homo sapiens
ggcccaaggcccaggtcgagct

SEQ ID NO: 8233834 - DNA, 22 bp, Homo sapiens
ggcccacactgacagctgagct

SEQ ID NO: 8233835 - DNA, 22 bp, Homo sapiens
ggcccacactgacagctgagct

SEQ ID NO: 8233836 - DNA, 22 bp, Homo sapiens
ggcccacactgacagctgagct

SEQ ID NO: 8233837 - DNA, 22 bp, Homo sapiens
ggcccaaggtgccaaggcctcc

SEQ ID NO: 8233838 - DNA, 22 bp, Homo sapiens
ggccatggttggggaagacatg

SEQ ID NO: 8233839 - DNA, 22 bp, Homo sapiens
ggccattgcaacgtcaggagga

SEQ ID NO: 8233840 - DNA, 22 bp, Homo sapiens
ggccatttttgttcttatctct

SEQ ID NO: 8233841 - DNA, 22 bp, Homo sapiens
ggccatggtggtttgagcacct

SEQ ID NO: 8233842 - DNA, 22 bp, Homo sapiens
ggccatggtggtttgagcacct

SEQ ID NO: 8233843 - DNA, 17 bp, Homo sapiens
ggccatggtgcaaggtt

SEQ ID NO: 8233844 - DNA, 17 bp, Homo sapiens
ggccatggtgcaaggtt

SEQ ID NO: 8233845 - DNA, 22 bp, Homo sapiens
ggccatggtcatgggtgagctt

SEQ ID NO: 8233846 - DNA, 22 bp, Homo sapiens
ggccatggtgaggtcttctcag

SEQ ID NO: 8233847 - DNA, 20 bp, Homo sapiens
ggccatgggttgcctgaggt

SEQ ID NO: 8233848 - DNA, 20 bp, Homo sapiens
ggccatgggttgcctgaggt

SEQ ID NO: 8233849 - DNA, 20 bp, Homo sapiens
ggccatgggttgcctgaggt

SEQ ID NO: 8233850 - DNA, 22 bp, Homo sapiens
ggcccagcctcagacatgccct

SEQ ID NO: 8233851 - DNA, 22 bp, Homo sapiens
ggcccagcctggcaacaatgac

SEQ ID NO: 8233852 - DNA, 22 bp, Homo sapiens
ggcccagcctcagacatgccct

SEQ ID NO: 8233853 - DNA, 22 bp, Homo sapiens
ggcccagcgaggccacctacag

SEQ ID NO: 8233854 - DNA, 22 bp, Homo sapiens
ggccccagattctgggctgggt

SEQ ID NO: 8233855 - DNA, 22 bp, Homo sapiens
ggccccacgggggagtcctagt

SEQ ID NO: 8233856 - DNA, 22 bp, Homo sapiens
ggccccacgggggagtcctagt

SEQ ID NO: 8233857 - DNA, 21 bp, Homo sapiens
ggccccgcagacccagcacgt

SEQ ID NO: 8233858 - DNA, 22 bp, Homo sapiens
ggccccagttcactcctggccg

SEQ ID NO: 8233859 - DNA, 22 bp, Homo sapiens
ggccccagttcactcctggccg

SEQ ID NO: 8233860 - DNA, 19 bp, Homo sapiens
ggcccctctcacaggagtt

SEQ ID NO: 8233861 - DNA, 19 bp, Homo sapiens
ggcccctctcacaggagtt

SEQ ID NO: 8233862 - DNA, 22 bp, Homo sapiens
ggcccctcagcatctgagtcag

SEQ ID NO: 8233863 - DNA, 22 bp, Homo sapiens
ggcccctcttgtggcacatacg

SEQ ID NO: 8233864 - DNA, 22 bp, Homo sapiens
ggcccctggcaccaggctgatt

SEQ ID NO: 8233865 - DNA, 22 bp, Homo sapiens
ggcccctgcggactgcctagag

SEQ ID NO: 8233866 - DNA, 22 bp, Homo sapiens
ggcccctgcggactgcctagag

SEQ ID NO: 8233867 - DNA, 22 bp, Homo sapiens
ggcccctcttgtggcacatacg

SEQ ID NO: 8233868 - DNA, 22 bp, Homo sapiens
ggcccctgcggactgcctagag

SEQ ID NO: 8233869 - DNA, 17 bp, Homo sapiens
ggccagaggcggggctg

SEQ ID NO: 8233870 - DNA, 17 bp, Homo sapiens
ggccagaggcggggctg

SEQ ID NO: 8233871 - DNA, 17 bp, Homo sapiens
ggccagaggcggggctg

SEQ ID NO: 8233872 - DNA, 17 bp, Homo sapiens
ggccagaggcggggctg

SEQ ID NO: 8233873 - DNA, 22 bp, Homo sapiens
ggccagagggagggcacaaatc

SEQ ID NO: 8233874 - DNA, 18 bp, Homo sapiens
ggccagagggagggtccc

SEQ ID NO: 8233875 - DNA, 18 bp, Homo sapiens
ggccagagggagggtccc

SEQ ID NO: 8233876 - DNA, 18 bp, Homo sapiens
ggccagagggagggtccc

SEQ ID NO: 8233877 - DNA, 18 bp, Homo sapiens
ggccagagggagggtccc

SEQ ID NO: 8233878 - DNA, 22 bp, Homo sapiens
ggccagaggtgtcctcagttct

SEQ ID NO: 8233879 - DNA, 22 bp, Homo sapiens
ggccagaggtggtacatagctt

SEQ ID NO: 8233880 - DNA, 22 bp, Homo sapiens
ggccagaggtgtcctcagttct

SEQ ID NO: 8233881 - DNA, 22 bp, Homo sapiens
ggccatgggaagaggtggagag

SEQ ID NO: 8233882 - DNA, 22 bp, Homo sapiens
ggccagaggccatcctcctgct

SEQ ID NO: 8233883 - DNA, 22 bp, Homo sapiens
ggccagaggccatcctcctgct

SEQ ID NO: 8233884 - DNA, 22 bp, Homo sapiens
ggccagaggccacagctgtgtc

SEQ ID NO: 8233885 - DNA, 22 bp, Homo sapiens
ggccagaggacctctcatagcc

SEQ ID NO: 8233886 - DNA, 22 bp, Homo sapiens
ggccagaggacctctcatagcc

SEQ ID NO: 8233887 - DNA, 22 bp, Homo sapiens
ggccagaggccacagctgtgtc

SEQ ID NO: 8233888 - DNA, 22 bp, Homo sapiens
ggccagaggccacagctgtgtc

SEQ ID NO: 8233889 - DNA, 22 bp, Homo sapiens
ggccagaggccacagctgtgtc

SEQ ID NO: 8233890 - DNA, 22 bp, Homo sapiens
ggccagagctcaaacagtcgca

SEQ ID NO: 8233891 - DNA, 22 bp, Homo sapiens
ggccagagctgacctatcaatg

SEQ ID NO: 8233892 - DNA, 22 bp, Homo sapiens
ggccagagagccgctgttagga

SEQ ID NO: 8233893 - DNA, 22 bp, Homo sapiens
ggccagagaatatgccttacgt

SEQ ID NO: 8233894 - DNA, 22 bp, Homo sapiens
ggccagagagcagccaggattc

SEQ ID NO: 8233895 - DNA, 22 bp, Homo sapiens
ggccagagagcagccaggattc

SEQ ID NO: 8233896 - DNA, 22 bp, Homo sapiens
ggccagagagcagccaggattc

SEQ ID NO: 8233897 - DNA, 22 bp, Homo sapiens
ggccagagagcagccaggattc

SEQ ID NO: 8233898 - DNA, 22 bp, Homo sapiens
ggccagagagcagccaggattc

SEQ ID NO: 8233899 - DNA, 22 bp, Homo sapiens
ggcaggtggaaggtctccattc

SEQ ID NO: 8233900 - DNA, 22 bp, Homo sapiens
ggcaggtggaaggtctccattc

SEQ ID NO: 8233901 - DNA, 22 bp, Homo sapiens
ggcaggtggaaggtctccattc

SEQ ID NO: 8233902 - DNA, 22 bp, Homo sapiens
ggcaggtggaaggtctccattc

SEQ ID NO: 8233903 - DNA, 22 bp, Homo sapiens
ggcaggtggaagttggcagagc

SEQ ID NO: 8233904 - DNA, 22 bp, Homo sapiens
ggcaggtggaagttggcagagc

SEQ ID NO: 8233905 - DNA, 22 bp, Homo sapiens
ggcaggtgcttgtcgaaggcct

SEQ ID NO: 8233906 - DNA, 22 bp, Homo sapiens
ggcaggtgcttgtcgaaggcct

SEQ ID NO: 8233907 - DNA, 22 bp, Homo sapiens
ggcaggtgcttgtcgaaggcct

SEQ ID NO: 8233908 - DNA, 22 bp, Homo sapiens
ggcaggtgcttgtcgaaggcct

SEQ ID NO: 8233909 - DNA, 22 bp, Homo sapiens
ggcaggtgcttgtcgaaggcct

SEQ ID NO: 8233910 - DNA, 22 bp, Homo sapiens
ggcaggtgcttgtcgaaggcct

SEQ ID NO: 8233911 - DNA, 22 bp, Homo sapiens
ggcaggtgctctgtgggcctgg

SEQ ID NO: 8233912 - DNA, 22 bp, Homo sapiens
ggcaggtgctctgtgggcctgg

SEQ ID NO: 8233913 - DNA, 22 bp, Homo sapiens
ggcaggtgctctgtgggcctgg

SEQ ID NO: 8233914 - DNA, 22 bp, Homo sapiens
ggcaggtgctctgtgggcctgg

SEQ ID NO: 8233915 - DNA, 22 bp, Homo sapiens
ggcaggtgctctgtgggcctgg

SEQ ID NO: 8233916 - DNA, 22 bp, Homo sapiens
ggcaggtgctgggagcatctca

SEQ ID NO: 8233917 - DNA, 22 bp, Homo sapiens
ggcaggtgctgggagcatctca

SEQ ID NO: 8233918 - DNA, 22 bp, Homo sapiens
ggcaggtgctctgtgggcctgg

SEQ ID NO: 8233919 - DNA, 22 bp, Homo sapiens
ggcaggtgctgggagcatctca

SEQ ID NO: 8233920 - DNA, 22 bp, Homo sapiens
ggcaggtgctgggagcatctca

SEQ ID NO: 8233921 - DNA, 20 bp, Homo sapiens
ggcaggtgctgtcccctcct

SEQ ID NO: 8233922 - DNA, 20 bp, Homo sapiens
ggcaggtgctgtcccctcct

SEQ ID NO: 8233923 - DNA, 22 bp, Homo sapiens
ggccagaagctggggcatagga

SEQ ID NO: 8233924 - DNA, 22 bp, Homo sapiens
ggccagaagctggggcatagga

SEQ ID NO: 8233925 - DNA, 20 bp, Homo sapiens
ggccacctgcttcagacccc

SEQ ID NO: 8233926 - DNA, 22 bp, Homo sapiens
ggccagagaagtcagacccttg

SEQ ID NO: 8233927 - DNA, 22 bp, Homo sapiens
ggccagagaagtcagacccttg

SEQ ID NO: 8233928 - DNA, 22 bp, Homo sapiens
ggccagactgagtgaggtcaag

SEQ ID NO: 8233929 - DNA, 22 bp, Homo sapiens
ggccagagaatatgccttacgt

SEQ ID NO: 8233930 - DNA, 22 bp, Homo sapiens
ggccagacatatcgctcccaaa

SEQ ID NO: 8233931 - DNA, 22 bp, Homo sapiens
ggccagaagttggaaaagagcc

SEQ ID NO: 8233932 - DNA, 22 bp, Homo sapiens
ggccagaagttggaaaagagcc

SEQ ID NO: 8233933 - DNA, 22 bp, Homo sapiens
ggctccttgccaccagctctgc

SEQ ID NO: 8233934 - DNA, 20 bp, Homo sapiens
ggctccttctttcatggccc

SEQ ID NO: 8233935 - DNA, 22 bp, Homo sapiens
ggctctagagctgtgcacacat

SEQ ID NO: 8233936 - DNA, 22 bp, Homo sapiens
ggctctaggcggagtcccgcga

SEQ ID NO: 8233937 - DNA, 22 bp, Homo sapiens
ggctctccactatggatgagaa

SEQ ID NO: 8233938 - DNA, 22 bp, Homo sapiens
ggctctcagggaaaggcctccc

SEQ ID NO: 8233939 - DNA, 22 bp, Homo sapiens
ggctctagagactctagagaaa

SEQ ID NO: 8233940 - DNA, 22 bp, Homo sapiens
ggctcgtgtccagtatagaaag

SEQ ID NO: 8233941 - DNA, 19 bp, Homo sapiens
ggctcctggggctcagccc

SEQ ID NO: 8233942 - DNA, 22 bp, Homo sapiens
ggctcctggggaggtgagcttg

SEQ ID NO: 8233943 - DNA, 22 bp, Homo sapiens
ggctcctggggaggtgagcttg

SEQ ID NO: 8233944 - DNA, 22 bp, Homo sapiens
ggctcctgttttaaaaggtgaa

SEQ ID NO: 8233945 - DNA, 23 bp, Homo sapiens
ggctcctggattcaaatcctgcc

SEQ ID NO: 8233946 - DNA, 23 bp, Homo sapiens
ggctcctggattcaaatcctgcc

SEQ ID NO: 8233947 - DNA, 22 bp, Homo sapiens
ggctcctggcatctggtgggta

SEQ ID NO: 8233948 - DNA, 22 bp, Homo sapiens
ggctcctgggagaagttttatt

SEQ ID NO: 8233949 - DNA, 22 bp, Homo sapiens
ggctcctgggatgggactgagc

SEQ ID NO: 8233950 - DNA, 22 bp, Homo sapiens
ggctcctgggcagctgctccct

SEQ ID NO: 8233951 - DNA, 22 bp, Homo sapiens
ggctcctgggcagctgctccct

SEQ ID NO: 8233952 - DNA, 22 bp, Homo sapiens
ggctgcagagctgggtgggcct

SEQ ID NO: 8233953 - DNA, 22 bp, Homo sapiens
ggctgcagagctggtgccctgg

SEQ ID NO: 8233954 - DNA, 22 bp, Homo sapiens
ggctgcagagctgggtgggcct

SEQ ID NO: 8233955 - DNA, 22 bp, Homo sapiens
ggctgcagagctgggtgggcct

SEQ ID NO: 8233956 - DNA, 22 bp, Homo sapiens
ggctgcagaagtacttccggat

SEQ ID NO: 8233957 - DNA, 19 bp, Homo sapiens
ggctgcagagccccggcgc

SEQ ID NO: 8233958 - DNA, 19 bp, Homo sapiens
ggctgcagagccccggcgc

SEQ ID NO: 8233959 - DNA, 19 bp, Homo sapiens
ggctgcagagccccggcgc

SEQ ID NO: 8233960 - DNA, 19 bp, Homo sapiens
ggctgcagagccccggcgc

SEQ ID NO: 8233961 - DNA, 22 bp, Homo sapiens
ggctgcagagctggtgccctgg

SEQ ID NO: 8233962 - DNA, 22 bp, Homo sapiens
ggctgcagaggcccccagtggg

SEQ ID NO: 8233963 - DNA, 22 bp, Homo sapiens
ggctgcagaggcccccagtggg

SEQ ID NO: 8233964 - DNA, 22 bp, Homo sapiens
ggctgcagaggcgatctgaggt

SEQ ID NO: 8233965 - DNA, 22 bp, Homo sapiens
ggctgcagaggcgatctgaggt

SEQ ID NO: 8233966 - DNA, 22 bp, Homo sapiens
ggctgcagaggcccccagtggg

SEQ ID NO: 8233967 - DNA, 22 bp, Homo sapiens
ggctgcagaggcgatctgaggt

SEQ ID NO: 8233968 - DNA, 22 bp, Homo sapiens
ggctgcaggaacgacggagggg

SEQ ID NO: 8233969 - DNA, 22 bp, Homo sapiens
ggctgcagaggcgatctgaggt

SEQ ID NO: 8233970 - DNA, 22 bp, Homo sapiens
ggctgcagaagtacttccggat

SEQ ID NO: 8233971 - DNA, 22 bp, Homo sapiens
ggctgcaagcctttggggctgg

SEQ ID NO: 8233972 - DNA, 22 bp, Homo sapiens
ggctgcacagcaaagaagcctt

SEQ ID NO: 8233973 - DNA, 22 bp, Homo sapiens
ggctgcacgcctctcagcttgc

SEQ ID NO: 8233974 - DNA, 22 bp, Homo sapiens
ggctgcaagcatgcacagatac

SEQ ID NO: 8233975 - DNA, 22 bp, Homo sapiens
ggctgcaacattttcttaggta

SEQ ID NO: 8233976 - DNA, 22 bp, Homo sapiens
ggctgcaagacaaggttggttt

SEQ ID NO: 8233977 - DNA, 22 bp, Homo sapiens
ggctgcaaaggaaaagtggtga

SEQ ID NO: 8233978 - DNA, 22 bp, Homo sapiens
ggctgcaaataacaactagctt

SEQ ID NO: 8233979 - DNA, 17 bp, Homo sapiens
ggctgcaaaggctctgg

SEQ ID NO: 8233980 - DNA, 22 bp, Homo sapiens
ggctgatgggcatgagctgtca

SEQ ID NO: 8233981 - DNA, 22 bp, Homo sapiens
ggctgatgggcatgagctgtca

SEQ ID NO: 8233982 - DNA, 22 bp, Homo sapiens
ggctgatgagcttagctagaga

SEQ ID NO: 8233983 - DNA, 22 bp, Homo sapiens
ggctgagttgagaggattactt

SEQ ID NO: 8233984 - DNA, 22 bp, Homo sapiens
ggctgagttgagaggattactt

SEQ ID NO: 8233985 - DNA, 22 bp, Homo sapiens
ggctgagttgagaggattactt

SEQ ID NO: 8233986 - DNA, 19 bp, Homo sapiens
ggctctcccttgagagagc

SEQ ID NO: 8233987 - DNA, 22 bp, Homo sapiens
ggctgagttgagaggattactt

SEQ ID NO: 8233988 - DNA, 22 bp, Homo sapiens
ggctgcaggaacgacggagggg

SEQ ID NO: 8233989 - DNA, 22 bp, Homo sapiens
ggctgcaggaacgacggagggg

SEQ ID NO: 8233990 - DNA, 22 bp, Homo sapiens
ggctgcaggatgcccagccgtg

SEQ ID NO: 8233991 - DNA, 20 bp, Homo sapiens
ggctgcaggactcattggct

SEQ ID NO: 8233992 - DNA, 20 bp, Homo sapiens
ggctgcaggactcattggct

SEQ ID NO: 8233993 - DNA, 22 bp, Homo sapiens
ggctgcaggatgcccagccgtg

SEQ ID NO: 8233994 - DNA, 22 bp, Homo sapiens
ggctgcaggatgcccagccgtg

SEQ ID NO: 8233995 - DNA, 22 bp, Homo sapiens
ggctgcaggcagaggctgtctg

SEQ ID NO: 8233996 - DNA, 22 bp, Homo sapiens
ggctgcaggatgcccagccgtg

SEQ ID NO: 8233997 - DNA, 22 bp, Homo sapiens
ggctgcaggcagaggctgtctg

SEQ ID NO: 8233998 - DNA, 22 bp, Homo sapiens
ggctgcaggcagaggctgtctg

SEQ ID NO: 8233999 - DNA, 22 bp, Homo sapiens
ggctgcaggcagggtatccact

SEQ ID NO: 8234000 - DNA, 22 bp, Homo sapiens
ggctgcaggcagaggctgtctg

SEQ ID NO: 8234001 - DNA, 19 bp, Homo sapiens
ggctgcctggagcgagggc

SEQ ID NO: 8234002 - DNA, 19 bp, Homo sapiens
ggctgcctggagcgagggc

SEQ ID NO: 8234003 - DNA, 22 bp, Homo sapiens
ggctgcctgggagccctcctct

SEQ ID NO: 8234004 - DNA, 22 bp, Homo sapiens
ggctgcctgggagccctcctct

SEQ ID NO: 8234005 - DNA, 22 bp, Homo sapiens
ggctgcctggtttagtgctgac

SEQ ID NO: 8234006 - DNA, 22 bp, Homo sapiens
ggctgcctgtgcccaggcacac

SEQ ID NO: 8234007 - DNA, 22 bp, Homo sapiens
ggctgcctggtttagtgctgac

SEQ ID NO: 8234008 - DNA, 22 bp, Homo sapiens
ggctgcctggtttcttgtaagg

SEQ ID NO: 8234009 - DNA, 22 bp, Homo sapiens
ggctgcctggtttcttgtaagg

SEQ ID NO: 8234010 - DNA, 22 bp, Homo sapiens
ggctgccttcagactccagctt

SEQ ID NO: 8234011 - DNA, 22 bp, Homo sapiens
ggctgccttcagactccagctt

SEQ ID NO: 8234012 - DNA, 22 bp, Homo sapiens
ggctgccttcagactccagctt

SEQ ID NO: 8234013 - DNA, 18 bp, Homo sapiens
ggctgcctgttcctgaag

SEQ ID NO: 8234014 - DNA, 22 bp, Homo sapiens
ggctgcctgtgcccaggcacac

SEQ ID NO: 8234015 - DNA, 22 bp, Homo sapiens
ggctgccttcagactccagctt

SEQ ID NO: 8234016 - DNA, 22 bp, Homo sapiens
ggctgccttcagactccagctt

SEQ ID NO: 8234017 - DNA, 22 bp, Homo sapiens
ggctgccttcatagaccatggg

SEQ ID NO: 8234018 - DNA, 22 bp, Homo sapiens
ggctgccttcatagaccatggg

SEQ ID NO: 8234019 - DNA, 22 bp, Homo sapiens
ggctgctcggagcctcctgtga

SEQ ID NO: 8234020 - DNA, 22 bp, Homo sapiens
ggctgctcggcagctcctgagc

SEQ ID NO: 8234021 - DNA, 22 bp, Homo sapiens
ggctgctcggcagctcctgagc

SEQ ID NO: 8234022 - DNA, 22 bp, Homo sapiens
ggctgccttgaccctggctccg

SEQ ID NO: 8234023 - DNA, 22 bp, Homo sapiens
ggctgccttgaccctggctccg

SEQ ID NO: 8234024 - DNA, 19 bp, Homo sapiens
ggctgccttctgctcatct

SEQ ID NO: 8234025 - DNA, 22 bp, Homo sapiens
ggctgccttccctgagccccgg

SEQ ID NO: 8234026 - DNA, 22 bp, Homo sapiens
ggctgctctccatcccaggcct

SEQ ID NO: 8234027 - DNA, 22 bp, Homo sapiens
ggctgctctccatcccaggcct

SEQ ID NO: 8234028 - DNA, 22 bp, Homo sapiens
ggctgctctccatcccaggcct

SEQ ID NO: 8234029 - DNA, 22 bp, Homo sapiens
ggctgctctgagagtgggtttt

SEQ ID NO: 8234030 - DNA, 22 bp, Homo sapiens
ggctgctctgagagtgggtttt

SEQ ID NO: 8234031 - DNA, 22 bp, Homo sapiens
ggctgctctgccttccagctgg

SEQ ID NO: 8234032 - DNA, 22 bp, Homo sapiens
ggctgctctgcacaggggctgg

SEQ ID NO: 8234033 - DNA, 22 bp, Homo sapiens
ggctgctctgcacaggggctgg

SEQ ID NO: 8234034 - DNA, 22 bp, Homo sapiens
ggctgctcttcttggcgacctc

SEQ ID NO: 8234035 - DNA, 22 bp, Homo sapiens
ggctgctcttcttggcgacctc

SEQ ID NO: 8234036 - DNA, 22 bp, Homo sapiens
ggctgctcttcttggcgacctc

SEQ ID NO: 8234037 - DNA, 22 bp, Homo sapiens
ggctgctctgccttccagctgg

SEQ ID NO: 8234038 - DNA, 22 bp, Homo sapiens
ggctgctctgccttccagctgg

SEQ ID NO: 8234039 - DNA, 22 bp, Homo sapiens
ggctgctgaacaagggaaccct

SEQ ID NO: 8234040 - DNA, 22 bp, Homo sapiens
ggctgctgaacaagggaaccct

SEQ ID NO: 8234041 - DNA, 22 bp, Homo sapiens
ggctggcctcagggtcctcgct

SEQ ID NO: 8234042 - DNA, 22 bp, Homo sapiens
ggctggcctcagggtcctcgct

SEQ ID NO: 8234043 - DNA, 23 bp, Homo sapiens
ggctggcccggggctgctcctga

SEQ ID NO: 8234044 - DNA, 23 bp, Homo sapiens
ggctggcccggggctgctcctga

SEQ ID NO: 8234045 - DNA, 22 bp, Homo sapiens
ggctggcgctctcccagcgctg

SEQ ID NO: 8234046 - DNA, 22 bp, Homo sapiens
ggctggcctctacagggaggca

SEQ ID NO: 8234047 - DNA, 22 bp, Homo sapiens
ggctggcctctacagggaggca

SEQ ID NO: 8234048 - DNA, 22 bp, Homo sapiens
ggctggcctcagggtcctcgct

SEQ ID NO: 8234049 - DNA, 22 bp, Homo sapiens
ggctggcctctacagggaggca

SEQ ID NO: 8234050 - DNA, 22 bp, Homo sapiens
ggctggcctctacagggaggca

SEQ ID NO: 8234051 - DNA, 22 bp, Homo sapiens
ggctggcgggtgggtgaaagac

SEQ ID NO: 8234052 - DNA, 22 bp, Homo sapiens
ggctggctacattggaggaagg

SEQ ID NO: 8234053 - DNA, 22 bp, Homo sapiens
ggctggctacattggaggaagg

SEQ ID NO: 8234054 - DNA, 22 bp, Homo sapiens
ggctggcttgccaagctcaggg

SEQ ID NO: 8234055 - DNA, 22 bp, Homo sapiens
ggctgtggtggcatccctgagc

SEQ ID NO: 8234056 - DNA, 22 bp, Homo sapiens
ggctgtggtggcatccctgagc

SEQ ID NO: 8234057 - DNA, 19 bp, Homo sapiens
ggctgtggtggtgccttgc

SEQ ID NO: 8234058 - DNA, 22 bp, Homo sapiens
ggctggcttgccaagctcaggg

SEQ ID NO: 8234059 - DNA, 22 bp, Homo sapiens
ggctggcttgccaagctcaggg

SEQ ID NO: 8234060 - DNA, 22 bp, Homo sapiens
ggctggcttgccaagctcaggg

SEQ ID NO: 8234061 - DNA, 22 bp, Homo sapiens
ggctggctgtgccctgtactct

SEQ ID NO: 8234062 - DNA, 22 bp, Homo sapiens
ggctggcttgccaagctcaggg

SEQ ID NO: 8234063 - DNA, 22 bp, Homo sapiens
ggctggctgtgccctgtactct

SEQ ID NO: 8234064 - DNA, 22 bp, Homo sapiens
ggctggctgtgccctgtactct

SEQ ID NO: 8234065 - DNA, 22 bp, Homo sapiens
ggctggctggcttagcagagga

SEQ ID NO: 8234066 - DNA, 22 bp, Homo sapiens
ggctggctggcttagcagagga

SEQ ID NO: 8234067 - DNA, 22 bp, Homo sapiens
ggctggctggcttagcagagga

SEQ ID NO: 8234068 - DNA, 22 bp, Homo sapiens
ggctggctggctggtagacaag

SEQ ID NO: 8234069 - DNA, 22 bp, Homo sapiens
ggctggctggctggtagacaag

SEQ ID NO: 8234070 - DNA, 22 bp, Homo sapiens
ggctggctcttaccgacagcgt

SEQ ID NO: 8234071 - DNA, 22 bp, Homo sapiens
ggctggctcttaccgacagcgt

SEQ ID NO: 8234072 - DNA, 22 bp, Homo sapiens
ggctggctgataaagggttgag

SEQ ID NO: 8234073 - DNA, 22 bp, Homo sapiens
ggctggctgataaagggttgag

SEQ ID NO: 8234074 - DNA, 22 bp, Homo sapiens
ggctggctgcatgccccctcct

SEQ ID NO: 8234075 - DNA, 22 bp, Homo sapiens
ggctggctggatgaatggatta

SEQ ID NO: 8234076 - DNA, 22 bp, Homo sapiens
ggctggctgcatgccccctcct

SEQ ID NO: 8234077 - DNA, 22 bp, Homo sapiens
ggctggctgataaagggttgag

SEQ ID NO: 8234078 - DNA, 22 bp, Homo sapiens
ggctggctcttaccgacagcgt

SEQ ID NO: 8234079 - DNA, 22 bp, Homo sapiens
ggctggctccacctaggtagct

SEQ ID NO: 8234080 - DNA, 22 bp, Homo sapiens
ggctggctatctgtggttgcct

SEQ ID NO: 8234081 - DNA, 22 bp, Homo sapiens
ggctggctcagggcttgagaga

SEQ ID NO: 8234082 - DNA, 22 bp, Homo sapiens
ggctggctcagggcttgagaga

SEQ ID NO: 8234083 - DNA, 22 bp, Homo sapiens
ggctggctatctgtggttgcct

SEQ ID NO: 8234084 - DNA, 22 bp, Homo sapiens
ggctggctatctgtggttgcct

SEQ ID NO: 8234085 - DNA, 22 bp, Homo sapiens
ggctggctacattggaggaagg

SEQ ID NO: 8234086 - DNA, 22 bp, Homo sapiens
ggcttccccacagtcctgagct

SEQ ID NO: 8234087 - DNA, 22 bp, Homo sapiens
ggcttccccacagtcctgagct

SEQ ID NO: 8234088 - DNA, 22 bp, Homo sapiens
ggcttcccctccagtgctctgt

SEQ ID NO: 8234089 - DNA, 20 bp, Homo sapiens
ggcttccccgccatcttccg

SEQ ID NO: 8234090 - DNA, 22 bp, Homo sapiens
ggcttcccctccagtgctctgt

SEQ ID NO: 8234091 - DNA, 22 bp, Homo sapiens
ggcttccctgcctcacttattc

SEQ ID NO: 8234092 - DNA, 18 bp, Homo sapiens
ggcttccctactcacttc

SEQ ID NO: 8234093 - DNA, 22 bp, Homo sapiens
ggcttccctttccgagaggaga

SEQ ID NO: 8234094 - DNA, 22 bp, Homo sapiens
ggcttccctgtttgctgtgcct

SEQ ID NO: 8234095 - DNA, 22 bp, Homo sapiens
ggcttcccaggcggtccccaca

SEQ ID NO: 8234096 - DNA, 22 bp, Homo sapiens
ggcttcccagtccctgctctca

SEQ ID NO: 8234097 - DNA, 22 bp, Homo sapiens
ggcttcccagtccctgctctca

SEQ ID NO: 8234098 - DNA, 22 bp, Homo sapiens
ggcttcccaaggagccaggatg

SEQ ID NO: 8234099 - DNA, 22 bp, Homo sapiens
ggcttcccagcagagggcgcac

SEQ ID NO: 8234100 - DNA, 22 bp, Homo sapiens
ggcttccagctgggccttggag

SEQ ID NO: 8234101 - DNA, 19 bp, Homo sapiens
ggcttcagtttagcaggct

SEQ ID NO: 8234102 - DNA, 19 bp, Homo sapiens
ggcttcagtttagcaggct

SEQ ID NO: 8234103 - DNA, 22 bp, Homo sapiens
ggcttcatttctgtccttgatt

SEQ ID NO: 8234104 - DNA, 22 bp, Homo sapiens
ggcttcagtgagctgagctcac

SEQ ID NO: 8234105 - DNA, 22 bp, Homo sapiens
ggcttcagtgagctgagctcac

SEQ ID NO: 8234106 - DNA, 22 bp, Homo sapiens
ggcttcagtgagctgagctcac

SEQ ID NO: 8234107 - DNA, 22 bp, Homo sapiens
ggcttcagtggccagagatgat

SEQ ID NO: 8234108 - DNA, 22 bp, Homo sapiens
ggcttcagtgagctgagctcac

SEQ ID NO: 8234109 - DNA, 23 bp, Homo sapiens
ggcttcagtgagagtccctgctg

SEQ ID NO: 8234110 - DNA, 22 bp, Homo sapiens
ggcttcagtgactggtgccctc

SEQ ID NO: 8234111 - DNA, 22 bp, Homo sapiens
ggcttcaggggcccagtcagca

SEQ ID NO: 8234112 - DNA, 21 bp, Homo sapiens
ggctgtgttcagggcatgcgg

SEQ ID NO: 8234113 - DNA, 22 bp, Homo sapiens
ggctgtgtggccgtgggctcta

SEQ ID NO: 8234114 - DNA, 22 bp, Homo sapiens
gggaactgtttaacaggggttt

SEQ ID NO: 8234115 - DNA, 22 bp, Homo sapiens
gggaactgtgtggtgctctgat

SEQ ID NO: 8234116 - DNA, 22 bp, Homo sapiens
gggaacagcatatctgaagggt

SEQ ID NO: 8234117 - DNA, 22 bp, Homo sapiens
gggaacagcatatctgaagggt

SEQ ID NO: 8234118 - DNA, 22 bp, Homo sapiens
gggaacagcttgggctctgcca

SEQ ID NO: 8234119 - DNA, 22 bp, Homo sapiens
gggaacagcatatctgaagggt

SEQ ID NO: 8234120 - DNA, 22 bp, Homo sapiens
gggaacagagtgccagactgac

SEQ ID NO: 8234121 - DNA, 22 bp, Homo sapiens
gggaagagaggaggtggtttcg

SEQ ID NO: 8234122 - DNA, 22 bp, Homo sapiens
gggaagagaggaggtggtttcg

SEQ ID NO: 8234123 - DNA, 22 bp, Homo sapiens
gggaagagaggaggtggtttcg

SEQ ID NO: 8234124 - DNA, 22 bp, Homo sapiens
gggaagagaccgtaccctggcc

SEQ ID NO: 8234125 - DNA, 22 bp, Homo sapiens
gggaagagaccgtaccctggcc

SEQ ID NO: 8234126 - DNA, 22 bp, Homo sapiens
gggaagagaccgtaccctggcc

SEQ ID NO: 8234127 - DNA, 22 bp, Homo sapiens
gggaagacttagtcggttcaat

SEQ ID NO: 8234128 - DNA, 22 bp, Homo sapiens
gggaagaagacatggtgaaggc

SEQ ID NO: 8234129 - DNA, 21 bp, Homo sapiens
gggaagactgtcaggattcct

SEQ ID NO: 8234130 - DNA, 18 bp, Homo sapiens
gggaagaggatctggccc

SEQ ID NO: 8234131 - DNA, 18 bp, Homo sapiens
gggaagaggatctggccc

SEQ ID NO: 8234132 - DNA, 22 bp, Homo sapiens
gggaccaggtcagggctctgac

SEQ ID NO: 8234133 - DNA, 22 bp, Homo sapiens
gggaccaggtcagggctctgac

SEQ ID NO: 8234134 - DNA, 22 bp, Homo sapiens
gggaagagatttccacatcatt

SEQ ID NO: 8234135 - DNA, 22 bp, Homo sapiens
ggcttcctccttcctgctgtca

SEQ ID NO: 8234136 - DNA, 22 bp, Homo sapiens
ggcttcctatcccatctgagtg

SEQ ID NO: 8234137 - DNA, 22 bp, Homo sapiens
ggcttcctggggcctcctgcaa

SEQ ID NO: 8234138 - DNA, 18 bp, Homo sapiens
ggcttctcactgacctca

SEQ ID NO: 8234139 - DNA, 22 bp, Homo sapiens
ggcttctcagcacactgtccac

SEQ ID NO: 8234140 - DNA, 18 bp, Homo sapiens
ggcttctcactgacctca

SEQ ID NO: 8234141 - DNA, 19 bp, Homo sapiens
ggcttcgaggctggggaag

SEQ ID NO: 8234142 - DNA, 22 bp, Homo sapiens
ggctttggggtgtgcagagatg

SEQ ID NO: 8234143 - DNA, 22 bp, Homo sapiens
ggctttgggattcagcatgaga

SEQ ID NO: 8234144 - DNA, 22 bp, Homo sapiens
ggcttctcagcacactgtccac

SEQ ID NO: 8234145 - DNA, 22 bp, Homo sapiens
gggaaaggatcagtgggaggct

SEQ ID NO: 8234146 - DNA, 22 bp, Homo sapiens
gggaaaggatttacagtttgat

SEQ ID NO: 8234147 - DNA, 22 bp, Homo sapiens
gggaaaggatttacagtttgat

SEQ ID NO: 8234148 - DNA, 22 bp, Homo sapiens
gggaaaggatttacagtttgat

SEQ ID NO: 8234149 - DNA, 22 bp, Homo sapiens
gggaaaggatttacagtttgat

SEQ ID NO: 8234150 - DNA, 22 bp, Homo sapiens
gggaaaggatcagtgggaggct

SEQ ID NO: 8234151 - DNA, 22 bp, Homo sapiens
gggaaaggatcagtgggaggct

SEQ ID NO: 8234152 - DNA, 22 bp, Homo sapiens
ggctttgtggggtgaagtaaag

SEQ ID NO: 8234153 - DNA, 22 bp, Homo sapiens
ggctttgtggggtgaagtaaag

SEQ ID NO: 8234154 - DNA, 22 bp, Homo sapiens
gggaacagagtgccagactgac

SEQ ID NO: 8234155 - DNA, 22 bp, Homo sapiens
gggaacagaggagggtgttgct

SEQ ID NO: 8234156 - DNA, 22 bp, Homo sapiens
gggaacacagacttgatgatga

SEQ ID NO: 8234157 - DNA, 22 bp, Homo sapiens
gggaaatctcgtcctctattta

SEQ ID NO: 8234158 - DNA, 22 bp, Homo sapiens
gggctggagagtcccacgtggg

SEQ ID NO: 8234159 - DNA, 16 bp, Homo sapiens
gggctggagatacagt

SEQ ID NO: 8234160 - DNA, 22 bp, Homo sapiens
gggctggagacaagtgagccgc

SEQ ID NO: 8234161 - DNA, 22 bp, Homo sapiens
gggctggagacaagtgagccgc

SEQ ID NO: 8234162 - DNA, 22 bp, Homo sapiens
gggctggaccgctcgcctccct

SEQ ID NO: 8234163 - DNA, 22 bp, Homo sapiens
gggctggactgcattgcctcgc

SEQ ID NO: 8234164 - DNA, 22 bp, Homo sapiens
gggctggaccgcgacccctgag

SEQ ID NO: 8234165 - DNA, 22 bp, Homo sapiens
gggctggagcctggcggtggtt

SEQ ID NO: 8234166 - DNA, 22 bp, Homo sapiens
gggctggagcctggcggtggtt

SEQ ID NO: 8234167 - DNA, 22 bp, Homo sapiens
gggctggagcctggcggtggtt

SEQ ID NO: 8234168 - DNA, 22 bp, Homo sapiens
gggctggatctcctgcaggcag

SEQ ID NO: 8234169 - DNA, 22 bp, Homo sapiens
gggctggagcctggcggtggtt

SEQ ID NO: 8234170 - DNA, 22 bp, Homo sapiens
gggctggagccagctgtggctg

SEQ ID NO: 8234171 - DNA, 22 bp, Homo sapiens
gggctggagccagctgtggctg

SEQ ID NO: 8234172 - DNA, 22 bp, Homo sapiens
gggctggagccagctgtggctg

SEQ ID NO: 8234173 - DNA, 22 bp, Homo sapiens
gggctggagccagctgtggctg

SEQ ID NO: 8234174 - DNA, 22 bp, Homo sapiens
gggctggagccagctgtggctg

SEQ ID NO: 8234175 - DNA, 22 bp, Homo sapiens
gggctggagccagctgtggctg

SEQ ID NO: 8234176 - DNA, 22 bp, Homo sapiens
gggctggagatgcttatggaga

SEQ ID NO: 8234177 - DNA, 22 bp, Homo sapiens
gggctggatgtttgatgacgaa

SEQ ID NO: 8234178 - DNA, 22 bp, Homo sapiens
gggctggatgtttgatgacgaa

SEQ ID NO: 8234179 - DNA, 22 bp, Homo sapiens
gggctggattactgaactgagt

SEQ ID NO: 8234180 - DNA, 22 bp, Homo sapiens
gggctggatgggagccttggcc

SEQ ID NO: 8234181 - DNA, 22 bp, Homo sapiens
gggctggatgtttgatgacgaa

SEQ ID NO: 8234182 - DNA, 22 bp, Homo sapiens
gggctggatctcctgcaggcag

SEQ ID NO: 8234183 - DNA, 17 bp, Homo sapiens
gggctggatggccatgg

SEQ ID NO: 8234184 - DNA, 22 bp, Homo sapiens
gggctggatgggagccttggcc

SEQ ID NO: 8234185 - DNA, 17 bp, Homo sapiens
gggctggatggccatgg

SEQ ID NO: 8234186 - DNA, 17 bp, Homo sapiens
gggctggatggccatgg

SEQ ID NO: 8234187 - DNA, 22 bp, Homo sapiens
gggctggcaggacctgggctga

SEQ ID NO: 8234188 - DNA, 22 bp, Homo sapiens
gggctggcaggacctgggctga

SEQ ID NO: 8234189 - DNA, 22 bp, Homo sapiens
gggctggcaggacctgggctga

SEQ ID NO: 8234190 - DNA, 22 bp, Homo sapiens
gggctggcaggacctgggctga

SEQ ID NO: 8234191 - DNA, 22 bp, Homo sapiens
gggctggcaggacctgggctga

SEQ ID NO: 8234192 - DNA, 22 bp, Homo sapiens
gggctggcaggacctgggctga

SEQ ID NO: 8234193 - DNA, 22 bp, Homo sapiens
gggctggcaggacctgggctga

SEQ ID NO: 8234194 - DNA, 22 bp, Homo sapiens
gggctggcatcagttgccgaga

SEQ ID NO: 8234195 - DNA, 22 bp, Homo sapiens
gggctggcatcagttgccgaga

SEQ ID NO: 8234196 - DNA, 22 bp, Homo sapiens
gggctggcatcggttgctgaga

SEQ ID NO: 8234197 - DNA, 22 bp, Homo sapiens
gggctggcaggacctgggctga

SEQ ID NO: 8234198 - DNA, 22 bp, Homo sapiens
gggctggcaggacctgggctga

SEQ ID NO: 8234199 - DNA, 22 bp, Homo sapiens
ggggaagggagtccaagtgtta

SEQ ID NO: 8234200 - DNA, 22 bp, Homo sapiens
ggggaagggagtccaagtgtta

SEQ ID NO: 8234201 - DNA, 22 bp, Homo sapiens
ggggaagggagtccaagtgtta

SEQ ID NO: 8234202 - DNA, 22 bp, Homo sapiens
ggggaaggattgagttgaccca

SEQ ID NO: 8234203 - DNA, 23 bp, Homo sapiens
ggggaagtggcagtgagtgaggc

SEQ ID NO: 8234204 - DNA, 23 bp, Homo sapiens
ggggaagtggcagtgagtgaggc

SEQ ID NO: 8234205 - DNA, 22 bp, Homo sapiens
ggggaatgagtgcccagaaagc

SEQ ID NO: 8234206 - DNA, 23 bp, Homo sapiens
ggggacagagggcagcccgcatc

SEQ ID NO: 8234207 - DNA, 23 bp, Homo sapiens
ggggacagagggcagcccgcatc

SEQ ID NO: 8234208 - DNA, 23 bp, Homo sapiens
ggggacagagggcagcccgcatc

SEQ ID NO: 8234209 - DNA, 23 bp, Homo sapiens
ggggacagagggcagcccgcatc

SEQ ID NO: 8234210 - DNA, 22 bp, Homo sapiens
ggggacagttaaagaccaagac

SEQ ID NO: 8234211 - DNA, 22 bp, Homo sapiens
ggggacagttaaagaccaagac

SEQ ID NO: 8234212 - DNA, 23 bp, Homo sapiens
ggggacagttcccactggggtct

SEQ ID NO: 8234213 - DNA, 23 bp, Homo sapiens
ggggacagttcccactggggtct

SEQ ID NO: 8234214 - DNA, 23 bp, Homo sapiens
ggggacagttcccactggggtct

SEQ ID NO: 8234215 - DNA, 23 bp, Homo sapiens
ggggacagttcccactggggtct

SEQ ID NO: 8234216 - DNA, 22 bp, Homo sapiens
ggggacagttaaagaccaagac

SEQ ID NO: 8234217 - DNA, 22 bp, Homo sapiens
ggggacagtcgatctagtgatt

SEQ ID NO: 8234218 - DNA, 22 bp, Homo sapiens
ggggacagtcgatctagtgatt

SEQ ID NO: 8234219 - DNA, 22 bp, Homo sapiens
ggggacagtcgatctagtgatt

SEQ ID NO: 8234220 - DNA, 22 bp, Homo sapiens
ggggacagtcgatctagtgatt

SEQ ID NO: 8234221 - DNA, 22 bp, Homo sapiens
ggggacagtcgatctagtgatt

SEQ ID NO: 8234222 - DNA, 22 bp, Homo sapiens
ggggacagtcgatctagtgatt

SEQ ID NO: 8234223 - DNA, 22 bp, Homo sapiens
gggctgcttttaagggtctcag

SEQ ID NO: 8234224 - DNA, 22 bp, Homo sapiens
gggctgcttttttcttagcaga

SEQ ID NO: 8234225 - DNA, 22 bp, Homo sapiens
gggctgcttggaggaggcgctc

SEQ ID NO: 8234226 - DNA, 22 bp, Homo sapiens
gggctgcttgctggagacagac

SEQ ID NO: 8234227 - DNA, 22 bp, Homo sapiens
gggctgcttggaggaggcgctc

SEQ ID NO: 8234228 - DNA, 22 bp, Homo sapiens
gggctgcttggaggaggcgctc

SEQ ID NO: 8234229 - DNA, 22 bp, Homo sapiens
gggctgagacgatggggtcttc

SEQ ID NO: 8234230 - DNA, 22 bp, Homo sapiens
gggctgcttatactgatgataa

SEQ ID NO: 8234231 - DNA, 22 bp, Homo sapiens
gggctgcttcctggggaatgct

SEQ ID NO: 8234232 - DNA, 22 bp, Homo sapiens
gggctgcttgctggagacagac

SEQ ID NO: 8234233 - DNA, 22 bp, Homo sapiens
gggctgcttgctggagacagac

SEQ ID NO: 8234234 - DNA, 22 bp, Homo sapiens
gggctgcttgctggagacagac

SEQ ID NO: 8234235 - DNA, 22 bp, Homo sapiens
gggctgcttgctggagacagac

SEQ ID NO: 8234236 - DNA, 22 bp, Homo sapiens
gggctggacatctaaggtagct

SEQ ID NO: 8234237 - DNA, 21 bp, Homo sapiens
gggctggacatggtggctcat

SEQ ID NO: 8234238 - DNA, 21 bp, Homo sapiens
gggctggacatggtggctcat

SEQ ID NO: 8234239 - DNA, 22 bp, Homo sapiens
gggctggacatctaaggtagct

SEQ ID NO: 8234240 - DNA, 22 bp, Homo sapiens
gggctggaagtgcattgatgct

SEQ ID NO: 8234241 - DNA, 22 bp, Homo sapiens
gggctggaagacaggaaatgct

SEQ ID NO: 8234242 - DNA, 22 bp, Homo sapiens
gggctggaagacaggaaatgct

SEQ ID NO: 8234243 - DNA, 22 bp, Homo sapiens
gggctgcttttttcttagcaga

SEQ ID NO: 8234244 - DNA, 22 bp, Homo sapiens
gggctggaaaaacaacatacaa

SEQ ID NO: 8234245 - DNA, 22 bp, Homo sapiens
gggctctgtggcttccttctta

SEQ ID NO: 8234246 - DNA, 22 bp, Homo sapiens
gggctctgtggcttccttctta

SEQ ID NO: 8234247 - DNA, 22 bp, Homo sapiens
gggctctgtggttgtgctttgt

SEQ ID NO: 8234248 - DNA, 22 bp, Homo sapiens
gggctctgtggttgtgctttgt

SEQ ID NO: 8234249 - DNA, 22 bp, Homo sapiens
gggctctgtgttctagctctcg

SEQ ID NO: 8234250 - DNA, 22 bp, Homo sapiens
gggctgagaagttgatcccaag

SEQ ID NO: 8234251 - DNA, 22 bp, Homo sapiens
gggctgagaattcagctttcct

SEQ ID NO: 8234252 - DNA, 22 bp, Homo sapiens
gggctctgtgttctagctctcg

SEQ ID NO: 8234253 - DNA, 22 bp, Homo sapiens
gggctctgtgttctagctctcg

SEQ ID NO: 8234254 - DNA, 22 bp, Homo sapiens
gggctgagaagttgatcccaag

SEQ ID NO: 8234255 - DNA, 22 bp, Homo sapiens
gggctgagaagttgatcccaag

SEQ ID NO: 8234256 - DNA, 22 bp, Homo sapiens
gggctgagacgatggggtcttc

SEQ ID NO: 8234257 - DNA, 22 bp, Homo sapiens
gggctgagaattcagctttcct

SEQ ID NO: 8234258 - DNA, 22 bp, Homo sapiens
gggctgagaattcagctttcct

SEQ ID NO: 8234259 - DNA, 22 bp, Homo sapiens
gggctgagaattcagctttcct

SEQ ID NO: 8234260 - DNA, 22 bp, Homo sapiens
gggctgagaattcagctttcct

SEQ ID NO: 8234261 - DNA, 22 bp, Homo sapiens
gggctgagaattcagctttcct

SEQ ID NO: 8234262 - DNA, 22 bp, Homo sapiens
gggctgagacgatggggtcttc

SEQ ID NO: 8234263 - DNA, 22 bp, Homo sapiens
gggctgagacgatggggtcttc

SEQ ID NO: 8234264 - DNA, 22 bp, Homo sapiens
gggctgagacgatggggtcttc

SEQ ID NO: 8234265 - DNA, 22 bp, Homo sapiens
gggctgagaattcagctttcct

SEQ ID NO: 8234266 - DNA, 22 bp, Homo sapiens
gggctgagacgatggggtcttc

SEQ ID NO: 8234267 - DNA, 22 bp, Homo sapiens
gggctctgtggatgtgagagct

SEQ ID NO: 8234268 - DNA, 22 bp, Homo sapiens
gggctctgtggcttccttctta

SEQ ID NO: 8234269 - DNA, 22 bp, Homo sapiens
gggctctgtggcttccttctta

SEQ ID NO: 8234270 - DNA, 22 bp, Homo sapiens
gggctctgtggcttccttctta

SEQ ID NO: 8234271 - DNA, 22 bp, Homo sapiens
gggctctgtggatgtgagagct

SEQ ID NO: 8234272 - DNA, 22 bp, Homo sapiens
gggctctgtggatgtgagagct

SEQ ID NO: 8234273 - DNA, 22 bp, Homo sapiens
gggctctgtggatgtgagagct

SEQ ID NO: 8234274 - DNA, 22 bp, Homo sapiens
gggctctgtggatgtgagagct

SEQ ID NO: 8234275 - DNA, 22 bp, Homo sapiens
gggctctgtccattccttcata

SEQ ID NO: 8234276 - DNA, 22 bp, Homo sapiens
gggctctgtgcaccccagcacc

SEQ ID NO: 8234277 - DNA, 22 bp, Homo sapiens
gggctctgtccattccttcata

SEQ ID NO: 8234278 - DNA, 22 bp, Homo sapiens
gggctctgtgcaccccagcacc

SEQ ID NO: 8234279 - DNA, 22 bp, Homo sapiens
gggctctgtgcaccccagcacc

SEQ ID NO: 8234280 - DNA, 22 bp, Homo sapiens
gggctctgtgcaccccagcacc

SEQ ID NO: 8234281 - DNA, 22 bp, Homo sapiens
gggctctggtcctgaactgaag

SEQ ID NO: 8234282 - DNA, 22 bp, Homo sapiens
gggctctggtcctgaactgaag

SEQ ID NO: 8234283 - DNA, 22 bp, Homo sapiens
gggctctggtcctgaactgaag

SEQ ID NO: 8234284 - DNA, 22 bp, Homo sapiens
gggctctggtcctgaactgaag

SEQ ID NO: 8234285 - DNA, 22 bp, Homo sapiens
gggctctggtacttcctggctc

SEQ ID NO: 8234286 - DNA, 22 bp, Homo sapiens
gggctctggtacttcctggctc

SEQ ID NO: 8234287 - DNA, 22 bp, Homo sapiens
gggctctggtacttcctggctc

SEQ ID NO: 8234288 - DNA, 20 bp, Homo sapiens
gggctctgtaaggttgaaag

SEQ ID NO: 8234289 - DNA, 22 bp, Homo sapiens
gggctctgtccattccttcata

SEQ ID NO: 8234290 - DNA, 22 bp, Homo sapiens
gggctctgtccattccttcata

SEQ ID NO: 8234291 - DNA, 20 bp, Homo sapiens
gggctctgtaaggttgaaag

SEQ ID NO: 8234292 - DNA, 20 bp, Homo sapiens
gggctctgtaaggttgaaag

SEQ ID NO: 8234293 - DNA, 22 bp, Homo sapiens
gggctctggtgctattgacgaa

SEQ ID NO: 8234294 - DNA, 22 bp, Homo sapiens
gggctctggtgccttcacagaa

SEQ ID NO: 8234295 - DNA, 22 bp, Homo sapiens
gggctctggtgccttcacagaa

SEQ ID NO: 8234296 - DNA, 22 bp, Homo sapiens
gggctctggtgctattgacgaa

SEQ ID NO: 8234297 - DNA, 18 bp, Homo sapiens
gggctaggcaaggaccac

SEQ ID NO: 8234298 - DNA, 22 bp, Homo sapiens
gggctagcctcttccctgctcc

SEQ ID NO: 8234299 - DNA, 22 bp, Homo sapiens
gggctagcctcttccctgctcc

SEQ ID NO: 8234300 - DNA, 20 bp, Homo sapiens
gggctagaccagggcagagg

SEQ ID NO: 8234301 - DNA, 20 bp, Homo sapiens
gggctagaccagggcagagg

SEQ ID NO: 8234302 - DNA, 22 bp, Homo sapiens
gggctagcctcttccctgctcc

SEQ ID NO: 8234303 - DNA, 22 bp, Homo sapiens
gggctctgggtcgtgtctccat

SEQ ID NO: 8234304 - DNA, 22 bp, Homo sapiens
gggctctgggtcgtgtctccat

SEQ ID NO: 8234305 - DNA, 22 bp, Homo sapiens
gggctctggtacttcctggctc

SEQ ID NO: 8234306 - DNA, 22 bp, Homo sapiens
gggctctggtacttcctggctc

SEQ ID NO: 8234307 - DNA, 22 bp, Homo sapiens
gggctctggtacttcctggctc

SEQ ID NO: 8234308 - DNA, 22 bp, Homo sapiens
gggctctggtacttcctggctc

SEQ ID NO: 8234309 - DNA, 22 bp, Homo sapiens
gggctaggcttggccagcactg

SEQ ID NO: 8234310 - DNA, 20 bp, Homo sapiens
gggctaggtagccatttggc

SEQ ID NO: 8234311 - DNA, 22 bp, Homo sapiens
ggggggtgacaagtagaggttg

SEQ ID NO: 8234312 - DNA, 22 bp, Homo sapiens
ggggggtgacaagtagaggttg

SEQ ID NO: 8234313 - DNA, 22 bp, Homo sapiens
ggggggtgacaagtagaggttg

SEQ ID NO: 8234314 - DNA, 22 bp, Homo sapiens
ggggggctgttctggacaggaa

SEQ ID NO: 8234315 - DNA, 22 bp, Homo sapiens
gggggtaggcagacaaggacat

SEQ ID NO: 8234316 - DNA, 22 bp, Homo sapiens
gggggtgacgatggcagctggt

SEQ ID NO: 8234317 - DNA, 22 bp, Homo sapiens
gggggtgacgatggcagctggt

SEQ ID NO: 8234318 - DNA, 22 bp, Homo sapiens
gggggtgacgatggcagctggt

SEQ ID NO: 8234319 - DNA, 22 bp, Homo sapiens
ggggggtgctgatcagtggagc

SEQ ID NO: 8234320 - DNA, 22 bp, Homo sapiens
gggggtggttctaagtcctata

SEQ ID NO: 8234321 - DNA, 22 bp, Homo sapiens
gggggtgaggacaggagcactg

SEQ ID NO: 8234322 - DNA, 16 bp, Homo sapiens
gggggtgagagagagt

SEQ ID NO: 8234323 - DNA, 22 bp, Homo sapiens
gggggtgagcctgccaggccca

SEQ ID NO: 8234324 - DNA, 22 bp, Homo sapiens
gggtccaggcgtggcccagatg

SEQ ID NO: 8234325 - DNA, 22 bp, Homo sapiens
gggtccagggccagtggctgag

SEQ ID NO: 8234326 - DNA, 22 bp, Homo sapiens
ggggtaggcaggtgatctgatc

SEQ ID NO: 8234327 - DNA, 22 bp, Homo sapiens
ggggtaggaagagaaaatagtg

SEQ ID NO: 8234328 - DNA, 20 bp, Homo sapiens
gggtccaggactctgaattt

SEQ ID NO: 8234329 - DNA, 22 bp, Homo sapiens
gggtccagctacatcagggtgg

SEQ ID NO: 8234330 - DNA, 22 bp, Homo sapiens
ggggaccctcaggactgcgtct

SEQ ID NO: 8234331 - DNA, 22 bp, Homo sapiens
ggggaccctcaggactgcgtct

SEQ ID NO: 8234332 - DNA, 22 bp, Homo sapiens
ggggaccctcaggactgcgtct

SEQ ID NO: 8234333 - DNA, 22 bp, Homo sapiens
gggggctccaggcgagaatgtg

SEQ ID NO: 8234334 - DNA, 22 bp, Homo sapiens
ggggactgaggcactgaaggtg

SEQ ID NO: 8234335 - DNA, 22 bp, Homo sapiens
ggggactgccttccacagacac

SEQ ID NO: 8234336 - DNA, 22 bp, Homo sapiens
gggggctggactttcccacaca

SEQ ID NO: 8234337 - DNA, 22 bp, Homo sapiens
gggggctggactttcccacaca

SEQ ID NO: 8234338 - DNA, 23 bp, Homo sapiens
gggggctggttgactctctgcag

SEQ ID NO: 8234339 - DNA, 22 bp, Homo sapiens
gggggctggaatatccatcaac

SEQ ID NO: 8234340 - DNA, 22 bp, Homo sapiens
gggggctgatcatttactgggc

SEQ ID NO: 8234341 - DNA, 22 bp, Homo sapiens
gggggctgatcatttactgggc

SEQ ID NO: 8234342 - DNA, 22 bp, Homo sapiens
gggggctgaggctgttctgagg

SEQ ID NO: 8234343 - DNA, 22 bp, Homo sapiens
gggtgggcccagcccagagaag

SEQ ID NO: 8234344 - DNA, 22 bp, Homo sapiens
gggtgggcccagcccagagaag

SEQ ID NO: 8234345 - DNA, 22 bp, Homo sapiens
gggtgggccccaggtatctgta

SEQ ID NO: 8234346 - DNA, 22 bp, Homo sapiens
gggtgggcctgtctggccatgt

SEQ ID NO: 8234347 - DNA, 22 bp, Homo sapiens
gggtgggcctgtctggccatgt

SEQ ID NO: 8234348 - DNA, 22 bp, Homo sapiens
gggtgggccactgagcagcgtg

SEQ ID NO: 8234349 - DNA, 23 bp, Homo sapiens
gggtgggccaaattaggtagcct

SEQ ID NO: 8234350 - DNA, 23 bp, Homo sapiens
gggtgggccaaattaggtagcct

SEQ ID NO: 8234351 - DNA, 23 bp, Homo sapiens
gggtgggccaaattaggtagcct

SEQ ID NO: 8234352 - DNA, 23 bp, Homo sapiens
gggtgggccaaattaggtagcct

SEQ ID NO: 8234353 - DNA, 17 bp, Homo sapiens
gggtgggcactgctggc

SEQ ID NO: 8234354 - DNA, 17 bp, Homo sapiens
gggtgggcactgctggc

SEQ ID NO: 8234355 - DNA, 22 bp, Homo sapiens
gggtgggatggcaggagccgct

SEQ ID NO: 8234356 - DNA, 22 bp, Homo sapiens
gggtgggatggcaggagccgct

SEQ ID NO: 8234357 - DNA, 20 bp, Homo sapiens
gggtgagatgtaggagaggg

SEQ ID NO: 8234358 - DNA, 19 bp, Homo sapiens
gggtgaggaagagcgttgc

SEQ ID NO: 8234359 - DNA, 22 bp, Homo sapiens
gggtgaggagctgccagtcatg

SEQ ID NO: 8234360 - DNA, 22 bp, Homo sapiens
gggtgaggagctgccagtcatg

SEQ ID NO: 8234361 - DNA, 22 bp, Homo sapiens
gggtgaggagctgccagtcatg

SEQ ID NO: 8234362 - DNA, 22 bp, Homo sapiens
gggtgggaacaggatgccagga

SEQ ID NO: 8234363 - DNA, 22 bp, Homo sapiens
gggtgggaacaggatgccagga

SEQ ID NO: 8234364 - DNA, 22 bp, Homo sapiens
gggtggctgagaacaggacccc

SEQ ID NO: 8234365 - DNA, 22 bp, Homo sapiens
gggtgggatgccgctgtctcca

SEQ ID NO: 8234366 - DNA, 22 bp, Homo sapiens
gggtgggatgccgctgtctcca

SEQ ID NO: 8234367 - DNA, 22 bp, Homo sapiens
gggtgggatggcaggagccgct

SEQ ID NO: 8234368 - DNA, 22 bp, Homo sapiens
gggtgaagctcctgcaggggcc

SEQ ID NO: 8234369 - DNA, 22 bp, Homo sapiens
gggtctgggcaggcgcttcctc

SEQ ID NO: 8234370 - DNA, 22 bp, Homo sapiens
gggtctgggcaggcgcttcctc

SEQ ID NO: 8234371 - DNA, 22 bp, Homo sapiens
gggtctggcatgctgagatgga

SEQ ID NO: 8234372 - DNA, 22 bp, Homo sapiens
gggtctggagggcagcccttct

SEQ ID NO: 8234373 - DNA, 22 bp, Homo sapiens
gggtctggcatgctgagatgga

SEQ ID NO: 8234374 - DNA, 22 bp, Homo sapiens
gggtctggcatgctgagatgga

SEQ ID NO: 8234375 - DNA, 22 bp, Homo sapiens
gggtctggcatgctgagatgga

SEQ ID NO: 8234376 - DNA, 22 bp, Homo sapiens
gggtctggcatgctgagatgga

SEQ ID NO: 8234377 - DNA, 22 bp, Homo sapiens
gggtctggcatgctgagatgga

SEQ ID NO: 8234378 - DNA, 22 bp, Homo sapiens
gggtgacattaggaagatagac

SEQ ID NO: 8234379 - DNA, 22 bp, Homo sapiens
gggtgacattaggaagatagac

SEQ ID NO: 8234380 - DNA, 22 bp, Homo sapiens
gggtgacatagtgatggggcat

SEQ ID NO: 8234381 - DNA, 22 bp, Homo sapiens
gggtgaagctcctgcaggggcc

SEQ ID NO: 8234382 - DNA, 22 bp, Homo sapiens
gggtgaagctcctgcaggggcc

SEQ ID NO: 8234383 - DNA, 22 bp, Homo sapiens
gggtctggagggcagcccttct

SEQ ID NO: 8234384 - DNA, 22 bp, Homo sapiens
gggtctggagatccgggtgaag

SEQ ID NO: 8234385 - DNA, 22 bp, Homo sapiens
gggtctggagatccgggtgaag

SEQ ID NO: 8234386 - DNA, 22 bp, Homo sapiens
gggtctggacggctgcaggaag

SEQ ID NO: 8234387 - DNA, 22 bp, Homo sapiens
gggtctggacggctgcaggaag

SEQ ID NO: 8234388 - DNA, 22 bp, Homo sapiens
gggtctggacggctgcaggaag

SEQ ID NO: 8234389 - DNA, 22 bp, Homo sapiens
gggtctggacggctgcaggaag

SEQ ID NO: 8234390 - DNA, 22 bp, Homo sapiens
gggtctggacggctgcaggaag

SEQ ID NO: 8234391 - DNA, 22 bp, Homo sapiens
gggtctggacggctgcaggaag

SEQ ID NO: 8234392 - DNA, 22 bp, Homo sapiens
gggtctccatgttaacatcact

SEQ ID NO: 8234393 - DNA, 22 bp, Homo sapiens
gggtctcctgagagaagatgct

SEQ ID NO: 8234394 - DNA, 22 bp, Homo sapiens
gggtctctcagaaggctgcaat

SEQ ID NO: 8234395 - DNA, 22 bp, Homo sapiens
gggtctctcatgcagttgctgt

SEQ ID NO: 8234396 - DNA, 22 bp, Homo sapiens
gggtctctcagaaggctgcaat

SEQ ID NO: 8234397 - DNA, 22 bp, Homo sapiens
gggtctctctcggctccacgcg

SEQ ID NO: 8234398 - DNA, 22 bp, Homo sapiens
gggtctctgagcttccaagata

SEQ ID NO: 8234399 - DNA, 22 bp, Homo sapiens
gggtctctgagcttccaagata

SEQ ID NO: 8234400 - DNA, 22 bp, Homo sapiens
gggtctctcctccccagctgtg

SEQ ID NO: 8234401 - DNA, 22 bp, Homo sapiens
gggtctctctcggctccacgcg

SEQ ID NO: 8234402 - DNA, 22 bp, Homo sapiens
gggtctctcctccccagctgtg

SEQ ID NO: 8234403 - DNA, 22 bp, Homo sapiens
gggtctctcctccccagctgtg

SEQ ID NO: 8234404 - DNA, 22 bp, Homo sapiens
gggaggctggctctggccacag

SEQ ID NO: 8234405 - DNA, 22 bp, Homo sapiens
gggaggctggctctggccacag

SEQ ID NO: 8234406 - DNA, 22 bp, Homo sapiens
gggaggcttgagccatactgcc

SEQ ID NO: 8234407 - DNA, 22 bp, Homo sapiens
gggaggcttgagccatactgcc

SEQ ID NO: 8234408 - DNA, 22 bp, Homo sapiens
gggagggaaagcttgatctgtc

SEQ ID NO: 8234409 - DNA, 22 bp, Homo sapiens
gggagggaaagcttgatctgtc

SEQ ID NO: 8234410 - DNA, 22 bp, Homo sapiens
gggagggaaggaccttatgaat

SEQ ID NO: 8234411 - DNA, 22 bp, Homo sapiens
gggagggaaagcttgatctgtc

SEQ ID NO: 8234412 - DNA, 22 bp, Homo sapiens
gggagggaaggaggcgccgtgt

SEQ ID NO: 8234413 - DNA, 22 bp, Homo sapiens
gggagggaaggtacctgtgtga

SEQ ID NO: 8234414 - DNA, 22 bp, Homo sapiens
gggagggaaggtacctgtgtga

SEQ ID NO: 8234415 - DNA, 22 bp, Homo sapiens
gggatgaggatcaatcagggag

SEQ ID NO: 8234416 - DNA, 22 bp, Homo sapiens
gggatctgagtaggcagaagct

SEQ ID NO: 8234417 - DNA, 22 bp, Homo sapiens
gggatgaggatcaatcagggag

SEQ ID NO: 8234418 - DNA, 22 bp, Homo sapiens
gggatgataatgccagagttaa

SEQ ID NO: 8234419 - DNA, 22 bp, Homo sapiens
gggatgccagtcctggccctgc

SEQ ID NO: 8234420 - DNA, 22 bp, Homo sapiens
gggatggctttgtggctgactc

SEQ ID NO: 8234421 - DNA, 22 bp, Homo sapiens
gggatgggagagcatttagaga

SEQ ID NO: 8234422 - DNA, 19 bp, Homo sapiens
gggatgggccctcaccctc

SEQ ID NO: 8234423 - DNA, 22 bp, Homo sapiens
gggatggggagctggaaagggg

SEQ ID NO: 8234424 - DNA, 22 bp, Homo sapiens
gggatggggagctggaaagggg

SEQ ID NO: 8234425 - DNA, 22 bp, Homo sapiens
gggatggggagctggaaagggg

SEQ ID NO: 8234426 - DNA, 22 bp, Homo sapiens
gggcagaggggcgcttccctct

SEQ ID NO: 8234427 - DNA, 22 bp, Homo sapiens
gggcagaggggcgcttccctct

SEQ ID NO: 8234428 - DNA, 22 bp, Homo sapiens
gggatggggagctggaaagggg

SEQ ID NO: 8234429 - DNA, 22 bp, Homo sapiens
gggatggggagctggaaagggg

SEQ ID NO: 8234430 - DNA, 22 bp, Homo sapiens
gggatggggagctggaaagggg

SEQ ID NO: 8234431 - DNA, 22 bp, Homo sapiens
gggcagaggggcgcttccctct

SEQ ID NO: 8234432 - DNA, 22 bp, Homo sapiens
gggatggcctagactagcttgg

SEQ ID NO: 8234433 - DNA, 22 bp, Homo sapiens
gggatggcctagactagcttgg

SEQ ID NO: 8234434 - DNA, 22 bp, Homo sapiens
gggatggatcttggctgaggct

SEQ ID NO: 8234435 - DNA, 22 bp, Homo sapiens
gggatggctcaaaggagtcagg

SEQ ID NO: 8234436 - DNA, 22 bp, Homo sapiens
gggatggctcaaaggagtcagg

SEQ ID NO: 8234437 - DNA, 22 bp, Homo sapiens
gggatggctcaaaggagtcagg

SEQ ID NO: 8234438 - DNA, 22 bp, Homo sapiens
gggatggctgcctgcatcagga

SEQ ID NO: 8234439 - DNA, 22 bp, Homo sapiens
gggatggctcaaaggagtcagg

SEQ ID NO: 8234440 - DNA, 22 bp, Homo sapiens
gggatggatcttggctgaggct

SEQ ID NO: 8234441 - DNA, 22 bp, Homo sapiens
gggatggagggtagagcaagtg

SEQ ID NO: 8234442 - DNA, 22 bp, Homo sapiens
gggatggatcttggctgaggct

SEQ ID NO: 8234443 - DNA, 22 bp, Homo sapiens
gggatggatcttggctgaggct

SEQ ID NO: 8234444 - DNA, 22 bp, Homo sapiens
gggatggatcttggctgaggct

SEQ ID NO: 8234445 - DNA, 22 bp, Homo sapiens
gggatggagggtagagcaagtg

SEQ ID NO: 8234446 - DNA, 22 bp, Homo sapiens
gggatggacttggggactccag

SEQ ID NO: 8234447 - DNA, 22 bp, Homo sapiens
gggatggagggtagagcaagtg

SEQ ID NO: 8234448 - DNA, 22 bp, Homo sapiens
gggatggactgacggtagcgcg

SEQ ID NO: 8234449 - DNA, 22 bp, Homo sapiens
gggatggactgacggtagcgcg

SEQ ID NO: 8234450 - DNA, 22 bp, Homo sapiens
gggatggactgacggtagcgcg

SEQ ID NO: 8234451 - DNA, 22 bp, Homo sapiens
gggaggcgccgagggtagctaa

SEQ ID NO: 8234452 - DNA, 22 bp, Homo sapiens
gggaggcgccgagggtagctaa

SEQ ID NO: 8234453 - DNA, 18 bp, Homo sapiens
gggaggccccagcaggag

SEQ ID NO: 8234454 - DNA, 20 bp, Homo sapiens
gggaggcgagggctgagcag

SEQ ID NO: 8234455 - DNA, 20 bp, Homo sapiens
gggaggcgagggctgagcag

SEQ ID NO: 8234456 - DNA, 17 bp, Homo sapiens
gggaggccttggtttcc

SEQ ID NO: 8234457 - DNA, 22 bp, Homo sapiens
gggaggctcagtggtgtcctct

SEQ ID NO: 8234458 - DNA, 22 bp, Homo sapiens
gggaggctctgctcagcccccg

SEQ ID NO: 8234459 - DNA, 22 bp, Homo sapiens
gggaggctgccatccttcagga

SEQ ID NO: 8234460 - DNA, 22 bp, Homo sapiens
gggaggctgccatccttcagga

SEQ ID NO: 8234461 - DNA, 22 bp, Homo sapiens
gggaggctctgctcagcccccg

SEQ ID NO: 8234462 - DNA, 20 bp, Homo sapiens
gggagaagggctgatgagag

SEQ ID NO: 8234463 - DNA, 22 bp, Homo sapiens
gggagaaggaggactgtgctgt

SEQ ID NO: 8234464 - DNA, 22 bp, Homo sapiens
gggagaaggaggactgtgctgt

SEQ ID NO: 8234465 - DNA, 22 bp, Homo sapiens
gggaggagggtgctggctaaac

SEQ ID NO: 8234466 - DNA, 22 bp, Homo sapiens
gggaggaggaatgttttgtgta

SEQ ID NO: 8234467 - DNA, 22 bp, Homo sapiens
gggaggagggtgctggctaaac

SEQ ID NO: 8234468 - DNA, 22 bp, Homo sapiens
gggacgagccccaggctggagg

SEQ ID NO: 8234469 - DNA, 22 bp, Homo sapiens
gggacgagccccaggctggagg

SEQ ID NO: 8234470 - DNA, 22 bp, Homo sapiens
gggacgagatcttggcagtgtg

SEQ ID NO: 8234471 - DNA, 22 bp, Homo sapiens
gggacgagatcttggcagtgtg

SEQ ID NO: 8234472 - DNA, 22 bp, Homo sapiens
gggacgacaggctctgtggtag

SEQ ID NO: 8234473 - DNA, 22 bp, Homo sapiens
gggacgggcagtccaaggggtc

SEQ ID NO: 8234474 - DNA, 22 bp, Homo sapiens
gggacgtgagtgaagaaggtct

SEQ ID NO: 8234475 - DNA, 22 bp, Homo sapiens
gggactccataagcacatggat

SEQ ID NO: 8234476 - DNA, 22 bp, Homo sapiens
gggactccaaaactgtacccaa

SEQ ID NO: 8234477 - DNA, 22 bp, Homo sapiens
gggactccagggccactgggcc

SEQ ID NO: 8234478 - DNA, 22 bp, Homo sapiens
gggagaagaatgtgtcaattgt

SEQ ID NO: 8234479 - DNA, 22 bp, Homo sapiens
gggagaagaatgtgtcaattgt

SEQ ID NO: 8234480 - DNA, 22 bp, Homo sapiens
gggagaaggagctagttcttga

SEQ ID NO: 8234481 - DNA, 22 bp, Homo sapiens
gggagaactgggtggagcatct

SEQ ID NO: 8234482 - DNA, 22 bp, Homo sapiens
gggactccataagcacatggat

SEQ ID NO: 8234483 - DNA, 22 bp, Homo sapiens
gggagaaatgtctggcctgctg

SEQ ID NO: 8234484 - DNA, 22 bp, Homo sapiens
gggacctggcgagggtcacaca

SEQ ID NO: 8234485 - DNA, 22 bp, Homo sapiens
gggacctgcgccactcactgtc

SEQ ID NO: 8234486 - DNA, 22 bp, Homo sapiens
gggacctgcgccactcactgtc

SEQ ID NO: 8234487 - DNA, 22 bp, Homo sapiens
gggacctgccaaggccacccag

SEQ ID NO: 8234488 - DNA, 22 bp, Homo sapiens
gggacctgccaaggccacccag

SEQ ID NO: 8234489 - DNA, 22 bp, Homo sapiens
gggacctgccattgctcacagg

SEQ ID NO: 8234490 - DNA, 22 bp, Homo sapiens
gggacctggtctagcactgagc

SEQ ID NO: 8234491 - DNA, 22 bp, Homo sapiens
gggacctgggccagaggacagt

SEQ ID NO: 8234492 - DNA, 22 bp, Homo sapiens
gggacctggcgagggtcacaca

SEQ ID NO: 8234493 - DNA, 22 bp, Homo sapiens
gggcagcctgctttctgatcca

SEQ ID NO: 8234494 - DNA, 22 bp, Homo sapiens
gggcagcctcggtgcctgctgc

SEQ ID NO: 8234495 - DNA, 22 bp, Homo sapiens
gggcagcctcggtgcctgctgc

SEQ ID NO: 8234496 - DNA, 22 bp, Homo sapiens
gggcagctcctgtggaatccac

SEQ ID NO: 8234497 - DNA, 22 bp, Homo sapiens
gggcagctcggaagtgggaaag

SEQ ID NO: 8234498 - DNA, 22 bp, Homo sapiens
gggccacaggagaggctgtcag

SEQ ID NO: 8234499 - DNA, 21 bp, Homo sapiens
gggccacaccttctgcagacc

SEQ ID NO: 8234500 - DNA, 22 bp, Homo sapiens
gggccaggtggaccccagcctc

SEQ ID NO: 8234501 - DNA, 22 bp, Homo sapiens
gggccagtctgactctgctggt

SEQ ID NO: 8234502 - DNA, 22 bp, Homo sapiens
gggccagtagcacctgtgtgga

SEQ ID NO: 8234503 - DNA, 22 bp, Homo sapiens
gggccaggtcggtgaatggtca

SEQ ID NO: 8234504 - DNA, 22 bp, Homo sapiens
gggccaggtggaccccagcctc

SEQ ID NO: 8234505 - DNA, 22 bp, Homo sapiens
gggccaggtatcgtctttagta

SEQ ID NO: 8234506 - DNA, 22 bp, Homo sapiens
gggccaggagtggagatatggg

SEQ ID NO: 8234507 - DNA, 22 bp, Homo sapiens
gggccacaggccttgcccgcag

SEQ ID NO: 8234508 - DNA, 22 bp, Homo sapiens
gggcagaggttcaacttcaaca

SEQ ID NO: 8234509 - DNA, 18 bp, Homo sapiens
gggcagcacagcagcctc

SEQ ID NO: 8234510 - DNA, 20 bp, Homo sapiens
gggcagcaagacatttgaca

SEQ ID NO: 8234511 - DNA, 22 bp, Homo sapiens
gggcagcaaatctgagtctggt

SEQ ID NO: 8234512 - DNA, 22 bp, Homo sapiens
gggcagcacgtttcaggaggat

SEQ ID NO: 8234513 - DNA, 22 bp, Homo sapiens
gggcagcacgtttcaggaggat

SEQ ID NO: 8234514 - DNA, 22 bp, Homo sapiens
gggcagcacgtttcaggaggat

SEQ ID NO: 8234515 - DNA, 21 bp, Homo sapiens
gggcagcacgtcattcctgtg

SEQ ID NO: 8234516 - DNA, 22 bp, Homo sapiens
gggcagcagaattggacagaaa

SEQ ID NO: 8234517 - DNA, 20 bp, Homo sapiens
gggcagcctcgggagtgggt

SEQ ID NO: 8234518 - DNA, 22 bp, Homo sapiens
gggcagccgcgtgacctgccag

SEQ ID NO: 8234519 - DNA, 22 bp, Homo sapiens
gggcagccgcgtgacctgccag

SEQ ID NO: 8234520 - DNA, 22 bp, Homo sapiens
gggcagccccagcgcgttggct

SEQ ID NO: 8234521 - DNA, 20 bp, Homo sapiens
gggcagcctcgggagtgggt

SEQ ID NO: 8234522 - DNA, 20 bp, Homo sapiens
gggcagcctcgggagtgggt

SEQ ID NO: 8234523 - DNA, 20 bp, Homo sapiens
gggcagcctcgggagtgggt

SEQ ID NO: 8234524 - DNA, 20 bp, Homo sapiens
gggcagcctcgggagtgggt

SEQ ID NO: 8234525 - DNA, 22 bp, Homo sapiens
gggcgtcctggaccctcccctg

SEQ ID NO: 8234526 - DNA, 22 bp, Homo sapiens
gggcgtggatggtcagtgcagg

SEQ ID NO: 8234527 - DNA, 22 bp, Homo sapiens
gggcgtggatggtcagtgcagg

SEQ ID NO: 8234528 - DNA, 22 bp, Homo sapiens
gggctagaaattctgcagtgga

SEQ ID NO: 8234529 - DNA, 22 bp, Homo sapiens
gggctagaagttagctagagaa

SEQ ID NO: 8234530 - DNA, 22 bp, Homo sapiens
gggctagaagttagctagagaa

SEQ ID NO: 8234531 - DNA, 22 bp, Homo sapiens
gggctagaagttagctagagaa

SEQ ID NO: 8234532 - DNA, 22 bp, Homo sapiens
gggcggggggagctggaatgaa

SEQ ID NO: 8234533 - DNA, 22 bp, Homo sapiens
gggcggggggagctggaatgaa

SEQ ID NO: 8234534 - DNA, 22 bp, Homo sapiens
gggcggatcatttgaggtcagg

SEQ ID NO: 8234535 - DNA, 22 bp, Homo sapiens
gggcggatcatttgaggtcagg

SEQ ID NO: 8234536 - DNA, 22 bp, Homo sapiens
gggcggatcacctgaggtcagg

SEQ ID NO: 8234537 - DNA, 22 bp, Homo sapiens
gggcggatcacctgaggtcagg

SEQ ID NO: 8234538 - DNA, 22 bp, Homo sapiens
gggcggatcacctgaggtcagg

SEQ ID NO: 8234539 - DNA, 22 bp, Homo sapiens
gggcggatcatttgaggtcagg

SEQ ID NO: 8234540 - DNA, 22 bp, Homo sapiens
gggcctgtctcactccctggtt

SEQ ID NO: 8234541 - DNA, 22 bp, Homo sapiens
gggcctgtgcacagttctgtta

SEQ ID NO: 8234542 - DNA, 22 bp, Homo sapiens
gggcctgtgtgttcaggagcct

SEQ ID NO: 8234543 - DNA, 22 bp, Homo sapiens
gggcctgttcatgccaccggga

SEQ ID NO: 8234544 - DNA, 19 bp, Homo sapiens
gggcccagcatggagggtt

SEQ ID NO: 8234545 - DNA, 19 bp, Homo sapiens
gggcccagcatggagggtt

SEQ ID NO: 8234546 - DNA, 22 bp, Homo sapiens
gggcccagccctctgctcactg

SEQ ID NO: 8234547 - DNA, 22 bp, Homo sapiens
gggcccagccctctgctcactg

SEQ ID NO: 8234548 - DNA, 22 bp, Homo sapiens
gggccagttctccgcctctttt

SEQ ID NO: 8234549 - DNA, 22 bp, Homo sapiens
gggccagttctccgcctctttt

SEQ ID NO: 8234550 - DNA, 22 bp, Homo sapiens
gggccagtgggacctgggtctc

SEQ ID NO: 8234551 - DNA, 22 bp, Homo sapiens
gggccagtgagtcgggagagct

SEQ ID NO: 8234552 - DNA, 22 bp, Homo sapiens
gggccagtgaacaatgagggaa

SEQ ID NO: 8234553 - DNA, 22 bp, Homo sapiens
gggccagtgagtcgggagagct

SEQ ID NO: 8234554 - DNA, 22 bp, Homo sapiens
gggccagtgaacaatgagggaa

SEQ ID NO: 8234555 - DNA, 22 bp, Homo sapiens
gggccatgagaggttcatcaac

SEQ ID NO: 8234556 - DNA, 22 bp, Homo sapiens
gggccatgagaggttcatcaac

SEQ ID NO: 8234557 - DNA, 23 bp, Homo sapiens
gggcccagcacaggacctggcag

SEQ ID NO: 8234558 - DNA, 23 bp, Homo sapiens
gggcccagcacaggacctggcag

SEQ ID NO: 8234559 - DNA, 23 bp, Homo sapiens
gggcccagcacaggacctggcag

SEQ ID NO: 8234560 - DNA, 22 bp, Homo sapiens
gggcccagcactggctgggatc

SEQ ID NO: 8234561 - DNA, 22 bp, Homo sapiens
gataccagacagggagggagaa

SEQ ID NO: 8234562 - DNA, 22 bp, Homo sapiens
gataccagacagggagggagaa

SEQ ID NO: 8234563 - DNA, 22 bp, Homo sapiens
gatacataaaaatgtgctctat

SEQ ID NO: 8234564 - DNA, 22 bp, Homo sapiens
gatacattccatttctacttaa

SEQ ID NO: 8234565 - DNA, 22 bp, Homo sapiens
gatacattccatttctacttaa

SEQ ID NO: 8234566 - DNA, 22 bp, Homo sapiens
gatacagatctttaactgccct

SEQ ID NO: 8234567 - DNA, 21 bp, Homo sapiens
gatacagagggccactgattg

SEQ ID NO: 8234568 - DNA, 22 bp, Homo sapiens
gatacagatctttaactgccct

SEQ ID NO: 8234569 - DNA, 22 bp, Homo sapiens
gatacacattttagctttgtct

SEQ ID NO: 8234570 - DNA, 22 bp, Homo sapiens
gatacacattttagctttgtct

SEQ ID NO: 8234571 - DNA, 20 bp, Homo sapiens
gatacacagcacagagggcc

SEQ ID NO: 8234572 - DNA, 22 bp, Homo sapiens
gatacacacccttgataggact

SEQ ID NO: 8234573 - DNA, 20 bp, Homo sapiens
gatacacagcttcactgttg

SEQ ID NO: 8234574 - DNA, 22 bp, Homo sapiens
gatacacagggctaagatggat

SEQ ID NO: 8234575 - DNA, 15 bp, Homo sapiens
gatacacatgactgg

SEQ ID NO: 8234576 - DNA, 22 bp, Homo sapiens
gatacacatgcatgtgcatgta

SEQ ID NO: 8234577 - DNA, 22 bp, Homo sapiens
gataatacttattaagcactta

SEQ ID NO: 8234578 - DNA, 22 bp, Homo sapiens
gataagttatgtaacttgctca

SEQ ID NO: 8234579 - DNA, 22 bp, Homo sapiens
gataacattttgaagtgctagt

SEQ ID NO: 8234580 - DNA, 22 bp, Homo sapiens
gatactttccatccaaatgcat

SEQ ID NO: 8234581 - DNA, 22 bp, Homo sapiens
gatactttccatccaaatgcat

SEQ ID NO: 8234582 - DNA, 22 bp, Homo sapiens
gataccagacagggagggagaa

SEQ ID NO: 8234583 - DNA, 22 bp, Homo sapiens
gatactttgtggaatcctggat

SEQ ID NO: 8234584 - DNA, 22 bp, Homo sapiens
gatactttgtggaatcctggat

SEQ ID NO: 8234585 - DNA, 22 bp, Homo sapiens
gatactttctcatttacccaag

SEQ ID NO: 8234586 - DNA, 22 bp, Homo sapiens
gatactttctcatttacccaag

SEQ ID NO: 8234587 - DNA, 22 bp, Homo sapiens
gatactttccatccaaatgcat

SEQ ID NO: 8234588 - DNA, 22 bp, Homo sapiens
gatagaaaggtgttgaaatcca

SEQ ID NO: 8234589 - DNA, 22 bp, Homo sapiens
gatagataaaactatattttca

SEQ ID NO: 8234590 - DNA, 22 bp, Homo sapiens
gataggctgaaagactatggcg

SEQ ID NO: 8234591 - DNA, 19 bp, Homo sapiens
gatataaagagatggtgaa

SEQ ID NO: 8234592 - DNA, 19 bp, Homo sapiens
gatataaagagatggtgaa

SEQ ID NO: 8234593 - DNA, 19 bp, Homo sapiens
gatataaagagatggtgaa

SEQ ID NO: 8234594 - DNA, 22 bp, Homo sapiens
gatagtcacctcccttaacttt

SEQ ID NO: 8234595 - DNA, 22 bp, Homo sapiens
gatagtcacctcccttaacttt

SEQ ID NO: 8234596 - DNA, 22 bp, Homo sapiens
gatagtcacctcccttaacttt

SEQ ID NO: 8234597 - DNA, 19 bp, Homo sapiens
gatataaagagatggtgaa

SEQ ID NO: 8234598 - DNA, 22 bp, Homo sapiens
gatataaattaatcaagtgcaa

SEQ ID NO: 8234599 - DNA, 22 bp, Homo sapiens
gatataaattaatcaagtgcaa

SEQ ID NO: 8234600 - DNA, 22 bp, Homo sapiens
gatataaattaatcaagtgcaa

SEQ ID NO: 8234601 - DNA, 22 bp, Homo sapiens
gatataaattaatcaagtgcaa

SEQ ID NO: 8234602 - DNA, 22 bp, Homo sapiens
gatataaattaatcaagtgcaa

SEQ ID NO: 8234603 - DNA, 22 bp, Homo sapiens
gatatacaatccacagttgatt

SEQ ID NO: 8234604 - DNA, 22 bp, Homo sapiens
gatataaattaatcaagtgcaa

SEQ ID NO: 8234605 - DNA, 22 bp, Homo sapiens
gatatacagagcattctttgat

SEQ ID NO: 8234606 - DNA, 22 bp, Homo sapiens
gatcacatgaatggaatagaag

SEQ ID NO: 8234607 - DNA, 22 bp, Homo sapiens
gatcagaatcttcattttcagt

SEQ ID NO: 8234608 - DNA, 22 bp, Homo sapiens
gatcaatactattaagatcata

SEQ ID NO: 8234609 - DNA, 22 bp, Homo sapiens
gatcacagtattttagatgtgt

SEQ ID NO: 8234610 - DNA, 22 bp, Homo sapiens
gatcaaggcagtagggccagct

SEQ ID NO: 8234611 - DNA, 22 bp, Homo sapiens
gatatttttagtatttctgcct

SEQ ID NO: 8234612 - DNA, 22 bp, Homo sapiens
gatcagtttattaattttctag

SEQ ID NO: 8234613 - DNA, 22 bp, Homo sapiens
gatcatctgggctccttgtagt

SEQ ID NO: 8234614 - DNA, 22 bp, Homo sapiens
gatcatcatctttcaggcaagt

SEQ ID NO: 8234615 - DNA, 22 bp, Homo sapiens
gatcatcaagcaagaacctgat

SEQ ID NO: 8234616 - DNA, 22 bp, Homo sapiens
gatcatcatggctctggagctg

SEQ ID NO: 8234617 - DNA, 22 bp, Homo sapiens
gatcatttacttgttctggact

SEQ ID NO: 8234618 - DNA, 22 bp, Homo sapiens
gatcatttcagtccagtaaata

SEQ ID NO: 8234619 - DNA, 22 bp, Homo sapiens
gatcattggcctttctgcagtg

SEQ ID NO: 8234620 - DNA, 22 bp, Homo sapiens
gatcattagcttttcaaaggag

SEQ ID NO: 8234621 - DNA, 22 bp, Homo sapiens
gatcatgtgatttgaagtaatg

SEQ ID NO: 8234622 - DNA, 22 bp, Homo sapiens
gatcattaacaaccttaccctt

SEQ ID NO: 8234623 - DNA, 22 bp, Homo sapiens
gatcattgaacaggcactggag

SEQ ID NO: 8234624 - DNA, 22 bp, Homo sapiens
gatcattgctgcctttttctat

SEQ ID NO: 8234625 - DNA, 22 bp, Homo sapiens
gatcattagcttttcaaaggag

SEQ ID NO: 8234626 - DNA, 19 bp, Homo sapiens
gatcagagtgtcagcttgt

SEQ ID NO: 8234627 - DNA, 22 bp, Homo sapiens
gatcagagtggctagagccttg

SEQ ID NO: 8234628 - DNA, 22 bp, Homo sapiens
gatcagagccagagatgataac

SEQ ID NO: 8234629 - DNA, 22 bp, Homo sapiens
gatcagagagttagaaatgtca

SEQ ID NO: 8234630 - DNA, 22 bp, Homo sapiens
gatcagagagctctttatggcc

SEQ ID NO: 8234631 - DNA, 22 bp, Homo sapiens
gatcagaatttacttataattg

SEQ ID NO: 8234632 - DNA, 22 bp, Homo sapiens
gatcaggacatagctataggct

SEQ ID NO: 8234633 - DNA, 22 bp, Homo sapiens
gatatttacattaagcacattg

SEQ ID NO: 8234634 - DNA, 22 bp, Homo sapiens
gatatatgtaaaagtagacaga

SEQ ID NO: 8234635 - DNA, 18 bp, Homo sapiens
gatatataggaggaaagt

SEQ ID NO: 8234636 - DNA, 21 bp, Homo sapiens
gatatttatgactcattcctt

SEQ ID NO: 8234637 - DNA, 22 bp, Homo sapiens
gatatttattaagtggttggta

SEQ ID NO: 8234638 - DNA, 18 bp, Homo sapiens
gatatataggaggaaagt

SEQ ID NO: 8234639 - DNA, 18 bp, Homo sapiens
gatatataggaggaaagt

SEQ ID NO: 8234640 - DNA, 18 bp, Homo sapiens
gatatataggaggaaagt

SEQ ID NO: 8234641 - DNA, 18 bp, Homo sapiens
gatatataggaggaaagt

SEQ ID NO: 8234642 - DNA, 22 bp, Homo sapiens
gatatagtaatattcctgaact

SEQ ID NO: 8234643 - DNA, 18 bp, Homo sapiens
gatatataggaggaaagt

SEQ ID NO: 8234644 - DNA, 22 bp, Homo sapiens
gatatacataggtttctatgca

SEQ ID NO: 8234645 - DNA, 22 bp, Homo sapiens
gatatactgtctgtattacata

SEQ ID NO: 8234646 - DNA, 22 bp, Homo sapiens
gatattttgagaaatcctatga

SEQ ID NO: 8234647 - DNA, 22 bp, Homo sapiens
gatattttgagaaatcctatga

SEQ ID NO: 8234648 - DNA, 22 bp, Homo sapiens
gatattttgagaaatcctatga

SEQ ID NO: 8234649 - DNA, 22 bp, Homo sapiens
gatattttgagaaatcctatga

SEQ ID NO: 8234650 - DNA, 22 bp, Homo sapiens
gatatttttaggtgatgcaggc

SEQ ID NO: 8234651 - DNA, 22 bp, Homo sapiens
gatattttcattcggatgctca

SEQ ID NO: 8234652 - DNA, 22 bp, Homo sapiens
gatattttcagtctcctttcaa

SEQ ID NO: 8234653 - DNA, 22 bp, Homo sapiens
gatattttcattcggatgctca

SEQ ID NO: 8234654 - DNA, 22 bp, Homo sapiens
gatattttcgcagggagaattc

SEQ ID NO: 8234655 - DNA, 22 bp, Homo sapiens
gatgcacattgaacaatcacaa

SEQ ID NO: 8234656 - DNA, 22 bp, Homo sapiens
gatgcagggcagctctgggaca

SEQ ID NO: 8234657 - DNA, 22 bp, Homo sapiens
gatgcagaaagtagacaccatc

SEQ ID NO: 8234658 - DNA, 22 bp, Homo sapiens
gatgcagtgcttaaatcatttg

SEQ ID NO: 8234659 - DNA, 22 bp, Homo sapiens
gatgcagggctggcaggagctt

SEQ ID NO: 8234660 - DNA, 22 bp, Homo sapiens
gatgattgttggctctcttgat

SEQ ID NO: 8234661 - DNA, 22 bp, Homo sapiens
gatgatttaagtggccaaagta

SEQ ID NO: 8234662 - DNA, 22 bp, Homo sapiens
gatgattttctgtgttagaaga

SEQ ID NO: 8234663 - DNA, 22 bp, Homo sapiens
gatgattttgatgcagtaaaga

SEQ ID NO: 8234664 - DNA, 22 bp, Homo sapiens
gatgatttgaggatttcatgag

SEQ ID NO: 8234665 - DNA, 22 bp, Homo sapiens
gatgattttagttgactaaact

SEQ ID NO: 8234666 - DNA, 22 bp, Homo sapiens
gatgattttgttggtgattcaa

SEQ ID NO: 8234667 - DNA, 22 bp, Homo sapiens
gatgattttgatgcagtaaaga

SEQ ID NO: 8234668 - DNA, 22 bp, Homo sapiens
gatgatttttgccagtgtgatg

SEQ ID NO: 8234669 - DNA, 22 bp, Homo sapiens
gatgagacagaatagcccaagg

SEQ ID NO: 8234670 - DNA, 22 bp, Homo sapiens
gatgatgggttgatgtgaaggg

SEQ ID NO: 8234671 - DNA, 22 bp, Homo sapiens
gatgatggtggacagctggtta

SEQ ID NO: 8234672 - DNA, 22 bp, Homo sapiens
gatgaggaatttgaggttagaa

SEQ ID NO: 8234673 - DNA, 22 bp, Homo sapiens
gatgagcattgtttcatgtgtt

SEQ ID NO: 8234674 - DNA, 22 bp, Homo sapiens
gatgagctgctcaatctgtggt

SEQ ID NO: 8234675 - DNA, 22 bp, Homo sapiens
gatgacagttctagcatctgaa

SEQ ID NO: 8234676 - DNA, 22 bp, Homo sapiens
gatgacagttctagcatctgaa

SEQ ID NO: 8234677 - DNA, 22 bp, Homo sapiens
gatgacagtgagtaaccccaac

SEQ ID NO: 8234678 - DNA, 22 bp, Homo sapiens
gatgacagttctagcatctgaa

SEQ ID NO: 8234679 - DNA, 22 bp, Homo sapiens
gatgacagcagctgtggctcac

SEQ ID NO: 8234680 - DNA, 22 bp, Homo sapiens
gatgaatgtgtccagaagactt

SEQ ID NO: 8234681 - DNA, 22 bp, Homo sapiens
gatgaatgtgggtcaagtacct

SEQ ID NO: 8234682 - DNA, 21 bp, Homo sapiens
gatgaatgtcctgaccagaac

SEQ ID NO: 8234683 - DNA, 22 bp, Homo sapiens
gatgaatgggtacacaggatga

SEQ ID NO: 8234684 - DNA, 22 bp, Homo sapiens
gatgaattctggcttggacaga

SEQ ID NO: 8234685 - DNA, 22 bp, Homo sapiens
gatgaattgaaatcattgggca

SEQ ID NO: 8234686 - DNA, 21 bp, Homo sapiens
gatgaagcaatctttctgttg

SEQ ID NO: 8234687 - DNA, 22 bp, Homo sapiens
gatgaaatttgggcaggttaaa

SEQ ID NO: 8234688 - DNA, 22 bp, Homo sapiens
gatgaaatttgggcaggttaaa

SEQ ID NO: 8234689 - DNA, 22 bp, Homo sapiens
gatgaaggggctggtgccctct

SEQ ID NO: 8234690 - DNA, 22 bp, Homo sapiens
gatgaagcctgacttctcggtg

SEQ ID NO: 8234691 - DNA, 22 bp, Homo sapiens
gatgaaaaaagacgagcatata

SEQ ID NO: 8234692 - DNA, 22 bp, Homo sapiens
gatgaaaaaagacgagcatata

SEQ ID NO: 8234693 - DNA, 22 bp, Homo sapiens
gatgaaaaaagacgagcatata

SEQ ID NO: 8234694 - DNA, 22 bp, Homo sapiens
gatgaaaaattgctgtgtcata

SEQ ID NO: 8234695 - DNA, 22 bp, Homo sapiens
gatgaaaatcttgagatgtcga

SEQ ID NO: 8234696 - DNA, 22 bp, Homo sapiens
gatgaaatagaattaatttagg

SEQ ID NO: 8234697 - DNA, 17 bp, Homo sapiens
gatgaaatgatgcacac

SEQ ID NO: 8234698 - DNA, 17 bp, Homo sapiens
gatgaaatgatgcacac

SEQ ID NO: 8234699 - DNA, 17 bp, Homo sapiens
gatgaaatgatgcacac

SEQ ID NO: 8234700 - DNA, 22 bp, Homo sapiens
gatgaaatccagatcacaggtg

SEQ ID NO: 8234701 - DNA, 17 bp, Homo sapiens
gatgaaatgatgcacac

SEQ ID NO: 8234702 - DNA, 22 bp, Homo sapiens
gatgaaatccagatcacaggtg

SEQ ID NO: 8234703 - DNA, 20 bp, Homo sapiens
gatgaaatcactgggcagcc

SEQ ID NO: 8234704 - DNA, 22 bp, Homo sapiens
gatgaaatccagatcacaggtg

SEQ ID NO: 8234705 - DNA, 20 bp, Homo sapiens
gatgaaatcactgggcagcc

SEQ ID NO: 8234706 - DNA, 20 bp, Homo sapiens
gatgaaatcactgggcagcc

SEQ ID NO: 8234707 - DNA, 22 bp, Homo sapiens
gatgaaatagcaaaggcatttg

SEQ ID NO: 8234708 - DNA, 22 bp, Homo sapiens
gatgaaatagcaaaggcatttg

SEQ ID NO: 8234709 - DNA, 22 bp, Homo sapiens
gatgaaatagcaaaggcatttg

SEQ ID NO: 8234710 - DNA, 22 bp, Homo sapiens
gatgaaatagaattaatttagg

SEQ ID NO: 8234711 - DNA, 22 bp, Homo sapiens
gatgaaattgttttgatacttt

SEQ ID NO: 8234712 - DNA, 22 bp, Homo sapiens
gatgaaattgttttgatacttt

SEQ ID NO: 8234713 - DNA, 22 bp, Homo sapiens
gatgaaattcagaattgagggg

SEQ ID NO: 8234714 - DNA, 22 bp, Homo sapiens
gatgaaattgttttgatacttt

SEQ ID NO: 8234715 - DNA, 22 bp, Homo sapiens
gatgaaattgttttgatacttt

SEQ ID NO: 8234716 - DNA, 22 bp, Homo sapiens
gatgaaatttgaaaatagtgtt

SEQ ID NO: 8234717 - DNA, 22 bp, Homo sapiens
gatgaaatttgaaaatagtgtt

SEQ ID NO: 8234718 - DNA, 22 bp, Homo sapiens
gatgaaatgtgaaagttctggg

SEQ ID NO: 8234719 - DNA, 22 bp, Homo sapiens
gatgaaatgtgaaagttctggg

SEQ ID NO: 8234720 - DNA, 22 bp, Homo sapiens
gatgaaatgctgagcctgagtt

SEQ ID NO: 8234721 - DNA, 22 bp, Homo sapiens
gatgaaatgctgagcctgagtt

SEQ ID NO: 8234722 - DNA, 22 bp, Homo sapiens
gatgaaattcagaattgagggg

SEQ ID NO: 8234723 - DNA, 22 bp, Homo sapiens
gatgaaattcagaattgagggg

SEQ ID NO: 8234724 - DNA, 22 bp, Homo sapiens
gatgaaatgtgaaagttctggg

SEQ ID NO: 8234725 - DNA, 22 bp, Homo sapiens
gatgaaatgctgagcctgagtt

SEQ ID NO: 8234726 - DNA, 22 bp, Homo sapiens
gatgaaatgtgaaagttctggg

SEQ ID NO: 8234727 - DNA, 22 bp, Homo sapiens
gatccgaatcattgctctttta

SEQ ID NO: 8234728 - DNA, 22 bp, Homo sapiens
gatctggtctttgattagacac

SEQ ID NO: 8234729 - DNA, 22 bp, Homo sapiens
gatctgttataatctcttttat

SEQ ID NO: 8234730 - DNA, 22 bp, Homo sapiens
gatcttctagcagaagtaattt

SEQ ID NO: 8234731 - DNA, 22 bp, Homo sapiens
gatctgtttcattcacagtctg

SEQ ID NO: 8234732 - DNA, 22 bp, Homo sapiens
gatcttctatgtaatgaagtgt

SEQ ID NO: 8234733 - DNA, 22 bp, Homo sapiens
gatcttctttctctgtagaggt

SEQ ID NO: 8234734 - DNA, 22 bp, Homo sapiens
gatcccctattcttttcctcag

SEQ ID NO: 8234735 - DNA, 22 bp, Homo sapiens
gatccccagggcaggcctcccg

SEQ ID NO: 8234736 - DNA, 22 bp, Homo sapiens
gatccctgccctcagcctggac

SEQ ID NO: 8234737 - DNA, 22 bp, Homo sapiens
gatccctgccctcagcctggac

SEQ ID NO: 8234738 - DNA, 22 bp, Homo sapiens
gatccccaggactagggggtgg

SEQ ID NO: 8234739 - DNA, 22 bp, Homo sapiens
gatccagcttctacacagagct

SEQ ID NO: 8234740 - DNA, 22 bp, Homo sapiens
gatccagcttctacacagagct

SEQ ID NO: 8234741 - DNA, 22 bp, Homo sapiens
gatccacagtttgatgatcata

SEQ ID NO: 8234742 - DNA, 22 bp, Homo sapiens
gatcatttgcaggaaacattaa

SEQ ID NO: 8234743 - DNA, 22 bp, Homo sapiens
gatcatttgactttataaggct

SEQ ID NO: 8234744 - DNA, 22 bp, Homo sapiens
gatcattttgtatagcaaaggt

SEQ ID NO: 8234745 - DNA, 22 bp, Homo sapiens
gatcattttgatgcccttttag

SEQ ID NO: 8234746 - DNA, 22 bp, Homo sapiens
gatccacaggaaccaaaacgca

SEQ ID NO: 8234747 - DNA, 22 bp, Homo sapiens
gatccacagggccctggcccag

SEQ ID NO: 8234748 - DNA, 15 bp, Homo sapiens
gagtggctttcagaa

SEQ ID NO: 8234749 - DNA, 22 bp, Homo sapiens
gagtggctttggagaagtaggg

SEQ ID NO: 8234750 - DNA, 22 bp, Homo sapiens
gagtggctttggagaagtaggg

SEQ ID NO: 8234751 - DNA, 22 bp, Homo sapiens
gagtggctgagtaagaggggag

SEQ ID NO: 8234752 - DNA, 22 bp, Homo sapiens
gagtggctgagtaagaggggag

SEQ ID NO: 8234753 - DNA, 22 bp, Homo sapiens
gagtggctgggtgtttgaatcc

SEQ ID NO: 8234754 - DNA, 15 bp, Homo sapiens
gagtggctggtgaaa

SEQ ID NO: 8234755 - DNA, 22 bp, Homo sapiens
gagtggctgtgtacatgcccag

SEQ ID NO: 8234756 - DNA, 22 bp, Homo sapiens
gagtggctaaagtatgtcatgg

SEQ ID NO: 8234757 - DNA, 22 bp, Homo sapiens
gagtggccagtggtggcatgtc

SEQ ID NO: 8234758 - DNA, 22 bp, Homo sapiens
gagtggccagtggtggcatgtc

SEQ ID NO: 8234759 - DNA, 22 bp, Homo sapiens
gagtggcatatgtgcctgtgaa

SEQ ID NO: 8234760 - DNA, 22 bp, Homo sapiens
gagtggcatatgtgcctgtgaa

SEQ ID NO: 8234761 - DNA, 22 bp, Homo sapiens
gagtggctacaggcagcttaca

SEQ ID NO: 8234762 - DNA, 22 bp, Homo sapiens
gagtggctattgatccgtgatg

SEQ ID NO: 8234763 - DNA, 22 bp, Homo sapiens
gagtggctccaatttggtccta

SEQ ID NO: 8234764 - DNA, 22 bp, Homo sapiens
gagtggctattgatccgtgatg

SEQ ID NO: 8234765 - DNA, 22 bp, Homo sapiens
gagtggctccctgggtttggca

SEQ ID NO: 8234766 - DNA, 22 bp, Homo sapiens
gagtggctccttacaagttcca

SEQ ID NO: 8234767 - DNA, 22 bp, Homo sapiens
gagtggctccctgggtttggca

SEQ ID NO: 8234768 - DNA, 22 bp, Homo sapiens
gagtgggcaccgtgggcacact

SEQ ID NO: 8234769 - DNA, 22 bp, Homo sapiens
gagtggggctttaaaggctcag

SEQ ID NO: 8234770 - DNA, 21 bp, Homo sapiens
gagtgggacatgggagtggtt

SEQ ID NO: 8234771 - DNA, 22 bp, Homo sapiens
gagtggcttttttatggtaatg

SEQ ID NO: 8234772 - DNA, 22 bp, Homo sapiens
gagtggagatcgtgccactgca

SEQ ID NO: 8234773 - DNA, 22 bp, Homo sapiens
gagtggagatcgtgccactgca

SEQ ID NO: 8234774 - DNA, 22 bp, Homo sapiens
gagtggagatcgtgccactgca

SEQ ID NO: 8234775 - DNA, 21 bp, Homo sapiens
gagtggaacgctcttcacacc

SEQ ID NO: 8234776 - DNA, 21 bp, Homo sapiens
gagtggaacgctcttcacacc

SEQ ID NO: 8234777 - DNA, 22 bp, Homo sapiens
gagtggagatcgtgccactgca

SEQ ID NO: 8234778 - DNA, 22 bp, Homo sapiens
gagtgctgtatctgagaaagca

SEQ ID NO: 8234779 - DNA, 22 bp, Homo sapiens
gagtggagcaaaagaggtagat

SEQ ID NO: 8234780 - DNA, 22 bp, Homo sapiens
gagtggagcaaaagaggtagat

SEQ ID NO: 8234781 - DNA, 22 bp, Homo sapiens
gagtggagcaaaagaggtagat

SEQ ID NO: 8234782 - DNA, 22 bp, Homo sapiens
gagtggagcaaaagaggtagat

SEQ ID NO: 8234783 - DNA, 22 bp, Homo sapiens
gagtggcaggcactgtgacgga

SEQ ID NO: 8234784 - DNA, 22 bp, Homo sapiens
gagtggcaggcactgtgacgga

SEQ ID NO: 8234785 - DNA, 22 bp, Homo sapiens
gagtggcatagaagcatataga

SEQ ID NO: 8234786 - DNA, 22 bp, Homo sapiens
gagtgctgcttgggatagtgag

SEQ ID NO: 8234787 - DNA, 22 bp, Homo sapiens
gagtgctggaggtgtgagtggg

SEQ ID NO: 8234788 - DNA, 22 bp, Homo sapiens
gagtgctggaggtgtgagtggg

SEQ ID NO: 8234789 - DNA, 22 bp, Homo sapiens
gagtgctggaggtgtgagtggg

SEQ ID NO: 8234790 - DNA, 22 bp, Homo sapiens
gagtgctggaggtgtgagtggg

SEQ ID NO: 8234791 - DNA, 22 bp, Homo sapiens
gagtgctggaggtgtgagtggg

SEQ ID NO: 8234792 - DNA, 22 bp, Homo sapiens
gagtgctgcttgggatagtgag

SEQ ID NO: 8234793 - DNA, 22 bp, Homo sapiens
gagtgctgctaatgcaagggtg

SEQ ID NO: 8234794 - DNA, 22 bp, Homo sapiens
gagtgctgctaatgcaagggtg

SEQ ID NO: 8234795 - DNA, 22 bp, Homo sapiens
gagtgctgaatgcgagaacaga

SEQ ID NO: 8234796 - DNA, 22 bp, Homo sapiens
gagtgctgaatgcgagaacaga

SEQ ID NO: 8234797 - DNA, 22 bp, Homo sapiens
gagtgctgtatctgagaaagca

SEQ ID NO: 8234798 - DNA, 22 bp, Homo sapiens
gagtgctgtaggactgagccct

SEQ ID NO: 8234799 - DNA, 17 bp, Homo sapiens
gagtgctggtggagctc

SEQ ID NO: 8234800 - DNA, 17 bp, Homo sapiens
gagtgctggtggagctc

SEQ ID NO: 8234801 - DNA, 17 bp, Homo sapiens
gagtgctggtggagctc

SEQ ID NO: 8234802 - DNA, 17 bp, Homo sapiens
gagtgctggtggagctc

SEQ ID NO: 8234803 - DNA, 22 bp, Homo sapiens
gagtgctggggtgcagagaggt

SEQ ID NO: 8234804 - DNA, 22 bp, Homo sapiens
gagtgctggggtgcagagaggt

SEQ ID NO: 8234805 - DNA, 22 bp, Homo sapiens
gagtgctagcattagtatataa

SEQ ID NO: 8234806 - DNA, 22 bp, Homo sapiens
gagtgcagttggggtgagggga

SEQ ID NO: 8234807 - DNA, 22 bp, Homo sapiens
gagtgcagtatgagaggctgct

SEQ ID NO: 8234808 - DNA, 22 bp, Homo sapiens
gagtgcagtatgagaggctgct

SEQ ID NO: 8234809 - DNA, 22 bp, Homo sapiens
gagtgcagtatgagaggctgct

SEQ ID NO: 8234810 - DNA, 22 bp, Homo sapiens
gagtgcagtggcgtgatctctg

SEQ ID NO: 8234811 - DNA, 22 bp, Homo sapiens
gagtgcagttggggtgagggga

SEQ ID NO: 8234812 - DNA, 22 bp, Homo sapiens
gagtgcagtggcgtgatctctg

SEQ ID NO: 8234813 - DNA, 23 bp, Homo sapiens
gagtgcagaatagacatgcagtg

SEQ ID NO: 8234814 - DNA, 23 bp, Homo sapiens
gagtgcagaatagacatgcagtg

SEQ ID NO: 8234815 - DNA, 22 bp, Homo sapiens
gagtgcagtatgagaggctgct

SEQ ID NO: 8234816 - DNA, 22 bp, Homo sapiens
gagtctggtcattttctctccc

SEQ ID NO: 8234817 - DNA, 22 bp, Homo sapiens
gagtctgaggggagagctgggt

SEQ ID NO: 8234818 - DNA, 22 bp, Homo sapiens
gagtctgagaactgggctcagt

SEQ ID NO: 8234819 - DNA, 22 bp, Homo sapiens
gagtctgatgtcccccaggcca

SEQ ID NO: 8234820 - DNA, 22 bp, Homo sapiens
gagtctgaggggagagctgggt

SEQ ID NO: 8234821 - DNA, 18 bp, Homo sapiens
gagtctttgttactgctg

SEQ ID NO: 8234822 - DNA, 22 bp, Homo sapiens
gagtctttggtaaagtctgctg

SEQ ID NO: 8234823 - DNA, 22 bp, Homo sapiens
gagtgactctagaaagtttctt

SEQ ID NO: 8234824 - DNA, 22 bp, Homo sapiens
gagtgacggctcatctctggaa

SEQ ID NO: 8234825 - DNA, 22 bp, Homo sapiens
gagtcttaggcaaaaataatgg

SEQ ID NO: 8234826 - DNA, 22 bp, Homo sapiens
gagtctgtggtattttatcata

SEQ ID NO: 8234827 - DNA, 22 bp, Homo sapiens
gagtgagtggccaggaggcaga

SEQ ID NO: 8234828 - DNA, 19 bp, Homo sapiens
gagtgattgcagggaccct

SEQ ID NO: 8234829 - DNA, 19 bp, Homo sapiens
gagtgatggatctccttgc

SEQ ID NO: 8234830 - DNA, 18 bp, Homo sapiens
gagtgatgaccgtgccag

SEQ ID NO: 8234831 - DNA, 22 bp, Homo sapiens
gagtgagtgctgggctgaggct

SEQ ID NO: 8234832 - DNA, 22 bp, Homo sapiens
gagtgagtgctgggctgaggct

SEQ ID NO: 8234833 - DNA, 22 bp, Homo sapiens
gagtgattgctcctttaaactt

SEQ ID NO: 8234834 - DNA, 22 bp, Homo sapiens
gagtgattggagttagcattct

SEQ ID NO: 8234835 - DNA, 22 bp, Homo sapiens
gagtgatttccagagagacgtt

SEQ ID NO: 8234836 - DNA, 22 bp, Homo sapiens
gagtgatttaagctatttttaa

SEQ ID NO: 8234837 - DNA, 22 bp, Homo sapiens
gagtgagggcagcaggggctgc

SEQ ID NO: 8234838 - DNA, 22 bp, Homo sapiens
gagtgagggccaacatccagct

SEQ ID NO: 8234839 - DNA, 22 bp, Homo sapiens
gagtgaggctggaatcatggct

SEQ ID NO: 8234840 - DNA, 22 bp, Homo sapiens
gagtgaggctggaatcatggct

SEQ ID NO: 8234841 - DNA, 22 bp, Homo sapiens
gagtgagggcagcaggggctgc

SEQ ID NO: 8234842 - DNA, 22 bp, Homo sapiens
gagtccttctggctggcaggat

SEQ ID NO: 8234843 - DNA, 22 bp, Homo sapiens
gagtccttccagcaggcattta

SEQ ID NO: 8234844 - DNA, 22 bp, Homo sapiens
gagtcctttgttccttgccaca

SEQ ID NO: 8234845 - DNA, 22 bp, Homo sapiens
gagtcgagcagaaagccgtcgg

SEQ ID NO: 8234846 - DNA, 22 bp, Homo sapiens
gagtccttttcatagcagtggg

SEQ ID NO: 8234847 - DNA, 22 bp, Homo sapiens
gagtctctcatgcagttacagt

SEQ ID NO: 8234848 - DNA, 22 bp, Homo sapiens
gagtctctagtctggtcctggc

SEQ ID NO: 8234849 - DNA, 22 bp, Homo sapiens
gagtctctagtctggtcctggc

SEQ ID NO: 8234850 - DNA, 22 bp, Homo sapiens
gagtctcctactggctgtcctt

SEQ ID NO: 8234851 - DNA, 22 bp, Homo sapiens
gagtctctgctatgttttctct

SEQ ID NO: 8234852 - DNA, 22 bp, Homo sapiens
gagtctctgctatgttttctct

SEQ ID NO: 8234853 - DNA, 22 bp, Homo sapiens
gagtctctggaggggtcagacc

SEQ ID NO: 8234854 - DNA, 22 bp, Homo sapiens
gagtctcctactggctgtcctt

SEQ ID NO: 8234855 - DNA, 22 bp, Homo sapiens
gagtctccaatccatgcctgtc

SEQ ID NO: 8234856 - DNA, 22 bp, Homo sapiens
gagtctaaggaaaaatagagta

SEQ ID NO: 8234857 - DNA, 22 bp, Homo sapiens
gagtctaagtagaatgtgaaaa

SEQ ID NO: 8234858 - DNA, 22 bp, Homo sapiens
gagtcctgaatcctgtggcaac

SEQ ID NO: 8234859 - DNA, 22 bp, Homo sapiens
gagtcctgaatcctgtggcaac

SEQ ID NO: 8234860 - DNA, 22 bp, Homo sapiens
gagtcctgatccttagctctcc

SEQ ID NO: 8234861 - DNA, 22 bp, Homo sapiens
gagtcctgcccttgtgtagtcc

SEQ ID NO: 8234862 - DNA, 22 bp, Homo sapiens
gagtcctggaaccctgaatgct

SEQ ID NO: 8234863 - DNA, 22 bp, Homo sapiens
gagtcctgcccttgtgtagtcc

SEQ ID NO: 8234864 - DNA, 22 bp, Homo sapiens
gagtcctggagagcccgagcgc

SEQ ID NO: 8234865 - DNA, 21 bp, Homo sapiens
gagtcctggctagggtggcag

SEQ ID NO: 8234866 - DNA, 21 bp, Homo sapiens
gagtcctggctagggtggcag

SEQ ID NO: 8234867 - DNA, 22 bp, Homo sapiens
gagtcctggaaccctgaatgct

SEQ ID NO: 8234868 - DNA, 22 bp, Homo sapiens
gagtcctggaaccctgaatgct

SEQ ID NO: 8234869 - DNA, 22 bp, Homo sapiens
gagtcctggagaaacgcaggtg

SEQ ID NO: 8234870 - DNA, 22 bp, Homo sapiens
gagtcctggagaaacgcaggtg

SEQ ID NO: 8234871 - DNA, 20 bp, Homo sapiens
gagtccttatgggctgaggt

SEQ ID NO: 8234872 - DNA, 22 bp, Homo sapiens
gagtccttaatacactggtgga

SEQ ID NO: 8234873 - DNA, 22 bp, Homo sapiens
gagtcctgggtcacggcctctt

SEQ ID NO: 8234874 - DNA, 21 bp, Homo sapiens
gagtcctggctagggtggcag

SEQ ID NO: 8234875 - DNA, 21 bp, Homo sapiens
gagtcctggctagggtggcag

SEQ ID NO: 8234876 - DNA, 19 bp, Homo sapiens
gagtcctgtgctccttgtt

SEQ ID NO: 8234877 - DNA, 22 bp, Homo sapiens
gagtgtgttctttatgctgtga

SEQ ID NO: 8234878 - DNA, 22 bp, Homo sapiens
gagttaaaaatgcctccatgga

SEQ ID NO: 8234879 - DNA, 22 bp, Homo sapiens
gagtgtgtgacttcactttagc

SEQ ID NO: 8234880 - DNA, 22 bp, Homo sapiens
gagtgtgtgcatgatctcttat

SEQ ID NO: 8234881 - DNA, 22 bp, Homo sapiens
gagtgtggtgaacaggagcacc

SEQ ID NO: 8234882 - DNA, 22 bp, Homo sapiens
gagtgtggtgaacaggagcacc

SEQ ID NO: 8234883 - DNA, 22 bp, Homo sapiens
gagttctattatggttagaagt

SEQ ID NO: 8234884 - DNA, 22 bp, Homo sapiens
gagttctgtagggtgaaatagt

SEQ ID NO: 8234885 - DNA, 22 bp, Homo sapiens
gagttctggtcagcagggcagc

SEQ ID NO: 8234886 - DNA, 22 bp, Homo sapiens
gagttaaaggaaaataacttta

SEQ ID NO: 8234887 - DNA, 22 bp, Homo sapiens
gagttaaagtacctttgtatgt

SEQ ID NO: 8234888 - DNA, 22 bp, Homo sapiens
gagttaaaggaaaataacttta

SEQ ID NO: 8234889 - DNA, 22 bp, Homo sapiens
gagtgtgggggtgctgaggaca

SEQ ID NO: 8234890 - DNA, 22 bp, Homo sapiens
gagtgtgggggtgctgaggaca

SEQ ID NO: 8234891 - DNA, 22 bp, Homo sapiens
gagtgtggtatgctctgaggct

SEQ ID NO: 8234892 - DNA, 22 bp, Homo sapiens
gagtgtggtatgctctgaggct

SEQ ID NO: 8234893 - DNA, 22 bp, Homo sapiens
gagtgtggtgaacaggagcacc

SEQ ID NO: 8234894 - DNA, 22 bp, Homo sapiens
gagtgtggatcccagaagcaga

SEQ ID NO: 8234895 - DNA, 22 bp, Homo sapiens
gagtgtggatcccagaagcaga

SEQ ID NO: 8234896 - DNA, 22 bp, Homo sapiens
gagtgtggatcccagaagcaga

SEQ ID NO: 8234897 - DNA, 22 bp, Homo sapiens
gagtgtctgtgacagctcatga

SEQ ID NO: 8234898 - DNA, 22 bp, Homo sapiens
gagtgtctgtggggcatggaca

SEQ ID NO: 8234899 - DNA, 22 bp, Homo sapiens
gagtgtctgtggggcatggaca

SEQ ID NO: 8234900 - DNA, 18 bp, Homo sapiens
gagtgtggcactgggccc

SEQ ID NO: 8234901 - DNA, 18 bp, Homo sapiens
gagtgtggcactgggccc

SEQ ID NO: 8234902 - DNA, 22 bp, Homo sapiens
gagtgtgggcacgggggccttg

SEQ ID NO: 8234903 - DNA, 22 bp, Homo sapiens
gagtgtgggcacgggggccttg

SEQ ID NO: 8234904 - DNA, 22 bp, Homo sapiens
gagtgtgggcacgggggccttg

SEQ ID NO: 8234905 - DNA, 22 bp, Homo sapiens
gagtggggtctgggcatcagtc

SEQ ID NO: 8234906 - DNA, 22 bp, Homo sapiens
gagtggggctttaaaggctcag

SEQ ID NO: 8234907 - DNA, 22 bp, Homo sapiens
gagtggggggtccgtctcagtg

SEQ ID NO: 8234908 - DNA, 22 bp, Homo sapiens
gagtgggtaaaggtgcttggct

SEQ ID NO: 8234909 - DNA, 22 bp, Homo sapiens
gagtggggtctgggcatcagtc

SEQ ID NO: 8234910 - DNA, 22 bp, Homo sapiens
gagtgggtaaaggtgcttggct

SEQ ID NO: 8234911 - DNA, 22 bp, Homo sapiens
gagtgggtaccggagcaggtgc

SEQ ID NO: 8234912 - DNA, 22 bp, Homo sapiens
gagtgggtctcatatatctggc

SEQ ID NO: 8234913 - DNA, 22 bp, Homo sapiens
gagtgggtccacagaggtgaca

SEQ ID NO: 8234914 - DNA, 22 bp, Homo sapiens
gagtgggtccacagaggtgaca

SEQ ID NO: 8234915 - DNA, 22 bp, Homo sapiens
gagtgtctaatcacgtttcaca

SEQ ID NO: 8234916 - DNA, 22 bp, Homo sapiens
gagtgtcagtgcttggggctac

SEQ ID NO: 8234917 - DNA, 22 bp, Homo sapiens
gagtgtcagtgcctggcttgtt

SEQ ID NO: 8234918 - DNA, 21 bp, Homo sapiens
gagtgtctaatccaggctgtc

SEQ ID NO: 8234919 - DNA, 22 bp, Homo sapiens
gagtgtctatgtttagtctttc

SEQ ID NO: 8234920 - DNA, 22 bp, Homo sapiens
gagtgtctatgtttagtctttc

SEQ ID NO: 8234921 - DNA, 22 bp, Homo sapiens
gagtgtctgtattttgggcaag

SEQ ID NO: 8234922 - DNA, 22 bp, Homo sapiens
gagtgtctgaattagagcacaa

SEQ ID NO: 8234923 - DNA, 22 bp, Homo sapiens
gagtgtctcacagtagcatttt

SEQ ID NO: 8234924 - DNA, 22 bp, Homo sapiens
gagtgtagttcattccgtccta

SEQ ID NO: 8234925 - DNA, 22 bp, Homo sapiens
gagtgtagttcattccgtccta

SEQ ID NO: 8234926 - DNA, 22 bp, Homo sapiens
gagtgtaatctgaaaacttgaa

SEQ ID NO: 8234927 - DNA, 22 bp, Homo sapiens
gagtgtaaaaacttagtgagat

SEQ ID NO: 8234928 - DNA, 22 bp, Homo sapiens
gagtgggtgaatgtgctcataa

SEQ ID NO: 8234929 - DNA, 22 bp, Homo sapiens
gagtgggtgaatgtgctcataa

SEQ ID NO: 8234930 - DNA, 22 bp, Homo sapiens
gagtgggtgaatgtgctcataa

SEQ ID NO: 8234931 - DNA, 22 bp, Homo sapiens
gagtgggtgagagacttggcac

SEQ ID NO: 8234932 - DNA, 22 bp, Homo sapiens
gagtgggtgacagaaggaggta

SEQ ID NO: 8234933 - DNA, 22 bp, Homo sapiens
gagtgggtgagagacttggcac

SEQ ID NO: 8234934 - DNA, 22 bp, Homo sapiens
gataaacatgggagaaaggaat

SEQ ID NO: 8234935 - DNA, 22 bp, Homo sapiens
gataaacacaaggtgatttcat

SEQ ID NO: 8234936 - DNA, 22 bp, Homo sapiens
gataaaataactatggaatact

SEQ ID NO: 8234937 - DNA, 22 bp, Homo sapiens
gataaaataactatggaatact

SEQ ID NO: 8234938 - DNA, 22 bp, Homo sapiens
gataaaataactatggaatact

SEQ ID NO: 8234939 - DNA, 22 bp, Homo sapiens
gataaaatatgtggcctttagt

SEQ ID NO: 8234940 - DNA, 22 bp, Homo sapiens
gataaaatatgtggcctttagt

SEQ ID NO: 8234941 - DNA, 22 bp, Homo sapiens
gataaaattcttattttacccg

SEQ ID NO: 8234942 - DNA, 22 bp, Homo sapiens
gataaaattcttattttacccg

SEQ ID NO: 8234943 - DNA, 21 bp, Homo sapiens
gataaaatgggccttggtcct

SEQ ID NO: 8234944 - DNA, 21 bp, Homo sapiens
gataaaatgggccttggtcct

SEQ ID NO: 8234945 - DNA, 21 bp, Homo sapiens
gataaaatgggccttggtcct

SEQ ID NO: 8234946 - DNA, 21 bp, Homo sapiens
gataaaatgggccttggtcct

SEQ ID NO: 8234947 - DNA, 22 bp, Homo sapiens
gataaattgcactttttcttac

SEQ ID NO: 8234948 - DNA, 20 bp, Homo sapiens
gataaattgtctcttaagtg

SEQ ID NO: 8234949 - DNA, 20 bp, Homo sapiens
gataaattgtctcttaagtg

SEQ ID NO: 8234950 - DNA, 20 bp, Homo sapiens
gataaattgtctcttaagtg

SEQ ID NO: 8234951 - DNA, 22 bp, Homo sapiens
gataaagtagatttgttctaga

SEQ ID NO: 8234952 - DNA, 21 bp, Homo sapiens
gataaagcagcttgcctaagg

SEQ ID NO: 8234953 - DNA, 21 bp, Homo sapiens
gataaagcagcttgcctaagg

SEQ ID NO: 8234954 - DNA, 20 bp, Homo sapiens
gataaagcattgagtaaatt

SEQ ID NO: 8234955 - DNA, 22 bp, Homo sapiens
gataaagcaggtaggagaagat

SEQ ID NO: 8234956 - DNA, 22 bp, Homo sapiens
gataaagcaaggatgactgaag

SEQ ID NO: 8234957 - DNA, 22 bp, Homo sapiens
gataaacttgtggagttttggt

SEQ ID NO: 8234958 - DNA, 22 bp, Homo sapiens
gagttgactcctccagaggagt

SEQ ID NO: 8234959 - DNA, 22 bp, Homo sapiens
gagttctgttccttgggagttt

SEQ ID NO: 8234960 - DNA, 22 bp, Homo sapiens
gagttctgtgattatttgggac

SEQ ID NO: 8234961 - DNA, 22 bp, Homo sapiens
gagtttaaaaagcctggtttgt

SEQ ID NO: 8234962 - DNA, 22 bp, Homo sapiens
gagttggctgttcgaaggtagc

SEQ ID NO: 8234963 - DNA, 22 bp, Homo sapiens
gagttggctactctctgaggct

SEQ ID NO: 8234964 - DNA, 22 bp, Homo sapiens
gagtttaaaacgcttgtattta

SEQ ID NO: 8234965 - DNA, 22 bp, Homo sapiens
gagtttaaaacgcttgtattta

SEQ ID NO: 8234966 - DNA, 22 bp, Homo sapiens
gagtttaaagcatacatatttt

SEQ ID NO: 8234967 - DNA, 22 bp, Homo sapiens
gagtttaatcattgttctatcc

SEQ ID NO: 8234968 - DNA, 22 bp, Homo sapiens
gagtttaacacttggagaaaag

SEQ ID NO: 8234969 - DNA, 22 bp, Homo sapiens
gagtttaaagcatacatatttt

SEQ ID NO: 8234970 - DNA, 22 bp, Homo sapiens
gagtttaatcattgttctatcc

SEQ ID NO: 8234971 - DNA, 22 bp, Homo sapiens
gagtttatgtctttcattgttc

SEQ ID NO: 8234972 - DNA, 22 bp, Homo sapiens
gagtttatgtctttcattgttc

SEQ ID NO: 8234973 - DNA, 22 bp, Homo sapiens
gagtttattcaggaaatagcca

SEQ ID NO: 8234974 - DNA, 22 bp, Homo sapiens
gagtttattcaggaaatagcca

SEQ ID NO: 8234975 - DNA, 22 bp, Homo sapiens
gagtttattcaggaaatagcca

SEQ ID NO: 8234976 - DNA, 22 bp, Homo sapiens
gagtttattcaggaaatagcca

SEQ ID NO: 8234977 - DNA, 19 bp, Homo sapiens
gagtttatctcctagccct

SEQ ID NO: 8234978 - DNA, 19 bp, Homo sapiens
gagtttatctcctagccct

SEQ ID NO: 8234979 - DNA, 19 bp, Homo sapiens
gagtttatctcctagccct

SEQ ID NO: 8234980 - DNA, 22 bp, Homo sapiens
gagtttatgtctttcattgttc

SEQ ID NO: 8234981 - DNA, 22 bp, Homo sapiens
gataaaataactatggaatact

SEQ ID NO: 8234982 - DNA, 22 bp, Homo sapiens
gataaaagaggaaatttgttca

SEQ ID NO: 8234983 - DNA, 22 bp, Homo sapiens
gataaaagaggaaatttgttca

SEQ ID NO: 8234984 - DNA, 22 bp, Homo sapiens
gagtttttccaaggtcacatga

SEQ ID NO: 8234985 - DNA, 22 bp, Homo sapiens
gagtttctgattcagtctgtgt

SEQ ID NO: 8234986 - DNA, 22 bp, Homo sapiens
gagtttattgtcttccaggctt

SEQ ID NO: 8234987 - DNA, 22 bp, Homo sapiens
gagtttatttgactggattctc

SEQ ID NO: 8234988 - DNA, 22 bp, Homo sapiens
gagtttattgtcttccaggctt

SEQ ID NO: 8234989 - DNA, 22 bp, Homo sapiens
gagtttattgtcttccaggctt

SEQ ID NO: 8234990 - DNA, 22 bp, Homo sapiens
gagtttatttgactggattctc

SEQ ID NO: 8234991 - DNA, 22 bp, Homo sapiens
gagtttatttgactggattctc

SEQ ID NO: 8234992 - DNA, 22 bp, Homo sapiens
gaggctgggaagtccaatatca

SEQ ID NO: 8234993 - DNA, 22 bp, Homo sapiens
gaggctgggaagtccaagatca

SEQ ID NO: 8234994 - DNA, 22 bp, Homo sapiens
gaggctgggaagtccaagatca

SEQ ID NO: 8234995 - DNA, 22 bp, Homo sapiens
gaggctgggggctgccttcctc

SEQ ID NO: 8234996 - DNA, 22 bp, Homo sapiens
gaggctgggggctgccttcctc

SEQ ID NO: 8234997 - DNA, 22 bp, Homo sapiens
gaggctgggggctgccttcctc

SEQ ID NO: 8234998 - DNA, 22 bp, Homo sapiens
gaggctgggggctgccttcctc

SEQ ID NO: 8234999 - DNA, 22 bp, Homo sapiens
gaggctgggaagtccaagatca

SEQ ID NO: 8235000 - DNA, 22 bp, Homo sapiens
gaggctgggaagtccaagacca

SEQ ID NO: 8235001 - DNA, 22 bp, Homo sapiens
gaggctgggaagtccaagacca

SEQ ID NO: 8235002 - DNA, 16 bp, Homo sapiens
gaggctggcagatgtc

SEQ ID NO: 8235003 - DNA, 22 bp, Homo sapiens
gagggcagagtctaatgatgca

SEQ ID NO: 8235004 - DNA, 22 bp, Homo sapiens
gagggcagagtctaatgatgca

SEQ ID NO: 8235005 - DNA, 16 bp, Homo sapiens
gagggcagaggcggaa

SEQ ID NO: 8235006 - DNA, 16 bp, Homo sapiens
gagggcagaggcggaa

SEQ ID NO: 8235007 - DNA, 16 bp, Homo sapiens
gagggcagaggcggaa

SEQ ID NO: 8235008 - DNA, 22 bp, Homo sapiens
gaggctggggtctgcctttctg

SEQ ID NO: 8235009 - DNA, 22 bp, Homo sapiens
gagggatctttaggcagcctca

SEQ ID NO: 8235010 - DNA, 22 bp, Homo sapiens
gagggatgcagaaacagaggcc

SEQ ID NO: 8235011 - DNA, 22 bp, Homo sapiens
gagggatgcagaaacagaggcc

SEQ ID NO: 8235012 - DNA, 22 bp, Homo sapiens
gagggatggtagttgacactga

SEQ ID NO: 8235013 - DNA, 22 bp, Homo sapiens
gagggatgcagaaacagaggcc

SEQ ID NO: 8235014 - DNA, 22 bp, Homo sapiens
gagggatgcagaaacagaggcc

SEQ ID NO: 8235015 - DNA, 22 bp, Homo sapiens
gagggcagagacagtgattcac

SEQ ID NO: 8235016 - DNA, 22 bp, Homo sapiens
gagggcagagacagtgattcac

SEQ ID NO: 8235017 - DNA, 16 bp, Homo sapiens
gaggctggcagatgtc

SEQ ID NO: 8235018 - DNA, 22 bp, Homo sapiens
gaggctggcagaaaagcacagg

SEQ ID NO: 8235019 - DNA, 22 bp, Homo sapiens
gaggctggaggtcaaagatgaa

SEQ ID NO: 8235020 - DNA, 22 bp, Homo sapiens
gaggctggcagaaaagcacagg

SEQ ID NO: 8235021 - DNA, 22 bp, Homo sapiens
gaggctggaggtcaaagatgaa

SEQ ID NO: 8235022 - DNA, 22 bp, Homo sapiens
gaggctggaggtcaaagatgaa

SEQ ID NO: 8235023 - DNA, 22 bp, Homo sapiens
gaggctggaggtcaaagatgaa

SEQ ID NO: 8235024 - DNA, 22 bp, Homo sapiens
gaggctggaggtcaaagatgaa

SEQ ID NO: 8235025 - DNA, 22 bp, Homo sapiens
gaggctggagatattccaatct

SEQ ID NO: 8235026 - DNA, 22 bp, Homo sapiens
gaggctggacgtgcatttctac

SEQ ID NO: 8235027 - DNA, 22 bp, Homo sapiens
gaggctggacgtgcatttctac

SEQ ID NO: 8235028 - DNA, 22 bp, Homo sapiens
gaggctggagatattccaatct

SEQ ID NO: 8235029 - DNA, 22 bp, Homo sapiens
gaggctggaggtcaaagatgaa

SEQ ID NO: 8235030 - DNA, 22 bp, Homo sapiens
gaggctgcccaactggagtgga

SEQ ID NO: 8235031 - DNA, 22 bp, Homo sapiens
gaggctgcccaactggagtgga

SEQ ID NO: 8235032 - DNA, 22 bp, Homo sapiens
gaggctgcccacacctgcgccg

SEQ ID NO: 8235033 - DNA, 22 bp, Homo sapiens
gaggctggacgtgcatttctac

SEQ ID NO: 8235034 - DNA, 22 bp, Homo sapiens
gaggctggaatattagaaatgt

SEQ ID NO: 8235035 - DNA, 22 bp, Homo sapiens
gaggcctgaggctgcctggagc

SEQ ID NO: 8235036 - DNA, 22 bp, Homo sapiens
gaggcctgaggctgcctggagc

SEQ ID NO: 8235037 - DNA, 22 bp, Homo sapiens
gaggcctgaggctgcctggagc

SEQ ID NO: 8235038 - DNA, 22 bp, Homo sapiens
gaggcctgcagcgtggtccctg

SEQ ID NO: 8235039 - DNA, 22 bp, Homo sapiens
gaggcctgcagcgtggtccctg

SEQ ID NO: 8235040 - DNA, 22 bp, Homo sapiens
gaggcctgctttggcactctgg

SEQ ID NO: 8235041 - DNA, 22 bp, Homo sapiens
gaggcctgctttggcactctgg

SEQ ID NO: 8235042 - DNA, 22 bp, Homo sapiens
gaggctgcccaactggagtgga

SEQ ID NO: 8235043 - DNA, 22 bp, Homo sapiens
gagggccaatgtgtccctgagc

SEQ ID NO: 8235044 - DNA, 22 bp, Homo sapiens
gaggggaaagtgtgaggctgcg

SEQ ID NO: 8235045 - DNA, 22 bp, Homo sapiens
gagggccaaagagcaagagcct

SEQ ID NO: 8235046 - DNA, 22 bp, Homo sapiens
gagggccaaagagcaagagcct

SEQ ID NO: 8235047 - DNA, 22 bp, Homo sapiens
gagggccaaagagcaagagcct

SEQ ID NO: 8235048 - DNA, 22 bp, Homo sapiens
gagggccaaagagcaagagcct

SEQ ID NO: 8235049 - DNA, 22 bp, Homo sapiens
gagggcatctagagcctaatcc

SEQ ID NO: 8235050 - DNA, 22 bp, Homo sapiens
gagggcatagttaaataggagg

SEQ ID NO: 8235051 - DNA, 22 bp, Homo sapiens
gagggcagtgaattttgaagct

SEQ ID NO: 8235052 - DNA, 22 bp, Homo sapiens
gagggcagagtctaatgatgca

SEQ ID NO: 8235053 - DNA, 20 bp, Homo sapiens
gagggcaggcacccatttca

SEQ ID NO: 8235054 - DNA, 20 bp, Homo sapiens
gagggcaggcacccatttca

SEQ ID NO: 8235055 - DNA, 22 bp, Homo sapiens
gagggcaggggtcttgcacggt

SEQ ID NO: 8235056 - DNA, 22 bp, Homo sapiens
gagggcaggggtcttgcacggt

SEQ ID NO: 8235057 - DNA, 20 bp, Homo sapiens
gagggcaggcacccatttca

SEQ ID NO: 8235058 - DNA, 22 bp, Homo sapiens
gagggcagtgaattttgaagct

SEQ ID NO: 8235059 - DNA, 22 bp, Homo sapiens
gagggcagtagcctcgtaccct

SEQ ID NO: 8235060 - DNA, 22 bp, Homo sapiens
gagggcagtagcctcgtaccct

SEQ ID NO: 8235061 - DNA, 22 bp, Homo sapiens
gagggcagtagcctcgtaccct

SEQ ID NO: 8235062 - DNA, 22 bp, Homo sapiens
gagggcagtagcctcgtaccct

SEQ ID NO: 8235063 - DNA, 22 bp, Homo sapiens
gagggcagtagcctcgtaccct

SEQ ID NO: 8235064 - DNA, 22 bp, Homo sapiens
gagggcaggggtcttgcacggt

SEQ ID NO: 8235065 - DNA, 22 bp, Homo sapiens
gagggcaggggtcttgcacggt

SEQ ID NO: 8235066 - DNA, 22 bp, Homo sapiens
gagggcaggggtcttgcacggt

SEQ ID NO: 8235067 - DNA, 22 bp, Homo sapiens
gagggcaggggtcttgcacggt

SEQ ID NO: 8235068 - DNA, 22 bp, Homo sapiens
gaggggagtgtcctccgggccc

SEQ ID NO: 8235069 - DNA, 22 bp, Homo sapiens
gaggggagtaaagtcatgttac

SEQ ID NO: 8235070 - DNA, 22 bp, Homo sapiens
gaggggagtgtcctccgggccc

SEQ ID NO: 8235071 - DNA, 22 bp, Homo sapiens
gaggggcaatgagggaaagagt

SEQ ID NO: 8235072 - DNA, 22 bp, Homo sapiens
gaggggatgcagagaggcttat

SEQ ID NO: 8235073 - DNA, 22 bp, Homo sapiens
gaggggcaagaagttggcctct

SEQ ID NO: 8235074 - DNA, 22 bp, Homo sapiens
gaggggcacagtaaagggtccc

SEQ ID NO: 8235075 - DNA, 22 bp, Homo sapiens
gaggggcacagtaaagggtccc

SEQ ID NO: 8235076 - DNA, 22 bp, Homo sapiens
gaggggcagaatgtgatcaggg

SEQ ID NO: 8235077 - DNA, 22 bp, Homo sapiens
gaggggccggcatgtgcctctc

SEQ ID NO: 8235078 - DNA, 22 bp, Homo sapiens
gaggggcagaggtagagaacaa

SEQ ID NO: 8235079 - DNA, 21 bp, Homo sapiens
gaggggcagctcttagcatta

SEQ ID NO: 8235080 - DNA, 22 bp, Homo sapiens
gaggggcaggattattgggatt

SEQ ID NO: 8235081 - DNA, 22 bp, Homo sapiens
gaggtggtcgaggaggggtacc

SEQ ID NO: 8235082 - DNA, 22 bp, Homo sapiens
gaggtggtcgaggaggggtacc

SEQ ID NO: 8235083 - DNA, 22 bp, Homo sapiens
gaggtggtggtggaggcatagc

SEQ ID NO: 8235084 - DNA, 22 bp, Homo sapiens
gaggtggtggtggaggcatagc

SEQ ID NO: 8235085 - DNA, 22 bp, Homo sapiens
gaggtggtttgtggtgactcat

SEQ ID NO: 8235086 - DNA, 22 bp, Homo sapiens
gaggtggtttgtggtgactcat

SEQ ID NO: 8235087 - DNA, 22 bp, Homo sapiens
gaggtggttcaggtagagccca

SEQ ID NO: 8235088 - DNA, 22 bp, Homo sapiens
gaggtggttcaggtagagccca

SEQ ID NO: 8235089 - DNA, 22 bp, Homo sapiens
gaggtgtcagggtagtcatgat

SEQ ID NO: 8235090 - DNA, 22 bp, Homo sapiens
gaggtgtcactattttgcttat

SEQ ID NO: 8235091 - DNA, 22 bp, Homo sapiens
gaggtggttcaggtagagccca

SEQ ID NO: 8235092 - DNA, 22 bp, Homo sapiens
gaggtgtcagggtagtcatgat

SEQ ID NO: 8235093 - DNA, 22 bp, Homo sapiens
gaggtgtcactattttgcttat

SEQ ID NO: 8235094 - DNA, 22 bp, Homo sapiens
gaggtgtcagggtagtcatgat

SEQ ID NO: 8235095 - DNA, 19 bp, Homo sapiens
gaggtgggtccccgcagcc

SEQ ID NO: 8235096 - DNA, 22 bp, Homo sapiens
gaggtgggtgtatcacaggtca

SEQ ID NO: 8235097 - DNA, 22 bp, Homo sapiens
gaggtgggtgtatcacaggtca

SEQ ID NO: 8235098 - DNA, 22 bp, Homo sapiens
gaggtgtctggcctttgtagga

SEQ ID NO: 8235099 - DNA, 22 bp, Homo sapiens
gaggtgtctgctgtgttcaaag

SEQ ID NO: 8235100 - DNA, 22 bp, Homo sapiens
gagtcagaaagtagtgtgccta

SEQ ID NO: 8235101 - DNA, 22 bp, Homo sapiens
gaggtgtcccgcagtccccaag

SEQ ID NO: 8235102 - DNA, 22 bp, Homo sapiens
gaggtgtccctgaccctttgca

SEQ ID NO: 8235103 - DNA, 22 bp, Homo sapiens
gaggtgtcctcagccaactctg

SEQ ID NO: 8235104 - DNA, 22 bp, Homo sapiens
gaggtgtcgtagattattctca

SEQ ID NO: 8235105 - DNA, 22 bp, Homo sapiens
gaggtgtcctcagccaactctg

SEQ ID NO: 8235106 - DNA, 22 bp, Homo sapiens
gaggtgtcctcagccaactctg

SEQ ID NO: 8235107 - DNA, 22 bp, Homo sapiens
gaggtgtcctagaagtattcag

SEQ ID NO: 8235108 - DNA, 22 bp, Homo sapiens
gaggtgtctgagtggggacctg

SEQ ID NO: 8235109 - DNA, 22 bp, Homo sapiens
gaggtgtctagatctaccagta

SEQ ID NO: 8235110 - DNA, 22 bp, Homo sapiens
gaggtgtctgctgtgttcaaag

SEQ ID NO: 8235111 - DNA, 22 bp, Homo sapiens
gaggtgtcgtagattattctca

SEQ ID NO: 8235112 - DNA, 22 bp, Homo sapiens
gaggtgtctgagtggggacctg

SEQ ID NO: 8235113 - DNA, 22 bp, Homo sapiens
gaggtgtctagatctaccagta

SEQ ID NO: 8235114 - DNA, 22 bp, Homo sapiens
gaggtgtcctagaagtattcag

SEQ ID NO: 8235115 - DNA, 22 bp, Homo sapiens
gaggtgtccctgaccctttgca

SEQ ID NO: 8235116 - DNA, 22 bp, Homo sapiens
gaggtgtcccgcagtccccaag

SEQ ID NO: 8235117 - DNA, 22 bp, Homo sapiens
gaggtgtcatttagttaatcag

SEQ ID NO: 8235118 - DNA, 22 bp, Homo sapiens
gaggtgtcatgagggcctgctc

SEQ ID NO: 8235119 - DNA, 22 bp, Homo sapiens
gaggtgtcatgagggcctgctc

SEQ ID NO: 8235120 - DNA, 22 bp, Homo sapiens
gaggtgtcatcaggcagctctg

SEQ ID NO: 8235121 - DNA, 22 bp, Homo sapiens
gaggtgtcatttagttaatcag

SEQ ID NO: 8235122 - DNA, 22 bp, Homo sapiens
gaggtgtcatcaggcagctctg

SEQ ID NO: 8235123 - DNA, 22 bp, Homo sapiens
gagtcaggctagggtgacaggc

SEQ ID NO: 8235124 - DNA, 22 bp, Homo sapiens
gagtcaggagtcctgtgtgaga

SEQ ID NO: 8235125 - DNA, 22 bp, Homo sapiens
gagtcagaatgtcctcctgcgg

SEQ ID NO: 8235126 - DNA, 22 bp, Homo sapiens
gagtcagaccgactgggctcat

SEQ ID NO: 8235127 - DNA, 22 bp, Homo sapiens
gagtcagattgcagacagggct

SEQ ID NO: 8235128 - DNA, 22 bp, Homo sapiens
gagtcagaccgactgggctcat

SEQ ID NO: 8235129 - DNA, 22 bp, Homo sapiens
gagtccagacaccatacctgat

SEQ ID NO: 8235130 - DNA, 22 bp, Homo sapiens
gagtccagttctttccagcagt

SEQ ID NO: 8235131 - DNA, 22 bp, Homo sapiens
gagtcatttgggggcttcttga

SEQ ID NO: 8235132 - DNA, 22 bp, Homo sapiens
gagtcagtaatggatatgtcat

SEQ ID NO: 8235133 - DNA, 22 bp, Homo sapiens
gagtcatgcactgtctttctcc

SEQ ID NO: 8235134 - DNA, 22 bp, Homo sapiens
gagtcctcaacggggagaggcg

SEQ ID NO: 8235135 - DNA, 22 bp, Homo sapiens
gagtcctgaatcctgtggcaac

SEQ ID NO: 8235136 - DNA, 22 bp, Homo sapiens
gagtcccatgatgatagccaca

SEQ ID NO: 8235137 - DNA, 22 bp, Homo sapiens
gagtccagttgttcacagaggc

SEQ ID NO: 8235138 - DNA, 22 bp, Homo sapiens
gagtccagttgttcacagaggc

SEQ ID NO: 8235139 - DNA, 22 bp, Homo sapiens
gaggtatagttctattagatga

SEQ ID NO: 8235140 - DNA, 22 bp, Homo sapiens
gaggtaggtgtaggaggcctgc

SEQ ID NO: 8235141 - DNA, 22 bp, Homo sapiens
gaggtaggtgtaggaggcctgc

SEQ ID NO: 8235142 - DNA, 22 bp, Homo sapiens
gagggttgtaagattgtagagc

SEQ ID NO: 8235143 - DNA, 22 bp, Homo sapiens
gaggtaacaactgaaatgagaa

SEQ ID NO: 8235144 - DNA, 22 bp, Homo sapiens
gaggtaggtgtaggaggcctgc

SEQ ID NO: 8235145 - DNA, 22 bp, Homo sapiens
gaggtcaaggtcaagagacaga

SEQ ID NO: 8235146 - DNA, 19 bp, Homo sapiens
gaggtcagcaagaagtatt

SEQ ID NO: 8235147 - DNA, 19 bp, Homo sapiens
gaggtcagcaagaagtatt

SEQ ID NO: 8235148 - DNA, 22 bp, Homo sapiens
gaggtatcttagagagtgtaga

SEQ ID NO: 8235149 - DNA, 22 bp, Homo sapiens
gaggtattggccattgtctgtt

SEQ ID NO: 8235150 - DNA, 22 bp, Homo sapiens
gaggtatttttgcatgcctgat

SEQ ID NO: 8235151 - DNA, 23 bp, Homo sapiens
gaggtcaaggctgcagtgattgc

SEQ ID NO: 8235152 - DNA, 22 bp, Homo sapiens
gaggggctcttgggcatgaagg

SEQ ID NO: 8235153 - DNA, 22 bp, Homo sapiens
gaggggctcttgggcatgaagg

SEQ ID NO: 8235154 - DNA, 22 bp, Homo sapiens
gaggggcgtcctgagtgggcct

SEQ ID NO: 8235155 - DNA, 22 bp, Homo sapiens
gaggggctcttgggcatgaagg

SEQ ID NO: 8235156 - DNA, 22 bp, Homo sapiens
gagggtgtctggatgctagact

SEQ ID NO: 8235157 - DNA, 22 bp, Homo sapiens
gagggtgtgaacactggctgtg

SEQ ID NO: 8235158 - DNA, 22 bp, Homo sapiens
gaggggccggcatgtgcctctc

SEQ ID NO: 8235159 - DNA, 22 bp, Homo sapiens
gaggggcctggcactgagctgg

SEQ ID NO: 8235160 - DNA, 22 bp, Homo sapiens
gaggggcctggcactgagctgg

SEQ ID NO: 8235161 - DNA, 22 bp, Homo sapiens
gaggggcctggcgaggacatgt

SEQ ID NO: 8235162 - DNA, 22 bp, Homo sapiens
gaggggcctggcgaggacatgt

SEQ ID NO: 8235163 - DNA, 22 bp, Homo sapiens
gaggggcctggcgaggacatgt

SEQ ID NO: 8235164 - DNA, 22 bp, Homo sapiens
gaggtcccccatggctgtgact

SEQ ID NO: 8235165 - DNA, 22 bp, Homo sapiens
gaggtcccccatggctgtgact

SEQ ID NO: 8235166 - DNA, 22 bp, Homo sapiens
gaggtccattttcacatatgat

SEQ ID NO: 8235167 - DNA, 22 bp, Homo sapiens
gaggtccagggtggggcctgag

SEQ ID NO: 8235168 - DNA, 22 bp, Homo sapiens
gaggtccagggtggggcctgag

SEQ ID NO: 8235169 - DNA, 22 bp, Homo sapiens
gaggtccatacagctattctac

SEQ ID NO: 8235170 - DNA, 22 bp, Homo sapiens
gaggtccagagcaggttcagtg

SEQ ID NO: 8235171 - DNA, 22 bp, Homo sapiens
gaggtccagagcaggttcagtg

SEQ ID NO: 8235172 - DNA, 22 bp, Homo sapiens
gaggtccagggtggggcctgag

SEQ ID NO: 8235173 - DNA, 22 bp, Homo sapiens
gaggtccagccaagcggcaagg

SEQ ID NO: 8235174 - DNA, 22 bp, Homo sapiens
gaggtccagccaagcggcaagg

SEQ ID NO: 8235175 - DNA, 22 bp, Homo sapiens
gaggtggggttttgttcttgaa

SEQ ID NO: 8235176 - DNA, 22 bp, Homo sapiens
gaggtgggcggatcacaaggtc

SEQ ID NO: 8235177 - DNA, 22 bp, Homo sapiens
gaggtgggatgtgtgtgctact

SEQ ID NO: 8235178 - DNA, 22 bp, Homo sapiens
gaggtgggatgtgtgtgctact

SEQ ID NO: 8235179 - DNA, 22 bp, Homo sapiens
gaggtgggatgtgtgtgctact

SEQ ID NO: 8235180 - DNA, 22 bp, Homo sapiens
gaggtcatctgttttggttact

SEQ ID NO: 8235181 - DNA, 22 bp, Homo sapiens
gaggtcatgcaaaattgaatca

SEQ ID NO: 8235182 - DNA, 22 bp, Homo sapiens
gaggtccactgaggcaacaggg

SEQ ID NO: 8235183 - DNA, 22 bp, Homo sapiens
gaggtccaacacaatgggtgtt

SEQ ID NO: 8235184 - DNA, 22 bp, Homo sapiens
gaggtccactgaggcaacaggg

SEQ ID NO: 8235185 - DNA, 22 bp, Homo sapiens
gaggtccactgaggcaacaggg

SEQ ID NO: 8235186 - DNA, 22 bp, Homo sapiens
gaggtccactgaggcaacaggg

SEQ ID NO: 8235187 - DNA, 22 bp, Homo sapiens
gaggtcagtcagaccagggttt

SEQ ID NO: 8235188 - DNA, 22 bp, Homo sapiens
gaggtcagtcagaccagggttt

SEQ ID NO: 8235189 - DNA, 22 bp, Homo sapiens
gaggtcagtcagaccagggttt

SEQ ID NO: 8235190 - DNA, 22 bp, Homo sapiens
gaggtcatcaccaatatatgcc

SEQ ID NO: 8235191 - DNA, 22 bp, Homo sapiens
gaggtcataattggtttgtagt

SEQ ID NO: 8235192 - DNA, 22 bp, Homo sapiens
gaggtcaggtgaggaattaaga

SEQ ID NO: 8235193 - DNA, 22 bp, Homo sapiens
gaggtcaggggagaggctgatg

SEQ ID NO: 8235194 - DNA, 22 bp, Homo sapiens
gaggtcaggcttgcagcagggt

SEQ ID NO: 8235195 - DNA, 22 bp, Homo sapiens
gaggtcaggcttgcagcagggt

SEQ ID NO: 8235196 - DNA, 22 bp, Homo sapiens
gaggtcaggcttgcagcagggt

SEQ ID NO: 8235197 - DNA, 22 bp, Homo sapiens
gaggtcaggcttgcagcagggt

SEQ ID NO: 8235198 - DNA, 22 bp, Homo sapiens
gaggtcaggggagaggctgatg

SEQ ID NO: 8235199 - DNA, 22 bp, Homo sapiens
gaggtcaggctcaagctgggcc

SEQ ID NO: 8235200 - DNA, 22 bp, Homo sapiens
gaggtcaggctcaagctgggcc

SEQ ID NO: 8235201 - DNA, 22 bp, Homo sapiens
gaggtcaggctcaagctgggcc

SEQ ID NO: 8235202 - DNA, 22 bp, Homo sapiens
gaggccctgaagacagctgggg

SEQ ID NO: 8235203 - DNA, 22 bp, Homo sapiens
gaggccctgaagacagctgggg

SEQ ID NO: 8235204 - DNA, 22 bp, Homo sapiens
gaggccctgaagacagctgggg

SEQ ID NO: 8235205 - DNA, 22 bp, Homo sapiens
gaggccctcttgccacaatgaa

SEQ ID NO: 8235206 - DNA, 22 bp, Homo sapiens
gaggccctgaagacagctgggg

SEQ ID NO: 8235207 - DNA, 22 bp, Homo sapiens
gaggcctataggcaagtgctgc

SEQ ID NO: 8235208 - DNA, 22 bp, Homo sapiens
gaggccctggtaggtcagagtg

SEQ ID NO: 8235209 - DNA, 21 bp, Homo sapiens
gaggcctcagcctcagctcct

SEQ ID NO: 8235210 - DNA, 22 bp, Homo sapiens
gaggccctccagctgtcagctg

SEQ ID NO: 8235211 - DNA, 21 bp, Homo sapiens
gaggcccatgggacaggggct

SEQ ID NO: 8235212 - DNA, 22 bp, Homo sapiens
gaggccctccagctgtcagctg

SEQ ID NO: 8235213 - DNA, 22 bp, Homo sapiens
gaggccctcttgccacaatgaa

SEQ ID NO: 8235214 - DNA, 22 bp, Homo sapiens
gaggcccagtcctgcaagcacg

SEQ ID NO: 8235215 - DNA, 22 bp, Homo sapiens
gaggcccagtggagggccatgg

SEQ ID NO: 8235216 - DNA, 22 bp, Homo sapiens
gaggcccagtcctgcaagcacg

SEQ ID NO: 8235217 - DNA, 19 bp, Homo sapiens
gaggcccatgagggtgctc

SEQ ID NO: 8235218 - DNA, 22 bp, Homo sapiens
gaggcctgaggctgcctggagc

SEQ ID NO: 8235219 - DNA, 18 bp, Homo sapiens
gaggcctgagaaccaggt

SEQ ID NO: 8235220 - DNA, 18 bp, Homo sapiens
gaggcctgagaaccaggt

SEQ ID NO: 8235221 - DNA, 18 bp, Homo sapiens
gaggcctgagaaccaggt

SEQ ID NO: 8235222 - DNA, 22 bp, Homo sapiens
gaggcctgaaaggggacctatg

SEQ ID NO: 8235223 - DNA, 22 bp, Homo sapiens
gaggcctgaaaggggacctatg

SEQ ID NO: 8235224 - DNA, 22 bp, Homo sapiens
gaggcctcttctttgttaacct

SEQ ID NO: 8235225 - DNA, 22 bp, Homo sapiens
gaggcctctgtcccgccaggga

SEQ ID NO: 8235226 - DNA, 17 bp, Homo sapiens
gaggcctcttggcatct

SEQ ID NO: 8235227 - DNA, 22 bp, Homo sapiens
gaggcctcctctgagacatctg

SEQ ID NO: 8235228 - DNA, 22 bp, Homo sapiens
gaggcctcatgaggtgagcatt

SEQ ID NO: 8235229 - DNA, 21 bp, Homo sapiens
gaggcctcagcctcagctcct

SEQ ID NO: 8235230 - DNA, 22 bp, Homo sapiens
gaggcctcagcctgccctgaac

SEQ ID NO: 8235231 - DNA, 22 bp, Homo sapiens
gaggcctctgtcccaccaggga

SEQ ID NO: 8235232 - DNA, 22 bp, Homo sapiens
gaggcctctgtcccaccaggga

SEQ ID NO: 8235233 - DNA, 22 bp, Homo sapiens
gaggcagctgggatacaaggga

SEQ ID NO: 8235234 - DNA, 22 bp, Homo sapiens
gaggcagctgaaggagtgacag

SEQ ID NO: 8235235 - DNA, 22 bp, Homo sapiens
gaggcagctgaaggagtgacag

SEQ ID NO: 8235236 - DNA, 22 bp, Homo sapiens
gaggcagctgggctggtggttt

SEQ ID NO: 8235237 - DNA, 22 bp, Homo sapiens
gaggcagctgggctggtggttt

SEQ ID NO: 8235238 - DNA, 22 bp, Homo sapiens
gaggcagctgggatacaaggga

SEQ ID NO: 8235239 - DNA, 22 bp, Homo sapiens
gaggcagctgggtccggtcggg

SEQ ID NO: 8235240 - DNA, 22 bp, Homo sapiens
gaggcccagggtacaggccgct

SEQ ID NO: 8235241 - DNA, 22 bp, Homo sapiens
gaggcccagcattcagggcagg

SEQ ID NO: 8235242 - DNA, 22 bp, Homo sapiens
gaggcccagcattcagggcagg

SEQ ID NO: 8235243 - DNA, 22 bp, Homo sapiens
gaggcccagcattcagggcagg

SEQ ID NO: 8235244 - DNA, 22 bp, Homo sapiens
gaggcccaggtcaagcagccac

SEQ ID NO: 8235245 - DNA, 22 bp, Homo sapiens
gaggcccaggtcaagcagccac

SEQ ID NO: 8235246 - DNA, 22 bp, Homo sapiens
gaggcccagggtacaggccgct

SEQ ID NO: 8235247 - DNA, 22 bp, Homo sapiens
gaggcccagggtacaggccgct

SEQ ID NO: 8235248 - DNA, 22 bp, Homo sapiens
gaggcccagtcctgcaagcacg

SEQ ID NO: 8235249 - DNA, 22 bp, Homo sapiens
gaggcccaggtcaagcagccac

SEQ ID NO: 8235250 - DNA, 22 bp, Homo sapiens
gaggcccaggtcaagcagccac

SEQ ID NO: 8235251 - DNA, 22 bp, Homo sapiens
gaggcccagtcctgcaagcacg

SEQ ID NO: 8235252 - DNA, 22 bp, Homo sapiens
gaggcagcaggctgaggaggat

SEQ ID NO: 8235253 - DNA, 22 bp, Homo sapiens
gaggcagcagaacatggaagag

SEQ ID NO: 8235254 - DNA, 22 bp, Homo sapiens
gaggcagcaggctgaggaggat

SEQ ID NO: 8235255 - DNA, 22 bp, Homo sapiens
gaggcagctgaaggagtgacag

SEQ ID NO: 8235256 - DNA, 23 bp, Homo sapiens
gaggcagctcctgcagtgccctg

SEQ ID NO: 8235257 - DNA, 18 bp, Homo sapiens
gaggcagctagcaatttt

SEQ ID NO: 8235258 - DNA, 23 bp, Homo sapiens
gaggcagctcctgcagtgccctg

SEQ ID NO: 8235259 - DNA, 23 bp, Homo sapiens
gaggcagctcctgcagtgccctg

SEQ ID NO: 8235260 - DNA, 23 bp, Homo sapiens
gaggcagctcctgcagtgccctg

SEQ ID NO: 8235261 - DNA, 23 bp, Homo sapiens
gaggcagctcctgcagtgccctg

SEQ ID NO: 8235262 - DNA, 22 bp, Homo sapiens
gaggaggtcccccgacatgcct

SEQ ID NO: 8235263 - DNA, 22 bp, Homo sapiens
gaggaggtcccccgacatgcct

SEQ ID NO: 8235264 - DNA, 22 bp, Homo sapiens
gaggaggtcccccgacatgcct

SEQ ID NO: 8235265 - DNA, 22 bp, Homo sapiens
gaggaggtcgctgctgagcccc

SEQ ID NO: 8235266 - DNA, 22 bp, Homo sapiens
gaggaggtcgctgctgagcccc

SEQ ID NO: 8235267 - DNA, 22 bp, Homo sapiens
gaggagggttggccttaggtag

SEQ ID NO: 8235268 - DNA, 22 bp, Homo sapiens
gaggagggttggccttaggtag

SEQ ID NO: 8235269 - DNA, 22 bp, Homo sapiens
gaggagggttggccttaggtag

SEQ ID NO: 8235270 - DNA, 22 bp, Homo sapiens
gaggcagaggttgcagtgagct

SEQ ID NO: 8235271 - DNA, 22 bp, Homo sapiens
gaggcagaggttgcagtgagct

SEQ ID NO: 8235272 - DNA, 22 bp, Homo sapiens
gaggcagaggttgcagtgagct

SEQ ID NO: 8235273 - DNA, 22 bp, Homo sapiens
gaggcagaggttgcagtgagct

SEQ ID NO: 8235274 - DNA, 22 bp, Homo sapiens
gaggaggtggaattccaggaat

SEQ ID NO: 8235275 - DNA, 22 bp, Homo sapiens
gaggaggtctcctccgcagggg

SEQ ID NO: 8235276 - DNA, 22 bp, Homo sapiens
gaggaggtggaattccaggaat

SEQ ID NO: 8235277 - DNA, 22 bp, Homo sapiens
gaggaggtggagtcatgcagag

SEQ ID NO: 8235278 - DNA, 22 bp, Homo sapiens
gaggaggtggagtcatgcagag

SEQ ID NO: 8235279 - DNA, 22 bp, Homo sapiens
gaggcagcagaacatggaagag

SEQ ID NO: 8235280 - DNA, 22 bp, Homo sapiens
gaggcagcagaacatggaagag

SEQ ID NO: 8235281 - DNA, 22 bp, Homo sapiens
gaggcagcaaaatatatcataa

SEQ ID NO: 8235282 - DNA, 22 bp, Homo sapiens
gaggcagagtgcaccccaggag

SEQ ID NO: 8235283 - DNA, 22 bp, Homo sapiens
gaggcagagtgcaccccaggag

SEQ ID NO: 8235284 - DNA, 22 bp, Homo sapiens
gaggcagagtgcaccccaggag

SEQ ID NO: 8235285 - DNA, 22 bp, Homo sapiens
gaggcagagtcacaaagagtct

SEQ ID NO: 8235286 - DNA, 22 bp, Homo sapiens
gaggcagagtcacaaagagtct

SEQ ID NO: 8235287 - DNA, 22 bp, Homo sapiens
gaggcagagtgcaccccaggag

SEQ ID NO: 8235288 - DNA, 22 bp, Homo sapiens
gaggcagagtcacaaagagtct

SEQ ID NO: 8235289 - DNA, 22 bp, Homo sapiens
gaggcagagtcacaaagagtct

SEQ ID NO: 8235290 - DNA, 22 bp, Homo sapiens
gaggcagagtcacaaagagtct

SEQ ID NO: 8235291 - DNA, 22 bp, Homo sapiens
gaggcagaggttgttgcagtga

SEQ ID NO: 8235292 - DNA, 22 bp, Homo sapiens
gaggcagaggttgttgcagtga

SEQ ID NO: 8235293 - DNA, 22 bp, Homo sapiens
gaggcagaggttgcagtgagct

SEQ ID NO: 8235294 - DNA, 22 bp, Homo sapiens
gaggcagaggttgcagtgagct

SEQ ID NO: 8235295 - DNA, 22 bp, Homo sapiens
gaggcagaggttgttgcagtga

SEQ ID NO: 8235296 - DNA, 22 bp, Homo sapiens
gaggaggctgtttctctgcatt

SEQ ID NO: 8235297 - DNA, 22 bp, Homo sapiens
gaggaggctgtttctctgcatt

SEQ ID NO: 8235298 - DNA, 22 bp, Homo sapiens
gaggaggctgtttctctgcatt

SEQ ID NO: 8235299 - DNA, 22 bp, Homo sapiens
gaggaggcttccgggaggcacg

SEQ ID NO: 8235300 - DNA, 22 bp, Homo sapiens
gaggaggcttccgggaggcacg

SEQ ID NO: 8235301 - DNA, 22 bp, Homo sapiens
gaggaggcttccgggaggcacg

SEQ ID NO: 8235302 - DNA, 22 bp, Homo sapiens
gaggaggcttccgggaggcacg

SEQ ID NO: 8235303 - DNA, 22 bp, Homo sapiens
gaggaggcttccgggaggcacg

SEQ ID NO: 8235304 - DNA, 22 bp, Homo sapiens
gaggagggagaattaggcttaa

SEQ ID NO: 8235305 - DNA, 22 bp, Homo sapiens
gaggagggagaattaggcttaa

SEQ ID NO: 8235306 - DNA, 22 bp, Homo sapiens
gaggagggagctggaagctctt

SEQ ID NO: 8235307 - DNA, 22 bp, Homo sapiens
gaggagggagctggaagctctt

SEQ ID NO: 8235308 - DNA, 22 bp, Homo sapiens
gaggagggagctggaagctctt

SEQ ID NO: 8235309 - DNA, 23 bp, Homo sapiens
gaggagggtctgacaagtgtagc

SEQ ID NO: 8235310 - DNA, 23 bp, Homo sapiens
gaggagggtctgacaagtgtagc

SEQ ID NO: 8235311 - DNA, 22 bp, Homo sapiens
gaggagggttggccttaggtag

SEQ ID NO: 8235312 - DNA, 23 bp, Homo sapiens
gaggagggtctgacaagtgtagc

SEQ ID NO: 8235313 - DNA, 22 bp, Homo sapiens
gaggagggagctggaagctctt

SEQ ID NO: 8235314 - DNA, 22 bp, Homo sapiens
gaggagggagctggaagctctt

SEQ ID NO: 8235315 - DNA, 23 bp, Homo sapiens
gaggagggtctgacaagtgtagc

SEQ ID NO: 8235316 - DNA, 22 bp, Homo sapiens
gaggacagagccgcctggcaag

SEQ ID NO: 8235317 - DNA, 22 bp, Homo sapiens
gaggacagagccgcctggcaag

SEQ ID NO: 8235318 - DNA, 22 bp, Homo sapiens
gaggacagagccgcctggcaag

SEQ ID NO: 8235319 - DNA, 22 bp, Homo sapiens
gaggacacatgactccagcagg

SEQ ID NO: 8235320 - DNA, 22 bp, Homo sapiens
gaggacagagccgcctggcaag

SEQ ID NO: 8235321 - DNA, 22 bp, Homo sapiens
gaggacagcttagggcttcctg

SEQ ID NO: 8235322 - DNA, 22 bp, Homo sapiens
gaggacagcttagggcttcctg

SEQ ID NO: 8235323 - DNA, 22 bp, Homo sapiens
gaggacagcttagggcttcctg

SEQ ID NO: 8235324 - DNA, 22 bp, Homo sapiens
gaggacagcttagggcttcctg

SEQ ID NO: 8235325 - DNA, 22 bp, Homo sapiens
gaggacagcttagggcttcctg

SEQ ID NO: 8235326 - DNA, 22 bp, Homo sapiens
gaggacagcttagggcttcctg

SEQ ID NO: 8235327 - DNA, 22 bp, Homo sapiens
gaggaatgggtgtctcgtgatt

SEQ ID NO: 8235328 - DNA, 21 bp, Homo sapiens
gaggaatggtttgcaaagcac

SEQ ID NO: 8235329 - DNA, 22 bp, Homo sapiens
gaggaatgggtgtctcgtgatt

SEQ ID NO: 8235330 - DNA, 22 bp, Homo sapiens
gaggaaggtcccatcagaattt

SEQ ID NO: 8235331 - DNA, 22 bp, Homo sapiens
gaggaaggtcccatcagaattt

SEQ ID NO: 8235332 - DNA, 22 bp, Homo sapiens
gaggaaggtcccatcagaattt

SEQ ID NO: 8235333 - DNA, 22 bp, Homo sapiens
gaggaaggtcccatcagaattt

SEQ ID NO: 8235334 - DNA, 22 bp, Homo sapiens
gaggaagttctatgattacatc

SEQ ID NO: 8235335 - DNA, 22 bp, Homo sapiens
gaggaagttaggatacattggt

SEQ ID NO: 8235336 - DNA, 22 bp, Homo sapiens
gaggacaaagcccaggtgctgg

SEQ ID NO: 8235337 - DNA, 22 bp, Homo sapiens
gaggaatgttattaaaggagct

SEQ ID NO: 8235338 - DNA, 22 bp, Homo sapiens
gaggaatgtcagcacaggcctc

SEQ ID NO: 8235339 - DNA, 22 bp, Homo sapiens
gaggaatgttattaaaggagct

SEQ ID NO: 8235340 - DNA, 22 bp, Homo sapiens
gaggacaaagcccaggtgctgg

SEQ ID NO: 8235341 - DNA, 22 bp, Homo sapiens
gaggacaagctgtgagtggggt

SEQ ID NO: 8235342 - DNA, 22 bp, Homo sapiens
gaggacacaaagtggctgagat

SEQ ID NO: 8235343 - DNA, 23 bp, Homo sapiens
gaggacacagcccagacagccgt

SEQ ID NO: 8235344 - DNA, 23 bp, Homo sapiens
gagctgggatacaggcttactgc

SEQ ID NO: 8235345 - DNA, 22 bp, Homo sapiens
gagctgggattcatctatgtct

SEQ ID NO: 8235346 - DNA, 22 bp, Homo sapiens
gaggaagaattggttattggag

SEQ ID NO: 8235347 - DNA, 23 bp, Homo sapiens
gagctgggatacaggcttactgc

SEQ ID NO: 8235348 - DNA, 22 bp, Homo sapiens
gaggaagagcatggccagtttc

SEQ ID NO: 8235349 - DNA, 22 bp, Homo sapiens
gaggaagagagctctgccttgt

SEQ ID NO: 8235350 - DNA, 22 bp, Homo sapiens
gaggaaggtcccatcagaattt

SEQ ID NO: 8235351 - DNA, 22 bp, Homo sapiens
gaggaagggctgcctgccgggc

SEQ ID NO: 8235352 - DNA, 22 bp, Homo sapiens
gaggaagggctgcctgccgggc

SEQ ID NO: 8235353 - DNA, 22 bp, Homo sapiens
gaggaagggctgcctgccgggc

SEQ ID NO: 8235354 - DNA, 22 bp, Homo sapiens
gaggaagggctgcctgccgggc

SEQ ID NO: 8235355 - DNA, 22 bp, Homo sapiens
gaggaagggactttattatctg

SEQ ID NO: 8235356 - DNA, 22 bp, Homo sapiens
gaggaagatggttgagtggtcc

SEQ ID NO: 8235357 - DNA, 22 bp, Homo sapiens
gaggaagggactttattatctg

SEQ ID NO: 8235358 - DNA, 22 bp, Homo sapiens
gagctgggagttatagcatgtt

SEQ ID NO: 8235359 - DNA, 22 bp, Homo sapiens
gagctgggaggactgggaactt

SEQ ID NO: 8235360 - DNA, 22 bp, Homo sapiens
gagctgggaggactgggaactt

SEQ ID NO: 8235361 - DNA, 22 bp, Homo sapiens
gagctgggaggactgggaactt

SEQ ID NO: 8235362 - DNA, 22 bp, Homo sapiens
gagctgggagctgggatttgga

SEQ ID NO: 8235363 - DNA, 22 bp, Homo sapiens
gagctgggagctgggatttgga

SEQ ID NO: 8235364 - DNA, 22 bp, Homo sapiens
gagctgggagctgggatttgga

SEQ ID NO: 8235365 - DNA, 18 bp, Homo sapiens
gagctgggagaaggaagg

SEQ ID NO: 8235366 - DNA, 18 bp, Homo sapiens
gagctgggagaaggaagg

SEQ ID NO: 8235367 - DNA, 18 bp, Homo sapiens
gagctgggagaaggaagg

SEQ ID NO: 8235368 - DNA, 18 bp, Homo sapiens
gagctgggagaaggaagg

SEQ ID NO: 8235369 - DNA, 22 bp, Homo sapiens
gagctgggacttggaatccaca

SEQ ID NO: 8235370 - DNA, 22 bp, Homo sapiens
gagctgggacttggaatccaca

SEQ ID NO: 8235371 - DNA, 22 bp, Homo sapiens
gagctgggacatgggtcctctc

SEQ ID NO: 8235372 - DNA, 22 bp, Homo sapiens
gagctgggacatgggtcctctc

SEQ ID NO: 8235373 - DNA, 22 bp, Homo sapiens
gagctgggacatgggtcctctc

SEQ ID NO: 8235374 - DNA, 22 bp, Homo sapiens
gagctgggaagatagcttgagc

SEQ ID NO: 8235375 - DNA, 22 bp, Homo sapiens
gagctgggaagatagcttgagc

SEQ ID NO: 8235376 - DNA, 22 bp, Homo sapiens
gagctggctgtggttgagtgca

SEQ ID NO: 8235377 - DNA, 22 bp, Homo sapiens
gagctggctgtggttgagtgca

SEQ ID NO: 8235378 - DNA, 22 bp, Homo sapiens
gagctggcctcaggcacaggag

SEQ ID NO: 8235379 - DNA, 22 bp, Homo sapiens
gagctggcctcaggcacaggag

SEQ ID NO: 8235380 - DNA, 22 bp, Homo sapiens
gagctggcctcaggcacaggag

SEQ ID NO: 8235381 - DNA, 22 bp, Homo sapiens
gagctggcctcaggcacaggag

SEQ ID NO: 8235382 - DNA, 22 bp, Homo sapiens
gagctggcctcaggcacaggag

SEQ ID NO: 8235383 - DNA, 22 bp, Homo sapiens
gagctggctccgccatgctgct

SEQ ID NO: 8235384 - DNA, 22 bp, Homo sapiens
gagctggctccgccatgctgct

SEQ ID NO: 8235385 - DNA, 22 bp, Homo sapiens
gagctggctccgccatgctgct

SEQ ID NO: 8235386 - DNA, 22 bp, Homo sapiens
gagctggctccgccatgctgct

SEQ ID NO: 8235387 - DNA, 22 bp, Homo sapiens
gagctggctaatactgacttat

SEQ ID NO: 8235388 - DNA, 22 bp, Homo sapiens
gagctggctgtggttgagtgca

SEQ ID NO: 8235389 - DNA, 22 bp, Homo sapiens
gagctggctcctccgaggatgg

SEQ ID NO: 8235390 - DNA, 22 bp, Homo sapiens
gagctggctccgccatgctgct

SEQ ID NO: 8235391 - DNA, 22 bp, Homo sapiens
gagctgcttgcccagaagcaga

SEQ ID NO: 8235392 - DNA, 22 bp, Homo sapiens
gagctggaagtctgtggtcaga

SEQ ID NO: 8235393 - DNA, 22 bp, Homo sapiens
gagctggaggaccaggactggg

SEQ ID NO: 8235394 - DNA, 22 bp, Homo sapiens
gagctggaggcagtgctgaggt

SEQ ID NO: 8235395 - DNA, 22 bp, Homo sapiens
gagctggaggcagtgctgaggt

SEQ ID NO: 8235396 - DNA, 22 bp, Homo sapiens
gagctggcaagtctgtccttgg

SEQ ID NO: 8235397 - DNA, 22 bp, Homo sapiens
gagctggaggcagtgctgaggt

SEQ ID NO: 8235398 - DNA, 22 bp, Homo sapiens
gagctggcacagaaggatctta

SEQ ID NO: 8235399 - DNA, 22 bp, Homo sapiens
gagctggcaatgacttgtgtat

SEQ ID NO: 8235400 - DNA, 22 bp, Homo sapiens
gagctggcacagaaggatctta

SEQ ID NO: 8235401 - DNA, 22 bp, Homo sapiens
gagctggcaatgacttgtgtat

SEQ ID NO: 8235402 - DNA, 22 bp, Homo sapiens
gagctggcacagaaggatctta

SEQ ID NO: 8235403 - DNA, 22 bp, Homo sapiens
gagctggcagtggtagacatgg

SEQ ID NO: 8235404 - DNA, 22 bp, Homo sapiens
gagctggcagtggtagacatgg

SEQ ID NO: 8235405 - DNA, 22 bp, Homo sapiens
gagctggcaggaggctccccga

SEQ ID NO: 8235406 - DNA, 22 bp, Homo sapiens
gagctggccgcagagagggcag

SEQ ID NO: 8235407 - DNA, 22 bp, Homo sapiens
gagctggccgcagagagggcag

SEQ ID NO: 8235408 - DNA, 22 bp, Homo sapiens
gagctggccgcagagagggcag

SEQ ID NO: 8235409 - DNA, 22 bp, Homo sapiens
gagagtggatggagctgcgaag

SEQ ID NO: 8235410 - DNA, 22 bp, Homo sapiens
gagagtggatggagctgcgaag

SEQ ID NO: 8235411 - DNA, 22 bp, Homo sapiens
gagagtggatggagctgcgaag

SEQ ID NO: 8235412 - DNA, 22 bp, Homo sapiens
gagagtgatgaatggttaaaca

SEQ ID NO: 8235413 - DNA, 22 bp, Homo sapiens
gagagtggaaagcaagctgagt

SEQ ID NO: 8235414 - DNA, 22 bp, Homo sapiens
gagagtggaaagcaagctgagt

SEQ ID NO: 8235415 - DNA, 22 bp, Homo sapiens
gagagtgaggcctgggaatcta

SEQ ID NO: 8235416 - DNA, 22 bp, Homo sapiens
gagagtgaggcatcaggggcag

SEQ ID NO: 8235417 - DNA, 22 bp, Homo sapiens
gagagtgaggcatcaggggcag

SEQ ID NO: 8235418 - DNA, 22 bp, Homo sapiens
gagagtgagatcctcctgggga

SEQ ID NO: 8235419 - DNA, 22 bp, Homo sapiens
gagagtgagatcctcctgggga

SEQ ID NO: 8235420 - DNA, 22 bp, Homo sapiens
gagagtctagtgcacctagttt

SEQ ID NO: 8235421 - DNA, 22 bp, Homo sapiens
gagagtgtctggaggaagctaa

SEQ ID NO: 8235422 - DNA, 22 bp, Homo sapiens
gagagtgtctggaggaagctaa

SEQ ID NO: 8235423 - DNA, 19 bp, Homo sapiens
gagatactgaagtgaggaa

SEQ ID NO: 8235424 - DNA, 22 bp, Homo sapiens
gagatacagttggctgcaggct

SEQ ID NO: 8235425 - DNA, 22 bp, Homo sapiens
gagatatattaacattaatctt

SEQ ID NO: 8235426 - DNA, 22 bp, Homo sapiens
gagatatattaacattaatctt

SEQ ID NO: 8235427 - DNA, 22 bp, Homo sapiens
gagatatattaacattaatctt

SEQ ID NO: 8235428 - DNA, 19 bp, Homo sapiens
gagatatagaagtagatgt

SEQ ID NO: 8235429 - DNA, 19 bp, Homo sapiens
gagatatagaagtagatgt

SEQ ID NO: 8235430 - DNA, 22 bp, Homo sapiens
gagatatgttggcagctggtat

SEQ ID NO: 8235431 - DNA, 22 bp, Homo sapiens
gagagctgcattctcagacaca

SEQ ID NO: 8235432 - DNA, 18 bp, Homo sapiens
gagagctgctacctagct

SEQ ID NO: 8235433 - DNA, 17 bp, Homo sapiens
gagagctgctgcttccg

SEQ ID NO: 8235434 - DNA, 17 bp, Homo sapiens
gagagctgctgcttccg

SEQ ID NO: 8235435 - DNA, 17 bp, Homo sapiens
gagagctgctgcttccg

SEQ ID NO: 8235436 - DNA, 22 bp, Homo sapiens
gagagctgcagccgagaggggg

SEQ ID NO: 8235437 - DNA, 22 bp, Homo sapiens
gagagctgcaaggtagggcggg

SEQ ID NO: 8235438 - DNA, 22 bp, Homo sapiens
gagagctgcaaggtagggcggg

SEQ ID NO: 8235439 - DNA, 22 bp, Homo sapiens
gagagctgaggggcctggcact

SEQ ID NO: 8235440 - DNA, 22 bp, Homo sapiens
gagagctgaggggcctggcact

SEQ ID NO: 8235441 - DNA, 22 bp, Homo sapiens
gagagctgatagatgagctact

SEQ ID NO: 8235442 - DNA, 22 bp, Homo sapiens
gagagctccatgttcatgctgt

SEQ ID NO: 8235443 - DNA, 23 bp, Homo sapiens
gagagctgactgtcaagactgtt

SEQ ID NO: 8235444 - DNA, 23 bp, Homo sapiens
gagagctgactgtcaagactgtt

SEQ ID NO: 8235445 - DNA, 22 bp, Homo sapiens
gagagccctgctcctatcccag

SEQ ID NO: 8235446 - DNA, 22 bp, Homo sapiens
gagacagatctcggctccatgc

SEQ ID NO: 8235447 - DNA, 22 bp, Homo sapiens
gagacagatctcggctccatgc

SEQ ID NO: 8235448 - DNA, 22 bp, Homo sapiens
gagacagatctcggctccatgc

SEQ ID NO: 8235449 - DNA, 22 bp, Homo sapiens
gagacagagtttcactcttgtt

SEQ ID NO: 8235450 - DNA, 22 bp, Homo sapiens
gagacagagtttcactcttgtt

SEQ ID NO: 8235451 - DNA, 22 bp, Homo sapiens
gagacagagtttcactcttgtt

SEQ ID NO: 8235452 - DNA, 22 bp, Homo sapiens
gagacagagatcttgctgagtc

SEQ ID NO: 8235453 - DNA, 22 bp, Homo sapiens
gagacagagatcttgctgagtc

SEQ ID NO: 8235454 - DNA, 22 bp, Homo sapiens
gagacagagatcttgctgagtc

SEQ ID NO: 8235455 - DNA, 22 bp, Homo sapiens
gagaggtacggaaagagcgtgg

SEQ ID NO: 8235456 - DNA, 22 bp, Homo sapiens
gagaggtacggaaagagcgtgg

SEQ ID NO: 8235457 - DNA, 22 bp, Homo sapiens
gagaggtacaccctttaaactt

SEQ ID NO: 8235458 - DNA, 22 bp, Homo sapiens
gagaggtacggaaagagcgtgg

SEQ ID NO: 8235459 - DNA, 22 bp, Homo sapiens
gagaggtagaggctctgcttaa

SEQ ID NO: 8235460 - DNA, 22 bp, Homo sapiens
gagagtccttagtttgcaggta

SEQ ID NO: 8235461 - DNA, 22 bp, Homo sapiens
gagagtctaggaacctcatata

SEQ ID NO: 8235462 - DNA, 22 bp, Homo sapiens
gagagtctaggaacctcatata

SEQ ID NO: 8235463 - DNA, 22 bp, Homo sapiens
gagagctgggggactgtggatg

SEQ ID NO: 8235464 - DNA, 20 bp, Homo sapiens
gagagctggggatgaggctg

SEQ ID NO: 8235465 - DNA, 22 bp, Homo sapiens
gagagctgggggactgtggatg

SEQ ID NO: 8235466 - DNA, 22 bp, Homo sapiens
gagagctgggggactgtggatg

SEQ ID NO: 8235467 - DNA, 22 bp, Homo sapiens
gagagctgggttcaagtagctg

SEQ ID NO: 8235468 - DNA, 22 bp, Homo sapiens
gagagctgggttcaagtagctg

SEQ ID NO: 8235469 - DNA, 22 bp, Homo sapiens
gagagctgggttcaagtagctg

SEQ ID NO: 8235470 - DNA, 22 bp, Homo sapiens
gagagctgggctttgggtgaag

SEQ ID NO: 8235471 - DNA, 22 bp, Homo sapiens
gagagctgggctttgggtgaag

SEQ ID NO: 8235472 - DNA, 22 bp, Homo sapiens
gagagctgggctttgggtgaag

SEQ ID NO: 8235473 - DNA, 22 bp, Homo sapiens
gagagctgggaaagccgtggag

SEQ ID NO: 8235474 - DNA, 22 bp, Homo sapiens
gagagctgggaaagccgtggag

SEQ ID NO: 8235475 - DNA, 22 bp, Homo sapiens
gagagctgggaaagccgtggag

SEQ ID NO: 8235476 - DNA, 22 bp, Homo sapiens
gagagctgggctttgggtgaag

SEQ ID NO: 8235477 - DNA, 20 bp, Homo sapiens
gagagctggggatgaggctg

SEQ ID NO: 8235478 - DNA, 22 bp, Homo sapiens
gagagctgggctttgggtgaag

SEQ ID NO: 8235479 - DNA, 20 bp, Homo sapiens
gagagctggggatgaggctg

SEQ ID NO: 8235480 - DNA, 20 bp, Homo sapiens
gagagctggggatgaggctg

SEQ ID NO: 8235481 - DNA, 22 bp, Homo sapiens
gagagctgggaaagccgtggag

SEQ ID NO: 8235482 - DNA, 22 bp, Homo sapiens
gagagctggccagcttcagtat

SEQ ID NO: 8235483 - DNA, 22 bp, Homo sapiens
gagagctggattctggataggt

SEQ ID NO: 8235484 - DNA, 22 bp, Homo sapiens
gagagctggattctggataggt

SEQ ID NO: 8235485 - DNA, 22 bp, Homo sapiens
gagagctggattctggataggt

SEQ ID NO: 8235486 - DNA, 22 bp, Homo sapiens
gagagctggattctggataggt

SEQ ID NO: 8235487 - DNA, 22 bp, Homo sapiens
gagagctggattctggataggt

SEQ ID NO: 8235488 - DNA, 22 bp, Homo sapiens
gagacacacccaaggttatgag

SEQ ID NO: 8235489 - DNA, 22 bp, Homo sapiens
gagacacacccaaggttatgag

SEQ ID NO: 8235490 - DNA, 22 bp, Homo sapiens
gagacacacacaggaggtggca

SEQ ID NO: 8235491 - DNA, 22 bp, Homo sapiens
gagacacacacaggaggtggca

SEQ ID NO: 8235492 - DNA, 22 bp, Homo sapiens
gagacacaatctcatttacatt

SEQ ID NO: 8235493 - DNA, 22 bp, Homo sapiens
gagacacaagaagacatgcaca

SEQ ID NO: 8235494 - DNA, 22 bp, Homo sapiens
gagacacaagacgcaactctgt

SEQ ID NO: 8235495 - DNA, 18 bp, Homo sapiens
gagacacaagggcctgga

SEQ ID NO: 8235496 - DNA, 22 bp, Homo sapiens
gagacacagcagatattcaatc

SEQ ID NO: 8235497 - DNA, 22 bp, Homo sapiens
gagacacaggcacagaagaggc

SEQ ID NO: 8235498 - DNA, 22 bp, Homo sapiens
gagacactcaacaaagatatga

SEQ ID NO: 8235499 - DNA, 22 bp, Homo sapiens
gagacacagttatcaggcatac

SEQ ID NO: 8235500 - DNA, 22 bp, Homo sapiens
gagacacagttatcaggcatac

SEQ ID NO: 8235501 - DNA, 22 bp, Homo sapiens
gagacacagttatcaggcatac

SEQ ID NO: 8235502 - DNA, 22 bp, Homo sapiens
gagacagagatcttgctgagtc

SEQ ID NO: 8235503 - DNA, 22 bp, Homo sapiens
gagacacttgctgtgaggtcgc

SEQ ID NO: 8235504 - DNA, 21 bp, Homo sapiens
gagacagactttcgtcccctg

SEQ ID NO: 8235505 - DNA, 22 bp, Homo sapiens
gagacacaagaagacatgcaca

SEQ ID NO: 8235506 - DNA, 22 bp, Homo sapiens
gagaaacaacacttgatgcctt

SEQ ID NO: 8235507 - DNA, 22 bp, Homo sapiens
gagaaacaacacttgatgcctt

SEQ ID NO: 8235508 - DNA, 22 bp, Homo sapiens
gagaaacaacacttgatgcctt

SEQ ID NO: 8235509 - DNA, 22 bp, Homo sapiens
gagaaaatcttgggtcaagaat

SEQ ID NO: 8235510 - DNA, 22 bp, Homo sapiens
gagaaaatcttgggtcaagaat

SEQ ID NO: 8235511 - DNA, 22 bp, Homo sapiens
gagaaaatgtcagacttggtcg

SEQ ID NO: 8235512 - DNA, 22 bp, Homo sapiens
gacttttccatcatccccctta

SEQ ID NO: 8235513 - DNA, 22 bp, Homo sapiens
gacttttagaatggtgaggaat

SEQ ID NO: 8235514 - DNA, 22 bp, Homo sapiens
gacttttgaataaggtaggata

SEQ ID NO: 8235515 - DNA, 22 bp, Homo sapiens
gagaaaagcgaaggacctggag

SEQ ID NO: 8235516 - DNA, 22 bp, Homo sapiens
gagaaaagcgaaggacctggag

SEQ ID NO: 8235517 - DNA, 22 bp, Homo sapiens
gacttttctgagacaatgcttt

SEQ ID NO: 8235518 - DNA, 22 bp, Homo sapiens
gagaaaagcgaaggacctggag

SEQ ID NO: 8235519 - DNA, 22 bp, Homo sapiens
gactttattatagtggcaatag

SEQ ID NO: 8235520 - DNA, 22 bp, Homo sapiens
gactttattatagtggcaatag

SEQ ID NO: 8235521 - DNA, 22 bp, Homo sapiens
gactttattatagtggcaatag

SEQ ID NO: 8235522 - DNA, 22 bp, Homo sapiens
gactttattcgttaactgttaa

SEQ ID NO: 8235523 - DNA, 22 bp, Homo sapiens
gactttattcgttaactgttaa

SEQ ID NO: 8235524 - DNA, 22 bp, Homo sapiens
gactttattcgttaactgttaa

SEQ ID NO: 8235525 - DNA, 22 bp, Homo sapiens
gactttatttccttatttgtga

SEQ ID NO: 8235526 - DNA, 22 bp, Homo sapiens
gactttatttccttatttgtga

SEQ ID NO: 8235527 - DNA, 22 bp, Homo sapiens
gactttattttaacggagattc

SEQ ID NO: 8235528 - DNA, 22 bp, Homo sapiens
gactttattttaacggagattc

SEQ ID NO: 8235529 - DNA, 22 bp, Homo sapiens
gactttattactaaccctgtga

SEQ ID NO: 8235530 - DNA, 22 bp, Homo sapiens
gactttattactaaccctgtga

SEQ ID NO: 8235531 - DNA, 22 bp, Homo sapiens
gactttatgaagagatgaccaa

SEQ ID NO: 8235532 - DNA, 22 bp, Homo sapiens
gactttatgaagagatgaccaa

SEQ ID NO: 8235533 - DNA, 22 bp, Homo sapiens
gactttatcttgtccttcctgc

SEQ ID NO: 8235534 - DNA, 22 bp, Homo sapiens
gactttatgaagagatgaccaa

SEQ ID NO: 8235535 - DNA, 22 bp, Homo sapiens
gactttatcttgtccttcctgc

SEQ ID NO: 8235536 - DNA, 22 bp, Homo sapiens
gactttataaatgagaggcgga

SEQ ID NO: 8235537 - DNA, 22 bp, Homo sapiens
gactttatcctgcctgaccacg

SEQ ID NO: 8235538 - DNA, 22 bp, Homo sapiens
gactttataaatgagaggcgga

SEQ ID NO: 8235539 - DNA, 22 bp, Homo sapiens
gactttataaatgagaggcgga

SEQ ID NO: 8235540 - DNA, 22 bp, Homo sapiens
gactttatcctgcctgaccacg

SEQ ID NO: 8235541 - DNA, 22 bp, Homo sapiens
gactttatcctgcctgaccacg

SEQ ID NO: 8235542 - DNA, 22 bp, Homo sapiens
gactgtccagaattcctaggtg

SEQ ID NO: 8235543 - DNA, 22 bp, Homo sapiens
gactggtttgccaccgacagat

SEQ ID NO: 8235544 - DNA, 22 bp, Homo sapiens
gactggtttctagcctcatagt

SEQ ID NO: 8235545 - DNA, 22 bp, Homo sapiens
gactgtgccagtcagtgggcgg

SEQ ID NO: 8235546 - DNA, 22 bp, Homo sapiens
gactgtcttgtttctaagatga

SEQ ID NO: 8235547 - DNA, 22 bp, Homo sapiens
gactgtctcctgtcatgaggga

SEQ ID NO: 8235548 - DNA, 22 bp, Homo sapiens
gactgtccagaattcctaggtg

SEQ ID NO: 8235549 - DNA, 22 bp, Homo sapiens
gactgcttaaatatatgatgtt

SEQ ID NO: 8235550 - DNA, 22 bp, Homo sapiens
gactgcttatatgttaaagata

SEQ ID NO: 8235551 - DNA, 22 bp, Homo sapiens
gactgcttatatgttaaagata

SEQ ID NO: 8235552 - DNA, 22 bp, Homo sapiens
gactgcttcccagtaagggttt

SEQ ID NO: 8235553 - DNA, 22 bp, Homo sapiens
gactgctttggtttgtaaatgt

SEQ ID NO: 8235554 - DNA, 22 bp, Homo sapiens
gactgctttgacaaatgatacc

SEQ ID NO: 8235555 - DNA, 22 bp, Homo sapiens
gactgctttgaccaatagcaca

SEQ ID NO: 8235556 - DNA, 22 bp, Homo sapiens
gactgcttccctgggattgctc

SEQ ID NO: 8235557 - DNA, 22 bp, Homo sapiens
gactgcttctccttggtaggtt

SEQ ID NO: 8235558 - DNA, 22 bp, Homo sapiens
gactgcttgagaaggaacaaat

SEQ ID NO: 8235559 - DNA, 22 bp, Homo sapiens
gactgctttaaccaagaaagca

SEQ ID NO: 8235560 - DNA, 22 bp, Homo sapiens
gacccagggtttctgcacaggg

SEQ ID NO: 8235561 - DNA, 22 bp, Homo sapiens
gacccagggtggtcacctgaaa

SEQ ID NO: 8235562 - DNA, 22 bp, Homo sapiens
gacccagggtttctgcacaggg

SEQ ID NO: 8235563 - DNA, 22 bp, Homo sapiens
gactgggtcctctgcttatggt

SEQ ID NO: 8235564 - DNA, 22 bp, Homo sapiens
gactggttgctaagcacagctt

SEQ ID NO: 8235565 - DNA, 22 bp, Homo sapiens
gactggttgaactcaggacaga

SEQ ID NO: 8235566 - DNA, 22 bp, Homo sapiens
gactggttatccccagcacaca

SEQ ID NO: 8235567 - DNA, 22 bp, Homo sapiens
gactggggtaaggtgaggaggt

SEQ ID NO: 8235568 - DNA, 22 bp, Homo sapiens
gactggaaagcctgtcctcaga

SEQ ID NO: 8235569 - DNA, 22 bp, Homo sapiens
gactgcttttctagtctaaaat

SEQ ID NO: 8235570 - DNA, 22 bp, Homo sapiens
gactggaaagcctgtcctcaga

SEQ ID NO: 8235571 - DNA, 22 bp, Homo sapiens
gacttcataatattgagcatgt

SEQ ID NO: 8235572 - DNA, 22 bp, Homo sapiens
gacttcatgacattcaggtcag

SEQ ID NO: 8235573 - DNA, 21 bp, Homo sapiens
gacttcatgggtcaaccaatt

SEQ ID NO: 8235574 - DNA, 22 bp, Homo sapiens
gacttctcatgaggggaggtca

SEQ ID NO: 8235575 - DNA, 22 bp, Homo sapiens
gacttctccagactgcctggta

SEQ ID NO: 8235576 - DNA, 22 bp, Homo sapiens
gacttctcccaaccatcagagg

SEQ ID NO: 8235577 - DNA, 22 bp, Homo sapiens
gacttctcccaaccatcagagg

SEQ ID NO: 8235578 - DNA, 22 bp, Homo sapiens
gacttctcggcaccctttggca

SEQ ID NO: 8235579 - DNA, 22 bp, Homo sapiens
gacttctccgtcatctccagtg

SEQ ID NO: 8235580 - DNA, 19 bp, Homo sapiens
gacttctgatgtccagatg

SEQ ID NO: 8235581 - DNA, 22 bp, Homo sapiens
gacttctgaattcctatcaggt

SEQ ID NO: 8235582 - DNA, 22 bp, Homo sapiens
gacttctgagctatccagctgt

SEQ ID NO: 8235583 - DNA, 22 bp, Homo sapiens
gacttctctgcatgagataagt

SEQ ID NO: 8235584 - DNA, 21 bp, Homo sapiens
gacttatctatattctattta

SEQ ID NO: 8235585 - DNA, 22 bp, Homo sapiens
gacttatctatgagtgggtttt

SEQ ID NO: 8235586 - DNA, 22 bp, Homo sapiens
gactgtgtccatgtgctggatt

SEQ ID NO: 8235587 - DNA, 22 bp, Homo sapiens
gacttaaaggctgaatgtagga

SEQ ID NO: 8235588 - DNA, 22 bp, Homo sapiens
gacttaaaggctgaatgtagga

SEQ ID NO: 8235589 - DNA, 22 bp, Homo sapiens
gacttaaaggctgaatgtagga

SEQ ID NO: 8235590 - DNA, 22 bp, Homo sapiens
gactgttattgttaatagcatg

SEQ ID NO: 8235591 - DNA, 22 bp, Homo sapiens
gacttggggatttatctcacag

SEQ ID NO: 8235592 - DNA, 22 bp, Homo sapiens
gacttgcctgcactgagcctat

SEQ ID NO: 8235593 - DNA, 22 bp, Homo sapiens
gacttgcctgcactgagcctat

SEQ ID NO: 8235594 - DNA, 22 bp, Homo sapiens
gacttgaatcccaactcctctc

SEQ ID NO: 8235595 - DNA, 22 bp, Homo sapiens
gacttcttcatgtcttttccac

SEQ ID NO: 8235596 - DNA, 22 bp, Homo sapiens
gactttaaaatgctagaacagg

SEQ ID NO: 8235597 - DNA, 22 bp, Homo sapiens
gactttaaaatgctagaacagg

SEQ ID NO: 8235598 - DNA, 22 bp, Homo sapiens
gactttaaaatgctagaacagg

SEQ ID NO: 8235599 - DNA, 21 bp, Homo sapiens
gactttaatttgagagcaaaa

SEQ ID NO: 8235600 - DNA, 22 bp, Homo sapiens
gactttaaaagtttgtgcttgg

SEQ ID NO: 8235601 - DNA, 18 bp, Homo sapiens
gactttaaaacactgctc

SEQ ID NO: 8235602 - DNA, 18 bp, Homo sapiens
gactttaaaacactgctc

SEQ ID NO: 8235603 - DNA, 22 bp, Homo sapiens
gacttgttctctgactgcttta

SEQ ID NO: 8235604 - DNA, 22 bp, Homo sapiens
gacttgtagaatcttctctgca

SEQ ID NO: 8235605 - DNA, 22 bp, Homo sapiens
gacaggaggcagagctcaggtg

SEQ ID NO: 8235606 - DNA, 22 bp, Homo sapiens
gacaggaggcagagctcaggtg

SEQ ID NO: 8235607 - DNA, 22 bp, Homo sapiens
gacaggaggcagagctcaggtg

SEQ ID NO: 8235608 - DNA, 22 bp, Homo sapiens
gacaggaggcagagctcaggtg

SEQ ID NO: 8235609 - DNA, 22 bp, Homo sapiens
gacaggaggcagagctcaggtg

SEQ ID NO: 8235610 - DNA, 20 bp, Homo sapiens
gacaggagagttaggtaggt

SEQ ID NO: 8235611 - DNA, 22 bp, Homo sapiens
gacaggaggcagagctcaggtg

SEQ ID NO: 8235612 - DNA, 22 bp, Homo sapiens
gacaggaggcagagctcaggtg

SEQ ID NO: 8235613 - DNA, 22 bp, Homo sapiens
gacaggaggcagagctcaggtg

SEQ ID NO: 8235614 - DNA, 22 bp, Homo sapiens
gacaggaggcagagctcaggtg

SEQ ID NO: 8235615 - DNA, 22 bp, Homo sapiens
gacaggaggcagagctcaggtg

SEQ ID NO: 8235616 - DNA, 22 bp, Homo sapiens
gacaggcaattaccagcgccca

SEQ ID NO: 8235617 - DNA, 22 bp, Homo sapiens
gacaggcaattaccagcgccca

SEQ ID NO: 8235618 - DNA, 22 bp, Homo sapiens
gacaggcaattaccagcgccca

SEQ ID NO: 8235619 - DNA, 21 bp, Homo sapiens
gacaggcaaggagtcacttag

SEQ ID NO: 8235620 - DNA, 22 bp, Homo sapiens
gacaggcacgaaattgggctgg

SEQ ID NO: 8235621 - DNA, 22 bp, Homo sapiens
gacaggcaccttgtctgtcttg

SEQ ID NO: 8235622 - DNA, 22 bp, Homo sapiens
gacaggcacgaaattgggctgg

SEQ ID NO: 8235623 - DNA, 22 bp, Homo sapiens
gacaggcagacctgtgccctgg

SEQ ID NO: 8235624 - DNA, 22 bp, Homo sapiens
gaccatcctggccaacgtggta

SEQ ID NO: 8235625 - DNA, 22 bp, Homo sapiens
gaccatcctggccaacgtggta

SEQ ID NO: 8235626 - DNA, 22 bp, Homo sapiens
gaccagggtcactcacagggct

SEQ ID NO: 8235627 - DNA, 22 bp, Homo sapiens
gaccagggtcactcacagggct

SEQ ID NO: 8235628 - DNA, 22 bp, Homo sapiens
gaccagtcattactcatgccct

SEQ ID NO: 8235629 - DNA, 22 bp, Homo sapiens
gacaggcaggccagggctgtgg

SEQ ID NO: 8235630 - DNA, 22 bp, Homo sapiens
gacaggcaggccagggctgtgg

SEQ ID NO: 8235631 - DNA, 22 bp, Homo sapiens
gacaggcaggccagggctgtgg

SEQ ID NO: 8235632 - DNA, 22 bp, Homo sapiens
gacaggcagttttccagatcag

SEQ ID NO: 8235633 - DNA, 22 bp, Homo sapiens
gacaggcaggccagggctgtgg

SEQ ID NO: 8235634 - DNA, 22 bp, Homo sapiens
gacaggccagacaggagactga

SEQ ID NO: 8235635 - DNA, 22 bp, Homo sapiens
gacaggccagacaggagactga

SEQ ID NO: 8235636 - DNA, 22 bp, Homo sapiens
gacaggcatgctttcaggacta

SEQ ID NO: 8235637 - DNA, 22 bp, Homo sapiens
gacaggcatgctttcaggacta

SEQ ID NO: 8235638 - DNA, 22 bp, Homo sapiens
gacaggcatgctttcaggacta

SEQ ID NO: 8235639 - DNA, 22 bp, Homo sapiens
gacaggcatgctttcaggacta

SEQ ID NO: 8235640 - DNA, 22 bp, Homo sapiens
gacccaggaagctacttctggt

SEQ ID NO: 8235641 - DNA, 18 bp, Homo sapiens
gacccaggaaagagtcct

SEQ ID NO: 8235642 - DNA, 18 bp, Homo sapiens
gacccaggaaagagtcct

SEQ ID NO: 8235643 - DNA, 22 bp, Homo sapiens
gacccagctaaccaggtgggga

SEQ ID NO: 8235644 - DNA, 22 bp, Homo sapiens
gacccagcttaagtcacatgtt

SEQ ID NO: 8235645 - DNA, 22 bp, Homo sapiens
gacccagaaggagtgccctaga

SEQ ID NO: 8235646 - DNA, 22 bp, Homo sapiens
gacccagaggcctgacagtgtg

SEQ ID NO: 8235647 - DNA, 22 bp, Homo sapiens
gacccagaggcctgacagtgtg

SEQ ID NO: 8235648 - DNA, 22 bp, Homo sapiens
gaccatttctaggaatcagact

SEQ ID NO: 8235649 - DNA, 22 bp, Homo sapiens
gacccagggtatccagagctgc

SEQ ID NO: 8235650 - DNA, 22 bp, Homo sapiens
gacccagggtatccagagctgc

SEQ ID NO: 8235651 - DNA, 22 bp, Homo sapiens
gacccaggctcgtgggacggct

SEQ ID NO: 8235652 - DNA, 22 bp, Homo sapiens
gacccaggctcgtgggacggct

SEQ ID NO: 8235653 - DNA, 22 bp, Homo sapiens
gacccaggggcagggagaaagt

SEQ ID NO: 8235654 - DNA, 22 bp, Homo sapiens
gacccagggtatccagagctgc

SEQ ID NO: 8235655 - DNA, 22 bp, Homo sapiens
gacccagggtatccagagctgc

SEQ ID NO: 8235656 - DNA, 22 bp, Homo sapiens
gacccaggagtgcagagagtgg

SEQ ID NO: 8235657 - DNA, 22 bp, Homo sapiens
gacccaggagtgcagagagtgg

SEQ ID NO: 8235658 - DNA, 22 bp, Homo sapiens
gacccaggagagagggttgcat

SEQ ID NO: 8235659 - DNA, 22 bp, Homo sapiens
gacccaggagagagggttgcat

SEQ ID NO: 8235660 - DNA, 22 bp, Homo sapiens
gacccaggcctggggcttaagg

SEQ ID NO: 8235661 - DNA, 22 bp, Homo sapiens
gacccaggcccaaggctgccag

SEQ ID NO: 8235662 - DNA, 22 bp, Homo sapiens
gaagtggaattactgggtcata

SEQ ID NO: 8235663 - DNA, 22 bp, Homo sapiens
gaagtggaattactgggtcata

SEQ ID NO: 8235664 - DNA, 22 bp, Homo sapiens
gaagtgggctttgtggtcagct

SEQ ID NO: 8235665 - DNA, 22 bp, Homo sapiens
gaagtgggctttgtggtcagct

SEQ ID NO: 8235666 - DNA, 22 bp, Homo sapiens
gaagtgtagtcttgagccccca

SEQ ID NO: 8235667 - DNA, 22 bp, Homo sapiens
gaagtgggtggtgatatcactg

SEQ ID NO: 8235668 - DNA, 22 bp, Homo sapiens
gaagtggggaagcaacaggaga

SEQ ID NO: 8235669 - DNA, 22 bp, Homo sapiens
gaagtgggctttgtggtcagct

SEQ ID NO: 8235670 - DNA, 22 bp, Homo sapiens
gaagtggggaagcaacaggaga

SEQ ID NO: 8235671 - DNA, 22 bp, Homo sapiens
gaagtggggaagcaacaggaga

SEQ ID NO: 8235672 - DNA, 22 bp, Homo sapiens
gaagtgggtggtgatatcactg

SEQ ID NO: 8235673 - DNA, 22 bp, Homo sapiens
gaagttactctcgttaaatatg

SEQ ID NO: 8235674 - DNA, 20 bp, Homo sapiens
gaagtgtggagttgggaagc

SEQ ID NO: 8235675 - DNA, 22 bp, Homo sapiens
gaagtgtgaaggtgatgtggag

SEQ ID NO: 8235676 - DNA, 22 bp, Homo sapiens
gaagtgtgaaggtgatgtggag

SEQ ID NO: 8235677 - DNA, 20 bp, Homo sapiens
gaagtgtcttgtttctggat

SEQ ID NO: 8235678 - DNA, 22 bp, Homo sapiens
gaagtggaagccatcggcagtc

SEQ ID NO: 8235679 - DNA, 22 bp, Homo sapiens
gaagtgatgctggttgagatct

SEQ ID NO: 8235680 - DNA, 22 bp, Homo sapiens
gaagtgcaaaaccacatggtaa

SEQ ID NO: 8235681 - DNA, 22 bp, Homo sapiens
gaagtgatcttccagaagaata

SEQ ID NO: 8235682 - DNA, 22 bp, Homo sapiens
gaagtgatgacgctgtgttttt

SEQ ID NO: 8235683 - DNA, 22 bp, Homo sapiens
gaagtgaagagattagaaatca

SEQ ID NO: 8235684 - DNA, 22 bp, Homo sapiens
gaagtgaaggttactctagatt

SEQ ID NO: 8235685 - DNA, 22 bp, Homo sapiens
gaagggaactgggtctccttgt

SEQ ID NO: 8235686 - DNA, 22 bp, Homo sapiens
gaaggttttcaggagcctagtc

SEQ ID NO: 8235687 - DNA, 22 bp, Homo sapiens
gaaggttttcaggagcctagtc

SEQ ID NO: 8235688 - DNA, 22 bp, Homo sapiens
gaagtacaaaggacatggaaac

SEQ ID NO: 8235689 - DNA, 22 bp, Homo sapiens
gaaggttttgattccactgaat

SEQ ID NO: 8235690 - DNA, 22 bp, Homo sapiens
gaaggttttgtttgcaaatcat

SEQ ID NO: 8235691 - DNA, 22 bp, Homo sapiens
gaaggttttgtttgcaaatcat

SEQ ID NO: 8235692 - DNA, 22 bp, Homo sapiens
gaaggttttgattccactgaat

SEQ ID NO: 8235693 - DNA, 22 bp, Homo sapiens
gaaggctgcgaggggagtgccg

SEQ ID NO: 8235694 - DNA, 22 bp, Homo sapiens
gaaggctgcgaggggagtgccg

SEQ ID NO: 8235695 - DNA, 22 bp, Homo sapiens
gaaggctgcatggaggctgtgg

SEQ ID NO: 8235696 - DNA, 22 bp, Homo sapiens
gaaggctgagcagacaggccaa

SEQ ID NO: 8235697 - DNA, 22 bp, Homo sapiens
gaaggctgagtgggtacggagg

SEQ ID NO: 8235698 - DNA, 22 bp, Homo sapiens
gaaggctgatgacagattctgc

SEQ ID NO: 8235699 - DNA, 22 bp, Homo sapiens
gaaggctaaaggggcagaggtt

SEQ ID NO: 8235700 - DNA, 19 bp, Homo sapiens
gaaggctgaaatgaagcac

SEQ ID NO: 8235701 - DNA, 22 bp, Homo sapiens
gaaggctgcgaggggagtgccg

SEQ ID NO: 8235702 - DNA, 22 bp, Homo sapiens
gaaggcttttctaccagatctt

SEQ ID NO: 8235703 - DNA, 20 bp, Homo sapiens
gaaggcttggacagtgacag

SEQ ID NO: 8235704 - DNA, 22 bp, Homo sapiens
gaacttaacggcaactatttaa

SEQ ID NO: 8235705 - DNA, 22 bp, Homo sapiens
gaactgtgggtaatatattaga

SEQ ID NO: 8235706 - DNA, 22 bp, Homo sapiens
gaactgtgtacattgtagataa

SEQ ID NO: 8235707 - DNA, 22 bp, Homo sapiens
gaactgtgtttgtttctaggtc

SEQ ID NO: 8235708 - DNA, 22 bp, Homo sapiens
gaactgtggggtggtagcagga

SEQ ID NO: 8235709 - DNA, 22 bp, Homo sapiens
gaaggaagggctggctgtcttg

SEQ ID NO: 8235710 - DNA, 21 bp, Homo sapiens
gaaggagaaagcaagtgctgc

SEQ ID NO: 8235711 - DNA, 22 bp, Homo sapiens
gaaggacctgtccgtggtgctg

SEQ ID NO: 8235712 - DNA, 22 bp, Homo sapiens
gaaggaagtcattagtgcagac

SEQ ID NO: 8235713 - DNA, 20 bp, Homo sapiens
gaaggaagggggcaaggtga

SEQ ID NO: 8235714 - DNA, 20 bp, Homo sapiens
gaaggaagggggcaaggtga

SEQ ID NO: 8235715 - DNA, 22 bp, Homo sapiens
gaaggaagtcattagtgcagac

SEQ ID NO: 8235716 - DNA, 22 bp, Homo sapiens
gaaggaagtcattagtgcagac

SEQ ID NO: 8235717 - DNA, 22 bp, Homo sapiens
gaaggaagtcattagtgcagac

SEQ ID NO: 8235718 - DNA, 22 bp, Homo sapiens
gaaggaagtcattagtgcagac

SEQ ID NO: 8235719 - DNA, 22 bp, Homo sapiens
gaaggaagtcattagtgcagac

SEQ ID NO: 8235720 - DNA, 21 bp, Homo sapiens
gaaggagaaagcaagtgctgc

SEQ ID NO: 8235721 - DNA, 21 bp, Homo sapiens
gaaggagaaagcaagtgctgc

SEQ ID NO: 8235722 - DNA, 22 bp, Homo sapiens
gaaggagagaaaggcaattctg

SEQ ID NO: 8235723 - DNA, 22 bp, Homo sapiens
gaaggagaccctgaagatgctg

SEQ ID NO: 8235724 - DNA, 22 bp, Homo sapiens
gaaggagaggattgtgaggctg

SEQ ID NO: 8235725 - DNA, 22 bp, Homo sapiens
gaaggagaggattgtgaggctg

SEQ ID NO: 8235726 - DNA, 22 bp, Homo sapiens
gaaggagaggattgtgaggctg

SEQ ID NO: 8235727 - DNA, 22 bp, Homo sapiens
gaaggagagagacatcgtccct

SEQ ID NO: 8235728 - DNA, 19 bp, Homo sapiens
gaaggagagctgagttagg

SEQ ID NO: 8235729 - DNA, 19 bp, Homo sapiens
gaaggagagctgagttagg

SEQ ID NO: 8235730 - DNA, 19 bp, Homo sapiens
gaaggagagctgagttagg

SEQ ID NO: 8235731 - DNA, 19 bp, Homo sapiens
gaaggagagctgagttagg

SEQ ID NO: 8235732 - DNA, 22 bp, Homo sapiens
gaaggagagggtcaaggataat

SEQ ID NO: 8235733 - DNA, 22 bp, Homo sapiens
gaaggagaggattgtgaggctg

SEQ ID NO: 8235734 - DNA, 22 bp, Homo sapiens
gaaggagaggattgtgaggctg

SEQ ID NO: 8235735 - DNA, 22 bp, Homo sapiens
gaaggagagggtcaaggataat

SEQ ID NO: 8235736 - DNA, 22 bp, Homo sapiens
gaaggcccgccctgagcaaggg

SEQ ID NO: 8235737 - DNA, 22 bp, Homo sapiens
gaaggagagggtcaaggataat

SEQ ID NO: 8235738 - DNA, 22 bp, Homo sapiens
gaaggcctaggaaggaagcctt

SEQ ID NO: 8235739 - DNA, 22 bp, Homo sapiens
gaaggcctagggatgctctgcg

SEQ ID NO: 8235740 - DNA, 22 bp, Homo sapiens
gaaggcctctccccttctccag

SEQ ID NO: 8235741 - DNA, 18 bp, Homo sapiens
gacacaggagagagtccc

SEQ ID NO: 8235742 - DNA, 18 bp, Homo sapiens
gacacaggagagagtccc

SEQ ID NO: 8235743 - DNA, 18 bp, Homo sapiens
gacacaggagagagtccc

SEQ ID NO: 8235744 - DNA, 23 bp, Homo sapiens
gacacaggagcacccagctgagc

SEQ ID NO: 8235745 - DNA, 22 bp, Homo sapiens
gacacaggaaaagctccagccc

SEQ ID NO: 8235746 - DNA, 22 bp, Homo sapiens
gacacaggaaaagctccagccc

SEQ ID NO: 8235747 - DNA, 22 bp, Homo sapiens
gacacaggaaaagctccagccc

SEQ ID NO: 8235748 - DNA, 22 bp, Homo sapiens
gacacaggaaaagctccagccc

SEQ ID NO: 8235749 - DNA, 22 bp, Homo sapiens
gacacaggaaaagctccagccc

SEQ ID NO: 8235750 - DNA, 22 bp, Homo sapiens
gacacaggaatcaccttggatg

SEQ ID NO: 8235751 - DNA, 22 bp, Homo sapiens
gacacaggaatcaccttggatg

SEQ ID NO: 8235752 - DNA, 22 bp, Homo sapiens
gacacaggaatcaccttggatg

SEQ ID NO: 8235753 - DNA, 20 bp, Homo sapiens
gacacaggcagtcctcagag

SEQ ID NO: 8235754 - DNA, 20 bp, Homo sapiens
gacacaggcagtcctcagag

SEQ ID NO: 8235755 - DNA, 20 bp, Homo sapiens
gacacaggcagtcctcagag

SEQ ID NO: 8235756 - DNA, 20 bp, Homo sapiens
gacacaggcagtcctcagag

SEQ ID NO: 8235757 - DNA, 20 bp, Homo sapiens
gacacaggcagtcctcagag

SEQ ID NO: 8235758 - DNA, 22 bp, Homo sapiens
gacacaggattcctggctctgc

SEQ ID NO: 8235759 - DNA, 22 bp, Homo sapiens
gacacaggattcctggctctgc

SEQ ID NO: 8235760 - DNA, 22 bp, Homo sapiens
gacacaggattcctggctctgc

SEQ ID NO: 8235761 - DNA, 23 bp, Homo sapiens
gacacaggagcacccagctgagc

SEQ ID NO: 8235762 - DNA, 23 bp, Homo sapiens
gacacaggagcacccagctgagc

SEQ ID NO: 8235763 - DNA, 23 bp, Homo sapiens
gacacaggagcacccagctgagc

SEQ ID NO: 8235764 - DNA, 22 bp, Homo sapiens
gacacagatgatcaggtgtgga

SEQ ID NO: 8235765 - DNA, 22 bp, Homo sapiens
gacacagatgatcaggtgtgga

SEQ ID NO: 8235766 - DNA, 22 bp, Homo sapiens
gacacagatatctctgagatta

SEQ ID NO: 8235767 - DNA, 22 bp, Homo sapiens
gacacagagggcaccagatatg

SEQ ID NO: 8235768 - DNA, 22 bp, Homo sapiens
gacacagagggcaccagatatg

SEQ ID NO: 8235769 - DNA, 22 bp, Homo sapiens
gacacagagctcacagtctcct

SEQ ID NO: 8235770 - DNA, 22 bp, Homo sapiens
gacacagagataggcctgtgtt

SEQ ID NO: 8235771 - DNA, 22 bp, Homo sapiens
gacacagagataggcctgtgtt

SEQ ID NO: 8235772 - DNA, 22 bp, Homo sapiens
gacaggaagtctgaaggaggga

SEQ ID NO: 8235773 - DNA, 22 bp, Homo sapiens
gacaggaacataaatgtaggag

SEQ ID NO: 8235774 - DNA, 22 bp, Homo sapiens
gacaggaacataaatgtaggag

SEQ ID NO: 8235775 - DNA, 19 bp, Homo sapiens
gacaggaaggctaccagta

SEQ ID NO: 8235776 - DNA, 19 bp, Homo sapiens
gacaggacgaagggaagtt

SEQ ID NO: 8235777 - DNA, 19 bp, Homo sapiens
gacaggacgaagggaagtt

SEQ ID NO: 8235778 - DNA, 22 bp, Homo sapiens
gacaggaatgtgtggatgcgga

SEQ ID NO: 8235779 - DNA, 22 bp, Homo sapiens
gacaggaatgtgtggatgcgga

SEQ ID NO: 8235780 - DNA, 20 bp, Homo sapiens
gacaggagagttaggtaggt

SEQ ID NO: 8235781 - DNA, 20 bp, Homo sapiens
gacaggagagttaggtaggt

SEQ ID NO: 8235782 - DNA, 20 bp, Homo sapiens
gacaggagagttaggtaggt

SEQ ID NO: 8235783 - DNA, 22 bp, Homo sapiens
gacacaggtagaataaagtact

SEQ ID NO: 8235784 - DNA, 22 bp, Homo sapiens
gacagctgtgcaggagaagggg

SEQ ID NO: 8235785 - DNA, 22 bp, Homo sapiens
gacagctgtggagaggcatgtg

SEQ ID NO: 8235786 - DNA, 22 bp, Homo sapiens
gacacagggacgtgctctgcct

SEQ ID NO: 8235787 - DNA, 22 bp, Homo sapiens
gacacagggacgtgctctgcct

SEQ ID NO: 8235788 - DNA, 22 bp, Homo sapiens
gacacagggacgtgctctgcct

SEQ ID NO: 8235789 - DNA, 22 bp, Homo sapiens
gacacagggggatgtgtggacg

SEQ ID NO: 8235790 - DNA, 22 bp, Homo sapiens
gacacagggggatgtgtggacg

SEQ ID NO: 8235791 - DNA, 22 bp, Homo sapiens
gacacagggggatgtgtggacg

SEQ ID NO: 8235792 - DNA, 22 bp, Homo sapiens
gacacaggggggcgctagaaga

SEQ ID NO: 8235793 - DNA, 22 bp, Homo sapiens
gacacaggggggcgctagaaga

SEQ ID NO: 8235794 - DNA, 22 bp, Homo sapiens
gacacaggtagaataaagtact

SEQ ID NO: 8235795 - DNA, 22 bp, Homo sapiens
gacacaggtagaataaagtact

SEQ ID NO: 8235796 - DNA, 22 bp, Homo sapiens
gacacaggggggcgctagaaga

SEQ ID NO: 8235797 - DNA, 22 bp, Homo sapiens
gacacaggggggcgctagaaga

SEQ ID NO: 8235798 - DNA, 22 bp, Homo sapiens
gaattacatgaccctgagtaga

SEQ ID NO: 8235799 - DNA, 22 bp, Homo sapiens
gaattacatagtttctaggttc

SEQ ID NO: 8235800 - DNA, 22 bp, Homo sapiens
gaattacatgaccctgagtaga

SEQ ID NO: 8235801 - DNA, 22 bp, Homo sapiens
gaattacattgttagccttcct

SEQ ID NO: 8235802 - DNA, 22 bp, Homo sapiens
gaattacattgttagccttcct

SEQ ID NO: 8235803 - DNA, 22 bp, Homo sapiens
gaattacatttgtgttactgca

SEQ ID NO: 8235804 - DNA, 22 bp, Homo sapiens
gaattacatttgtgttactgca

SEQ ID NO: 8235805 - DNA, 22 bp, Homo sapiens
gaattagacatgctttgctttt

SEQ ID NO: 8235806 - DNA, 22 bp, Homo sapiens
gaattacatttgtgttactgca

SEQ ID NO: 8235807 - DNA, 22 bp, Homo sapiens
gaattataaactagtgacttca

SEQ ID NO: 8235808 - DNA, 19 bp, Homo sapiens
gaattatttttatgggatg

SEQ ID NO: 8235809 - DNA, 22 bp, Homo sapiens
gaattatgggcttgtttggaga

SEQ ID NO: 8235810 - DNA, 22 bp, Homo sapiens
gaattcattagggaagctatct

SEQ ID NO: 8235811 - DNA, 22 bp, Homo sapiens
gaagttatcaaagatgtattct

SEQ ID NO: 8235812 - DNA, 22 bp, Homo sapiens
gaagttatagctatgatcttaa

SEQ ID NO: 8235813 - DNA, 22 bp, Homo sapiens
gaagttatcaggattaaagttg

SEQ ID NO: 8235814 - DNA, 22 bp, Homo sapiens
gaagttattgcctgtgatgaaa

SEQ ID NO: 8235815 - DNA, 22 bp, Homo sapiens
gaagttattgcctgtgatgaaa

SEQ ID NO: 8235816 - DNA, 22 bp, Homo sapiens
gaagttatttgctatctactga

SEQ ID NO: 8235817 - DNA, 22 bp, Homo sapiens
gaagttatttgctatctactga

SEQ ID NO: 8235818 - DNA, 22 bp, Homo sapiens
gaagttatttcctggtgttgga

SEQ ID NO: 8235819 - DNA, 22 bp, Homo sapiens
gaagttattttacctgttaaag

SEQ ID NO: 8235820 - DNA, 22 bp, Homo sapiens
gaagttcaatgtcagcatctat

SEQ ID NO: 8235821 - DNA, 22 bp, Homo sapiens
gaagttcaactgccatgcttgg

SEQ ID NO: 8235822 - DNA, 22 bp, Homo sapiens
gaagttcaatgtcagcatctat

SEQ ID NO: 8235823 - DNA, 22 bp, Homo sapiens
gaattacatagtttctaggttc

SEQ ID NO: 8235824 - DNA, 22 bp, Homo sapiens
gaagttctcagctaggtgatgt

SEQ ID NO: 8235825 - DNA, 22 bp, Homo sapiens
gaagttctcaaggatcacagaa

SEQ ID NO: 8235826 - DNA, 22 bp, Homo sapiens
gaattctaaccattaagccaag

SEQ ID NO: 8235827 - DNA, 22 bp, Homo sapiens
gaattctagggtaaatatccta

SEQ ID NO: 8235828 - DNA, 22 bp, Homo sapiens
gaattctagtcacacacattca

SEQ ID NO: 8235829 - DNA, 23 bp, Homo sapiens
gaattcttaaggtcactaaagtc

SEQ ID NO: 8235830 - DNA, 22 bp, Homo sapiens
gaattctttgatcttaatcttg

SEQ ID NO: 8235831 - DNA, 22 bp, Homo sapiens
gaattcttttctttctgaaagt

SEQ ID NO: 8235832 - DNA, 22 bp, Homo sapiens
gaattgctaatccaagtgactg

SEQ ID NO: 8235833 - DNA, 22 bp, Homo sapiens
gaattgctagcgcaccaattct

SEQ ID NO: 8235834 - DNA, 22 bp, Homo sapiens
gaattgatttacgtggctctct

SEQ ID NO: 8235835 - DNA, 22 bp, Homo sapiens
gaattgatgcttatggtcaggg

SEQ ID NO: 8235836 - DNA, 22 bp, Homo sapiens
gaattgattgatatgtactgta

SEQ ID NO: 8235837 - DNA, 22 bp, Homo sapiens
gaattgcttgctgagattaaag

SEQ ID NO: 8235838 - DNA, 22 bp, Homo sapiens
gaattgtatgcagttacttgga

SEQ ID NO: 8235839 - DNA, 22 bp, Homo sapiens
gaattgtatgctgtcttgatag

SEQ ID NO: 8235840 - DNA, 22 bp, Homo sapiens
gaattgtattgatttttcagag

SEQ ID NO: 8235841 - DNA, 22 bp, Homo sapiens
gaatttaagaggatgaatctgt

SEQ ID NO: 8235842 - DNA, 22 bp, Homo sapiens
gaatttaagaggatgaatctgt

SEQ ID NO: 8235843 - DNA, 22 bp, Homo sapiens
gaatttaaatttaaatctacca

SEQ ID NO: 8235844 - DNA, 22 bp, Homo sapiens
gaatttaaatttaaatctacca

SEQ ID NO: 8235845 - DNA, 22 bp, Homo sapiens
gacacagagataggcctgtgtt

SEQ ID NO: 8235846 - DNA, 22 bp, Homo sapiens
gaaagggtctttgatttccctc

SEQ ID NO: 8235847 - DNA, 22 bp, Homo sapiens
gaaaggtcagttccacttccat

SEQ ID NO: 8235848 - DNA, 22 bp, Homo sapiens
gaaagggtctttgatttccctc

SEQ ID NO: 8235849 - DNA, 22 bp, Homo sapiens
gaaagggtctttgatttccctc

SEQ ID NO: 8235850 - DNA, 22 bp, Homo sapiens
gaaagtgccagaataggaggcc

SEQ ID NO: 8235851 - DNA, 22 bp, Homo sapiens
gaaaggttgggtgaatggtgga

SEQ ID NO: 8235852 - DNA, 22 bp, Homo sapiens
gaaaggttgggtgaatggtgga

SEQ ID NO: 8235853 - DNA, 22 bp, Homo sapiens
gaaaggtcttccggtcttccag

SEQ ID NO: 8235854 - DNA, 22 bp, Homo sapiens
gaaaggttcttgggagttcaca

SEQ ID NO: 8235855 - DNA, 18 bp, Homo sapiens
gaaagtgcggggcagggg

SEQ ID NO: 8235856 - DNA, 22 bp, Homo sapiens
gaaagtgcctcagtcctcttat

SEQ ID NO: 8235857 - DNA, 22 bp, Homo sapiens
gaaagtgccagaataggaggcc

SEQ ID NO: 8235858 - DNA, 18 bp, Homo sapiens
gaaagtgcggggcagggg

SEQ ID NO: 8235859 - DNA, 18 bp, Homo sapiens
gaaagtgcggggcagggg

SEQ ID NO: 8235860 - DNA, 22 bp, Homo sapiens
gaaagtgcttttgagtgtgtgc

SEQ ID NO: 8235861 - DNA, 22 bp, Homo sapiens
gaaagtgcttagagtgtggtat

SEQ ID NO: 8235862 - DNA, 22 bp, Homo sapiens
gaaagtttctcacacatgcaga

SEQ ID NO: 8235863 - DNA, 22 bp, Homo sapiens
gaaagtttctcacacatgcaga

SEQ ID NO: 8235864 - DNA, 22 bp, Homo sapiens
gaaagtttataggttatataat

SEQ ID NO: 8235865 - DNA, 22 bp, Homo sapiens
gaaagtttataggttatataat

SEQ ID NO: 8235866 - DNA, 22 bp, Homo sapiens
gaaagggagtgaagatggtata

SEQ ID NO: 8235867 - DNA, 22 bp, Homo sapiens
gaaagggaatggatttctgttg

SEQ ID NO: 8235868 - DNA, 22 bp, Homo sapiens
gaaaggcatcttcagtctctga

SEQ ID NO: 8235869 - DNA, 22 bp, Homo sapiens
gaaaatacttcagtgttctggc

SEQ ID NO: 8235870 - DNA, 22 bp, Homo sapiens
gaaaggcagtacagctgagcct

SEQ ID NO: 8235871 - DNA, 18 bp, Homo sapiens
gaaaatactctgggctca

SEQ ID NO: 8235872 - DNA, 18 bp, Homo sapiens
gaaaatactctgggctca

SEQ ID NO: 8235873 - DNA, 21 bp, Homo sapiens
gaaaatacaatgagcttgacc

SEQ ID NO: 8235874 - DNA, 22 bp, Homo sapiens
gaaaatacaaatagccttgaaa

SEQ ID NO: 8235875 - DNA, 21 bp, Homo sapiens
gaaaatacaatgagcttgacc

SEQ ID NO: 8235876 - DNA, 21 bp, Homo sapiens
gaaaatacaatgagcttgacc

SEQ ID NO: 8235877 - DNA, 22 bp, Homo sapiens
gaaaatacaaatagccttgaaa

SEQ ID NO: 8235878 - DNA, 22 bp, Homo sapiens
gaaaagttcatcatatattcag

SEQ ID NO: 8235879 - DNA, 22 bp, Homo sapiens
gaaaagtatgtttattttgact

SEQ ID NO: 8235880 - DNA, 22 bp, Homo sapiens
gaaaagttcatcatatattcag

SEQ ID NO: 8235881 - DNA, 22 bp, Homo sapiens
cttttacactcatctgggaggg

SEQ ID NO: 8235882 - DNA, 22 bp, Homo sapiens
gaaaacatccagagatagacct

SEQ ID NO: 8235883 - DNA, 22 bp, Homo sapiens
gaaaacactttgatctgaaagt

SEQ ID NO: 8235884 - DNA, 22 bp, Homo sapiens
cttttaagggataataagatgt

SEQ ID NO: 8235885 - DNA, 22 bp, Homo sapiens
cttttaagggataataagatgt

SEQ ID NO: 8235886 - DNA, 22 bp, Homo sapiens
ctttgttttactcagaggcatg

SEQ ID NO: 8235887 - DNA, 23 bp, Homo sapiens
cttttaactagagtatcagctgc

SEQ ID NO: 8235888 - DNA, 23 bp, Homo sapiens
cttttaacttgatctgagaccag

SEQ ID NO: 8235889 - DNA, 22 bp, Homo sapiens
ctttgtttatatttctcctcga

SEQ ID NO: 8235890 - DNA, 22 bp, Homo sapiens
ctttgttagcagccaatttgtt

SEQ ID NO: 8235891 - DNA, 22 bp, Homo sapiens
ctttgttatctgtaaatggtta

SEQ ID NO: 8235892 - DNA, 22 bp, Homo sapiens
ctttgttcatgacatctgcttc

SEQ ID NO: 8235893 - DNA, 22 bp, Homo sapiens
ctttgttctgccaatggcccat

SEQ ID NO: 8235894 - DNA, 22 bp, Homo sapiens
ctttgttctgcacacacagaca

SEQ ID NO: 8235895 - DNA, 22 bp, Homo sapiens
ctttgttctgcacacacagaca

SEQ ID NO: 8235896 - DNA, 22 bp, Homo sapiens
ctttgtgatagtgttaagacca

SEQ ID NO: 8235897 - DNA, 22 bp, Homo sapiens
ctttgtgtctgttaataattat

SEQ ID NO: 8235898 - DNA, 22 bp, Homo sapiens
ctttgtgtctgttaataattat

SEQ ID NO: 8235899 - DNA, 22 bp, Homo sapiens
ctttgtggctcctgcaggccat

SEQ ID NO: 8235900 - DNA, 22 bp, Homo sapiens
gaaaagagtcctgtgtgaggag

SEQ ID NO: 8235901 - DNA, 22 bp, Homo sapiens
gaaaagagacagggtgggtgat

SEQ ID NO: 8235902 - DNA, 22 bp, Homo sapiens
gaaaacatccagagatagacct

SEQ ID NO: 8235903 - DNA, 22 bp, Homo sapiens
gaaaaggaaatttatagagatc

SEQ ID NO: 8235904 - DNA, 22 bp, Homo sapiens
gaaaaggaaatttatagagatc

SEQ ID NO: 8235905 - DNA, 22 bp, Homo sapiens
gaaaaggaaatttatagagatc

SEQ ID NO: 8235906 - DNA, 22 bp, Homo sapiens
gaaaagcttactgccacttggc

SEQ ID NO: 8235907 - DNA, 21 bp, Homo sapiens
gaaaagcaagggagtagaaca

SEQ ID NO: 8235908 - DNA, 22 bp, Homo sapiens
gaaaaggccactcctaggagct

SEQ ID NO: 8235909 - DNA, 22 bp, Homo sapiens
gaaaaggcctccccataggaat

SEQ ID NO: 8235910 - DNA, 22 bp, Homo sapiens
gaaaaggattggtaaaatatct

SEQ ID NO: 8235911 - DNA, 22 bp, Homo sapiens
gaaaaggattggtaaaatatct

SEQ ID NO: 8235912 - DNA, 17 bp, Homo sapiens
gaacagcagaggggaca

SEQ ID NO: 8235913 - DNA, 22 bp, Homo sapiens
gaacagatgcctgattcatagg

SEQ ID NO: 8235914 - DNA, 23 bp, Homo sapiens
gaacccagctctgccacttgcca

SEQ ID NO: 8235915 - DNA, 21 bp, Homo sapiens
gaacccagcagcagtgctctg

SEQ ID NO: 8235916 - DNA, 22 bp, Homo sapiens
gaacccaggaggttgcagtgag

SEQ ID NO: 8235917 - DNA, 23 bp, Homo sapiens
gaacccagctctgccacttgcca

SEQ ID NO: 8235918 - DNA, 22 bp, Homo sapiens
gaacctctatatttgtgacatc

SEQ ID NO: 8235919 - DNA, 22 bp, Homo sapiens
gaaccccaacttataagacaga

SEQ ID NO: 8235920 - DNA, 22 bp, Homo sapiens
gaacccaggaggttgcagtgag

SEQ ID NO: 8235921 - DNA, 22 bp, Homo sapiens
gaacccagtccaggtgcagcct

SEQ ID NO: 8235922 - DNA, 22 bp, Homo sapiens
gaacagaattaccgaagatctg

SEQ ID NO: 8235923 - DNA, 22 bp, Homo sapiens
gaacactttaacattccttttc

SEQ ID NO: 8235924 - DNA, 22 bp, Homo sapiens
gaacacttgctgttaataagtg

SEQ ID NO: 8235925 - DNA, 22 bp, Homo sapiens
gaacacttgctgttaataagtg

SEQ ID NO: 8235926 - DNA, 19 bp, Homo sapiens
gaacacttactatatttct

SEQ ID NO: 8235927 - DNA, 22 bp, Homo sapiens
gaacactgaggacactgagaat

SEQ ID NO: 8235928 - DNA, 22 bp, Homo sapiens
gaacactgagagagatgggcag

SEQ ID NO: 8235929 - DNA, 22 bp, Homo sapiens
gaacactgaggacactgagaat

SEQ ID NO: 8235930 - DNA, 22 bp, Homo sapiens
gaacactgaggacactgagaat

SEQ ID NO: 8235931 - DNA, 22 bp, Homo sapiens
gaacactggggtatcattgagc

SEQ ID NO: 8235932 - DNA, 22 bp, Homo sapiens
gaacactggggtatcattgagc

SEQ ID NO: 8235933 - DNA, 22 bp, Homo sapiens
gaacactgctgttgggttctga

SEQ ID NO: 8235934 - DNA, 22 bp, Homo sapiens
gaacactgtttcttcgtgaaca

SEQ ID NO: 8235935 - DNA, 22 bp, Homo sapiens
gaacactggggtatcattgagc

SEQ ID NO: 8235936 - DNA, 22 bp, Homo sapiens
gaactggtgaagtgaagggcag

SEQ ID NO: 8235937 - DNA, 22 bp, Homo sapiens
gaactgagaaggactagcccat

SEQ ID NO: 8235938 - DNA, 22 bp, Homo sapiens
gaactgaagacttttactgtac

SEQ ID NO: 8235939 - DNA, 22 bp, Homo sapiens
gaactgaaacttggtttaaagc

SEQ ID NO: 8235940 - DNA, 22 bp, Homo sapiens
gaactctgggcaagccaagggc

SEQ ID NO: 8235941 - DNA, 22 bp, Homo sapiens
gaactgagttttctgcctggac

SEQ ID NO: 8235942 - DNA, 22 bp, Homo sapiens
gaactgagatttttgtctggct

SEQ ID NO: 8235943 - DNA, 22 bp, Homo sapiens
gaactctaggtaaatgagatat

SEQ ID NO: 8235944 - DNA, 22 bp, Homo sapiens
gaactccagatgactcaggaac

SEQ ID NO: 8235945 - DNA, 19 bp, Homo sapiens
gaactctgcagactgggaa

SEQ ID NO: 8235946 - DNA, 22 bp, Homo sapiens
gaactctgagaggagcacaggc

SEQ ID NO: 8235947 - DNA, 22 bp, Homo sapiens
gaactctgacagggggcaaaag

SEQ ID NO: 8235948 - DNA, 22 bp, Homo sapiens
gaactctgagaggagcacaggc

SEQ ID NO: 8235949 - DNA, 22 bp, Homo sapiens
gaactctgagaggagcacaggc

SEQ ID NO: 8235950 - DNA, 22 bp, Homo sapiens
gaactcagagcctgagctagga

SEQ ID NO: 8235951 - DNA, 22 bp, Homo sapiens
gaactatatcttcaagaaaatg

SEQ ID NO: 8235952 - DNA, 22 bp, Homo sapiens
gaactaaatttgacagacaaca

SEQ ID NO: 8235953 - DNA, 22 bp, Homo sapiens
gaactaaatttgacagacaaca

SEQ ID NO: 8235954 - DNA, 22 bp, Homo sapiens
gaactacagtaagaattgatgt

SEQ ID NO: 8235955 - DNA, 22 bp, Homo sapiens
gaactacaggtgcagcaagtga

SEQ ID NO: 8235956 - DNA, 22 bp, Homo sapiens
gaactacagtgcattttcttaa

SEQ ID NO: 8235957 - DNA, 22 bp, Homo sapiens
gaactacagtaagaattgatgt

SEQ ID NO: 8235958 - DNA, 22 bp, Homo sapiens
gaactacaggtgcagcaagtga

SEQ ID NO: 8235959 - DNA, 22 bp, Homo sapiens
gaactacagtgcattttcttaa

SEQ ID NO: 8235960 - DNA, 22 bp, Homo sapiens
gaactaaatgaaattactggtg

SEQ ID NO: 8235961 - DNA, 22 bp, Homo sapiens
gaactaaatgaaattactggtg

SEQ ID NO: 8235962 - DNA, 22 bp, Homo sapiens
gaactaaaagctaacatcaggc

SEQ ID NO: 8235963 - DNA, 22 bp, Homo sapiens
gaactaaaagctaacatcaggc

SEQ ID NO: 8235964 - DNA, 22 bp, Homo sapiens
gaacgggtgcagccatgggccc

SEQ ID NO: 8235965 - DNA, 22 bp, Homo sapiens
gaacctggaatctattacaagg

SEQ ID NO: 8235966 - DNA, 22 bp, Homo sapiens
gaacctggaatgtggcgcccaa

SEQ ID NO: 8235967 - DNA, 20 bp, Homo sapiens
gaacctggggaaggagtagg

SEQ ID NO: 8235968 - DNA, 22 bp, Homo sapiens
gaacctggcagccctatatctg

SEQ ID NO: 8235969 - DNA, 22 bp, Homo sapiens
gaacctggaatgtggcgcccaa

SEQ ID NO: 8235970 - DNA, 22 bp, Homo sapiens
gaaatacaattttgtcccagct

SEQ ID NO: 8235971 - DNA, 22 bp, Homo sapiens
gaaatacaaatgcctagatcct

SEQ ID NO: 8235972 - DNA, 22 bp, Homo sapiens
gaaatacaaatgcctagatcct

SEQ ID NO: 8235973 - DNA, 22 bp, Homo sapiens
gaaatacaaatgcctagatcct

SEQ ID NO: 8235974 - DNA, 22 bp, Homo sapiens
gaaatacagaaagggctgaatg

SEQ ID NO: 8235975 - DNA, 22 bp, Homo sapiens
gaaattgtgcatttagcaacac

SEQ ID NO: 8235976 - DNA, 22 bp, Homo sapiens
gaaattgtgcatttagcaacac

SEQ ID NO: 8235977 - DNA, 22 bp, Homo sapiens
gaaattgtggggttaaaaggct

SEQ ID NO: 8235978 - DNA, 22 bp, Homo sapiens
gaacacagtgtgatcgtatgtc

SEQ ID NO: 8235979 - DNA, 22 bp, Homo sapiens
gaacacagtgtgatcgtatgtc

SEQ ID NO: 8235980 - DNA, 22 bp, Homo sapiens
gaacacaggtggcccggcaggg

SEQ ID NO: 8235981 - DNA, 22 bp, Homo sapiens
gaacacagtacttttcctgatg

SEQ ID NO: 8235982 - DNA, 22 bp, Homo sapiens
gaacactgagaaagtcagcttt

SEQ ID NO: 8235983 - DNA, 22 bp, Homo sapiens
gaacactgagaaagtcagcttt

SEQ ID NO: 8235984 - DNA, 22 bp, Homo sapiens
gaacactgacattttcctgact

SEQ ID NO: 8235985 - DNA, 22 bp, Homo sapiens
gaacactcatggaagagttttt

SEQ ID NO: 8235986 - DNA, 22 bp, Homo sapiens
gaacacatttctctgactgtag

SEQ ID NO: 8235987 - DNA, 22 bp, Homo sapiens
gaacactgacattttcctgact

SEQ ID NO: 8235988 - DNA, 22 bp, Homo sapiens
gaacacattagtctgagttggc

SEQ ID NO: 8235989 - DNA, 22 bp, Homo sapiens
gaacacatgtcctccttggatt

SEQ ID NO: 8235990 - DNA, 22 bp, Homo sapiens
gaaagtttcttcattaagatgt

SEQ ID NO: 8235991 - DNA, 22 bp, Homo sapiens
gaaagttttcatatataccaaa

SEQ ID NO: 8235992 - DNA, 22 bp, Homo sapiens
gaaagttttcatatataccaaa

SEQ ID NO: 8235993 - DNA, 22 bp, Homo sapiens
gaaagttttctcacacagtaat

SEQ ID NO: 8235994 - DNA, 22 bp, Homo sapiens
gaaataacagctctggaagagt

SEQ ID NO: 8235995 - DNA, 22 bp, Homo sapiens
gaaagttttctcacacagtaat

SEQ ID NO: 8235996 - DNA, 22 bp, Homo sapiens
gaaataacctcatgcaccatga

SEQ ID NO: 8235997 - DNA, 22 bp, Homo sapiens
gaaataagagtccatgccaggt

SEQ ID NO: 8235998 - DNA, 22 bp, Homo sapiens
gaaataacctcatgcaccatga

SEQ ID NO: 8235999 - DNA, 22 bp, Homo sapiens
gaaataagagtccatgccaggt

SEQ ID NO: 8236000 - DNA, 22 bp, Homo sapiens
gaaataatacagtgctcttctc

SEQ ID NO: 8236001 - DNA, 22 bp, Homo sapiens
gaaatacaaagccagccatttt

SEQ ID NO: 8236002 - DNA, 22 bp, Homo sapiens
gaaatacaaagccagccatttt

SEQ ID NO: 8236003 - DNA, 22 bp, Homo sapiens
gaaatacaaagccagccatttt

SEQ ID NO: 8236004 - DNA, 22 bp, Homo sapiens
gaaatacaaatgcctagatcct

SEQ ID NO: 8236005 - DNA, 22 bp, Homo sapiens
gaaatacaaagccagccatttt

SEQ ID NO: 8236006 - DNA, 22 bp, Homo sapiens
gaaatacaaagccagccatttt

SEQ ID NO: 8236007 - DNA, 22 bp, Homo sapiens
gaaataattctgtgtctgaaca

SEQ ID NO: 8236008 - DNA, 22 bp, Homo sapiens
gaaataattctgtgtctgaaca

SEQ ID NO: 8236009 - DNA, 22 bp, Homo sapiens
gaaataattctgtgtctgaaca

SEQ ID NO: 8236010 - DNA, 22 bp, Homo sapiens
gaaataatacagtgctcttctc

SEQ ID NO: 8236011 - DNA, 22 bp, Homo sapiens
gaaataatacagtgctcttctc

SEQ ID NO: 8236012 - DNA, 22 bp, Homo sapiens
gaaataatttagaaggtattcc

SEQ ID NO: 8236013 - DNA, 22 bp, Homo sapiens
gaaataattctgtgtctgaaca

SEQ ID NO: 8236014 - DNA, 22 bp, Homo sapiens
gaaataatttagaaggtattcc

SEQ ID NO: 8236015 - DNA, 22 bp, Homo sapiens
gaaataatttagaaggtattcc

SEQ ID NO: 8236016 - DNA, 22 bp, Homo sapiens
ctttatatccagatgtttggtg

SEQ ID NO: 8236017 - DNA, 22 bp, Homo sapiens
ctttatctgtgtcctcttgcct

SEQ ID NO: 8236018 - DNA, 22 bp, Homo sapiens
ctttatctagggtaagaaaacc

SEQ ID NO: 8236019 - DNA, 22 bp, Homo sapiens
ctttatctagggtaagaaaacc

SEQ ID NO: 8236020 - DNA, 22 bp, Homo sapiens
ctttatctagggtaagaaaacc

SEQ ID NO: 8236021 - DNA, 22 bp, Homo sapiens
ctttatctagggtaagaaaacc

SEQ ID NO: 8236022 - DNA, 22 bp, Homo sapiens
ctttatgactgagttgtcaatt

SEQ ID NO: 8236023 - DNA, 22 bp, Homo sapiens
ctttatgagccttgtgaaggag

SEQ ID NO: 8236024 - DNA, 22 bp, Homo sapiens
ctttggcagcctcagctgcagg

SEQ ID NO: 8236025 - DNA, 22 bp, Homo sapiens
ctttatgaacctgttcagcttg

SEQ ID NO: 8236026 - DNA, 22 bp, Homo sapiens
ctttatgaaggaacaatgctcc

SEQ ID NO: 8236027 - DNA, 22 bp, Homo sapiens
ctttatgaacctgttcagcttg

SEQ ID NO: 8236028 - DNA, 22 bp, Homo sapiens
ctttatgaaaaccagattgggg

SEQ ID NO: 8236029 - DNA, 22 bp, Homo sapiens
ctttatgaaaacctgaattatg

SEQ ID NO: 8236030 - DNA, 22 bp, Homo sapiens
ctttgtagctgcttctgattta

SEQ ID NO: 8236031 - DNA, 22 bp, Homo sapiens
ctttgtagctgcttctgattta

SEQ ID NO: 8236032 - DNA, 22 bp, Homo sapiens
ctttgtatctaaatatcttgaa

SEQ ID NO: 8236033 - DNA, 19 bp, Homo sapiens
ctttgtcagaacatgcttc

SEQ ID NO: 8236034 - DNA, 21 bp, Homo sapiens
ctttggtttcctcctgccttc

SEQ ID NO: 8236035 - DNA, 22 bp, Homo sapiens
ctttggttctgtccttcccaga

SEQ ID NO: 8236036 - DNA, 21 bp, Homo sapiens
ctttggtttctgacttgcata

SEQ ID NO: 8236037 - DNA, 21 bp, Homo sapiens
ctttggtttctgacttgcata

SEQ ID NO: 8236038 - DNA, 22 bp, Homo sapiens
ctttggttcaggagtacctctc

SEQ ID NO: 8236039 - DNA, 22 bp, Homo sapiens
ctttggcagcctctgctattga

SEQ ID NO: 8236040 - DNA, 22 bp, Homo sapiens
ctttacacaatgattttcttta

SEQ ID NO: 8236041 - DNA, 20 bp, Homo sapiens
ctttagaagaacccaagcat

SEQ ID NO: 8236042 - DNA, 22 bp, Homo sapiens
ctttagaagggtaacggaatta

SEQ ID NO: 8236043 - DNA, 22 bp, Homo sapiens
ctttacaattcaagggaactct

SEQ ID NO: 8236044 - DNA, 22 bp, Homo sapiens
ctttacaattcaagggaactct

SEQ ID NO: 8236045 - DNA, 22 bp, Homo sapiens
ctttacaacctaagttgaagct

SEQ ID NO: 8236046 - DNA, 22 bp, Homo sapiens
ctttacaacctaagttgaagct

SEQ ID NO: 8236047 - DNA, 22 bp, Homo sapiens
ctttagacatacagaatttcca

SEQ ID NO: 8236048 - DNA, 22 bp, Homo sapiens
ctttagatgttgctttaactat

SEQ ID NO: 8236049 - DNA, 19 bp, Homo sapiens
ctttagacacacctggaca

SEQ ID NO: 8236050 - DNA, 22 bp, Homo sapiens
ctttagaatttgatataatcaa

SEQ ID NO: 8236051 - DNA, 22 bp, Homo sapiens
ctttagaatttcatgtttggtc

SEQ ID NO: 8236052 - DNA, 22 bp, Homo sapiens
ctttagaatttgatataatcaa

SEQ ID NO: 8236053 - DNA, 22 bp, Homo sapiens
ctttagaatttgatataatcaa

SEQ ID NO: 8236054 - DNA, 22 bp, Homo sapiens
ctttagatttctatgtatcact

SEQ ID NO: 8236055 - DNA, 22 bp, Homo sapiens
ctttaggttttgcctgagatct

SEQ ID NO: 8236056 - DNA, 20 bp, Homo sapiens
ctttagttattaacagcact

SEQ ID NO: 8236057 - DNA, 20 bp, Homo sapiens
ctttagttattaacagcact

SEQ ID NO: 8236058 - DNA, 22 bp, Homo sapiens
ctttagttagtagataatggca

SEQ ID NO: 8236059 - DNA, 22 bp, Homo sapiens
ctttagtttaagaacatgatga

SEQ ID NO: 8236060 - DNA, 22 bp, Homo sapiens
ctttagtttgtaagagcaagag

SEQ ID NO: 8236061 - DNA, 22 bp, Homo sapiens
ctttagttatttagactacagt

SEQ ID NO: 8236062 - DNA, 22 bp, Homo sapiens
ctttagttgtctcctcaagggt

SEQ ID NO: 8236063 - DNA, 22 bp, Homo sapiens
ctttagttgttatttcttcaca

SEQ ID NO: 8236064 - DNA, 22 bp, Homo sapiens
cttgggagtagaggcaggagca

SEQ ID NO: 8236065 - DNA, 22 bp, Homo sapiens
cttgggagtagaggcaggagca

SEQ ID NO: 8236066 - DNA, 22 bp, Homo sapiens
cttgggagtagaggcaggagca

SEQ ID NO: 8236067 - DNA, 22 bp, Homo sapiens
cttgggagtagaggcaggagca

SEQ ID NO: 8236068 - DNA, 22 bp, Homo sapiens
cttgggagtagaggcaggagca

SEQ ID NO: 8236069 - DNA, 22 bp, Homo sapiens
cttgggcaagcagcattcagaa

SEQ ID NO: 8236070 - DNA, 22 bp, Homo sapiens
cttgggccctccccttgtgaat

SEQ ID NO: 8236071 - DNA, 22 bp, Homo sapiens
cttgggaggcagaggttgcagt

SEQ ID NO: 8236072 - DNA, 22 bp, Homo sapiens
cttgggaggagaacaaagctcc

SEQ ID NO: 8236073 - DNA, 22 bp, Homo sapiens
cttgggagacacaagaagacat

SEQ ID NO: 8236074 - DNA, 22 bp, Homo sapiens
cttgggagacacaagaagacat

SEQ ID NO: 8236075 - DNA, 22 bp, Homo sapiens
cttgggagacacaagaagacat

SEQ ID NO: 8236076 - DNA, 22 bp, Homo sapiens
cttgggaggggagcattggcct

SEQ ID NO: 8236077 - DNA, 22 bp, Homo sapiens
cttgggaggggagcattggcct

SEQ ID NO: 8236078 - DNA, 22 bp, Homo sapiens
cttgggagtagaggcaggagca

SEQ ID NO: 8236079 - DNA, 22 bp, Homo sapiens
cttgggagtagaggcaggagca

SEQ ID NO: 8236080 - DNA, 22 bp, Homo sapiens
cttgggagtagaggcaggagca

SEQ ID NO: 8236081 - DNA, 22 bp, Homo sapiens
cttgggagtagaggcaggagca

SEQ ID NO: 8236082 - DNA, 22 bp, Homo sapiens
ctttacaaattagctctcggga

SEQ ID NO: 8236083 - DNA, 22 bp, Homo sapiens
cttggggctttgtgtgtaggat

SEQ ID NO: 8236084 - DNA, 22 bp, Homo sapiens
cttggggctttgtgtgtaggat

SEQ ID NO: 8236085 - DNA, 22 bp, Homo sapiens
cttgggggccattaaggggcct

SEQ ID NO: 8236086 - DNA, 22 bp, Homo sapiens
cttggggctgtcactctggcat

SEQ ID NO: 8236087 - DNA, 22 bp, Homo sapiens
cttggggctttgtgtgtaggat

SEQ ID NO: 8236088 - DNA, 22 bp, Homo sapiens
cttggggctgtcactctggcat

SEQ ID NO: 8236089 - DNA, 22 bp, Homo sapiens
cttggggctgtcactctggcat

SEQ ID NO: 8236090 - DNA, 22 bp, Homo sapiens
cttggggcagcccaggctgagc

SEQ ID NO: 8236091 - DNA, 22 bp, Homo sapiens
cttggggcagcccaggctgagc

SEQ ID NO: 8236092 - DNA, 22 bp, Homo sapiens
cttgggctcagacttgaggaca

SEQ ID NO: 8236093 - DNA, 22 bp, Homo sapiens
cttgggctcagcaccgtgtgga

SEQ ID NO: 8236094 - DNA, 22 bp, Homo sapiens
cttgggcttagaaggtaagtga

SEQ ID NO: 8236095 - DNA, 22 bp, Homo sapiens
cttgggctctaaatgccagtga

SEQ ID NO: 8236096 - DNA, 22 bp, Homo sapiens
cttggggattttaaagacctct

SEQ ID NO: 8236097 - DNA, 22 bp, Homo sapiens
cttggggaggacgcagtgtcct

SEQ ID NO: 8236098 - DNA, 22 bp, Homo sapiens
cttgggaatgctaacagatgac

SEQ ID NO: 8236099 - DNA, 22 bp, Homo sapiens
cttggctttagaacatgggagc

SEQ ID NO: 8236100 - DNA, 18 bp, Homo sapiens
cttggctgatgggggtgt

SEQ ID NO: 8236101 - DNA, 18 bp, Homo sapiens
cttggctgatgggggtgt

SEQ ID NO: 8236102 - DNA, 22 bp, Homo sapiens
cttggctgcttttgtgcacatt

SEQ ID NO: 8236103 - DNA, 17 bp, Homo sapiens
cttggctgctgtgcgat

SEQ ID NO: 8236104 - DNA, 21 bp, Homo sapiens
cttggctgcagtgacaggcat

SEQ ID NO: 8236105 - DNA, 21 bp, Homo sapiens
cttggctgcagtgacaggcat

SEQ ID NO: 8236106 - DNA, 22 bp, Homo sapiens
cttggctgtaaaatcagaggct

SEQ ID NO: 8236107 - DNA, 22 bp, Homo sapiens
cttggctggaactcctgagaaa

SEQ ID NO: 8236108 - DNA, 22 bp, Homo sapiens
cttggattcctcatatgcacag

SEQ ID NO: 8236109 - DNA, 22 bp, Homo sapiens
cttggattacccatatgattag

SEQ ID NO: 8236110 - DNA, 22 bp, Homo sapiens
cttggatgccagcggcctccta

SEQ ID NO: 8236111 - DNA, 21 bp, Homo sapiens
cttggagttggttgaggatgc

SEQ ID NO: 8236112 - DNA, 22 bp, Homo sapiens
cttggagttagggtctttaaag

SEQ ID NO: 8236113 - DNA, 22 bp, Homo sapiens
cttgaatcttctgagtatttgc

SEQ ID NO: 8236114 - DNA, 22 bp, Homo sapiens
cttgaatcttctgagtatttgc

SEQ ID NO: 8236115 - DNA, 22 bp, Homo sapiens
cttgaagtttgcttagattcct

SEQ ID NO: 8236116 - DNA, 22 bp, Homo sapiens
cttgaaaataagaaagactttc

SEQ ID NO: 8236117 - DNA, 22 bp, Homo sapiens
cttgaaaataagaaagactttc

SEQ ID NO: 8236118 - DNA, 22 bp, Homo sapiens
cttgaaagaagggtcttttaat

SEQ ID NO: 8236119 - DNA, 22 bp, Homo sapiens
cttcttttgaagggcgttgtgt

SEQ ID NO: 8236120 - DNA, 22 bp, Homo sapiens
cttcttttcatggcttgggaag

SEQ ID NO: 8236121 - DNA, 22 bp, Homo sapiens
cttgaaaaatatgccttgcttc

SEQ ID NO: 8236122 - DNA, 19 bp, Homo sapiens
cttgaaatgagactgaagg

SEQ ID NO: 8236123 - DNA, 22 bp, Homo sapiens
cttgaagacaatggcagattcc

SEQ ID NO: 8236124 - DNA, 22 bp, Homo sapiens
cttgaaatccagatttcagagg

SEQ ID NO: 8236125 - DNA, 21 bp, Homo sapiens
cttgaaaggtagagtctacag

SEQ ID NO: 8236126 - DNA, 22 bp, Homo sapiens
cttcttttacaggtcttgggtt

SEQ ID NO: 8236127 - DNA, 22 bp, Homo sapiens
cttctttgtgcctattggtgac

SEQ ID NO: 8236128 - DNA, 22 bp, Homo sapiens
cttctttcttttgatcacaggt

SEQ ID NO: 8236129 - DNA, 22 bp, Homo sapiens
cttctttcttttgatcacaggt

SEQ ID NO: 8236130 - DNA, 22 bp, Homo sapiens
cttctttcttttgatcacaggt

SEQ ID NO: 8236131 - DNA, 22 bp, Homo sapiens
cttctttcccaggcatgtttta

SEQ ID NO: 8236132 - DNA, 22 bp, Homo sapiens
cttctttactttctagaaataa

SEQ ID NO: 8236133 - DNA, 22 bp, Homo sapiens
cttctttagggatctcttgctg

SEQ ID NO: 8236134 - DNA, 22 bp, Homo sapiens
cttctctggcagatgtgtgtcc

SEQ ID NO: 8236135 - DNA, 22 bp, Homo sapiens
cttctctggcagatgtgtgtcc

SEQ ID NO: 8236136 - DNA, 22 bp, Homo sapiens
cttctctggcagatgtgtgtcc

SEQ ID NO: 8236137 - DNA, 17 bp, Homo sapiens
cttctctggcagaagat

SEQ ID NO: 8236138 - DNA, 17 bp, Homo sapiens
cttctctggcagaagat

SEQ ID NO: 8236139 - DNA, 22 bp, Homo sapiens
cttctctgcccataggaaatgc

SEQ ID NO: 8236140 - DNA, 22 bp, Homo sapiens
cttctctgcccataggaaatgc

SEQ ID NO: 8236141 - DNA, 22 bp, Homo sapiens
cttctctgcccataggaaatgc

SEQ ID NO: 8236142 - DNA, 22 bp, Homo sapiens
cttctctggctcctcagcgccc

SEQ ID NO: 8236143 - DNA, 22 bp, Homo sapiens
cttctctggcatagcaagcagg

SEQ ID NO: 8236144 - DNA, 22 bp, Homo sapiens
cttctctggcatagcaagcagg

SEQ ID NO: 8236145 - DNA, 22 bp, Homo sapiens
cttctctggcatagcaagcagg

SEQ ID NO: 8236146 - DNA, 22 bp, Homo sapiens
cttctctggctcctcagcgccc

SEQ ID NO: 8236147 - DNA, 22 bp, Homo sapiens
cttctctggctcctcagcgccc

SEQ ID NO: 8236148 - DNA, 22 bp, Homo sapiens
cttctctggctcctcagcgccc

SEQ ID NO: 8236149 - DNA, 22 bp, Homo sapiens
cttctctggctcctcagcgccc

SEQ ID NO: 8236150 - DNA, 22 bp, Homo sapiens
cttctctctgcataggcatggg

SEQ ID NO: 8236151 - DNA, 22 bp, Homo sapiens
cttctctctgcataggcatggg

SEQ ID NO: 8236152 - DNA, 22 bp, Homo sapiens
cttctctctgcataggcatggg

SEQ ID NO: 8236153 - DNA, 22 bp, Homo sapiens
cttctctctgcataggcatggg

SEQ ID NO: 8236154 - DNA, 22 bp, Homo sapiens
cttctctgacagtctgtttcac

SEQ ID NO: 8236155 - DNA, 23 bp, Homo sapiens
cttctctgagctaggaatgctct

SEQ ID NO: 8236156 - DNA, 22 bp, Homo sapiens
cttctctgacagtctgtttcac

SEQ ID NO: 8236157 - DNA, 22 bp, Homo sapiens
cttctctgacagtctgtttcac

SEQ ID NO: 8236158 - DNA, 22 bp, Homo sapiens
cttctctgcaccccacttttgc

SEQ ID NO: 8236159 - DNA, 22 bp, Homo sapiens
cttctctgcaccccacttttgc

SEQ ID NO: 8236160 - DNA, 23 bp, Homo sapiens
cttctctgagctaggaatgctct

SEQ ID NO: 8236161 - DNA, 22 bp, Homo sapiens
cttctctgcaccccacttttgc

SEQ ID NO: 8236162 - DNA, 22 bp, Homo sapiens
cttctctgcaccccacttttgc

SEQ ID NO: 8236163 - DNA, 22 bp, Homo sapiens
cttctttactttctagaaataa

SEQ ID NO: 8236164 - DNA, 22 bp, Homo sapiens
cttcttgaagtcctccagaagt

SEQ ID NO: 8236165 - DNA, 22 bp, Homo sapiens
cttctcttggtagttcttgttg

SEQ ID NO: 8236166 - DNA, 22 bp, Homo sapiens
cttcttcttttaataaatgtct

SEQ ID NO: 8236167 - DNA, 22 bp, Homo sapiens
cttcttcttttaataaatgtct

SEQ ID NO: 8236168 - DNA, 22 bp, Homo sapiens
cttctcttggtagttcttgttg

SEQ ID NO: 8236169 - DNA, 22 bp, Homo sapiens
cttcttcttttaataaatgtct

SEQ ID NO: 8236170 - DNA, 22 bp, Homo sapiens
cttctcttgggtgtggtgtctt

SEQ ID NO: 8236171 - DNA, 22 bp, Homo sapiens
cttctcttgggtgtggtgtctt

SEQ ID NO: 8236172 - DNA, 22 bp, Homo sapiens
cttctcttcctttgtcaactga

SEQ ID NO: 8236173 - DNA, 22 bp, Homo sapiens
cttctcttcctttgtcaactga

SEQ ID NO: 8236174 - DNA, 22 bp, Homo sapiens
cttctcttcccagggacacagg

SEQ ID NO: 8236175 - DNA, 22 bp, Homo sapiens
cttctcttcccagggacacagg

SEQ ID NO: 8236176 - DNA, 22 bp, Homo sapiens
cttctctgtcacagggttacgt

SEQ ID NO: 8236177 - DNA, 22 bp, Homo sapiens
cttctctgtgtagagattcaga

SEQ ID NO: 8236178 - DNA, 22 bp, Homo sapiens
cttctctgtgtagagattcaga

SEQ ID NO: 8236179 - DNA, 22 bp, Homo sapiens
cttctctcggtgcatccctcac

SEQ ID NO: 8236180 - DNA, 22 bp, Homo sapiens
cttctctcggtgcatccctcac

SEQ ID NO: 8236181 - DNA, 22 bp, Homo sapiens
cttctctcggtgcatccctcac

SEQ ID NO: 8236182 - DNA, 22 bp, Homo sapiens
cttctctcggtgcatccctcac

SEQ ID NO: 8236183 - DNA, 22 bp, Homo sapiens
cttctctccctggcactcagac

SEQ ID NO: 8236184 - DNA, 22 bp, Homo sapiens
cttctctccctggcactcagac

SEQ ID NO: 8236185 - DNA, 22 bp, Homo sapiens
cttctctccctggcactcagac

SEQ ID NO: 8236186 - DNA, 22 bp, Homo sapiens
cttctctatctttggcacatca

SEQ ID NO: 8236187 - DNA, 22 bp, Homo sapiens
cttctctccctggcactcagac

SEQ ID NO: 8236188 - DNA, 22 bp, Homo sapiens
cttctcagttgcaagtgtcaga

SEQ ID NO: 8236189 - DNA, 22 bp, Homo sapiens
cttctcagttgcaagtgtcaga

SEQ ID NO: 8236190 - DNA, 22 bp, Homo sapiens
cttctcagttgcaagtgtcaga

SEQ ID NO: 8236191 - DNA, 22 bp, Homo sapiens
cttctcagtcacctgtgagtct

SEQ ID NO: 8236192 - DNA, 22 bp, Homo sapiens
ctggctgtgaaatggcagtgtc

SEQ ID NO: 8236193 - DNA, 22 bp, Homo sapiens
cttctcagtcacctgtgagtct

SEQ ID NO: 8236194 - DNA, 22 bp, Homo sapiens
cttctcggggttcccgcgccct

SEQ ID NO: 8236195 - DNA, 22 bp, Homo sapiens
cttctctacttcctggaagggg

SEQ ID NO: 8236196 - DNA, 22 bp, Homo sapiens
cttctccagccacgcccactcc

SEQ ID NO: 8236197 - DNA, 22 bp, Homo sapiens
cttctcattcaagcaaaacaga

SEQ ID NO: 8236198 - DNA, 22 bp, Homo sapiens
ctggctggttactatttctggt

SEQ ID NO: 8236199 - DNA, 22 bp, Homo sapiens
ctggctggtctgagcagtcgca

SEQ ID NO: 8236200 - DNA, 22 bp, Homo sapiens
ctggctggtctgagcagtcgca

SEQ ID NO: 8236201 - DNA, 22 bp, Homo sapiens
ctggctggtctgagcagtcgca

SEQ ID NO: 8236202 - DNA, 22 bp, Homo sapiens
ctggctggtctgagcagtcgca

SEQ ID NO: 8236203 - DNA, 22 bp, Homo sapiens
ctggctggttggggagaagaca

SEQ ID NO: 8236204 - DNA, 22 bp, Homo sapiens
ctggctggttccctgctccagg

SEQ ID NO: 8236205 - DNA, 22 bp, Homo sapiens
ctggctggttccctgctccagg

SEQ ID NO: 8236206 - DNA, 22 bp, Homo sapiens
ctggctggttccctgctccagg

SEQ ID NO: 8236207 - DNA, 22 bp, Homo sapiens
ctggctgtcttggaggaaggag

SEQ ID NO: 8236208 - DNA, 22 bp, Homo sapiens
ctggctgtcttctgggagctgt

SEQ ID NO: 8236209 - DNA, 22 bp, Homo sapiens
ctggctgtattagtttgatcct

SEQ ID NO: 8236210 - DNA, 22 bp, Homo sapiens
ctggctgtattagtttgatcct

SEQ ID NO: 8236211 - DNA, 22 bp, Homo sapiens
ctggctgtcttctgggagctgt

SEQ ID NO: 8236212 - DNA, 22 bp, Homo sapiens
ctggctgtaacattttgccata

SEQ ID NO: 8236213 - DNA, 22 bp, Homo sapiens
ctggctggtttttaaagctagg

SEQ ID NO: 8236214 - DNA, 22 bp, Homo sapiens
ctggctggtttttaaagctagg

SEQ ID NO: 8236215 - DNA, 22 bp, Homo sapiens
ctggctggttgtctcaatccag

SEQ ID NO: 8236216 - DNA, 22 bp, Homo sapiens
ctggctggttgtctcaatccag

SEQ ID NO: 8236217 - DNA, 22 bp, Homo sapiens
ctggctggttggggagaagaca

SEQ ID NO: 8236218 - DNA, 22 bp, Homo sapiens
ctggctggtcctcggggacagc

SEQ ID NO: 8236219 - DNA, 22 bp, Homo sapiens
ctggctggtcctcggggacagc

SEQ ID NO: 8236220 - DNA, 22 bp, Homo sapiens
ctggctggtcctcggggacagc

SEQ ID NO: 8236221 - DNA, 22 bp, Homo sapiens
ctggctggtcctcggggacagc

SEQ ID NO: 8236222 - DNA, 22 bp, Homo sapiens
ctggctggtcatgtcatgagcc

SEQ ID NO: 8236223 - DNA, 22 bp, Homo sapiens
ctggctggtcatgtcatgagcc

SEQ ID NO: 8236224 - DNA, 22 bp, Homo sapiens
ctggctggtcatgtcatgagcc

SEQ ID NO: 8236225 - DNA, 22 bp, Homo sapiens
ctggctggtcatcagcagtacg

SEQ ID NO: 8236226 - DNA, 22 bp, Homo sapiens
ctggctggtcatcagcagtacg

SEQ ID NO: 8236227 - DNA, 22 bp, Homo sapiens
ctggctggtagaattgtgacct

SEQ ID NO: 8236228 - DNA, 22 bp, Homo sapiens
ctggctggtaatggaacgacag

SEQ ID NO: 8236229 - DNA, 22 bp, Homo sapiens
ctggctggtaatggaacgacag

SEQ ID NO: 8236230 - DNA, 22 bp, Homo sapiens
ctggctgggttccaggattcca

SEQ ID NO: 8236231 - DNA, 22 bp, Homo sapiens
ctggctgggttccaggattcca

SEQ ID NO: 8236232 - DNA, 22 bp, Homo sapiens
ctggctgggttccaggattcca

SEQ ID NO: 8236233 - DNA, 22 bp, Homo sapiens
ctggctggggtccatcctctaa

SEQ ID NO: 8236234 - DNA, 22 bp, Homo sapiens
ctggctggggtccatcctctaa

SEQ ID NO: 8236235 - DNA, 22 bp, Homo sapiens
ctggctggagtgcaggtgagtg

SEQ ID NO: 8236236 - DNA, 22 bp, Homo sapiens
ctggctggagtgcaggtgagtg

SEQ ID NO: 8236237 - DNA, 22 bp, Homo sapiens
ctggctggagtgcaggtgagtg

SEQ ID NO: 8236238 - DNA, 22 bp, Homo sapiens
ctggctgggagctcgcctgcgg

SEQ ID NO: 8236239 - DNA, 22 bp, Homo sapiens
ctggctgggagctcgcctgcgg

SEQ ID NO: 8236240 - DNA, 22 bp, Homo sapiens
ctggctgggagctcgcctgcgg

SEQ ID NO: 8236241 - DNA, 22 bp, Homo sapiens
ctggctggagctgttgtaggct

SEQ ID NO: 8236242 - DNA, 22 bp, Homo sapiens
ctggctggagctgttgtaggct

SEQ ID NO: 8236243 - DNA, 22 bp, Homo sapiens
ctggctggagctgttgtaggct

SEQ ID NO: 8236244 - DNA, 22 bp, Homo sapiens
ctggctggaggtgagtcactga

SEQ ID NO: 8236245 - DNA, 22 bp, Homo sapiens
ctggctggaggtgagtcactga

SEQ ID NO: 8236246 - DNA, 22 bp, Homo sapiens
ctggctggaggtgagtcactga

SEQ ID NO: 8236247 - DNA, 22 bp, Homo sapiens
ctggctggagctgttgtaggct

SEQ ID NO: 8236248 - DNA, 22 bp, Homo sapiens
ctggctggggtaccagttgaac

SEQ ID NO: 8236249 - DNA, 22 bp, Homo sapiens
ctggctggggtaccagttgaac

SEQ ID NO: 8236250 - DNA, 22 bp, Homo sapiens
ctggctggggaagtcatttgat

SEQ ID NO: 8236251 - DNA, 22 bp, Homo sapiens
ctggctggggaagtcatttgat

SEQ ID NO: 8236252 - DNA, 22 bp, Homo sapiens
ctggctggggccttagataaga

SEQ ID NO: 8236253 - DNA, 22 bp, Homo sapiens
ctggctgggattttaaagagca

SEQ ID NO: 8236254 - DNA, 22 bp, Homo sapiens
ctggctgggattttaaagagca

SEQ ID NO: 8236255 - DNA, 22 bp, Homo sapiens
ctggctgggcagacagaatgct

SEQ ID NO: 8236256 - DNA, 22 bp, Homo sapiens
ctggctgggccatttctttagg

SEQ ID NO: 8236257 - DNA, 17 bp, Homo sapiens
gatgttgaatctcttta

SEQ ID NO: 8236258 - DNA, 22 bp, Homo sapiens
gatgttgatttgattaaggctt

SEQ ID NO: 8236259 - DNA, 22 bp, Homo sapiens
gatgttgagtatcaatgcttta

SEQ ID NO: 8236260 - DNA, 22 bp, Homo sapiens
gatgttgattcttactctcaat

SEQ ID NO: 8236261 - DNA, 22 bp, Homo sapiens
gatgtttatatctaacttaagt

SEQ ID NO: 8236262 - DNA, 22 bp, Homo sapiens
gatgttttctggaaaatgaatg

SEQ ID NO: 8236263 - DNA, 22 bp, Homo sapiens
gatgttttttaggatctcagca

SEQ ID NO: 8236264 - DNA, 22 bp, Homo sapiens
gatgttttaggtccctgtagct

SEQ ID NO: 8236265 - DNA, 22 bp, Homo sapiens
gatgttctagaagtgtggtgtt

SEQ ID NO: 8236266 - DNA, 22 bp, Homo sapiens
gatgttaagaaggaattgaagt

SEQ ID NO: 8236267 - DNA, 22 bp, Homo sapiens
gatgttaaaggttggtaagtca

SEQ ID NO: 8236268 - DNA, 22 bp, Homo sapiens
gatgttaaatgtaaatagctgc

SEQ ID NO: 8236269 - DNA, 22 bp, Homo sapiens
gatgttaaatgtaaatagctgc

SEQ ID NO: 8236270 - DNA, 22 bp, Homo sapiens
gatgtgtttccaggatttgttt

SEQ ID NO: 8236271 - DNA, 22 bp, Homo sapiens
gatgtgtgtgccctgggcctgc

SEQ ID NO: 8236272 - DNA, 22 bp, Homo sapiens
gattaagagaagtttcttatcg

SEQ ID NO: 8236273 - DNA, 21 bp, Homo sapiens
gattaaatttaagctacatgc

SEQ ID NO: 8236274 - DNA, 21 bp, Homo sapiens
gattaaatttaagctacatgc

SEQ ID NO: 8236275 - DNA, 22 bp, Homo sapiens
gattaaaaataacccatgctga

SEQ ID NO: 8236276 - DNA, 22 bp, Homo sapiens
gattaagattacatatttaagt

SEQ ID NO: 8236277 - DNA, 22 bp, Homo sapiens
gattaattcaggatcaggaaat

SEQ ID NO: 8236278 - DNA, 22 bp, Homo sapiens
gattacaaaactcatctatgac

SEQ ID NO: 8236279 - DNA, 20 bp, Homo sapiens
gattacaaaatgaaatgcat

SEQ ID NO: 8236280 - DNA, 22 bp, Homo sapiens
gattacaaaggtccttttctct

SEQ ID NO: 8236281 - DNA, 22 bp, Homo sapiens
gattacaattcaggttgataag

SEQ ID NO: 8236282 - DNA, 22 bp, Homo sapiens
gattctttggcctttattgaca

SEQ ID NO: 8236283 - DNA, 22 bp, Homo sapiens
gattctttacatctctgctgac

SEQ ID NO: 8236284 - DNA, 22 bp, Homo sapiens
gattctttactcagattttgtt

SEQ ID NO: 8236285 - DNA, 22 bp, Homo sapiens
gattcactcatattttacgttt

SEQ ID NO: 8236286 - DNA, 22 bp, Homo sapiens
gattcactcatattttacgttt

SEQ ID NO: 8236287 - DNA, 22 bp, Homo sapiens
gattcactcatattttacgttt

SEQ ID NO: 8236288 - DNA, 22 bp, Homo sapiens
gattcactcatattttacgttt

SEQ ID NO: 8236289 - DNA, 22 bp, Homo sapiens
gattcactcatattttacgttt

SEQ ID NO: 8236290 - DNA, 23 bp, Homo sapiens
gattcacagggtggtttatgggg

SEQ ID NO: 8236291 - DNA, 22 bp, Homo sapiens
gattatggagaaataattagaa

SEQ ID NO: 8236292 - DNA, 22 bp, Homo sapiens
gattagctaaactctcaggttc

SEQ ID NO: 8236293 - DNA, 22 bp, Homo sapiens
gattagatgactaatgagctgt

SEQ ID NO: 8236294 - DNA, 22 bp, Homo sapiens
gattagaatgggaagatacaag

SEQ ID NO: 8236295 - DNA, 22 bp, Homo sapiens
gattatggtagaaacaagaagt

SEQ ID NO: 8236296 - DNA, 22 bp, Homo sapiens
gattatggtaacaatgattaaa

SEQ ID NO: 8236297 - DNA, 22 bp, Homo sapiens
gattatggatggacagtggagc

SEQ ID NO: 8236298 - DNA, 22 bp, Homo sapiens
gattatggagaagaacaatgaa

SEQ ID NO: 8236299 - DNA, 22 bp, Homo sapiens
gattcaaagacagactcatttc

SEQ ID NO: 8236300 - DNA, 22 bp, Homo sapiens
gattcaaagttaatgaagatgc

SEQ ID NO: 8236301 - DNA, 22 bp, Homo sapiens
gattcaaagttaatgaagatgc

SEQ ID NO: 8236302 - DNA, 22 bp, Homo sapiens
gattcaaaagtttgagctccaa

SEQ ID NO: 8236303 - DNA, 22 bp, Homo sapiens
gattcaaaaataagctcctatt

SEQ ID NO: 8236304 - DNA, 22 bp, Homo sapiens
gattgcattgatttgctccaag

SEQ ID NO: 8236305 - DNA, 22 bp, Homo sapiens
gattgctgggattggtactgat

SEQ ID NO: 8236306 - DNA, 22 bp, Homo sapiens
gattgaatcatatgaaattgtg

SEQ ID NO: 8236307 - DNA, 22 bp, Homo sapiens
gattgagtctgaggatgctgca

SEQ ID NO: 8236308 - DNA, 22 bp, Homo sapiens
gattgcaaatcattacaaagga

SEQ ID NO: 8236309 - DNA, 22 bp, Homo sapiens
gattgagtctgaggatgctgca

SEQ ID NO: 8236310 - DNA, 22 bp, Homo sapiens
gattggaaatggaaatggtaaa

SEQ ID NO: 8236311 - DNA, 22 bp, Homo sapiens
gattggactaaaggcaacagct

SEQ ID NO: 8236312 - DNA, 22 bp, Homo sapiens
gattggttgaaagtagaatact

SEQ ID NO: 8236313 - DNA, 21 bp, Homo sapiens
gattggttcactcatgttgac

SEQ ID NO: 8236314 - DNA, 22 bp, Homo sapiens
gattgtaaaacagatcattatc

SEQ ID NO: 8236315 - DNA, 22 bp, Homo sapiens
gattgtctttattttatggcta

SEQ ID NO: 8236316 - DNA, 22 bp, Homo sapiens
gattgtgatacctagagcagca

SEQ ID NO: 8236317 - DNA, 22 bp, Homo sapiens
gattgtggaagtcagtggttct

SEQ ID NO: 8236318 - DNA, 22 bp, Homo sapiens
gattgttgcctggctttgacct

SEQ ID NO: 8236319 - DNA, 22 bp, Homo sapiens
gattgtggaagtcagtggttct

SEQ ID NO: 8236320 - DNA, 22 bp, Homo sapiens
gattgtggaagtcagtggttct

SEQ ID NO: 8236321 - DNA, 19 bp, Homo sapiens
gatttaaacgtggctctat

SEQ ID NO: 8236322 - DNA, 19 bp, Homo sapiens
gatttaaacgtggctctat

SEQ ID NO: 8236323 - DNA, 22 bp, Homo sapiens
gatttaaagtagacctttgttt

SEQ ID NO: 8236324 - DNA, 22 bp, Homo sapiens
gatttacaaagctctctagtgt

SEQ ID NO: 8236325 - DNA, 22 bp, Homo sapiens
gatttacaaagctctctagtgt

SEQ ID NO: 8236326 - DNA, 22 bp, Homo sapiens
gatttacaaagctctctagtgt

SEQ ID NO: 8236327 - DNA, 22 bp, Homo sapiens
gatttaaagtagacctttgttt

SEQ ID NO: 8236328 - DNA, 22 bp, Homo sapiens
gatttacagatctaagggtcac

SEQ ID NO: 8236329 - DNA, 22 bp, Homo sapiens
gatttacagatctaagggtcac

SEQ ID NO: 8236330 - DNA, 22 bp, Homo sapiens
gatttacagatctaagggtcac

SEQ ID NO: 8236331 - DNA, 22 bp, Homo sapiens
gatttacaaagctctctagtgt

SEQ ID NO: 8236332 - DNA, 22 bp, Homo sapiens
gatttataaaggttgcactgga

SEQ ID NO: 8236333 - DNA, 21 bp, Homo sapiens
gatttataagccttaagccta

SEQ ID NO: 8236334 - DNA, 22 bp, Homo sapiens
gatttacagctatacccaatgg

SEQ ID NO: 8236335 - DNA, 22 bp, Homo sapiens
gatttacagctatacccaatgg

SEQ ID NO: 8236336 - DNA, 22 bp, Homo sapiens
gatttacagctatacccaatgg

SEQ ID NO: 8236337 - DNA, 22 bp, Homo sapiens
gatttacagctatacccaatgg

SEQ ID NO: 8236338 - DNA, 22 bp, Homo sapiens
gatttacagatctaagggtcac

SEQ ID NO: 8236339 - DNA, 22 bp, Homo sapiens
gatttacaggttaggtcctgta

SEQ ID NO: 8236340 - DNA, 22 bp, Homo sapiens
gatttacaggttaggtcctgta

SEQ ID NO: 8236341 - DNA, 22 bp, Homo sapiens
gatttacttgtgctgtttctgg

SEQ ID NO: 8236342 - DNA, 22 bp, Homo sapiens
gatttacaggttaggtcctgta

SEQ ID NO: 8236343 - DNA, 22 bp, Homo sapiens
gatttatttttaatcagcaggg

SEQ ID NO: 8236344 - DNA, 22 bp, Homo sapiens
gatttatttttaatcagcaggg

SEQ ID NO: 8236345 - DNA, 22 bp, Homo sapiens
gatttatttttaatcagcaggg

SEQ ID NO: 8236346 - DNA, 22 bp, Homo sapiens
gatttattgtccctgtcctgct

SEQ ID NO: 8236347 - DNA, 22 bp, Homo sapiens
gatttattgtccctgtcctgct

SEQ ID NO: 8236348 - DNA, 22 bp, Homo sapiens
gatttatttttaatcagcaggg

SEQ ID NO: 8236349 - DNA, 22 bp, Homo sapiens
gatttatttttaatcagcaggg

SEQ ID NO: 8236350 - DNA, 22 bp, Homo sapiens
gatttattggtctttcattggt

SEQ ID NO: 8236351 - DNA, 22 bp, Homo sapiens
gatttattggtctttcattggt

SEQ ID NO: 8236352 - DNA, 22 bp, Homo sapiens
gatttatagtatgtgctttcag

SEQ ID NO: 8236353 - DNA, 22 bp, Homo sapiens
gatttatagtatgtgctttcag

SEQ ID NO: 8236354 - DNA, 22 bp, Homo sapiens
gatttattggtctttcattggt

SEQ ID NO: 8236355 - DNA, 22 bp, Homo sapiens
gatttattggtctttcattggt

SEQ ID NO: 8236356 - DNA, 22 bp, Homo sapiens
gatttattgtccctgtcctgct

SEQ ID NO: 8236357 - DNA, 22 bp, Homo sapiens
gatttattgtccctgtcctgct

SEQ ID NO: 8236358 - DNA, 22 bp, Homo sapiens
gatggggtccttgacctggcca

SEQ ID NO: 8236359 - DNA, 22 bp, Homo sapiens
gatggggtccttgacctggcca

SEQ ID NO: 8236360 - DNA, 18 bp, Homo sapiens
gatggggtccaggcatag

SEQ ID NO: 8236361 - DNA, 22 bp, Homo sapiens
gatggggctggctttgagggtt

SEQ ID NO: 8236362 - DNA, 17 bp, Homo sapiens
gatggggctgacatcag

SEQ ID NO: 8236363 - DNA, 22 bp, Homo sapiens
gatgggcttcttccatgaagaa

SEQ ID NO: 8236364 - DNA, 22 bp, Homo sapiens
gatgggcttcttccatgaagaa

SEQ ID NO: 8236365 - DNA, 22 bp, Homo sapiens
gatggtctttgtctctgataag

SEQ ID NO: 8236366 - DNA, 22 bp, Homo sapiens
gatgggtggtctcagacttgcc

SEQ ID NO: 8236367 - DNA, 22 bp, Homo sapiens
gatgggtgccccagacaagctg

SEQ ID NO: 8236368 - DNA, 22 bp, Homo sapiens
gatgggtgggttctgtgagagg

SEQ ID NO: 8236369 - DNA, 22 bp, Homo sapiens
gatggggttttgccaggctggt

SEQ ID NO: 8236370 - DNA, 22 bp, Homo sapiens
gatgggtagaagtggaagaggt

SEQ ID NO: 8236371 - DNA, 22 bp, Homo sapiens
gatggggttttgccaggctggt

SEQ ID NO: 8236372 - DNA, 22 bp, Homo sapiens
gatggggttttgccaggctggt

SEQ ID NO: 8236373 - DNA, 22 bp, Homo sapiens
gatgggtgggttctgtgagagg

SEQ ID NO: 8236374 - DNA, 22 bp, Homo sapiens
gatgggtgccccagacaagctg

SEQ ID NO: 8236375 - DNA, 22 bp, Homo sapiens
gatgtacaagattgtaggaatg

SEQ ID NO: 8236376 - DNA, 22 bp, Homo sapiens
gatgtacaatgtcactatgacc

SEQ ID NO: 8236377 - DNA, 22 bp, Homo sapiens
gatgtacaagattgtaggaatg

SEQ ID NO: 8236378 - DNA, 22 bp, Homo sapiens
gatgtacaagtaaaatatgtgt

SEQ ID NO: 8236379 - DNA, 22 bp, Homo sapiens
gatgtacaatgtcactatgacc

SEQ ID NO: 8236380 - DNA, 22 bp, Homo sapiens
gatgtacaaagagaggatttca

SEQ ID NO: 8236381 - DNA, 22 bp, Homo sapiens
gatgtaaactgggacttcctag

SEQ ID NO: 8236382 - DNA, 22 bp, Homo sapiens
gatgtaaactgggacttcctag

SEQ ID NO: 8236383 - DNA, 22 bp, Homo sapiens
gatggtgtcccaggctcaggct

SEQ ID NO: 8236384 - DNA, 22 bp, Homo sapiens
gatggtttatgatagatgggaa

SEQ ID NO: 8236385 - DNA, 22 bp, Homo sapiens
gatggtttggtaaaagtatgtt

SEQ ID NO: 8236386 - DNA, 22 bp, Homo sapiens
gatggtttggtaaaagtatgtt

SEQ ID NO: 8236387 - DNA, 22 bp, Homo sapiens
gatggtttggaatgaagtagct

SEQ ID NO: 8236388 - DNA, 22 bp, Homo sapiens
gatggtttggaatgaagtagct

SEQ ID NO: 8236389 - DNA, 22 bp, Homo sapiens
gatgtaaaaactcctttcgaaa

SEQ ID NO: 8236390 - DNA, 18 bp, Homo sapiens
gatgtaaaatagtagctt

SEQ ID NO: 8236391 - DNA, 22 bp, Homo sapiens
gatggtgcaggtgaagtgctgg

SEQ ID NO: 8236392 - DNA, 22 bp, Homo sapiens
gatggtgcaattatcgtgcatg

SEQ ID NO: 8236393 - DNA, 22 bp, Homo sapiens
gatggtgcaattatcgtgcatg

SEQ ID NO: 8236394 - DNA, 22 bp, Homo sapiens
gatggtggcaagagccaagtct

SEQ ID NO: 8236395 - DNA, 22 bp, Homo sapiens
gatgtgtgtgccctgggcctgc

SEQ ID NO: 8236396 - DNA, 22 bp, Homo sapiens
gatgtgtctccgtttcaaggca

SEQ ID NO: 8236397 - DNA, 22 bp, Homo sapiens
gatgtgtctccatacaccaccc

SEQ ID NO: 8236398 - DNA, 22 bp, Homo sapiens
gatgtgtctccgtttcaaggca

SEQ ID NO: 8236399 - DNA, 22 bp, Homo sapiens
gatgtgtctggctcccctgcaa

SEQ ID NO: 8236400 - DNA, 22 bp, Homo sapiens
gatgtgtctggctcccctgcaa

SEQ ID NO: 8236401 - DNA, 20 bp, Homo sapiens
gatgtgtcctcagcagtggt

SEQ ID NO: 8236402 - DNA, 22 bp, Homo sapiens
gatgtgtccctttcaactcaga

SEQ ID NO: 8236403 - DNA, 22 bp, Homo sapiens
gatgtgtcctagtacgggtggg

SEQ ID NO: 8236404 - DNA, 22 bp, Homo sapiens
gatgtgtccttttctccatcca

SEQ ID NO: 8236405 - DNA, 20 bp, Homo sapiens
gatgtgtcctcagcagtggt

SEQ ID NO: 8236406 - DNA, 22 bp, Homo sapiens
gatgtgtctccatacaccaccc

SEQ ID NO: 8236407 - DNA, 22 bp, Homo sapiens
gatgtgtctattcaacatgaaa

SEQ ID NO: 8236408 - DNA, 22 bp, Homo sapiens
gatgtgtctattcaacatgaaa

SEQ ID NO: 8236409 - DNA, 22 bp, Homo sapiens
gatgtgtccttttctccatcca

SEQ ID NO: 8236410 - DNA, 22 bp, Homo sapiens
gatgtctgggtgaggtctactg

SEQ ID NO: 8236411 - DNA, 22 bp, Homo sapiens
gatgtgtcctagtacgggtggg

SEQ ID NO: 8236412 - DNA, 22 bp, Homo sapiens
gatgtgtccctttcaactcaga

SEQ ID NO: 8236413 - DNA, 22 bp, Homo sapiens
gatgtgtccccagaggattgaa

SEQ ID NO: 8236414 - DNA, 22 bp, Homo sapiens
gatgtgtccccagaggattgaa

SEQ ID NO: 8236415 - DNA, 22 bp, Homo sapiens
gatgtcttaggtaacattctat

SEQ ID NO: 8236416 - DNA, 22 bp, Homo sapiens
gatgtacaggagtttttcaagg

SEQ ID NO: 8236417 - DNA, 22 bp, Homo sapiens
gatgtacactcagaaaagtcat

SEQ ID NO: 8236418 - DNA, 22 bp, Homo sapiens
gatgtacactcagaaaagtcat

SEQ ID NO: 8236419 - DNA, 22 bp, Homo sapiens
gatgtacatgcaagcacttaga

SEQ ID NO: 8236420 - DNA, 21 bp, Homo sapiens
gatgtacatcaagcactttgc

SEQ ID NO: 8236421 - DNA, 22 bp, Homo sapiens
gatgtagacacttggaggctta

SEQ ID NO: 8236422 - DNA, 22 bp, Homo sapiens
gatgtataacctggctatgtta

SEQ ID NO: 8236423 - DNA, 22 bp, Homo sapiens
gatgtataacctggctatgtta

SEQ ID NO: 8236424 - DNA, 22 bp, Homo sapiens
gatgtagattcatatgtggtgt

SEQ ID NO: 8236425 - DNA, 22 bp, Homo sapiens
gatgtagacacttggaggctta

SEQ ID NO: 8236426 - DNA, 22 bp, Homo sapiens
gatgtagagggaagattttaaa

SEQ ID NO: 8236427 - DNA, 19 bp, Homo sapiens
gatgtcctccatagtacgg

SEQ ID NO: 8236428 - DNA, 19 bp, Homo sapiens
gatgtctcctttcattgag

SEQ ID NO: 8236429 - DNA, 22 bp, Homo sapiens
gatgtatattctgtgccaggat

SEQ ID NO: 8236430 - DNA, 23 bp, Homo sapiens
gatgtatatatgagccgtcacat

SEQ ID NO: 8236431 - DNA, 22 bp, Homo sapiens
gatgtatatacctggtgtggaa

SEQ ID NO: 8236432 - DNA, 22 bp, Homo sapiens
gatgtatagtatgtaatttctg

SEQ ID NO: 8236433 - DNA, 22 bp, Homo sapiens
gatgtatagggccatgacacca

SEQ ID NO: 8236434 - DNA, 22 bp, Homo sapiens
gatgtatagctttaactgaccc

SEQ ID NO: 8236435 - DNA, 22 bp, Homo sapiens
gatgtatagggccatgacacca

SEQ ID NO: 8236436 - DNA, 22 bp, Homo sapiens
gatgtataacctggctatgtta

SEQ ID NO: 8236437 - DNA, 22 bp, Homo sapiens
gatgtatacagggttgactcat

SEQ ID NO: 8236438 - DNA, 22 bp, Homo sapiens
gatgtatacttttctttctctg

SEQ ID NO: 8236439 - DNA, 22 bp, Homo sapiens
gatgcctgtggtgagcacacat

SEQ ID NO: 8236440 - DNA, 22 bp, Homo sapiens
gatgcctgcatttcaggagagt

SEQ ID NO: 8236441 - DNA, 22 bp, Homo sapiens
gatgccctggcctgtccccgca

SEQ ID NO: 8236442 - DNA, 22 bp, Homo sapiens
gatgcctccaaatgagggcaga

SEQ ID NO: 8236443 - DNA, 22 bp, Homo sapiens
gatgccctgcatgagtcctgct

SEQ ID NO: 8236444 - DNA, 22 bp, Homo sapiens
gatgctgactttccgctgccac

SEQ ID NO: 8236445 - DNA, 22 bp, Homo sapiens
gatgctgaaatccagttcgggg

SEQ ID NO: 8236446 - DNA, 22 bp, Homo sapiens
gatgctgaagtgaagtgatctt

SEQ ID NO: 8236447 - DNA, 22 bp, Homo sapiens
gatgctgaagtgaagtgatctt

SEQ ID NO: 8236448 - DNA, 22 bp, Homo sapiens
gatgcgggcccgctccactgcc

SEQ ID NO: 8236449 - DNA, 22 bp, Homo sapiens
gatgcgggcccgctccactgcc

SEQ ID NO: 8236450 - DNA, 22 bp, Homo sapiens
gatgcgggcccgctccactgcc

SEQ ID NO: 8236451 - DNA, 22 bp, Homo sapiens
gatggaagaaaaatgcatgtct

SEQ ID NO: 8236452 - DNA, 18 bp, Homo sapiens
gatggaaagtgtatgagt

SEQ ID NO: 8236453 - DNA, 22 bp, Homo sapiens
gatgctgtaaaatgctaaacat

SEQ ID NO: 8236454 - DNA, 22 bp, Homo sapiens
gatgctgtggggttgaccctgg

SEQ ID NO: 8236455 - DNA, 22 bp, Homo sapiens
gatgctgtgctatgtctacaga

SEQ ID NO: 8236456 - DNA, 22 bp, Homo sapiens
gatgctgtgctatgtctacaga

SEQ ID NO: 8236457 - DNA, 22 bp, Homo sapiens
gatgctgggaccacagagtgtt

SEQ ID NO: 8236458 - DNA, 22 bp, Homo sapiens
gatgctgggaccacagagtgtt

SEQ ID NO: 8236459 - DNA, 22 bp, Homo sapiens
gatgctggaagtgctgatcttg

SEQ ID NO: 8236460 - DNA, 22 bp, Homo sapiens
gatgctggcctggccatctggg

SEQ ID NO: 8236461 - DNA, 22 bp, Homo sapiens
gatgctgagctgtatggctggt

SEQ ID NO: 8236462 - DNA, 22 bp, Homo sapiens
gatgctgagaggtggagggaac

SEQ ID NO: 8236463 - DNA, 22 bp, Homo sapiens
gatgctgataattcatgagaag

SEQ ID NO: 8236464 - DNA, 22 bp, Homo sapiens
gatggaatgtcacttctgtggt

SEQ ID NO: 8236465 - DNA, 22 bp, Homo sapiens
gatggaatgtcacttctgtggt

SEQ ID NO: 8236466 - DNA, 18 bp, Homo sapiens
gatggccatttcaatgtt

SEQ ID NO: 8236467 - DNA, 22 bp, Homo sapiens
gatggaggagatggcagggtgc

SEQ ID NO: 8236468 - DNA, 22 bp, Homo sapiens
gatggcctgtatttgggccaga

SEQ ID NO: 8236469 - DNA, 22 bp, Homo sapiens
gatggcccgctagctggcctct

SEQ ID NO: 8236470 - DNA, 22 bp, Homo sapiens
gatggctaggggactggagtta

SEQ ID NO: 8236471 - DNA, 22 bp, Homo sapiens
gatggctgcctcctgcggtcct

SEQ ID NO: 8236472 - DNA, 22 bp, Homo sapiens
gatggctgccttctccctgtgt

SEQ ID NO: 8236473 - DNA, 22 bp, Homo sapiens
gatggctggagccagtgctttg

SEQ ID NO: 8236474 - DNA, 22 bp, Homo sapiens
gatggctggctatatcagggga

SEQ ID NO: 8236475 - DNA, 22 bp, Homo sapiens
gatggctgtcttctccctgtgt

SEQ ID NO: 8236476 - DNA, 18 bp, Homo sapiens
gatgggagcaagagaaga

SEQ ID NO: 8236477 - DNA, 22 bp, Homo sapiens
gatgggaggaacctgggtccct

SEQ ID NO: 8236478 - DNA, 22 bp, Homo sapiens
gatgggctgtctgagcgctgtg

SEQ ID NO: 8236479 - DNA, 22 bp, Homo sapiens
gatgggctgtctgagcgctgtg

SEQ ID NO: 8236480 - DNA, 22 bp, Homo sapiens
gatgggcagcacagctggccaa

SEQ ID NO: 8236481 - DNA, 22 bp, Homo sapiens
gatgggcgtggcgcgtttggtg

SEQ ID NO: 8236482 - DNA, 20 bp, Homo sapiens
gatgggaatcggagctggta

SEQ ID NO: 8236483 - DNA, 20 bp, Homo sapiens
gatgggaatcggagctggta

SEQ ID NO: 8236484 - DNA, 22 bp, Homo sapiens
gcacaagcagcccactgacatt

SEQ ID NO: 8236485 - DNA, 22 bp, Homo sapiens
gcacaaggagcagtgtatgaaa

SEQ ID NO: 8236486 - DNA, 22 bp, Homo sapiens
gcacaaggagcagtgtatgaaa

SEQ ID NO: 8236487 - DNA, 22 bp, Homo sapiens
gcacaaatacaaagttgagaaa

SEQ ID NO: 8236488 - DNA, 22 bp, Homo sapiens
gcacaacaccaagggaggtatc

SEQ ID NO: 8236489 - DNA, 22 bp, Homo sapiens
gcacaagaataaccatatttaa

SEQ ID NO: 8236490 - DNA, 22 bp, Homo sapiens
gcacaaaggtggaaggaggaag

SEQ ID NO: 8236491 - DNA, 22 bp, Homo sapiens
gcacaaaggtggaaggaggaag

SEQ ID NO: 8236492 - DNA, 22 bp, Homo sapiens
gcacaaagatgaatacagaatg

SEQ ID NO: 8236493 - DNA, 22 bp, Homo sapiens
gcacaaaacacattttgacaat

SEQ ID NO: 8236494 - DNA, 22 bp, Homo sapiens
gcacaaaacacattttgacaat

SEQ ID NO: 8236495 - DNA, 22 bp, Homo sapiens
gcacaaaaggtacttcatgtag

SEQ ID NO: 8236496 - DNA, 22 bp, Homo sapiens
gcacaaaaggtacttcatgtag

SEQ ID NO: 8236497 - DNA, 22 bp, Homo sapiens
gcaattaaccagaccttgattc

SEQ ID NO: 8236498 - DNA, 20 bp, Homo sapiens
gcaattaatttttggttaca

SEQ ID NO: 8236499 - DNA, 22 bp, Homo sapiens
gcaattacagtggcatgtattt

SEQ ID NO: 8236500 - DNA, 22 bp, Homo sapiens
gcaatgcataacagagtgggcc

SEQ ID NO: 8236501 - DNA, 22 bp, Homo sapiens
gcaatataatttgtgggatatc

SEQ ID NO: 8236502 - DNA, 22 bp, Homo sapiens
gcaatatactttctggcagtga

SEQ ID NO: 8236503 - DNA, 20 bp, Homo sapiens
gcaatatatgagtgcaataa

SEQ ID NO: 8236504 - DNA, 22 bp, Homo sapiens
gcaatcaatgatttatatttgt

SEQ ID NO: 8236505 - DNA, 22 bp, Homo sapiens
gcaatgagcacccagagggcag

SEQ ID NO: 8236506 - DNA, 22 bp, Homo sapiens
gcaatgcaatctttattatatt

SEQ ID NO: 8236507 - DNA, 22 bp, Homo sapiens
gcaatataaccagttgtcatgc

SEQ ID NO: 8236508 - DNA, 22 bp, Homo sapiens
gcaaacatgttgtgagatacca

SEQ ID NO: 8236509 - DNA, 22 bp, Homo sapiens
gcaaacatgtgctcattttgtg

SEQ ID NO: 8236510 - DNA, 22 bp, Homo sapiens
gcaaacatcttagccatagagt

SEQ ID NO: 8236511 - DNA, 22 bp, Homo sapiens
gcaaacatctttatttggcaag

SEQ ID NO: 8236512 - DNA, 22 bp, Homo sapiens
gcaaacatgctgagaaataaga

SEQ ID NO: 8236513 - DNA, 22 bp, Homo sapiens
gatttttatataaagtgagaaa

SEQ ID NO: 8236514 - DNA, 22 bp, Homo sapiens
gattttgtcaaattccaaatgt

SEQ ID NO: 8236515 - DNA, 22 bp, Homo sapiens
gatttttatataaagtgagaaa

SEQ ID NO: 8236516 - DNA, 22 bp, Homo sapiens
gattttgtcaaattccaaatgt

SEQ ID NO: 8236517 - DNA, 22 bp, Homo sapiens
gatttttatataaagtgagaaa

SEQ ID NO: 8236518 - DNA, 22 bp, Homo sapiens
gattttgaatattaaagaagag

SEQ ID NO: 8236519 - DNA, 22 bp, Homo sapiens
gattttgtcaaattccaaatgt

SEQ ID NO: 8236520 - DNA, 22 bp, Homo sapiens
gattttctgagccttcaaattt

SEQ ID NO: 8236521 - DNA, 22 bp, Homo sapiens
gattttctgagccttcaaattt

SEQ ID NO: 8236522 - DNA, 22 bp, Homo sapiens
gattttcttgggaaacaatgag

SEQ ID NO: 8236523 - DNA, 22 bp, Homo sapiens
gcaaacagaaatgcaggacgct

SEQ ID NO: 8236524 - DNA, 22 bp, Homo sapiens
gcaaacagccaggcgcagaagt

SEQ ID NO: 8236525 - DNA, 22 bp, Homo sapiens
gcaaacatccactgcccttgta

SEQ ID NO: 8236526 - DNA, 22 bp, Homo sapiens
gatttttatataaagtgagaaa

SEQ ID NO: 8236527 - DNA, 22 bp, Homo sapiens
gatttttatataaagtgagaaa

SEQ ID NO: 8236528 - DNA, 22 bp, Homo sapiens
gatttttatataaagtgagaaa

SEQ ID NO: 8236529 - DNA, 22 bp, Homo sapiens
gatttcttgacccctgtctcag

SEQ ID NO: 8236530 - DNA, 22 bp, Homo sapiens
gatttcttctctcccaagagga

SEQ ID NO: 8236531 - DNA, 22 bp, Homo sapiens
gatttcttcatttgtggtgaat

SEQ ID NO: 8236532 - DNA, 22 bp, Homo sapiens
gatttcttgataattcaaatcc

SEQ ID NO: 8236533 - DNA, 22 bp, Homo sapiens
gatttcttgataagtagtgtga

SEQ ID NO: 8236534 - DNA, 22 bp, Homo sapiens
gatttcttgagcaagttgctta

SEQ ID NO: 8236535 - DNA, 22 bp, Homo sapiens
gatttcttgacccctgtctcag

SEQ ID NO: 8236536 - DNA, 22 bp, Homo sapiens
gatttcttgagcaagttgctta

SEQ ID NO: 8236537 - DNA, 22 bp, Homo sapiens
gatttctgtggcttgtacatat

SEQ ID NO: 8236538 - DNA, 22 bp, Homo sapiens
gatttcacccacttcccagtgt

SEQ ID NO: 8236539 - DNA, 22 bp, Homo sapiens
gatttcttgataattcaaatcc

SEQ ID NO: 8236540 - DNA, 22 bp, Homo sapiens
gatttcttgataattcaaatcc

SEQ ID NO: 8236541 - DNA, 22 bp, Homo sapiens
gatttctttagctcatcagatc

SEQ ID NO: 8236542 - DNA, 22 bp, Homo sapiens
gatttctttaggtgtaatagtg

SEQ ID NO: 8236543 - DNA, 22 bp, Homo sapiens
gatttctttaggtgtaatagtg

SEQ ID NO: 8236544 - DNA, 22 bp, Homo sapiens
gatttctttaggtgtaatagtg

SEQ ID NO: 8236545 - DNA, 22 bp, Homo sapiens
gatttctttatgaagtacagaa

SEQ ID NO: 8236546 - DNA, 22 bp, Homo sapiens
gatttctttatgaagtacagaa

SEQ ID NO: 8236547 - DNA, 22 bp, Homo sapiens
gatttctttgcaagctgtgttc

SEQ ID NO: 8236548 - DNA, 22 bp, Homo sapiens
gatttctttgaattagagaggt

SEQ ID NO: 8236549 - DNA, 22 bp, Homo sapiens
gatttctttgcaagctgtgttc

SEQ ID NO: 8236550 - DNA, 21 bp, Homo sapiens
gatttgcagaaactagacagg

SEQ ID NO: 8236551 - DNA, 22 bp, Homo sapiens
gatttgcattctgaaagctacc

SEQ ID NO: 8236552 - DNA, 22 bp, Homo sapiens
gatttgcagctagagcaaaggt

SEQ ID NO: 8236553 - DNA, 22 bp, Homo sapiens
gattttatatggcatactgtgg

SEQ ID NO: 8236554 - DNA, 22 bp, Homo sapiens
gattttatagtcaggaaaaaga

SEQ ID NO: 8236555 - DNA, 22 bp, Homo sapiens
gattttatagtcaggaaaaaga

SEQ ID NO: 8236556 - DNA, 22 bp, Homo sapiens
gattttaattataggaggtcct

SEQ ID NO: 8236557 - DNA, 22 bp, Homo sapiens
gatttgtttcaagttagcatct

SEQ ID NO: 8236558 - DNA, 22 bp, Homo sapiens
gatttgtctaggtcatgacttt

SEQ ID NO: 8236559 - DNA, 21 bp, Homo sapiens
gattttaaagagactgccaca

SEQ ID NO: 8236560 - DNA, 21 bp, Homo sapiens
gattttaaagagactgccaca

SEQ ID NO: 8236561 - DNA, 22 bp, Homo sapiens
gattttcattatagctagtttc

SEQ ID NO: 8236562 - DNA, 22 bp, Homo sapiens
gattttcatgataaacttgtga

SEQ ID NO: 8236563 - DNA, 22 bp, Homo sapiens
gattttcatgataaacttgtga

SEQ ID NO: 8236564 - DNA, 22 bp, Homo sapiens
gattttcatttgcactctagaa

SEQ ID NO: 8236565 - DNA, 22 bp, Homo sapiens
gattttcattatagctagtttc

SEQ ID NO: 8236566 - DNA, 22 bp, Homo sapiens
gattttcatttgcactctagaa

SEQ ID NO: 8236567 - DNA, 22 bp, Homo sapiens
gattttcatttgcactctagaa

SEQ ID NO: 8236568 - DNA, 22 bp, Homo sapiens
gattttattagcccaaactttg

SEQ ID NO: 8236569 - DNA, 22 bp, Homo sapiens
gattttatctttgtgtgcagta

SEQ ID NO: 8236570 - DNA, 22 bp, Homo sapiens
gattttatctttgtgtgcagta

SEQ ID NO: 8236571 - DNA, 22 bp, Homo sapiens
gattttattagcccaaactttg

SEQ ID NO: 8236572 - DNA, 22 bp, Homo sapiens
gattttatctttgtgtgcagta

SEQ ID NO: 8236573 - DNA, 22 bp, Homo sapiens
gattttatcgtcatccttctgg

SEQ ID NO: 8236574 - DNA, 22 bp, Homo sapiens
gattttatctttgtgtgcagta

SEQ ID NO: 8236575 - DNA, 22 bp, Homo sapiens
gattttatatggcatactgtgg

SEQ ID NO: 8236576 - DNA, 22 bp, Homo sapiens
gattttatcgtcatccttctgg

SEQ ID NO: 8236577 - DNA, 22 bp, Homo sapiens
gattttatcgtcatccttctgg

SEQ ID NO: 8236578 - DNA, 22 bp, Homo sapiens
gcacctgattgatttcactgct

SEQ ID NO: 8236579 - DNA, 22 bp, Homo sapiens
gcacctgcaggatgagccaggg

SEQ ID NO: 8236580 - DNA, 22 bp, Homo sapiens
gcacctccaggggccgcccacc

SEQ ID NO: 8236581 - DNA, 22 bp, Homo sapiens
gcacctcattttgcaggtagaa

SEQ ID NO: 8236582 - DNA, 22 bp, Homo sapiens
gcacctgaggaggcatctggag

SEQ ID NO: 8236583 - DNA, 20 bp, Homo sapiens
gcacttggctgctgcttctc

SEQ ID NO: 8236584 - DNA, 22 bp, Homo sapiens
gcacctggacagtgaccctagc

SEQ ID NO: 8236585 - DNA, 22 bp, Homo sapiens
gcacctggacagtgaccctagc

SEQ ID NO: 8236586 - DNA, 22 bp, Homo sapiens
gcacctggctgcccaggtggag

SEQ ID NO: 8236587 - DNA, 22 bp, Homo sapiens
gcaccctgagtgttcagctcca

SEQ ID NO: 8236588 - DNA, 22 bp, Homo sapiens
gcaccgccttggaccgcccgct

SEQ ID NO: 8236589 - DNA, 22 bp, Homo sapiens
gcaccgccttggaccgcccgct

SEQ ID NO: 8236590 - DNA, 19 bp, Homo sapiens
gcaccccatcttcctcctg

SEQ ID NO: 8236591 - DNA, 19 bp, Homo sapiens
gcaccctgaggtcatggcc

SEQ ID NO: 8236592 - DNA, 22 bp, Homo sapiens
gcaccctctgagctccgctccg

SEQ ID NO: 8236593 - DNA, 22 bp, Homo sapiens
gcacccctggacggtagggcca

SEQ ID NO: 8236594 - DNA, 22 bp, Homo sapiens
gcacccctggacggtagggcca

SEQ ID NO: 8236595 - DNA, 16 bp, Homo sapiens
gcacacacatcaatga

SEQ ID NO: 8236596 - DNA, 16 bp, Homo sapiens
gcacacacatcaatga

SEQ ID NO: 8236597 - DNA, 22 bp, Homo sapiens
gcacaatttgactctattcata

SEQ ID NO: 8236598 - DNA, 22 bp, Homo sapiens
gcacaataatttttttaagagg

SEQ ID NO: 8236599 - DNA, 22 bp, Homo sapiens
gcacaagtttcttcattgttca

SEQ ID NO: 8236600 - DNA, 22 bp, Homo sapiens
gcacccaggccggcgactgcag

SEQ ID NO: 8236601 - DNA, 22 bp, Homo sapiens
gcacacactgttttcctcacat

SEQ ID NO: 8236602 - DNA, 22 bp, Homo sapiens
gcacacactgttttcctcacat

SEQ ID NO: 8236603 - DNA, 22 bp, Homo sapiens
gcacacactgttttcctcacat

SEQ ID NO: 8236604 - DNA, 22 bp, Homo sapiens
gcacacactgttttcctcacat

SEQ ID NO: 8236605 - DNA, 22 bp, Homo sapiens
gcacacactgttttcctcacat

SEQ ID NO: 8236606 - DNA, 22 bp, Homo sapiens
gcacacacatgtgagtacatgc

SEQ ID NO: 8236607 - DNA, 22 bp, Homo sapiens
gcacacacatgtgagtacatgc

SEQ ID NO: 8236608 - DNA, 22 bp, Homo sapiens
gcacccaggcttgggcagcaac

SEQ ID NO: 8236609 - DNA, 22 bp, Homo sapiens
gcacccaggcttgggcagcaac

SEQ ID NO: 8236610 - DNA, 22 bp, Homo sapiens
gcacccagtttgtctcagggtt

SEQ ID NO: 8236611 - DNA, 22 bp, Homo sapiens
gcacccagtgggatgcttagca

SEQ ID NO: 8236612 - DNA, 23 bp, Homo sapiens
gcacttttataggtggggaaaca

SEQ ID NO: 8236613 - DNA, 22 bp, Homo sapiens
gcactttgtggattgtatttcc

SEQ ID NO: 8236614 - DNA, 22 bp, Homo sapiens
gcacttttcaaagcttcctgtg

SEQ ID NO: 8236615 - DNA, 22 bp, Homo sapiens
gcactttatagtagaaagagca

SEQ ID NO: 8236616 - DNA, 22 bp, Homo sapiens
gcactttgtggattgtatttcc

SEQ ID NO: 8236617 - DNA, 21 bp, Homo sapiens
gcagaaaggaatcttaggtcc

SEQ ID NO: 8236618 - DNA, 22 bp, Homo sapiens
gcagaacaacgtaggagtggag

SEQ ID NO: 8236619 - DNA, 22 bp, Homo sapiens
gcagaaatatgatgcataaagg

SEQ ID NO: 8236620 - DNA, 22 bp, Homo sapiens
gcagaaagcttagagggtttgc

SEQ ID NO: 8236621 - DNA, 22 bp, Homo sapiens
gcagaaagctccttgcgatctg

SEQ ID NO: 8236622 - DNA, 22 bp, Homo sapiens
gcagaagcagggcaggggcaaa

SEQ ID NO: 8236623 - DNA, 22 bp, Homo sapiens
gcagaagcagcagatgggcgca

SEQ ID NO: 8236624 - DNA, 22 bp, Homo sapiens
gcagaagctgggagaagggatt

SEQ ID NO: 8236625 - DNA, 22 bp, Homo sapiens
gcagaagcccggtcagcgcacg

SEQ ID NO: 8236626 - DNA, 22 bp, Homo sapiens
gcagaagctgggcagcgaggtg

SEQ ID NO: 8236627 - DNA, 22 bp, Homo sapiens
gcagaagctgggcagcgaggtg

SEQ ID NO: 8236628 - DNA, 22 bp, Homo sapiens
gcagaagaccatggtggaaaga

SEQ ID NO: 8236629 - DNA, 22 bp, Homo sapiens
gcagaagaccatggtggaaaga

SEQ ID NO: 8236630 - DNA, 22 bp, Homo sapiens
gcagaagcagaggagcctatga

SEQ ID NO: 8236631 - DNA, 22 bp, Homo sapiens
gcagaagcacaggtgacgggcc

SEQ ID NO: 8236632 - DNA, 22 bp, Homo sapiens
gcagaacatttcacagtatctt

SEQ ID NO: 8236633 - DNA, 22 bp, Homo sapiens
gcagaacaacgtaggagtggag

SEQ ID NO: 8236634 - DNA, 22 bp, Homo sapiens
gcagaaggatccgcaggtgcaa

SEQ ID NO: 8236635 - DNA, 22 bp, Homo sapiens
gcagagcagtactctcttgact

SEQ ID NO: 8236636 - DNA, 22 bp, Homo sapiens
gcagagcagtactctcttgact

SEQ ID NO: 8236637 - DNA, 22 bp, Homo sapiens
gcagagcagtgcttgcccagcg

SEQ ID NO: 8236638 - DNA, 22 bp, Homo sapiens
gcagagcagtgcttgcccagcg

SEQ ID NO: 8236639 - DNA, 22 bp, Homo sapiens
gcagaagctgggcagcgaggtg

SEQ ID NO: 8236640 - DNA, 22 bp, Homo sapiens
gcagaaggatccgcaggtgcaa

SEQ ID NO: 8236641 - DNA, 22 bp, Homo sapiens
gcagaagctgttcgaaggccgc

SEQ ID NO: 8236642 - DNA, 22 bp, Homo sapiens
gcagaagctgttcgaaggccgc

SEQ ID NO: 8236643 - DNA, 22 bp, Homo sapiens
gcagaagctgttcgaaggccgc

SEQ ID NO: 8236644 - DNA, 18 bp, Homo sapiens
gcagagcatcaagggtta

SEQ ID NO: 8236645 - DNA, 22 bp, Homo sapiens
gcagagcagtgcttgcccagcg

SEQ ID NO: 8236646 - DNA, 22 bp, Homo sapiens
gcagagcatgtcctcaggacag

SEQ ID NO: 8236647 - DNA, 22 bp, Homo sapiens
gcagagcatgtcctcaggacag

SEQ ID NO: 8236648 - DNA, 22 bp, Homo sapiens
gcagagcatgtcctcaggacag

SEQ ID NO: 8236649 - DNA, 22 bp, Homo sapiens
gcagagcatgtcctcaggacag

SEQ ID NO: 8236650 - DNA, 22 bp, Homo sapiens
gcagagcattggagggaccctg

SEQ ID NO: 8236651 - DNA, 22 bp, Homo sapiens
gcagagcattggagggaccctg

SEQ ID NO: 8236652 - DNA, 22 bp, Homo sapiens
gcagagccagaatggccaggac

SEQ ID NO: 8236653 - DNA, 22 bp, Homo sapiens
gcagagcatttcggttgcttcc

SEQ ID NO: 8236654 - DNA, 22 bp, Homo sapiens
gcagagcattggagggaccctg

SEQ ID NO: 8236655 - DNA, 22 bp, Homo sapiens
gcagagccccattgctggcggg

SEQ ID NO: 8236656 - DNA, 22 bp, Homo sapiens
gcagagccaggctggggcaggt

SEQ ID NO: 8236657 - DNA, 22 bp, Homo sapiens
gcagagccaggagcccaggatc

SEQ ID NO: 8236658 - DNA, 22 bp, Homo sapiens
gcagagccaggctggggcaggt

SEQ ID NO: 8236659 - DNA, 22 bp, Homo sapiens
gcagagccaggagcccaggatc

SEQ ID NO: 8236660 - DNA, 22 bp, Homo sapiens
gcagggacgcagcactctccgt

SEQ ID NO: 8236661 - DNA, 22 bp, Homo sapiens
gcagggacgcagcactctccgt

SEQ ID NO: 8236662 - DNA, 22 bp, Homo sapiens
gcagggaccttgcccaccctcc

SEQ ID NO: 8236663 - DNA, 22 bp, Homo sapiens
gcagggaagacccggagcagcg

SEQ ID NO: 8236664 - DNA, 22 bp, Homo sapiens
gcagggaagacccggagcagcg

SEQ ID NO: 8236665 - DNA, 22 bp, Homo sapiens
gcagggcaaacccaggtgttca

SEQ ID NO: 8236666 - DNA, 22 bp, Homo sapiens
gcagggacgccagggacagcaa

SEQ ID NO: 8236667 - DNA, 22 bp, Homo sapiens
gcagggacgccagggacagcaa

SEQ ID NO: 8236668 - DNA, 22 bp, Homo sapiens
gcagggaaacaggtgctaagga

SEQ ID NO: 8236669 - DNA, 22 bp, Homo sapiens
gcagggaaacaggtgctaagga

SEQ ID NO: 8236670 - DNA, 22 bp, Homo sapiens
gcagggaagacccggagcagcg

SEQ ID NO: 8236671 - DNA, 22 bp, Homo sapiens
gcagggaaacaggtgctaagga

SEQ ID NO: 8236672 - DNA, 22 bp, Homo sapiens
gcaggctttgacttggggcaac

SEQ ID NO: 8236673 - DNA, 18 bp, Homo sapiens
gcaggcttttcctgggtc

SEQ ID NO: 8236674 - DNA, 22 bp, Homo sapiens
gcaggctttgacttggggcagc

SEQ ID NO: 8236675 - DNA, 22 bp, Homo sapiens
gcaggcttgcccggcctccttc

SEQ ID NO: 8236676 - DNA, 22 bp, Homo sapiens
gcaggcttgggacgagctggag

SEQ ID NO: 8236677 - DNA, 19 bp, Homo sapiens
gcaggcttgggtctcccca

SEQ ID NO: 8236678 - DNA, 19 bp, Homo sapiens
gcaggcttgggtctcccca

SEQ ID NO: 8236679 - DNA, 22 bp, Homo sapiens
gcaggcttgggacgagctggag

SEQ ID NO: 8236680 - DNA, 21 bp, Homo sapiens
gcaggctggtcaaacctcagt

SEQ ID NO: 8236681 - DNA, 21 bp, Homo sapiens
gcaggctggtcaaacctcagt

SEQ ID NO: 8236682 - DNA, 22 bp, Homo sapiens
gcaggctggggtagccccactt

SEQ ID NO: 8236683 - DNA, 22 bp, Homo sapiens
gcaggctggggtagccccactt

SEQ ID NO: 8236684 - DNA, 22 bp, Homo sapiens
gcaggctggggtagccccactt

SEQ ID NO: 8236685 - DNA, 22 bp, Homo sapiens
gcaggctggggtagccccactt

SEQ ID NO: 8236686 - DNA, 22 bp, Homo sapiens
gcaggctggtctgaccatccct

SEQ ID NO: 8236687 - DNA, 22 bp, Homo sapiens
gcaggctgtggtatgttgggca

SEQ ID NO: 8236688 - DNA, 22 bp, Homo sapiens
gcaggctggtctgaccatccct

SEQ ID NO: 8236689 - DNA, 22 bp, Homo sapiens
gcaggctggtctgaccatccct

SEQ ID NO: 8236690 - DNA, 21 bp, Homo sapiens
gcaggctggtcaaacctcagt

SEQ ID NO: 8236691 - DNA, 21 bp, Homo sapiens
gcaggctggtcaaacctcagt

SEQ ID NO: 8236692 - DNA, 22 bp, Homo sapiens
gcaggcttatggggagacagag

SEQ ID NO: 8236693 - DNA, 22 bp, Homo sapiens
gcaggcttcaagcacagctttt

SEQ ID NO: 8236694 - DNA, 22 bp, Homo sapiens
gcaggcttcaagcacagctttt

SEQ ID NO: 8236695 - DNA, 22 bp, Homo sapiens
gcaggcttcccccacacctacg

SEQ ID NO: 8236696 - DNA, 22 bp, Homo sapiens
gcaggcttgcccggcctccttc

SEQ ID NO: 8236697 - DNA, 22 bp, Homo sapiens
gcaggcagaggtggaggagaca

SEQ ID NO: 8236698 - DNA, 22 bp, Homo sapiens
gcaggcagaggtggaggagaca

SEQ ID NO: 8236699 - DNA, 22 bp, Homo sapiens
gcaggcagaggtggaggagaca

SEQ ID NO: 8236700 - DNA, 22 bp, Homo sapiens
gcaggctgccctcttgtgttga

SEQ ID NO: 8236701 - DNA, 22 bp, Homo sapiens
gcaggctgccctcttgtgttga

SEQ ID NO: 8236702 - DNA, 22 bp, Homo sapiens
gcaggcagaggtggaggagaca

SEQ ID NO: 8236703 - DNA, 22 bp, Homo sapiens
gcaggctgccaccttctgagtt

SEQ ID NO: 8236704 - DNA, 22 bp, Homo sapiens
gcaggctgccaccttctgagtt

SEQ ID NO: 8236705 - DNA, 22 bp, Homo sapiens
gcaggctgccaccttctgagtt

SEQ ID NO: 8236706 - DNA, 22 bp, Homo sapiens
gcaggctgctgagatccttagg

SEQ ID NO: 8236707 - DNA, 22 bp, Homo sapiens
gcaggctgccctcttgtgttga

SEQ ID NO: 8236708 - DNA, 22 bp, Homo sapiens
gcaggctgctgagatccttagg

SEQ ID NO: 8236709 - DNA, 22 bp, Homo sapiens
gcaggctgctgagatccttagg

SEQ ID NO: 8236710 - DNA, 22 bp, Homo sapiens
gcaggctggaggctgttctggg

SEQ ID NO: 8236711 - DNA, 22 bp, Homo sapiens
gcaggctggaggctgttctggg

SEQ ID NO: 8236712 - DNA, 22 bp, Homo sapiens
gcaggctggaggctgttctggg

SEQ ID NO: 8236713 - DNA, 22 bp, Homo sapiens
gcaggctggaggctgttctggg

SEQ ID NO: 8236714 - DNA, 22 bp, Homo sapiens
gcaggctggaggctgttctggg

SEQ ID NO: 8236715 - DNA, 22 bp, Homo sapiens
gcaggctggaggctgttctggg

SEQ ID NO: 8236716 - DNA, 22 bp, Homo sapiens
gcaggctggaggctgttctggg

SEQ ID NO: 8236717 - DNA, 21 bp, Homo sapiens
gcaggcactctagaggagctg

SEQ ID NO: 8236718 - DNA, 21 bp, Homo sapiens
gcaggcactctagaggagctg

SEQ ID NO: 8236719 - DNA, 17 bp, Homo sapiens
gcaggcactgctgcctg

SEQ ID NO: 8236720 - DNA, 17 bp, Homo sapiens
gcaggcactgctgcctg

SEQ ID NO: 8236721 - DNA, 21 bp, Homo sapiens
gcaggcactctagaggagctg

SEQ ID NO: 8236722 - DNA, 21 bp, Homo sapiens
gcaggcactctagaggagctg

SEQ ID NO: 8236723 - DNA, 22 bp, Homo sapiens
gcaggcactcctaggaccatca

SEQ ID NO: 8236724 - DNA, 22 bp, Homo sapiens
gcaggcactcctaggaccatca

SEQ ID NO: 8236725 - DNA, 22 bp, Homo sapiens
gcaggcagaggtggaggagaca

SEQ ID NO: 8236726 - DNA, 22 bp, Homo sapiens
gcaggcagagaggggtttccag

SEQ ID NO: 8236727 - DNA, 22 bp, Homo sapiens
gcaggcagagaggggtttccag

SEQ ID NO: 8236728 - DNA, 22 bp, Homo sapiens
gcaggcagagaaggaacattta

SEQ ID NO: 8236729 - DNA, 22 bp, Homo sapiens
gcaggcagagaaggaacattta

SEQ ID NO: 8236730 - DNA, 14 bp, Homo sapiens
gcaggcagaccacc

SEQ ID NO: 8236731 - DNA, 17 bp, Homo sapiens
gcaggcactgctgcctg

SEQ ID NO: 8236732 - DNA, 22 bp, Homo sapiens
gcaggcagagaaggaacattta

SEQ ID NO: 8236733 - DNA, 22 bp, Homo sapiens
gcaggcagagaaggaacattta

SEQ ID NO: 8236734 - DNA, 22 bp, Homo sapiens
gcaggcagagaaggaacattta

SEQ ID NO: 8236735 - DNA, 22 bp, Homo sapiens
gcagggcagccacaggccccct

SEQ ID NO: 8236736 - DNA, 22 bp, Homo sapiens
gcagggcagccacaggccccct

SEQ ID NO: 8236737 - DNA, 22 bp, Homo sapiens
gcagggcagccacaggccccct

SEQ ID NO: 8236738 - DNA, 22 bp, Homo sapiens
gcaggggcaggagatctcaggc

SEQ ID NO: 8236739 - DNA, 22 bp, Homo sapiens
gcaggggcaggagatctcaggc

SEQ ID NO: 8236740 - DNA, 22 bp, Homo sapiens
gcaggggcaggagatctcaggc

SEQ ID NO: 8236741 - DNA, 22 bp, Homo sapiens
gcaggggctactctgagcttcc

SEQ ID NO: 8236742 - DNA, 22 bp, Homo sapiens
gcaggggcggctgggtttccag

SEQ ID NO: 8236743 - DNA, 22 bp, Homo sapiens
gcaggggctaaggacacagaga

SEQ ID NO: 8236744 - DNA, 22 bp, Homo sapiens
gcaggggctaaggacacagaga

SEQ ID NO: 8236745 - DNA, 22 bp, Homo sapiens
gcaggggctaaggacacagaga

SEQ ID NO: 8236746 - DNA, 22 bp, Homo sapiens
gcaggggctaaggacacagaga

SEQ ID NO: 8236747 - DNA, 22 bp, Homo sapiens
gcagggggtcattcacgctggc

SEQ ID NO: 8236748 - DNA, 22 bp, Homo sapiens
gcagggtgacgttgcccacctc

SEQ ID NO: 8236749 - DNA, 22 bp, Homo sapiens
gcagggggtcattcacgctggc

SEQ ID NO: 8236750 - DNA, 22 bp, Homo sapiens
gcagggggtcattcacgctggc

SEQ ID NO: 8236751 - DNA, 22 bp, Homo sapiens
gcagggggtcattcacgctggc

SEQ ID NO: 8236752 - DNA, 22 bp, Homo sapiens
gcagggggatggagttgaaatg

SEQ ID NO: 8236753 - DNA, 22 bp, Homo sapiens
gcaggggctgctgggaactcgg

SEQ ID NO: 8236754 - DNA, 22 bp, Homo sapiens
gcaggggctgctgggaactcgg

SEQ ID NO: 8236755 - DNA, 22 bp, Homo sapiens
gcaggggctgctgggaactcgg

SEQ ID NO: 8236756 - DNA, 22 bp, Homo sapiens
gcaggggctgctgggaactcgg

SEQ ID NO: 8236757 - DNA, 22 bp, Homo sapiens
gcaggggctgctgggaactcgg

SEQ ID NO: 8236758 - DNA, 22 bp, Homo sapiens
gcaggggctgagcaccagcggg

SEQ ID NO: 8236759 - DNA, 22 bp, Homo sapiens
gcaggggctgagcaccagcggg

SEQ ID NO: 8236760 - DNA, 22 bp, Homo sapiens
gcaggggctgagcaccagcggg

SEQ ID NO: 8236761 - DNA, 22 bp, Homo sapiens
gcaggggctgagcaccagcggg

SEQ ID NO: 8236762 - DNA, 22 bp, Homo sapiens
gcaggggctgagcaccagcggg

SEQ ID NO: 8236763 - DNA, 20 bp, Homo sapiens
gcagggcaagggatatgaaa

SEQ ID NO: 8236764 - DNA, 22 bp, Homo sapiens
gcagggcaaatgtggaaaggag

SEQ ID NO: 8236765 - DNA, 20 bp, Homo sapiens
gcagggcaagggatatgaaa

SEQ ID NO: 8236766 - DNA, 22 bp, Homo sapiens
gcagggcaaatgtggaaaggag

SEQ ID NO: 8236767 - DNA, 22 bp, Homo sapiens
gcagggcaaatgtggaaaggag

SEQ ID NO: 8236768 - DNA, 22 bp, Homo sapiens
gcagggcaaatgtggaaaggag

SEQ ID NO: 8236769 - DNA, 22 bp, Homo sapiens
gcagggcaaacccaggtgttca

SEQ ID NO: 8236770 - DNA, 22 bp, Homo sapiens
gcagggcaatgatcccgagagg

SEQ ID NO: 8236771 - DNA, 22 bp, Homo sapiens
gcagggcaatgatcccgagagg

SEQ ID NO: 8236772 - DNA, 22 bp, Homo sapiens
gcagggcacaaggacgcacagg

SEQ ID NO: 8236773 - DNA, 22 bp, Homo sapiens
gcagggcacacaagaatgataa

SEQ ID NO: 8236774 - DNA, 22 bp, Homo sapiens
gcagggcacacaagaatgataa

SEQ ID NO: 8236775 - DNA, 22 bp, Homo sapiens
gcagggcacacaagaatgataa

SEQ ID NO: 8236776 - DNA, 22 bp, Homo sapiens
gcagggcacaaggacgcacagg

SEQ ID NO: 8236777 - DNA, 22 bp, Homo sapiens
gcagggcacaaggacgcacagg

SEQ ID NO: 8236778 - DNA, 22 bp, Homo sapiens
gcagggcacaaggacgcacagg

SEQ ID NO: 8236779 - DNA, 22 bp, Homo sapiens
gcagggcacagacagtgccaag

SEQ ID NO: 8236780 - DNA, 22 bp, Homo sapiens
gcagggcacagacagtgccaag

SEQ ID NO: 8236781 - DNA, 22 bp, Homo sapiens
gcagggcacagacagtgccaag

SEQ ID NO: 8236782 - DNA, 22 bp, Homo sapiens
gcagggcagaaggtgctgagga

SEQ ID NO: 8236783 - DNA, 22 bp, Homo sapiens
gcagggcagaaggtgctgagga

SEQ ID NO: 8236784 - DNA, 22 bp, Homo sapiens
gcagggcagaaggtgctgagga

SEQ ID NO: 8236785 - DNA, 22 bp, Homo sapiens
gcagggcagacctccagcctat

SEQ ID NO: 8236786 - DNA, 22 bp, Homo sapiens
gcagggcagacctccagcctat

SEQ ID NO: 8236787 - DNA, 22 bp, Homo sapiens
gcagggcagaaggtgctgagga

SEQ ID NO: 8236788 - DNA, 22 bp, Homo sapiens
gcagggcagaaggtgctgagga

SEQ ID NO: 8236789 - DNA, 22 bp, Homo sapiens
gcagggcagagggagaatctct

SEQ ID NO: 8236790 - DNA, 22 bp, Homo sapiens
gcagggcagacctccagcctat

SEQ ID NO: 8236791 - DNA, 22 bp, Homo sapiens
gcagggcagagggagaatctct

SEQ ID NO: 8236792 - DNA, 22 bp, Homo sapiens
gcagcctctgcagttcaggagg

SEQ ID NO: 8236793 - DNA, 22 bp, Homo sapiens
gcagcctctgcagttcaggagg

SEQ ID NO: 8236794 - DNA, 23 bp, Homo sapiens
gcagcgtccgcaccccggccggg

SEQ ID NO: 8236795 - DNA, 17 bp, Homo sapiens
gcagcctcttggtagtg

SEQ ID NO: 8236796 - DNA, 22 bp, Homo sapiens
gcagcgctactcacagctctga

SEQ ID NO: 8236797 - DNA, 22 bp, Homo sapiens
gcagcgctactcacagctctga

SEQ ID NO: 8236798 - DNA, 22 bp, Homo sapiens
gcagcgtggggctgagtcagct

SEQ ID NO: 8236799 - DNA, 22 bp, Homo sapiens
gcagcgtggggacaggagctca

SEQ ID NO: 8236800 - DNA, 22 bp, Homo sapiens
gcagctaccacccaggaaggac

SEQ ID NO: 8236801 - DNA, 22 bp, Homo sapiens
gcagagctatcttctggatttg

SEQ ID NO: 8236802 - DNA, 22 bp, Homo sapiens
gcagagctcaaggtgttcagct

SEQ ID NO: 8236803 - DNA, 22 bp, Homo sapiens
gcagagctcaaggtgttcagct

SEQ ID NO: 8236804 - DNA, 22 bp, Homo sapiens
gcagagctccccaagacaccaa

SEQ ID NO: 8236805 - DNA, 22 bp, Homo sapiens
gcagcctctgatgatggccgta

SEQ ID NO: 8236806 - DNA, 22 bp, Homo sapiens
gcagcctctgatgatggccgta

SEQ ID NO: 8236807 - DNA, 22 bp, Homo sapiens
gcagagctcatgcctgcacctc

SEQ ID NO: 8236808 - DNA, 22 bp, Homo sapiens
gcagagctcatgcctgcacctc

SEQ ID NO: 8236809 - DNA, 20 bp, Homo sapiens
gcagagcctcactgcaaggg

SEQ ID NO: 8236810 - DNA, 22 bp, Homo sapiens
gcagagcctgtgtctgagcaaa

SEQ ID NO: 8236811 - DNA, 22 bp, Homo sapiens
gcagagcctgtgtctgagcaaa

SEQ ID NO: 8236812 - DNA, 22 bp, Homo sapiens
gcagagcctgggggtctgcgga

SEQ ID NO: 8236813 - DNA, 22 bp, Homo sapiens
gcagctctgacaatgcctggaa

SEQ ID NO: 8236814 - DNA, 22 bp, Homo sapiens
gcagctctctggcctgccctgg

SEQ ID NO: 8236815 - DNA, 22 bp, Homo sapiens
gcagctctgagactctacagaa

SEQ ID NO: 8236816 - DNA, 22 bp, Homo sapiens
gcagctgaatgtccattgctgc

SEQ ID NO: 8236817 - DNA, 22 bp, Homo sapiens
gcagctgaatgtccattgctgc

SEQ ID NO: 8236818 - DNA, 22 bp, Homo sapiens
gcagctgaagctgcagttccag

SEQ ID NO: 8236819 - DNA, 20 bp, Homo sapiens
gcagctgaaagtatgacacc

SEQ ID NO: 8236820 - DNA, 22 bp, Homo sapiens
gcagctgaaagggatctctaca

SEQ ID NO: 8236821 - DNA, 22 bp, Homo sapiens
gcagctgaaagggatctctaca

SEQ ID NO: 8236822 - DNA, 22 bp, Homo sapiens
gcagctgaaagggatctctaca

SEQ ID NO: 8236823 - DNA, 22 bp, Homo sapiens
gcagctccttcaatctcaccat

SEQ ID NO: 8236824 - DNA, 22 bp, Homo sapiens
gcagctcctggcacagtttttt

SEQ ID NO: 8236825 - DNA, 22 bp, Homo sapiens
gcagctcctcctgggctggaga

SEQ ID NO: 8236826 - DNA, 22 bp, Homo sapiens
gcagctcccttgaacttctcct

SEQ ID NO: 8236827 - DNA, 22 bp, Homo sapiens
gcagctattgtctcctgggccc

SEQ ID NO: 8236828 - DNA, 22 bp, Homo sapiens
gcagctcacacagcaagttttg

SEQ ID NO: 8236829 - DNA, 22 bp, Homo sapiens
gcagctcacagtctccgccatc

SEQ ID NO: 8236830 - DNA, 22 bp, Homo sapiens
gcaggagccaggccgagctggt

SEQ ID NO: 8236831 - DNA, 22 bp, Homo sapiens
gcaggagccaggccgagctggt

SEQ ID NO: 8236832 - DNA, 22 bp, Homo sapiens
gcaggagccctggcatgttctt

SEQ ID NO: 8236833 - DNA, 22 bp, Homo sapiens
gcaggagccaggccgagctggt

SEQ ID NO: 8236834 - DNA, 22 bp, Homo sapiens
gcaggagccaggccgagctggt

SEQ ID NO: 8236835 - DNA, 22 bp, Homo sapiens
gcaggagctcgtttccaggctg

SEQ ID NO: 8236836 - DNA, 22 bp, Homo sapiens
gcaggagccctggcatgttctt

SEQ ID NO: 8236837 - DNA, 22 bp, Homo sapiens
gcaggagctcgtttccaggctg

SEQ ID NO: 8236838 - DNA, 22 bp, Homo sapiens
gcaggagctcgtttccaggctg

SEQ ID NO: 8236839 - DNA, 22 bp, Homo sapiens
gcaggagctgctctcctgacga

SEQ ID NO: 8236840 - DNA, 22 bp, Homo sapiens
gcaggagctcgtttccaggctg

SEQ ID NO: 8236841 - DNA, 22 bp, Homo sapiens
gcaggagctgctctcctgacga

SEQ ID NO: 8236842 - DNA, 22 bp, Homo sapiens
gcaggagctgctctcctgacga

SEQ ID NO: 8236843 - DNA, 22 bp, Homo sapiens
gcaggagttaggcgtcgtggat

SEQ ID NO: 8236844 - DNA, 22 bp, Homo sapiens
gcaggagttagggtaaaaatga

SEQ ID NO: 8236845 - DNA, 22 bp, Homo sapiens
gcaggcacatgggcgggtctgg

SEQ ID NO: 8236846 - DNA, 22 bp, Homo sapiens
gcaggcacatgggcgggtctgg

SEQ ID NO: 8236847 - DNA, 22 bp, Homo sapiens
gcaggcaccacggctcaggtct

SEQ ID NO: 8236848 - DNA, 19 bp, Homo sapiens
gcaggcacagccctgggtg

SEQ ID NO: 8236849 - DNA, 19 bp, Homo sapiens
gcaggcacagccctgggtg

SEQ ID NO: 8236850 - DNA, 19 bp, Homo sapiens
gcaggcacagccctgggtg

SEQ ID NO: 8236851 - DNA, 19 bp, Homo sapiens
gcaggcacagccctgggtg

SEQ ID NO: 8236852 - DNA, 22 bp, Homo sapiens
gcaggcaattttggaaggtcag

SEQ ID NO: 8236853 - DNA, 19 bp, Homo sapiens
gcaggcacagccctgggtg

SEQ ID NO: 8236854 - DNA, 23 bp, Homo sapiens
gcaggagttcctggactccagga

SEQ ID NO: 8236855 - DNA, 22 bp, Homo sapiens
gcaggagttcaattgcccatga

SEQ ID NO: 8236856 - DNA, 23 bp, Homo sapiens
gcaggagttcctggactccagga

SEQ ID NO: 8236857 - DNA, 22 bp, Homo sapiens
gcaggagttagggtaaaaatga

SEQ ID NO: 8236858 - DNA, 22 bp, Homo sapiens
gcaggagttcaattgcccatga

SEQ ID NO: 8236859 - DNA, 22 bp, Homo sapiens
gcaggagttcaattgcccatga

SEQ ID NO: 8236860 - DNA, 22 bp, Homo sapiens
gcaggcaccgcggcggcaggtt

SEQ ID NO: 8236861 - DNA, 22 bp, Homo sapiens
gcaggcaccgcggcggcaggtt

SEQ ID NO: 8236862 - DNA, 22 bp, Homo sapiens
gcaggcaccacggctcaggtct

SEQ ID NO: 8236863 - DNA, 22 bp, Homo sapiens
gcaggcaccgcggcggcaggtt

SEQ ID NO: 8236864 - DNA, 22 bp, Homo sapiens
gcaggcaccacggctcaggtct

SEQ ID NO: 8236865 - DNA, 22 bp, Homo sapiens
gcaggcacctcgtggagtggaa

SEQ ID NO: 8236866 - DNA, 22 bp, Homo sapiens
gcaggcactcctaggaccatca

SEQ ID NO: 8236867 - DNA, 22 bp, Homo sapiens
gcaggcacctcgtggagtggaa

SEQ ID NO: 8236868 - DNA, 22 bp, Homo sapiens
gcaggcaccgggttgctcccct

SEQ ID NO: 8236869 - DNA, 22 bp, Homo sapiens
gcaggcaccgggttgctcccct

SEQ ID NO: 8236870 - DNA, 22 bp, Homo sapiens
gcaggagacaactgtaaggaga

SEQ ID NO: 8236871 - DNA, 22 bp, Homo sapiens
gcaggagactggctgtggtagt

SEQ ID NO: 8236872 - DNA, 22 bp, Homo sapiens
gcaggagacaactgtaaggaga

SEQ ID NO: 8236873 - DNA, 22 bp, Homo sapiens
gcaggagacaactgtaaggaga

SEQ ID NO: 8236874 - DNA, 22 bp, Homo sapiens
gcaggagagccagcaggcttcc

SEQ ID NO: 8236875 - DNA, 22 bp, Homo sapiens
gcaggagactggctgtggtagt

SEQ ID NO: 8236876 - DNA, 22 bp, Homo sapiens
gcaggagactggctgtggtagt

SEQ ID NO: 8236877 - DNA, 22 bp, Homo sapiens
gcaggagagccagcaggcttcc

SEQ ID NO: 8236878 - DNA, 22 bp, Homo sapiens
gcaggagaaatgaagattgggt

SEQ ID NO: 8236879 - DNA, 22 bp, Homo sapiens
gcaggagaaatgaagattgggt

SEQ ID NO: 8236880 - DNA, 22 bp, Homo sapiens
gcaggagaacaaagcaagctgc

SEQ ID NO: 8236881 - DNA, 22 bp, Homo sapiens
gcaggagaaatgaagattgggt

SEQ ID NO: 8236882 - DNA, 22 bp, Homo sapiens
gcaggagaaatgaagattgggt

SEQ ID NO: 8236883 - DNA, 22 bp, Homo sapiens
gcaggactttgtggatgatgga

SEQ ID NO: 8236884 - DNA, 22 bp, Homo sapiens
gcaggagaaatgaagattgggt

SEQ ID NO: 8236885 - DNA, 22 bp, Homo sapiens
gcagctgagagaagaacagggc

SEQ ID NO: 8236886 - DNA, 22 bp, Homo sapiens
gcagctgacatctggctgggcc

SEQ ID NO: 8236887 - DNA, 22 bp, Homo sapiens
gcagctgagagaagaacagggc

SEQ ID NO: 8236888 - DNA, 22 bp, Homo sapiens
gcaggacagacccaagcagtct

SEQ ID NO: 8236889 - DNA, 22 bp, Homo sapiens
gcaggacagacccaagcagtct

SEQ ID NO: 8236890 - DNA, 22 bp, Homo sapiens
gcaggacagacccaagcagtct

SEQ ID NO: 8236891 - DNA, 22 bp, Homo sapiens
gcaggacaggcgttggtccagt

SEQ ID NO: 8236892 - DNA, 22 bp, Homo sapiens
gcaggacctctggatgcaatgc

SEQ ID NO: 8236893 - DNA, 22 bp, Homo sapiens
gcaggacctggcagatggggca

SEQ ID NO: 8236894 - DNA, 22 bp, Homo sapiens
gcaggactcaaatctgaaggca

SEQ ID NO: 8236895 - DNA, 22 bp, Homo sapiens
gcaggacttgaatccaggcagt

SEQ ID NO: 8236896 - DNA, 22 bp, Homo sapiens
gcaggacttgaatccaggcagt

SEQ ID NO: 8236897 - DNA, 22 bp, Homo sapiens
gcaggacttgaatccaggcagt

SEQ ID NO: 8236898 - DNA, 19 bp, Homo sapiens
gcaggactcccagctcctc

SEQ ID NO: 8236899 - DNA, 22 bp, Homo sapiens
gcaggacttgaatccaggcagt

SEQ ID NO: 8236900 - DNA, 19 bp, Homo sapiens
gcaggactcccagctcctc

SEQ ID NO: 8236901 - DNA, 22 bp, Homo sapiens
gcaggacattcagtgaatgggc

SEQ ID NO: 8236902 - DNA, 22 bp, Homo sapiens
gcaggacaggcgttggtccagt

SEQ ID NO: 8236903 - DNA, 22 bp, Homo sapiens
gcagtgggagcttaggcagtgc

SEQ ID NO: 8236904 - DNA, 22 bp, Homo sapiens
gcagtatatccattacttcata

SEQ ID NO: 8236905 - DNA, 22 bp, Homo sapiens
gcagtgggcaacaagagctgga

SEQ ID NO: 8236906 - DNA, 22 bp, Homo sapiens
gcagtataagtggattatgtcc

SEQ ID NO: 8236907 - DNA, 22 bp, Homo sapiens
gcagtagtgtcagtacagcaaa

SEQ ID NO: 8236908 - DNA, 18 bp, Homo sapiens
gcagtaggcgcgcaggac

SEQ ID NO: 8236909 - DNA, 22 bp, Homo sapiens
gcagtaggagtttccagggtgg

SEQ ID NO: 8236910 - DNA, 22 bp, Homo sapiens
gcagtaggggctggagggctgt

SEQ ID NO: 8236911 - DNA, 22 bp, Homo sapiens
gcagtagcagtatccagaagca

SEQ ID NO: 8236912 - DNA, 22 bp, Homo sapiens
gcagtagcagcctagatgccat

SEQ ID NO: 8236913 - DNA, 22 bp, Homo sapiens
gcagtaggagaagaggatgctt

SEQ ID NO: 8236914 - DNA, 22 bp, Homo sapiens
gcagtacacacatatgtattcg

SEQ ID NO: 8236915 - DNA, 22 bp, Homo sapiens
gcaggtgtgaatgtgaattaag

SEQ ID NO: 8236916 - DNA, 22 bp, Homo sapiens
gcagtagaactgtcatgatgtt

SEQ ID NO: 8236917 - DNA, 22 bp, Homo sapiens
gcagtagaaatttcattgctct

SEQ ID NO: 8236918 - DNA, 22 bp, Homo sapiens
gcaggtgtcctgggctggcagt

SEQ ID NO: 8236919 - DNA, 22 bp, Homo sapiens
gcaggtgtcagtccccaaggtg

SEQ ID NO: 8236920 - DNA, 22 bp, Homo sapiens
gcaggtgtctgactgccttctt

SEQ ID NO: 8236921 - DNA, 22 bp, Homo sapiens
gcaggtgtcagtccccaaggtg

SEQ ID NO: 8236922 - DNA, 22 bp, Homo sapiens
gcaggtgtcctgggctggcagt

SEQ ID NO: 8236923 - DNA, 22 bp, Homo sapiens
gcaggtgtcttcagcaggatga

SEQ ID NO: 8236924 - DNA, 22 bp, Homo sapiens
gcaggtgtctgactgccttctt

SEQ ID NO: 8236925 - DNA, 22 bp, Homo sapiens
gcaggtgtcctgggctggcagt

SEQ ID NO: 8236926 - DNA, 22 bp, Homo sapiens
gcaggtgtgaatgtgaattaag

SEQ ID NO: 8236927 - DNA, 22 bp, Homo sapiens
gcaggtgtgctgaattacgtga

SEQ ID NO: 8236928 - DNA, 22 bp, Homo sapiens
gcaggtgtgaatgtgaattaag

SEQ ID NO: 8236929 - DNA, 22 bp, Homo sapiens
gcaggtgtcttcatggaactct

SEQ ID NO: 8236930 - DNA, 22 bp, Homo sapiens
gcaggtgtcttcatggaactct

SEQ ID NO: 8236931 - DNA, 19 bp, Homo sapiens
gcaggtgtgaatccgtaga

SEQ ID NO: 8236932 - DNA, 22 bp, Homo sapiens
gcaggtgtcttcatggaactct

SEQ ID NO: 8236933 - DNA, 22 bp, Homo sapiens
gcaggtgtcttcagcaggatga

SEQ ID NO: 8236934 - DNA, 22 bp, Homo sapiens
gcaggtgtcttcagcaggatga

SEQ ID NO: 8236935 - DNA, 19 bp, Homo sapiens
gcaggtgtgaatccgtaga

SEQ ID NO: 8236936 - DNA, 22 bp, Homo sapiens
gcaggtgtcttcatggaactct

SEQ ID NO: 8236937 - DNA, 22 bp, Homo sapiens
gcagtgtccagggtggtctgca

SEQ ID NO: 8236938 - DNA, 22 bp, Homo sapiens
gcagtgtccagggtggtctgca

SEQ ID NO: 8236939 - DNA, 21 bp, Homo sapiens
gcagtgtcatggtttcaagtt

SEQ ID NO: 8236940 - DNA, 22 bp, Homo sapiens
gcagtgtctttgacctccaccc

SEQ ID NO: 8236941 - DNA, 22 bp, Homo sapiens
gcagtgttaggaataaaaatga

SEQ ID NO: 8236942 - DNA, 19 bp, Homo sapiens
gcagtgtcatggtaggagc

SEQ ID NO: 8236943 - DNA, 22 bp, Homo sapiens
gcagtgtcagtgcctgggtggt

SEQ ID NO: 8236944 - DNA, 22 bp, Homo sapiens
gcagtgtcagtgcctgggtggt

SEQ ID NO: 8236945 - DNA, 22 bp, Homo sapiens
gcagtgttatgttttctataat

SEQ ID NO: 8236946 - DNA, 22 bp, Homo sapiens
gcagtgttccttctactggggc

SEQ ID NO: 8236947 - DNA, 22 bp, Homo sapiens
gcagtgttcagtgaagcaggag

SEQ ID NO: 8236948 - DNA, 22 bp, Homo sapiens
gcagtgttgactatggtatgag

SEQ ID NO: 8236949 - DNA, 22 bp, Homo sapiens
gcagtgttgagtggtggctgaa

SEQ ID NO: 8236950 - DNA, 22 bp, Homo sapiens
gcagtgttgagccagctggggg

SEQ ID NO: 8236951 - DNA, 22 bp, Homo sapiens
gcagtgttcttgttgcttttat

SEQ ID NO: 8236952 - DNA, 22 bp, Homo sapiens
gcagtgttctaaattgggtgtg

SEQ ID NO: 8236953 - DNA, 22 bp, Homo sapiens
gcagtggggaatgctggggaga

SEQ ID NO: 8236954 - DNA, 22 bp, Homo sapiens
gcagtggggaatgctggggaga

SEQ ID NO: 8236955 - DNA, 22 bp, Homo sapiens
gcagtggggcaatcatagctca

SEQ ID NO: 8236956 - DNA, 22 bp, Homo sapiens
gcagtggggaatgctggggaga

SEQ ID NO: 8236957 - DNA, 22 bp, Homo sapiens
gcagtggggaatgctggggaga

SEQ ID NO: 8236958 - DNA, 22 bp, Homo sapiens
gcagtggtccagttcacaccca

SEQ ID NO: 8236959 - DNA, 22 bp, Homo sapiens
gcagtggggcgctgggagttgg

SEQ ID NO: 8236960 - DNA, 22 bp, Homo sapiens
gcagtggggcgctgggagttgg

SEQ ID NO: 8236961 - DNA, 22 bp, Homo sapiens
gcagtgggcaacaagagctgga

SEQ ID NO: 8236962 - DNA, 22 bp, Homo sapiens
gcagtgggcaacaagagctgga

SEQ ID NO: 8236963 - DNA, 22 bp, Homo sapiens
gcagtgggcctgaggaagggtg

SEQ ID NO: 8236964 - DNA, 22 bp, Homo sapiens
gcagggtggatggcagggccag

SEQ ID NO: 8236965 - DNA, 22 bp, Homo sapiens
gcagggtggatggcagggccag

SEQ ID NO: 8236966 - DNA, 22 bp, Homo sapiens
gcaggtggaagcagcagactca

SEQ ID NO: 8236967 - DNA, 22 bp, Homo sapiens
gcaggtggaagcagcagactca

SEQ ID NO: 8236968 - DNA, 19 bp, Homo sapiens
gcagggtggcagagctctt

SEQ ID NO: 8236969 - DNA, 19 bp, Homo sapiens
gcagggtggcagagctctt

SEQ ID NO: 8236970 - DNA, 19 bp, Homo sapiens
gcagggtggcagagctctt

SEQ ID NO: 8236971 - DNA, 22 bp, Homo sapiens
gcagggtgccgacttcagggat

SEQ ID NO: 8236972 - DNA, 22 bp, Homo sapiens
gcagggtgacgttgcccacctc

SEQ ID NO: 8236973 - DNA, 22 bp, Homo sapiens
gcagggtgacgttgcccacctc

SEQ ID NO: 8236974 - DNA, 22 bp, Homo sapiens
gcagggtgatagtgaggctcag

SEQ ID NO: 8236975 - DNA, 22 bp, Homo sapiens
gcagggtgatagtgaggctcag

SEQ ID NO: 8236976 - DNA, 22 bp, Homo sapiens
gcagggtgatagtgaggctcag

SEQ ID NO: 8236977 - DNA, 22 bp, Homo sapiens
gcaggtggcagaggtgggatct

SEQ ID NO: 8236978 - DNA, 22 bp, Homo sapiens
gcaggtggattatcagaagtgc

SEQ ID NO: 8236979 - DNA, 22 bp, Homo sapiens
gcaggtggcagaggtgggatct

SEQ ID NO: 8236980 - DNA, 22 bp, Homo sapiens
gcaggtgggagccgctgcctga

SEQ ID NO: 8236981 - DNA, 22 bp, Homo sapiens
gcaggtgggagccgctgcctga

SEQ ID NO: 8236982 - DNA, 22 bp, Homo sapiens
gcaggtgggagccgctgcctga

SEQ ID NO: 8236983 - DNA, 22 bp, Homo sapiens
gcaggtggcagaggtgggatct

SEQ ID NO: 8236984 - DNA, 22 bp, Homo sapiens
gcaggtggcagaggtgggatct

SEQ ID NO: 8236985 - DNA, 22 bp, Homo sapiens
gcaggtggagcagtagtctggt

SEQ ID NO: 8236986 - DNA, 22 bp, Homo sapiens
gcaggtggagcagtagtctggt

SEQ ID NO: 8236987 - DNA, 22 bp, Homo sapiens
gcaggtggagcagtagtctggt

SEQ ID NO: 8236988 - DNA, 19 bp, Homo sapiens
gcaggtggatgtggtcagc

SEQ ID NO: 8236989 - DNA, 19 bp, Homo sapiens
gcaggtggatgtggtcagc

SEQ ID NO: 8236990 - DNA, 22 bp, Homo sapiens
gcaggtggagcagtagtctggt

SEQ ID NO: 8236991 - DNA, 22 bp, Homo sapiens
gcaggtggagcagtagtctggt

SEQ ID NO: 8236992 - DNA, 22 bp, Homo sapiens
gcaggtggaagcagcagactca

SEQ ID NO: 8236993 - DNA, 22 bp, Homo sapiens
gcaggtggattatcagaagtgc

SEQ ID NO: 8236994 - DNA, 22 bp, Homo sapiens
gcaggtggattatcagaagtgc

SEQ ID NO: 8236995 - DNA, 19 bp, Homo sapiens
gcaggtggatgtggtcagc

SEQ ID NO: 8236996 - DNA, 22 bp, Homo sapiens
gcaggtggttaaggtcccatgt

SEQ ID NO: 8236997 - DNA, 23 bp, Homo sapiens
gcaggtggttcgaacagaagttt

SEQ ID NO: 8236998 - DNA, 23 bp, Homo sapiens
gcaggtggttcgaacagaagttt

SEQ ID NO: 8236999 - DNA, 23 bp, Homo sapiens
gcaggtggttcgaacagaagttt

SEQ ID NO: 8237000 - DNA, 22 bp, Homo sapiens
gcaggtggttaaggtcccatgt

SEQ ID NO: 8237001 - DNA, 22 bp, Homo sapiens
gcaggtggttaaggtcccatgt

SEQ ID NO: 8237002 - DNA, 22 bp, Homo sapiens
gcaggtggttaaggtcccatgt

SEQ ID NO: 8237003 - DNA, 22 bp, Homo sapiens
gcaggtggtgggggagccgttc

SEQ ID NO: 8237004 - DNA, 22 bp, Homo sapiens
gcaggtggtgggggagccgttc

SEQ ID NO: 8237005 - DNA, 22 bp, Homo sapiens
gcaggtggtccccgtggagtgg

SEQ ID NO: 8237006 - DNA, 22 bp, Homo sapiens
gcaggtggtccccgtggagtgg

SEQ ID NO: 8237007 - DNA, 22 bp, Homo sapiens
gcaggtggtggcgcgcgccctg

SEQ ID NO: 8237008 - DNA, 22 bp, Homo sapiens
gcaggtggtggggctatgatct

SEQ ID NO: 8237009 - DNA, 22 bp, Homo sapiens
gcaggtggtggcgcgcgccctg

SEQ ID NO: 8237010 - DNA, 22 bp, Homo sapiens
gcaggtggtggcgcgcgccctg

SEQ ID NO: 8237011 - DNA, 22 bp, Homo sapiens
gcaggtggtggcgcgcgccctg

SEQ ID NO: 8237012 - DNA, 22 bp, Homo sapiens
gcaggtggtggggctatgatct

SEQ ID NO: 8237013 - DNA, 22 bp, Homo sapiens
gcaggtggtgggggagccgttc

SEQ ID NO: 8237014 - DNA, 22 bp, Homo sapiens
gcaggtggtgggggagccgttc

SEQ ID NO: 8237015 - DNA, 22 bp, Homo sapiens
gcaggtgggggagaagttgtga

SEQ ID NO: 8237016 - DNA, 22 bp, Homo sapiens
gcaggtgggggagaagttgtga

SEQ ID NO: 8237017 - DNA, 22 bp, Homo sapiens
gcaggtgggggagaagttgtga

SEQ ID NO: 8237018 - DNA, 22 bp, Homo sapiens
gcaggtggggctgctaccagaa

SEQ ID NO: 8237019 - DNA, 22 bp, Homo sapiens
gcaggtggggctgctaccagaa

SEQ ID NO: 8237020 - DNA, 22 bp, Homo sapiens
gcaggtggggctgctaccagaa

SEQ ID NO: 8237021 - DNA, 22 bp, Homo sapiens
gcaggtggggctgctaccagaa

SEQ ID NO: 8237022 - DNA, 22 bp, Homo sapiens
gcaggtgggagccgctgcctga

SEQ ID NO: 8237023 - DNA, 22 bp, Homo sapiens
gcaggtgggagccgctgcctga

SEQ ID NO: 8237024 - DNA, 16 bp, Homo sapiens
gcaggtggggcgcgca

SEQ ID NO: 8237025 - DNA, 16 bp, Homo sapiens
gcaggtggggcgcgca

SEQ ID NO: 8237026 - DNA, 22 bp, Homo sapiens
gcaggtggggctgctaccagaa

SEQ ID NO: 8237027 - DNA, 22 bp, Homo sapiens
gcaggtggggctgctaccagaa

SEQ ID NO: 8237028 - DNA, 22 bp, Homo sapiens
gcaggtgggggtcggtgcatct

SEQ ID NO: 8237029 - DNA, 22 bp, Homo sapiens
gcaggtgggggtcggtgcatct

SEQ ID NO: 8237030 - DNA, 22 bp, Homo sapiens
gcaggtgggggtcggtgcatct

SEQ ID NO: 8237031 - DNA, 22 bp, Homo sapiens
gcaggtgggggtcggtgcatct

SEQ ID NO: 8237032 - DNA, 22 bp, Homo sapiens
gcaggtgggggtcggtgcatct

SEQ ID NO: 8237033 - DNA, 22 bp, Homo sapiens
gcaggtgggggtcggtgcatct

SEQ ID NO: 8237034 - DNA, 22 bp, Homo sapiens
gcaggtggtcactcatccccag

SEQ ID NO: 8237035 - DNA, 22 bp, Homo sapiens
gcaggtggtcactcatccccag

SEQ ID NO: 8237036 - DNA, 22 bp, Homo sapiens
gcaggtggtccccgtggagtgg

SEQ ID NO: 8237037 - DNA, 22 bp, Homo sapiens
gcaggtgggggtcggtgcatct

SEQ ID NO: 8237038 - DNA, 22 bp, Homo sapiens
gccagatttacagatttgccct

SEQ ID NO: 8237039 - DNA, 22 bp, Homo sapiens
gccagatgtagatagcaaggta

SEQ ID NO: 8237040 - DNA, 22 bp, Homo sapiens
gccagatgccgtaaagatgggc

SEQ ID NO: 8237041 - DNA, 22 bp, Homo sapiens
gccagatgtagatagcaaggta

SEQ ID NO: 8237042 - DNA, 22 bp, Homo sapiens
gccagatgccgtaaagatgggc

SEQ ID NO: 8237043 - DNA, 22 bp, Homo sapiens
gccagatgtagatagcaaggta

SEQ ID NO: 8237044 - DNA, 22 bp, Homo sapiens
gccagaggctcaggttgccatg

SEQ ID NO: 8237045 - DNA, 20 bp, Homo sapiens
gccagaggccggcaggggct

SEQ ID NO: 8237046 - DNA, 22 bp, Homo sapiens
gccacaggctccagcatcagta

SEQ ID NO: 8237047 - DNA, 22 bp, Homo sapiens
gccacaggctccagcatcagta

SEQ ID NO: 8237048 - DNA, 22 bp, Homo sapiens
gccacaggcacttaagggctgg

SEQ ID NO: 8237049 - DNA, 22 bp, Homo sapiens
gccacagcttagatcacagcct

SEQ ID NO: 8237050 - DNA, 22 bp, Homo sapiens
gccacagcttagatcacagcct

SEQ ID NO: 8237051 - DNA, 22 bp, Homo sapiens
gccacagcttagatcacagcct

SEQ ID NO: 8237052 - DNA, 22 bp, Homo sapiens
gccacagctccagtcaggtgac

SEQ ID NO: 8237053 - DNA, 22 bp, Homo sapiens
gccacagcggggccgctagagc

SEQ ID NO: 8237054 - DNA, 22 bp, Homo sapiens
gccacagctcacgttccccatt

SEQ ID NO: 8237055 - DNA, 22 bp, Homo sapiens
gccacagcttttaacctcgggg

SEQ ID NO: 8237056 - DNA, 22 bp, Homo sapiens
gccacagcttagatcacagcct

SEQ ID NO: 8237057 - DNA, 22 bp, Homo sapiens
gccacaggaaagcaccctggag

SEQ ID NO: 8237058 - DNA, 22 bp, Homo sapiens
gccacagcttttaacctcgggg

SEQ ID NO: 8237059 - DNA, 22 bp, Homo sapiens
gccacaggcacttaagggctgg

SEQ ID NO: 8237060 - DNA, 22 bp, Homo sapiens
gccacaggcacttaagggctgg

SEQ ID NO: 8237061 - DNA, 22 bp, Homo sapiens
gccacaggaaagcaccctggag

SEQ ID NO: 8237062 - DNA, 22 bp, Homo sapiens
gccagcagcccagaaggacttt

SEQ ID NO: 8237063 - DNA, 22 bp, Homo sapiens
gccagcagcccagaaggacttt

SEQ ID NO: 8237064 - DNA, 22 bp, Homo sapiens
gccagcagcccagaaggacttt

SEQ ID NO: 8237065 - DNA, 22 bp, Homo sapiens
gccagcagcccagaaggacttt

SEQ ID NO: 8237066 - DNA, 22 bp, Homo sapiens
gccagcagctcttgggcgggca

SEQ ID NO: 8237067 - DNA, 22 bp, Homo sapiens
gccagcagctgtggggtggcca

SEQ ID NO: 8237068 - DNA, 22 bp, Homo sapiens
gccagcagggaagccttgggct

SEQ ID NO: 8237069 - DNA, 22 bp, Homo sapiens
gccagcagcttcttctcatcct

SEQ ID NO: 8237070 - DNA, 22 bp, Homo sapiens
gccagcagctgtggggtggcca

SEQ ID NO: 8237071 - DNA, 22 bp, Homo sapiens
gccagcagccacagaagtcact

SEQ ID NO: 8237072 - DNA, 22 bp, Homo sapiens
gccagcagccacagaagtcact

SEQ ID NO: 8237073 - DNA, 19 bp, Homo sapiens
gccagcagaatgatgaggc

SEQ ID NO: 8237074 - DNA, 19 bp, Homo sapiens
gccagcagaatgatgaggc

SEQ ID NO: 8237075 - DNA, 22 bp, Homo sapiens
gccagcaccttctcatatgttt

SEQ ID NO: 8237076 - DNA, 19 bp, Homo sapiens
gccagcacatgtcttctag

SEQ ID NO: 8237077 - DNA, 20 bp, Homo sapiens
gccagcacagggagcagttc

SEQ ID NO: 8237078 - DNA, 22 bp, Homo sapiens
gccagcaagtatcaccaaagcc

SEQ ID NO: 8237079 - DNA, 22 bp, Homo sapiens
gccagcaccagctactagtcac

SEQ ID NO: 8237080 - DNA, 19 bp, Homo sapiens
gccagcacccagctgtgtc

SEQ ID NO: 8237081 - DNA, 22 bp, Homo sapiens
gccagcaccttagcatgaatca

SEQ ID NO: 8237082 - DNA, 19 bp, Homo sapiens
gccagcacccagctgtgtc

SEQ ID NO: 8237083 - DNA, 19 bp, Homo sapiens
gccagcacccagctgtgtc

SEQ ID NO: 8237084 - DNA, 22 bp, Homo sapiens
gccacagcccgagcaccatgag

SEQ ID NO: 8237085 - DNA, 22 bp, Homo sapiens
gccacagcccgagcaccatgag

SEQ ID NO: 8237086 - DNA, 22 bp, Homo sapiens
gccacagcccgagcaccatgag

SEQ ID NO: 8237087 - DNA, 22 bp, Homo sapiens
gccacagccgaacccttgggcc

SEQ ID NO: 8237088 - DNA, 22 bp, Homo sapiens
gccacactgcttctttgagcct

SEQ ID NO: 8237089 - DNA, 22 bp, Homo sapiens
gccacagcaacaataatgcagc

SEQ ID NO: 8237090 - DNA, 22 bp, Homo sapiens
gccacagcagggccctctcagg

SEQ ID NO: 8237091 - DNA, 22 bp, Homo sapiens
gccacacttattctcatgcaca

SEQ ID NO: 8237092 - DNA, 22 bp, Homo sapiens
gccacagacagagagtctagtg

SEQ ID NO: 8237093 - DNA, 22 bp, Homo sapiens
gcatgtgttattttatgtatga

SEQ ID NO: 8237094 - DNA, 22 bp, Homo sapiens
gcatgtgttcttgaaaggccac

SEQ ID NO: 8237095 - DNA, 22 bp, Homo sapiens
gcatgtgttattttatgtatga

SEQ ID NO: 8237096 - DNA, 22 bp, Homo sapiens
gcatgtgttggtttatgcatgt

SEQ ID NO: 8237097 - DNA, 22 bp, Homo sapiens
gcatgtttcttaagattgcatt

SEQ ID NO: 8237098 - DNA, 22 bp, Homo sapiens
gcatgtgttagagtgtgcatgc

SEQ ID NO: 8237099 - DNA, 22 bp, Homo sapiens
gcatgtgttagagtgtgcatgc

SEQ ID NO: 8237100 - DNA, 22 bp, Homo sapiens
gcatgtgttatttctctgtggg

SEQ ID NO: 8237101 - DNA, 22 bp, Homo sapiens
gcatgtgttatttctctgtggg

SEQ ID NO: 8237102 - DNA, 22 bp, Homo sapiens
gcatgtgttattttatgtatga

SEQ ID NO: 8237103 - DNA, 22 bp, Homo sapiens
gccaataactgccatttgcttt

SEQ ID NO: 8237104 - DNA, 22 bp, Homo sapiens
gccaataactggttccaaattt

SEQ ID NO: 8237105 - DNA, 22 bp, Homo sapiens
gccaataaatggaaaagatgga

SEQ ID NO: 8237106 - DNA, 22 bp, Homo sapiens
gccaataacctaagatgggtag

SEQ ID NO: 8237107 - DNA, 20 bp, Homo sapiens
gccaataaactgttagcagg

SEQ ID NO: 8237108 - DNA, 21 bp, Homo sapiens
gcattaaaagcagttgttggt

SEQ ID NO: 8237109 - DNA, 22 bp, Homo sapiens
gccaatggctcatgagcaggac

SEQ ID NO: 8237110 - DNA, 22 bp, Homo sapiens
gcatgggcaagaggactggggg

SEQ ID NO: 8237111 - DNA, 22 bp, Homo sapiens
gcatgggcaagaggactggggg

SEQ ID NO: 8237112 - DNA, 22 bp, Homo sapiens
gcatgggcaccagtctctaggt

SEQ ID NO: 8237113 - DNA, 22 bp, Homo sapiens
gcatgggcaagaggactggggg

SEQ ID NO: 8237114 - DNA, 22 bp, Homo sapiens
gcatggcttctgccaggcacct

SEQ ID NO: 8237115 - DNA, 22 bp, Homo sapiens
gcatggcttctgccaggcacct

SEQ ID NO: 8237116 - DNA, 22 bp, Homo sapiens
gcatggcttctgccaggcacct

SEQ ID NO: 8237117 - DNA, 22 bp, Homo sapiens
gcagtgttgctaggtgcggtga

SEQ ID NO: 8237118 - DNA, 22 bp, Homo sapiens
gcatggcttctgccaggcacct

SEQ ID NO: 8237119 - DNA, 22 bp, Homo sapiens
gcatggtggccttagggtagcc

SEQ ID NO: 8237120 - DNA, 22 bp, Homo sapiens
gcatggtggagtctgagcaggg

SEQ ID NO: 8237121 - DNA, 22 bp, Homo sapiens
gcatggtgacatcatgtgaatg

SEQ ID NO: 8237122 - DNA, 22 bp, Homo sapiens
gcatggtgacatcatgtgaatg

SEQ ID NO: 8237123 - DNA, 22 bp, Homo sapiens
gcatgggctttctcagagttct

SEQ ID NO: 8237124 - DNA, 22 bp, Homo sapiens
gcatggtggagtctgagcaggg

SEQ ID NO: 8237125 - DNA, 22 bp, Homo sapiens
gcatgtggaatctctccatggt

SEQ ID NO: 8237126 - DNA, 22 bp, Homo sapiens
gcatggttagacatcaatgtga

SEQ ID NO: 8237127 - DNA, 22 bp, Homo sapiens
gcatggtggggagatggcagcc

SEQ ID NO: 8237128 - DNA, 15 bp, Homo sapiens
gcatgtgtaataggc

SEQ ID NO: 8237129 - DNA, 22 bp, Homo sapiens
gcatgtgtatggtaggaatatt

SEQ ID NO: 8237130 - DNA, 20 bp, Homo sapiens
gcatgtgtatggaaggggga

SEQ ID NO: 8237131 - DNA, 22 bp, Homo sapiens
gcatgtgtcatctgcctttcgt

SEQ ID NO: 8237132 - DNA, 22 bp, Homo sapiens
gcatgtgtggaggagatgtgct

SEQ ID NO: 8237133 - DNA, 22 bp, Homo sapiens
gcatgtgtggaggagatgtgct

SEQ ID NO: 8237134 - DNA, 22 bp, Homo sapiens
gcatgtgtctttatagcagcat

SEQ ID NO: 8237135 - DNA, 22 bp, Homo sapiens
gcatgtgtgtcactttcctgcc

SEQ ID NO: 8237136 - DNA, 21 bp, Homo sapiens
gcatgtgtggtgtgctccaca

SEQ ID NO: 8237137 - DNA, 21 bp, Homo sapiens
gcatgtgtgggactggatcct

SEQ ID NO: 8237138 - DNA, 22 bp, Homo sapiens
gcatgtgtggaggagatgtgct

SEQ ID NO: 8237139 - DNA, 22 bp, Homo sapiens
gcatgtgtctccccagtggagg

SEQ ID NO: 8237140 - DNA, 22 bp, Homo sapiens
gcatgtgtctccccagtggagg

SEQ ID NO: 8237141 - DNA, 22 bp, Homo sapiens
gcatgtgtccctcagtctgtgc

SEQ ID NO: 8237142 - DNA, 22 bp, Homo sapiens
gcatgtgtgagaccttttagca

SEQ ID NO: 8237143 - DNA, 22 bp, Homo sapiens
gcatgtgtctttatagcagcat

SEQ ID NO: 8237144 - DNA, 22 bp, Homo sapiens
gcatgtgtctccccagtggagg

SEQ ID NO: 8237145 - DNA, 22 bp, Homo sapiens
gctgaactacatgaagttgccg

SEQ ID NO: 8237146 - DNA, 19 bp, Homo sapiens
gctgaacaagtcagcaacc

SEQ ID NO: 8237147 - DNA, 22 bp, Homo sapiens
gctgaaattggaacctgggcct

SEQ ID NO: 8237148 - DNA, 18 bp, Homo sapiens
gctgaaattctaaacaaa

SEQ ID NO: 8237149 - DNA, 22 bp, Homo sapiens
gctgaaattagactgcagaagt

SEQ ID NO: 8237150 - DNA, 22 bp, Homo sapiens
gctgaaattcagattcctaggc

SEQ ID NO: 8237151 - DNA, 22 bp, Homo sapiens
gctgaaattcagattcctaggc

SEQ ID NO: 8237152 - DNA, 22 bp, Homo sapiens
gctgaaatgtttaatttgggag

SEQ ID NO: 8237153 - DNA, 22 bp, Homo sapiens
gctgaaattagactgcagaagt

SEQ ID NO: 8237154 - DNA, 22 bp, Homo sapiens
gctgaaatgtctttagcagtgt

SEQ ID NO: 8237155 - DNA, 22 bp, Homo sapiens
gctgaaatgtctttagcagtgt

SEQ ID NO: 8237156 - DNA, 22 bp, Homo sapiens
gctcttggaagacaggatgtgt

SEQ ID NO: 8237157 - DNA, 22 bp, Homo sapiens
gctgaaatgccttgtaaatatt

SEQ ID NO: 8237158 - DNA, 22 bp, Homo sapiens
gctgaaatgggcactgaaggcc

SEQ ID NO: 8237159 - DNA, 22 bp, Homo sapiens
gctgaaatgggcactgaaggcc

SEQ ID NO: 8237160 - DNA, 22 bp, Homo sapiens
gctcttgaagtactgggtgttg

SEQ ID NO: 8237161 - DNA, 22 bp, Homo sapiens
gctcttgactcccagttctgtg

SEQ ID NO: 8237162 - DNA, 20 bp, Homo sapiens
gctgaagaagtagcatgtac

SEQ ID NO: 8237163 - DNA, 22 bp, Homo sapiens
gctgagagtgggtgcagtgctt

SEQ ID NO: 8237164 - DNA, 22 bp, Homo sapiens
gctgagagtgggtgcagtgctt

SEQ ID NO: 8237165 - DNA, 22 bp, Homo sapiens
gctgagcacacctagggtagag

SEQ ID NO: 8237166 - DNA, 22 bp, Homo sapiens
gctgagcacagcctgtgtcctc

SEQ ID NO: 8237167 - DNA, 22 bp, Homo sapiens
gctgagagtgtgagatcagatt

SEQ ID NO: 8237168 - DNA, 22 bp, Homo sapiens
gctgagatgtcgttagatatct

SEQ ID NO: 8237169 - DNA, 22 bp, Homo sapiens
gctgagattacgggcatgagcc

SEQ ID NO: 8237170 - DNA, 22 bp, Homo sapiens
gctgagcaacgtggagagtttt

SEQ ID NO: 8237171 - DNA, 22 bp, Homo sapiens
gctctgtgttccctccaggctc

SEQ ID NO: 8237172 - DNA, 22 bp, Homo sapiens
gctctgtgttccctccaggctc

SEQ ID NO: 8237173 - DNA, 22 bp, Homo sapiens
gctctgcccaggaccgtccttg

SEQ ID NO: 8237174 - DNA, 22 bp, Homo sapiens
gctctgcccaggaccgtccttg

SEQ ID NO: 8237175 - DNA, 22 bp, Homo sapiens
gctctgcccaatgtccctacac

SEQ ID NO: 8237176 - DNA, 22 bp, Homo sapiens
gctctgccagcccaaggcgcag

SEQ ID NO: 8237177 - DNA, 17 bp, Homo sapiens
gctctgccaggaaagag

SEQ ID NO: 8237178 - DNA, 17 bp, Homo sapiens
gctctgccaggaaagag

SEQ ID NO: 8237179 - DNA, 20 bp, Homo sapiens
gctctgccacttagaagctg

SEQ ID NO: 8237180 - DNA, 21 bp, Homo sapiens
gctctgccacttaccagattt

SEQ ID NO: 8237181 - DNA, 22 bp, Homo sapiens
gctcttctcagattgtacactc

SEQ ID NO: 8237182 - DNA, 22 bp, Homo sapiens
gctcttctaaagaatgtacagg

SEQ ID NO: 8237183 - DNA, 22 bp, Homo sapiens
gctcttctcagattgtacactc

SEQ ID NO: 8237184 - DNA, 22 bp, Homo sapiens
gctcttgaaactggggtttcca

SEQ ID NO: 8237185 - DNA, 22 bp, Homo sapiens
gctcttatagtcccagcatgtt

SEQ ID NO: 8237186 - DNA, 22 bp, Homo sapiens
gctcttatattgacatcatgct

SEQ ID NO: 8237187 - DNA, 22 bp, Homo sapiens
gctctgtgttgtcagaggcacc

SEQ ID NO: 8237188 - DNA, 22 bp, Homo sapiens
gctctgtgttttgcccaggaga

SEQ ID NO: 8237189 - DNA, 22 bp, Homo sapiens
gctctgtgttgtcagaggcacc

SEQ ID NO: 8237190 - DNA, 22 bp, Homo sapiens
gctctgtgttcctctggattgc

SEQ ID NO: 8237191 - DNA, 22 bp, Homo sapiens
gctctgtgttgtcagaggcacc

SEQ ID NO: 8237192 - DNA, 22 bp, Homo sapiens
gctctgttgtctctgaattgca

SEQ ID NO: 8237193 - DNA, 22 bp, Homo sapiens
gctctgttgaagtagaatagac

SEQ ID NO: 8237194 - DNA, 22 bp, Homo sapiens
gctctgtttatccctgacaatt

SEQ ID NO: 8237195 - DNA, 22 bp, Homo sapiens
gctctgtgttttgcccaggaga

SEQ ID NO: 8237196 - DNA, 22 bp, Homo sapiens
gctctgccaaggacccattctc

SEQ ID NO: 8237197 - DNA, 22 bp, Homo sapiens
gctctgccaaggacccattctc

SEQ ID NO: 8237198 - DNA, 18 bp, Homo sapiens
gctctgcaggtgctcggt

SEQ ID NO: 8237199 - DNA, 18 bp, Homo sapiens
gctctgcaggtgctcggt

SEQ ID NO: 8237200 - DNA, 18 bp, Homo sapiens
gctctgcaggtgctcggt

SEQ ID NO: 8237201 - DNA, 18 bp, Homo sapiens
gctctgcagctgaggctt

SEQ ID NO: 8237202 - DNA, 18 bp, Homo sapiens
gctctgcagctgaggctt

SEQ ID NO: 8237203 - DNA, 22 bp, Homo sapiens
gctctgagtgcatgcttttggg

SEQ ID NO: 8237204 - DNA, 22 bp, Homo sapiens
gctctgagtgcatgcttttggg

SEQ ID NO: 8237205 - DNA, 18 bp, Homo sapiens
gctctgcagctgaggctt

SEQ ID NO: 8237206 - DNA, 18 bp, Homo sapiens
gctctgcagctgaggctt

SEQ ID NO: 8237207 - DNA, 23 bp, Homo sapiens
gctctgccacttaatagctgtgt

SEQ ID NO: 8237208 - DNA, 22 bp, Homo sapiens
gctctgccaaggacccattctc

SEQ ID NO: 8237209 - DNA, 21 bp, Homo sapiens
gctctgccacttaccagattt

SEQ ID NO: 8237210 - DNA, 22 bp, Homo sapiens
gctctgagtgatcagctgggaa

SEQ ID NO: 8237211 - DNA, 22 bp, Homo sapiens
gctctgagtgattaaggagctt

SEQ ID NO: 8237212 - DNA, 22 bp, Homo sapiens
gctctgagtgagactagattta

SEQ ID NO: 8237213 - DNA, 22 bp, Homo sapiens
gctctgagtgatcagctgggaa

SEQ ID NO: 8237214 - DNA, 22 bp, Homo sapiens
gctctgagctgtcttgcaggtc

SEQ ID NO: 8237215 - DNA, 23 bp, Homo sapiens
gctctgaggaagttgggcacggg

SEQ ID NO: 8237216 - DNA, 22 bp, Homo sapiens
gctctgagccgggggcctgtcc

SEQ ID NO: 8237217 - DNA, 22 bp, Homo sapiens
gctctgagcccccagaagcaga

SEQ ID NO: 8237218 - DNA, 22 bp, Homo sapiens
gctctgaggctgggagcactct

SEQ ID NO: 8237219 - DNA, 22 bp, Homo sapiens
gctctgaggctgggagcactct

SEQ ID NO: 8237220 - DNA, 22 bp, Homo sapiens
gctctgaggagccaagaatgtg

SEQ ID NO: 8237221 - DNA, 23 bp, Homo sapiens
gctctgagggcttatccctccca

SEQ ID NO: 8237222 - DNA, 22 bp, Homo sapiens
gctctgaggctgtgaggtgctg

SEQ ID NO: 8237223 - DNA, 22 bp, Homo sapiens
gctcctggcttcactgacatca

SEQ ID NO: 8237224 - DNA, 16 bp, Homo sapiens
gctcctgggccctcga

SEQ ID NO: 8237225 - DNA, 22 bp, Homo sapiens
gctcctggcttcactgacatca

SEQ ID NO: 8237226 - DNA, 22 bp, Homo sapiens
gctcctggctctggccaaggga

SEQ ID NO: 8237227 - DNA, 22 bp, Homo sapiens
gctcctggctctggccaaggga

SEQ ID NO: 8237228 - DNA, 22 bp, Homo sapiens
gctcctggctctggccaaggga

SEQ ID NO: 8237229 - DNA, 19 bp, Homo sapiens
gctcctgggcctcactcat

SEQ ID NO: 8237230 - DNA, 19 bp, Homo sapiens
gctcctgggcctcactcat

SEQ ID NO: 8237231 - DNA, 16 bp, Homo sapiens
gctcctgggccctcga

SEQ ID NO: 8237232 - DNA, 22 bp, Homo sapiens
gctcctgggccctgggctaact

SEQ ID NO: 8237233 - DNA, 22 bp, Homo sapiens
gctcctgggccctgggctaact

SEQ ID NO: 8237234 - DNA, 16 bp, Homo sapiens
gctcctgggccctcga

SEQ ID NO: 8237235 - DNA, 19 bp, Homo sapiens
gctcctgggcctcactcat

SEQ ID NO: 8237236 - DNA, 22 bp, Homo sapiens
gctctctttgtgccacttaagg

SEQ ID NO: 8237237 - DNA, 22 bp, Homo sapiens
gctctgaaaaatggaggttggc

SEQ ID NO: 8237238 - DNA, 22 bp, Homo sapiens
gctctctttccatgtggaggat

SEQ ID NO: 8237239 - DNA, 22 bp, Homo sapiens
gctctgagcccccagaagcaga

SEQ ID NO: 8237240 - DNA, 22 bp, Homo sapiens
gctctgagcagggagaaacagg

SEQ ID NO: 8237241 - DNA, 22 bp, Homo sapiens
gctctgaaaaatggaggttggc

SEQ ID NO: 8237242 - DNA, 22 bp, Homo sapiens
gctcctgggtgtggctgcccct

SEQ ID NO: 8237243 - DNA, 22 bp, Homo sapiens
gctcctgggtgtggctgcccct

SEQ ID NO: 8237244 - DNA, 22 bp, Homo sapiens
gctcctgggtgtggctgcccct

SEQ ID NO: 8237245 - DNA, 22 bp, Homo sapiens
gctcctgggctctaccttgcta

SEQ ID NO: 8237246 - DNA, 22 bp, Homo sapiens
gctcctgggctctaccttgcta

SEQ ID NO: 8237247 - DNA, 22 bp, Homo sapiens
gctcctggtctggagcttcaag

SEQ ID NO: 8237248 - DNA, 22 bp, Homo sapiens
gctcctgggtgtggctgcccct

SEQ ID NO: 8237249 - DNA, 22 bp, Homo sapiens
gctctctttaaactgcatggct

SEQ ID NO: 8237250 - DNA, 22 bp, Homo sapiens
gctctcttggtggctgtcctgg

SEQ ID NO: 8237251 - DNA, 22 bp, Homo sapiens
gctcagagataaaactgatcag

SEQ ID NO: 8237252 - DNA, 22 bp, Homo sapiens
gctcagagatggggaatgaaaa

SEQ ID NO: 8237253 - DNA, 22 bp, Homo sapiens
gctcagagatggggaatgaaaa

SEQ ID NO: 8237254 - DNA, 22 bp, Homo sapiens
gctcagagatgtctgctgcctt

SEQ ID NO: 8237255 - DNA, 22 bp, Homo sapiens
gctcagagcactcagactcagc

SEQ ID NO: 8237256 - DNA, 22 bp, Homo sapiens
gctcagagatgttcagtagctt

SEQ ID NO: 8237257 - DNA, 22 bp, Homo sapiens
gctcagagatgttcagtagctt

SEQ ID NO: 8237258 - DNA, 22 bp, Homo sapiens
gctcagagatgttcagtagctt

SEQ ID NO: 8237259 - DNA, 22 bp, Homo sapiens
gctcagaagatatttgatgctg

SEQ ID NO: 8237260 - DNA, 22 bp, Homo sapiens
gctcagaagatatttgatgctg

SEQ ID NO: 8237261 - DNA, 22 bp, Homo sapiens
gctcagaaatggcagatggaga

SEQ ID NO: 8237262 - DNA, 22 bp, Homo sapiens
gctcactggcctgaagaggacg

SEQ ID NO: 8237263 - DNA, 22 bp, Homo sapiens
gctcacttaatttcatgctaca

SEQ ID NO: 8237264 - DNA, 22 bp, Homo sapiens
gctcagaccccaccctggcaga

SEQ ID NO: 8237265 - DNA, 22 bp, Homo sapiens
gctcagacctgtaatcttagca

SEQ ID NO: 8237266 - DNA, 22 bp, Homo sapiens
gctcagactctggcctgatgat

SEQ ID NO: 8237267 - DNA, 22 bp, Homo sapiens
gctcagactctggcctgatgat

SEQ ID NO: 8237268 - DNA, 22 bp, Homo sapiens
gctcagacctgtaatcttagca

SEQ ID NO: 8237269 - DNA, 22 bp, Homo sapiens
gctcagaccccaccctggcaga

SEQ ID NO: 8237270 - DNA, 19 bp, Homo sapiens
gctcagacattaagcagct

SEQ ID NO: 8237271 - DNA, 22 bp, Homo sapiens
gctcagaccccaccctggcaga

SEQ ID NO: 8237272 - DNA, 19 bp, Homo sapiens
gctcagacattaagcagct

SEQ ID NO: 8237273 - DNA, 22 bp, Homo sapiens
gctcagacagatatttcgagat

SEQ ID NO: 8237274 - DNA, 22 bp, Homo sapiens
gctcagacagatatttcgagat

SEQ ID NO: 8237275 - DNA, 19 bp, Homo sapiens
gctcagagccatgggggct

SEQ ID NO: 8237276 - DNA, 22 bp, Homo sapiens
gctcagagcccgaggcttgcat

SEQ ID NO: 8237277 - DNA, 22 bp, Homo sapiens
gctcagagcatcccagtgaatg

SEQ ID NO: 8237278 - DNA, 22 bp, Homo sapiens
gctcagagcatcccagtgaatg

SEQ ID NO: 8237279 - DNA, 22 bp, Homo sapiens
gctcagagcactcagactcagc

SEQ ID NO: 8237280 - DNA, 22 bp, Homo sapiens
gctcagagcactcagactcagc

SEQ ID NO: 8237281 - DNA, 22 bp, Homo sapiens
gctcagagcagatggtactcag

SEQ ID NO: 8237282 - DNA, 22 bp, Homo sapiens
gctcatgggcccagagcagccc

SEQ ID NO: 8237283 - DNA, 22 bp, Homo sapiens
gctcatgactgtaatcccagca

SEQ ID NO: 8237284 - DNA, 22 bp, Homo sapiens
gctcatgactgtaatcccagca

SEQ ID NO: 8237285 - DNA, 22 bp, Homo sapiens
gctcatgactgtaatcccagca

SEQ ID NO: 8237286 - DNA, 20 bp, Homo sapiens
gctcagagcctgaacttcat

SEQ ID NO: 8237287 - DNA, 22 bp, Homo sapiens
gctcactgcctgggcaacaaga

SEQ ID NO: 8237288 - DNA, 22 bp, Homo sapiens
gctcactggcctgaagaggacg

SEQ ID NO: 8237289 - DNA, 22 bp, Homo sapiens
gctcactgccattctctagatg

SEQ ID NO: 8237290 - DNA, 22 bp, Homo sapiens
gctcactgccattctctagatg

SEQ ID NO: 8237291 - DNA, 22 bp, Homo sapiens
gctcactgcaagctctgcctcc

SEQ ID NO: 8237292 - DNA, 22 bp, Homo sapiens
gctcactgcaagctctgcctcc

SEQ ID NO: 8237293 - DNA, 22 bp, Homo sapiens
gctcactgcaagctctgcctcc

SEQ ID NO: 8237294 - DNA, 22 bp, Homo sapiens
gctcactgcaagctctgcctcc

SEQ ID NO: 8237295 - DNA, 22 bp, Homo sapiens
gctcactgcaagctccgcctcc

SEQ ID NO: 8237296 - DNA, 22 bp, Homo sapiens
gctcactgcaagctccgcctcc

SEQ ID NO: 8237297 - DNA, 22 bp, Homo sapiens
gctcactgcaagctctgcctcc

SEQ ID NO: 8237298 - DNA, 22 bp, Homo sapiens
gctcactgcaagctccgcctcc

SEQ ID NO: 8237299 - DNA, 22 bp, Homo sapiens
gctcactgcaacctctgcctcc

SEQ ID NO: 8237300 - DNA, 22 bp, Homo sapiens
gctcactgcaacctctgcctcc

SEQ ID NO: 8237301 - DNA, 22 bp, Homo sapiens
gctcactgcaacctctgcctcc

SEQ ID NO: 8237302 - DNA, 22 bp, Homo sapiens
gctcactgcaacctctgcttcc

SEQ ID NO: 8237303 - DNA, 22 bp, Homo sapiens
gctcactgcaacctctgcttcc

SEQ ID NO: 8237304 - DNA, 22 bp, Homo sapiens
gctcactgcaacctctgcctcc

SEQ ID NO: 8237305 - DNA, 22 bp, Homo sapiens
gctcactgcaacctccgccttc

SEQ ID NO: 8237306 - DNA, 22 bp, Homo sapiens
gctcactgcaacctccgccttc

SEQ ID NO: 8237307 - DNA, 22 bp, Homo sapiens
gctcactgcaacctctgcctcc

SEQ ID NO: 8237308 - DNA, 22 bp, Homo sapiens
gctcactgcaacctccgccttc

SEQ ID NO: 8237309 - DNA, 19 bp, Homo sapiens
gccttaacctgttaagggg

SEQ ID NO: 8237310 - DNA, 22 bp, Homo sapiens
gctccagcacctagagcaggtc

SEQ ID NO: 8237311 - DNA, 22 bp, Homo sapiens
gctccagagtgtggcatctggg

SEQ ID NO: 8237312 - DNA, 22 bp, Homo sapiens
gctccagatgaatgcacttgtt

SEQ ID NO: 8237313 - DNA, 22 bp, Homo sapiens
gctccagatgaatgcacttgtt

SEQ ID NO: 8237314 - DNA, 22 bp, Homo sapiens
gctccagatgaatgcacttgtt

SEQ ID NO: 8237315 - DNA, 22 bp, Homo sapiens
gctccagctcgtggctcccagc

SEQ ID NO: 8237316 - DNA, 22 bp, Homo sapiens
gctccagctcgtggctcccagc

SEQ ID NO: 8237317 - DNA, 22 bp, Homo sapiens
gctccaggagagggaagcagat

SEQ ID NO: 8237318 - DNA, 22 bp, Homo sapiens
gctccaggagagggaagcagat

SEQ ID NO: 8237319 - DNA, 22 bp, Homo sapiens
gctccaggaagggaaatctcca

SEQ ID NO: 8237320 - DNA, 22 bp, Homo sapiens
gctccaggaagggaaatctcca

SEQ ID NO: 8237321 - DNA, 22 bp, Homo sapiens
gctccaagatcattttcccatt

SEQ ID NO: 8237322 - DNA, 22 bp, Homo sapiens
gctccactaggaatctgctctt

SEQ ID NO: 8237323 - DNA, 22 bp, Homo sapiens
gctccactgcccctgggcaccg

SEQ ID NO: 8237324 - DNA, 22 bp, Homo sapiens
gctccaaggtatccaccagggt

SEQ ID NO: 8237325 - DNA, 22 bp, Homo sapiens
gctccaagccttctttgttact

SEQ ID NO: 8237326 - DNA, 22 bp, Homo sapiens
gctccaaggtatccaccagggt

SEQ ID NO: 8237327 - DNA, 22 bp, Homo sapiens
gctccacttgattgttacagca

SEQ ID NO: 8237328 - DNA, 22 bp, Homo sapiens
gctccacttccttctgccctca

SEQ ID NO: 8237329 - DNA, 22 bp, Homo sapiens
gctccacttgcagctaggcttg

SEQ ID NO: 8237330 - DNA, 22 bp, Homo sapiens
gctccactgtttattggcagaa

SEQ ID NO: 8237331 - DNA, 22 bp, Homo sapiens
gctccacttgcagctaggcttg

SEQ ID NO: 8237332 - DNA, 22 bp, Homo sapiens
gctccagagtgtggcatctggg

SEQ ID NO: 8237333 - DNA, 22 bp, Homo sapiens
gctccagagtgtggcatctggg

SEQ ID NO: 8237334 - DNA, 22 bp, Homo sapiens
gctccaggagagggaagcagat

SEQ ID NO: 8237335 - DNA, 22 bp, Homo sapiens
gctccaggagctcacagctcgc

SEQ ID NO: 8237336 - DNA, 22 bp, Homo sapiens
gctccaggagctcacagctcgc

SEQ ID NO: 8237337 - DNA, 22 bp, Homo sapiens
gctccaggagctcacagctcgc

SEQ ID NO: 8237338 - DNA, 22 bp, Homo sapiens
gctccaggagctcacagctcgc

SEQ ID NO: 8237339 - DNA, 22 bp, Homo sapiens
gctccaggagctcacagctcgc

SEQ ID NO: 8237340 - DNA, 22 bp, Homo sapiens
gctccaggagctcacagctcgc

SEQ ID NO: 8237341 - DNA, 22 bp, Homo sapiens
gctccaggaggatgaccttcct

SEQ ID NO: 8237342 - DNA, 22 bp, Homo sapiens
gctcctctcccagagctgcagg

SEQ ID NO: 8237343 - DNA, 22 bp, Homo sapiens
gctccaggaggatgaccttcct

SEQ ID NO: 8237344 - DNA, 22 bp, Homo sapiens
gctcctcttatttcatcagggc

SEQ ID NO: 8237345 - DNA, 22 bp, Homo sapiens
gctcctcttatttcatcagggc

SEQ ID NO: 8237346 - DNA, 22 bp, Homo sapiens
gctcctggcaggcagtgtgtgt

SEQ ID NO: 8237347 - DNA, 22 bp, Homo sapiens
gctcctggcaggcagtgtgtgt

SEQ ID NO: 8237348 - DNA, 22 bp, Homo sapiens
gctcctggcatcctgcttttaa

SEQ ID NO: 8237349 - DNA, 22 bp, Homo sapiens
gctcctggccagcacagggccc

SEQ ID NO: 8237350 - DNA, 22 bp, Homo sapiens
gctcctggcaggcagtgtgtgt

SEQ ID NO: 8237351 - DNA, 22 bp, Homo sapiens
gctcctggccagcacagggccc

SEQ ID NO: 8237352 - DNA, 22 bp, Homo sapiens
gctcctggccagcacagggccc

SEQ ID NO: 8237353 - DNA, 22 bp, Homo sapiens
gctcctggccagcacagggccc

SEQ ID NO: 8237354 - DNA, 22 bp, Homo sapiens
gctcctggctccaggcagccaa

SEQ ID NO: 8237355 - DNA, 22 bp, Homo sapiens
gctcctggctccaggcagccaa

SEQ ID NO: 8237356 - DNA, 22 bp, Homo sapiens
gctcctggctccaggcagccaa

SEQ ID NO: 8237357 - DNA, 22 bp, Homo sapiens
gctcctggctccaggcagccaa

SEQ ID NO: 8237358 - DNA, 22 bp, Homo sapiens
gctcctggctctctgagggctg

SEQ ID NO: 8237359 - DNA, 22 bp, Homo sapiens
gctcctggctctctgagggctg

SEQ ID NO: 8237360 - DNA, 22 bp, Homo sapiens
gctcctggctctctgagggctg

SEQ ID NO: 8237361 - DNA, 22 bp, Homo sapiens
gctcctggctctctgagggctg

SEQ ID NO: 8237362 - DNA, 22 bp, Homo sapiens
gctcctggctctctgagggctg

SEQ ID NO: 8237363 - DNA, 22 bp, Homo sapiens
gctgctgcctgtagccagggtg

SEQ ID NO: 8237364 - DNA, 19 bp, Homo sapiens
gctgctgctcctccctcgc

SEQ ID NO: 8237365 - DNA, 21 bp, Homo sapiens
gctggagagccaggcaggggc

SEQ ID NO: 8237366 - DNA, 21 bp, Homo sapiens
gctggagagccaggcaggggc

SEQ ID NO: 8237367 - DNA, 21 bp, Homo sapiens
gctggagagccaggcaggggc

SEQ ID NO: 8237368 - DNA, 21 bp, Homo sapiens
gctggagagccaggcaggggc

SEQ ID NO: 8237369 - DNA, 21 bp, Homo sapiens
gctggagagccaggcaggggc

SEQ ID NO: 8237370 - DNA, 22 bp, Homo sapiens
gctggagaggggtcactctgag

SEQ ID NO: 8237371 - DNA, 22 bp, Homo sapiens
gctggagaggatcccaaagcca

SEQ ID NO: 8237372 - DNA, 21 bp, Homo sapiens
gctggagagccaggcaggggc

SEQ ID NO: 8237373 - DNA, 21 bp, Homo sapiens
gctggagagccaggcaggggc

SEQ ID NO: 8237374 - DNA, 22 bp, Homo sapiens
gctgctgccgcggccgctggga

SEQ ID NO: 8237375 - DNA, 22 bp, Homo sapiens
gctgctgcatgaacagcggtca

SEQ ID NO: 8237376 - DNA, 20 bp, Homo sapiens
gctgctgagcttccctgggg

SEQ ID NO: 8237377 - DNA, 22 bp, Homo sapiens
gctgctcttttcagagatgaga

SEQ ID NO: 8237378 - DNA, 22 bp, Homo sapiens
gctgctcttttcagagatgaga

SEQ ID NO: 8237379 - DNA, 22 bp, Homo sapiens
gctgctctgttaattgctgtaa

SEQ ID NO: 8237380 - DNA, 22 bp, Homo sapiens
gctgctcttgaggggctcactg

SEQ ID NO: 8237381 - DNA, 22 bp, Homo sapiens
gctgctcttgaggggctcactg

SEQ ID NO: 8237382 - DNA, 22 bp, Homo sapiens
gctgctctgtgacagcctccgg

SEQ ID NO: 8237383 - DNA, 22 bp, Homo sapiens
gctgctctgtgacagcctccgg

SEQ ID NO: 8237384 - DNA, 22 bp, Homo sapiens
gctgctctgggtctgcccagct

SEQ ID NO: 8237385 - DNA, 22 bp, Homo sapiens
gctgctctgggtctgcccagct

SEQ ID NO: 8237386 - DNA, 22 bp, Homo sapiens
gctgcctgtcccaggatgagga

SEQ ID NO: 8237387 - DNA, 22 bp, Homo sapiens
gctgcctgtcccaggatgagga

SEQ ID NO: 8237388 - DNA, 22 bp, Homo sapiens
gctgcctgtcccaggatgagga

SEQ ID NO: 8237389 - DNA, 22 bp, Homo sapiens
gctgcctgtcccaggatgagga

SEQ ID NO: 8237390 - DNA, 22 bp, Homo sapiens
gctgctctcagagctcatgctg

SEQ ID NO: 8237391 - DNA, 22 bp, Homo sapiens
gctgctctacccatgcatctgt

SEQ ID NO: 8237392 - DNA, 20 bp, Homo sapiens
gctgctcgctgcagtcactc

SEQ ID NO: 8237393 - DNA, 20 bp, Homo sapiens
gctgctcgctgcagtcactc

SEQ ID NO: 8237394 - DNA, 22 bp, Homo sapiens
gctgctctacccatgcatctgt

SEQ ID NO: 8237395 - DNA, 22 bp, Homo sapiens
gctgcctggtttctcagctgca

SEQ ID NO: 8237396 - DNA, 22 bp, Homo sapiens
gctgcctgtcccaggatgagga

SEQ ID NO: 8237397 - DNA, 22 bp, Homo sapiens
gctgcctgggcaggaggcgctg

SEQ ID NO: 8237398 - DNA, 22 bp, Homo sapiens
gctgcctgggcaggaggcgctg

SEQ ID NO: 8237399 - DNA, 22 bp, Homo sapiens
gctgcctggtttctcagctgca

SEQ ID NO: 8237400 - DNA, 22 bp, Homo sapiens
gctgcctgggctggcattccca

SEQ ID NO: 8237401 - DNA, 22 bp, Homo sapiens
gctgctctccaagcctccttga

SEQ ID NO: 8237402 - DNA, 22 bp, Homo sapiens
gctgctctccaagcctccttga

SEQ ID NO: 8237403 - DNA, 22 bp, Homo sapiens
gctgctctcatagatggcttca

SEQ ID NO: 8237404 - DNA, 22 bp, Homo sapiens
gctgctctcagagctcatgctg

SEQ ID NO: 8237405 - DNA, 20 bp, Homo sapiens
gctgctctccacggtctgca

SEQ ID NO: 8237406 - DNA, 22 bp, Homo sapiens
gctgctctccaagcctccttga

SEQ ID NO: 8237407 - DNA, 20 bp, Homo sapiens
gctgctctccacggtctgca

SEQ ID NO: 8237408 - DNA, 22 bp, Homo sapiens
gctgctctgaaaatgactgttg

SEQ ID NO: 8237409 - DNA, 22 bp, Homo sapiens
gctgctctgctgtgtaagcagg

SEQ ID NO: 8237410 - DNA, 22 bp, Homo sapiens
gctgctctggctctgcagtgtc

SEQ ID NO: 8237411 - DNA, 22 bp, Homo sapiens
gctgctctggctctgcagtgtc

SEQ ID NO: 8237412 - DNA, 19 bp, Homo sapiens
gctgctctgggtctcatct

SEQ ID NO: 8237413 - DNA, 22 bp, Homo sapiens
gctgctctgctgtgtaagcagg

SEQ ID NO: 8237414 - DNA, 19 bp, Homo sapiens
gctgctctgggtctcatct

SEQ ID NO: 8237415 - DNA, 22 bp, Homo sapiens
gctgagctagaaaaggaccaca

SEQ ID NO: 8237416 - DNA, 22 bp, Homo sapiens
gctgagctagaaaaggaccaca

SEQ ID NO: 8237417 - DNA, 22 bp, Homo sapiens
gctgagctagaaaaggaccaca

SEQ ID NO: 8237418 - DNA, 22 bp, Homo sapiens
gctgagcctagctgtctcctgt

SEQ ID NO: 8237419 - DNA, 22 bp, Homo sapiens
gctgagctagaaaaggaccaca

SEQ ID NO: 8237420 - DNA, 22 bp, Homo sapiens
gctgagctagaaaaggaccaca

SEQ ID NO: 8237421 - DNA, 22 bp, Homo sapiens
gctgagctgaggcagggctggg

SEQ ID NO: 8237422 - DNA, 22 bp, Homo sapiens
gctgagctcccagcagtatctg

SEQ ID NO: 8237423 - DNA, 22 bp, Homo sapiens
gctgaggaggtgtggttaggtg

SEQ ID NO: 8237424 - DNA, 22 bp, Homo sapiens
gctgaggatatagcaggaacaa

SEQ ID NO: 8237425 - DNA, 22 bp, Homo sapiens
gctgagcaggtgtaaggaaggc

SEQ ID NO: 8237426 - DNA, 22 bp, Homo sapiens
gctgagcaggtttgatgctttt

SEQ ID NO: 8237427 - DNA, 22 bp, Homo sapiens
gctgagccacaggcagtgcact

SEQ ID NO: 8237428 - DNA, 22 bp, Homo sapiens
gctgagccacaggcagtgcact

SEQ ID NO: 8237429 - DNA, 22 bp, Homo sapiens
gctgagccctcatccctagttt

SEQ ID NO: 8237430 - DNA, 22 bp, Homo sapiens
gctgagccctcatccctagttt

SEQ ID NO: 8237431 - DNA, 22 bp, Homo sapiens
gctgaggatatagcaggaacaa

SEQ ID NO: 8237432 - DNA, 22 bp, Homo sapiens
gctgaggattacttgaagtcag

SEQ ID NO: 8237433 - DNA, 22 bp, Homo sapiens
gctgaggattacttgaagtcag

SEQ ID NO: 8237434 - DNA, 22 bp, Homo sapiens
gctgaggattacttgaagtcag

SEQ ID NO: 8237435 - DNA, 22 bp, Homo sapiens
gctgaggattacttgaagtcag

SEQ ID NO: 8237436 - DNA, 22 bp, Homo sapiens
gctgaggattacttgaagtcag

SEQ ID NO: 8237437 - DNA, 20 bp, Homo sapiens
gctgaggattcctggcccct

SEQ ID NO: 8237438 - DNA, 20 bp, Homo sapiens
gctgaggattcctggcccct

SEQ ID NO: 8237439 - DNA, 22 bp, Homo sapiens
gctgaggattgaagagttgcca

SEQ ID NO: 8237440 - DNA, 20 bp, Homo sapiens
gctgaggattcctggcccct

SEQ ID NO: 8237441 - DNA, 22 bp, Homo sapiens
gctgaggcagtccacccttgtg

SEQ ID NO: 8237442 - DNA, 22 bp, Homo sapiens
gctgaggcaagatttgaaccca

SEQ ID NO: 8237443 - DNA, 22 bp, Homo sapiens
gctgaggcaagatttgaaccca

SEQ ID NO: 8237444 - DNA, 22 bp, Homo sapiens
gctgaggcagtccacccttgtg

SEQ ID NO: 8237445 - DNA, 22 bp, Homo sapiens
gctgaggcaaaccaagaatgta

SEQ ID NO: 8237446 - DNA, 22 bp, Homo sapiens
gctgaggattgaagagttgcca

SEQ ID NO: 8237447 - DNA, 22 bp, Homo sapiens
gctgaggcaaaccaagaatgta

SEQ ID NO: 8237448 - DNA, 22 bp, Homo sapiens
gctgaggcaaaccaagaatgta

SEQ ID NO: 8237449 - DNA, 22 bp, Homo sapiens
gctgaggcaaatagttttaagt

SEQ ID NO: 8237450 - DNA, 22 bp, Homo sapiens
gctgaggcaaatagttttaagt

SEQ ID NO: 8237451 - DNA, 22 bp, Homo sapiens
gctgcctgatgtccagcaggac

SEQ ID NO: 8237452 - DNA, 22 bp, Homo sapiens
gctgcctgatgtccagcaggac

SEQ ID NO: 8237453 - DNA, 22 bp, Homo sapiens
gctgcctgatcatacaccaggg

SEQ ID NO: 8237454 - DNA, 22 bp, Homo sapiens
gctgcctgctcacccggcctgg

SEQ ID NO: 8237455 - DNA, 22 bp, Homo sapiens
gctgcctgctcacccggcctgg

SEQ ID NO: 8237456 - DNA, 22 bp, Homo sapiens
gctgcctgctcacccggcctgg

SEQ ID NO: 8237457 - DNA, 22 bp, Homo sapiens
gctgcctgccttgcctggagga

SEQ ID NO: 8237458 - DNA, 22 bp, Homo sapiens
gctgcctgctcggctcctggga

SEQ ID NO: 8237459 - DNA, 22 bp, Homo sapiens
gctgcctgctcggctcctggga

SEQ ID NO: 8237460 - DNA, 22 bp, Homo sapiens
gctgcctgctcggctcctggga

SEQ ID NO: 8237461 - DNA, 22 bp, Homo sapiens
gctgcctggaataacggctggc

SEQ ID NO: 8237462 - DNA, 22 bp, Homo sapiens
gctgcctgcttcatgtgggaga

SEQ ID NO: 8237463 - DNA, 22 bp, Homo sapiens
gctgcctgcttcatgtgggaga

SEQ ID NO: 8237464 - DNA, 22 bp, Homo sapiens
gctgcctggagaggcagggatg

SEQ ID NO: 8237465 - DNA, 22 bp, Homo sapiens
gctgcctggagaggcagggatg

SEQ ID NO: 8237466 - DNA, 22 bp, Homo sapiens
gctgcctggaataacggctggc

SEQ ID NO: 8237467 - DNA, 22 bp, Homo sapiens
gctgcctggagaggcagggatg

SEQ ID NO: 8237468 - DNA, 22 bp, Homo sapiens
gctgcctggaataacggctggc

SEQ ID NO: 8237469 - DNA, 22 bp, Homo sapiens
gctgcctggagctcagcctgcc

SEQ ID NO: 8237470 - DNA, 22 bp, Homo sapiens
gctgcctggagaggcagggatg

SEQ ID NO: 8237471 - DNA, 22 bp, Homo sapiens
gctgcctggagctcagcctgcc

SEQ ID NO: 8237472 - DNA, 22 bp, Homo sapiens
gctgcctggagctcagcctgcc

SEQ ID NO: 8237473 - DNA, 22 bp, Homo sapiens
gctgcctggagctcagcctgcc

SEQ ID NO: 8237474 - DNA, 22 bp, Homo sapiens
gctgcctggagctcagcctgcc

SEQ ID NO: 8237475 - DNA, 22 bp, Homo sapiens
gctgcctggagctcagcctgcc

SEQ ID NO: 8237476 - DNA, 22 bp, Homo sapiens
gctgcctggatttgcaatcctc

SEQ ID NO: 8237477 - DNA, 22 bp, Homo sapiens
gctgcctgggcaggaggcgctg

SEQ ID NO: 8237478 - DNA, 22 bp, Homo sapiens
gctgcctgggcaggaggcgctg

SEQ ID NO: 8237479 - DNA, 22 bp, Homo sapiens
gctgcctggctttagtccactt

SEQ ID NO: 8237480 - DNA, 22 bp, Homo sapiens
gctgcctggctttagtccactt

SEQ ID NO: 8237481 - DNA, 22 bp, Homo sapiens
gctgcctggctttagtccactt

SEQ ID NO: 8237482 - DNA, 22 bp, Homo sapiens
gctgggcagcctggccgctgcc

SEQ ID NO: 8237483 - DNA, 22 bp, Homo sapiens
gctgggcagcctggccgctgcc

SEQ ID NO: 8237484 - DNA, 22 bp, Homo sapiens
gctgggcagcccctacagagag

SEQ ID NO: 8237485 - DNA, 22 bp, Homo sapiens
gctgggcagcaggctctccggg

SEQ ID NO: 8237486 - DNA, 22 bp, Homo sapiens
gctgggcagcccctacagagag

SEQ ID NO: 8237487 - DNA, 22 bp, Homo sapiens
gctgggcagcccctacagagag

SEQ ID NO: 8237488 - DNA, 22 bp, Homo sapiens
gctgggcagctgaggcctctca

SEQ ID NO: 8237489 - DNA, 22 bp, Homo sapiens
gctgggcaggcctcgtgagggc

SEQ ID NO: 8237490 - DNA, 22 bp, Homo sapiens
gctgggcagctgaggcctctca

SEQ ID NO: 8237491 - DNA, 22 bp, Homo sapiens
gctgggcagctgaggcctctca

SEQ ID NO: 8237492 - DNA, 22 bp, Homo sapiens
gctgggcagtgagtgagtcctt

SEQ ID NO: 8237493 - DNA, 22 bp, Homo sapiens
gctgggcagtgagtgagtcctt

SEQ ID NO: 8237494 - DNA, 22 bp, Homo sapiens
gctgggcaggcctcgtgagggc

SEQ ID NO: 8237495 - DNA, 22 bp, Homo sapiens
gctgggcaagtgccttgggttt

SEQ ID NO: 8237496 - DNA, 22 bp, Homo sapiens
gctgggcaatgccagagaggag

SEQ ID NO: 8237497 - DNA, 22 bp, Homo sapiens
gctgggcaaggctgaagctacc

SEQ ID NO: 8237498 - DNA, 22 bp, Homo sapiens
gctgggcaaggctgaagctacc

SEQ ID NO: 8237499 - DNA, 22 bp, Homo sapiens
gctgggcaacgggcagaaagat

SEQ ID NO: 8237500 - DNA, 22 bp, Homo sapiens
gctgggcaacgggcagaaagat

SEQ ID NO: 8237501 - DNA, 22 bp, Homo sapiens
gctgggcaacgggcagaaagat

SEQ ID NO: 8237502 - DNA, 22 bp, Homo sapiens
gctgggcaacggaagagagaaa

SEQ ID NO: 8237503 - DNA, 22 bp, Homo sapiens
gctgggcaatgccagagaggag

SEQ ID NO: 8237504 - DNA, 22 bp, Homo sapiens
gctgggcaatgccagagaggag

SEQ ID NO: 8237505 - DNA, 22 bp, Homo sapiens
gctgggcaccggagagacccca

SEQ ID NO: 8237506 - DNA, 22 bp, Homo sapiens
gctgggcaccggagagacccca

SEQ ID NO: 8237507 - DNA, 22 bp, Homo sapiens
gctgggcacctctcccagattg

SEQ ID NO: 8237508 - DNA, 22 bp, Homo sapiens
gctggcggcagtggtgtctctg

SEQ ID NO: 8237509 - DNA, 22 bp, Homo sapiens
gctggcggcagtggtgtctctg

SEQ ID NO: 8237510 - DNA, 22 bp, Homo sapiens
gctggcctttgaggaagctgcg

SEQ ID NO: 8237511 - DNA, 22 bp, Homo sapiens
gctggcctttgaggaagctgcg

SEQ ID NO: 8237512 - DNA, 22 bp, Homo sapiens
gctgggagtgggcaagatgaga

SEQ ID NO: 8237513 - DNA, 22 bp, Homo sapiens
gctgggagttactgtctccttt

SEQ ID NO: 8237514 - DNA, 22 bp, Homo sapiens
gctgggagtgggcaagatgaga

SEQ ID NO: 8237515 - DNA, 22 bp, Homo sapiens
gctgggagtttgatttgactgg

SEQ ID NO: 8237516 - DNA, 22 bp, Homo sapiens
gctgggagtttgatttgactgg

SEQ ID NO: 8237517 - DNA, 22 bp, Homo sapiens
gctgggagttactgtctccttt

SEQ ID NO: 8237518 - DNA, 22 bp, Homo sapiens
gctgggagttactgtctccttt

SEQ ID NO: 8237519 - DNA, 22 bp, Homo sapiens
gctgggagttactgtctccttt

SEQ ID NO: 8237520 - DNA, 22 bp, Homo sapiens
gctgggagtttgatttgactgg

SEQ ID NO: 8237521 - DNA, 22 bp, Homo sapiens
gctgggatgcgtcttcccaggc

SEQ ID NO: 8237522 - DNA, 22 bp, Homo sapiens
gctgggatggagactgcagtga

SEQ ID NO: 8237523 - DNA, 22 bp, Homo sapiens
gctgggcaacggaagagagaaa

SEQ ID NO: 8237524 - DNA, 22 bp, Homo sapiens
gctgggcaacggaagagagaaa

SEQ ID NO: 8237525 - DNA, 22 bp, Homo sapiens
gctggccttgtgtctgaggaag

SEQ ID NO: 8237526 - DNA, 22 bp, Homo sapiens
gctggccttgtgtctgaggaag

SEQ ID NO: 8237527 - DNA, 22 bp, Homo sapiens
gctggccttgtgtctgaggaag

SEQ ID NO: 8237528 - DNA, 22 bp, Homo sapiens
gctggccttctgcagagttctg

SEQ ID NO: 8237529 - DNA, 22 bp, Homo sapiens
gctggcctgggctcaagaccag

SEQ ID NO: 8237530 - DNA, 22 bp, Homo sapiens
gctggcctgggcagcctgtcgg

SEQ ID NO: 8237531 - DNA, 22 bp, Homo sapiens
gctggcctgggcagcctgtcgg

SEQ ID NO: 8237532 - DNA, 22 bp, Homo sapiens
gctggcctgcgagggcaggctg

SEQ ID NO: 8237533 - DNA, 22 bp, Homo sapiens
gctggcctgcgagggcaggctg

SEQ ID NO: 8237534 - DNA, 22 bp, Homo sapiens
gctggcctgggcagaggctatg

SEQ ID NO: 8237535 - DNA, 22 bp, Homo sapiens
gctggcctgggcagaggctatg

SEQ ID NO: 8237536 - DNA, 22 bp, Homo sapiens
gctggcctgggcagaggctatg

SEQ ID NO: 8237537 - DNA, 22 bp, Homo sapiens
gctggcctgggcagaggctatg

SEQ ID NO: 8237538 - DNA, 22 bp, Homo sapiens
gctggcctgggcagcctgtcgg

SEQ ID NO: 8237539 - DNA, 22 bp, Homo sapiens
gctggagcgggttcgggccgct

SEQ ID NO: 8237540 - DNA, 22 bp, Homo sapiens
gctggagccttctgctctgttg

SEQ ID NO: 8237541 - DNA, 22 bp, Homo sapiens
gctggagccttctgctctgttg

SEQ ID NO: 8237542 - DNA, 22 bp, Homo sapiens
gctggagccttctgctctgttg

SEQ ID NO: 8237543 - DNA, 22 bp, Homo sapiens
gctggagctgagttccctgggc

SEQ ID NO: 8237544 - DNA, 22 bp, Homo sapiens
gctggagctgagttccctgggc

SEQ ID NO: 8237545 - DNA, 22 bp, Homo sapiens
gctggagctgcagcctgggcct

SEQ ID NO: 8237546 - DNA, 22 bp, Homo sapiens
gctggagctgagttccctgggc

SEQ ID NO: 8237547 - DNA, 22 bp, Homo sapiens
gctggagctgagttccctgggc

SEQ ID NO: 8237548 - DNA, 22 bp, Homo sapiens
gctggagccattggcttggcct

SEQ ID NO: 8237549 - DNA, 22 bp, Homo sapiens
gctggagccttctgctctgttg

SEQ ID NO: 8237550 - DNA, 22 bp, Homo sapiens
gctggagccaagctgctcttgg

SEQ ID NO: 8237551 - DNA, 22 bp, Homo sapiens
gctggagccaagctgctcttgg

SEQ ID NO: 8237552 - DNA, 22 bp, Homo sapiens
gctggagccattggcttggcct

SEQ ID NO: 8237553 - DNA, 22 bp, Homo sapiens
gctggagccattggcttggcct

SEQ ID NO: 8237554 - DNA, 22 bp, Homo sapiens
gctggagatgctatgcagaggg

SEQ ID NO: 8237555 - DNA, 22 bp, Homo sapiens
gctggagatgctatgcagaggg

SEQ ID NO: 8237556 - DNA, 22 bp, Homo sapiens
gctggagatgctatgcagaggg

SEQ ID NO: 8237557 - DNA, 22 bp, Homo sapiens
gctggagatgctatgcagaggg

SEQ ID NO: 8237558 - DNA, 22 bp, Homo sapiens
gctggagatgctatgcagaggg

SEQ ID NO: 8237559 - DNA, 22 bp, Homo sapiens
gctggagatgctatgcagaggg

SEQ ID NO: 8237560 - DNA, 22 bp, Homo sapiens
gctggagatgctatgcagaggg

SEQ ID NO: 8237561 - DNA, 22 bp, Homo sapiens
gctggagatagtaggatccata

SEQ ID NO: 8237562 - DNA, 22 bp, Homo sapiens
gctggagatagtaggatccata

SEQ ID NO: 8237563 - DNA, 22 bp, Homo sapiens
gctggagatagaatggccactg

SEQ ID NO: 8237564 - DNA, 22 bp, Homo sapiens
gctggagatagaatggccactg

SEQ ID NO: 8237565 - DNA, 22 bp, Homo sapiens
gctggagatactgctcagtatc

SEQ ID NO: 8237566 - DNA, 22 bp, Homo sapiens
gctggagatagaatggccactg

SEQ ID NO: 8237567 - DNA, 22 bp, Homo sapiens
gctggagagtgaggggagcaag

SEQ ID NO: 8237568 - DNA, 22 bp, Homo sapiens
gctggagagtgaggggagcaag

SEQ ID NO: 8237569 - DNA, 22 bp, Homo sapiens
gctggagagtagtaagcagtta

SEQ ID NO: 8237570 - DNA, 22 bp, Homo sapiens
gctggagagtgaggggagcaag

SEQ ID NO: 8237571 - DNA, 22 bp, Homo sapiens
gctggagagtgaggggagcaag

SEQ ID NO: 8237572 - DNA, 22 bp, Homo sapiens
gctggagagtgaggggagcaag

SEQ ID NO: 8237573 - DNA, 22 bp, Homo sapiens
gctggagagtgaggggagcaag

SEQ ID NO: 8237574 - DNA, 22 bp, Homo sapiens
gctggagatactgctcagtatc

SEQ ID NO: 8237575 - DNA, 22 bp, Homo sapiens
gctggagatactgctcagtatc

SEQ ID NO: 8237576 - DNA, 22 bp, Homo sapiens
gctggagatactgctcagtatc

SEQ ID NO: 8237577 - DNA, 22 bp, Homo sapiens
gctggcctcgcaggcaggatgt

SEQ ID NO: 8237578 - DNA, 22 bp, Homo sapiens
gctggcctcgcaggcaggatgt

SEQ ID NO: 8237579 - DNA, 22 bp, Homo sapiens
gctggcctcctgctagatggaa

SEQ ID NO: 8237580 - DNA, 22 bp, Homo sapiens
gctggcctcatcactgacttct

SEQ ID NO: 8237581 - DNA, 22 bp, Homo sapiens
gctggccgaacggtgccctggc

SEQ ID NO: 8237582 - DNA, 22 bp, Homo sapiens
gctggccgaacggtgccctggc

SEQ ID NO: 8237583 - DNA, 19 bp, Homo sapiens
gctggcccctgggatccag

SEQ ID NO: 8237584 - DNA, 19 bp, Homo sapiens
gctggcccctgggatccag

SEQ ID NO: 8237585 - DNA, 22 bp, Homo sapiens
gctggccagtgtcccagggatc

SEQ ID NO: 8237586 - DNA, 22 bp, Homo sapiens
gctggccagtgtcccagggatc

SEQ ID NO: 8237587 - DNA, 22 bp, Homo sapiens
gctggccaggtgctttggttct

SEQ ID NO: 8237588 - DNA, 22 bp, Homo sapiens
gctggccagggctgctcgcgga

SEQ ID NO: 8237589 - DNA, 22 bp, Homo sapiens
gctggagctgcagcctgggcct

SEQ ID NO: 8237590 - DNA, 22 bp, Homo sapiens
gctggagctgcagcctgggcct

SEQ ID NO: 8237591 - DNA, 22 bp, Homo sapiens
gctggccagggctgctcgcgga

SEQ ID NO: 8237592 - DNA, 22 bp, Homo sapiens
gctggccagggctgctcgcgga

SEQ ID NO: 8237593 - DNA, 22 bp, Homo sapiens
gctggccagggctgctcgcgga

SEQ ID NO: 8237594 - DNA, 22 bp, Homo sapiens
gctggccagggctgctcgcgga

SEQ ID NO: 8237595 - DNA, 22 bp, Homo sapiens
gctggcctctacaggccggcca

SEQ ID NO: 8237596 - DNA, 22 bp, Homo sapiens
gctggcctctacaggccggcca

SEQ ID NO: 8237597 - DNA, 22 bp, Homo sapiens
gctggcctgaccagccacaggc

SEQ ID NO: 8237598 - DNA, 22 bp, Homo sapiens
gctggcctgaccagccacaggc

SEQ ID NO: 8237599 - DNA, 22 bp, Homo sapiens
gctggcctctggagaagggctt

SEQ ID NO: 8237600 - DNA, 22 bp, Homo sapiens
gctggcctctggagaagggctt

SEQ ID NO: 8237601 - DNA, 22 bp, Homo sapiens
gctggcctgcaaagcccggctg

SEQ ID NO: 8237602 - DNA, 22 bp, Homo sapiens
gctggcctgagggccgaggctc

SEQ ID NO: 8237603 - DNA, 22 bp, Homo sapiens
gctggcctgacctgaggctggg

SEQ ID NO: 8237604 - DNA, 22 bp, Homo sapiens
gctggcctgagggccgaggctc

SEQ ID NO: 8237605 - DNA, 22 bp, Homo sapiens
gctggcctgacctgaggctggg

SEQ ID NO: 8237606 - DNA, 22 bp, Homo sapiens
gctggcctgacctgaggctggg

SEQ ID NO: 8237607 - DNA, 22 bp, Homo sapiens
gctggcctgacctgaggctggg

SEQ ID NO: 8237608 - DNA, 22 bp, Homo sapiens
gctggcctgacctgaggctggg

SEQ ID NO: 8237609 - DNA, 22 bp, Homo sapiens
gcccaggctggagtgcagtagc

SEQ ID NO: 8237610 - DNA, 22 bp, Homo sapiens
gcccaggctggagtgcagtggc

SEQ ID NO: 8237611 - DNA, 22 bp, Homo sapiens
gcccaggctggagtgcagtggc

SEQ ID NO: 8237612 - DNA, 22 bp, Homo sapiens
gcccaggctggagtgcagtggc

SEQ ID NO: 8237613 - DNA, 22 bp, Homo sapiens
gcccaggctggagtgcagtggc

SEQ ID NO: 8237614 - DNA, 22 bp, Homo sapiens
gcccaggctggagtgcagtggc

SEQ ID NO: 8237615 - DNA, 22 bp, Homo sapiens
gcccaggctagcgtagagtgca

SEQ ID NO: 8237616 - DNA, 22 bp, Homo sapiens
gcccaggctggagtgcagtagc

SEQ ID NO: 8237617 - DNA, 22 bp, Homo sapiens
gcccaggctggagtgcagtagc

SEQ ID NO: 8237618 - DNA, 22 bp, Homo sapiens
gcccaggctagcgtagagtgca

SEQ ID NO: 8237619 - DNA, 22 bp, Homo sapiens
gcccaggctagcgtagagtgca

SEQ ID NO: 8237620 - DNA, 22 bp, Homo sapiens
gcccaggctagcgtagagtgca

SEQ ID NO: 8237621 - DNA, 22 bp, Homo sapiens
gcccaggctagcgtagagtgca

SEQ ID NO: 8237622 - DNA, 22 bp, Homo sapiens
gcccaggattctttcttcctta

SEQ ID NO: 8237623 - DNA, 22 bp, Homo sapiens
gcccaggattctttcttcctta

SEQ ID NO: 8237624 - DNA, 22 bp, Homo sapiens
gcccaggatggtgtgtagtggt

SEQ ID NO: 8237625 - DNA, 22 bp, Homo sapiens
gcccaggatggctggaggtgct

SEQ ID NO: 8237626 - DNA, 22 bp, Homo sapiens
gcccaggatggctggaggtgct

SEQ ID NO: 8237627 - DNA, 22 bp, Homo sapiens
gcccaggatggctggaggtgct

SEQ ID NO: 8237628 - DNA, 22 bp, Homo sapiens
gcccaggatctgctcagatcat

SEQ ID NO: 8237629 - DNA, 20 bp, Homo sapiens
gcccaggatctctgaggcat

SEQ ID NO: 8237630 - DNA, 20 bp, Homo sapiens
gcccaggatctctgaggcat

SEQ ID NO: 8237631 - DNA, 20 bp, Homo sapiens
gcccaggatctctgaggcat

SEQ ID NO: 8237632 - DNA, 22 bp, Homo sapiens
gcccaggatggctggaggtgct

SEQ ID NO: 8237633 - DNA, 22 bp, Homo sapiens
gcccaggatggagaatagtggt

SEQ ID NO: 8237634 - DNA, 22 bp, Homo sapiens
gcccaggatctgctcagatcat

SEQ ID NO: 8237635 - DNA, 22 bp, Homo sapiens
gcccaggatctgctcagatcat

SEQ ID NO: 8237636 - DNA, 20 bp, Homo sapiens
gcccaggatctctgaggcat

SEQ ID NO: 8237637 - DNA, 22 bp, Homo sapiens
gcccaggataatgctgtccctg

SEQ ID NO: 8237638 - DNA, 22 bp, Homo sapiens
gcccaggagttggtggctgcag

SEQ ID NO: 8237639 - DNA, 22 bp, Homo sapiens
gcccaggagtttgcattttaac

SEQ ID NO: 8237640 - DNA, 22 bp, Homo sapiens
gcccaggagttggtggctgcag

SEQ ID NO: 8237641 - DNA, 23 bp, Homo sapiens
gccatggctgccccacaggcctc

SEQ ID NO: 8237642 - DNA, 23 bp, Homo sapiens
gccatggctgccccacaggcctc

SEQ ID NO: 8237643 - DNA, 22 bp, Homo sapiens
gccatgggcaaatgcagagctg

SEQ ID NO: 8237644 - DNA, 19 bp, Homo sapiens
gccatgggctggcagcaga

SEQ ID NO: 8237645 - DNA, 19 bp, Homo sapiens
gccatgggctggcagcaga

SEQ ID NO: 8237646 - DNA, 19 bp, Homo sapiens
gccatgggctggcagcaga

SEQ ID NO: 8237647 - DNA, 22 bp, Homo sapiens
gccatgggcaaatgcagagctg

SEQ ID NO: 8237648 - DNA, 22 bp, Homo sapiens
gccatggggctcagctgcacta

SEQ ID NO: 8237649 - DNA, 22 bp, Homo sapiens
gccatggggagggcagcgcctg

SEQ ID NO: 8237650 - DNA, 22 bp, Homo sapiens
gccatgggtctgctggctcagc

SEQ ID NO: 8237651 - DNA, 22 bp, Homo sapiens
gccatgtgggcagaggaggctg

SEQ ID NO: 8237652 - DNA, 22 bp, Homo sapiens
gcccaggaggagaggctgcagt

SEQ ID NO: 8237653 - DNA, 21 bp, Homo sapiens
gccatttcacacagacatttg

SEQ ID NO: 8237654 - DNA, 22 bp, Homo sapiens
gccatttaggaggtggaaagga

SEQ ID NO: 8237655 - DNA, 22 bp, Homo sapiens
gccatttaggaggtggaaagga

SEQ ID NO: 8237656 - DNA, 22 bp, Homo sapiens
gcccaggaggagaggctgcagt

SEQ ID NO: 8237657 - DNA, 22 bp, Homo sapiens
gcccaggaggcagaggttgtgg

SEQ ID NO: 8237658 - DNA, 22 bp, Homo sapiens
gcccaggagttggaggctgcag

SEQ ID NO: 8237659 - DNA, 22 bp, Homo sapiens
gcccaggagttggaggctgcag

SEQ ID NO: 8237660 - DNA, 22 bp, Homo sapiens
gcccaggagttggaggctgcag

SEQ ID NO: 8237661 - DNA, 22 bp, Homo sapiens
gccagtgtttatagcagtgagg

SEQ ID NO: 8237662 - DNA, 22 bp, Homo sapiens
gccagtgtttatagcagtgagg

SEQ ID NO: 8237663 - DNA, 22 bp, Homo sapiens
gccagtgttattcctggggctg

SEQ ID NO: 8237664 - DNA, 22 bp, Homo sapiens
gccagtgtgtcttgcaggctcc

SEQ ID NO: 8237665 - DNA, 22 bp, Homo sapiens
gccagtgtgtcttgcaggctcc

SEQ ID NO: 8237666 - DNA, 19 bp, Homo sapiens
gccagtgtgtggtacagtg

SEQ ID NO: 8237667 - DNA, 22 bp, Homo sapiens
gccagtgtggtgtagtcatgaa

SEQ ID NO: 8237668 - DNA, 22 bp, Homo sapiens
gccagtgtgcaagaggccacca

SEQ ID NO: 8237669 - DNA, 22 bp, Homo sapiens
gccagtggtgagattccctggg

SEQ ID NO: 8237670 - DNA, 22 bp, Homo sapiens
gccagttttctgaggattaagt

SEQ ID NO: 8237671 - DNA, 22 bp, Homo sapiens
gccataaaatgtggatgaggga

SEQ ID NO: 8237672 - DNA, 22 bp, Homo sapiens
gccataaatgaaggaaaggtat

SEQ ID NO: 8237673 - DNA, 22 bp, Homo sapiens
gccagttcctgtggagtcagag

SEQ ID NO: 8237674 - DNA, 22 bp, Homo sapiens
gccagttggccccgggcatgca

SEQ ID NO: 8237675 - DNA, 17 bp, Homo sapiens
gccagttgtcttggcat

SEQ ID NO: 8237676 - DNA, 22 bp, Homo sapiens
gccagtttaaaccttgtgaata

SEQ ID NO: 8237677 - DNA, 22 bp, Homo sapiens
gccataaattgctggtcaaaat

SEQ ID NO: 8237678 - DNA, 22 bp, Homo sapiens
gccataaattgctggtcaaaat

SEQ ID NO: 8237679 - DNA, 22 bp, Homo sapiens
gccatcacatccaggctacctc

SEQ ID NO: 8237680 - DNA, 22 bp, Homo sapiens
gccatatatattttgcactagg

SEQ ID NO: 8237681 - DNA, 22 bp, Homo sapiens
gccagtggtcactgaggaagaa

SEQ ID NO: 8237682 - DNA, 22 bp, Homo sapiens
gccagtggtcactgaggaagaa

SEQ ID NO: 8237683 - DNA, 22 bp, Homo sapiens
gccagtggtcactgaggaagaa

SEQ ID NO: 8237684 - DNA, 22 bp, Homo sapiens
gccagtggtcagtgggagggtg

SEQ ID NO: 8237685 - DNA, 22 bp, Homo sapiens
gccagtggtcagctacgcttag

SEQ ID NO: 8237686 - DNA, 22 bp, Homo sapiens
gccagtgggtagttggagctgg

SEQ ID NO: 8237687 - DNA, 22 bp, Homo sapiens
gccagtggtagaggggaggccg

SEQ ID NO: 8237688 - DNA, 18 bp, Homo sapiens
gccagtgggtccaggtgc

SEQ ID NO: 8237689 - DNA, 18 bp, Homo sapiens
gccagtgggtccaggtgc

SEQ ID NO: 8237690 - DNA, 22 bp, Homo sapiens
gccagggaaactgcagaccagc

SEQ ID NO: 8237691 - DNA, 22 bp, Homo sapiens
gccaggctgtttttattactgt

SEQ ID NO: 8237692 - DNA, 22 bp, Homo sapiens
gccaggctgtttttattactgt

SEQ ID NO: 8237693 - DNA, 22 bp, Homo sapiens
gccagtgggacccgctgtgggc

SEQ ID NO: 8237694 - DNA, 22 bp, Homo sapiens
gccagggaaactgcagaccagc

SEQ ID NO: 8237695 - DNA, 22 bp, Homo sapiens
gccaggctgtggggaacttgaa

SEQ ID NO: 8237696 - DNA, 22 bp, Homo sapiens
gccaggctgtggggaacttgaa

SEQ ID NO: 8237697 - DNA, 22 bp, Homo sapiens
gccaggctgtttttattactgt

SEQ ID NO: 8237698 - DNA, 22 bp, Homo sapiens
gccaggctgtttttattactgt

SEQ ID NO: 8237699 - DNA, 22 bp, Homo sapiens
gccaggctcttggttatgtttt

SEQ ID NO: 8237700 - DNA, 22 bp, Homo sapiens
gccaggctcttggttatgtttt

SEQ ID NO: 8237701 - DNA, 22 bp, Homo sapiens
gccaggctcttccatttgggtc

SEQ ID NO: 8237702 - DNA, 22 bp, Homo sapiens
gccaggctcttccatttgggtc

SEQ ID NO: 8237703 - DNA, 19 bp, Homo sapiens
gccaggctcttattctgtg

SEQ ID NO: 8237704 - DNA, 19 bp, Homo sapiens
gccaggctcttattctgtg

SEQ ID NO: 8237705 - DNA, 19 bp, Homo sapiens
gccaggctcttattctgtg

SEQ ID NO: 8237706 - DNA, 22 bp, Homo sapiens
gccagcagggcccaaatgctgg

SEQ ID NO: 8237707 - DNA, 22 bp, Homo sapiens
gccaggctctcagtgactgccc

SEQ ID NO: 8237708 - DNA, 22 bp, Homo sapiens
gccaggctgactcccccggcct

SEQ ID NO: 8237709 - DNA, 22 bp, Homo sapiens
gccaggctgactcccccggcct

SEQ ID NO: 8237710 - DNA, 22 bp, Homo sapiens
gccaggctcttggttatgtttt

SEQ ID NO: 8237711 - DNA, 22 bp, Homo sapiens
gccaggctgccttatctctagc

SEQ ID NO: 8237712 - DNA, 22 bp, Homo sapiens
gccaggctgccttatctctagc

SEQ ID NO: 8237713 - DNA, 22 bp, Homo sapiens
gccaggctgaggctctggaaga

SEQ ID NO: 8237714 - DNA, 22 bp, Homo sapiens
gccaggctgaggctctggaaga

SEQ ID NO: 8237715 - DNA, 22 bp, Homo sapiens
gccaggctgaggctctggaaga

SEQ ID NO: 8237716 - DNA, 22 bp, Homo sapiens
gccaggctggttatttaatgag

SEQ ID NO: 8237717 - DNA, 22 bp, Homo sapiens
gccaggctggttatttaatgag

SEQ ID NO: 8237718 - DNA, 22 bp, Homo sapiens
gccaggctggttatttaatgag

SEQ ID NO: 8237719 - DNA, 22 bp, Homo sapiens
gccaggctgtggggaacttgaa

SEQ ID NO: 8237720 - DNA, 22 bp, Homo sapiens
gccaggctggtgtcacaactct

SEQ ID NO: 8237721 - DNA, 22 bp, Homo sapiens
gccaggctggtgtcacaactct

SEQ ID NO: 8237722 - DNA, 22 bp, Homo sapiens
gccaggctggtgtcacaactct

SEQ ID NO: 8237723 - DNA, 22 bp, Homo sapiens
gccaggctgctggctgctgtcc

SEQ ID NO: 8237724 - DNA, 22 bp, Homo sapiens
gccaggctgccttatctctagc

SEQ ID NO: 8237725 - DNA, 22 bp, Homo sapiens
gccaggctgctccagggaggcc

SEQ ID NO: 8237726 - DNA, 22 bp, Homo sapiens
gccaggctgctccagggaggcc

SEQ ID NO: 8237727 - DNA, 22 bp, Homo sapiens
gccaggctgctccagggaggcc

SEQ ID NO: 8237728 - DNA, 22 bp, Homo sapiens
gccaggctgctggctgctgtcc

SEQ ID NO: 8237729 - DNA, 22 bp, Homo sapiens
gccaggctgctggctgctgtcc

SEQ ID NO: 8237730 - DNA, 22 bp, Homo sapiens
gccaggctgctggctgctgtcc

SEQ ID NO: 8237731 - DNA, 22 bp, Homo sapiens
gcccttccttagacagcaggat

SEQ ID NO: 8237732 - DNA, 22 bp, Homo sapiens
gcccttccttagacagcaggat

SEQ ID NO: 8237733 - DNA, 22 bp, Homo sapiens
gcccttggaacagcctcctgct

SEQ ID NO: 8237734 - DNA, 22 bp, Homo sapiens
gcccttggaaagccaaggcagc

SEQ ID NO: 8237735 - DNA, 22 bp, Homo sapiens
gcccttggcaaattctccttta

SEQ ID NO: 8237736 - DNA, 22 bp, Homo sapiens
gcccttggcctctttggcccgg

SEQ ID NO: 8237737 - DNA, 22 bp, Homo sapiens
gcccttgggaggttccactggg

SEQ ID NO: 8237738 - DNA, 22 bp, Homo sapiens
gccctttgtggtcagaggcctg

SEQ ID NO: 8237739 - DNA, 22 bp, Homo sapiens
gccgaacttgagggccaggcgg

SEQ ID NO: 8237740 - DNA, 22 bp, Homo sapiens
gcccttgggaggttccactggg

SEQ ID NO: 8237741 - DNA, 22 bp, Homo sapiens
gcccttggggtgtctgtaataa

SEQ ID NO: 8237742 - DNA, 22 bp, Homo sapiens
gcccttacagggtggtcagcca

SEQ ID NO: 8237743 - DNA, 22 bp, Homo sapiens
gccctgttctggacaggcacaa

SEQ ID NO: 8237744 - DNA, 22 bp, Homo sapiens
gccctctggcacagagatgcag

SEQ ID NO: 8237745 - DNA, 22 bp, Homo sapiens
gccctctggcacagagatgcag

SEQ ID NO: 8237746 - DNA, 22 bp, Homo sapiens
gccctctgcacagctctgagca

SEQ ID NO: 8237747 - DNA, 22 bp, Homo sapiens
gccctctgccacaggacgccag

SEQ ID NO: 8237748 - DNA, 22 bp, Homo sapiens
gcccaggctggagtgcagtggc

SEQ ID NO: 8237749 - DNA, 22 bp, Homo sapiens
gcccaggctggagtgcagtggc

SEQ ID NO: 8237750 - DNA, 22 bp, Homo sapiens
gccctcagatgggaaaggaggg

SEQ ID NO: 8237751 - DNA, 22 bp, Homo sapiens
gccctcagagttccccacagtg

SEQ ID NO: 8237752 - DNA, 22 bp, Homo sapiens
gccctcagatgggaaaggaggg

SEQ ID NO: 8237753 - DNA, 22 bp, Homo sapiens
gccctcagcaggaaagatcaac

SEQ ID NO: 8237754 - DNA, 17 bp, Homo sapiens
gccctcagctttaacca

SEQ ID NO: 8237755 - DNA, 22 bp, Homo sapiens
gccctcaggacaaggttacgct

SEQ ID NO: 8237756 - DNA, 19 bp, Homo sapiens
gccctcaggcagctccatc

SEQ ID NO: 8237757 - DNA, 22 bp, Homo sapiens
gccctcagcttgatgttgttct

SEQ ID NO: 8237758 - DNA, 22 bp, Homo sapiens
gccctcagctcctggacacatg

SEQ ID NO: 8237759 - DNA, 22 bp, Homo sapiens
gccctcagctcctggacacatg

SEQ ID NO: 8237760 - DNA, 22 bp, Homo sapiens
gccctcagcatcctcagggcca

SEQ ID NO: 8237761 - DNA, 22 bp, Homo sapiens
gccctcagcaggaaagatcaac

SEQ ID NO: 8237762 - DNA, 22 bp, Homo sapiens
gccctcagcaggaaagatcaac

SEQ ID NO: 8237763 - DNA, 23 bp, Homo sapiens
gccctcagtagaaaatgttagaa

SEQ ID NO: 8237764 - DNA, 21 bp, Homo sapiens
gccctcaggggaggatggcct

SEQ ID NO: 8237765 - DNA, 22 bp, Homo sapiens
gccctcagtgaccactgattca

SEQ ID NO: 8237766 - DNA, 20 bp, Homo sapiens
gccctcagtcttgtctttat

SEQ ID NO: 8237767 - DNA, 21 bp, Homo sapiens
gccctcaggggaggatggcct

SEQ ID NO: 8237768 - DNA, 21 bp, Homo sapiens
gccctcaggggaggatggcct

SEQ ID NO: 8237769 - DNA, 15 bp, Homo sapiens
gccctcaggcgacac

SEQ ID NO: 8237770 - DNA, 22 bp, Homo sapiens
gccctcaggcagggagtctttc

SEQ ID NO: 8237771 - DNA, 19 bp, Homo sapiens
gccctcaggcagctccatc

SEQ ID NO: 8237772 - DNA, 22 bp, Homo sapiens
gccctctcggcatagcaggggc

SEQ ID NO: 8237773 - DNA, 22 bp, Homo sapiens
gccctctcttctgcagcctcca

SEQ ID NO: 8237774 - DNA, 22 bp, Homo sapiens
gccctctcttctgcagcctcca

SEQ ID NO: 8237775 - DNA, 22 bp, Homo sapiens
gccctcgcttcttcctaggggt

SEQ ID NO: 8237776 - DNA, 22 bp, Homo sapiens
gccctctaccttggctatagaa

SEQ ID NO: 8237777 - DNA, 22 bp, Homo sapiens
gccctcctttgcttctcctagt

SEQ ID NO: 8237778 - DNA, 22 bp, Homo sapiens
gccctcctttgcttctcctagt

SEQ ID NO: 8237779 - DNA, 22 bp, Homo sapiens
gccctcagtggattcttattgt

SEQ ID NO: 8237780 - DNA, 22 bp, Homo sapiens
gcctctgcggggcccgagcccg

SEQ ID NO: 8237781 - DNA, 22 bp, Homo sapiens
gcctctgcggggcccgagcccg

SEQ ID NO: 8237782 - DNA, 22 bp, Homo sapiens
gcctctgcggagctgtacatca

SEQ ID NO: 8237783 - DNA, 22 bp, Homo sapiens
gcctctgctcggactttgcctc

SEQ ID NO: 8237784 - DNA, 22 bp, Homo sapiens
gcctctgctcggactttgcctc

SEQ ID NO: 8237785 - DNA, 22 bp, Homo sapiens
gcctctgcggagctgtacatca

SEQ ID NO: 8237786 - DNA, 22 bp, Homo sapiens
gcctctgcggagctgtacatca

SEQ ID NO: 8237787 - DNA, 22 bp, Homo sapiens
gcctctgctctcaggtagcctc

SEQ ID NO: 8237788 - DNA, 22 bp, Homo sapiens
gcctctgctctcaggtagcctc

SEQ ID NO: 8237789 - DNA, 22 bp, Homo sapiens
gcctctgctgcaagcctggttg

SEQ ID NO: 8237790 - DNA, 22 bp, Homo sapiens
gcctctgctgcaagcctggttg

SEQ ID NO: 8237791 - DNA, 22 bp, Homo sapiens
gcctctgctgacaagatggaca

SEQ ID NO: 8237792 - DNA, 19 bp, Homo sapiens
gcctctgctggggacaggc

SEQ ID NO: 8237793 - DNA, 19 bp, Homo sapiens
gcctctgctggggacaggc

SEQ ID NO: 8237794 - DNA, 19 bp, Homo sapiens
gcctctgctggggacaggc

SEQ ID NO: 8237795 - DNA, 19 bp, Homo sapiens
gcctctgctggggacaggc

SEQ ID NO: 8237796 - DNA, 19 bp, Homo sapiens
gcctctgctggggacaggc

SEQ ID NO: 8237797 - DNA, 22 bp, Homo sapiens
gcctctgcaactccgccttggt

SEQ ID NO: 8237798 - DNA, 22 bp, Homo sapiens
gcctctgcaccagtactgtgcc

SEQ ID NO: 8237799 - DNA, 22 bp, Homo sapiens
gcctctgcaattacattgtgcc

SEQ ID NO: 8237800 - DNA, 22 bp, Homo sapiens
gcctctgcaccagtactgtgcc

SEQ ID NO: 8237801 - DNA, 22 bp, Homo sapiens
gcctctgcactgtggcacacca

SEQ ID NO: 8237802 - DNA, 22 bp, Homo sapiens
gcctctgcactgtggcacacca

SEQ ID NO: 8237803 - DNA, 22 bp, Homo sapiens
gcctctgcactgtggcacacca

SEQ ID NO: 8237804 - DNA, 23 bp, Homo sapiens
gcctctgcagcctagttagtgtc

SEQ ID NO: 8237805 - DNA, 22 bp, Homo sapiens
gcctctgcatgctcagcaccca

SEQ ID NO: 8237806 - DNA, 22 bp, Homo sapiens
gcctctgcatcttcgccgcact

SEQ ID NO: 8237807 - DNA, 22 bp, Homo sapiens
gcctctgcatcatcactccagc

SEQ ID NO: 8237808 - DNA, 22 bp, Homo sapiens
gcctctgcatcatcactccagc

SEQ ID NO: 8237809 - DNA, 22 bp, Homo sapiens
gcctctgcatcatcactccagc

SEQ ID NO: 8237810 - DNA, 22 bp, Homo sapiens
gcctctgccaagggggctgcgg

SEQ ID NO: 8237811 - DNA, 22 bp, Homo sapiens
gcctctgcccatccaccatcag

SEQ ID NO: 8237812 - DNA, 22 bp, Homo sapiens
gcctctgcccatccaccatcag

SEQ ID NO: 8237813 - DNA, 22 bp, Homo sapiens
gcctctgcccatccaccatcag

SEQ ID NO: 8237814 - DNA, 22 bp, Homo sapiens
gcctctgccaagggggctgcgg

SEQ ID NO: 8237815 - DNA, 22 bp, Homo sapiens
gccgtccacctcgatggccact

SEQ ID NO: 8237816 - DNA, 22 bp, Homo sapiens
gccgggttcaagccattctcct

SEQ ID NO: 8237817 - DNA, 22 bp, Homo sapiens
gcctcctgtcccaggctgagga

SEQ ID NO: 8237818 - DNA, 22 bp, Homo sapiens
gccgtgtgggcaacatggtcat

SEQ ID NO: 8237819 - DNA, 22 bp, Homo sapiens
gcctaacttggctttgttcacc

SEQ ID NO: 8237820 - DNA, 19 bp, Homo sapiens
gcctaaatgtggaattagt

SEQ ID NO: 8237821 - DNA, 22 bp, Homo sapiens
gcctcctgttatgccatgtgcc

SEQ ID NO: 8237822 - DNA, 22 bp, Homo sapiens
gcctcctgttatgccatgtgcc

SEQ ID NO: 8237823 - DNA, 22 bp, Homo sapiens
gcctcctgtcccaggctgagga

SEQ ID NO: 8237824 - DNA, 22 bp, Homo sapiens
gcctcctgtcccaggctgagga

SEQ ID NO: 8237825 - DNA, 22 bp, Homo sapiens
gccgaggctctgcccagctgct

SEQ ID NO: 8237826 - DNA, 21 bp, Homo sapiens
gccgctgctgcgtgtcccttt

SEQ ID NO: 8237827 - DNA, 22 bp, Homo sapiens
gccgctggaaggtgagtgacgt

SEQ ID NO: 8237828 - DNA, 22 bp, Homo sapiens
gccgccgctgtgcaatttagca

SEQ ID NO: 8237829 - DNA, 22 bp, Homo sapiens
gccgccctctgcaggggctgag

SEQ ID NO: 8237830 - DNA, 22 bp, Homo sapiens
gccgccgctgtgcaatttagca

SEQ ID NO: 8237831 - DNA, 22 bp, Homo sapiens
gccgaggctctgcccagctgct

SEQ ID NO: 8237832 - DNA, 22 bp, Homo sapiens
gccgaggctctgcccagctgct

SEQ ID NO: 8237833 - DNA, 22 bp, Homo sapiens
gccgggaccaaggccacggagc

SEQ ID NO: 8237834 - DNA, 22 bp, Homo sapiens
gccgggaccaaggccacggagc

SEQ ID NO: 8237835 - DNA, 22 bp, Homo sapiens
gccggggctggggagagacatg

SEQ ID NO: 8237836 - DNA, 22 bp, Homo sapiens
gccggggctggggagagacatg

SEQ ID NO: 8237837 - DNA, 22 bp, Homo sapiens
gccggggctggggagagacatg

SEQ ID NO: 8237838 - DNA, 22 bp, Homo sapiens
gccggggctggggagagacatg

SEQ ID NO: 8237839 - DNA, 22 bp, Homo sapiens
gcctgggaactctgatctcctg

SEQ ID NO: 8237840 - DNA, 22 bp, Homo sapiens
gcctgggaaatggtggggtcag

SEQ ID NO: 8237841 - DNA, 21 bp, Homo sapiens
gcctgggaaatctgggaagcc

SEQ ID NO: 8237842 - DNA, 22 bp, Homo sapiens
gcctgggaaagagtagggaaat

SEQ ID NO: 8237843 - DNA, 21 bp, Homo sapiens
gcctgggaaatctgggaagcc

SEQ ID NO: 8237844 - DNA, 22 bp, Homo sapiens
gcctgggaaagagtagggaaat

SEQ ID NO: 8237845 - DNA, 22 bp, Homo sapiens
gcctgggaaagagtagggaaat

SEQ ID NO: 8237846 - DNA, 22 bp, Homo sapiens
gcctggcctgaactaggaggtg

SEQ ID NO: 8237847 - DNA, 22 bp, Homo sapiens
gcctggctaagcagaaggaccc

SEQ ID NO: 8237848 - DNA, 22 bp, Homo sapiens
gcctggccgctccgagctccgc

SEQ ID NO: 8237849 - DNA, 22 bp, Homo sapiens
gcctggccgctccgagctccgc

SEQ ID NO: 8237850 - DNA, 22 bp, Homo sapiens
gcctggccgctccgagctccgc

SEQ ID NO: 8237851 - DNA, 22 bp, Homo sapiens
gcctggcctgaactaggaggtg

SEQ ID NO: 8237852 - DNA, 22 bp, Homo sapiens
gcctggccgggtcttggatttt

SEQ ID NO: 8237853 - DNA, 22 bp, Homo sapiens
gcctggccgctccgagctccgc

SEQ ID NO: 8237854 - DNA, 22 bp, Homo sapiens
gcctggcccagggctcttgttg

SEQ ID NO: 8237855 - DNA, 22 bp, Homo sapiens
gcctggccgctccgagctccgc

SEQ ID NO: 8237856 - DNA, 22 bp, Homo sapiens
gcctggccgctccgagctccgc

SEQ ID NO: 8237857 - DNA, 22 bp, Homo sapiens
gcctggcccagggctccgcagg

SEQ ID NO: 8237858 - DNA, 22 bp, Homo sapiens
gcctggcccagggctcttgttg

SEQ ID NO: 8237859 - DNA, 22 bp, Homo sapiens
gcctggcccagggctccgcagg

SEQ ID NO: 8237860 - DNA, 22 bp, Homo sapiens
gcctggcccagggctccgcagg

SEQ ID NO: 8237861 - DNA, 23 bp, Homo sapiens
gcctggccaccccagggctgctt

SEQ ID NO: 8237862 - DNA, 23 bp, Homo sapiens
gcctggccaccccagggctgctt

SEQ ID NO: 8237863 - DNA, 23 bp, Homo sapiens
gcctggccaccccagggctgctt

SEQ ID NO: 8237864 - DNA, 23 bp, Homo sapiens
gcctggccaccccagggctgctt

SEQ ID NO: 8237865 - DNA, 17 bp, Homo sapiens
gcctggcccagcctggc

SEQ ID NO: 8237866 - DNA, 17 bp, Homo sapiens
gcctggcccagcctggc

SEQ ID NO: 8237867 - DNA, 17 bp, Homo sapiens
gcctggcccagcctggc

SEQ ID NO: 8237868 - DNA, 17 bp, Homo sapiens
gcctggcccagcctggc

SEQ ID NO: 8237869 - DNA, 17 bp, Homo sapiens
gcctggcccagcctggc

SEQ ID NO: 8237870 - DNA, 17 bp, Homo sapiens
gcctggcccagcctggc

SEQ ID NO: 8237871 - DNA, 22 bp, Homo sapiens
gcctggcaggcctgggccagca

SEQ ID NO: 8237872 - DNA, 22 bp, Homo sapiens
gcctggagtagcatggcaagcc

SEQ ID NO: 8237873 - DNA, 22 bp, Homo sapiens
gcctggcaggcctcatgagggg

SEQ ID NO: 8237874 - DNA, 22 bp, Homo sapiens
gcctggcaggcctgggccagca

SEQ ID NO: 8237875 - DNA, 22 bp, Homo sapiens
gcctggcaggcctgggccagca

SEQ ID NO: 8237876 - DNA, 22 bp, Homo sapiens
gcctggcaggcctgggccagca

SEQ ID NO: 8237877 - DNA, 22 bp, Homo sapiens
gcctggcagggagattgtaaga

SEQ ID NO: 8237878 - DNA, 22 bp, Homo sapiens
gcctggcaggcctgttggggct

SEQ ID NO: 8237879 - DNA, 22 bp, Homo sapiens
gcctggcagggcccggacggca

SEQ ID NO: 8237880 - DNA, 22 bp, Homo sapiens
gcctggcagggagattgtaaga

SEQ ID NO: 8237881 - DNA, 22 bp, Homo sapiens
gcctggcagggcccggacggca

SEQ ID NO: 8237882 - DNA, 22 bp, Homo sapiens
gcctggcaggcctgttggggct

SEQ ID NO: 8237883 - DNA, 22 bp, Homo sapiens
gcctggcaggcctgttggggct

SEQ ID NO: 8237884 - DNA, 22 bp, Homo sapiens
gcctggcaggcctgttggggct

SEQ ID NO: 8237885 - DNA, 22 bp, Homo sapiens
gcctggagtactccttgaagtg

SEQ ID NO: 8237886 - DNA, 22 bp, Homo sapiens
gcctggagggttgaggttttgt

SEQ ID NO: 8237887 - DNA, 22 bp, Homo sapiens
gcctggagggttgaggttttgt

SEQ ID NO: 8237888 - DNA, 22 bp, Homo sapiens
gcctggagtactccttgaagtg

SEQ ID NO: 8237889 - DNA, 22 bp, Homo sapiens
gcctggagtactccttgaagtg

SEQ ID NO: 8237890 - DNA, 22 bp, Homo sapiens
gcctggagtactccttgaagtg

SEQ ID NO: 8237891 - DNA, 22 bp, Homo sapiens
gcctggagtagcatggcaagcc

SEQ ID NO: 8237892 - DNA, 22 bp, Homo sapiens
gcctggagtagcatggcaagcc

SEQ ID NO: 8237893 - DNA, 22 bp, Homo sapiens
gcctggagtagcatggcaagcc

SEQ ID NO: 8237894 - DNA, 21 bp, Homo sapiens
gcctggcaggtggaagggctc

SEQ ID NO: 8237895 - DNA, 21 bp, Homo sapiens
gcctggcaggtggaagggctc

SEQ ID NO: 8237896 - DNA, 21 bp, Homo sapiens
gcctggcaggtggaagggctc

SEQ ID NO: 8237897 - DNA, 22 bp, Homo sapiens
gcctggcagtgatgtcttttgg

SEQ ID NO: 8237898 - DNA, 22 bp, Homo sapiens
gcctggcagtgatgtcttttgg

SEQ ID NO: 8237899 - DNA, 22 bp, Homo sapiens
gcctggcagtggggccctggga

SEQ ID NO: 8237900 - DNA, 22 bp, Homo sapiens
gcctggcagggcccggacggca

SEQ ID NO: 8237901 - DNA, 22 bp, Homo sapiens
gcctggcaggggcctgggagtg

SEQ ID NO: 8237902 - DNA, 22 bp, Homo sapiens
gcctggcaggggcctgggagtg

SEQ ID NO: 8237903 - DNA, 22 bp, Homo sapiens
gcctggcaggggcctgggagtg

SEQ ID NO: 8237904 - DNA, 22 bp, Homo sapiens
gcctggcaggggcctgggagtg

SEQ ID NO: 8237905 - DNA, 21 bp, Homo sapiens
gcctggcaggtggaagggctc

SEQ ID NO: 8237906 - DNA, 19 bp, Homo sapiens
gcctggcagtgtacaaggc

SEQ ID NO: 8237907 - DNA, 22 bp, Homo sapiens
gcctggcagttgacagtttgct

SEQ ID NO: 8237908 - DNA, 22 bp, Homo sapiens
gcctggcagttgacagtttgct

SEQ ID NO: 8237909 - DNA, 19 bp, Homo sapiens
gcctggcagtgtacaaggc

SEQ ID NO: 8237910 - DNA, 22 bp, Homo sapiens
gcctggcagtgtaattcctgtc

SEQ ID NO: 8237911 - DNA, 22 bp, Homo sapiens
gcctggcagtgtaattcctgtc

SEQ ID NO: 8237912 - DNA, 22 bp, Homo sapiens
gcctggcagtggggccctggga

SEQ ID NO: 8237913 - DNA, 22 bp, Homo sapiens
gcctggcagtggggccctggga

SEQ ID NO: 8237914 - DNA, 22 bp, Homo sapiens
gcctggcattacagcactcctg

SEQ ID NO: 8237915 - DNA, 22 bp, Homo sapiens
gcctggcattacagcactcctg

SEQ ID NO: 8237916 - DNA, 22 bp, Homo sapiens
gcctggcatatagtagttgtgc

SEQ ID NO: 8237917 - DNA, 22 bp, Homo sapiens
gcctggcatatagtagttgtgc

SEQ ID NO: 8237918 - DNA, 22 bp, Homo sapiens
gcctggcattggagccggggca

SEQ ID NO: 8237919 - DNA, 22 bp, Homo sapiens
gcctggcattggagccggggca

SEQ ID NO: 8237920 - DNA, 23 bp, Homo sapiens
gcctgggactggtagtgtgacct

SEQ ID NO: 8237921 - DNA, 23 bp, Homo sapiens
gcctgggactggtagtgtgacct

SEQ ID NO: 8237922 - DNA, 23 bp, Homo sapiens
gcctgggactggtagtgtgacct

SEQ ID NO: 8237923 - DNA, 22 bp, Homo sapiens
gcctgggactggatgtgtttgt

SEQ ID NO: 8237924 - DNA, 22 bp, Homo sapiens
gcctgggactgcagatccccag

SEQ ID NO: 8237925 - DNA, 23 bp, Homo sapiens
gcctgggactcaggaggagctca

SEQ ID NO: 8237926 - DNA, 23 bp, Homo sapiens
gcctgggactcaggaggagctca

SEQ ID NO: 8237927 - DNA, 22 bp, Homo sapiens
gcctgggaactctgatctcctg

SEQ ID NO: 8237928 - DNA, 22 bp, Homo sapiens
gcctgggaagactaagtgggag

SEQ ID NO: 8237929 - DNA, 23 bp, Homo sapiens
gcctgggactcaggaggagctca

SEQ ID NO: 8237930 - DNA, 23 bp, Homo sapiens
gcctgggactcaggaggagctca

SEQ ID NO: 8237931 - DNA, 21 bp, Homo sapiens
gcctgggaagagaaaggtaag

SEQ ID NO: 8237932 - DNA, 19 bp, Homo sapiens
gcctgggatgggcagaact

SEQ ID NO: 8237933 - DNA, 19 bp, Homo sapiens
gcctgggatgggcagaact

SEQ ID NO: 8237934 - DNA, 22 bp, Homo sapiens
gcctgggattctcaaaggggtg

SEQ ID NO: 8237935 - DNA, 22 bp, Homo sapiens
gcctgggattcccagaggggca

SEQ ID NO: 8237936 - DNA, 21 bp, Homo sapiens
gcctgggatagtggcctccgg

SEQ ID NO: 8237937 - DNA, 21 bp, Homo sapiens
gcctgggatagtggcctccgg

SEQ ID NO: 8237938 - DNA, 21 bp, Homo sapiens
gcctgggatagtggcctccgg

SEQ ID NO: 8237939 - DNA, 19 bp, Homo sapiens
gcctgggatgggcagaact

SEQ ID NO: 8237940 - DNA, 19 bp, Homo sapiens
gcctgggatgggcagaact

SEQ ID NO: 8237941 - DNA, 22 bp, Homo sapiens
gcctgggagaatgacctccaac

SEQ ID NO: 8237942 - DNA, 22 bp, Homo sapiens
gcctgggatagaggcaatgcat

SEQ ID NO: 8237943 - DNA, 22 bp, Homo sapiens
gcctgggatagaggcaatgcat

SEQ ID NO: 8237944 - DNA, 22 bp, Homo sapiens
gcctgggatagaggcaatgcat

SEQ ID NO: 8237945 - DNA, 22 bp, Homo sapiens
gcctgtgggttggagcttggcc

SEQ ID NO: 8237946 - DNA, 22 bp, Homo sapiens
gcctgtggggctgaggctgcct

SEQ ID NO: 8237947 - DNA, 22 bp, Homo sapiens
gcctgtggggctgaggctgcct

SEQ ID NO: 8237948 - DNA, 22 bp, Homo sapiens
gcctgtggggctgaggctgcct

SEQ ID NO: 8237949 - DNA, 22 bp, Homo sapiens
gcctgtgtctgggtggccagag

SEQ ID NO: 8237950 - DNA, 22 bp, Homo sapiens
gcctgtgtccttcccagtgggg

SEQ ID NO: 8237951 - DNA, 22 bp, Homo sapiens
gcctgtgtccttcccagtgggg

SEQ ID NO: 8237952 - DNA, 22 bp, Homo sapiens
gcctgtgtcatgtagtagcttc

SEQ ID NO: 8237953 - DNA, 21 bp, Homo sapiens
gcctgtgtaaattgagtttcc

SEQ ID NO: 8237954 - DNA, 22 bp, Homo sapiens
gcctgtgtggatgcgccggtgc

SEQ ID NO: 8237955 - DNA, 22 bp, Homo sapiens
gcctgtgtggatgcgccggtgc

SEQ ID NO: 8237956 - DNA, 22 bp, Homo sapiens
gcctgtgtggatgggcccctgg

SEQ ID NO: 8237957 - DNA, 22 bp, Homo sapiens
gcctgtgtggatgggcccctgg

SEQ ID NO: 8237958 - DNA, 22 bp, Homo sapiens
gcctgtgtgtttagctctgggg

SEQ ID NO: 8237959 - DNA, 22 bp, Homo sapiens
gcctgtgtttttaactctagga

SEQ ID NO: 8237960 - DNA, 22 bp, Homo sapiens
gcctgttggtgactttctgttg

SEQ ID NO: 8237961 - DNA, 21 bp, Homo sapiens
gcctgtggagcccaagggccc

SEQ ID NO: 8237962 - DNA, 19 bp, Homo sapiens
gcctgtggcttgatgttgg

SEQ ID NO: 8237963 - DNA, 22 bp, Homo sapiens
gcctgtcaattttgtgtacaat

SEQ ID NO: 8237964 - DNA, 22 bp, Homo sapiens
gcctggtgtctccccaaggaag

SEQ ID NO: 8237965 - DNA, 22 bp, Homo sapiens
gcctggtgtgcgccgcgcagct

SEQ ID NO: 8237966 - DNA, 22 bp, Homo sapiens
gcctggtgtctccccaaggaag

SEQ ID NO: 8237967 - DNA, 22 bp, Homo sapiens
gcctggtgtccagaggcgagtg

SEQ ID NO: 8237968 - DNA, 22 bp, Homo sapiens
gcctgggattgtgtaagtgaat

SEQ ID NO: 8237969 - DNA, 22 bp, Homo sapiens
gcctgcctttgtgaggaagcgg

SEQ ID NO: 8237970 - DNA, 22 bp, Homo sapiens
gcctgcctttgtgaggaagcgg

SEQ ID NO: 8237971 - DNA, 22 bp, Homo sapiens
gcctgccttttggaggcacatt

SEQ ID NO: 8237972 - DNA, 22 bp, Homo sapiens
gcctgccttttggaggcacatt

SEQ ID NO: 8237973 - DNA, 22 bp, Homo sapiens
gcctgccttttggaggcacatt

SEQ ID NO: 8237974 - DNA, 18 bp, Homo sapiens
gcctgctctgctctcccc

SEQ ID NO: 8237975 - DNA, 22 bp, Homo sapiens
gcctgctgggagacacccccag

SEQ ID NO: 8237976 - DNA, 22 bp, Homo sapiens
gcctgctctccggatccctgat

SEQ ID NO: 8237977 - DNA, 22 bp, Homo sapiens
gcctgctcagacctagcaggcc

SEQ ID NO: 8237978 - DNA, 22 bp, Homo sapiens
gcctgctgttaactgcaggaat

SEQ ID NO: 8237979 - DNA, 22 bp, Homo sapiens
gcctgctgttaactgcaggaat

SEQ ID NO: 8237980 - DNA, 21 bp, Homo sapiens
gcctgctgttcaccctgccac

SEQ ID NO: 8237981 - DNA, 21 bp, Homo sapiens
gcctgctgttcaccctgccac

SEQ ID NO: 8237982 - DNA, 22 bp, Homo sapiens
gcctgctgttgagggaagagct

SEQ ID NO: 8237983 - DNA, 22 bp, Homo sapiens
gcctgctgttgagggaagagct

SEQ ID NO: 8237984 - DNA, 22 bp, Homo sapiens
gcctgctttgtgcctgatcttt

SEQ ID NO: 8237985 - DNA, 22 bp, Homo sapiens
gcctggaaacagtgagcgaagg

SEQ ID NO: 8237986 - DNA, 22 bp, Homo sapiens
gcctgcttccttttcatagatg

SEQ ID NO: 8237987 - DNA, 22 bp, Homo sapiens
gcctgcttcctagccttccaag

SEQ ID NO: 8237988 - DNA, 22 bp, Homo sapiens
gcctggaagtgtgtcgtgggaa

SEQ ID NO: 8237989 - DNA, 22 bp, Homo sapiens
gcctggaatcatgcaggggtta

SEQ ID NO: 8237990 - DNA, 22 bp, Homo sapiens
gcctggaatgcaatgtgacgaa

SEQ ID NO: 8237991 - DNA, 22 bp, Homo sapiens
gcctggaagtccagagtacatt

SEQ ID NO: 8237992 - DNA, 22 bp, Homo sapiens
gcctggaaattgaggcacagtt

SEQ ID NO: 8237993 - DNA, 22 bp, Homo sapiens
gcctggaaattgaggcacagtt

SEQ ID NO: 8237994 - DNA, 22 bp, Homo sapiens
gcctggaggggccagggtggta

SEQ ID NO: 8237995 - DNA, 22 bp, Homo sapiens
gcctggaggggccagggtggta

SEQ ID NO: 8237996 - DNA, 22 bp, Homo sapiens
gcctggaggggccagggtggta

SEQ ID NO: 8237997 - DNA, 22 bp, Homo sapiens
gcctggaggggccagggtggta

SEQ ID NO: 8237998 - DNA, 22 bp, Homo sapiens
gcctggaggggccagggtggta

SEQ ID NO: 8237999 - DNA, 22 bp, Homo sapiens
gcctggaggggccagggtggta

SEQ ID NO: 8238000 - DNA, 22 bp, Homo sapiens
gcctggagggtccctctctgga

SEQ ID NO: 8238001 - DNA, 22 bp, Homo sapiens
gcctggagggtccctctctgga

SEQ ID NO: 8238002 - DNA, 22 bp, Homo sapiens
gcctggagggtccctctctgga

SEQ ID NO: 8238003 - DNA, 22 bp, Homo sapiens
gcctggagggtccctctctgga

SEQ ID NO: 8238004 - DNA, 22 bp, Homo sapiens
gcctggagggtccctctctgga

SEQ ID NO: 8238005 - DNA, 22 bp, Homo sapiens
gcctggagggtccctctctgga

SEQ ID NO: 8238006 - DNA, 22 bp, Homo sapiens
gcctggagggtccctctctgga

SEQ ID NO: 8238007 - DNA, 22 bp, Homo sapiens
gcctggaggggacagtctctgg

SEQ ID NO: 8238008 - DNA, 22 bp, Homo sapiens
gcctggaggggacagtctctgg

SEQ ID NO: 8238009 - DNA, 22 bp, Homo sapiens
gcctggaggggacagtctctgg

SEQ ID NO: 8238010 - DNA, 22 bp, Homo sapiens
gcctggaggggacagtctctgg

SEQ ID NO: 8238011 - DNA, 22 bp, Homo sapiens
gcctggaggggccagggtggta

SEQ ID NO: 8238012 - DNA, 22 bp, Homo sapiens
gcctggaggggacagtctctgg

SEQ ID NO: 8238013 - DNA, 22 bp, Homo sapiens
gcctggaggggacagtctctgg

SEQ ID NO: 8238014 - DNA, 22 bp, Homo sapiens
gcctggagggctctagagaggc

SEQ ID NO: 8238015 - DNA, 22 bp, Homo sapiens
gcctggaggggacagtctctgg

SEQ ID NO: 8238016 - DNA, 22 bp, Homo sapiens
gcctggagggctctagagaggc

SEQ ID NO: 8238017 - DNA, 22 bp, Homo sapiens
gcctggagggctctagagaggc

SEQ ID NO: 8238018 - DNA, 22 bp, Homo sapiens
gcctggagggctctagagaggc

SEQ ID NO: 8238019 - DNA, 22 bp, Homo sapiens
gcctggagcctcagcaaggagg

SEQ ID NO: 8238020 - DNA, 22 bp, Homo sapiens
gcctggagcctcagcaaggagg

SEQ ID NO: 8238021 - DNA, 22 bp, Homo sapiens
gcctggagcctcagcaaggagg

SEQ ID NO: 8238022 - DNA, 22 bp, Homo sapiens
gcctggacaccgcccttgcaga

SEQ ID NO: 8238023 - DNA, 20 bp, Homo sapiens
gcctggaggcaatgggaaga

SEQ ID NO: 8238024 - DNA, 20 bp, Homo sapiens
gcctggaggcaatgggaaga

SEQ ID NO: 8238025 - DNA, 20 bp, Homo sapiens
gcctggaggcaatgggaaga

SEQ ID NO: 8238026 - DNA, 22 bp, Homo sapiens
gcctggagcctcagcaaggagg

SEQ ID NO: 8238027 - DNA, 22 bp, Homo sapiens
gcctggagcctcagcaaggagg

SEQ ID NO: 8238028 - DNA, 20 bp, Homo sapiens
gcctggaggcagagataaag

SEQ ID NO: 8238029 - DNA, 20 bp, Homo sapiens
gcctggaggcagagataaag

SEQ ID NO: 8238030 - DNA, 20 bp, Homo sapiens
gcctggaggcagagataaag

SEQ ID NO: 8238031 - DNA, 22 bp, Homo sapiens
gcctggaggcgagaacccaatg

SEQ ID NO: 8238032 - DNA, 20 bp, Homo sapiens
gcctggaggcagagataaag

SEQ ID NO: 8238033 - DNA, 20 bp, Homo sapiens
gcctggaggcagagataaag

SEQ ID NO: 8238034 - DNA, 22 bp, Homo sapiens
gcctggagggatagaatgcaag

SEQ ID NO: 8238035 - DNA, 22 bp, Homo sapiens
gcctggagggatagaatgcaag

SEQ ID NO: 8238036 - DNA, 22 bp, Homo sapiens
gcctggagggctctagagaggc

SEQ ID NO: 8238037 - DNA, 22 bp, Homo sapiens
gcctggaggcgagaacccaatg

SEQ ID NO: 8238038 - DNA, 22 bp, Homo sapiens
gcctggaggcgagaacccaatg

SEQ ID NO: 8238039 - DNA, 22 bp, Homo sapiens
gcctggagggatagaatgcaag

SEQ ID NO: 8238040 - DNA, 22 bp, Homo sapiens
gcctgccttcggtgcgcagcgg

SEQ ID NO: 8238041 - DNA, 22 bp, Homo sapiens
gcctgccttcggtgcgcagcgg

SEQ ID NO: 8238042 - DNA, 22 bp, Homo sapiens
gcctgccttcggtgcgcagcgg

SEQ ID NO: 8238043 - DNA, 22 bp, Homo sapiens
gcctgccttcggtgcgcagcgg

SEQ ID NO: 8238044 - DNA, 22 bp, Homo sapiens
gcctgcctttgtgaggaagcgg

SEQ ID NO: 8238045 - DNA, 22 bp, Homo sapiens
gcctgcctttgtatgaccctga

SEQ ID NO: 8238046 - DNA, 22 bp, Homo sapiens
gcctgcctttgtatgaccctga

SEQ ID NO: 8238047 - DNA, 22 bp, Homo sapiens
gcctgccttcggtgcgcagcgg

SEQ ID NO: 8238048 - DNA, 22 bp, Homo sapiens
gcctgcctgttggctgaggtgc

SEQ ID NO: 8238049 - DNA, 22 bp, Homo sapiens
gcctgcctgttggctgaggtgc

SEQ ID NO: 8238050 - DNA, 19 bp, Homo sapiens
gcctgcctgggtttctgag

SEQ ID NO: 8238051 - DNA, 19 bp, Homo sapiens
gcctgcctgggtttctgag

SEQ ID NO: 8238052 - DNA, 22 bp, Homo sapiens
gcctgcctgttggctgaggtgc

SEQ ID NO: 8238053 - DNA, 22 bp, Homo sapiens
gcctgcctgctgtgtgcaagtt

SEQ ID NO: 8238054 - DNA, 22 bp, Homo sapiens
gcctgcctggagcttgaggtga

SEQ ID NO: 8238055 - DNA, 22 bp, Homo sapiens
gcctgcctgctgtgtgcaagtt

SEQ ID NO: 8238056 - DNA, 22 bp, Homo sapiens
gcctgcctgctgtgtgcaagtt

SEQ ID NO: 8238057 - DNA, 22 bp, Homo sapiens
gcctgcctggagcttgaggtga

SEQ ID NO: 8238058 - DNA, 22 bp, Homo sapiens
gcctgcctgctgtcatctgcct

SEQ ID NO: 8238059 - DNA, 22 bp, Homo sapiens
gcctgcctgctgtcatctgcct

SEQ ID NO: 8238060 - DNA, 22 bp, Homo sapiens
gcctgcctgctgtcatctgcct

SEQ ID NO: 8238061 - DNA, 22 bp, Homo sapiens
gcctgcctgctgtcatctgcct

SEQ ID NO: 8238062 - DNA, 22 bp, Homo sapiens
gcctgcctgctgtcatctgcct

SEQ ID NO: 8238063 - DNA, 21 bp, Homo sapiens
gcctgcctgcgtgaccctctt

SEQ ID NO: 8238064 - DNA, 21 bp, Homo sapiens
gcctgcctgcgtgaccctctt

SEQ ID NO: 8238065 - DNA, 23 bp, Homo sapiens
gcctgcctgacctgtgcaaagtc

SEQ ID NO: 8238066 - DNA, 20 bp, Homo sapiens
gcctgcctcagctagctgag

SEQ ID NO: 8238067 - DNA, 20 bp, Homo sapiens
gcctgcctcagctagctgag

SEQ ID NO: 8238068 - DNA, 22 bp, Homo sapiens
gcctgcctgaaggctgtaccag

SEQ ID NO: 8238069 - DNA, 22 bp, Homo sapiens
gcctgcctcaaaatcccagttc

SEQ ID NO: 8238070 - DNA, 20 bp, Homo sapiens
gcctgcctcagctagctgag

SEQ ID NO: 8238071 - DNA, 20 bp, Homo sapiens
gcctgcctcagctagctgag

SEQ ID NO: 8238072 - DNA, 20 bp, Homo sapiens
gcctgcctcagctagctgag

SEQ ID NO: 8238073 - DNA, 18 bp, Homo sapiens
gcctgcctagagcttgcc

SEQ ID NO: 8238074 - DNA, 22 bp, Homo sapiens
gcctgcctcaaaatcccagttc

SEQ ID NO: 8238075 - DNA, 22 bp, Homo sapiens
gcctgccagccacagtggcagc

SEQ ID NO: 8238076 - DNA, 23 bp, Homo sapiens
gcctgccatatacctggaaacag

SEQ ID NO: 8238077 - DNA, 22 bp, Homo sapiens
gcctgccaaaagaagctgctgg

SEQ ID NO: 8238078 - DNA, 23 bp, Homo sapiens
gcctctggagccccagtgctcag

SEQ ID NO: 8238079 - DNA, 22 bp, Homo sapiens
gcctgccacgcatgcagagtca

SEQ ID NO: 8238080 - DNA, 18 bp, Homo sapiens
gcctgccaactcctgatc

SEQ ID NO: 8238081 - DNA, 23 bp, Homo sapiens
gcctctggagccccagtgctcag

SEQ ID NO: 8238082 - DNA, 20 bp, Homo sapiens
gcctctggagccaaggacca

SEQ ID NO: 8238083 - DNA, 20 bp, Homo sapiens
gcctctggagccaaggacca

SEQ ID NO: 8238084 - DNA, 20 bp, Homo sapiens
gcctctggagccaaggacca

SEQ ID NO: 8238085 - DNA, 20 bp, Homo sapiens
gcctctggagccaaggacca

SEQ ID NO: 8238086 - DNA, 20 bp, Homo sapiens
gcctctggagccaaggacca

SEQ ID NO: 8238087 - DNA, 22 bp, Homo sapiens
gcctctggaagtgggaaggggt

SEQ ID NO: 8238088 - DNA, 22 bp, Homo sapiens
gcctctggaagtgggaaggggt

SEQ ID NO: 8238089 - DNA, 22 bp, Homo sapiens
gcctctggaagaattacatcca

SEQ ID NO: 8238090 - DNA, 17 bp, Homo sapiens
gcctctgcttgtgtcat

SEQ ID NO: 8238091 - DNA, 22 bp, Homo sapiens
tttcagttcagtttattatatc

SEQ ID NO: 8238092 - DNA, 20 bp, Homo sapiens
tttcagttatcttgaccttc

SEQ ID NO: 8238093 - DNA, 22 bp, Homo sapiens
tttcagtgtgtaaattgaaata

SEQ ID NO: 8238094 - DNA, 22 bp, Homo sapiens
tttcagtgttatgactttcatt

SEQ ID NO: 8238095 - DNA, 22 bp, Homo sapiens
tttcagtgtgctcctgagggct

SEQ ID NO: 8238096 - DNA, 22 bp, Homo sapiens
tttcagttgtcctgttaatagc

SEQ ID NO: 8238097 - DNA, 22 bp, Homo sapiens
tttcagttgttttagctctgtg

SEQ ID NO: 8238098 - DNA, 21 bp, Homo sapiens
ctctccagtggttcctgattc

SEQ ID NO: 8238099 - DNA, 22 bp, Homo sapiens
ctctcccccacagcagccttct

SEQ ID NO: 8238100 - DNA, 22 bp, Homo sapiens
tttcagttgcagtggttgtcta

SEQ ID NO: 8238101 - DNA, 22 bp, Homo sapiens
tttcagttcatctgtgaagatt

SEQ ID NO: 8238102 - DNA, 22 bp, Homo sapiens
tttcagttcatgtattccgagt

SEQ ID NO: 8238103 - DNA, 22 bp, Homo sapiens
ctctccctggccagctgtgcag

SEQ ID NO: 8238104 - DNA, 22 bp, Homo sapiens
ctctcccttgggtgggctttgg

SEQ ID NO: 8238105 - DNA, 22 bp, Homo sapiens
ctctcccttgggtgggctttgg

SEQ ID NO: 8238106 - DNA, 22 bp, Homo sapiens
ctctccctggccagctgtgcag

SEQ ID NO: 8238107 - DNA, 22 bp, Homo sapiens
ctctcctcagaacaggccctct

SEQ ID NO: 8238108 - DNA, 22 bp, Homo sapiens
ctctcctccaacagccctgccg

SEQ ID NO: 8238109 - DNA, 22 bp, Homo sapiens
ctctcctccaacagccctgccg

SEQ ID NO: 8238110 - DNA, 22 bp, Homo sapiens
ctctcctccaacagccctgccg

SEQ ID NO: 8238111 - DNA, 22 bp, Homo sapiens
ctctcctccaggaactcacagt

SEQ ID NO: 8238112 - DNA, 22 bp, Homo sapiens
ctctcctccaggaactcacagt

SEQ ID NO: 8238113 - DNA, 22 bp, Homo sapiens
ctctcctccaggaactcacagt

SEQ ID NO: 8238114 - DNA, 22 bp, Homo sapiens
ctctccctcattgggttccatt

SEQ ID NO: 8238115 - DNA, 22 bp, Homo sapiens
ctctccctggccagctgtgcag

SEQ ID NO: 8238116 - DNA, 22 bp, Homo sapiens
ctctccctggccagctgtgcag

SEQ ID NO: 8238117 - DNA, 22 bp, Homo sapiens
ctctccctatgcctcccaggag

SEQ ID NO: 8238118 - DNA, 22 bp, Homo sapiens
ctctccctatgcctcccaggag

SEQ ID NO: 8238119 - DNA, 22 bp, Homo sapiens
ctctccctatgcctcccaggag

SEQ ID NO: 8238120 - DNA, 22 bp, Homo sapiens
ctctccctatgcctcccaggag

SEQ ID NO: 8238121 - DNA, 22 bp, Homo sapiens
ctctccctaggttagcggtcag

SEQ ID NO: 8238122 - DNA, 22 bp, Homo sapiens
ctctccctatgcctcccaggag

SEQ ID NO: 8238123 - DNA, 23 bp, Homo sapiens
ctctccccctttgatgttagctc

SEQ ID NO: 8238124 - DNA, 22 bp, Homo sapiens
ctctcccccacagcagccttct

SEQ ID NO: 8238125 - DNA, 22 bp, Homo sapiens
ctctcccccacagcagccttct

SEQ ID NO: 8238126 - DNA, 23 bp, Homo sapiens
ctctccccctttgatgttagctc

SEQ ID NO: 8238127 - DNA, 22 bp, Homo sapiens
ctctccccggtacgagcggccg

SEQ ID NO: 8238128 - DNA, 22 bp, Homo sapiens
ctctccccggtacgagcggccg

SEQ ID NO: 8238129 - DNA, 22 bp, Homo sapiens
ctctccctaggttagcggtcag

SEQ ID NO: 8238130 - DNA, 22 bp, Homo sapiens
ctctccctaggttagcggtcag

SEQ ID NO: 8238131 - DNA, 22 bp, Homo sapiens
ctcctgggctgggaactcagcc

SEQ ID NO: 8238132 - DNA, 22 bp, Homo sapiens
ctcctgggctgggaactcagcc

SEQ ID NO: 8238133 - DNA, 22 bp, Homo sapiens
ctcctgggctgtcggcgctctg

SEQ ID NO: 8238134 - DNA, 22 bp, Homo sapiens
ctcctgggctgtcggcgctctg

SEQ ID NO: 8238135 - DNA, 22 bp, Homo sapiens
ctcctgggctgtcggcgctctg

SEQ ID NO: 8238136 - DNA, 22 bp, Homo sapiens
ctctccagaattattactatta

SEQ ID NO: 8238137 - DNA, 22 bp, Homo sapiens
ctcctgggctgtcggcgctctg

SEQ ID NO: 8238138 - DNA, 22 bp, Homo sapiens
ctctccagcagatgtagtctgt

SEQ ID NO: 8238139 - DNA, 22 bp, Homo sapiens
ctctccagatctgctgagccag

SEQ ID NO: 8238140 - DNA, 22 bp, Homo sapiens
ctctccagagcccttccggccc

SEQ ID NO: 8238141 - DNA, 22 bp, Homo sapiens
ctctccagatctgctgagccag

SEQ ID NO: 8238142 - DNA, 22 bp, Homo sapiens
ctctccagcctttagcccacgc

SEQ ID NO: 8238143 - DNA, 22 bp, Homo sapiens
ctctccagccaggggcttcctg

SEQ ID NO: 8238144 - DNA, 22 bp, Homo sapiens
ctctccagccacagaagctgct

SEQ ID NO: 8238145 - DNA, 19 bp, Homo sapiens
ctctccagctccagtagct

SEQ ID NO: 8238146 - DNA, 22 bp, Homo sapiens
ctcctgggctcaagtgatcctc

SEQ ID NO: 8238147 - DNA, 22 bp, Homo sapiens
ctcctgggctatgtctgcttgg

SEQ ID NO: 8238148 - DNA, 22 bp, Homo sapiens
ctcctgggctatgtctgcttgg

SEQ ID NO: 8238149 - DNA, 22 bp, Homo sapiens
ctcctgggctatgtctgcttgg

SEQ ID NO: 8238150 - DNA, 22 bp, Homo sapiens
ctcctgggatgactctttcttt

SEQ ID NO: 8238151 - DNA, 22 bp, Homo sapiens
ctcctgggatgactctttcttt

SEQ ID NO: 8238152 - DNA, 22 bp, Homo sapiens
ctcctgggatgactctttcttt

SEQ ID NO: 8238153 - DNA, 21 bp, Homo sapiens
ctcctgggctaagatatagtg

SEQ ID NO: 8238154 - DNA, 21 bp, Homo sapiens
ctcctgggctaagatatagtg

SEQ ID NO: 8238155 - DNA, 21 bp, Homo sapiens
ctcctgggctaagatatagtg

SEQ ID NO: 8238156 - DNA, 22 bp, Homo sapiens
ctcctgggctcaagtgatcctc

SEQ ID NO: 8238157 - DNA, 22 bp, Homo sapiens
ctcctgggctcaagtgatcctc

SEQ ID NO: 8238158 - DNA, 22 bp, Homo sapiens
ctcctgggctcaagtgatcctc

SEQ ID NO: 8238159 - DNA, 22 bp, Homo sapiens
ctcctgggctcatatcattcag

SEQ ID NO: 8238160 - DNA, 22 bp, Homo sapiens
ctcctgggctcaagtgatcctc

SEQ ID NO: 8238161 - DNA, 22 bp, Homo sapiens
ctcctgggctcatatcattcag

SEQ ID NO: 8238162 - DNA, 22 bp, Homo sapiens
ctcctgggctcatatcattcag

SEQ ID NO: 8238163 - DNA, 18 bp, Homo sapiens
ctcctgggctgcagatgc

SEQ ID NO: 8238164 - DNA, 22 bp, Homo sapiens
ctcctgggctcatatcattcag

SEQ ID NO: 8238165 - DNA, 18 bp, Homo sapiens
ctcctgggctgcagatgc

SEQ ID NO: 8238166 - DNA, 18 bp, Homo sapiens
ctcctgggctgcagatgc

SEQ ID NO: 8238167 - DNA, 22 bp, Homo sapiens
ctcctgggagctgtggcagagc

SEQ ID NO: 8238168 - DNA, 22 bp, Homo sapiens
ctcctgggaggatgcggacccg

SEQ ID NO: 8238169 - DNA, 22 bp, Homo sapiens
ctcctgggaggatgcggacccg

SEQ ID NO: 8238170 - DNA, 22 bp, Homo sapiens
ctcctgggaggatgcggacccg

SEQ ID NO: 8238171 - DNA, 22 bp, Homo sapiens
ctcctgggagtcttcctggatg

SEQ ID NO: 8238172 - DNA, 22 bp, Homo sapiens
ctcctgggagtcttcctggatg

SEQ ID NO: 8238173 - DNA, 22 bp, Homo sapiens
ctcctgggagtcttcctggatg

SEQ ID NO: 8238174 - DNA, 22 bp, Homo sapiens
ctcctgggagtcttcctggatg

SEQ ID NO: 8238175 - DNA, 22 bp, Homo sapiens
ctcctgggagctgtggcagagc

SEQ ID NO: 8238176 - DNA, 22 bp, Homo sapiens
ctcctgggagctgtggcagagc

SEQ ID NO: 8238177 - DNA, 22 bp, Homo sapiens
ctcctgggagctgtggcagagc

SEQ ID NO: 8238178 - DNA, 22 bp, Homo sapiens
ctcctgggagctgtggcagagc

SEQ ID NO: 8238179 - DNA, 22 bp, Homo sapiens
ctcctgggagctgtggcagagc

SEQ ID NO: 8238180 - DNA, 22 bp, Homo sapiens
ctcctgggagcagggatggatg

SEQ ID NO: 8238181 - DNA, 22 bp, Homo sapiens
ctcctgggagcagggatggatg

SEQ ID NO: 8238182 - DNA, 22 bp, Homo sapiens
ctcctgggagcagggatggatg

SEQ ID NO: 8238183 - DNA, 22 bp, Homo sapiens
tttacatggaatattgtcttgt

SEQ ID NO: 8238184 - DNA, 22 bp, Homo sapiens
tttacatgtaatgttatacaaa

SEQ ID NO: 8238185 - DNA, 22 bp, Homo sapiens
tttacatgtaatgttatacaaa

SEQ ID NO: 8238186 - DNA, 22 bp, Homo sapiens
tttacatgtccttcaagagcag

SEQ ID NO: 8238187 - DNA, 22 bp, Homo sapiens
tttacatgtccttcaagagcag

SEQ ID NO: 8238188 - DNA, 22 bp, Homo sapiens
tttacatgtcaagactggcagt

SEQ ID NO: 8238189 - DNA, 22 bp, Homo sapiens
tttacatgtcaagactggcagt

SEQ ID NO: 8238190 - DNA, 22 bp, Homo sapiens
tttacatgtaatgttatacaaa

SEQ ID NO: 8238191 - DNA, 22 bp, Homo sapiens
tttacatgtaatgttatacaaa

SEQ ID NO: 8238192 - DNA, 22 bp, Homo sapiens
tttacatgtaatgttatacaaa

SEQ ID NO: 8238193 - DNA, 17 bp, Homo sapiens
tttagaatacaatgttt

SEQ ID NO: 8238194 - DNA, 17 bp, Homo sapiens
tttagaatacaatgttt

SEQ ID NO: 8238195 - DNA, 17 bp, Homo sapiens
tttagaatacaatgttt

SEQ ID NO: 8238196 - DNA, 17 bp, Homo sapiens
tttagaatacaatgttt

SEQ ID NO: 8238197 - DNA, 22 bp, Homo sapiens
tttacatttccctctgtcagtt

SEQ ID NO: 8238198 - DNA, 22 bp, Homo sapiens
tttacatggaatattgtcttgt

SEQ ID NO: 8238199 - DNA, 22 bp, Homo sapiens
tttacagttccatgtgataggc

SEQ ID NO: 8238200 - DNA, 22 bp, Homo sapiens
tttacatctcaccagattcata

SEQ ID NO: 8238201 - DNA, 22 bp, Homo sapiens
tttacatctcaccagattcata

SEQ ID NO: 8238202 - DNA, 22 bp, Homo sapiens
tttacagttaagaaatgttacc

SEQ ID NO: 8238203 - DNA, 22 bp, Homo sapiens
tttacagttaagaaatgttacc

SEQ ID NO: 8238204 - DNA, 22 bp, Homo sapiens
tttacagttaagaaatgttacc

SEQ ID NO: 8238205 - DNA, 22 bp, Homo sapiens
tttacagttaagaaatgttacc

SEQ ID NO: 8238206 - DNA, 22 bp, Homo sapiens
tttacagttccatgtgataggc

SEQ ID NO: 8238207 - DNA, 22 bp, Homo sapiens
tttacagttccatgtgataggc

SEQ ID NO: 8238208 - DNA, 22 bp, Homo sapiens
tttacagttccatgtgataggc

SEQ ID NO: 8238209 - DNA, 22 bp, Homo sapiens
tttacagttccatgtgataggc

SEQ ID NO: 8238210 - DNA, 22 bp, Homo sapiens
tttacagttaagaaatgttacc

SEQ ID NO: 8238211 - DNA, 22 bp, Homo sapiens
tttacagttaagaaatgttacc

SEQ ID NO: 8238212 - DNA, 22 bp, Homo sapiens
tttacagttaagaaatgttacc

SEQ ID NO: 8238213 - DNA, 22 bp, Homo sapiens
tttacagttaagaaatgttacc

SEQ ID NO: 8238214 - DNA, 22 bp, Homo sapiens
tttacagtgtcttgttgactgt

SEQ ID NO: 8238215 - DNA, 22 bp, Homo sapiens
tttacacatacctctttaaagt

SEQ ID NO: 8238216 - DNA, 22 bp, Homo sapiens
tttacagtgtcttgttgactgt

SEQ ID NO: 8238217 - DNA, 22 bp, Homo sapiens
tttacacatacctctttaaagt

SEQ ID NO: 8238218 - DNA, 22 bp, Homo sapiens
tttacacatacctctttaaagt

SEQ ID NO: 8238219 - DNA, 22 bp, Homo sapiens
tttaacagatgctatgtctacc

SEQ ID NO: 8238220 - DNA, 22 bp, Homo sapiens
tttaaaagttatcatctgtcca

SEQ ID NO: 8238221 - DNA, 22 bp, Homo sapiens
tttaaaaggggtattaagtcca

SEQ ID NO: 8238222 - DNA, 22 bp, Homo sapiens
tttaaaaggggtattaagtcca

SEQ ID NO: 8238223 - DNA, 22 bp, Homo sapiens
tttaaaaccaaagaaagcctct

SEQ ID NO: 8238224 - DNA, 22 bp, Homo sapiens
tttaaaaccaaagaaagcctct

SEQ ID NO: 8238225 - DNA, 22 bp, Homo sapiens
tttaaaaggcagcttcttttgt

SEQ ID NO: 8238226 - DNA, 22 bp, Homo sapiens
tttaaaaaactagtctgagtct

SEQ ID NO: 8238227 - DNA, 22 bp, Homo sapiens
tttaaaaaactagtctgagtct

SEQ ID NO: 8238228 - DNA, 22 bp, Homo sapiens
tttaaaaaactagtctgagtct

SEQ ID NO: 8238229 - DNA, 22 bp, Homo sapiens
tttaaaaaactagtctgagtct

SEQ ID NO: 8238230 - DNA, 22 bp, Homo sapiens
tttaaaaaactagtctgagtct

SEQ ID NO: 8238231 - DNA, 22 bp, Homo sapiens
tttaaaaaactagtctgagtct

SEQ ID NO: 8238232 - DNA, 22 bp, Homo sapiens
tttaaaaccaaagaaagcctct

SEQ ID NO: 8238233 - DNA, 22 bp, Homo sapiens
tttaaatttagaagaaacactg

SEQ ID NO: 8238234 - DNA, 22 bp, Homo sapiens
tttaaatttagaagaaacactg

SEQ ID NO: 8238235 - DNA, 22 bp, Homo sapiens
tttaaattctgtctgccgctta

SEQ ID NO: 8238236 - DNA, 22 bp, Homo sapiens
tttaaattctgtctgccgctta

SEQ ID NO: 8238237 - DNA, 16 bp, Homo sapiens
ctcctctccttcagga

SEQ ID NO: 8238238 - DNA, 16 bp, Homo sapiens
ctcctctccttcagga

SEQ ID NO: 8238239 - DNA, 22 bp, Homo sapiens
ctcctcccacggtctcaggaag

SEQ ID NO: 8238240 - DNA, 22 bp, Homo sapiens
ctcctctccatcagcgccaccc

SEQ ID NO: 8238241 - DNA, 22 bp, Homo sapiens
ctcctcccaattgccaagtgct

SEQ ID NO: 8238242 - DNA, 22 bp, Homo sapiens
tttagacatctataattgctaa

SEQ ID NO: 8238243 - DNA, 22 bp, Homo sapiens
ctcctcccaattgccaagtgct

SEQ ID NO: 8238244 - DNA, 22 bp, Homo sapiens
ctcctctggaaattcctctgcc

SEQ ID NO: 8238245 - DNA, 22 bp, Homo sapiens
ctcctctggaaattcctctgcc

SEQ ID NO: 8238246 - DNA, 22 bp, Homo sapiens
ctcctctggaaattcctctgcc

SEQ ID NO: 8238247 - DNA, 22 bp, Homo sapiens
ctcctctggaaattcctctgcc

SEQ ID NO: 8238248 - DNA, 22 bp, Homo sapiens
ctcctctggcttcctggaggca

SEQ ID NO: 8238249 - DNA, 22 bp, Homo sapiens
ctcctctggcttcctggaggca

SEQ ID NO: 8238250 - DNA, 22 bp, Homo sapiens
ctcctctggcttcctggaggca

SEQ ID NO: 8238251 - DNA, 22 bp, Homo sapiens
tttagaatgtgactgtatttga

SEQ ID NO: 8238252 - DNA, 22 bp, Homo sapiens
tttagaatgtgactgtatttga

SEQ ID NO: 8238253 - DNA, 22 bp, Homo sapiens
tttagaatgtgactgtatttga

SEQ ID NO: 8238254 - DNA, 22 bp, Homo sapiens
tttagaatgttagcgttaaagg

SEQ ID NO: 8238255 - DNA, 22 bp, Homo sapiens
tttagaatgttagcgttaaagg

SEQ ID NO: 8238256 - DNA, 22 bp, Homo sapiens
tttagaatgttagcgttaaagg

SEQ ID NO: 8238257 - DNA, 22 bp, Homo sapiens
tttagacacactttgtatattt

SEQ ID NO: 8238258 - DNA, 22 bp, Homo sapiens
tttagacacactttgtatattt

SEQ ID NO: 8238259 - DNA, 22 bp, Homo sapiens
tttagaattggctagtgggaat

SEQ ID NO: 8238260 - DNA, 22 bp, Homo sapiens
tttagacatagctgaaatcatt

SEQ ID NO: 8238261 - DNA, 22 bp, Homo sapiens
tttagacatagctgaaatcatt

SEQ ID NO: 8238262 - DNA, 22 bp, Homo sapiens
tttagacagcatctggtgactt

SEQ ID NO: 8238263 - DNA, 22 bp, Homo sapiens
ctcctgagaattttcagttgga

SEQ ID NO: 8238264 - DNA, 22 bp, Homo sapiens
ctcctgagaggatctctgttgt

SEQ ID NO: 8238265 - DNA, 22 bp, Homo sapiens
ctcctgagaggatctctgttgt

SEQ ID NO: 8238266 - DNA, 22 bp, Homo sapiens
ctcctgagaggatctctgttgt

SEQ ID NO: 8238267 - DNA, 22 bp, Homo sapiens
ctcctgagctctgaggaagctt

SEQ ID NO: 8238268 - DNA, 22 bp, Homo sapiens
ctcctgagaggatctctgttgt

SEQ ID NO: 8238269 - DNA, 22 bp, Homo sapiens
ctcctgagaggatctctgttgt

SEQ ID NO: 8238270 - DNA, 22 bp, Homo sapiens
ctcctgagaggatctctgttgt

SEQ ID NO: 8238271 - DNA, 22 bp, Homo sapiens
ctcctggctcgcccccagctga

SEQ ID NO: 8238272 - DNA, 22 bp, Homo sapiens
ctcctggctcgcccccagctga

SEQ ID NO: 8238273 - DNA, 22 bp, Homo sapiens
ctcctggctatgactacatttc

SEQ ID NO: 8238274 - DNA, 22 bp, Homo sapiens
ctcctggctatgactacatttc

SEQ ID NO: 8238275 - DNA, 22 bp, Homo sapiens
ctcctgagctctgaggaagctt

SEQ ID NO: 8238276 - DNA, 22 bp, Homo sapiens
ctcctgagctctgaggaagctt

SEQ ID NO: 8238277 - DNA, 22 bp, Homo sapiens
ctcctgagctctgaggaagctt

SEQ ID NO: 8238278 - DNA, 22 bp, Homo sapiens
ctcctctttagccccagctgga

SEQ ID NO: 8238279 - DNA, 22 bp, Homo sapiens
ctcctctttagccccagctgga

SEQ ID NO: 8238280 - DNA, 22 bp, Homo sapiens
ctcctctttacccgcatggtct

SEQ ID NO: 8238281 - DNA, 22 bp, Homo sapiens
ctcctgacacagtccacacttg

SEQ ID NO: 8238282 - DNA, 22 bp, Homo sapiens
ctcctgaattgtccctcacagc

SEQ ID NO: 8238283 - DNA, 22 bp, Homo sapiens
ctcctgagaaataagcaagtaa

SEQ ID NO: 8238284 - DNA, 22 bp, Homo sapiens
ctcctgagaattttcagttgga

SEQ ID NO: 8238285 - DNA, 22 bp, Homo sapiens
ctcctgagaattttcagttgga

SEQ ID NO: 8238286 - DNA, 22 bp, Homo sapiens
ctcctgagaattttcagttgga

SEQ ID NO: 8238287 - DNA, 22 bp, Homo sapiens
ctcctctggcttcctggaggca

SEQ ID NO: 8238288 - DNA, 22 bp, Homo sapiens
ctcctctgggtcctggtggcca

SEQ ID NO: 8238289 - DNA, 22 bp, Homo sapiens
ctcctctgggtcctggtggcca

SEQ ID NO: 8238290 - DNA, 22 bp, Homo sapiens
ctcctctgggtcctggtggcca

SEQ ID NO: 8238291 - DNA, 22 bp, Homo sapiens
ctcctctgtctaccacgagggt

SEQ ID NO: 8238292 - DNA, 22 bp, Homo sapiens
ctcctctgtctaccacgagggt

SEQ ID NO: 8238293 - DNA, 22 bp, Homo sapiens
ctcctctgtattgattgggact

SEQ ID NO: 8238294 - DNA, 22 bp, Homo sapiens
ctcctctgtctggccctgagcc

SEQ ID NO: 8238295 - DNA, 22 bp, Homo sapiens
ctcctctgtctggccctgagcc

SEQ ID NO: 8238296 - DNA, 22 bp, Homo sapiens
ctcctctgtctaccacgagggt

SEQ ID NO: 8238297 - DNA, 22 bp, Homo sapiens
ctcctctgtctggccctgagcc

SEQ ID NO: 8238298 - DNA, 22 bp, Homo sapiens
ctcctctgtctggccctgagcc

SEQ ID NO: 8238299 - DNA, 22 bp, Homo sapiens
ttgtatttgattgtcatatcgt

SEQ ID NO: 8238300 - DNA, 22 bp, Homo sapiens
ttgtatttgattgtcatatcgt

SEQ ID NO: 8238301 - DNA, 22 bp, Homo sapiens
ttgtatttcttccggtctcatt

SEQ ID NO: 8238302 - DNA, 22 bp, Homo sapiens
ttgtatttcttccggtctcatt

SEQ ID NO: 8238303 - DNA, 22 bp, Homo sapiens
ttgtatttctccactttctgtt

SEQ ID NO: 8238304 - DNA, 22 bp, Homo sapiens
ttgtatttctccactttctgtt

SEQ ID NO: 8238305 - DNA, 22 bp, Homo sapiens
ttgtatttctccactttctgtt

SEQ ID NO: 8238306 - DNA, 22 bp, Homo sapiens
ctccagggggcatccacacagc

SEQ ID NO: 8238307 - DNA, 22 bp, Homo sapiens
ctccagggggcatccacacagc

SEQ ID NO: 8238308 - DNA, 22 bp, Homo sapiens
ctccagggggcatccacacagc

SEQ ID NO: 8238309 - DNA, 22 bp, Homo sapiens
ttgtatttgattgtcatatcgt

SEQ ID NO: 8238310 - DNA, 22 bp, Homo sapiens
ttgtatttgattgtcatatcgt

SEQ ID NO: 8238311 - DNA, 22 bp, Homo sapiens
ttgtatttgattgtcatatcgt

SEQ ID NO: 8238312 - DNA, 22 bp, Homo sapiens
ttgtatttgattgtcatatcgt

SEQ ID NO: 8238313 - DNA, 22 bp, Homo sapiens
ttgtatttgggtagtatagaga

SEQ ID NO: 8238314 - DNA, 22 bp, Homo sapiens
ttgtatttgggtagtatagaga

SEQ ID NO: 8238315 - DNA, 22 bp, Homo sapiens
ttgtatttgggtagtatagaga

SEQ ID NO: 8238316 - DNA, 22 bp, Homo sapiens
ttgtatttgggtagtatagaga

SEQ ID NO: 8238317 - DNA, 22 bp, Homo sapiens
ttgtatttgggtagtatagaga

SEQ ID NO: 8238318 - DNA, 22 bp, Homo sapiens
ctccagggatgagacagagtag

SEQ ID NO: 8238319 - DNA, 22 bp, Homo sapiens
ctccagggcagcatggcagtgg

SEQ ID NO: 8238320 - DNA, 22 bp, Homo sapiens
ctccagggatgagacagagtag

SEQ ID NO: 8238321 - DNA, 22 bp, Homo sapiens
ctccagggatgagacagagtag

SEQ ID NO: 8238322 - DNA, 22 bp, Homo sapiens
ctccagggaggtctgcaggact

SEQ ID NO: 8238323 - DNA, 22 bp, Homo sapiens
ctccagggaggtctgcaggact

SEQ ID NO: 8238324 - DNA, 22 bp, Homo sapiens
ctccagggaggtctgcaggact

SEQ ID NO: 8238325 - DNA, 22 bp, Homo sapiens
ctccagggaggtctgcaggact

SEQ ID NO: 8238326 - DNA, 22 bp, Homo sapiens
ctccagggaggtctgcaggact

SEQ ID NO: 8238327 - DNA, 22 bp, Homo sapiens
ctccagggaggagcacgggttc

SEQ ID NO: 8238328 - DNA, 22 bp, Homo sapiens
ctccagggaggagcacgggttc

SEQ ID NO: 8238329 - DNA, 22 bp, Homo sapiens
ctccaggggccagaagcctggc

SEQ ID NO: 8238330 - DNA, 20 bp, Homo sapiens
ctccaggggaagagccttcc

SEQ ID NO: 8238331 - DNA, 20 bp, Homo sapiens
ctccaggggaagagccttcc

SEQ ID NO: 8238332 - DNA, 20 bp, Homo sapiens
ctccaggggaagagccttcc

SEQ ID NO: 8238333 - DNA, 22 bp, Homo sapiens
ctccagggctaccaggttttag

SEQ ID NO: 8238334 - DNA, 22 bp, Homo sapiens
ttgggttttcccttgaaactga

SEQ ID NO: 8238335 - DNA, 22 bp, Homo sapiens
ttgggtcttatggctggagtag

SEQ ID NO: 8238336 - DNA, 22 bp, Homo sapiens
ttgggtaggagaaagaacagat

SEQ ID NO: 8238337 - DNA, 22 bp, Homo sapiens
ttgggtaggagaaagaacagat

SEQ ID NO: 8238338 - DNA, 22 bp, Homo sapiens
ttgggtgctgtcatggggcacg

SEQ ID NO: 8238339 - DNA, 22 bp, Homo sapiens
ttgggttgaagggcgcttcctt

SEQ ID NO: 8238340 - DNA, 22 bp, Homo sapiens
ttgggtggtggggagagttcag

SEQ ID NO: 8238341 - DNA, 22 bp, Homo sapiens
ttgggtggtggggagagttcag

SEQ ID NO: 8238342 - DNA, 22 bp, Homo sapiens
ctccaggcgcttaccaagcgct

SEQ ID NO: 8238343 - DNA, 22 bp, Homo sapiens
ctccagggagctgcgggagcca

SEQ ID NO: 8238344 - DNA, 22 bp, Homo sapiens
ctccagggagctgtggaggttt

SEQ ID NO: 8238345 - DNA, 22 bp, Homo sapiens
ctccagggagcttggaaagacc

SEQ ID NO: 8238346 - DNA, 22 bp, Homo sapiens
ctccagggaggagcacgggttc

SEQ ID NO: 8238347 - DNA, 22 bp, Homo sapiens
ctccaggcgccgcttttgcagt

SEQ ID NO: 8238348 - DNA, 22 bp, Homo sapiens
ttggtcaagctgtcttctttgc

SEQ ID NO: 8238349 - DNA, 22 bp, Homo sapiens
ttggtattttacaatgtcagtg

SEQ ID NO: 8238350 - DNA, 22 bp, Homo sapiens
ttggtcaagctgtcttctttgc

SEQ ID NO: 8238351 - DNA, 22 bp, Homo sapiens
ttggtcaaatgtcatctggtgt

SEQ ID NO: 8238352 - DNA, 22 bp, Homo sapiens
ttggtattttacaatgtcagtg

SEQ ID NO: 8238353 - DNA, 22 bp, Homo sapiens
ttggtatattgtgctactttat

SEQ ID NO: 8238354 - DNA, 22 bp, Homo sapiens
ttggtaggggactagagtccag

SEQ ID NO: 8238355 - DNA, 22 bp, Homo sapiens
ttgttaaagatgcagattccat

SEQ ID NO: 8238356 - DNA, 22 bp, Homo sapiens
ttgttaaagatgcagattccat

SEQ ID NO: 8238357 - DNA, 22 bp, Homo sapiens
ttgttaaagatgcagattccat

SEQ ID NO: 8238358 - DNA, 22 bp, Homo sapiens
ttgttaaaggcaaaacaagcac

SEQ ID NO: 8238359 - DNA, 22 bp, Homo sapiens
ttgttaaaggcaaaacaagcac

SEQ ID NO: 8238360 - DNA, 22 bp, Homo sapiens
ttgttaaatggatgcagaataa

SEQ ID NO: 8238361 - DNA, 22 bp, Homo sapiens
ttgttaaatggatgcagaataa

SEQ ID NO: 8238362 - DNA, 22 bp, Homo sapiens
ttgttacagcagcaatagaaaa

SEQ ID NO: 8238363 - DNA, 22 bp, Homo sapiens
ctccaggtagctaagtcctggg

SEQ ID NO: 8238364 - DNA, 22 bp, Homo sapiens
ctccagggttccccgatccact

SEQ ID NO: 8238365 - DNA, 22 bp, Homo sapiens
ctccaggtagctaagtcctggg

SEQ ID NO: 8238366 - DNA, 22 bp, Homo sapiens
ttgttacacataataacatttt

SEQ ID NO: 8238367 - DNA, 21 bp, Homo sapiens
ttgttacaatgcaagagtatg

SEQ ID NO: 8238368 - DNA, 21 bp, Homo sapiens
ttgttacaatgcaagagtatg

SEQ ID NO: 8238369 - DNA, 22 bp, Homo sapiens
ttgtattttgttatgctactgc

SEQ ID NO: 8238370 - DNA, 22 bp, Homo sapiens
ttgtattttgttatgctactgc

SEQ ID NO: 8238371 - DNA, 22 bp, Homo sapiens
ttgtgtactacagtatgccaca

SEQ ID NO: 8238372 - DNA, 22 bp, Homo sapiens
ttgtattttgttatgctactgc

SEQ ID NO: 8238373 - DNA, 22 bp, Homo sapiens
ttgttaaaaatagatttccagg

SEQ ID NO: 8238374 - DNA, 22 bp, Homo sapiens
ttgtgtactgttggttgatatt

SEQ ID NO: 8238375 - DNA, 22 bp, Homo sapiens
ttgttaaaactccattggtttg

SEQ ID NO: 8238376 - DNA, 22 bp, Homo sapiens
ttgttaaaatattggagaaagg

SEQ ID NO: 8238377 - DNA, 22 bp, Homo sapiens
ttgttaaaatgcatattctggt

SEQ ID NO: 8238378 - DNA, 22 bp, Homo sapiens
ttgttaaaatgcatattctggt

SEQ ID NO: 8238379 - DNA, 22 bp, Homo sapiens
ttgttaaaatgcatattctggt

SEQ ID NO: 8238380 - DNA, 22 bp, Homo sapiens
ttgttaaaatgcatattctggt

SEQ ID NO: 8238381 - DNA, 22 bp, Homo sapiens
ctccaggttacttagcctagct

SEQ ID NO: 8238382 - DNA, 22 bp, Homo sapiens
ctccagtctagtagagcctgct

SEQ ID NO: 8238383 - DNA, 22 bp, Homo sapiens
ctccagtgagcgcggggcatgg

SEQ ID NO: 8238384 - DNA, 22 bp, Homo sapiens
ctccagtgcgcaggacagcccc

SEQ ID NO: 8238385 - DNA, 22 bp, Homo sapiens
ttgtttcagctgtatgctatgt

SEQ ID NO: 8238386 - DNA, 22 bp, Homo sapiens
ctccagtgccctccttgggggc

SEQ ID NO: 8238387 - DNA, 22 bp, Homo sapiens
ctccagtgcacccagaggattt

SEQ ID NO: 8238388 - DNA, 22 bp, Homo sapiens
tttaaaaaactagtctgagtct

SEQ ID NO: 8238389 - DNA, 22 bp, Homo sapiens
tttaaaaaactagtctgagtct

SEQ ID NO: 8238390 - DNA, 22 bp, Homo sapiens
tttaaaaaactagtctgagtct

SEQ ID NO: 8238391 - DNA, 22 bp, Homo sapiens
tttaaaaaactagtctgagtct

SEQ ID NO: 8238392 - DNA, 22 bp, Homo sapiens
tttaaaaaactagtctgagtct

SEQ ID NO: 8238393 - DNA, 22 bp, Homo sapiens
ttgggcagggaaaggacaggca

SEQ ID NO: 8238394 - DNA, 22 bp, Homo sapiens
ttgggcacggacaggtggggat

SEQ ID NO: 8238395 - DNA, 22 bp, Homo sapiens
ttgggcagaggccaggaggatg

SEQ ID NO: 8238396 - DNA, 22 bp, Homo sapiens
ttgggcagaggctgtgcagagg

SEQ ID NO: 8238397 - DNA, 22 bp, Homo sapiens
ttgggcagaggccaggaggatg

SEQ ID NO: 8238398 - DNA, 22 bp, Homo sapiens
ttgggcagaggctgtgcagagg

SEQ ID NO: 8238399 - DNA, 22 bp, Homo sapiens
ttgggcagatgtttcctgtgga

SEQ ID NO: 8238400 - DNA, 22 bp, Homo sapiens
ttgggagttcctactgcggttt

SEQ ID NO: 8238401 - DNA, 22 bp, Homo sapiens
ttgggagttcctactgcggttt

SEQ ID NO: 8238402 - DNA, 22 bp, Homo sapiens
ttgggagtaataaaaaattcca

SEQ ID NO: 8238403 - DNA, 22 bp, Homo sapiens
ttgggaggtcataaatctgttc

SEQ ID NO: 8238404 - DNA, 22 bp, Homo sapiens
ttgggaggtaatggagccaagt

SEQ ID NO: 8238405 - DNA, 22 bp, Homo sapiens
ttggctgctcagtgatatgaga

SEQ ID NO: 8238406 - DNA, 22 bp, Homo sapiens
ttggctgctctgtgtttagtat

SEQ ID NO: 8238407 - DNA, 22 bp, Homo sapiens
ttggctgctgaaatatgttctg

SEQ ID NO: 8238408 - DNA, 22 bp, Homo sapiens
ttggctgctgggaactcaaaca

SEQ ID NO: 8238409 - DNA, 22 bp, Homo sapiens
ctcatctcccacctgcgtgcag

SEQ ID NO: 8238410 - DNA, 20 bp, Homo sapiens
ctcatctctgagcctcctgg

SEQ ID NO: 8238411 - DNA, 22 bp, Homo sapiens
ttggctgctatttccatattta

SEQ ID NO: 8238412 - DNA, 22 bp, Homo sapiens
ctcatctcccacctgcgtgcag

SEQ ID NO: 8238413 - DNA, 20 bp, Homo sapiens
ctcatctctgagcctcctgg

SEQ ID NO: 8238414 - DNA, 20 bp, Homo sapiens
ctcatctctgagcctcctgg

SEQ ID NO: 8238415 - DNA, 22 bp, Homo sapiens
ttggccaacatggtgaaacccc

SEQ ID NO: 8238416 - DNA, 22 bp, Homo sapiens
ttggccagaatcttcctagtga

SEQ ID NO: 8238417 - DNA, 22 bp, Homo sapiens
ttggccagacactacccccctt

SEQ ID NO: 8238418 - DNA, 22 bp, Homo sapiens
ttggccagaggtttctctcatg

SEQ ID NO: 8238419 - DNA, 22 bp, Homo sapiens
ttggccagactgaggtgctggg

SEQ ID NO: 8238420 - DNA, 22 bp, Homo sapiens
ttggccagagaccagagcaggg

SEQ ID NO: 8238421 - DNA, 22 bp, Homo sapiens
ctcatccaccgcagcccctcag

SEQ ID NO: 8238422 - DNA, 22 bp, Homo sapiens
ctcatcataaccctgtgaggat

SEQ ID NO: 8238423 - DNA, 22 bp, Homo sapiens
ctcatcataaccctgtgaggat

SEQ ID NO: 8238424 - DNA, 22 bp, Homo sapiens
ctcatcatgtcacccatgtgct

SEQ ID NO: 8238425 - DNA, 22 bp, Homo sapiens
ctcataatgtgactgtatttga

SEQ ID NO: 8238426 - DNA, 22 bp, Homo sapiens
ctcataatgtgactgtatttga

SEQ ID NO: 8238427 - DNA, 22 bp, Homo sapiens
ctcataaagtgagaatatgacc

SEQ ID NO: 8238428 - DNA, 22 bp, Homo sapiens
ttggccagatctgaggatactg

SEQ ID NO: 8238429 - DNA, 22 bp, Homo sapiens
ctcagtttttttaagagccatg

SEQ ID NO: 8238430 - DNA, 22 bp, Homo sapiens
ctcataaaggcacacttgttgt

SEQ ID NO: 8238431 - DNA, 22 bp, Homo sapiens
ctcataaaagctttgtttacac

SEQ ID NO: 8238432 - DNA, 22 bp, Homo sapiens
ctcataaacaattctttgaggt

SEQ ID NO: 8238433 - DNA, 22 bp, Homo sapiens
ctcagtgctttggatcctggat

SEQ ID NO: 8238434 - DNA, 20 bp, Homo sapiens
ctcagtgctttcattgcctc

SEQ ID NO: 8238435 - DNA, 22 bp, Homo sapiens
ctcagtgctttggatcctggat

SEQ ID NO: 8238436 - DNA, 22 bp, Homo sapiens
ctcagtttccccggcctgggcg

SEQ ID NO: 8238437 - DNA, 22 bp, Homo sapiens
ctcagtttccccggcctgggcg

SEQ ID NO: 8238438 - DNA, 22 bp, Homo sapiens
ctcagtttcctcttctgttgaa

SEQ ID NO: 8238439 - DNA, 22 bp, Homo sapiens
ctcagtttcctcttctgttgaa

SEQ ID NO: 8238440 - DNA, 22 bp, Homo sapiens
ctcagtttctgaagtggacagg

SEQ ID NO: 8238441 - DNA, 22 bp, Homo sapiens
ctcagtttctgaagtggacagg

SEQ ID NO: 8238442 - DNA, 20 bp, Homo sapiens
ctcagtttcctcatggctca

SEQ ID NO: 8238443 - DNA, 22 bp, Homo sapiens
ctcagtttcctcaactgcaaaa

SEQ ID NO: 8238444 - DNA, 22 bp, Homo sapiens
ctcagtttcctcaactgcaaaa

SEQ ID NO: 8238445 - DNA, 22 bp, Homo sapiens
ttgatatgttaggaagactgat

SEQ ID NO: 8238446 - DNA, 22 bp, Homo sapiens
ttgatattcccgatttaaggta

SEQ ID NO: 8238447 - DNA, 22 bp, Homo sapiens
ttgctttgccaccagaagtcta

SEQ ID NO: 8238448 - DNA, 22 bp, Homo sapiens
ctcagtttttgtgggcatcagc

SEQ ID NO: 8238449 - DNA, 22 bp, Homo sapiens
ctcagtttttgtgggcatcagc

SEQ ID NO: 8238450 - DNA, 22 bp, Homo sapiens
ctcagtttttgctgtctggttc

SEQ ID NO: 8238451 - DNA, 22 bp, Homo sapiens
ctcagttttgaaaaggtaagct

SEQ ID NO: 8238452 - DNA, 22 bp, Homo sapiens
ctcagttttgaaaaggtaagct

SEQ ID NO: 8238453 - DNA, 22 bp, Homo sapiens
ctcagttttgctagctggagtt

SEQ ID NO: 8238454 - DNA, 22 bp, Homo sapiens
ctcagttttgctagctggagtt

SEQ ID NO: 8238455 - DNA, 22 bp, Homo sapiens
ctcagttttaagactactcttt

SEQ ID NO: 8238456 - DNA, 22 bp, Homo sapiens
ctcagttttcccttgggagcgt

SEQ ID NO: 8238457 - DNA, 22 bp, Homo sapiens
ctcagtttcttcatattgtagg

SEQ ID NO: 8238458 - DNA, 22 bp, Homo sapiens
ctcagtttcttactctgtataa

SEQ ID NO: 8238459 - DNA, 22 bp, Homo sapiens
ctcagtttgaatgctgacactg

SEQ ID NO: 8238460 - DNA, 22 bp, Homo sapiens
ctcagtttgaggggtaggtgtt

SEQ ID NO: 8238461 - DNA, 22 bp, Homo sapiens
ctcagtttgtgtgatattgtct

SEQ ID NO: 8238462 - DNA, 22 bp, Homo sapiens
ctcagtttctgacattaaaatc

SEQ ID NO: 8238463 - DNA, 22 bp, Homo sapiens
ctcagtttctgacattaaaatc

SEQ ID NO: 8238464 - DNA, 22 bp, Homo sapiens
ctcagtttctgacattaaaatc

SEQ ID NO: 8238465 - DNA, 22 bp, Homo sapiens
ctcagtttctggataagctggg

SEQ ID NO: 8238466 - DNA, 22 bp, Homo sapiens
ctcagtttcttactctgtataa

SEQ ID NO: 8238467 - DNA, 22 bp, Homo sapiens
ctcagtttctggataagctggg

SEQ ID NO: 8238468 - DNA, 22 bp, Homo sapiens
ctcagtttctgacattaaaatc

SEQ ID NO: 8238469 - DNA, 22 bp, Homo sapiens
ttgcttttaatctttgtacatc

SEQ ID NO: 8238470 - DNA, 22 bp, Homo sapiens
ttgctttgttactgcagtttcc

SEQ ID NO: 8238471 - DNA, 22 bp, Homo sapiens
ttgcttttaatctttgtacatc

SEQ ID NO: 8238472 - DNA, 22 bp, Homo sapiens
ttgcttttaatctttgtacatc

SEQ ID NO: 8238473 - DNA, 18 bp, Homo sapiens
ttgctttgtaagcttgca

SEQ ID NO: 8238474 - DNA, 18 bp, Homo sapiens
ttgctttgtaagcttgca

SEQ ID NO: 8238475 - DNA, 22 bp, Homo sapiens
ttgctttgtggtggttcttcca

SEQ ID NO: 8238476 - DNA, 22 bp, Homo sapiens
ttgctttgtggtggttcttcca

SEQ ID NO: 8238477 - DNA, 22 bp, Homo sapiens
ttgcttttaattaatcattgct

SEQ ID NO: 8238478 - DNA, 22 bp, Homo sapiens
ttgcttttaatctttgtacatc

SEQ ID NO: 8238479 - DNA, 22 bp, Homo sapiens
ttgcttttgggaaaacatgcct

SEQ ID NO: 8238480 - DNA, 22 bp, Homo sapiens
ttggcatttttcctcagctgga

SEQ ID NO: 8238481 - DNA, 22 bp, Homo sapiens
ttggcattgaagtttcattggt

SEQ ID NO: 8238482 - DNA, 22 bp, Homo sapiens
ttggcattggagatgcaagaac

SEQ ID NO: 8238483 - DNA, 22 bp, Homo sapiens
ttggcattgaagtttcattggt

SEQ ID NO: 8238484 - DNA, 22 bp, Homo sapiens
ttggcattcatgggacaacaaa

SEQ ID NO: 8238485 - DNA, 22 bp, Homo sapiens
ttggaaaagcgttctctgtagc

SEQ ID NO: 8238486 - DNA, 22 bp, Homo sapiens
ttggaaaagcgttctctgtagc

SEQ ID NO: 8238487 - DNA, 22 bp, Homo sapiens
ttggaaaaacacgatagtggtt

SEQ ID NO: 8238488 - DNA, 22 bp, Homo sapiens
ttgctttttaattaggaggcag

SEQ ID NO: 8238489 - DNA, 22 bp, Homo sapiens
ttggaaaacttacacagagctg

SEQ ID NO: 8238490 - DNA, 22 bp, Homo sapiens
ttggaaaacttacacagagctg

SEQ ID NO: 8238491 - DNA, 22 bp, Homo sapiens
ctacaaaagtaattgtggtttt

SEQ ID NO: 8238492 - DNA, 22 bp, Homo sapiens
ctacaaaagtaattgtggtttt

SEQ ID NO: 8238493 - DNA, 22 bp, Homo sapiens
ctacaaaagtaattgtggtttt

SEQ ID NO: 8238494 - DNA, 22 bp, Homo sapiens
ctaatttttgttctgcattgaa

SEQ ID NO: 8238495 - DNA, 22 bp, Homo sapiens
ctacaaaagtaattgtggtttt

SEQ ID NO: 8238496 - DNA, 22 bp, Homo sapiens
ctaattgtaagctccttgaggg

SEQ ID NO: 8238497 - DNA, 22 bp, Homo sapiens
ctaattgtaagctccttgaggg

SEQ ID NO: 8238498 - DNA, 22 bp, Homo sapiens
ctaattctgtatttggtcattg

SEQ ID NO: 8238499 - DNA, 22 bp, Homo sapiens
ctaattgtaccagatttctctt

SEQ ID NO: 8238500 - DNA, 22 bp, Homo sapiens
ctaattgttaggtgtctgatgt

SEQ ID NO: 8238501 - DNA, 22 bp, Homo sapiens
ctaatttaatgaatgagtctta

SEQ ID NO: 8238502 - DNA, 22 bp, Homo sapiens
ctaattgtttgtgttgtcacct

SEQ ID NO: 8238503 - DNA, 22 bp, Homo sapiens
ctaattatgttgttataatcaa

SEQ ID NO: 8238504 - DNA, 22 bp, Homo sapiens
ctaattatgttgttataatcaa

SEQ ID NO: 8238505 - DNA, 22 bp, Homo sapiens
ctaagtcatgatcagacagaga

SEQ ID NO: 8238506 - DNA, 22 bp, Homo sapiens
ctaaggtgtccctcttgctgga

SEQ ID NO: 8238507 - DNA, 22 bp, Homo sapiens
ctaagtttatgtagttctttca

SEQ ID NO: 8238508 - DNA, 22 bp, Homo sapiens
ctaataacatgaactactttct

SEQ ID NO: 8238509 - DNA, 22 bp, Homo sapiens
ctaaggcaggtccattccagga

SEQ ID NO: 8238510 - DNA, 20 bp, Homo sapiens
ctaatattctactctaagga

SEQ ID NO: 8238511 - DNA, 22 bp, Homo sapiens
ctaatcatctttctcttaaagc

SEQ ID NO: 8238512 - DNA, 22 bp, Homo sapiens
ctaatgaagctgctttctatga

SEQ ID NO: 8238513 - DNA, 22 bp, Homo sapiens
ctaatgcagtatcagaatagca

SEQ ID NO: 8238514 - DNA, 22 bp, Homo sapiens
ctaatgtaaaacagacttgcat

SEQ ID NO: 8238515 - DNA, 22 bp, Homo sapiens
ttccttcccctagctgagaaac

SEQ ID NO: 8238516 - DNA, 22 bp, Homo sapiens
ttccttcccctagctgagaaac

SEQ ID NO: 8238517 - DNA, 22 bp, Homo sapiens
ttccttccctcagtggctgaag

SEQ ID NO: 8238518 - DNA, 22 bp, Homo sapiens
ttccttccgggcaccaggcact

SEQ ID NO: 8238519 - DNA, 22 bp, Homo sapiens
ttccttccagcttgtgacagtc

SEQ ID NO: 8238520 - DNA, 22 bp, Homo sapiens
ttccttccacttcaggattttg

SEQ ID NO: 8238521 - DNA, 22 bp, Homo sapiens
ttccttccacttcaggattttg

SEQ ID NO: 8238522 - DNA, 22 bp, Homo sapiens
ttccttccagcttgtgacagtc

SEQ ID NO: 8238523 - DNA, 22 bp, Homo sapiens
ttccttccatagcaaaacatgc

SEQ ID NO: 8238524 - DNA, 22 bp, Homo sapiens
ttccttccatagcaaaacatgc

SEQ ID NO: 8238525 - DNA, 22 bp, Homo sapiens
ttccttctaatattctgcctgt

SEQ ID NO: 8238526 - DNA, 22 bp, Homo sapiens
ttccttcctgtcttccttactg

SEQ ID NO: 8238527 - DNA, 22 bp, Homo sapiens
ttccttcctgtcttccttactg

SEQ ID NO: 8238528 - DNA, 22 bp, Homo sapiens
ttccttcctggggatttatcat

SEQ ID NO: 8238529 - DNA, 22 bp, Homo sapiens
ttccttcctcctccagttctgg

SEQ ID NO: 8238530 - DNA, 22 bp, Homo sapiens
ttccttcctctttcacaacagc

SEQ ID NO: 8238531 - DNA, 22 bp, Homo sapiens
ttccttcctctttcacaacagc

SEQ ID NO: 8238532 - DNA, 22 bp, Homo sapiens
ttccttcctcctccagttctgg

SEQ ID NO: 8238533 - DNA, 22 bp, Homo sapiens
ttccttcctcctccagttctgg

SEQ ID NO: 8238534 - DNA, 22 bp, Homo sapiens
ttccttcagcaagtcctgagca

SEQ ID NO: 8238535 - DNA, 20 bp, Homo sapiens
ttcctggggaatgatagaag

SEQ ID NO: 8238536 - DNA, 22 bp, Homo sapiens
ttcctggggacttaccgtcatt

SEQ ID NO: 8238537 - DNA, 22 bp, Homo sapiens
ctacaaaagtaattgtggtttt

SEQ ID NO: 8238538 - DNA, 22 bp, Homo sapiens
ctacaaatataaaacacagata

SEQ ID NO: 8238539 - DNA, 22 bp, Homo sapiens
ttcccacacccatattgtgatt

SEQ ID NO: 8238540 - DNA, 22 bp, Homo sapiens
ttcccacacccatattgtgatt

SEQ ID NO: 8238541 - DNA, 22 bp, Homo sapiens
ttcccacagagattacattgaa

SEQ ID NO: 8238542 - DNA, 22 bp, Homo sapiens
ttccctggtgggtgagaacctg

SEQ ID NO: 8238543 - DNA, 22 bp, Homo sapiens
ttccctgtgtgcagatgggtgt

SEQ ID NO: 8238544 - DNA, 22 bp, Homo sapiens
ttcccagaatgaatggatggag

SEQ ID NO: 8238545 - DNA, 22 bp, Homo sapiens
ttccctggtgggtgagaacctg

SEQ ID NO: 8238546 - DNA, 22 bp, Homo sapiens
ttcccttaaattatggcatcta

SEQ ID NO: 8238547 - DNA, 22 bp, Homo sapiens
ttcccttaaattatggcatcta

SEQ ID NO: 8238548 - DNA, 22 bp, Homo sapiens
ttccgctgtttagttgaagttt

SEQ ID NO: 8238549 - DNA, 22 bp, Homo sapiens
ttccggacgcccgtcttccagc

SEQ ID NO: 8238550 - DNA, 22 bp, Homo sapiens
ctaaggatgcatatgttttgtt

SEQ ID NO: 8238551 - DNA, 22 bp, Homo sapiens
ctaacttttacagtcatgttgc

SEQ ID NO: 8238552 - DNA, 22 bp, Homo sapiens
ttccctttggcagccttctcct

SEQ ID NO: 8238553 - DNA, 22 bp, Homo sapiens
ttcccttctagttttgagagac

SEQ ID NO: 8238554 - DNA, 22 bp, Homo sapiens
ttcccttcctcactctacttgt

SEQ ID NO: 8238555 - DNA, 21 bp, Homo sapiens
ttcccttctggttttgagaga

SEQ ID NO: 8238556 - DNA, 21 bp, Homo sapiens
ttcccttctggttttgagaga

SEQ ID NO: 8238557 - DNA, 22 bp, Homo sapiens
ttcccacaatctgcgtgtgtat

SEQ ID NO: 8238558 - DNA, 22 bp, Homo sapiens
ttccatttttctaactctcaga

SEQ ID NO: 8238559 - DNA, 22 bp, Homo sapiens
ttccatttggcacttcactgag

SEQ ID NO: 8238560 - DNA, 22 bp, Homo sapiens
ttccatttggcacttcactgag

SEQ ID NO: 8238561 - DNA, 22 bp, Homo sapiens
ttccatttttctaactctcaga

SEQ ID NO: 8238562 - DNA, 22 bp, Homo sapiens
ttccatttttctaactctcaga

SEQ ID NO: 8238563 - DNA, 22 bp, Homo sapiens
ttccatttattcttgtccagat

SEQ ID NO: 8238564 - DNA, 22 bp, Homo sapiens
ttccaggcacatcccaactcca

SEQ ID NO: 8238565 - DNA, 22 bp, Homo sapiens
ttccaaatggagaagatgagtt

SEQ ID NO: 8238566 - DNA, 22 bp, Homo sapiens
ttccaaatgttggacaactgta

SEQ ID NO: 8238567 - DNA, 22 bp, Homo sapiens
ttccaaatgagttccatcgaat

SEQ ID NO: 8238568 - DNA, 22 bp, Homo sapiens
ttccaaatgcccatctacacag

SEQ ID NO: 8238569 - DNA, 22 bp, Homo sapiens
ttccaaagaaattgaccaagac

SEQ ID NO: 8238570 - DNA, 22 bp, Homo sapiens
cggctgctgcctgagtcgctgt

SEQ ID NO: 8238571 - DNA, 22 bp, Homo sapiens
cggctgctgcctgagtcgctgt

SEQ ID NO: 8238572 - DNA, 22 bp, Homo sapiens
cggctgcttctgagccccggcg

SEQ ID NO: 8238573 - DNA, 22 bp, Homo sapiens
cggctgcttctgagccccggcg

SEQ ID NO: 8238574 - DNA, 22 bp, Homo sapiens
cggctggagctttgaacctgat

SEQ ID NO: 8238575 - DNA, 22 bp, Homo sapiens
cggctggaagctggacaggccg

SEQ ID NO: 8238576 - DNA, 22 bp, Homo sapiens
cggctggagctgagaaaggagc

SEQ ID NO: 8238577 - DNA, 22 bp, Homo sapiens
cggctcctccgcccttgctcac

SEQ ID NO: 8238578 - DNA, 21 bp, Homo sapiens
cggctcagtgcctgctccttc

SEQ ID NO: 8238579 - DNA, 22 bp, Homo sapiens
cggctctgtcctcagcactgct

SEQ ID NO: 8238580 - DNA, 22 bp, Homo sapiens
cggctgagacggccatagacac

SEQ ID NO: 8238581 - DNA, 22 bp, Homo sapiens
cggctgagacggccatagacac

SEQ ID NO: 8238582 - DNA, 22 bp, Homo sapiens
cggctgagcagtgctgatggaa

SEQ ID NO: 8238583 - DNA, 22 bp, Homo sapiens
cggctgagacggccatagacac

SEQ ID NO: 8238584 - DNA, 22 bp, Homo sapiens
cggctgaggatctccaggcctg

SEQ ID NO: 8238585 - DNA, 22 bp, Homo sapiens
cggctgagcagtgctgatggaa

SEQ ID NO: 8238586 - DNA, 23 bp, Homo sapiens
cggctgctcggccgagtcctcgg

SEQ ID NO: 8238587 - DNA, 23 bp, Homo sapiens
cggctgctcggccgagtcctcgg

SEQ ID NO: 8238588 - DNA, 22 bp, Homo sapiens
cggctgagcagtgctgatggaa

SEQ ID NO: 8238589 - DNA, 22 bp, Homo sapiens
cggctgagcagtgctgatggaa

SEQ ID NO: 8238590 - DNA, 22 bp, Homo sapiens
cggctgaggatctccaggcctg

SEQ ID NO: 8238591 - DNA, 22 bp, Homo sapiens
ttcagaaaaaacttcaataagt

SEQ ID NO: 8238592 - DNA, 22 bp, Homo sapiens
ttcagaaaaaacttcaataagt

SEQ ID NO: 8238593 - DNA, 22 bp, Homo sapiens
ttcacttaacatcatatcatga

SEQ ID NO: 8238594 - DNA, 22 bp, Homo sapiens
ttcacttaacatcatatcatga

SEQ ID NO: 8238595 - DNA, 22 bp, Homo sapiens
ttcacttatagggatgttattg

SEQ ID NO: 8238596 - DNA, 22 bp, Homo sapiens
ttcagaaacatcagtggatgga

SEQ ID NO: 8238597 - DNA, 22 bp, Homo sapiens
ttcagaaacccattgggtctct

SEQ ID NO: 8238598 - DNA, 22 bp, Homo sapiens
ttcagaaaggataattggaagg

SEQ ID NO: 8238599 - DNA, 22 bp, Homo sapiens
ttcagaaacagagtgagtgagt

SEQ ID NO: 8238600 - DNA, 19 bp, Homo sapiens
ttcattctcttattgttgt

SEQ ID NO: 8238601 - DNA, 22 bp, Homo sapiens
ttcattctgcagttctcagctc

SEQ ID NO: 8238602 - DNA, 22 bp, Homo sapiens
ttcattcttatttgtgatctgg

SEQ ID NO: 8238603 - DNA, 22 bp, Homo sapiens
ttcattcttgggatcagagagt

SEQ ID NO: 8238604 - DNA, 22 bp, Homo sapiens
ttcattcttatttgtgatctgg

SEQ ID NO: 8238605 - DNA, 22 bp, Homo sapiens
ttcattccttctgtaccttgcc

SEQ ID NO: 8238606 - DNA, 22 bp, Homo sapiens
ttcattcctgagcccatattta

SEQ ID NO: 8238607 - DNA, 22 bp, Homo sapiens
ttcattccttccctaagcaact

SEQ ID NO: 8238608 - DNA, 22 bp, Homo sapiens
ttcattcccaagagtaaacata

SEQ ID NO: 8238609 - DNA, 22 bp, Homo sapiens
ttcatgaggtacctgtgatcat

SEQ ID NO: 8238610 - DNA, 20 bp, Homo sapiens
ttcattcattccacaacttc

SEQ ID NO: 8238611 - DNA, 22 bp, Homo sapiens
ttcagaaaggtaaatggatttc

SEQ ID NO: 8238612 - DNA, 22 bp, Homo sapiens
ttcagaaaggttaatctggatt

SEQ ID NO: 8238613 - DNA, 22 bp, Homo sapiens
ttcagaaaggttaatctggatt

SEQ ID NO: 8238614 - DNA, 23 bp, Homo sapiens
ttcatgagattatctgcatgtgt

SEQ ID NO: 8238615 - DNA, 21 bp, Homo sapiens
ttcatgagataaccagctgta

SEQ ID NO: 8238616 - DNA, 22 bp, Homo sapiens
cgctgggggaacttcagccaat

SEQ ID NO: 8238617 - DNA, 22 bp, Homo sapiens
cgctgggggaacttcagccaat

SEQ ID NO: 8238618 - DNA, 22 bp, Homo sapiens
cgctgggggaacagcgagggtg

SEQ ID NO: 8238619 - DNA, 22 bp, Homo sapiens
cgctgggggaacagcgagggtg

SEQ ID NO: 8238620 - DNA, 22 bp, Homo sapiens
cgctgggggaacagcgagggtg

SEQ ID NO: 8238621 - DNA, 22 bp, Homo sapiens
cgctgggggaacagcgagggtg

SEQ ID NO: 8238622 - DNA, 22 bp, Homo sapiens
cgctgggggaacagcgagggtg

SEQ ID NO: 8238623 - DNA, 22 bp, Homo sapiens
cgctggggctttttgcttgaga

SEQ ID NO: 8238624 - DNA, 22 bp, Homo sapiens
cgctggggctttttgcttgaga

SEQ ID NO: 8238625 - DNA, 22 bp, Homo sapiens
cgctgggcgccgacctgctggc

SEQ ID NO: 8238626 - DNA, 22 bp, Homo sapiens
cgctgggcaggtccacttgtta

SEQ ID NO: 8238627 - DNA, 22 bp, Homo sapiens
ttcacatggcaatagagaggga

SEQ ID NO: 8238628 - DNA, 22 bp, Homo sapiens
ttcacatgttggacatagagga

SEQ ID NO: 8238629 - DNA, 22 bp, Homo sapiens
ttcacattacaaggccatattt

SEQ ID NO: 8238630 - DNA, 22 bp, Homo sapiens
ttcacattaagcctcctcctac

SEQ ID NO: 8238631 - DNA, 22 bp, Homo sapiens
cgctgggggaacttcagccaat

SEQ ID NO: 8238632 - DNA, 22 bp, Homo sapiens
cggaaactacgtgacacccgtt

SEQ ID NO: 8238633 - DNA, 21 bp, Homo sapiens
cggaaaggactagggctcaga

SEQ ID NO: 8238634 - DNA, 22 bp, Homo sapiens
cggaagacagtccgctctttca

SEQ ID NO: 8238635 - DNA, 22 bp, Homo sapiens
cggaagagggacagcgccagcc

SEQ ID NO: 8238636 - DNA, 21 bp, Homo sapiens
cggaaactcggctctggttcc

SEQ ID NO: 8238637 - DNA, 22 bp, Homo sapiens
cggaaacttgagaaccagccag

SEQ ID NO: 8238638 - DNA, 21 bp, Homo sapiens
cggctcagtgcctgctccttc

SEQ ID NO: 8238639 - DNA, 22 bp, Homo sapiens
cggcatccccacttcctcctgc

SEQ ID NO: 8238640 - DNA, 22 bp, Homo sapiens
cggcagtgggcgccaggtctcc

SEQ ID NO: 8238641 - DNA, 22 bp, Homo sapiens
cggcaggtgtgctcactctgcc

SEQ ID NO: 8238642 - DNA, 22 bp, Homo sapiens
cggacaggctcctggagctcct

SEQ ID NO: 8238643 - DNA, 22 bp, Homo sapiens
cggaatgtccttcttaaggtgt

SEQ ID NO: 8238644 - DNA, 22 bp, Homo sapiens
cggaatgtcccaggtcctgatc

SEQ ID NO: 8238645 - DNA, 22 bp, Homo sapiens
cggaagcgttctcagcaggggc

SEQ ID NO: 8238646 - DNA, 22 bp, Homo sapiens
cctgggtggttccggcaaggag

SEQ ID NO: 8238647 - DNA, 22 bp, Homo sapiens
cctgggtggttccggcaaggag

SEQ ID NO: 8238648 - DNA, 22 bp, Homo sapiens
ttcacagaccaggaggctgtga

SEQ ID NO: 8238649 - DNA, 22 bp, Homo sapiens
cctgggtggctgcctgcctttc

SEQ ID NO: 8238650 - DNA, 22 bp, Homo sapiens
cctgggtggcagaggttgcagt

SEQ ID NO: 8238651 - DNA, 22 bp, Homo sapiens
cctgggtggcagaggttgcagt

SEQ ID NO: 8238652 - DNA, 21 bp, Homo sapiens
cctgggtgggacccctcttcc

SEQ ID NO: 8238653 - DNA, 22 bp, Homo sapiens
cctgggtggttccggcaaggag

SEQ ID NO: 8238654 - DNA, 22 bp, Homo sapiens
ttcacagtggcttaggctatgg

SEQ ID NO: 8238655 - DNA, 22 bp, Homo sapiens
ttcacagtgtttctcacggtta

SEQ ID NO: 8238656 - DNA, 22 bp, Homo sapiens
ttcacagtggtagtgcatttag

SEQ ID NO: 8238657 - DNA, 22 bp, Homo sapiens
ttcacagttgggcaggttgtgt

SEQ ID NO: 8238658 - DNA, 22 bp, Homo sapiens
ttcacagttcctgggaaaacag

SEQ ID NO: 8238659 - DNA, 22 bp, Homo sapiens
ttcacataaatagatcacatca

SEQ ID NO: 8238660 - DNA, 22 bp, Homo sapiens
ttcacataaatagatcacatca

SEQ ID NO: 8238661 - DNA, 22 bp, Homo sapiens
ttcacatgaaagtaggaaagga

SEQ ID NO: 8238662 - DNA, 22 bp, Homo sapiens
ttgagaaaacacagagtttatt

SEQ ID NO: 8238663 - DNA, 22 bp, Homo sapiens
ttgacttttcttggtcacatga

SEQ ID NO: 8238664 - DNA, 22 bp, Homo sapiens
ttgagaaaatagttcgaatgtt

SEQ ID NO: 8238665 - DNA, 22 bp, Homo sapiens
ttgagaaaagctgtgtaaggat

SEQ ID NO: 8238666 - DNA, 20 bp, Homo sapiens
ttgagcttttagtacagaca

SEQ ID NO: 8238667 - DNA, 22 bp, Homo sapiens
ttgagctgtaaggtgggatgtg

SEQ ID NO: 8238668 - DNA, 22 bp, Homo sapiens
ttgagctgcctggctgtggctc

SEQ ID NO: 8238669 - DNA, 22 bp, Homo sapiens
ctcagcagtatactctgaagat

SEQ ID NO: 8238670 - DNA, 22 bp, Homo sapiens
ttgactgtacaaccttttgtag

SEQ ID NO: 8238671 - DNA, 22 bp, Homo sapiens
ttgactgcaccactcagccctc

SEQ ID NO: 8238672 - DNA, 22 bp, Homo sapiens
ttgactatactctggcggaaaa

SEQ ID NO: 8238673 - DNA, 22 bp, Homo sapiens
ttgacttcagaatgttgatggt

SEQ ID NO: 8238674 - DNA, 22 bp, Homo sapiens
ttgactgttttcactccctttc

SEQ ID NO: 8238675 - DNA, 17 bp, Homo sapiens
ttgactgttaatgggtt

SEQ ID NO: 8238676 - DNA, 22 bp, Homo sapiens
ttgactgttgctgccattctgg

SEQ ID NO: 8238677 - DNA, 22 bp, Homo sapiens
ttgactgttgctgccattctgg

SEQ ID NO: 8238678 - DNA, 22 bp, Homo sapiens
ttgactttacagttttcttagg

SEQ ID NO: 8238679 - DNA, 22 bp, Homo sapiens
ttgactttatgtcaacttgcct

SEQ ID NO: 8238680 - DNA, 22 bp, Homo sapiens
ttgaggaggcctttcagggctt

SEQ ID NO: 8238681 - DNA, 22 bp, Homo sapiens
ttgaggaggcctttcagggctt

SEQ ID NO: 8238682 - DNA, 22 bp, Homo sapiens
ttgaggagtacaaagcatgctt

SEQ ID NO: 8238683 - DNA, 23 bp, Homo sapiens
ttgaggacaatttacatggtgtt

SEQ ID NO: 8238684 - DNA, 20 bp, Homo sapiens
ttgagcttttagtacagaca

SEQ ID NO: 8238685 - DNA, 20 bp, Homo sapiens
ttgagcttttagtacagaca

SEQ ID NO: 8238686 - DNA, 22 bp, Homo sapiens
ttgaggagtggcgctggactta

SEQ ID NO: 8238687 - DNA, 22 bp, Homo sapiens
ttgagttctggtcttttaaaag

SEQ ID NO: 8238688 - DNA, 22 bp, Homo sapiens
ttgataaaatgatatcttcttt

SEQ ID NO: 8238689 - DNA, 22 bp, Homo sapiens
ttgataaaatgatgaaatcact

SEQ ID NO: 8238690 - DNA, 22 bp, Homo sapiens
ttgataaaatgatgaaatcact

SEQ ID NO: 8238691 - DNA, 22 bp, Homo sapiens
ttgataaaatgatatcttcttt

SEQ ID NO: 8238692 - DNA, 22 bp, Homo sapiens
ttgataaaatgatatcttcttt

SEQ ID NO: 8238693 - DNA, 22 bp, Homo sapiens
ttgataaaatgatgaaatcact

SEQ ID NO: 8238694 - DNA, 18 bp, Homo sapiens
ttgataaacaatttcatt

SEQ ID NO: 8238695 - DNA, 18 bp, Homo sapiens
ttgataaacaatttcatt

SEQ ID NO: 8238696 - DNA, 18 bp, Homo sapiens
ttgataaacaatttcatt

SEQ ID NO: 8238697 - DNA, 18 bp, Homo sapiens
ttgataaacaatttcatt

SEQ ID NO: 8238698 - DNA, 22 bp, Homo sapiens
ttgatacacaatggaacaatgt

SEQ ID NO: 8238699 - DNA, 17 bp, Homo sapiens
ctcagcagggctcactt

SEQ ID NO: 8238700 - DNA, 17 bp, Homo sapiens
ctcagcagggctcactt

SEQ ID NO: 8238701 - DNA, 17 bp, Homo sapiens
ctcagcagggctcactt

SEQ ID NO: 8238702 - DNA, 22 bp, Homo sapiens
ctcagcaggcactgtgccttac

SEQ ID NO: 8238703 - DNA, 22 bp, Homo sapiens
ctcagcagtaaacgtccggaac

SEQ ID NO: 8238704 - DNA, 22 bp, Homo sapiens
ctcagcaggtcttgggtagggg

SEQ ID NO: 8238705 - DNA, 22 bp, Homo sapiens
ctcagcaggtaccacatgatct

SEQ ID NO: 8238706 - DNA, 23 bp, Homo sapiens
ctcagcaggtcaggccccttcct

SEQ ID NO: 8238707 - DNA, 20 bp, Homo sapiens
ctcagcagattcttctagaa

SEQ ID NO: 8238708 - DNA, 20 bp, Homo sapiens
ctcagcagattcttctagaa

SEQ ID NO: 8238709 - DNA, 23 bp, Homo sapiens
ctcagcagcctgctgcagataag

SEQ ID NO: 8238710 - DNA, 22 bp, Homo sapiens
ctcagcagctgctgctggtggg

SEQ ID NO: 8238711 - DNA, 22 bp, Homo sapiens
ctcagcagctacaggattcggg

SEQ ID NO: 8238712 - DNA, 22 bp, Homo sapiens
ctcagcagctgctgctggtggg

SEQ ID NO: 8238713 - DNA, 22 bp, Homo sapiens
ctattttgcctgcctagaaatc

SEQ ID NO: 8238714 - DNA, 22 bp, Homo sapiens
ctatttttctgtaccctaattt

SEQ ID NO: 8238715 - DNA, 22 bp, Homo sapiens
ctatttttctgtaccctaattt

SEQ ID NO: 8238716 - DNA, 22 bp, Homo sapiens
ctatttttctgtaccctaattt

SEQ ID NO: 8238717 - DNA, 22 bp, Homo sapiens
ctcagcaccccgacaggacatt

SEQ ID NO: 8238718 - DNA, 22 bp, Homo sapiens
ctcagcaccccgacaggacatt

SEQ ID NO: 8238719 - DNA, 22 bp, Homo sapiens
ctcagcaccccgacaggacatt

SEQ ID NO: 8238720 - DNA, 22 bp, Homo sapiens
ctcagcactttggaaggctgat

SEQ ID NO: 8238721 - DNA, 22 bp, Homo sapiens
ctcagcagagaccagggaggaa

SEQ ID NO: 8238722 - DNA, 22 bp, Homo sapiens
ctcagcacccgggcctttcctc

SEQ ID NO: 8238723 - DNA, 22 bp, Homo sapiens
ctcagcactgacccaggagatg

SEQ ID NO: 8238724 - DNA, 22 bp, Homo sapiens
ctcagcactgacccaggagatg

SEQ ID NO: 8238725 - DNA, 22 bp, Homo sapiens
ctcagcactttggaaggctgat

SEQ ID NO: 8238726 - DNA, 22 bp, Homo sapiens
ttcttgtttattaagatataaa

SEQ ID NO: 8238727 - DNA, 22 bp, Homo sapiens
ttcttgtttattaagatataaa

SEQ ID NO: 8238728 - DNA, 22 bp, Homo sapiens
ttcttgtttattaagatataaa

SEQ ID NO: 8238729 - DNA, 22 bp, Homo sapiens
ctattttaagaggccattaggt

SEQ ID NO: 8238730 - DNA, 22 bp, Homo sapiens
ctattttaagaggccattaggt

SEQ ID NO: 8238731 - DNA, 22 bp, Homo sapiens
ctattttaacttgattacctct

SEQ ID NO: 8238732 - DNA, 22 bp, Homo sapiens
ctattttaacttgattacctct

SEQ ID NO: 8238733 - DNA, 22 bp, Homo sapiens
ctattttaacttgattacctct

SEQ ID NO: 8238734 - DNA, 22 bp, Homo sapiens
ctattttaagaggccattaggt

SEQ ID NO: 8238735 - DNA, 22 bp, Homo sapiens
ctattttaagaggccattaggt

SEQ ID NO: 8238736 - DNA, 22 bp, Homo sapiens
ctattttcattcttacattgtc

SEQ ID NO: 8238737 - DNA, 22 bp, Homo sapiens
ctattttccgcagcaggaagta

SEQ ID NO: 8238738 - DNA, 22 bp, Homo sapiens
ctattttctgtctctatagagt

SEQ ID NO: 8238739 - DNA, 22 bp, Homo sapiens
ctattttctgtctctatagagt

SEQ ID NO: 8238740 - DNA, 22 bp, Homo sapiens
ttcttgtatgtatgcaaaatca

SEQ ID NO: 8238741 - DNA, 22 bp, Homo sapiens
ttcttgtctttgttatgtagga

SEQ ID NO: 8238742 - DNA, 22 bp, Homo sapiens
ttcttgtctttgttatgtagga

SEQ ID NO: 8238743 - DNA, 22 bp, Homo sapiens
ttcttgtctttgttatgtagga

SEQ ID NO: 8238744 - DNA, 22 bp, Homo sapiens
ttcttgttctcctcatttagag

SEQ ID NO: 8238745 - DNA, 22 bp, Homo sapiens
ttcttgttctggttctgttagc

SEQ ID NO: 8238746 - DNA, 22 bp, Homo sapiens
ttcttgttggcctcaggtttgc

SEQ ID NO: 8238747 - DNA, 22 bp, Homo sapiens
ttcttgttctggttctgttagc

SEQ ID NO: 8238748 - DNA, 22 bp, Homo sapiens
ttcttgttctggttctgttagc

SEQ ID NO: 8238749 - DNA, 22 bp, Homo sapiens
ttcttgtatataaaaatcattt

SEQ ID NO: 8238750 - DNA, 22 bp, Homo sapiens
ttcttgtatataaaaatcattt

SEQ ID NO: 8238751 - DNA, 22 bp, Homo sapiens
ttcttgtactggagatacatga

SEQ ID NO: 8238752 - DNA, 22 bp, Homo sapiens
ttcttgtaatttggagaaatga

SEQ ID NO: 8238753 - DNA, 22 bp, Homo sapiens
ttcttgtaatttggagaaatga

SEQ ID NO: 8238754 - DNA, 21 bp, Homo sapiens
ttcttggcaggtgtatcataa

SEQ ID NO: 8238755 - DNA, 22 bp, Homo sapiens
ttcttggcaatggtattcatcc

SEQ ID NO: 8238756 - DNA, 22 bp, Homo sapiens
ttcttggcacagatgagattct

SEQ ID NO: 8238757 - DNA, 22 bp, Homo sapiens
ttcttgggctccaccccagact

SEQ ID NO: 8238758 - DNA, 22 bp, Homo sapiens
ttcttggctgttcatggtcagg

SEQ ID NO: 8238759 - DNA, 22 bp, Homo sapiens
ttcttggctgggctttgcttcc

SEQ ID NO: 8238760 - DNA, 22 bp, Homo sapiens
ctatttctaaacctataagtga

SEQ ID NO: 8238761 - DNA, 22 bp, Homo sapiens
ctatttctacacagggtcggcg

SEQ ID NO: 8238762 - DNA, 22 bp, Homo sapiens
ctatttctaaacctataagtga

SEQ ID NO: 8238763 - DNA, 23 bp, Homo sapiens
ctatttctcatagttcaggtctt

SEQ ID NO: 8238764 - DNA, 22 bp, Homo sapiens
ctatttcagctgcctttgactg

SEQ ID NO: 8238765 - DNA, 22 bp, Homo sapiens
ctatttctgcctaatgacctgt

SEQ ID NO: 8238766 - DNA, 22 bp, Homo sapiens
ctatttatgtgctattttgtat

SEQ ID NO: 8238767 - DNA, 22 bp, Homo sapiens
ctattcaattttgctattgtag

SEQ ID NO: 8238768 - DNA, 22 bp, Homo sapiens
ctattcaacttgactgtttcac

SEQ ID NO: 8238769 - DNA, 22 bp, Homo sapiens
ctagggctcgcaagggctggag

SEQ ID NO: 8238770 - DNA, 23 bp, Homo sapiens
ctagggcagtatttcacagacac

SEQ ID NO: 8238771 - DNA, 22 bp, Homo sapiens
ctagggctagacagacgcatgt

SEQ ID NO: 8238772 - DNA, 22 bp, Homo sapiens
ctagggccaaaggctgtgatgc

SEQ ID NO: 8238773 - DNA, 22 bp, Homo sapiens
ctagggctccaaagctgagaag

SEQ ID NO: 8238774 - DNA, 22 bp, Homo sapiens
ctagggctccaaagctgagaag

SEQ ID NO: 8238775 - DNA, 22 bp, Homo sapiens
ctagggagtggcagagctggga

SEQ ID NO: 8238776 - DNA, 22 bp, Homo sapiens
ctagggagtggcagagctggga

SEQ ID NO: 8238777 - DNA, 22 bp, Homo sapiens
ctagggagtggcagagctggga

SEQ ID NO: 8238778 - DNA, 22 bp, Homo sapiens
ttctgtcatttagcattgtcat

SEQ ID NO: 8238779 - DNA, 21 bp, Homo sapiens
ttcttcctaaatacagatctc

SEQ ID NO: 8238780 - DNA, 22 bp, Homo sapiens
ttcttcccttcattccaccacc

SEQ ID NO: 8238781 - DNA, 22 bp, Homo sapiens
ttcttcctcacactctcaccca

SEQ ID NO: 8238782 - DNA, 22 bp, Homo sapiens
ttcttcctcacactctcaccca

SEQ ID NO: 8238783 - DNA, 22 bp, Homo sapiens
ttcttcctcacactctcaccca

SEQ ID NO: 8238784 - DNA, 22 bp, Homo sapiens
ttctgtcacttttttggaatct

SEQ ID NO: 8238785 - DNA, 22 bp, Homo sapiens
ttctgtcacttgcaatcaagag

SEQ ID NO: 8238786 - DNA, 22 bp, Homo sapiens
ttctgtcacttaggaggtcata

SEQ ID NO: 8238787 - DNA, 22 bp, Homo sapiens
ttctgtcaaatgccagtagaga

SEQ ID NO: 8238788 - DNA, 22 bp, Homo sapiens
ttctgtcacagtgctggtatca

SEQ ID NO: 8238789 - DNA, 22 bp, Homo sapiens
ttctgtcagctgctttgtctca

SEQ ID NO: 8238790 - DNA, 22 bp, Homo sapiens
ttctgtcagcgtcagaaattct

SEQ ID NO: 8238791 - DNA, 22 bp, Homo sapiens
ttctgtcatgctcatgtaattg

SEQ ID NO: 8238792 - DNA, 22 bp, Homo sapiens
ttctgtcatgctcatgtaattg

SEQ ID NO: 8238793 - DNA, 22 bp, Homo sapiens
ctattttaacttgattacctct

SEQ ID NO: 8238794 - DNA, 22 bp, Homo sapiens
ttctgtaggcatggaacaggga

SEQ ID NO: 8238795 - DNA, 22 bp, Homo sapiens
ctattttaacttgattacctct

SEQ ID NO: 8238796 - DNA, 22 bp, Homo sapiens
ttctgtatattgtaaagactca

SEQ ID NO: 8238797 - DNA, 22 bp, Homo sapiens
ttctgtatacgttacaattgag

SEQ ID NO: 8238798 - DNA, 22 bp, Homo sapiens
ttctgtatattgaggttatagt

SEQ ID NO: 8238799 - DNA, 22 bp, Homo sapiens
ttctgtatgctctgggtccaga

SEQ ID NO: 8238800 - DNA, 22 bp, Homo sapiens
ttctgtcaaagactttttcagg

SEQ ID NO: 8238801 - DNA, 22 bp, Homo sapiens
ttctgtcaaatgccagtagaga

SEQ ID NO: 8238802 - DNA, 22 bp, Homo sapiens
ttctgtatttagtttgaggaca

SEQ ID NO: 8238803 - DNA, 20 bp, Homo sapiens
ttccttttcgcctctctccc

SEQ ID NO: 8238804 - DNA, 20 bp, Homo sapiens
ttccttttcgcctctctccc

SEQ ID NO: 8238805 - DNA, 22 bp, Homo sapiens
ttccttttcttctaccacatgt

SEQ ID NO: 8238806 - DNA, 22 bp, Homo sapiens
ttccttttcttaaacatatgtg

SEQ ID NO: 8238807 - DNA, 20 bp, Homo sapiens
ctagcctggccttgctctgg

SEQ ID NO: 8238808 - DNA, 20 bp, Homo sapiens
ctagcctggccttgctctgg

SEQ ID NO: 8238809 - DNA, 22 bp, Homo sapiens
ctagccatgggcattaaaggta

SEQ ID NO: 8238810 - DNA, 22 bp, Homo sapiens
ctagcccaggaatgccgtggcc

SEQ ID NO: 8238811 - DNA, 20 bp, Homo sapiens
ctaggcagcgagtgactgag

SEQ ID NO: 8238812 - DNA, 20 bp, Homo sapiens
ctaggcagcgagtgactgag

SEQ ID NO: 8238813 - DNA, 20 bp, Homo sapiens
ctaggcagcgagtgactgag

SEQ ID NO: 8238814 - DNA, 22 bp, Homo sapiens
ctaggcagatggagaagtggct

SEQ ID NO: 8238815 - DNA, 22 bp, Homo sapiens
ctaggcagatggagaagtggct

SEQ ID NO: 8238816 - DNA, 22 bp, Homo sapiens
ctaggcagatggagaagtggct

SEQ ID NO: 8238817 - DNA, 22 bp, Homo sapiens
ctaggcagatggagaagtggct

SEQ ID NO: 8238818 - DNA, 22 bp, Homo sapiens
ctaggcagatggagaagtggct

SEQ ID NO: 8238819 - DNA, 22 bp, Homo sapiens
ttcctttcccttgcttctgtgc

SEQ ID NO: 8238820 - DNA, 22 bp, Homo sapiens
ttcctttgggaaatcactaagg

SEQ ID NO: 8238821 - DNA, 22 bp, Homo sapiens
ttccttctaatattctgcctgt

SEQ ID NO: 8238822 - DNA, 22 bp, Homo sapiens
ttccttctaatattctgcctgt

SEQ ID NO: 8238823 - DNA, 22 bp, Homo sapiens
ttccttctaatattctgcctgt

SEQ ID NO: 8238824 - DNA, 22 bp, Homo sapiens
ttccttctaatattctgcctgt

SEQ ID NO: 8238825 - DNA, 22 bp, Homo sapiens
ttccttctaattttacacctga

SEQ ID NO: 8238826 - DNA, 22 bp, Homo sapiens
ttccttctaattttacacctga

SEQ ID NO: 8238827 - DNA, 22 bp, Homo sapiens
ttccttctaattttacacctga

SEQ ID NO: 8238828 - DNA, 22 bp, Homo sapiens
ttccttctaattttacacctga

SEQ ID NO: 8238829 - DNA, 22 bp, Homo sapiens
ttccttctaattttacacctga

SEQ ID NO: 8238830 - DNA, 22 bp, Homo sapiens
ttcctttccctcacagcctcgg

SEQ ID NO: 8238831 - DNA, 22 bp, Homo sapiens
ttcctttccctcacagcctcgg

SEQ ID NO: 8238832 - DNA, 22 bp, Homo sapiens
ctaggcagtcctgacggtacta

SEQ ID NO: 8238833 - DNA, 22 bp, Homo sapiens
ctaggcagttctagttctggaa

SEQ ID NO: 8238834 - DNA, 22 bp, Homo sapiens
ctaggcagttctagttctggaa

SEQ ID NO: 8238835 - DNA, 22 bp, Homo sapiens
ctaggccagttaggaagagaag

SEQ ID NO: 8238836 - DNA, 22 bp, Homo sapiens
ctaggccacttgctctcatgga

SEQ ID NO: 8238837 - DNA, 22 bp, Homo sapiens
ctaggcagctttgggtgtgaag

SEQ ID NO: 8238838 - DNA, 22 bp, Homo sapiens
ctaggcagctttgggtgtgaag

SEQ ID NO: 8238839 - DNA, 22 bp, Homo sapiens
ctaggcagctttgggtgtgaag

SEQ ID NO: 8238840 - DNA, 23 bp, Homo sapiens
ctaggcaggattgtaggcgggta

SEQ ID NO: 8238841 - DNA, 22 bp, Homo sapiens
ctaggcagggtgctgtgccatg

SEQ ID NO: 8238842 - DNA, 23 bp, Homo sapiens
ctaggcaggattgtaggcgggta

SEQ ID NO: 8238843 - DNA, 22 bp, Homo sapiens
ctaggcagctttgggtgtgaag

SEQ ID NO: 8238844 - DNA, 23 bp, Homo sapiens
ctaggcaggattgtaggcgggta

SEQ ID NO: 8238845 - DNA, 22 bp, Homo sapiens
ctaggcagggtgctgtgccatg

SEQ ID NO: 8238846 - DNA, 22 bp, Homo sapiens
ctaggccttcataggcatggaa

SEQ ID NO: 8238847 - DNA, 22 bp, Homo sapiens
ctaggctcagtctctggtctgt

SEQ ID NO: 8238848 - DNA, 22 bp, Homo sapiens
ctaggccatattttgagaactg

SEQ ID NO: 8238849 - DNA, 22 bp, Homo sapiens
ctaggcccatgaggtttgctgg

SEQ ID NO: 8238850 - DNA, 22 bp, Homo sapiens
ctaggccatattttgagaactg

SEQ ID NO: 8238851 - DNA, 22 bp, Homo sapiens
ctaggctctgccagcactgtcg

SEQ ID NO: 8238852 - DNA, 22 bp, Homo sapiens
ctaggctctgccagcactgtcg

SEQ ID NO: 8238853 - DNA, 22 bp, Homo sapiens
ctaggctcttctggaaggttgt

SEQ ID NO: 8238854 - DNA, 22 bp, Homo sapiens
ctaggctcttctggaaggttgt

SEQ ID NO: 8238855 - DNA, 22 bp, Homo sapiens
ctaggctgagctgggctgagct

SEQ ID NO: 8238856 - DNA, 22 bp, Homo sapiens
ctaggctcttctggaaggttgt

SEQ ID NO: 8238857 - DNA, 22 bp, Homo sapiens
ctagggagactcgcaggactca

SEQ ID NO: 8238858 - DNA, 22 bp, Homo sapiens
ctagggaaataaactgagtggt

SEQ ID NO: 8238859 - DNA, 22 bp, Homo sapiens
ctagggaacaagatgcccaggg

SEQ ID NO: 8238860 - DNA, 22 bp, Homo sapiens
ctaggctgcacctaggatggct

SEQ ID NO: 8238861 - DNA, 22 bp, Homo sapiens
ctaggctggagtgcattggcgt

SEQ ID NO: 8238862 - DNA, 22 bp, Homo sapiens
ctaggctgtaaagagctaggag

SEQ ID NO: 8238863 - DNA, 22 bp, Homo sapiens
ctaggctgtaaagagctaggag

SEQ ID NO: 8238864 - DNA, 22 bp, Homo sapiens
ctaggctgtaacccctgccagg

SEQ ID NO: 8238865 - DNA, 22 bp, Homo sapiens
tttgtcttggcctcagttttct

SEQ ID NO: 8238866 - DNA, 22 bp, Homo sapiens
ctctcctggggagcacacacac

SEQ ID NO: 8238867 - DNA, 22 bp, Homo sapiens
ctctcctggggagcacacacac

SEQ ID NO: 8238868 - DNA, 22 bp, Homo sapiens
ctctcctgggctgaccgtccga

SEQ ID NO: 8238869 - DNA, 22 bp, Homo sapiens
ctctcctggggagcacacacac

SEQ ID NO: 8238870 - DNA, 22 bp, Homo sapiens
tttgtacatcctaattctgagt

SEQ ID NO: 8238871 - DNA, 22 bp, Homo sapiens
tttgtacatcctaattctgagt

SEQ ID NO: 8238872 - DNA, 22 bp, Homo sapiens
ctctcctctgaagtggtgaccc

SEQ ID NO: 8238873 - DNA, 22 bp, Homo sapiens
ctctcctctgaagtggtgaccc

SEQ ID NO: 8238874 - DNA, 22 bp, Homo sapiens
ctctcctctgaagtggtgaccc

SEQ ID NO: 8238875 - DNA, 23 bp, Homo sapiens
ctctcctgaaggacaagctgccg

SEQ ID NO: 8238876 - DNA, 23 bp, Homo sapiens
ctctcctgaaggacaagctgccg

SEQ ID NO: 8238877 - DNA, 23 bp, Homo sapiens
ctctcctgaaggacaagctgccg

SEQ ID NO: 8238878 - DNA, 23 bp, Homo sapiens
ctctcctgaaggacaagctgccg

SEQ ID NO: 8238879 - DNA, 22 bp, Homo sapiens
ctctcctgggctgaccgtccga

SEQ ID NO: 8238880 - DNA, 22 bp, Homo sapiens
ctctcctgggctgaccgtccga

SEQ ID NO: 8238881 - DNA, 19 bp, Homo sapiens
tttgtgaagaaaatgatgc

SEQ ID NO: 8238882 - DNA, 22 bp, Homo sapiens
tttgtgaataagagaatgacag

SEQ ID NO: 8238883 - DNA, 22 bp, Homo sapiens
tttgtgaacttaggcaattagg

SEQ ID NO: 8238884 - DNA, 22 bp, Homo sapiens
tttgtcttgtgtccttaggacc

SEQ ID NO: 8238885 - DNA, 22 bp, Homo sapiens
ctctggctggctgggcctcagt

SEQ ID NO: 8238886 - DNA, 22 bp, Homo sapiens
ctctggctgtcccgatgagcag

SEQ ID NO: 8238887 - DNA, 22 bp, Homo sapiens
ctctggctgtcccgatgagcag

SEQ ID NO: 8238888 - DNA, 22 bp, Homo sapiens
ctctggctggcattgctggact

SEQ ID NO: 8238889 - DNA, 22 bp, Homo sapiens
ctctggctggcattgctggact

SEQ ID NO: 8238890 - DNA, 22 bp, Homo sapiens
ctctggctggcattgctggact

SEQ ID NO: 8238891 - DNA, 22 bp, Homo sapiens
ctctggctggcattgctggact

SEQ ID NO: 8238892 - DNA, 22 bp, Homo sapiens
ctctggcttagtatgctccaaa

SEQ ID NO: 8238893 - DNA, 22 bp, Homo sapiens
ctctggcttagtatgctccaaa

SEQ ID NO: 8238894 - DNA, 22 bp, Homo sapiens
ctctggcttctaccttgcagtt

SEQ ID NO: 8238895 - DNA, 22 bp, Homo sapiens
tttgtgaataggttggcttcca

SEQ ID NO: 8238896 - DNA, 22 bp, Homo sapiens
tttgtgaataggttggcttcca

SEQ ID NO: 8238897 - DNA, 22 bp, Homo sapiens
tttgtgaataggttggcttcca

SEQ ID NO: 8238898 - DNA, 22 bp, Homo sapiens
tttgtgaataggttggcttcca

SEQ ID NO: 8238899 - DNA, 22 bp, Homo sapiens
tttgtgaatggaatccacagac

SEQ ID NO: 8238900 - DNA, 19 bp, Homo sapiens
ctctggctcctgggctgcc

SEQ ID NO: 8238901 - DNA, 22 bp, Homo sapiens
ctctggctgcctctcaggcctg

SEQ ID NO: 8238902 - DNA, 22 bp, Homo sapiens
ttttattcatagggatggagag

SEQ ID NO: 8238903 - DNA, 22 bp, Homo sapiens
ttttattcaaatagttcacact

SEQ ID NO: 8238904 - DNA, 22 bp, Homo sapiens
ttttattcaaatagttcacact

SEQ ID NO: 8238905 - DNA, 22 bp, Homo sapiens
ttttattcaaatagttcacact

SEQ ID NO: 8238906 - DNA, 22 bp, Homo sapiens
ttttattcaaatagttcacact

SEQ ID NO: 8238907 - DNA, 22 bp, Homo sapiens
ttttattcaaatagttcacact

SEQ ID NO: 8238908 - DNA, 22 bp, Homo sapiens
ttttattatctttgaatgggac

SEQ ID NO: 8238909 - DNA, 22 bp, Homo sapiens
ttttattatctttgaatgggac

SEQ ID NO: 8238910 - DNA, 22 bp, Homo sapiens
ttttattatctttgaatgggac

SEQ ID NO: 8238911 - DNA, 22 bp, Homo sapiens
ttttattctaagtatgatggga

SEQ ID NO: 8238912 - DNA, 22 bp, Homo sapiens
ttttattctcaagacaatggga

SEQ ID NO: 8238913 - DNA, 22 bp, Homo sapiens
ttttattctaagtatgatggga

SEQ ID NO: 8238914 - DNA, 22 bp, Homo sapiens
ttttattcatagggatggagag

SEQ ID NO: 8238915 - DNA, 22 bp, Homo sapiens
ttttattcatagggatggagag

SEQ ID NO: 8238916 - DNA, 23 bp, Homo sapiens
ttttattgatatgtagctgttgt

SEQ ID NO: 8238917 - DNA, 23 bp, Homo sapiens
ttttattgatatgtagctgttgt

SEQ ID NO: 8238918 - DNA, 23 bp, Homo sapiens
ttttattgatatgtagctgttgt

SEQ ID NO: 8238919 - DNA, 23 bp, Homo sapiens
ttttattgatatgtagctgttgt

SEQ ID NO: 8238920 - DNA, 23 bp, Homo sapiens
ttttattgatatgtagctgttgt

SEQ ID NO: 8238921 - DNA, 22 bp, Homo sapiens
ttttattctcagctccagagag

SEQ ID NO: 8238922 - DNA, 22 bp, Homo sapiens
ttttattctcagctccagagag

SEQ ID NO: 8238923 - DNA, 22 bp, Homo sapiens
ttttattctcagctccagagag

SEQ ID NO: 8238924 - DNA, 22 bp, Homo sapiens
ttttattctcagctccagagag

SEQ ID NO: 8238925 - DNA, 22 bp, Homo sapiens
ttttattctcaagacaatggga

SEQ ID NO: 8238926 - DNA, 22 bp, Homo sapiens
ttttattctcaagacaatggga

SEQ ID NO: 8238927 - DNA, 22 bp, Homo sapiens
ctctgggcggcccaggccaacc

SEQ ID NO: 8238928 - DNA, 22 bp, Homo sapiens
ttttagttgtagttggtgagga

SEQ ID NO: 8238929 - DNA, 22 bp, Homo sapiens
ttttattatctttgaatgggac

SEQ ID NO: 8238930 - DNA, 22 bp, Homo sapiens
ctctgggcaaagatgcctcatc

SEQ ID NO: 8238931 - DNA, 22 bp, Homo sapiens
ctctgggatgaggcctaggcac

SEQ ID NO: 8238932 - DNA, 22 bp, Homo sapiens
ctctgggatgaggcctaggcac

SEQ ID NO: 8238933 - DNA, 18 bp, Homo sapiens
ctctgggagaggcataca

SEQ ID NO: 8238934 - DNA, 22 bp, Homo sapiens
ctctgggagtggccacttctca

SEQ ID NO: 8238935 - DNA, 22 bp, Homo sapiens
ctctgggatagagcctcggtct

SEQ ID NO: 8238936 - DNA, 22 bp, Homo sapiens
ctctgggaggtgttactatctg

SEQ ID NO: 8238937 - DNA, 22 bp, Homo sapiens
ctctggcttctaccttgcagtt

SEQ ID NO: 8238938 - DNA, 18 bp, Homo sapiens
ctctgggagaggcataca

SEQ ID NO: 8238939 - DNA, 22 bp, Homo sapiens
ctctgggcaagtttcttcatga

SEQ ID NO: 8238940 - DNA, 22 bp, Homo sapiens
ctctgggcaagtttcttcatga

SEQ ID NO: 8238941 - DNA, 22 bp, Homo sapiens
ctctgggcacattttccaggac

SEQ ID NO: 8238942 - DNA, 22 bp, Homo sapiens
ctctgggcaagtatgatagaaa

SEQ ID NO: 8238943 - DNA, 22 bp, Homo sapiens
ctctgggcaggaccagtggacc

SEQ ID NO: 8238944 - DNA, 22 bp, Homo sapiens
ctctgggcaggaccagtggacc

SEQ ID NO: 8238945 - DNA, 22 bp, Homo sapiens
ctctgggcaggaccagtggacc

SEQ ID NO: 8238946 - DNA, 17 bp, Homo sapiens
ctctgggcagcctgggg

SEQ ID NO: 8238947 - DNA, 17 bp, Homo sapiens
ctctgggcagcctgggg

SEQ ID NO: 8238948 - DNA, 22 bp, Homo sapiens
ctctgggcactgtatgggttct

SEQ ID NO: 8238949 - DNA, 22 bp, Homo sapiens
ctctgggcaccaaagagcagct

SEQ ID NO: 8238950 - DNA, 22 bp, Homo sapiens
ctctgggcaccaaagagcagct

SEQ ID NO: 8238951 - DNA, 20 bp, Homo sapiens
ctgaacacagaataagcaca

SEQ ID NO: 8238952 - DNA, 22 bp, Homo sapiens
ctgaacaaagaaatagtcatgg

SEQ ID NO: 8238953 - DNA, 22 bp, Homo sapiens
ctgaacaggctctgatggattc

SEQ ID NO: 8238954 - DNA, 22 bp, Homo sapiens
ctgaacatcatagagtgtactt

SEQ ID NO: 8238955 - DNA, 22 bp, Homo sapiens
ctgaacatcccgcagtgcacga

SEQ ID NO: 8238956 - DNA, 22 bp, Homo sapiens
ctgaacattcttgaacatctgt

SEQ ID NO: 8238957 - DNA, 20 bp, Homo sapiens
ctgaaaggagtcgggatgtc

SEQ ID NO: 8238958 - DNA, 22 bp, Homo sapiens
ctgaaaggagagctgcaaggat

SEQ ID NO: 8238959 - DNA, 22 bp, Homo sapiens
ctgaaaggaataaggctctttg

SEQ ID NO: 8238960 - DNA, 22 bp, Homo sapiens
ctgaaagcattaactccacttc

SEQ ID NO: 8238961 - DNA, 19 bp, Homo sapiens
tttttaatgggctggagca

SEQ ID NO: 8238962 - DNA, 19 bp, Homo sapiens
tttttaatgggctggagca

SEQ ID NO: 8238963 - DNA, 22 bp, Homo sapiens
ctgaagagcaaaccaactggac

SEQ ID NO: 8238964 - DNA, 22 bp, Homo sapiens
ctgaacttattgagtgcttgct

SEQ ID NO: 8238965 - DNA, 22 bp, Homo sapiens
ctgaagaaatatgattgcttaa

SEQ ID NO: 8238966 - DNA, 22 bp, Homo sapiens
ctgaactgacagactgcctgct

SEQ ID NO: 8238967 - DNA, 22 bp, Homo sapiens
ctgaacttattgagtgcttgct

SEQ ID NO: 8238968 - DNA, 22 bp, Homo sapiens
ctgaacttattgagtgcttgct

SEQ ID NO: 8238969 - DNA, 22 bp, Homo sapiens
ctgaacttattgagtgcttgct

SEQ ID NO: 8238970 - DNA, 22 bp, Homo sapiens
ctgaagagaaagggagctcttc

SEQ ID NO: 8238971 - DNA, 22 bp, Homo sapiens
ctgaagactgctgagaagttac

SEQ ID NO: 8238972 - DNA, 22 bp, Homo sapiens
ctgaagaatgacagtgctttga

SEQ ID NO: 8238973 - DNA, 22 bp, Homo sapiens
ctgaagaatgacagtgctttga

SEQ ID NO: 8238974 - DNA, 22 bp, Homo sapiens
ctgaagaagctgcagcctggag

SEQ ID NO: 8238975 - DNA, 22 bp, Homo sapiens
ctgaagaagtctctaggctatt

SEQ ID NO: 8238976 - DNA, 22 bp, Homo sapiens
ctgaagatgctggagcatgggt

SEQ ID NO: 8238977 - DNA, 22 bp, Homo sapiens
ctgactgtaattctgttcttaa

SEQ ID NO: 8238978 - DNA, 22 bp, Homo sapiens
ctgaagatgaggctgctggggg

SEQ ID NO: 8238979 - DNA, 22 bp, Homo sapiens
ctgaagatagtgtctgatcatg

SEQ ID NO: 8238980 - DNA, 17 bp, Homo sapiens
ctgaagataatggcaac

SEQ ID NO: 8238981 - DNA, 23 bp, Homo sapiens
ctgaagagccaacaaaaagcttg

SEQ ID NO: 8238982 - DNA, 22 bp, Homo sapiens
ctgaagaggacgcagcagcaag

SEQ ID NO: 8238983 - DNA, 22 bp, Homo sapiens
ctgaagaggacgcagcagcaag

SEQ ID NO: 8238984 - DNA, 22 bp, Homo sapiens
ctgaagaggttgttgaggaata

SEQ ID NO: 8238985 - DNA, 22 bp, Homo sapiens
ctgaagaggactgggttggagg

SEQ ID NO: 8238986 - DNA, 22 bp, Homo sapiens
ctgagaaagtgagggttaaaca

SEQ ID NO: 8238987 - DNA, 22 bp, Homo sapiens
ctgacttcagggataaaaagta

SEQ ID NO: 8238988 - DNA, 22 bp, Homo sapiens
ctgagaaatacccaagtctggt

SEQ ID NO: 8238989 - DNA, 22 bp, Homo sapiens
ctgagaataaagccagcaggag

SEQ ID NO: 8238990 - DNA, 19 bp, Homo sapiens
ctgagaatcctacttattt

SEQ ID NO: 8238991 - DNA, 22 bp, Homo sapiens
ctgagaataaagccagcaggag

SEQ ID NO: 8238992 - DNA, 22 bp, Homo sapiens
ctgagaaggaagcctccactct

SEQ ID NO: 8238993 - DNA, 22 bp, Homo sapiens
ctgagaagcactgtctgcaaga

SEQ ID NO: 8238994 - DNA, 20 bp, Homo sapiens
ctgagaactatgactgtctt

SEQ ID NO: 8238995 - DNA, 22 bp, Homo sapiens
ctgagaagagggtatgtggcgc

SEQ ID NO: 8238996 - DNA, 22 bp, Homo sapiens
ctgagaaattctttctttcact

SEQ ID NO: 8238997 - DNA, 22 bp, Homo sapiens
ctgagaagcaaagaactgcact

SEQ ID NO: 8238998 - DNA, 22 bp, Homo sapiens
ctgagaagcaaagaactgcact

SEQ ID NO: 8238999 - DNA, 22 bp, Homo sapiens
ctcttttaattgtcataacaac

SEQ ID NO: 8239000 - DNA, 20 bp, Homo sapiens
ctctttgttggcaaactctt

SEQ ID NO: 8239001 - DNA, 22 bp, Homo sapiens
ctctttgtggccacctaatctt

SEQ ID NO: 8239002 - DNA, 21 bp, Homo sapiens
ctctttgtggcaatgtatttt

SEQ ID NO: 8239003 - DNA, 22 bp, Homo sapiens
ctctttgtggaacggcagtgtc

SEQ ID NO: 8239004 - DNA, 22 bp, Homo sapiens
ctctttgtggaacggcagtgtc

SEQ ID NO: 8239005 - DNA, 22 bp, Homo sapiens
ctctttgtgctattatgatcct

SEQ ID NO: 8239006 - DNA, 22 bp, Homo sapiens
ctctttgtcactcatacagtca

SEQ ID NO: 8239007 - DNA, 22 bp, Homo sapiens
ctctggtcttcaaggccacctc

SEQ ID NO: 8239008 - DNA, 22 bp, Homo sapiens
ctctggtctcctgtagctacag

SEQ ID NO: 8239009 - DNA, 22 bp, Homo sapiens
ctctggtctcctgtagctacag

SEQ ID NO: 8239010 - DNA, 23 bp, Homo sapiens
ctctggttagatatcatatgctg

SEQ ID NO: 8239011 - DNA, 22 bp, Homo sapiens
ctctggtcttcaaggccacctc

SEQ ID NO: 8239012 - DNA, 22 bp, Homo sapiens
ctctggttcgtggtagatttta

SEQ ID NO: 8239013 - DNA, 22 bp, Homo sapiens
ctctggttcagggctccctggc

SEQ ID NO: 8239014 - DNA, 22 bp, Homo sapiens
ctctggttcagggctccctggc

SEQ ID NO: 8239015 - DNA, 22 bp, Homo sapiens
ctctggttcaaagtagtataat

SEQ ID NO: 8239016 - DNA, 22 bp, Homo sapiens
ctctggttcaaagtagtataat

SEQ ID NO: 8239017 - DNA, 22 bp, Homo sapiens
ctctggttcgtggtagatttta

SEQ ID NO: 8239018 - DNA, 22 bp, Homo sapiens
ctctgggttcactgaggctctg

SEQ ID NO: 8239019 - DNA, 22 bp, Homo sapiens
ctctgggttcactgaggctctg

SEQ ID NO: 8239020 - DNA, 22 bp, Homo sapiens
ctctgggttcagaacagcaagc

SEQ ID NO: 8239021 - DNA, 22 bp, Homo sapiens
ctctgggttcactgaggctctg

SEQ ID NO: 8239022 - DNA, 21 bp, Homo sapiens
ttttattgatgaatggccact

SEQ ID NO: 8239023 - DNA, 21 bp, Homo sapiens
ttttattgatgaatggccact

SEQ ID NO: 8239024 - DNA, 21 bp, Homo sapiens
ttttattgatgaatggccact

SEQ ID NO: 8239025 - DNA, 22 bp, Homo sapiens
ctctgggttcactgaggctctg

SEQ ID NO: 8239026 - DNA, 23 bp, Homo sapiens
ttttattgatatgtagctgttgt

SEQ ID NO: 8239027 - DNA, 21 bp, Homo sapiens
ttttattgatgaatggccact

SEQ ID NO: 8239028 - DNA, 23 bp, Homo sapiens
ttttattgatatgtagctgttgt

SEQ ID NO: 8239029 - DNA, 21 bp, Homo sapiens
ttttattgatgaatggccact

SEQ ID NO: 8239030 - DNA, 22 bp, Homo sapiens
ctctggtcatttggaagagcat

SEQ ID NO: 8239031 - DNA, 22 bp, Homo sapiens
ctctggtcaagcaaagaggttt

SEQ ID NO: 8239032 - DNA, 22 bp, Homo sapiens
ctctggtcaagcaaagaggttt

SEQ ID NO: 8239033 - DNA, 22 bp, Homo sapiens
ctctgggttttgtcagctgagg

SEQ ID NO: 8239034 - DNA, 22 bp, Homo sapiens
ctctgggttttgtcagctgagg

SEQ ID NO: 8239035 - DNA, 22 bp, Homo sapiens
ctctgggttttgtcagctgagg

SEQ ID NO: 8239036 - DNA, 22 bp, Homo sapiens
ctctgggttctggcctgcaccc

SEQ ID NO: 8239037 - DNA, 21 bp, Homo sapiens
ctctggtcctgtctggcaggc

SEQ ID NO: 8239038 - DNA, 22 bp, Homo sapiens
ctctggtcctgacaaagacaga

SEQ ID NO: 8239039 - DNA, 22 bp, Homo sapiens
ctctggtccttctgacaacctg

SEQ ID NO: 8239040 - DNA, 21 bp, Homo sapiens
ctctggtcctgtctggcaggc

SEQ ID NO: 8239041 - DNA, 22 bp, Homo sapiens
ctctggtcccctgtcaccagtt

SEQ ID NO: 8239042 - DNA, 22 bp, Homo sapiens
ctctggtcccctgtcaccagtt

SEQ ID NO: 8239043 - DNA, 22 bp, Homo sapiens
ctctggtcctgacaaagacaga

SEQ ID NO: 8239044 - DNA, 22 bp, Homo sapiens
ctctggtcatttggaagagcat

SEQ ID NO: 8239045 - DNA, 20 bp, Homo sapiens
ctcttttcactctcagtggt

SEQ ID NO: 8239046 - DNA, 22 bp, Homo sapiens
ctcttttcaaacctgtttatgg

SEQ ID NO: 8239047 - DNA, 22 bp, Homo sapiens
ctcttttacaccaaaaggccta

SEQ ID NO: 8239048 - DNA, 22 bp, Homo sapiens
ctcttttacaccaaaaggccta

SEQ ID NO: 8239049 - DNA, 22 bp, Homo sapiens
ctcttttaattgtcataacaac

SEQ ID NO: 8239050 - DNA, 22 bp, Homo sapiens
ctcttttatgtgacgtgtgtga

SEQ ID NO: 8239051 - DNA, 22 bp, Homo sapiens
ctcttttagagatgaaaattgg

SEQ ID NO: 8239052 - DNA, 19 bp, Homo sapiens
ctgaaaaacattctcagga

SEQ ID NO: 8239053 - DNA, 22 bp, Homo sapiens
ctctttttcagccttaccaaag

SEQ ID NO: 8239054 - DNA, 22 bp, Homo sapiens
ctctttttcacctctgtcagcg

SEQ ID NO: 8239055 - DNA, 22 bp, Homo sapiens
tttttaatgcagtctgagacat

SEQ ID NO: 8239056 - DNA, 22 bp, Homo sapiens
tttttaagctcctttgatgtca

SEQ ID NO: 8239057 - DNA, 22 bp, Homo sapiens
tttttaagctcctttgatgtca

SEQ ID NO: 8239058 - DNA, 22 bp, Homo sapiens
tttttaagctcctttgatgtca

SEQ ID NO: 8239059 - DNA, 22 bp, Homo sapiens
tttttaagagtctggaaatagt

SEQ ID NO: 8239060 - DNA, 22 bp, Homo sapiens
tttttaagagattctccagtct

SEQ ID NO: 8239061 - DNA, 22 bp, Homo sapiens
tttttaagagtctggaaatagt

SEQ ID NO: 8239062 - DNA, 22 bp, Homo sapiens
tttttaagagtctggaaatagt

SEQ ID NO: 8239063 - DNA, 22 bp, Homo sapiens
ttttgttttcttagaaacctgg

SEQ ID NO: 8239064 - DNA, 22 bp, Homo sapiens
tttttaagagattctccagtct

SEQ ID NO: 8239065 - DNA, 22 bp, Homo sapiens
tttttaagagattctccagtct

SEQ ID NO: 8239066 - DNA, 22 bp, Homo sapiens
ttttgttttcttagaaacctgg

SEQ ID NO: 8239067 - DNA, 19 bp, Homo sapiens
ctgaaaaacattctcagga

SEQ ID NO: 8239068 - DNA, 22 bp, Homo sapiens
ctgcagcagtagtccccaagtg

SEQ ID NO: 8239069 - DNA, 23 bp, Homo sapiens
ctgcagccgcgtggggacgtgga

SEQ ID NO: 8239070 - DNA, 23 bp, Homo sapiens
ctgcagccgcgtggggacgtgga

SEQ ID NO: 8239071 - DNA, 23 bp, Homo sapiens
ctgcagccgcgtggggacgtgga

SEQ ID NO: 8239072 - DNA, 22 bp, Homo sapiens
ctgccagctctctggaggctct

SEQ ID NO: 8239073 - DNA, 23 bp, Homo sapiens
ctgcagccgcgtggggacgtgga

SEQ ID NO: 8239074 - DNA, 22 bp, Homo sapiens
ctgccagctctctggaggctct

SEQ ID NO: 8239075 - DNA, 22 bp, Homo sapiens
ctgccaggactgacgtcttcag

SEQ ID NO: 8239076 - DNA, 22 bp, Homo sapiens
ctgccagctggagaccaaggaa

SEQ ID NO: 8239077 - DNA, 22 bp, Homo sapiens
ctgccagctggagaccaaggaa

SEQ ID NO: 8239078 - DNA, 22 bp, Homo sapiens
ctgccaggcctccgctgtcccc

SEQ ID NO: 8239079 - DNA, 22 bp, Homo sapiens
ctgccaggcctggggtgctgtc

SEQ ID NO: 8239080 - DNA, 22 bp, Homo sapiens
ctgccaggcctggggtgctgtc

SEQ ID NO: 8239081 - DNA, 22 bp, Homo sapiens
ctgccaggcctggggtgctgtc

SEQ ID NO: 8239082 - DNA, 22 bp, Homo sapiens
ctgccagggaggctgggaagtt

SEQ ID NO: 8239083 - DNA, 22 bp, Homo sapiens
ctgccagggaggctgggaagtt

SEQ ID NO: 8239084 - DNA, 22 bp, Homo sapiens
ctgccagggaggctgggaagtt

SEQ ID NO: 8239085 - DNA, 22 bp, Homo sapiens
ctgccaggctgtcccaggtccg

SEQ ID NO: 8239086 - DNA, 22 bp, Homo sapiens
ctgccaggcgatggattggctg

SEQ ID NO: 8239087 - DNA, 22 bp, Homo sapiens
ctgccaggcgatggattggctg

SEQ ID NO: 8239088 - DNA, 22 bp, Homo sapiens
ctgccaggcctggggtgctgtc

SEQ ID NO: 8239089 - DNA, 22 bp, Homo sapiens
ctgccaggggcctcacaggcca

SEQ ID NO: 8239090 - DNA, 22 bp, Homo sapiens
ctgccaggggcctcacaggcca

SEQ ID NO: 8239091 - DNA, 22 bp, Homo sapiens
ctgccaggtaaactgcaggaat

SEQ ID NO: 8239092 - DNA, 22 bp, Homo sapiens
ctgccaggggcctcacaggcca

SEQ ID NO: 8239093 - DNA, 22 bp, Homo sapiens
ctgccagggcatcctgtggtgg

SEQ ID NO: 8239094 - DNA, 22 bp, Homo sapiens
ctgccagggcatcctgtggtgg

SEQ ID NO: 8239095 - DNA, 22 bp, Homo sapiens
ctgcagcagaataatctgctca

SEQ ID NO: 8239096 - DNA, 22 bp, Homo sapiens
ctgcagatggtattgttctggt

SEQ ID NO: 8239097 - DNA, 22 bp, Homo sapiens
ctgcagatgtctcaattttatt

SEQ ID NO: 8239098 - DNA, 22 bp, Homo sapiens
ctgcagattggcctgatgttca

SEQ ID NO: 8239099 - DNA, 22 bp, Homo sapiens
ctgcagattggcctgatgttca

SEQ ID NO: 8239100 - DNA, 22 bp, Homo sapiens
ctgcagaggcctcgcctcctct

SEQ ID NO: 8239101 - DNA, 22 bp, Homo sapiens
ctgcagaggggttgaagggtcc

SEQ ID NO: 8239102 - DNA, 22 bp, Homo sapiens
ctgcagaggtcttgctgatggt

SEQ ID NO: 8239103 - DNA, 22 bp, Homo sapiens
ctgcagaggtcttgctgatggt

SEQ ID NO: 8239104 - DNA, 22 bp, Homo sapiens
ctgcagagggtttgagcatcct

SEQ ID NO: 8239105 - DNA, 22 bp, Homo sapiens
ctgcagagcttgtctggatgtg

SEQ ID NO: 8239106 - DNA, 22 bp, Homo sapiens
ctgcagagcttgtctggatgtg

SEQ ID NO: 8239107 - DNA, 22 bp, Homo sapiens
ctgcagagctaggctgagtgaa

SEQ ID NO: 8239108 - DNA, 22 bp, Homo sapiens
ctgcagaggcctcgcctcctct

SEQ ID NO: 8239109 - DNA, 22 bp, Homo sapiens
ctgccatcgggggccccactgc

SEQ ID NO: 8239110 - DNA, 22 bp, Homo sapiens
ctgccatctgagggtccagcct

SEQ ID NO: 8239111 - DNA, 20 bp, Homo sapiens
ctgccatgattgatagagtg

SEQ ID NO: 8239112 - DNA, 22 bp, Homo sapiens
ctgccagtctatgctgctcggc

SEQ ID NO: 8239113 - DNA, 22 bp, Homo sapiens
ctgccatccacggcccactcat

SEQ ID NO: 8239114 - DNA, 22 bp, Homo sapiens
ctgccatcctcaccagagcagc

SEQ ID NO: 8239115 - DNA, 22 bp, Homo sapiens
ctgccaggttggcgctcgctct

SEQ ID NO: 8239116 - DNA, 22 bp, Homo sapiens
ctgccaggtgcctttgtgcagt

SEQ ID NO: 8239117 - DNA, 22 bp, Homo sapiens
ctgccaggttggcgctcgctct

SEQ ID NO: 8239118 - DNA, 22 bp, Homo sapiens
ctgccaggttggcgctcgctct

SEQ ID NO: 8239119 - DNA, 22 bp, Homo sapiens
ctgccaggtgagctccaggcct

SEQ ID NO: 8239120 - DNA, 22 bp, Homo sapiens
ctgccaggtaaactgcaggaat

SEQ ID NO: 8239121 - DNA, 22 bp, Homo sapiens
ctgccaggtgccagggcgcggc

SEQ ID NO: 8239122 - DNA, 22 bp, Homo sapiens
ctgccctggggggcctccttgc

SEQ ID NO: 8239123 - DNA, 22 bp, Homo sapiens
ctgccctgggtgctggggatcc

SEQ ID NO: 8239124 - DNA, 22 bp, Homo sapiens
ctgccatgcagttagtccctca

SEQ ID NO: 8239125 - DNA, 22 bp, Homo sapiens
ctgccctggggggcctccttgc

SEQ ID NO: 8239126 - DNA, 22 bp, Homo sapiens
ctgccgagtgggtcatgaggca

SEQ ID NO: 8239127 - DNA, 22 bp, Homo sapiens
ctgccgtgtttttcatgttaaa

SEQ ID NO: 8239128 - DNA, 22 bp, Homo sapiens
ctgcctagaaaaccaggctcct

SEQ ID NO: 8239129 - DNA, 22 bp, Homo sapiens
ctgccgttgtgaagctcttaga

SEQ ID NO: 8239130 - DNA, 22 bp, Homo sapiens
ctgccgtgtttttcatgttaaa

SEQ ID NO: 8239131 - DNA, 22 bp, Homo sapiens
ctgccgtgtttttcatgttaaa

SEQ ID NO: 8239132 - DNA, 22 bp, Homo sapiens
ctgccgtgtttttcatgttaaa

SEQ ID NO: 8239133 - DNA, 22 bp, Homo sapiens
ctgcctccaggctcaccttgac

SEQ ID NO: 8239134 - DNA, 22 bp, Homo sapiens
ctgcctccaggctcaccttgac

SEQ ID NO: 8239135 - DNA, 22 bp, Homo sapiens
ctgcctcatgctgcctgcagcc

SEQ ID NO: 8239136 - DNA, 22 bp, Homo sapiens
ctgcctcatgctgcctgcagcc

SEQ ID NO: 8239137 - DNA, 22 bp, Homo sapiens
ctgcctcatgctgcctgcagcc

SEQ ID NO: 8239138 - DNA, 22 bp, Homo sapiens
ctgcctcatgctgcctgcagcc

SEQ ID NO: 8239139 - DNA, 22 bp, Homo sapiens
ctgcctcatgctgcctgcagcc

SEQ ID NO: 8239140 - DNA, 22 bp, Homo sapiens
ctgcctagcgccatctgcctct

SEQ ID NO: 8239141 - DNA, 22 bp, Homo sapiens
ctgcctagatttgaatcctggc

SEQ ID NO: 8239142 - DNA, 22 bp, Homo sapiens
ctgcctcacattggctgtgtga

SEQ ID NO: 8239143 - DNA, 22 bp, Homo sapiens
ctgcctcacattggctgtgtga

SEQ ID NO: 8239144 - DNA, 22 bp, Homo sapiens
ctgcctcagccttctgggtgac

SEQ ID NO: 8239145 - DNA, 22 bp, Homo sapiens
ctgcctcagccttctgggtgac

SEQ ID NO: 8239146 - DNA, 22 bp, Homo sapiens
ctgcctcagcgttgtggcccta

SEQ ID NO: 8239147 - DNA, 22 bp, Homo sapiens
ctgcctcagccttctgggtgac

SEQ ID NO: 8239148 - DNA, 22 bp, Homo sapiens
ctgcctcctcacgtccacagtg

SEQ ID NO: 8239149 - DNA, 22 bp, Homo sapiens
ctgcctcctcacgtccacagtg

SEQ ID NO: 8239150 - DNA, 22 bp, Homo sapiens
ctgcctccaggctcaccttgac

SEQ ID NO: 8239151 - DNA, 22 bp, Homo sapiens
ctgcctcctgccgtgcagcttc

SEQ ID NO: 8239152 - DNA, 22 bp, Homo sapiens
ctgcctcctcacgtccacagtg

SEQ ID NO: 8239153 - DNA, 22 bp, Homo sapiens
ctgcctcctcacgtccacagtg

SEQ ID NO: 8239154 - DNA, 22 bp, Homo sapiens
ctgcctctataggagtccacca

SEQ ID NO: 8239155 - DNA, 22 bp, Homo sapiens
ctgcctgcgttgcctcgtgcct

SEQ ID NO: 8239156 - DNA, 22 bp, Homo sapiens
ctgcctctataggagtccacca

SEQ ID NO: 8239157 - DNA, 22 bp, Homo sapiens
ctgcctcctggctgatgggtag

SEQ ID NO: 8239158 - DNA, 22 bp, Homo sapiens
ctgcctcctgccgtgcagcttc

SEQ ID NO: 8239159 - DNA, 22 bp, Homo sapiens
ctgcctcctgccgtgcagcttc

SEQ ID NO: 8239160 - DNA, 22 bp, Homo sapiens
ctgcctcctggctgatgggtag

SEQ ID NO: 8239161 - DNA, 22 bp, Homo sapiens
ctgcctcctgccgtgcagcttc

SEQ ID NO: 8239162 - DNA, 22 bp, Homo sapiens
ctgcctcctgccgtgcagcttc

SEQ ID NO: 8239163 - DNA, 22 bp, Homo sapiens
ctgagactgtaccacttcctcc

SEQ ID NO: 8239164 - DNA, 22 bp, Homo sapiens
ctgagacccagacacctgagga

SEQ ID NO: 8239165 - DNA, 22 bp, Homo sapiens
ctgagactttcatgtgctttta

SEQ ID NO: 8239166 - DNA, 22 bp, Homo sapiens
ctgagactgtaccacttcctcc

SEQ ID NO: 8239167 - DNA, 22 bp, Homo sapiens
ctgagagaaacatgactcagga

SEQ ID NO: 8239168 - DNA, 22 bp, Homo sapiens
ctgagagaaacatgactcagga

SEQ ID NO: 8239169 - DNA, 22 bp, Homo sapiens
ctgagagaaacatgactcagga

SEQ ID NO: 8239170 - DNA, 22 bp, Homo sapiens
ctgagagaaacatgactcagga

SEQ ID NO: 8239171 - DNA, 22 bp, Homo sapiens
ctgagagaaacatgactcagga

SEQ ID NO: 8239172 - DNA, 22 bp, Homo sapiens
ctgagagaagagcgcagtttgt

SEQ ID NO: 8239173 - DNA, 22 bp, Homo sapiens
ctgagagaaacatgactcagga

SEQ ID NO: 8239174 - DNA, 22 bp, Homo sapiens
ctgagagaatcatgctgcaggt

SEQ ID NO: 8239175 - DNA, 22 bp, Homo sapiens
ctgagaattactctgatgagta

SEQ ID NO: 8239176 - DNA, 22 bp, Homo sapiens
ctgagaattactctgatgagta

SEQ ID NO: 8239177 - DNA, 22 bp, Homo sapiens
ctgagaatggacagcagggcag

SEQ ID NO: 8239178 - DNA, 22 bp, Homo sapiens
ctgagaatgttttctgattgat

SEQ ID NO: 8239179 - DNA, 22 bp, Homo sapiens
ctgagacacagtggctgaaaag

SEQ ID NO: 8239180 - DNA, 22 bp, Homo sapiens
ctgagaattactctgatgagta

SEQ ID NO: 8239181 - DNA, 22 bp, Homo sapiens
ctgagacaggagaatggcgtga

SEQ ID NO: 8239182 - DNA, 22 bp, Homo sapiens
ctgagacatggtttgactggca

SEQ ID NO: 8239183 - DNA, 22 bp, Homo sapiens
ctgagacacggagaggctgtgt

SEQ ID NO: 8239184 - DNA, 22 bp, Homo sapiens
ctgagacacggagaggctgtgt

SEQ ID NO: 8239185 - DNA, 22 bp, Homo sapiens
ctgaggagaaatgggatggttc

SEQ ID NO: 8239186 - DNA, 22 bp, Homo sapiens
ctgaggagaacaatgagatcaa

SEQ ID NO: 8239187 - DNA, 22 bp, Homo sapiens
ctgaggagaacaatgagatcaa

SEQ ID NO: 8239188 - DNA, 22 bp, Homo sapiens
ctgaggagaaatgggatggttc

SEQ ID NO: 8239189 - DNA, 22 bp, Homo sapiens
ctgaggaggctaatttgaggat

SEQ ID NO: 8239190 - DNA, 22 bp, Homo sapiens
ctgaggagggaagtccccaaag

SEQ ID NO: 8239191 - DNA, 22 bp, Homo sapiens
ctgaggaggggcctgagtgaga

SEQ ID NO: 8239192 - DNA, 22 bp, Homo sapiens
ctgaggagggaagtccccaaag

SEQ ID NO: 8239193 - DNA, 22 bp, Homo sapiens
ctgagagagtaaagtagaatta

SEQ ID NO: 8239194 - DNA, 22 bp, Homo sapiens
ctgaggaccccacaggaggccc

SEQ ID NO: 8239195 - DNA, 22 bp, Homo sapiens
ctgagagaatcatgctgcaggt

SEQ ID NO: 8239196 - DNA, 22 bp, Homo sapiens
ctgagagaatcatgctgcaggt

SEQ ID NO: 8239197 - DNA, 22 bp, Homo sapiens
ctgagagaatcatgctgcaggt

SEQ ID NO: 8239198 - DNA, 22 bp, Homo sapiens
ctgagagactgtttgtaatatt

SEQ ID NO: 8239199 - DNA, 22 bp, Homo sapiens
ctgagagagtaaagtagaatta

SEQ ID NO: 8239200 - DNA, 22 bp, Homo sapiens
ctgaggagttggtgaataagcc

SEQ ID NO: 8239201 - DNA, 22 bp, Homo sapiens
ctgaggaggggcctgagtgaga

SEQ ID NO: 8239202 - DNA, 22 bp, Homo sapiens
ctgaggagtcagttccactcag

SEQ ID NO: 8239203 - DNA, 22 bp, Homo sapiens
ctgaggatggtgtggtcttctc

SEQ ID NO: 8239204 - DNA, 19 bp, Homo sapiens
ctgaggcaagtggtggtca

SEQ ID NO: 8239205 - DNA, 19 bp, Homo sapiens
ctgaggcaagtggtggtca

SEQ ID NO: 8239206 - DNA, 22 bp, Homo sapiens
ctgaggcacagtgaacttctcc

SEQ ID NO: 8239207 - DNA, 22 bp, Homo sapiens
ctgaggcacagtgaacttctcc

SEQ ID NO: 8239208 - DNA, 19 bp, Homo sapiens
ctgaggcaagtggtggtca

SEQ ID NO: 8239209 - DNA, 19 bp, Homo sapiens
ctgaggcaagtggtggtca

SEQ ID NO: 8239210 - DNA, 22 bp, Homo sapiens
ctgaggcacagtgaacttctcc

SEQ ID NO: 8239211 - DNA, 22 bp, Homo sapiens
ctgaggatctactgtgggctca

SEQ ID NO: 8239212 - DNA, 22 bp, Homo sapiens
ctgaggatctactgtgggctca

SEQ ID NO: 8239213 - DNA, 22 bp, Homo sapiens
ctgaggcactgtcagctgaggc

SEQ ID NO: 8239214 - DNA, 22 bp, Homo sapiens
ctgaggcagaaaaagcaagggt

SEQ ID NO: 8239215 - DNA, 22 bp, Homo sapiens
ctgaggcagaaaaagcaagggt

SEQ ID NO: 8239216 - DNA, 22 bp, Homo sapiens
ctgaggcactggtaatgggcat

SEQ ID NO: 8239217 - DNA, 22 bp, Homo sapiens
ctgaggcactggtaatgggcat

SEQ ID NO: 8239218 - DNA, 22 bp, Homo sapiens
ctgaggcactgtcagctgaggc

SEQ ID NO: 8239219 - DNA, 22 bp, Homo sapiens
ctgaggcactgtcagctgaggc

SEQ ID NO: 8239220 - DNA, 22 bp, Homo sapiens
ctgaggcactaacaaggacaag

SEQ ID NO: 8239221 - DNA, 22 bp, Homo sapiens
ctgaggcacctacagtctcggg

SEQ ID NO: 8239222 - DNA, 22 bp, Homo sapiens
ctgaggcacctacagtctcggg

SEQ ID NO: 8239223 - DNA, 22 bp, Homo sapiens
ctgaggcactaacaaggacaag

SEQ ID NO: 8239224 - DNA, 22 bp, Homo sapiens
ctgaggcactggtaatgggcat

SEQ ID NO: 8239225 - DNA, 22 bp, Homo sapiens
ctgaggcactaacaaggacaag

SEQ ID NO: 8239226 - DNA, 22 bp, Homo sapiens
ctgaggcacccatcttctcctg

SEQ ID NO: 8239227 - DNA, 22 bp, Homo sapiens
ctgaggcaccggcaatgttctg

SEQ ID NO: 8239228 - DNA, 22 bp, Homo sapiens
ctgaggcacccatcttctcctg

SEQ ID NO: 8239229 - DNA, 22 bp, Homo sapiens
ctgaggcacctacagtctcggg

SEQ ID NO: 8239230 - DNA, 22 bp, Homo sapiens
ctgaggcacctacagtctcggg

SEQ ID NO: 8239231 - DNA, 22 bp, Homo sapiens
ctgaggcacccatcttctcctg

SEQ ID NO: 8239232 - DNA, 22 bp, Homo sapiens
ctgaggcaccggcaatgttctg

SEQ ID NO: 8239233 - DNA, 22 bp, Homo sapiens
ctgaggcaccggcaatgttctg

SEQ ID NO: 8239234 - DNA, 22 bp, Homo sapiens
ctgatcctcctttaagtagctg

SEQ ID NO: 8239235 - DNA, 22 bp, Homo sapiens
ctgagtccttgggcttagagtg

SEQ ID NO: 8239236 - DNA, 22 bp, Homo sapiens
ctgagtcattgcagatgtggag

SEQ ID NO: 8239237 - DNA, 19 bp, Homo sapiens
ctgagtcaaaggttgtggg

SEQ ID NO: 8239238 - DNA, 22 bp, Homo sapiens
ctgagtccagggacagaggcgt

SEQ ID NO: 8239239 - DNA, 22 bp, Homo sapiens
ctgaggcagagaatgagtttgt

SEQ ID NO: 8239240 - DNA, 22 bp, Homo sapiens
ctgaggcagagaatgagtttgt

SEQ ID NO: 8239241 - DNA, 22 bp, Homo sapiens
ctgaggcagagagaacccgggc

SEQ ID NO: 8239242 - DNA, 22 bp, Homo sapiens
ctgaggcagagagaacccgggc

SEQ ID NO: 8239243 - DNA, 22 bp, Homo sapiens
ctgaggcagaaaaagcaagggt

SEQ ID NO: 8239244 - DNA, 22 bp, Homo sapiens
ctgaggcagagaatgagtttgt

SEQ ID NO: 8239245 - DNA, 22 bp, Homo sapiens
ctgatgcaaccagcatatggaa

SEQ ID NO: 8239246 - DNA, 22 bp, Homo sapiens
ctgatgcctctcttcttggctt

SEQ ID NO: 8239247 - DNA, 22 bp, Homo sapiens
ctgatgctataagccacagtgg

SEQ ID NO: 8239248 - DNA, 22 bp, Homo sapiens
ctgatggagactccactgtgat

SEQ ID NO: 8239249 - DNA, 22 bp, Homo sapiens
ctgatggagtgatggagaaatt

SEQ ID NO: 8239250 - DNA, 22 bp, Homo sapiens
ctgatggagagtgtgatttggg

SEQ ID NO: 8239251 - DNA, 22 bp, Homo sapiens
ctgatgctctggatgtagtcaa

SEQ ID NO: 8239252 - DNA, 22 bp, Homo sapiens
ctgattagagtgttaatgagga

SEQ ID NO: 8239253 - DNA, 22 bp, Homo sapiens
ctgattaggctaagcaagaggg

SEQ ID NO: 8239254 - DNA, 19 bp, Homo sapiens
ctgatgttccagagaagct

SEQ ID NO: 8239255 - DNA, 22 bp, Homo sapiens
ctgatggatgctacgtaagagg

SEQ ID NO: 8239256 - DNA, 22 bp, Homo sapiens
ctgatggatggacaggggtagt

SEQ ID NO: 8239257 - DNA, 17 bp, Homo sapiens
ctgatggattttttcca

SEQ ID NO: 8239258 - DNA, 22 bp, Homo sapiens
ctgatggagtgatggagaaatt

SEQ ID NO: 8239259 - DNA, 22 bp, Homo sapiens
ctgatggatgctacgtaagagg

SEQ ID NO: 8239260 - DNA, 22 bp, Homo sapiens
ctgatgtcccaagcattcgcag

SEQ ID NO: 8239261 - DNA, 22 bp, Homo sapiens
ctgatgttcatttcttttgtac

SEQ ID NO: 8239262 - DNA, 22 bp, Homo sapiens
ctgattttcaaaatgtgttaaa

SEQ ID NO: 8239263 - DNA, 17 bp, Homo sapiens
ctgatttattagcagac

SEQ ID NO: 8239264 - DNA, 22 bp, Homo sapiens
ctgatttcatgctatcaatgtt

SEQ ID NO: 8239265 - DNA, 22 bp, Homo sapiens
ctgatttacatatacaaaagat

SEQ ID NO: 8239266 - DNA, 22 bp, Homo sapiens
ctgatttagatttcacacgtga

SEQ ID NO: 8239267 - DNA, 22 bp, Homo sapiens
ctgattctgttgaacaccttcc

SEQ ID NO: 8239268 - DNA, 22 bp, Homo sapiens
ctgattgagaaggaaggggatc

SEQ ID NO: 8239269 - DNA, 22 bp, Homo sapiens
ctgattccctggtgcctccgtt

SEQ ID NO: 8239270 - DNA, 22 bp, Homo sapiens
ctgattccctggtgcctccgtt

SEQ ID NO: 8239271 - DNA, 22 bp, Homo sapiens
ctgattcctgattcatgctctt

SEQ ID NO: 8239272 - DNA, 22 bp, Homo sapiens
ctgattctaggcgttcctctca

SEQ ID NO: 8239273 - DNA, 22 bp, Homo sapiens
ctgattcctgattcatgctctt

SEQ ID NO: 8239274 - DNA, 22 bp, Homo sapiens
ctgattcctgattcatgctctt

SEQ ID NO: 8239275 - DNA, 22 bp, Homo sapiens
ctgcagactagatagaaactga

SEQ ID NO: 8239276 - DNA, 22 bp, Homo sapiens
ctgcagactagatagaaactga

SEQ ID NO: 8239277 - DNA, 22 bp, Homo sapiens
ctgcagagcataaatctgaata

SEQ ID NO: 8239278 - DNA, 22 bp, Homo sapiens
ctgcagagcataaatctgaata

SEQ ID NO: 8239279 - DNA, 22 bp, Homo sapiens
ctgcagagcataaatctgaata

SEQ ID NO: 8239280 - DNA, 22 bp, Homo sapiens
ctgcagagcataaatctgaata

SEQ ID NO: 8239281 - DNA, 21 bp, Homo sapiens
ctgcagagcatgcaaaatgtt

SEQ ID NO: 8239282 - DNA, 22 bp, Homo sapiens
ctgcagagctaggctgagtgaa

SEQ ID NO: 8239283 - DNA, 22 bp, Homo sapiens
ctgcagagctaggctgagtgaa

SEQ ID NO: 8239284 - DNA, 22 bp, Homo sapiens
ctgcagaaagctgagatgatta

SEQ ID NO: 8239285 - DNA, 22 bp, Homo sapiens
ctgcacttgacatgctctcaga

SEQ ID NO: 8239286 - DNA, 22 bp, Homo sapiens
ctgcaaaagtcattgtggtttt

SEQ ID NO: 8239287 - DNA, 22 bp, Homo sapiens
ctgcacttgacatgctctcaga

SEQ ID NO: 8239288 - DNA, 22 bp, Homo sapiens
ctgcaaaagtaattgcaggttt

SEQ ID NO: 8239289 - DNA, 22 bp, Homo sapiens
ctgcctgggccatgcccagtcc

SEQ ID NO: 8239290 - DNA, 22 bp, Homo sapiens
ctgcctgggccggccaccctct

SEQ ID NO: 8239291 - DNA, 22 bp, Homo sapiens
ctgcctggggaatgtgaggatt

SEQ ID NO: 8239292 - DNA, 22 bp, Homo sapiens
ctgcttctaagaacctgcagct

SEQ ID NO: 8239293 - DNA, 19 bp, Homo sapiens
ctgcttccttccctcactg

SEQ ID NO: 8239294 - DNA, 19 bp, Homo sapiens
ctgcttccttccctcactg

SEQ ID NO: 8239295 - DNA, 23 bp, Homo sapiens
ctgcttccttgcttcattgctgg

SEQ ID NO: 8239296 - DNA, 22 bp, Homo sapiens
ctgcctggcccagggatgggcc

SEQ ID NO: 8239297 - DNA, 22 bp, Homo sapiens
ctgcctggcccagggatgggcc

SEQ ID NO: 8239298 - DNA, 22 bp, Homo sapiens
ctgcctggctaaactcaagtcg

SEQ ID NO: 8239299 - DNA, 22 bp, Homo sapiens
ctgcctggctaaactcaagtcg

SEQ ID NO: 8239300 - DNA, 22 bp, Homo sapiens
ctgcctgggccatgcccagtcc

SEQ ID NO: 8239301 - DNA, 22 bp, Homo sapiens
ctgcctggctaaactcaagtcg

SEQ ID NO: 8239302 - DNA, 22 bp, Homo sapiens
ctgcctggcctgatctccacgc

SEQ ID NO: 8239303 - DNA, 22 bp, Homo sapiens
ctgcctggcctgatctccacgc

SEQ ID NO: 8239304 - DNA, 23 bp, Homo sapiens
ctgctttcccactccatgctctt

SEQ ID NO: 8239305 - DNA, 23 bp, Homo sapiens
ctgctttcccactccatgctctt

SEQ ID NO: 8239306 - DNA, 22 bp, Homo sapiens
ctgctttaggtggaatgttcta

SEQ ID NO: 8239307 - DNA, 22 bp, Homo sapiens
ctgcttctaagaacctgcagct

SEQ ID NO: 8239308 - DNA, 22 bp, Homo sapiens
ctgcttctaagaacctgcagct

SEQ ID NO: 8239309 - DNA, 22 bp, Homo sapiens
ctgctttagagctgagcctcag

SEQ ID NO: 8239310 - DNA, 21 bp, Homo sapiens
ctgctttacttcagaggatct

SEQ ID NO: 8239311 - DNA, 22 bp, Homo sapiens
ctgcctggaccggcagccctcc

SEQ ID NO: 8239312 - DNA, 22 bp, Homo sapiens
ctgcctggagcattctgaaggt

SEQ ID NO: 8239313 - DNA, 22 bp, Homo sapiens
ctgcctggagcattctgaaggt

SEQ ID NO: 8239314 - DNA, 22 bp, Homo sapiens
ctgcctggacagctcttacctt

SEQ ID NO: 8239315 - DNA, 22 bp, Homo sapiens
ctgcctggacagctcttacctt

SEQ ID NO: 8239316 - DNA, 22 bp, Homo sapiens
ctgcctggaccggcagccctcc

SEQ ID NO: 8239317 - DNA, 22 bp, Homo sapiens
ctgcctggaccggcagccctcc

SEQ ID NO: 8239318 - DNA, 22 bp, Homo sapiens
ctgcctggaatgccagcttctc

SEQ ID NO: 8239319 - DNA, 22 bp, Homo sapiens
ctgcctggaatgccagcttctc

SEQ ID NO: 8239320 - DNA, 22 bp, Homo sapiens
ctgcctgcgttgcctcgtgcct

SEQ ID NO: 8239321 - DNA, 17 bp, Homo sapiens
ctgcctggagtcccatc

SEQ ID NO: 8239322 - DNA, 22 bp, Homo sapiens
ctgcctggatgaatggcgcctt

SEQ ID NO: 8239323 - DNA, 20 bp, Homo sapiens
ctgcctggaggcctctacct

SEQ ID NO: 8239324 - DNA, 20 bp, Homo sapiens
ctgcctggaggcctctacct

SEQ ID NO: 8239325 - DNA, 17 bp, Homo sapiens
ctgcctggagtcccatc

SEQ ID NO: 8239326 - DNA, 20 bp, Homo sapiens
ctgcctggaggcctctacct

SEQ ID NO: 8239327 - DNA, 20 bp, Homo sapiens
ctgcctggaggcctctacct

SEQ ID NO: 8239328 - DNA, 20 bp, Homo sapiens
ctgcctggaggcctctacct

SEQ ID NO: 8239329 - DNA, 22 bp, Homo sapiens
ctgcctggcatagtctggtcga

SEQ ID NO: 8239330 - DNA, 22 bp, Homo sapiens
ctgcctggcatagtctggtcga

SEQ ID NO: 8239331 - DNA, 22 bp, Homo sapiens
ctgcctggcatggagaagagaa

SEQ ID NO: 8239332 - DNA, 22 bp, Homo sapiens
ctgcctggcatggagaagagaa

SEQ ID NO: 8239333 - DNA, 22 bp, Homo sapiens
ctgcctggcatggagaagagaa

SEQ ID NO: 8239334 - DNA, 22 bp, Homo sapiens
ctgcctggcatggagaagagaa

SEQ ID NO: 8239335 - DNA, 22 bp, Homo sapiens
ctgcctggcatggagaagagaa

SEQ ID NO: 8239336 - DNA, 22 bp, Homo sapiens
ctgcctggccacaacccagggt

SEQ ID NO: 8239337 - DNA, 22 bp, Homo sapiens
ctgcctggccacaacccagggt

SEQ ID NO: 8239338 - DNA, 22 bp, Homo sapiens
ctggaaagtacagtgtgtcaca

SEQ ID NO: 8239339 - DNA, 22 bp, Homo sapiens
ctggaaggttctttgtgtgcct

SEQ ID NO: 8239340 - DNA, 22 bp, Homo sapiens
ctggaaggttctttgtgtgcct

SEQ ID NO: 8239341 - DNA, 22 bp, Homo sapiens
ctggaaggttctttgtgtgcct

SEQ ID NO: 8239342 - DNA, 22 bp, Homo sapiens
ctggaaggttctttgtgtgcct

SEQ ID NO: 8239343 - DNA, 19 bp, Homo sapiens
ctggaatgtggctggtgca

SEQ ID NO: 8239344 - DNA, 22 bp, Homo sapiens
ctggaagtataggggagatgat

SEQ ID NO: 8239345 - DNA, 23 bp, Homo sapiens
ctggaagtgcttttatagctttg

SEQ ID NO: 8239346 - DNA, 22 bp, Homo sapiens
ctggaatgttctccagcatggc

SEQ ID NO: 8239347 - DNA, 22 bp, Homo sapiens
ctggacagaaaaggccactgga

SEQ ID NO: 8239348 - DNA, 22 bp, Homo sapiens
ctggacagaaaaggccactgga

SEQ ID NO: 8239349 - DNA, 22 bp, Homo sapiens
ctggacaggctggggactgcaa

SEQ ID NO: 8239350 - DNA, 22 bp, Homo sapiens
ctggacagtgggcagaggagac

SEQ ID NO: 8239351 - DNA, 22 bp, Homo sapiens
ctggacagtgctgcttgagatg

SEQ ID NO: 8239352 - DNA, 22 bp, Homo sapiens
ctggacaggaagaattgggagc

SEQ ID NO: 8239353 - DNA, 22 bp, Homo sapiens
ctggacaggctggggactgcaa

SEQ ID NO: 8239354 - DNA, 22 bp, Homo sapiens
ctggacagaagtggctgggcag

SEQ ID NO: 8239355 - DNA, 22 bp, Homo sapiens
ctggacagaagtggctgggcag

SEQ ID NO: 8239356 - DNA, 22 bp, Homo sapiens
ctggacagaagtggctgggcag

SEQ ID NO: 8239357 - DNA, 22 bp, Homo sapiens
ctggacagaaagggctgctgtg

SEQ ID NO: 8239358 - DNA, 22 bp, Homo sapiens
ctggacagaaaccagtcctggg

SEQ ID NO: 8239359 - DNA, 22 bp, Homo sapiens
ctggacagaaaccagtcctggg

SEQ ID NO: 8239360 - DNA, 22 bp, Homo sapiens
ctggaaagacctgcttgctttt

SEQ ID NO: 8239361 - DNA, 22 bp, Homo sapiens
ctggaaagacagagggcatggg

SEQ ID NO: 8239362 - DNA, 22 bp, Homo sapiens
ctggaaagggtcctcattctgt

SEQ ID NO: 8239363 - DNA, 22 bp, Homo sapiens
ctggaaagatttctttggagtc

SEQ ID NO: 8239364 - DNA, 22 bp, Homo sapiens
ctgctttgtgtggtccctccag

SEQ ID NO: 8239365 - DNA, 22 bp, Homo sapiens
ctggaaaatgaagaagcagagg

SEQ ID NO: 8239366 - DNA, 22 bp, Homo sapiens
ctggaaaatgaagaagcagagg

SEQ ID NO: 8239367 - DNA, 22 bp, Homo sapiens
ctgctttgcatagctgccagag

SEQ ID NO: 8239368 - DNA, 22 bp, Homo sapiens
ctgctttgattagaagagtaca

SEQ ID NO: 8239369 - DNA, 22 bp, Homo sapiens
ctgctttgactgttaagaacca

SEQ ID NO: 8239370 - DNA, 22 bp, Homo sapiens
ctgctttgaggggctctgtata

SEQ ID NO: 8239371 - DNA, 22 bp, Homo sapiens
ctgctttcttgttgcatcttaa

SEQ ID NO: 8239372 - DNA, 22 bp, Homo sapiens
ctgctttcttgttgcatcttaa

SEQ ID NO: 8239373 - DNA, 22 bp, Homo sapiens
ctgctttcttgttgcatcttaa

SEQ ID NO: 8239374 - DNA, 22 bp, Homo sapiens
ctgctttctgcaccccaggtcg

SEQ ID NO: 8239375 - DNA, 22 bp, Homo sapiens
ctgctttgtaaaatagacataa

SEQ ID NO: 8239376 - DNA, 22 bp, Homo sapiens
ctgctttgggcagctttgtggc

SEQ ID NO: 8239377 - DNA, 22 bp, Homo sapiens
ctgctttgtggaatcacactgg

SEQ ID NO: 8239378 - DNA, 22 bp, Homo sapiens
ctgctttgtggaatcacactgg

SEQ ID NO: 8239379 - DNA, 22 bp, Homo sapiens
ctgctttggacaactattcttg

SEQ ID NO: 8239380 - DNA, 22 bp, Homo sapiens
ctgctttggctcagtgacatca

SEQ ID NO: 8239381 - DNA, 22 bp, Homo sapiens
ctgctttgcatagctgccagag

SEQ ID NO: 8239382 - DNA, 18 bp, Homo sapiens
ctgctttgccttcattcc

SEQ ID NO: 8239383 - DNA, 22 bp, Homo sapiens
ctgctttggacaactattcttg

SEQ ID NO: 8239384 - DNA, 21 bp, Homo sapiens
ctggagggtagagttgggctg

SEQ ID NO: 8239385 - DNA, 22 bp, Homo sapiens
ctggagggtgagcctcatctct

SEQ ID NO: 8239386 - DNA, 22 bp, Homo sapiens
ctggagggtgagcctcatctct

SEQ ID NO: 8239387 - DNA, 22 bp, Homo sapiens
ctggagggggaaatgttcattg

SEQ ID NO: 8239388 - DNA, 22 bp, Homo sapiens
ctggagggggaaatgttcattg

SEQ ID NO: 8239389 - DNA, 22 bp, Homo sapiens
ctggagggggaaatgttcattg

SEQ ID NO: 8239390 - DNA, 21 bp, Homo sapiens
ctggagggtagagttgggctg

SEQ ID NO: 8239391 - DNA, 21 bp, Homo sapiens
ctggagggtagagttgggctg

SEQ ID NO: 8239392 - DNA, 19 bp, Homo sapiens
ctggaggtagagggttagt

SEQ ID NO: 8239393 - DNA, 22 bp, Homo sapiens
ctggagggtgagcctcatctct

SEQ ID NO: 8239394 - DNA, 22 bp, Homo sapiens
ctggagggtggagagaagtctc

SEQ ID NO: 8239395 - DNA, 22 bp, Homo sapiens
ctggagggtggagagaagtctc

SEQ ID NO: 8239396 - DNA, 22 bp, Homo sapiens
ctggaggtagatggtggtaatg

SEQ ID NO: 8239397 - DNA, 19 bp, Homo sapiens
ctggaggtagagggttagt

SEQ ID NO: 8239398 - DNA, 22 bp, Homo sapiens
ctggaggtagatggtggtaatg

SEQ ID NO: 8239399 - DNA, 22 bp, Homo sapiens
ctggaggtcatgtaatatggaa

SEQ ID NO: 8239400 - DNA, 22 bp, Homo sapiens
ctggaggtctacagtggtagct

SEQ ID NO: 8239401 - DNA, 22 bp, Homo sapiens
ctggaggtctacagtggtagct

SEQ ID NO: 8239402 - DNA, 22 bp, Homo sapiens
ctggaggtctacagtggtagct

SEQ ID NO: 8239403 - DNA, 22 bp, Homo sapiens
ctggagggacaaggtatgcatt

SEQ ID NO: 8239404 - DNA, 22 bp, Homo sapiens
ctggagggactttctcacggat

SEQ ID NO: 8239405 - DNA, 22 bp, Homo sapiens
ctggagggactttctcacggat

SEQ ID NO: 8239406 - DNA, 22 bp, Homo sapiens
ctggagggcttctgcaggttac

SEQ ID NO: 8239407 - DNA, 22 bp, Homo sapiens
ctggagggctggactaaggaaa

SEQ ID NO: 8239408 - DNA, 22 bp, Homo sapiens
ctggagggctggactaaggaaa

SEQ ID NO: 8239409 - DNA, 22 bp, Homo sapiens
ctggagggctggactaaggaaa

SEQ ID NO: 8239410 - DNA, 22 bp, Homo sapiens
ctggagggagattcaaaggagg

SEQ ID NO: 8239411 - DNA, 22 bp, Homo sapiens
ctggagggcttctgcaggttac

SEQ ID NO: 8239412 - DNA, 22 bp, Homo sapiens
ctggagggcttctgcaggttac

SEQ ID NO: 8239413 - DNA, 22 bp, Homo sapiens
ctggagggcttctgcaggttac

SEQ ID NO: 8239414 - DNA, 22 bp, Homo sapiens
ctggaggggccatccacagtct

SEQ ID NO: 8239415 - DNA, 22 bp, Homo sapiens
ctggaggggccatccacagtct

SEQ ID NO: 8239416 - DNA, 22 bp, Homo sapiens
ctggaggggctggcatggtagc

SEQ ID NO: 8239417 - DNA, 22 bp, Homo sapiens
ctggaggggctggcatggtagc

SEQ ID NO: 8239418 - DNA, 22 bp, Homo sapiens
ctggaggtgggggcaagagtgt

SEQ ID NO: 8239419 - DNA, 22 bp, Homo sapiens
ctggaggtgggggcaagagtgt

SEQ ID NO: 8239420 - DNA, 22 bp, Homo sapiens
ctggaggtgcttcgctggccac

SEQ ID NO: 8239421 - DNA, 22 bp, Homo sapiens
ctggaggtgcttcgctggccac

SEQ ID NO: 8239422 - DNA, 22 bp, Homo sapiens
ctggaggtgcctagatgagctc

SEQ ID NO: 8239423 - DNA, 22 bp, Homo sapiens
ctggaggtgcctagatgagctc

SEQ ID NO: 8239424 - DNA, 22 bp, Homo sapiens
ctggagtctccccaggagcgtg

SEQ ID NO: 8239425 - DNA, 21 bp, Homo sapiens
ctggagtcattttctgagtag

SEQ ID NO: 8239426 - DNA, 18 bp, Homo sapiens
ctggagtcacagtgggga

SEQ ID NO: 8239427 - DNA, 22 bp, Homo sapiens
ctggagtcagcaaggacgaggc

SEQ ID NO: 8239428 - DNA, 22 bp, Homo sapiens
ctggagtcactcatgtagctgc

SEQ ID NO: 8239429 - DNA, 22 bp, Homo sapiens
ctggagtcactcatgtagctgc

SEQ ID NO: 8239430 - DNA, 20 bp, Homo sapiens
ctggagtgtagcagtggctg

SEQ ID NO: 8239431 - DNA, 20 bp, Homo sapiens
ctggagtgtagcagtggctg

SEQ ID NO: 8239432 - DNA, 22 bp, Homo sapiens
ctggagtgtaaagagcatagaa

SEQ ID NO: 8239433 - DNA, 20 bp, Homo sapiens
ctggagtgtagcagtggctg

SEQ ID NO: 8239434 - DNA, 20 bp, Homo sapiens
ctggagtgtagcagtggctg

SEQ ID NO: 8239435 - DNA, 22 bp, Homo sapiens
ctggagtgtaaagagcatagaa

SEQ ID NO: 8239436 - DNA, 22 bp, Homo sapiens
ctggagtgtaaagagcatagaa

SEQ ID NO: 8239437 - DNA, 22 bp, Homo sapiens
ctggagtggccggtgctgtggc

SEQ ID NO: 8239438 - DNA, 22 bp, Homo sapiens
ctggagtgtaaagagcatagaa

SEQ ID NO: 8239439 - DNA, 22 bp, Homo sapiens
ctggagtctcttctgtagctac

SEQ ID NO: 8239440 - DNA, 22 bp, Homo sapiens
ctggagttttggaaaaatgctt

SEQ ID NO: 8239441 - DNA, 22 bp, Homo sapiens
ctggagtttgtggcttgctcaa

SEQ ID NO: 8239442 - DNA, 22 bp, Homo sapiens
ctggagttgggatgtgcctgga

SEQ ID NO: 8239443 - DNA, 22 bp, Homo sapiens
ctggagttgggatgtgcctgga

SEQ ID NO: 8239444 - DNA, 22 bp, Homo sapiens
ctggagttcagtggcgtgaaca

SEQ ID NO: 8239445 - DNA, 22 bp, Homo sapiens
ctggagtgttatggtcaagtca

SEQ ID NO: 8239446 - DNA, 22 bp, Homo sapiens
ctggagttctatgtgcttgtga

SEQ ID NO: 8239447 - DNA, 22 bp, Homo sapiens
ctggaccagaaaggacatggct

SEQ ID NO: 8239448 - DNA, 22 bp, Homo sapiens
ctggacagtgggcagaggagac

SEQ ID NO: 8239449 - DNA, 22 bp, Homo sapiens
ctggacatcagtgtgcctggct

SEQ ID NO: 8239450 - DNA, 22 bp, Homo sapiens
ctggaccagaaaggacatggct

SEQ ID NO: 8239451 - DNA, 23 bp, Homo sapiens
ctggactcaggggatgtgaagga

SEQ ID NO: 8239452 - DNA, 22 bp, Homo sapiens
ctggacttggggaggctagatt

SEQ ID NO: 8239453 - DNA, 22 bp, Homo sapiens
ctggagctctccagagccccgt

SEQ ID NO: 8239454 - DNA, 21 bp, Homo sapiens
ctggactgaggagacagtcgc

SEQ ID NO: 8239455 - DNA, 22 bp, Homo sapiens
ctggaggacagaggccatgtct

SEQ ID NO: 8239456 - DNA, 22 bp, Homo sapiens
ctggaggacagaggccatgtct

SEQ ID NO: 8239457 - DNA, 22 bp, Homo sapiens
ctggaggacagaggccatgtct

SEQ ID NO: 8239458 - DNA, 22 bp, Homo sapiens
ctggaggaatcacagaaggctt

SEQ ID NO: 8239459 - DNA, 22 bp, Homo sapiens
ctggaggaatcacagaaggctt

SEQ ID NO: 8239460 - DNA, 22 bp, Homo sapiens
ctggaggaccacagaagctggt

SEQ ID NO: 8239461 - DNA, 22 bp, Homo sapiens
ctggaggaccacagaagctggt

SEQ ID NO: 8239462 - DNA, 22 bp, Homo sapiens
ctggaggaccacagaagctggt

SEQ ID NO: 8239463 - DNA, 22 bp, Homo sapiens
ctggaggaccacagaagctggt

SEQ ID NO: 8239464 - DNA, 22 bp, Homo sapiens
ctggagctctgtgtgttcctga

SEQ ID NO: 8239465 - DNA, 22 bp, Homo sapiens
ctggagctctccagagccccgt

SEQ ID NO: 8239466 - DNA, 22 bp, Homo sapiens
ctggagctcttctgagtgtgct

SEQ ID NO: 8239467 - DNA, 22 bp, Homo sapiens
ctggagctctgtgtgttcctga

SEQ ID NO: 8239468 - DNA, 22 bp, Homo sapiens
ctggaggaataatggcatcttg

SEQ ID NO: 8239469 - DNA, 22 bp, Homo sapiens
ctggagctcttctgagtgtgct

SEQ ID NO: 8239470 - DNA, 22 bp, Homo sapiens
ctggaggcacccttagagaggc

SEQ ID NO: 8239471 - DNA, 22 bp, Homo sapiens
ctggaggcaaagcagaggcatg

SEQ ID NO: 8239472 - DNA, 22 bp, Homo sapiens
ctggaggcaaagcagaggcatg

SEQ ID NO: 8239473 - DNA, 22 bp, Homo sapiens
ctggaggcaaagcagaggcatg

SEQ ID NO: 8239474 - DNA, 22 bp, Homo sapiens
ctggaggaggaagtctacaatg

SEQ ID NO: 8239475 - DNA, 22 bp, Homo sapiens
ctggaggcaaagcagaggcatg

SEQ ID NO: 8239476 - DNA, 22 bp, Homo sapiens
ctggaggaggaagtctacaatg

SEQ ID NO: 8239477 - DNA, 22 bp, Homo sapiens
ctggaggaggaagtctacaatg

SEQ ID NO: 8239478 - DNA, 22 bp, Homo sapiens
ctggaggagcatggactggagt

SEQ ID NO: 8239479 - DNA, 22 bp, Homo sapiens
ctggaggagcatggactggagt

SEQ ID NO: 8239480 - DNA, 22 bp, Homo sapiens
ctggaggagcatggactggagt

SEQ ID NO: 8239481 - DNA, 22 bp, Homo sapiens
ctggaggacccctgcctggaag

SEQ ID NO: 8239482 - DNA, 22 bp, Homo sapiens
ctggaggacccctgcctggaag

SEQ ID NO: 8239483 - DNA, 22 bp, Homo sapiens
ctggaggacccctgcctggaag

SEQ ID NO: 8239484 - DNA, 22 bp, Homo sapiens
ctggaggacccctgcctggaag

SEQ ID NO: 8239485 - DNA, 22 bp, Homo sapiens
ctggaggagaacttgaggaagg

SEQ ID NO: 8239486 - DNA, 22 bp, Homo sapiens
ctggaggagaacttgaggaagg

SEQ ID NO: 8239487 - DNA, 22 bp, Homo sapiens
ctggaggagaacttgaggaagg

SEQ ID NO: 8239488 - DNA, 22 bp, Homo sapiens
ctggaggagaacttgaggaagg

SEQ ID NO: 8239489 - DNA, 22 bp, Homo sapiens
ctggaggagagtctgaatgaca

SEQ ID NO: 8239490 - DNA, 22 bp, Homo sapiens
ctggaggagcaatatggttagg

SEQ ID NO: 8239491 - DNA, 22 bp, Homo sapiens
ctggaggagagtctgaatgaca

SEQ ID NO: 8239492 - DNA, 22 bp, Homo sapiens
ctggaggagagtctgaatgaca

SEQ ID NO: 8239493 - DNA, 22 bp, Homo sapiens
ctggaggagagtctgaatgaca

SEQ ID NO: 8239494 - DNA, 22 bp, Homo sapiens
ctggaggagagtctgaatgaca

SEQ ID NO: 8239495 - DNA, 21 bp, Homo sapiens
ctggaggcaggtggtgccagg

SEQ ID NO: 8239496 - DNA, 21 bp, Homo sapiens
ctggaggcaggtggtgccagg

SEQ ID NO: 8239497 - DNA, 21 bp, Homo sapiens
ctggaggcaggtggtgccagg

SEQ ID NO: 8239498 - DNA, 21 bp, Homo sapiens
ctggaggcaggtggtgccagg

SEQ ID NO: 8239499 - DNA, 21 bp, Homo sapiens
ctggaggcaggtggtgccagg

SEQ ID NO: 8239500 - DNA, 21 bp, Homo sapiens
ctggaggcaggtggtgccagg

SEQ ID NO: 8239501 - DNA, 21 bp, Homo sapiens
ctggaggcaggtggtgccagg

SEQ ID NO: 8239502 - DNA, 22 bp, Homo sapiens
ctggaggcacccttagagaggc

SEQ ID NO: 8239503 - DNA, 22 bp, Homo sapiens
ctggaggctggcttcccctggc

SEQ ID NO: 8239504 - DNA, 22 bp, Homo sapiens
ctggaggctggcttcccctggc

SEQ ID NO: 8239505 - DNA, 22 bp, Homo sapiens
ctggagggacaaggtatgcatt

SEQ ID NO: 8239506 - DNA, 22 bp, Homo sapiens
ctggaggccactgtacagattg

SEQ ID NO: 8239507 - DNA, 22 bp, Homo sapiens
ctggaggctgagttgggtctcc

SEQ ID NO: 8239508 - DNA, 22 bp, Homo sapiens
ctggaggctgagttgggtctcc

SEQ ID NO: 8239509 - DNA, 22 bp, Homo sapiens
ctggaggctgagttgggtctcc

SEQ ID NO: 8239510 - DNA, 22 bp, Homo sapiens
ctggcatgtgtttggctcctgt

SEQ ID NO: 8239511 - DNA, 22 bp, Homo sapiens
ctggcatggtgtatttgttcaa

SEQ ID NO: 8239512 - DNA, 22 bp, Homo sapiens
ctggcatgtgtttggctcctgt

SEQ ID NO: 8239513 - DNA, 22 bp, Homo sapiens
ctggcatgccttgggtgcctct

SEQ ID NO: 8239514 - DNA, 22 bp, Homo sapiens
ctggcatgccttgggtgcctct

SEQ ID NO: 8239515 - DNA, 21 bp, Homo sapiens
ctggcatgaggagctttgttt

SEQ ID NO: 8239516 - DNA, 21 bp, Homo sapiens
ctggcatgaggagctttgttt

SEQ ID NO: 8239517 - DNA, 22 bp, Homo sapiens
ctggcatgctaatacagcctgt

SEQ ID NO: 8239518 - DNA, 22 bp, Homo sapiens
ctggcatgctaatacagcctgt

SEQ ID NO: 8239519 - DNA, 22 bp, Homo sapiens
ctggcatgccttgggtgcctct

SEQ ID NO: 8239520 - DNA, 22 bp, Homo sapiens
ctggccacaactagcccaggac

SEQ ID NO: 8239521 - DNA, 19 bp, Homo sapiens
ctggccacacctgctggtt

SEQ ID NO: 8239522 - DNA, 22 bp, Homo sapiens
ctggccacaactagcccaggac

SEQ ID NO: 8239523 - DNA, 22 bp, Homo sapiens
ctggccaacttgcttgttggca

SEQ ID NO: 8239524 - DNA, 22 bp, Homo sapiens
ctggccaggcggcccctgcatg

SEQ ID NO: 8239525 - DNA, 22 bp, Homo sapiens
ctggccaggcggcccctgcatg

SEQ ID NO: 8239526 - DNA, 22 bp, Homo sapiens
ctggccaggcggcccctgcatg

SEQ ID NO: 8239527 - DNA, 22 bp, Homo sapiens
ctggccaggcggcccctgcatg

SEQ ID NO: 8239528 - DNA, 22 bp, Homo sapiens
ctggccaggctctcacgtggtc

SEQ ID NO: 8239529 - DNA, 22 bp, Homo sapiens
ctggccagtgcctgtgggcccc

SEQ ID NO: 8239530 - DNA, 22 bp, Homo sapiens
ctggccaggctctcacgtggtc

SEQ ID NO: 8239531 - DNA, 19 bp, Homo sapiens
ctggccacacctgctggtt

SEQ ID NO: 8239532 - DNA, 22 bp, Homo sapiens
ctggccacatgtgtgctgagca

SEQ ID NO: 8239533 - DNA, 22 bp, Homo sapiens
ctggccaccaagagcttgctca

SEQ ID NO: 8239534 - DNA, 22 bp, Homo sapiens
ctggcatgaaatggcatctcat

SEQ ID NO: 8239535 - DNA, 22 bp, Homo sapiens
ctggcagtttgccaggagctcg

SEQ ID NO: 8239536 - DNA, 22 bp, Homo sapiens
ctggcagtttgccaggagctcg

SEQ ID NO: 8239537 - DNA, 22 bp, Homo sapiens
ctggcagtttgccaggagctcg

SEQ ID NO: 8239538 - DNA, 22 bp, Homo sapiens
ctggcagtgtgaccctggacag

SEQ ID NO: 8239539 - DNA, 22 bp, Homo sapiens
ctggcagtgtccagctcgtgat

SEQ ID NO: 8239540 - DNA, 22 bp, Homo sapiens
ctggcagtgtccagctcgtgat

SEQ ID NO: 8239541 - DNA, 22 bp, Homo sapiens
ctggcagtgtccagctcgtgat

SEQ ID NO: 8239542 - DNA, 22 bp, Homo sapiens
ctggcagtgtccagctcgtgat

SEQ ID NO: 8239543 - DNA, 22 bp, Homo sapiens
ctggcagtttgccaggagctcg

SEQ ID NO: 8239544 - DNA, 22 bp, Homo sapiens
ctggcagtgtgaccctggacag

SEQ ID NO: 8239545 - DNA, 22 bp, Homo sapiens
ctggcagttggcagggctgcca

SEQ ID NO: 8239546 - DNA, 22 bp, Homo sapiens
ctggcagttggcagggctgcca

SEQ ID NO: 8239547 - DNA, 22 bp, Homo sapiens
ctggcagttggcagggctgcca

SEQ ID NO: 8239548 - DNA, 22 bp, Homo sapiens
ctggcagtgacattgcaggtgc

SEQ ID NO: 8239549 - DNA, 22 bp, Homo sapiens
ctggcagtctggtggaaggcct

SEQ ID NO: 8239550 - DNA, 22 bp, Homo sapiens
ctggcagtctggtggaaggcct

SEQ ID NO: 8239551 - DNA, 22 bp, Homo sapiens
ctggcagtctggtggaaggcct

SEQ ID NO: 8239552 - DNA, 22 bp, Homo sapiens
ctggcagtctgcctcttcactg

SEQ ID NO: 8239553 - DNA, 22 bp, Homo sapiens
ctggcagtctggtggaaggcct

SEQ ID NO: 8239554 - DNA, 22 bp, Homo sapiens
ctggcagtcacggccatgtgct

SEQ ID NO: 8239555 - DNA, 22 bp, Homo sapiens
ctggcagtgccctcagccccca

SEQ ID NO: 8239556 - DNA, 22 bp, Homo sapiens
ctggcagtggggcctcagtgtt

SEQ ID NO: 8239557 - DNA, 22 bp, Homo sapiens
ctggcagtgccctcagccccca

SEQ ID NO: 8239558 - DNA, 22 bp, Homo sapiens
ctggcagtgcccagtcactgtt

SEQ ID NO: 8239559 - DNA, 22 bp, Homo sapiens
ctggcagtgagctggccactca

SEQ ID NO: 8239560 - DNA, 22 bp, Homo sapiens
ctggcagtgacattgcaggtgc

SEQ ID NO: 8239561 - DNA, 22 bp, Homo sapiens
ctggcagtgacattgcaggtgc

SEQ ID NO: 8239562 - DNA, 22 bp, Homo sapiens
ctggcagcatggagcctgtgct

SEQ ID NO: 8239563 - DNA, 22 bp, Homo sapiens
ctggcagcattaacagagagca

SEQ ID NO: 8239564 - DNA, 22 bp, Homo sapiens
ctggcagcattaacagagagca

SEQ ID NO: 8239565 - DNA, 22 bp, Homo sapiens
ctggcagcatggagcctgtgct

SEQ ID NO: 8239566 - DNA, 22 bp, Homo sapiens
ctggcagcatggagcctgtgct

SEQ ID NO: 8239567 - DNA, 22 bp, Homo sapiens
ctggcagcagttatgaaacaat

SEQ ID NO: 8239568 - DNA, 22 bp, Homo sapiens
ctggcagcatggagcctgtgct

SEQ ID NO: 8239569 - DNA, 22 bp, Homo sapiens
ctggcagggtgggctttgcttt

SEQ ID NO: 8239570 - DNA, 22 bp, Homo sapiens
ctggcagggtgggctttgcttt

SEQ ID NO: 8239571 - DNA, 22 bp, Homo sapiens
ctggcaggtatctaaagttgtc

SEQ ID NO: 8239572 - DNA, 22 bp, Homo sapiens
ctggcaggtccagctggactca

SEQ ID NO: 8239573 - DNA, 22 bp, Homo sapiens
ctggcagtcacggccatgtgct

SEQ ID NO: 8239574 - DNA, 22 bp, Homo sapiens
ctggcagcatttttttcagaag

SEQ ID NO: 8239575 - DNA, 22 bp, Homo sapiens
ctggcagggctctttgggtgct

SEQ ID NO: 8239576 - DNA, 22 bp, Homo sapiens
ctggcagggctctttgggtgct

SEQ ID NO: 8239577 - DNA, 22 bp, Homo sapiens
ctggcagggctctttgggtgct

SEQ ID NO: 8239578 - DNA, 22 bp, Homo sapiens
ctggcagggctctttgggtgct

SEQ ID NO: 8239579 - DNA, 22 bp, Homo sapiens
ctggcagggctctttgggtgct

SEQ ID NO: 8239580 - DNA, 22 bp, Homo sapiens
ctggcagggctggtattcaaaa

SEQ ID NO: 8239581 - DNA, 22 bp, Homo sapiens
ctggatccatcgggtcccgagt

SEQ ID NO: 8239582 - DNA, 22 bp, Homo sapiens
ctggataaatgctttagttgga

SEQ ID NO: 8239583 - DNA, 22 bp, Homo sapiens
ctggataatcacagaggagcat

SEQ ID NO: 8239584 - DNA, 22 bp, Homo sapiens
ctggatggtcccatgagcagct

SEQ ID NO: 8239585 - DNA, 22 bp, Homo sapiens
ctggatgcttcctctctgctag

SEQ ID NO: 8239586 - DNA, 22 bp, Homo sapiens
ctggatggtcccatgagcagct

SEQ ID NO: 8239587 - DNA, 22 bp, Homo sapiens
ctggattctcatcagagccaga

SEQ ID NO: 8239588 - DNA, 22 bp, Homo sapiens
ctggatttaattaactgttgct

SEQ ID NO: 8239589 - DNA, 22 bp, Homo sapiens
ctggattcatgccaggccaccc

SEQ ID NO: 8239590 - DNA, 22 bp, Homo sapiens
ctggatgtcttggggactcctg

SEQ ID NO: 8239591 - DNA, 22 bp, Homo sapiens
ctggatgtccttcccctgaagc

SEQ ID NO: 8239592 - DNA, 22 bp, Homo sapiens
ctggatgtaacgaaggtttcac

SEQ ID NO: 8239593 - DNA, 22 bp, Homo sapiens
ctggatgttttgctaaggactc

SEQ ID NO: 8239594 - DNA, 22 bp, Homo sapiens
ctggatgtttatgaaggaccca

SEQ ID NO: 8239595 - DNA, 22 bp, Homo sapiens
ctggcaagaaatatatatctta

SEQ ID NO: 8239596 - DNA, 22 bp, Homo sapiens
ctggcaagaaatatatatctta

SEQ ID NO: 8239597 - DNA, 22 bp, Homo sapiens
ctggcaagaaatatatatctta

SEQ ID NO: 8239598 - DNA, 22 bp, Homo sapiens
ctggcaagaaatatatatctta

SEQ ID NO: 8239599 - DNA, 22 bp, Homo sapiens
ctggatttaggactagtccaag

SEQ ID NO: 8239600 - DNA, 22 bp, Homo sapiens
ctggatttactgagttttatca

SEQ ID NO: 8239601 - DNA, 23 bp, Homo sapiens
ctggatttggaagcttaaataac

SEQ ID NO: 8239602 - DNA, 22 bp, Homo sapiens
ctggattttgatgagcagtttt

SEQ ID NO: 8239603 - DNA, 22 bp, Homo sapiens
ctggattttatcattgtagttt

SEQ ID NO: 8239604 - DNA, 22 bp, Homo sapiens
ctggattttagaaggcttccta

SEQ ID NO: 8239605 - DNA, 22 bp, Homo sapiens
ctggcactgtgtctgcggaggg

SEQ ID NO: 8239606 - DNA, 22 bp, Homo sapiens
ctggcactggatcgtgcatatc

SEQ ID NO: 8239607 - DNA, 22 bp, Homo sapiens
ctggcactgagtggcttatgac

SEQ ID NO: 8239608 - DNA, 22 bp, Homo sapiens
ctggcactgagtggcttatgac

SEQ ID NO: 8239609 - DNA, 22 bp, Homo sapiens
ctggcactggatcgtgcatatc

SEQ ID NO: 8239610 - DNA, 22 bp, Homo sapiens
ctggcactgtgtctgcggaggg

SEQ ID NO: 8239611 - DNA, 22 bp, Homo sapiens
ctggcacttggcacccatgaaa

SEQ ID NO: 8239612 - DNA, 22 bp, Homo sapiens
ctggcacgcccacgtaggcact

SEQ ID NO: 8239613 - DNA, 22 bp, Homo sapiens
ctggcactcataggccagttca

SEQ ID NO: 8239614 - DNA, 22 bp, Homo sapiens
ctggcactcataggccagttca

SEQ ID NO: 8239615 - DNA, 22 bp, Homo sapiens
ctggcaccccacactgtccacg

SEQ ID NO: 8239616 - DNA, 22 bp, Homo sapiens
ctggcacctccagctcatggcc

SEQ ID NO: 8239617 - DNA, 22 bp, Homo sapiens
ctggcacctccagctcatggcc

SEQ ID NO: 8239618 - DNA, 22 bp, Homo sapiens
ctggcaccccacactgtccacg

SEQ ID NO: 8239619 - DNA, 22 bp, Homo sapiens
ctggcacattgtaatatataca

SEQ ID NO: 8239620 - DNA, 22 bp, Homo sapiens
ctggcacattgtaatatataca

SEQ ID NO: 8239621 - DNA, 22 bp, Homo sapiens
ctggcacatgctccctgagtgg

SEQ ID NO: 8239622 - DNA, 22 bp, Homo sapiens
ctggcacatcactcctagttta

SEQ ID NO: 8239623 - DNA, 22 bp, Homo sapiens
ctggcacatcactcctagttta

SEQ ID NO: 8239624 - DNA, 22 bp, Homo sapiens
ctggcacatgctccctgagtgg

SEQ ID NO: 8239625 - DNA, 22 bp, Homo sapiens
ctggcacatgtgagccacatca

SEQ ID NO: 8239626 - DNA, 22 bp, Homo sapiens
ctggcacatgtgagccacatca

SEQ ID NO: 8239627 - DNA, 22 bp, Homo sapiens
ctggcaagtactgggccagctc

SEQ ID NO: 8239628 - DNA, 22 bp, Homo sapiens
ctggcacatagtaggtgcacag

SEQ ID NO: 8239629 - DNA, 22 bp, Homo sapiens
ctggcacatagtaggtgcacag

SEQ ID NO: 8239630 - DNA, 22 bp, Homo sapiens
ctggcacatagtcagcactcaa

SEQ ID NO: 8239631 - DNA, 22 bp, Homo sapiens
ctggcacatagtcagcactcaa

SEQ ID NO: 8239632 - DNA, 22 bp, Homo sapiens
ctggcacatagtcagcactcaa

SEQ ID NO: 8239633 - DNA, 22 bp, Homo sapiens
ctggcacatagtcagcactcaa

SEQ ID NO: 8239634 - DNA, 22 bp, Homo sapiens
ctggcagattggggtcagcagt

SEQ ID NO: 8239635 - DNA, 22 bp, Homo sapiens
ctggcagattggggtcagcagt

SEQ ID NO: 8239636 - DNA, 22 bp, Homo sapiens
ctggcagcagagctcaacatag

SEQ ID NO: 8239637 - DNA, 22 bp, Homo sapiens
ctggcagcagcttctggatcga

SEQ ID NO: 8239638 - DNA, 22 bp, Homo sapiens
ctggcagcagctggtaccttat

SEQ ID NO: 8239639 - DNA, 22 bp, Homo sapiens
ctggcagcaggtcacacgcaga

SEQ ID NO: 8239640 - DNA, 22 bp, Homo sapiens
ctggcagcaggtcacacgcaga

SEQ ID NO: 8239641 - DNA, 22 bp, Homo sapiens
ctggcagcagcttctggatcga

SEQ ID NO: 8239642 - DNA, 22 bp, Homo sapiens
ctggcagcagcttctggatcga

SEQ ID NO: 8239643 - DNA, 22 bp, Homo sapiens
ctggcagcagcttctggatcga

SEQ ID NO: 8239644 - DNA, 22 bp, Homo sapiens
ctggcagatatttgcagacatg

SEQ ID NO: 8239645 - DNA, 22 bp, Homo sapiens
ctggcagatagtaagtgatcaa

SEQ ID NO: 8239646 - DNA, 22 bp, Homo sapiens
ctggcagatagccacgcctgtc

SEQ ID NO: 8239647 - DNA, 22 bp, Homo sapiens
ctggcagaggatggggacccag

SEQ ID NO: 8239648 - DNA, 22 bp, Homo sapiens
ctggcagagtctgctgtctgca

SEQ ID NO: 8239649 - DNA, 22 bp, Homo sapiens
ctggcagaggatggggacccag

SEQ ID NO: 8239650 - DNA, 22 bp, Homo sapiens
ctggctccctctccctgagtca

SEQ ID NO: 8239651 - DNA, 22 bp, Homo sapiens
ctggctccaggtcatgcactca

SEQ ID NO: 8239652 - DNA, 23 bp, Homo sapiens
ctggctccgaagactccaggatc

SEQ ID NO: 8239653 - DNA, 22 bp, Homo sapiens
ctggctcctcagtattccactt

SEQ ID NO: 8239654 - DNA, 22 bp, Homo sapiens
ctggcctggggcctcagctgct

SEQ ID NO: 8239655 - DNA, 22 bp, Homo sapiens
ctggcctggggcctcagctgct

SEQ ID NO: 8239656 - DNA, 22 bp, Homo sapiens
ctggcctggggggacacatccc

SEQ ID NO: 8239657 - DNA, 22 bp, Homo sapiens
ctggcctggtctggcctctcca

SEQ ID NO: 8239658 - DNA, 22 bp, Homo sapiens
ctggcctggtctggcctctcca

SEQ ID NO: 8239659 - DNA, 22 bp, Homo sapiens
ctggcctggtctggcctctcca

SEQ ID NO: 8239660 - DNA, 22 bp, Homo sapiens
ctggcctggcgcagtggctcac

SEQ ID NO: 8239661 - DNA, 22 bp, Homo sapiens
ctggcctgggagctgctagcgt

SEQ ID NO: 8239662 - DNA, 22 bp, Homo sapiens
ctggcctgggagctgctagcgt

SEQ ID NO: 8239663 - DNA, 22 bp, Homo sapiens
ctggcctgggagctgctagcgt

SEQ ID NO: 8239664 - DNA, 22 bp, Homo sapiens
ctggcctggcgcagtggctcac

SEQ ID NO: 8239665 - DNA, 22 bp, Homo sapiens
ctggcctggcagggagggcatg

SEQ ID NO: 8239666 - DNA, 22 bp, Homo sapiens
ctggcctggcgcagtggctcac

SEQ ID NO: 8239667 - DNA, 22 bp, Homo sapiens
ctggcctggcgcagtggctcac

SEQ ID NO: 8239668 - DNA, 22 bp, Homo sapiens
ctggctctaagtgtcagctccc

SEQ ID NO: 8239669 - DNA, 22 bp, Homo sapiens
ctggctctcgctgggagtactt

SEQ ID NO: 8239670 - DNA, 22 bp, Homo sapiens
ctggctctatctccaaggctgg

SEQ ID NO: 8239671 - DNA, 22 bp, Homo sapiens
ctggctctctgatttcacattc

SEQ ID NO: 8239672 - DNA, 22 bp, Homo sapiens
ctggctctctgagatattgagt

SEQ ID NO: 8239673 - DNA, 22 bp, Homo sapiens
ctggctctgtgggacctggcct

SEQ ID NO: 8239674 - DNA, 23 bp, Homo sapiens
ctggctctgtaggtggcatcctt

SEQ ID NO: 8239675 - DNA, 22 bp, Homo sapiens
ctggctctgggctaagctccca

SEQ ID NO: 8239676 - DNA, 22 bp, Homo sapiens
ctggctctgggcctcagacact

SEQ ID NO: 8239677 - DNA, 22 bp, Homo sapiens
ctggctctgagcccacctccag

SEQ ID NO: 8239678 - DNA, 22 bp, Homo sapiens
ctggctctgactccgcatattt

SEQ ID NO: 8239679 - DNA, 22 bp, Homo sapiens
ctggctctgaccgcgctggcct

SEQ ID NO: 8239680 - DNA, 22 bp, Homo sapiens
ctggccagttgtcctggcttgg

SEQ ID NO: 8239681 - DNA, 22 bp, Homo sapiens
ctggccagttgccttcctgggt

SEQ ID NO: 8239682 - DNA, 22 bp, Homo sapiens
ctggccagttgccttcctgggt

SEQ ID NO: 8239683 - DNA, 22 bp, Homo sapiens
ctggccagttgccttcctgggt

SEQ ID NO: 8239684 - DNA, 22 bp, Homo sapiens
ctggccagttgccttcctgggt

SEQ ID NO: 8239685 - DNA, 22 bp, Homo sapiens
ctggccagtgtggctctgatct

SEQ ID NO: 8239686 - DNA, 22 bp, Homo sapiens
ctggccagttactgctattggc

SEQ ID NO: 8239687 - DNA, 22 bp, Homo sapiens
ctggccagtgtggctctgatct

SEQ ID NO: 8239688 - DNA, 22 bp, Homo sapiens
ctggccagtgtggctctgatct

SEQ ID NO: 8239689 - DNA, 17 bp, Homo sapiens
ctggccagtgtacttgg

SEQ ID NO: 8239690 - DNA, 22 bp, Homo sapiens
ctggcccagagagcagagctta

SEQ ID NO: 8239691 - DNA, 22 bp, Homo sapiens
ctggcccagagagcagagctta

SEQ ID NO: 8239692 - DNA, 22 bp, Homo sapiens
ctggccatgttgcctctgagac

SEQ ID NO: 8239693 - DNA, 22 bp, Homo sapiens
ctggccataggttctcagtgtg

SEQ ID NO: 8239694 - DNA, 22 bp, Homo sapiens
ctggccatggagaaggtgaagc

SEQ ID NO: 8239695 - DNA, 22 bp, Homo sapiens
ctggccataggttctcagtgtg

SEQ ID NO: 8239696 - DNA, 22 bp, Homo sapiens
ctggccagttgtcctggcttgg

SEQ ID NO: 8239697 - DNA, 22 bp, Homo sapiens
ctggcccaggctcctggggcac

SEQ ID NO: 8239698 - DNA, 21 bp, Homo sapiens
ctggcccagggatctgcattt

SEQ ID NO: 8239699 - DNA, 21 bp, Homo sapiens
ctggcccagggatctgcattt

SEQ ID NO: 8239700 - DNA, 21 bp, Homo sapiens
ctggcccagggatctgcattt

SEQ ID NO: 8239701 - DNA, 22 bp, Homo sapiens
ctggcccaggctcctggggcac

SEQ ID NO: 8239702 - DNA, 22 bp, Homo sapiens
ctggcccagagctctggccttt

SEQ ID NO: 8239703 - DNA, 22 bp, Homo sapiens
ctggcccagagctctggccttt

SEQ ID NO: 8239704 - DNA, 22 bp, Homo sapiens
ctggcctggcagggagggcatg

SEQ ID NO: 8239705 - DNA, 22 bp, Homo sapiens
ctggcctggcaggggacctcta

SEQ ID NO: 8239706 - DNA, 22 bp, Homo sapiens
ctggcctggcaggggacctcta

SEQ ID NO: 8239707 - DNA, 22 bp, Homo sapiens
ctggcctggcagggagggcatg

SEQ ID NO: 8239708 - DNA, 22 bp, Homo sapiens
ctggcctggcagggagggcatg

SEQ ID NO: 8239709 - DNA, 22 bp, Homo sapiens
ctggcctgctgggtgaggtcct

SEQ ID NO: 8239710 - DNA, 22 bp, Homo sapiens
ctggcctggagcctctgggtgg

SEQ ID NO: 8239711 - DNA, 22 bp, Homo sapiens
ctggcctgctgggtgaggtcct

SEQ ID NO: 8239712 - DNA, 22 bp, Homo sapiens
ctggcctgctgggtgaggtcct

SEQ ID NO: 8239713 - DNA, 22 bp, Homo sapiens
ctggcctgcagatcccagggtc

SEQ ID NO: 8239714 - DNA, 22 bp, Homo sapiens
ctggcctgaggtcggctgtagg

SEQ ID NO: 8239715 - DNA, 22 bp, Homo sapiens
ctggcctgaggtcggctgtagg

SEQ ID NO: 8239716 - DNA, 22 bp, Homo sapiens
ctggcccttctcttgcttcctg

SEQ ID NO: 8239717 - DNA, 22 bp, Homo sapiens
ctggcccttctcttgcttcctg

SEQ ID NO: 8239718 - DNA, 22 bp, Homo sapiens
ctggcctgagaatgctaccctt

SEQ ID NO: 8239719 - DNA, 22 bp, Homo sapiens
ctggccctgtggcctaaggact

SEQ ID NO: 8239720 - DNA, 22 bp, Homo sapiens
ctggccctgtggcctaaggact

SEQ ID NO: 8239721 - DNA, 22 bp, Homo sapiens
ctggcccttaggaaaacaaagt

SEQ ID NO: 8239722 - DNA, 22 bp, Homo sapiens
ctggccctgtggcctaaggact

SEQ ID NO: 8239723 - DNA, 22 bp, Homo sapiens
ctggccctgtggaggcaggaac

SEQ ID NO: 8239724 - DNA, 22 bp, Homo sapiens
ctggcctgaggccgccttcaga

SEQ ID NO: 8239725 - DNA, 22 bp, Homo sapiens
ctggcctgaggccgccttcaga

SEQ ID NO: 8239726 - DNA, 22 bp, Homo sapiens
ctggcctgagcacagcggctgc

SEQ ID NO: 8239727 - DNA, 22 bp, Homo sapiens
ctggcctgagcacagcggctgc

SEQ ID NO: 8239728 - DNA, 22 bp, Homo sapiens
tggcaagttaaaatgtggtctt

SEQ ID NO: 8239729 - DNA, 22 bp, Homo sapiens
tggcaagttcatatggtttaag

SEQ ID NO: 8239730 - DNA, 22 bp, Homo sapiens
tggcacaggaatttagatgcag

SEQ ID NO: 8239731 - DNA, 22 bp, Homo sapiens
tggcacaggaatttagatgcag

SEQ ID NO: 8239732 - DNA, 22 bp, Homo sapiens
tggcaagtggcaccggctgtgg

SEQ ID NO: 8239733 - DNA, 22 bp, Homo sapiens
tggcaaggccacaggtgcagtt

SEQ ID NO: 8239734 - DNA, 23 bp, Homo sapiens
tggcaaggaatgggatggagact

SEQ ID NO: 8239735 - DNA, 22 bp, Homo sapiens
tggcacagtcctgggtgcctgc

SEQ ID NO: 8239736 - DNA, 22 bp, Homo sapiens
tggcacagtcctgggtgcctgc

SEQ ID NO: 8239737 - DNA, 22 bp, Homo sapiens
tggcacagggcttggtcgctca

SEQ ID NO: 8239738 - DNA, 22 bp, Homo sapiens
tggcacagggcttggtcgctca

SEQ ID NO: 8239739 - DNA, 22 bp, Homo sapiens
tggcacagggcttggtcgctca

SEQ ID NO: 8239740 - DNA, 22 bp, Homo sapiens
tggcacagtcctgggtgcctgc

SEQ ID NO: 8239741 - DNA, 22 bp, Homo sapiens
tggcacaggatctcagcggcca

SEQ ID NO: 8239742 - DNA, 22 bp, Homo sapiens
tggcacaggcggtaagggtgtg

SEQ ID NO: 8239743 - DNA, 22 bp, Homo sapiens
tggcacaggagcactgccctgg

SEQ ID NO: 8239744 - DNA, 22 bp, Homo sapiens
tggcacaggatctcagcggcca

SEQ ID NO: 8239745 - DNA, 22 bp, Homo sapiens
tggcacaggatctcagcggcca

SEQ ID NO: 8239746 - DNA, 22 bp, Homo sapiens
tggcagcacggcatccactctc

SEQ ID NO: 8239747 - DNA, 22 bp, Homo sapiens
tggcagctggagggcaatggcc

SEQ ID NO: 8239748 - DNA, 22 bp, Homo sapiens
tggcagctggctctgcgcaggc

SEQ ID NO: 8239749 - DNA, 22 bp, Homo sapiens
tggcagctggatcccaaggcag

SEQ ID NO: 8239750 - DNA, 22 bp, Homo sapiens
tggcagcacaaggtggcccatg

SEQ ID NO: 8239751 - DNA, 22 bp, Homo sapiens
tggcagcaatttgtgatgttga

SEQ ID NO: 8239752 - DNA, 22 bp, Homo sapiens
tggcagcacaaggtggcccatg

SEQ ID NO: 8239753 - DNA, 21 bp, Homo sapiens
tggcagcacccacaccctctg

SEQ ID NO: 8239754 - DNA, 21 bp, Homo sapiens
tggcagcacccacaccctctg

SEQ ID NO: 8239755 - DNA, 22 bp, Homo sapiens
tggcagcaccagcagtgtcctt

SEQ ID NO: 8239756 - DNA, 22 bp, Homo sapiens
tggcagcacattgacccgggct

SEQ ID NO: 8239757 - DNA, 22 bp, Homo sapiens
tggcagaggtatattgggagga

SEQ ID NO: 8239758 - DNA, 22 bp, Homo sapiens
tggcagaggtatattgggagga

SEQ ID NO: 8239759 - DNA, 22 bp, Homo sapiens
tggcagaggtatattgggagga

SEQ ID NO: 8239760 - DNA, 22 bp, Homo sapiens
tggcagatgagccgcgctccaa

SEQ ID NO: 8239761 - DNA, 22 bp, Homo sapiens
tggcagatgtggcatagagcat

SEQ ID NO: 8239762 - DNA, 22 bp, Homo sapiens
tggcagatttaacattggaact

SEQ ID NO: 8239763 - DNA, 22 bp, Homo sapiens
tggcagattttctctggaggag

SEQ ID NO: 8239764 - DNA, 22 bp, Homo sapiens
tggcagcaattagctagagctg

SEQ ID NO: 8239765 - DNA, 22 bp, Homo sapiens
tggcagcaattagctagagctg

SEQ ID NO: 8239766 - DNA, 22 bp, Homo sapiens
tggcagcaagttcttgggaggt

SEQ ID NO: 8239767 - DNA, 22 bp, Homo sapiens
tggcagcaagttcttgggaggt

SEQ ID NO: 8239768 - DNA, 22 bp, Homo sapiens
tggcagcaaaaccagaatcaga

SEQ ID NO: 8239769 - DNA, 22 bp, Homo sapiens
tggcagattttctctggaggag

SEQ ID NO: 8239770 - DNA, 22 bp, Homo sapiens
tggcagcaaaaccagaatcaga

SEQ ID NO: 8239771 - DNA, 22 bp, Homo sapiens
tggcagcttgaatgcagtcttt

SEQ ID NO: 8239772 - DNA, 22 bp, Homo sapiens
tggccacacccacctagaggag

SEQ ID NO: 8239773 - DNA, 22 bp, Homo sapiens
tggccacacccacctagaggag

SEQ ID NO: 8239774 - DNA, 22 bp, Homo sapiens
tggccacacccacctagaggag

SEQ ID NO: 8239775 - DNA, 21 bp, Homo sapiens
tggccagctggagtctccaca

SEQ ID NO: 8239776 - DNA, 22 bp, Homo sapiens
tggccaggcaggtagaacggcc

SEQ ID NO: 8239777 - DNA, 22 bp, Homo sapiens
tggccaggcaggtagaacggcc

SEQ ID NO: 8239778 - DNA, 22 bp, Homo sapiens
tggccaggaggctgcttctgac

SEQ ID NO: 8239779 - DNA, 22 bp, Homo sapiens
tggccaggaggctgcttctgac

SEQ ID NO: 8239780 - DNA, 22 bp, Homo sapiens
tggccaggaggctgcttctgac

SEQ ID NO: 8239781 - DNA, 22 bp, Homo sapiens
tggccaggaggctgcttctgac

SEQ ID NO: 8239782 - DNA, 22 bp, Homo sapiens
tggccagctttttgtagtgctc

SEQ ID NO: 8239783 - DNA, 22 bp, Homo sapiens
tggcagctggctctgcgcaggc

SEQ ID NO: 8239784 - DNA, 22 bp, Homo sapiens
tggcagctggctctgcgcaggc

SEQ ID NO: 8239785 - DNA, 22 bp, Homo sapiens
tggcagctgtctgtggggtctc

SEQ ID NO: 8239786 - DNA, 22 bp, Homo sapiens
tggcagcttgaatgcagtcttt

SEQ ID NO: 8239787 - DNA, 22 bp, Homo sapiens
tggcagcttcctgctcatagga

SEQ ID NO: 8239788 - DNA, 22 bp, Homo sapiens
tggcagctgtgtccaggtagaa

SEQ ID NO: 8239789 - DNA, 22 bp, Homo sapiens
tggcagctgtgtccaggtagaa

SEQ ID NO: 8239790 - DNA, 22 bp, Homo sapiens
cctatgatatgtgttagataca

SEQ ID NO: 8239791 - DNA, 21 bp, Homo sapiens
cctagtgttaaaacagtttaa

SEQ ID NO: 8239792 - DNA, 20 bp, Homo sapiens
cctagttttctgagcgtgac

SEQ ID NO: 8239793 - DNA, 22 bp, Homo sapiens
cctagttttggacattcctgca

SEQ ID NO: 8239794 - DNA, 22 bp, Homo sapiens
cctagtttttcacttgtgctgt

SEQ ID NO: 8239795 - DNA, 22 bp, Homo sapiens
cctagttttcattcagcagcct

SEQ ID NO: 8239796 - DNA, 22 bp, Homo sapiens
cctagtttcttaattttgagaa

SEQ ID NO: 8239797 - DNA, 22 bp, Homo sapiens
cctagggagcctgagagcagtg

SEQ ID NO: 8239798 - DNA, 22 bp, Homo sapiens
cctaggtcctatatgacctagc

SEQ ID NO: 8239799 - DNA, 22 bp, Homo sapiens
cctagggtcagtgtggcaggag

SEQ ID NO: 8239800 - DNA, 22 bp, Homo sapiens
cctaggcttgttttcatcagct

SEQ ID NO: 8239801 - DNA, 22 bp, Homo sapiens
cctaggccttactttcctgtgc

SEQ ID NO: 8239802 - DNA, 22 bp, Homo sapiens
tggccaggcattcagataagac

SEQ ID NO: 8239803 - DNA, 22 bp, Homo sapiens
tggccaggcattcagataagac

SEQ ID NO: 8239804 - DNA, 22 bp, Homo sapiens
tggccaggcattcagataagac

SEQ ID NO: 8239805 - DNA, 23 bp, Homo sapiens
tggccaggcataaaggtgggtgg

SEQ ID NO: 8239806 - DNA, 22 bp, Homo sapiens
cctaggccctcaaagagcataa

SEQ ID NO: 8239807 - DNA, 22 bp, Homo sapiens
cctaggccctcaaagagcataa

SEQ ID NO: 8239808 - DNA, 22 bp, Homo sapiens
cctaggccctaggcttccatca

SEQ ID NO: 8239809 - DNA, 22 bp, Homo sapiens
cctaggccctaggcttccatca

SEQ ID NO: 8239810 - DNA, 22 bp, Homo sapiens
tggccaggcattcagataagac

SEQ ID NO: 8239811 - DNA, 22 bp, Homo sapiens
tggccaggcattcagataagac

SEQ ID NO: 8239812 - DNA, 22 bp, Homo sapiens
tggccaggcattcagataagac

SEQ ID NO: 8239813 - DNA, 22 bp, Homo sapiens
tggccaggcattcagataagac

SEQ ID NO: 8239814 - DNA, 22 bp, Homo sapiens
cctaggccgcccggtgcgtggg

SEQ ID NO: 8239815 - DNA, 20 bp, Homo sapiens
cctaggccctccggctgccc

SEQ ID NO: 8239816 - DNA, 22 bp, Homo sapiens
tggccaggcaggtagaacggcc

SEQ ID NO: 8239817 - DNA, 22 bp, Homo sapiens
tggccaggcaggtagaacggcc

SEQ ID NO: 8239818 - DNA, 22 bp, Homo sapiens
tggccaggcaggtagaacggcc

SEQ ID NO: 8239819 - DNA, 22 bp, Homo sapiens
tggccaggcaggtagaacggcc

SEQ ID NO: 8239820 - DNA, 22 bp, Homo sapiens
tggccaggcaggtagaacggcc

SEQ ID NO: 8239821 - DNA, 23 bp, Homo sapiens
tggccaggcataaaggtgggtgg

SEQ ID NO: 8239822 - DNA, 23 bp, Homo sapiens
tggccaggcataaaggtgggtgg

SEQ ID NO: 8239823 - DNA, 23 bp, Homo sapiens
tggccaggcataaaggtgggtgg

SEQ ID NO: 8239824 - DNA, 23 bp, Homo sapiens
tggccaggcataaaggtgggtgg

SEQ ID NO: 8239825 - DNA, 22 bp, Homo sapiens
ccctcatgtcagtccctgccca

SEQ ID NO: 8239826 - DNA, 22 bp, Homo sapiens
ccctcatgccagacagcatgca

SEQ ID NO: 8239827 - DNA, 22 bp, Homo sapiens
ccctcatgccagacagcatgca

SEQ ID NO: 8239828 - DNA, 22 bp, Homo sapiens
ccctccagagcttgacctgctg

SEQ ID NO: 8239829 - DNA, 22 bp, Homo sapiens
ccctccagagcctggacattct

SEQ ID NO: 8239830 - DNA, 22 bp, Homo sapiens
ccctccaccaagcagggcgcca

SEQ ID NO: 8239831 - DNA, 22 bp, Homo sapiens
ccctccacagacaggacttgtc

SEQ ID NO: 8239832 - DNA, 22 bp, Homo sapiens
ccctccagccatggacccaggt

SEQ ID NO: 8239833 - DNA, 22 bp, Homo sapiens
ccctccagccatggacccaggt

SEQ ID NO: 8239834 - DNA, 22 bp, Homo sapiens
ccctccagccatggacccaggt

SEQ ID NO: 8239835 - DNA, 20 bp, Homo sapiens
ccctccagcaaccaggactt

SEQ ID NO: 8239836 - DNA, 22 bp, Homo sapiens
ccctccagagcttgacctgctg

SEQ ID NO: 8239837 - DNA, 20 bp, Homo sapiens
ccctccagcaaccaggactt

SEQ ID NO: 8239838 - DNA, 20 bp, Homo sapiens
ccctccagcaaccaggactt

SEQ ID NO: 8239839 - DNA, 22 bp, Homo sapiens
ccctccagtgtcccagtgggga

SEQ ID NO: 8239840 - DNA, 22 bp, Homo sapiens
ccctccagggagccatgctggg

SEQ ID NO: 8239841 - DNA, 22 bp, Homo sapiens
ccctccagggagccatgctggg

SEQ ID NO: 8239842 - DNA, 22 bp, Homo sapiens
ccctgctgcagagagctttcca

SEQ ID NO: 8239843 - DNA, 22 bp, Homo sapiens
ccctgctgcagagagctttcca

SEQ ID NO: 8239844 - DNA, 22 bp, Homo sapiens
ccctggagaaggggacgcggag

SEQ ID NO: 8239845 - DNA, 19 bp, Homo sapiens
ccctggagaataccctgga

SEQ ID NO: 8239846 - DNA, 22 bp, Homo sapiens
ccctggagaaggggacgcggag

SEQ ID NO: 8239847 - DNA, 22 bp, Homo sapiens
ccctccagggagccatgctggg

SEQ ID NO: 8239848 - DNA, 22 bp, Homo sapiens
ccctccagctcaaagcaaccgg

SEQ ID NO: 8239849 - DNA, 22 bp, Homo sapiens
ccctccagctcaaagcaaccgg

SEQ ID NO: 8239850 - DNA, 22 bp, Homo sapiens
ccctccagctcaaagcaaccgg

SEQ ID NO: 8239851 - DNA, 22 bp, Homo sapiens
tggagctgactcacaccagcta

SEQ ID NO: 8239852 - DNA, 22 bp, Homo sapiens
tggagctgactcacaccagcta

SEQ ID NO: 8239853 - DNA, 23 bp, Homo sapiens
tggagctgacagtcagagggagg

SEQ ID NO: 8239854 - DNA, 23 bp, Homo sapiens
tggagctgacagtcagagggagg

SEQ ID NO: 8239855 - DNA, 22 bp, Homo sapiens
tggagctgactcacaccagcta

SEQ ID NO: 8239856 - DNA, 22 bp, Homo sapiens
tggagctgactcacaccagcta

SEQ ID NO: 8239857 - DNA, 22 bp, Homo sapiens
tggagctgagaagtggagctct

SEQ ID NO: 8239858 - DNA, 22 bp, Homo sapiens
tggagctgagaagtggagctct

SEQ ID NO: 8239859 - DNA, 22 bp, Homo sapiens
tggagctgagaagtggagctct

SEQ ID NO: 8239860 - DNA, 22 bp, Homo sapiens
tggagctgagagccaggctggc

SEQ ID NO: 8239861 - DNA, 22 bp, Homo sapiens
tggagctgagagccaggctggc

SEQ ID NO: 8239862 - DNA, 22 bp, Homo sapiens
tggagctgagaagtggagctct

SEQ ID NO: 8239863 - DNA, 22 bp, Homo sapiens
tggagctgagaagtggagctct

SEQ ID NO: 8239864 - DNA, 22 bp, Homo sapiens
tggagctgagaagtggagctct

SEQ ID NO: 8239865 - DNA, 22 bp, Homo sapiens
tggagctgagagccaggctggc

SEQ ID NO: 8239866 - DNA, 22 bp, Homo sapiens
tggagctgagagccaggctggc

SEQ ID NO: 8239867 - DNA, 22 bp, Homo sapiens
tggagctgagagccaggctggc

SEQ ID NO: 8239868 - DNA, 22 bp, Homo sapiens
tggagctgagagccaggctggc

SEQ ID NO: 8239869 - DNA, 22 bp, Homo sapiens
tggagctgagagttaataagga

SEQ ID NO: 8239870 - DNA, 22 bp, Homo sapiens
ccctggagatcgggagaggaag

SEQ ID NO: 8239871 - DNA, 22 bp, Homo sapiens
ccctggagcatctctgctgtct

SEQ ID NO: 8239872 - DNA, 22 bp, Homo sapiens
ccctggagcatctctgctgtct

SEQ ID NO: 8239873 - DNA, 22 bp, Homo sapiens
ccctggagatcgggagaggaag

SEQ ID NO: 8239874 - DNA, 22 bp, Homo sapiens
ccctggagatcgggagaggaag

SEQ ID NO: 8239875 - DNA, 22 bp, Homo sapiens
ccctggagctagtctgagcaga

SEQ ID NO: 8239876 - DNA, 22 bp, Homo sapiens
ccctggagctagtctgagcaga

SEQ ID NO: 8239877 - DNA, 22 bp, Homo sapiens
ccctggagcatctctgctgtct

SEQ ID NO: 8239878 - DNA, 22 bp, Homo sapiens
ccctggagcatctctgctgtct

SEQ ID NO: 8239879 - DNA, 22 bp, Homo sapiens
ccctggagcatctctgctgtct

SEQ ID NO: 8239880 - DNA, 20 bp, Homo sapiens
ccctggagagaagctccacg

SEQ ID NO: 8239881 - DNA, 20 bp, Homo sapiens
ccctggagagaagctccacg

SEQ ID NO: 8239882 - DNA, 22 bp, Homo sapiens
ccctggagaggactcacccctg

SEQ ID NO: 8239883 - DNA, 22 bp, Homo sapiens
ccctggagatcgggagaggaag

SEQ ID NO: 8239884 - DNA, 22 bp, Homo sapiens
ccctggagaggactcacccctg

SEQ ID NO: 8239885 - DNA, 19 bp, Homo sapiens
ccctggagaataccctgga

SEQ ID NO: 8239886 - DNA, 20 bp, Homo sapiens
ccctggagagaagctccacg

SEQ ID NO: 8239887 - DNA, 19 bp, Homo sapiens
ccctggagaataccctgga

SEQ ID NO: 8239888 - DNA, 20 bp, Homo sapiens
ccctggagagaagctccacg

SEQ ID NO: 8239889 - DNA, 22 bp, Homo sapiens
ccctggcctacaggcccagaga

SEQ ID NO: 8239890 - DNA, 22 bp, Homo sapiens
ccctggcctacaggcccagaga

SEQ ID NO: 8239891 - DNA, 22 bp, Homo sapiens
ccctggcctacaggcccagaga

SEQ ID NO: 8239892 - DNA, 22 bp, Homo sapiens
ccctggcctacaggcccagaga

SEQ ID NO: 8239893 - DNA, 22 bp, Homo sapiens
ccctggcctccaggcagtcctg

SEQ ID NO: 8239894 - DNA, 22 bp, Homo sapiens
ccctggcctccaggcagtcctg

SEQ ID NO: 8239895 - DNA, 22 bp, Homo sapiens
ccctggcctccaggcagtcctg

SEQ ID NO: 8239896 - DNA, 22 bp, Homo sapiens
ccctggcctccaggcagtcctg

SEQ ID NO: 8239897 - DNA, 20 bp, Homo sapiens
ccctggcctgtttcatgccc

SEQ ID NO: 8239898 - DNA, 20 bp, Homo sapiens
ccctggcctgtttcatgccc

SEQ ID NO: 8239899 - DNA, 22 bp, Homo sapiens
ccctggcctccaggcagtcctg

SEQ ID NO: 8239900 - DNA, 22 bp, Homo sapiens
ccctggcaaaatccctggtaca

SEQ ID NO: 8239901 - DNA, 22 bp, Homo sapiens
ccctggcaaaatccctggtaca

SEQ ID NO: 8239902 - DNA, 18 bp, Homo sapiens
tggagctgagggcaatgc

SEQ ID NO: 8239903 - DNA, 22 bp, Homo sapiens
ccctggcaaaacactctcttga

SEQ ID NO: 8239904 - DNA, 18 bp, Homo sapiens
tggagctgagggcaatgc

SEQ ID NO: 8239905 - DNA, 18 bp, Homo sapiens
tggagctgagggcaatgc

SEQ ID NO: 8239906 - DNA, 22 bp, Homo sapiens
tggagctgagcacctccagggc

SEQ ID NO: 8239907 - DNA, 22 bp, Homo sapiens
ccctggctctgcctcagagccc

SEQ ID NO: 8239908 - DNA, 22 bp, Homo sapiens
ccctggctctgcctcagagccc

SEQ ID NO: 8239909 - DNA, 22 bp, Homo sapiens
ccctggctctgcctcagagccc

SEQ ID NO: 8239910 - DNA, 22 bp, Homo sapiens
ccctggctctgcctcagagccc

SEQ ID NO: 8239911 - DNA, 22 bp, Homo sapiens
ccctggctgccagtcaccagac

SEQ ID NO: 8239912 - DNA, 22 bp, Homo sapiens
ccctggctgccagtcaccagac

SEQ ID NO: 8239913 - DNA, 22 bp, Homo sapiens
ccctggctgccagtcaccagac

SEQ ID NO: 8239914 - DNA, 22 bp, Homo sapiens
ccctggctgataccggaaaggc

SEQ ID NO: 8239915 - DNA, 23 bp, Homo sapiens
ccctggccttggggcacaggctg

SEQ ID NO: 8239916 - DNA, 23 bp, Homo sapiens
ccctggccttggggcacaggctg

SEQ ID NO: 8239917 - DNA, 23 bp, Homo sapiens
ccctggccttggggcacaggctg

SEQ ID NO: 8239918 - DNA, 22 bp, Homo sapiens
ccctggctcaggcagctttgtt

SEQ ID NO: 8239919 - DNA, 23 bp, Homo sapiens
ccctggccttggggcacaggctg

SEQ ID NO: 8239920 - DNA, 17 bp, Homo sapiens
ccctggctctaggtgga

SEQ ID NO: 8239921 - DNA, 22 bp, Homo sapiens
ccctggctcaggcagctttgtt

SEQ ID NO: 8239922 - DNA, 22 bp, Homo sapiens
tggcaagaaactgaggcctgct

SEQ ID NO: 8239923 - DNA, 22 bp, Homo sapiens
tggcaagaaccgcaattacttt

SEQ ID NO: 8239924 - DNA, 22 bp, Homo sapiens
tggcaagaaactgaggcctgct

SEQ ID NO: 8239925 - DNA, 22 bp, Homo sapiens
tggcaagaaactgaggcctgct

SEQ ID NO: 8239926 - DNA, 22 bp, Homo sapiens
tggcaagaactgcaattgcttt

SEQ ID NO: 8239927 - DNA, 22 bp, Homo sapiens
tggcaagaatattggaccagaa

SEQ ID NO: 8239928 - DNA, 22 bp, Homo sapiens
tggcaagaatattggaccagaa

SEQ ID NO: 8239929 - DNA, 22 bp, Homo sapiens
tggatgagttcaatgaggcaga

SEQ ID NO: 8239930 - DNA, 22 bp, Homo sapiens
tggatgagttcaatgaggcaga

SEQ ID NO: 8239931 - DNA, 17 bp, Homo sapiens
tggcaagacagctcagg

SEQ ID NO: 8239932 - DNA, 17 bp, Homo sapiens
tggcaagaatggaaatg

SEQ ID NO: 8239933 - DNA, 17 bp, Homo sapiens
tggcaagaatggaaatg

SEQ ID NO: 8239934 - DNA, 22 bp, Homo sapiens
tggcaagagggatgcaaggttt

SEQ ID NO: 8239935 - DNA, 22 bp, Homo sapiens
tggcaagagggatgcaaggttt

SEQ ID NO: 8239936 - DNA, 22 bp, Homo sapiens
tggcaagagggatgcaaggttt

SEQ ID NO: 8239937 - DNA, 22 bp, Homo sapiens
tggcaaggaaattagttctcct

SEQ ID NO: 8239938 - DNA, 22 bp, Homo sapiens
tggcaagctcgtttgggtcaga

SEQ ID NO: 8239939 - DNA, 22 bp, Homo sapiens
tggcaaggaaattagttctcct

SEQ ID NO: 8239940 - DNA, 22 bp, Homo sapiens
tggcaagctgggttgggtagcc

SEQ ID NO: 8239941 - DNA, 22 bp, Homo sapiens
tggcaagcagagtctggtgggg

SEQ ID NO: 8239942 - DNA, 22 bp, Homo sapiens
tggcaagcctgagatccgggag

SEQ ID NO: 8239943 - DNA, 22 bp, Homo sapiens
tggatgagattaaagtgaggtt

SEQ ID NO: 8239944 - DNA, 22 bp, Homo sapiens
tggatgagggctgagcactggg

SEQ ID NO: 8239945 - DNA, 22 bp, Homo sapiens
tggatgagggctgagcactggg

SEQ ID NO: 8239946 - DNA, 22 bp, Homo sapiens
tggatgagggctgagcactggg

SEQ ID NO: 8239947 - DNA, 22 bp, Homo sapiens
tggatgagggctgagcactggg

SEQ ID NO: 8239948 - DNA, 22 bp, Homo sapiens
tggatgaggctgggttaggcag

SEQ ID NO: 8239949 - DNA, 22 bp, Homo sapiens
tggatgagattaaagtgaggtt

SEQ ID NO: 8239950 - DNA, 22 bp, Homo sapiens
tggatgagaaactctggtgact

SEQ ID NO: 8239951 - DNA, 22 bp, Homo sapiens
tggatgaaatattgcatttatg

SEQ ID NO: 8239952 - DNA, 22 bp, Homo sapiens
tggatcatcttaagaagtgatt

SEQ ID NO: 8239953 - DNA, 22 bp, Homo sapiens
tggatcatgtgatgtcaggagt

SEQ ID NO: 8239954 - DNA, 22 bp, Homo sapiens
cctcggtttccacatctgtaca

SEQ ID NO: 8239955 - DNA, 22 bp, Homo sapiens
cctcgtccacaatccttgcaca

SEQ ID NO: 8239956 - DNA, 22 bp, Homo sapiens
cctcggctgggccttggccact

SEQ ID NO: 8239957 - DNA, 22 bp, Homo sapiens
cctcgggctgaggctcccaggc

SEQ ID NO: 8239958 - DNA, 22 bp, Homo sapiens
cctcggagcgggtcagagaggg

SEQ ID NO: 8239959 - DNA, 18 bp, Homo sapiens
cctcggagcctccgtgtc

SEQ ID NO: 8239960 - DNA, 22 bp, Homo sapiens
cctcggagaaaggcagctccac

SEQ ID NO: 8239961 - DNA, 22 bp, Homo sapiens
cctcggagcacgccggccgccc

SEQ ID NO: 8239962 - DNA, 22 bp, Homo sapiens
cctcctggtccagcatctcttt

SEQ ID NO: 8239963 - DNA, 22 bp, Homo sapiens
cctcctccttatggtggcccag

SEQ ID NO: 8239964 - DNA, 22 bp, Homo sapiens
cctcctccttatggtggcccag

SEQ ID NO: 8239965 - DNA, 22 bp, Homo sapiens
cctcctctgggaagattcagag

SEQ ID NO: 8239966 - DNA, 23 bp, Homo sapiens
cctcctcatatctttgactagtg

SEQ ID NO: 8239967 - DNA, 23 bp, Homo sapiens
cctcctcatatctttgactagtg

SEQ ID NO: 8239968 - DNA, 23 bp, Homo sapiens
cctcctcatatctttgactagtg

SEQ ID NO: 8239969 - DNA, 23 bp, Homo sapiens
cctcctcatatctttgactagtg

SEQ ID NO: 8239970 - DNA, 22 bp, Homo sapiens
cctccctggccagagcagcagc

SEQ ID NO: 8239971 - DNA, 22 bp, Homo sapiens
cctccctggccagagcagcagc

SEQ ID NO: 8239972 - DNA, 23 bp, Homo sapiens
tggctgaggtccaggtagtttca

SEQ ID NO: 8239973 - DNA, 22 bp, Homo sapiens
cctccctgggtgctgggattgc

SEQ ID NO: 8239974 - DNA, 22 bp, Homo sapiens
cctccctggtggctctggtcta

SEQ ID NO: 8239975 - DNA, 22 bp, Homo sapiens
cctccctggtggctctggtcta

SEQ ID NO: 8239976 - DNA, 22 bp, Homo sapiens
cctccctgggtgctgggattgc

SEQ ID NO: 8239977 - DNA, 22 bp, Homo sapiens
cctccctgggtgctgggattgc

SEQ ID NO: 8239978 - DNA, 22 bp, Homo sapiens
cctcccttttggtgtctgcata

SEQ ID NO: 8239979 - DNA, 22 bp, Homo sapiens
cctcccttttggtgtctgcata

SEQ ID NO: 8239980 - DNA, 22 bp, Homo sapiens
cctccctgtctacctgttgtgg

SEQ ID NO: 8239981 - DNA, 22 bp, Homo sapiens
cctccctgtctacctgttgtgg

SEQ ID NO: 8239982 - DNA, 22 bp, Homo sapiens
cctccctgtctacctgttgtgg

SEQ ID NO: 8239983 - DNA, 22 bp, Homo sapiens
tggctgagggggctctgctcag

SEQ ID NO: 8239984 - DNA, 22 bp, Homo sapiens
tggctgagggggcagttcagga

SEQ ID NO: 8239985 - DNA, 22 bp, Homo sapiens
tggctgagggggcagttcagga

SEQ ID NO: 8239986 - DNA, 22 bp, Homo sapiens
tggctgaggtaactatgaataa

SEQ ID NO: 8239987 - DNA, 22 bp, Homo sapiens
tggctgagggggctctgctcag

SEQ ID NO: 8239988 - DNA, 22 bp, Homo sapiens
tggctgagggggctctgctcag

SEQ ID NO: 8239989 - DNA, 22 bp, Homo sapiens
tggctgaggtctggggcttctg

SEQ ID NO: 8239990 - DNA, 23 bp, Homo sapiens
tggctgaggtccaggtagtttca

SEQ ID NO: 8239991 - DNA, 23 bp, Homo sapiens
tggctgaggtccaggtagtttca

SEQ ID NO: 8239992 - DNA, 22 bp, Homo sapiens
tggctgaggtaactatgaataa

SEQ ID NO: 8239993 - DNA, 23 bp, Homo sapiens
tggctgaggtccaggtagtttca

SEQ ID NO: 8239994 - DNA, 23 bp, Homo sapiens
tggctgaggtccaggtagtttca

SEQ ID NO: 8239995 - DNA, 22 bp, Homo sapiens
tggctgaggtaactatgaataa

SEQ ID NO: 8239996 - DNA, 22 bp, Homo sapiens
tggctgagggggctctgctcag

SEQ ID NO: 8239997 - DNA, 22 bp, Homo sapiens
tggctgaggtaactatgaataa

SEQ ID NO: 8239998 - DNA, 22 bp, Homo sapiens
tggctgagagcaattgactctg

SEQ ID NO: 8239999 - DNA, 22 bp, Homo sapiens
tggctgagagcaattgactctg

SEQ ID NO: 8240000 - DNA, 22 bp, Homo sapiens
tggctgagggggcagttcagga

SEQ ID NO: 8240001 - DNA, 22 bp, Homo sapiens
tggctgagggggcagttcagga

SEQ ID NO: 8240002 - DNA, 22 bp, Homo sapiens
tggctgagagcaattgactctg

SEQ ID NO: 8240003 - DNA, 22 bp, Homo sapiens
tggctgagggggcagttcagga

SEQ ID NO: 8240004 - DNA, 22 bp, Homo sapiens
cctccagcgcgatccactccgg

SEQ ID NO: 8240005 - DNA, 22 bp, Homo sapiens
cctccagcgcgatccactccgg

SEQ ID NO: 8240006 - DNA, 22 bp, Homo sapiens
cctccactctggcctctcaggt

SEQ ID NO: 8240007 - DNA, 22 bp, Homo sapiens
cctccactgcttcccagctttg

SEQ ID NO: 8240008 - DNA, 22 bp, Homo sapiens
cctccactctggcctctcaggt

SEQ ID NO: 8240009 - DNA, 22 bp, Homo sapiens
cctccaagtttgactcaggaca

SEQ ID NO: 8240010 - DNA, 22 bp, Homo sapiens
cctccacaggagctgcagtgct

SEQ ID NO: 8240011 - DNA, 22 bp, Homo sapiens
cctccacaggagctgcagtgct

SEQ ID NO: 8240012 - DNA, 22 bp, Homo sapiens
cctccaagtttgactcaggaca

SEQ ID NO: 8240013 - DNA, 22 bp, Homo sapiens
cctccaagtttgactcaggaca

SEQ ID NO: 8240014 - DNA, 22 bp, Homo sapiens
cctccaagtgagagatggtaca

SEQ ID NO: 8240015 - DNA, 20 bp, Homo sapiens
cctccactgtcactgacctg

SEQ ID NO: 8240016 - DNA, 22 bp, Homo sapiens
cctccagactttggccatcctc

SEQ ID NO: 8240017 - DNA, 22 bp, Homo sapiens
cctccagcattactggcccatg

SEQ ID NO: 8240018 - DNA, 22 bp, Homo sapiens
cctccagcattactggcccatg

SEQ ID NO: 8240019 - DNA, 22 bp, Homo sapiens
cctccagcattactggcccatg

SEQ ID NO: 8240020 - DNA, 22 bp, Homo sapiens
cctccagcattactggcccatg

SEQ ID NO: 8240021 - DNA, 22 bp, Homo sapiens
tggctcagtttgggggattgaa

SEQ ID NO: 8240022 - DNA, 22 bp, Homo sapiens
tggctcagtttctgcccagctg

SEQ ID NO: 8240023 - DNA, 22 bp, Homo sapiens
tggctcagtttgggggattgaa

SEQ ID NO: 8240024 - DNA, 22 bp, Homo sapiens
tggctcagtttgggggattgaa

SEQ ID NO: 8240025 - DNA, 22 bp, Homo sapiens
tggctcagtttctgcccagctg

SEQ ID NO: 8240026 - DNA, 22 bp, Homo sapiens
tggctcagtttcagtcctggtt

SEQ ID NO: 8240027 - DNA, 22 bp, Homo sapiens
tggctcagtttcagtcctggtt

SEQ ID NO: 8240028 - DNA, 22 bp, Homo sapiens
tggctcagtttcagtcctggtt

SEQ ID NO: 8240029 - DNA, 22 bp, Homo sapiens
tggctcagtttcagtcctggtt

SEQ ID NO: 8240030 - DNA, 22 bp, Homo sapiens
tggctcagtttcagtcctggtt

SEQ ID NO: 8240031 - DNA, 22 bp, Homo sapiens
tggctcagtttagcagctcagt

SEQ ID NO: 8240032 - DNA, 22 bp, Homo sapiens
tggctcagtttagcagctcagt

SEQ ID NO: 8240033 - DNA, 22 bp, Homo sapiens
tggctcagtttagcagctcagt

SEQ ID NO: 8240034 - DNA, 22 bp, Homo sapiens
tggccctgcttatgtctctctt

SEQ ID NO: 8240035 - DNA, 22 bp, Homo sapiens
tggccctgcttatgtctctctt

SEQ ID NO: 8240036 - DNA, 22 bp, Homo sapiens
tggctcagctgactcggcttct

SEQ ID NO: 8240037 - DNA, 22 bp, Homo sapiens
tggctcagctgtcacagcctgg

SEQ ID NO: 8240038 - DNA, 22 bp, Homo sapiens
tggccctgctgtatcatctgct

SEQ ID NO: 8240039 - DNA, 22 bp, Homo sapiens
tggccctgcttatgtctctctt

SEQ ID NO: 8240040 - DNA, 22 bp, Homo sapiens
tggccctgctgtatcatctgct

SEQ ID NO: 8240041 - DNA, 22 bp, Homo sapiens
tggccctgctgtatcatctgct

SEQ ID NO: 8240042 - DNA, 22 bp, Homo sapiens
tggccctgctgtatcatctgct

SEQ ID NO: 8240043 - DNA, 22 bp, Homo sapiens
tggccctgctgggtcagagctg

SEQ ID NO: 8240044 - DNA, 22 bp, Homo sapiens
tggccctgctgggtcagagctg

SEQ ID NO: 8240045 - DNA, 22 bp, Homo sapiens
tggcccagccctgctctagggc

SEQ ID NO: 8240046 - DNA, 22 bp, Homo sapiens
tggcccagtgcttatgctctga

SEQ ID NO: 8240047 - DNA, 22 bp, Homo sapiens
tggcccagtgcttatgctctga

SEQ ID NO: 8240048 - DNA, 20 bp, Homo sapiens
tggcccagtggggcagggtg

SEQ ID NO: 8240049 - DNA, 20 bp, Homo sapiens
tggcccagtggggcagggtg

SEQ ID NO: 8240050 - DNA, 20 bp, Homo sapiens
tggcccagtggggcagggtg

SEQ ID NO: 8240051 - DNA, 22 bp, Homo sapiens
tggccccacagggccttttcag

SEQ ID NO: 8240052 - DNA, 22 bp, Homo sapiens
tggccctgctatgatcctgcaa

SEQ ID NO: 8240053 - DNA, 22 bp, Homo sapiens
tggccctgctggacacgcctgc

SEQ ID NO: 8240054 - DNA, 22 bp, Homo sapiens
tggccctgctggacacgcctgc

SEQ ID NO: 8240055 - DNA, 22 bp, Homo sapiens
tggccctgctggccaaaggcta

SEQ ID NO: 8240056 - DNA, 22 bp, Homo sapiens
tggcccctgaggagcgtcagcc

SEQ ID NO: 8240057 - DNA, 22 bp, Homo sapiens
tggcccctgaggagcgtcagcc

SEQ ID NO: 8240058 - DNA, 22 bp, Homo sapiens
tggcccctgaggagcatcagcc

SEQ ID NO: 8240059 - DNA, 18 bp, Homo sapiens
tggccccttatcagtcct

SEQ ID NO: 8240060 - DNA, 22 bp, Homo sapiens
tggcccctggcacacggaggat

SEQ ID NO: 8240061 - DNA, 22 bp, Homo sapiens
tggcccctggcacacggaggat

SEQ ID NO: 8240062 - DNA, 22 bp, Homo sapiens
tggcccgaagatccgagggtca

SEQ ID NO: 8240063 - DNA, 22 bp, Homo sapiens
tggcccgacctctgctcatgca

SEQ ID NO: 8240064 - DNA, 22 bp, Homo sapiens
cctctgggctgcctgcacgggt

SEQ ID NO: 8240065 - DNA, 22 bp, Homo sapiens
cctctgggctggaaaattaatg

SEQ ID NO: 8240066 - DNA, 22 bp, Homo sapiens
cctctgggctgcctgcacgggt

SEQ ID NO: 8240067 - DNA, 22 bp, Homo sapiens
cctctgggctgcctgcacgggt

SEQ ID NO: 8240068 - DNA, 22 bp, Homo sapiens
cctctgggggcttccttaccct

SEQ ID NO: 8240069 - DNA, 22 bp, Homo sapiens
cctctggggcatcagacaaagg

SEQ ID NO: 8240070 - DNA, 22 bp, Homo sapiens
cctctgggggcttccttaccct

SEQ ID NO: 8240071 - DNA, 22 bp, Homo sapiens
cctctggggcatcagacaaagg

SEQ ID NO: 8240072 - DNA, 22 bp, Homo sapiens
cctctgggctggaaaattaatg

SEQ ID NO: 8240073 - DNA, 22 bp, Homo sapiens
cctctggctgtaccactggcac

SEQ ID NO: 8240074 - DNA, 22 bp, Homo sapiens
cctctgaggtcatggacttggc

SEQ ID NO: 8240075 - DNA, 22 bp, Homo sapiens
cctctgagctggcctgtggggc

SEQ ID NO: 8240076 - DNA, 22 bp, Homo sapiens
cctctgagccagcgtcttctct

SEQ ID NO: 8240077 - DNA, 22 bp, Homo sapiens
cctctgagagaaggccttcagc

SEQ ID NO: 8240078 - DNA, 22 bp, Homo sapiens
cctctgagaacacctggcgtcc

SEQ ID NO: 8240079 - DNA, 22 bp, Homo sapiens
cctctgagaccagctctgcacc

SEQ ID NO: 8240080 - DNA, 22 bp, Homo sapiens
cctctgagaccagctctgcacc

SEQ ID NO: 8240081 - DNA, 23 bp, Homo sapiens
cctctctttttaggtggtgtttg

SEQ ID NO: 8240082 - DNA, 23 bp, Homo sapiens
cctctctttttaggtggtgtttg

SEQ ID NO: 8240083 - DNA, 22 bp, Homo sapiens
cctctctttcctacaccttgga

SEQ ID NO: 8240084 - DNA, 22 bp, Homo sapiens
cctctcttggccgcagtcttct

SEQ ID NO: 8240085 - DNA, 22 bp, Homo sapiens
cctctcttggccgcagtcttct

SEQ ID NO: 8240086 - DNA, 22 bp, Homo sapiens
cctctggttgcccaggactagg

SEQ ID NO: 8240087 - DNA, 18 bp, Homo sapiens
cctctgggttttgttccc

SEQ ID NO: 8240088 - DNA, 18 bp, Homo sapiens
cctctgggttttgttccc

SEQ ID NO: 8240089 - DNA, 22 bp, Homo sapiens
cctctgggttagtttagggagc

SEQ ID NO: 8240090 - DNA, 22 bp, Homo sapiens
cctctgggttagtttagggagc

SEQ ID NO: 8240091 - DNA, 22 bp, Homo sapiens
cctctgggtgggaggccgggcg

SEQ ID NO: 8240092 - DNA, 22 bp, Homo sapiens
cctctgggttagtttagggagc

SEQ ID NO: 8240093 - DNA, 22 bp, Homo sapiens
cctctgtgacaaacagtcctgg

SEQ ID NO: 8240094 - DNA, 22 bp, Homo sapiens
cctctgtgatttctgagccaat

SEQ ID NO: 8240095 - DNA, 22 bp, Homo sapiens
cctctgtgcaggaaatacatgt

SEQ ID NO: 8240096 - DNA, 22 bp, Homo sapiens
cctctgtgatttctgagccaat

SEQ ID NO: 8240097 - DNA, 22 bp, Homo sapiens
cctctgggggcttccttaccct

SEQ ID NO: 8240098 - DNA, 22 bp, Homo sapiens
cctctgggggtcctcagagtct

SEQ ID NO: 8240099 - DNA, 22 bp, Homo sapiens
cctctgggggtcctcagagtct

SEQ ID NO: 8240100 - DNA, 22 bp, Homo sapiens
cctctgggggtcctcagagtct

SEQ ID NO: 8240101 - DNA, 22 bp, Homo sapiens
cctctggggtctagcaatagca

SEQ ID NO: 8240102 - DNA, 22 bp, Homo sapiens
cctctggggtgagtgggccact

SEQ ID NO: 8240103 - DNA, 22 bp, Homo sapiens
cctctggggtgagtgggccact

SEQ ID NO: 8240104 - DNA, 22 bp, Homo sapiens
cctctggggtgagtgggccact

SEQ ID NO: 8240105 - DNA, 22 bp, Homo sapiens
cctctggggtctagcaatagca

SEQ ID NO: 8240106 - DNA, 22 bp, Homo sapiens
cctctggggtctagcaatagca

SEQ ID NO: 8240107 - DNA, 22 bp, Homo sapiens
cctctggggtgagtgggccact

SEQ ID NO: 8240108 - DNA, 22 bp, Homo sapiens
cctctgggtatctgtggaagta

SEQ ID NO: 8240109 - DNA, 22 bp, Homo sapiens
cctctgggtatctgtggaagta

SEQ ID NO: 8240110 - DNA, 22 bp, Homo sapiens
cctctgggtatctgtggaagta

SEQ ID NO: 8240111 - DNA, 22 bp, Homo sapiens
cctctgggtgacagactcttgg

SEQ ID NO: 8240112 - DNA, 22 bp, Homo sapiens
cctctgggtgggaggccgggcg

SEQ ID NO: 8240113 - DNA, 22 bp, Homo sapiens
cctctgggtgggaggccgggcg

SEQ ID NO: 8240114 - DNA, 22 bp, Homo sapiens
cctctgggtgacagactcttgg

SEQ ID NO: 8240115 - DNA, 22 bp, Homo sapiens
cctctgggtgacagactcttgg

SEQ ID NO: 8240116 - DNA, 22 bp, Homo sapiens
cctctgggtgacagactcttgg

SEQ ID NO: 8240117 - DNA, 22 bp, Homo sapiens
tggctgcctgatcgagcaggtg

SEQ ID NO: 8240118 - DNA, 22 bp, Homo sapiens
tggctgcctcagtgtccctgca

SEQ ID NO: 8240119 - DNA, 22 bp, Homo sapiens
tggctgcctagtgtctgagcag

SEQ ID NO: 8240120 - DNA, 22 bp, Homo sapiens
tggctgcctagtgtctgagcag

SEQ ID NO: 8240121 - DNA, 22 bp, Homo sapiens
tggctgcctagtgtctgagcag

SEQ ID NO: 8240122 - DNA, 21 bp, Homo sapiens
tggctgcctggctctgtggtt

SEQ ID NO: 8240123 - DNA, 21 bp, Homo sapiens
tggctgcctggctctgtggtt

SEQ ID NO: 8240124 - DNA, 21 bp, Homo sapiens
tggctgcctggctctgtggtt

SEQ ID NO: 8240125 - DNA, 22 bp, Homo sapiens
tggctgcctgatcgagcaggtg

SEQ ID NO: 8240126 - DNA, 22 bp, Homo sapiens
tggctgcctagtccctcagcct

SEQ ID NO: 8240127 - DNA, 22 bp, Homo sapiens
tggctgcctagtccctcagcct

SEQ ID NO: 8240128 - DNA, 22 bp, Homo sapiens
tggctgcctagtccctcagcct

SEQ ID NO: 8240129 - DNA, 22 bp, Homo sapiens
tggctgcctagtccctcagcct

SEQ ID NO: 8240130 - DNA, 21 bp, Homo sapiens
tggctgcctacatgctgcagg

SEQ ID NO: 8240131 - DNA, 21 bp, Homo sapiens
tggctgcctacatgctgcagg

SEQ ID NO: 8240132 - DNA, 21 bp, Homo sapiens
tggctgcctacatgctgcagg

SEQ ID NO: 8240133 - DNA, 21 bp, Homo sapiens
tggctgcctacatgctgcagg

SEQ ID NO: 8240134 - DNA, 22 bp, Homo sapiens
tggctgccgactggctcttggc

SEQ ID NO: 8240135 - DNA, 22 bp, Homo sapiens
tggctgccctcatgggcctgat

SEQ ID NO: 8240136 - DNA, 22 bp, Homo sapiens
tggctgccctcatgggcctgat

SEQ ID NO: 8240137 - DNA, 22 bp, Homo sapiens
tggctgccctcatgggcctgat

SEQ ID NO: 8240138 - DNA, 22 bp, Homo sapiens
tggctgccgactggctcttggc

SEQ ID NO: 8240139 - DNA, 22 bp, Homo sapiens
cctctcagccggactgtcaggc

SEQ ID NO: 8240140 - DNA, 22 bp, Homo sapiens
cctctatagatgtgtgcatcta

SEQ ID NO: 8240141 - DNA, 22 bp, Homo sapiens
cctctacttaccactcagccag

SEQ ID NO: 8240142 - DNA, 22 bp, Homo sapiens
cctctaaattgtttgaagttgg

SEQ ID NO: 8240143 - DNA, 22 bp, Homo sapiens
cctctaaattgtttgaagttgg

SEQ ID NO: 8240144 - DNA, 22 bp, Homo sapiens
cctctcatagtctgtatccttt

SEQ ID NO: 8240145 - DNA, 22 bp, Homo sapiens
cctctccagcggcctcagggcc

SEQ ID NO: 8240146 - DNA, 22 bp, Homo sapiens
cctctcagtattgaactttata

SEQ ID NO: 8240147 - DNA, 22 bp, Homo sapiens
cctctcagcgattcctcttgga

SEQ ID NO: 8240148 - DNA, 19 bp, Homo sapiens
cctctccgcccaccagccc

SEQ ID NO: 8240149 - DNA, 22 bp, Homo sapiens
tggctgcctttcacctcatctc

SEQ ID NO: 8240150 - DNA, 22 bp, Homo sapiens
tggctgcctttcacctcatctc

SEQ ID NO: 8240151 - DNA, 22 bp, Homo sapiens
tggctgccttccctgctggagg

SEQ ID NO: 8240152 - DNA, 20 bp, Homo sapiens
cctctctgcatgctccctga

SEQ ID NO: 8240153 - DNA, 20 bp, Homo sapiens
cctctctgcatgctccctga

SEQ ID NO: 8240154 - DNA, 20 bp, Homo sapiens
cctctctgcatgctccctga

SEQ ID NO: 8240155 - DNA, 20 bp, Homo sapiens
cctctctgcatgctccctga

SEQ ID NO: 8240156 - DNA, 20 bp, Homo sapiens
cctctctgaagaggtcatct

SEQ ID NO: 8240157 - DNA, 20 bp, Homo sapiens
cctctctgaagaggtcatct

SEQ ID NO: 8240158 - DNA, 22 bp, Homo sapiens
cctctctcttgtagtccctgcc

SEQ ID NO: 8240159 - DNA, 20 bp, Homo sapiens
cctctctgaagaggtcatct

SEQ ID NO: 8240160 - DNA, 22 bp, Homo sapiens
cctctctgtgtggcctctccat

SEQ ID NO: 8240161 - DNA, 22 bp, Homo sapiens
cctctctgtgtggcctctccat

SEQ ID NO: 8240162 - DNA, 22 bp, Homo sapiens
cctctctgtgtggcctctccat

SEQ ID NO: 8240163 - DNA, 16 bp, Homo sapiens
cctctcttattcctcc

SEQ ID NO: 8240164 - DNA, 22 bp, Homo sapiens
cctctctgtgtggcctctccat

SEQ ID NO: 8240165 - DNA, 22 bp, Homo sapiens
cctctctgtaagggtccctccc

SEQ ID NO: 8240166 - DNA, 22 bp, Homo sapiens
cctctctgtagcagcccccagt

SEQ ID NO: 8240167 - DNA, 22 bp, Homo sapiens
cctctctgtaagggtccctccc

SEQ ID NO: 8240168 - DNA, 22 bp, Homo sapiens
cctctctgtaagggtccctccc

SEQ ID NO: 8240169 - DNA, 22 bp, Homo sapiens
cctctctgtaagggtccctccc

SEQ ID NO: 8240170 - DNA, 22 bp, Homo sapiens
cctctctgtaagggtccctccc

SEQ ID NO: 8240171 - DNA, 20 bp, Homo sapiens
cctctctgccctgcaaggcc

SEQ ID NO: 8240172 - DNA, 22 bp, Homo sapiens
tgccacagagactttcattgta

SEQ ID NO: 8240173 - DNA, 22 bp, Homo sapiens
tgccacagagactttcattgta

SEQ ID NO: 8240174 - DNA, 22 bp, Homo sapiens
tgccacagacaggacagaacag

SEQ ID NO: 8240175 - DNA, 22 bp, Homo sapiens
tgccacaccaacatctttcagc

SEQ ID NO: 8240176 - DNA, 22 bp, Homo sapiens
tgccaagtgcttacttggccct

SEQ ID NO: 8240177 - DNA, 22 bp, Homo sapiens
tgccaagggtatgggcaagata

SEQ ID NO: 8240178 - DNA, 22 bp, Homo sapiens
tgccaagataacacagctagta

SEQ ID NO: 8240179 - DNA, 22 bp, Homo sapiens
tgccaagatgtaggcaggcata

SEQ ID NO: 8240180 - DNA, 22 bp, Homo sapiens
tgccaagataacacagctagta

SEQ ID NO: 8240181 - DNA, 22 bp, Homo sapiens
tgccaagcacagaggggccact

SEQ ID NO: 8240182 - DNA, 22 bp, Homo sapiens
tgccaggcctcaggagtctcca

SEQ ID NO: 8240183 - DNA, 22 bp, Homo sapiens
tgccaggcctcaggagtctcca

SEQ ID NO: 8240184 - DNA, 22 bp, Homo sapiens
tgccaggcctcaggagtctcca

SEQ ID NO: 8240185 - DNA, 22 bp, Homo sapiens
cccaggaggtgtgcccaactcg

SEQ ID NO: 8240186 - DNA, 22 bp, Homo sapiens
cccaggaggttgaggctgcagt

SEQ ID NO: 8240187 - DNA, 22 bp, Homo sapiens
cccaggaggttgaggctgcagt

SEQ ID NO: 8240188 - DNA, 22 bp, Homo sapiens
cccaggaggttgaggctgcagt

SEQ ID NO: 8240189 - DNA, 22 bp, Homo sapiens
cccaggaggttgaggctgcagt

SEQ ID NO: 8240190 - DNA, 22 bp, Homo sapiens
cccaggaggtgtgcccaactcg

SEQ ID NO: 8240191 - DNA, 22 bp, Homo sapiens
cccaggaggtggagttcacagt

SEQ ID NO: 8240192 - DNA, 22 bp, Homo sapiens
cccaggaggtggaggctgcagt

SEQ ID NO: 8240193 - DNA, 22 bp, Homo sapiens
cccaggaggtggaggctgcagt

SEQ ID NO: 8240194 - DNA, 22 bp, Homo sapiens
cccaggaggtggaggctgcagt

SEQ ID NO: 8240195 - DNA, 22 bp, Homo sapiens
cccaggagggtggcctctgccc

SEQ ID NO: 8240196 - DNA, 22 bp, Homo sapiens
cccaggagggtggcctctgccc

SEQ ID NO: 8240197 - DNA, 22 bp, Homo sapiens
cccaggagggtggcctctgccc

SEQ ID NO: 8240198 - DNA, 22 bp, Homo sapiens
tgccacagagcaattctgctga

SEQ ID NO: 8240199 - DNA, 22 bp, Homo sapiens
tgccacagagcaattctgctga

SEQ ID NO: 8240200 - DNA, 22 bp, Homo sapiens
tgccacagagcaattctgctga

SEQ ID NO: 8240201 - DNA, 22 bp, Homo sapiens
cccaggaggtggaggttgcagt

SEQ ID NO: 8240202 - DNA, 22 bp, Homo sapiens
cccaggaggtggaggttgcagc

SEQ ID NO: 8240203 - DNA, 22 bp, Homo sapiens
tgccaggcgtggtggtgcgcac

SEQ ID NO: 8240204 - DNA, 22 bp, Homo sapiens
tgccaggcgtggtggtgcgcac

SEQ ID NO: 8240205 - DNA, 22 bp, Homo sapiens
tgccaggcgattgctatcagca

SEQ ID NO: 8240206 - DNA, 22 bp, Homo sapiens
tgccaggcgattgctatcagca

SEQ ID NO: 8240207 - DNA, 22 bp, Homo sapiens
tgccaggcgattgctatcagca

SEQ ID NO: 8240208 - DNA, 21 bp, Homo sapiens
tgccaggcctgagctggggtc

SEQ ID NO: 8240209 - DNA, 21 bp, Homo sapiens
tgccaggcctgagctggggtc

SEQ ID NO: 8240210 - DNA, 21 bp, Homo sapiens
tgccaggcctgagctggggtc

SEQ ID NO: 8240211 - DNA, 22 bp, Homo sapiens
tgccaggctaagtggaggactt

SEQ ID NO: 8240212 - DNA, 22 bp, Homo sapiens
tgccaggcgtggtggtgcgcac

SEQ ID NO: 8240213 - DNA, 22 bp, Homo sapiens
cccaggcagagagctggtgagc

SEQ ID NO: 8240214 - DNA, 22 bp, Homo sapiens
cccaggcagagagctggtgagc

SEQ ID NO: 8240215 - DNA, 22 bp, Homo sapiens
cccaggcagagagctggtgagc

SEQ ID NO: 8240216 - DNA, 22 bp, Homo sapiens
cccaggcagaattagtgtttca

SEQ ID NO: 8240217 - DNA, 22 bp, Homo sapiens
cccaggcagaattagtgtttca

SEQ ID NO: 8240218 - DNA, 22 bp, Homo sapiens
cccaggcagaattagtgtttca

SEQ ID NO: 8240219 - DNA, 22 bp, Homo sapiens
cccaggcactcttggtcatttt

SEQ ID NO: 8240220 - DNA, 22 bp, Homo sapiens
cccaggcactcttggtcatttt

SEQ ID NO: 8240221 - DNA, 22 bp, Homo sapiens
cccaggcacatccactctgtga

SEQ ID NO: 8240222 - DNA, 22 bp, Homo sapiens
cccaggcacactgaagtgacat

SEQ ID NO: 8240223 - DNA, 22 bp, Homo sapiens
cccaggcacactgaagtgacat

SEQ ID NO: 8240224 - DNA, 22 bp, Homo sapiens
cccaggcacactgaagtgacat

SEQ ID NO: 8240225 - DNA, 22 bp, Homo sapiens
cccaggcacaccccgaacggaa

SEQ ID NO: 8240226 - DNA, 22 bp, Homo sapiens
cccaggatgtcgaggctgcagt

SEQ ID NO: 8240227 - DNA, 22 bp, Homo sapiens
cccaggcacatccactctgtga

SEQ ID NO: 8240228 - DNA, 22 bp, Homo sapiens
cccaggcacatccactctgtga

SEQ ID NO: 8240229 - DNA, 22 bp, Homo sapiens
cccaggcacactgaagtgacat

SEQ ID NO: 8240230 - DNA, 22 bp, Homo sapiens
cccaggcacagattatcccaat

SEQ ID NO: 8240231 - DNA, 22 bp, Homo sapiens
cccaggcacagattatcccaat

SEQ ID NO: 8240232 - DNA, 22 bp, Homo sapiens
cccaggcagcggggtctccttg

SEQ ID NO: 8240233 - DNA, 22 bp, Homo sapiens
cccaggcagcggggtctccttg

SEQ ID NO: 8240234 - DNA, 22 bp, Homo sapiens
cccaggcagcggggtctccttg

SEQ ID NO: 8240235 - DNA, 22 bp, Homo sapiens
cccaggcagcggggtctccttg

SEQ ID NO: 8240236 - DNA, 22 bp, Homo sapiens
cccaggcagcctgcagggaagg

SEQ ID NO: 8240237 - DNA, 22 bp, Homo sapiens
cccaggcagcctgcagggaagg

SEQ ID NO: 8240238 - DNA, 22 bp, Homo sapiens
cccaggcagcctgcagggaagg

SEQ ID NO: 8240239 - DNA, 20 bp, Homo sapiens
cccaggcagagctagcggca

SEQ ID NO: 8240240 - DNA, 20 bp, Homo sapiens
cccaggcagagctagcggca

SEQ ID NO: 8240241 - DNA, 20 bp, Homo sapiens
cccaggcagagctagcggca

SEQ ID NO: 8240242 - DNA, 22 bp, Homo sapiens
cccaggcagcccttctgacgca

SEQ ID NO: 8240243 - DNA, 22 bp, Homo sapiens
cccaggcagcccttctgacgca

SEQ ID NO: 8240244 - DNA, 22 bp, Homo sapiens
cccaggcagccccagaagcttg

SEQ ID NO: 8240245 - DNA, 22 bp, Homo sapiens
cccaggcagccccagaagcttg

SEQ ID NO: 8240246 - DNA, 22 bp, Homo sapiens
cccaggcagccccagaagcttg

SEQ ID NO: 8240247 - DNA, 22 bp, Homo sapiens
cccaggcagtagaaagaagagg

SEQ ID NO: 8240248 - DNA, 22 bp, Homo sapiens
cccaggcagtagaaagaagagg

SEQ ID NO: 8240249 - DNA, 22 bp, Homo sapiens
cccaggcagggacgtgctctgg

SEQ ID NO: 8240250 - DNA, 22 bp, Homo sapiens
cccaggcagggacgtgctctgg

SEQ ID NO: 8240251 - DNA, 22 bp, Homo sapiens
cccaggcagggacgtgctctgg

SEQ ID NO: 8240252 - DNA, 22 bp, Homo sapiens
cccaggcagggacgtgctctgg

SEQ ID NO: 8240253 - DNA, 22 bp, Homo sapiens
cccaggcaggagtgtggtggct

SEQ ID NO: 8240254 - DNA, 22 bp, Homo sapiens
cccaggcaggagtgtggtggct

SEQ ID NO: 8240255 - DNA, 22 bp, Homo sapiens
cccaggcaggagtgtggtggct

SEQ ID NO: 8240256 - DNA, 22 bp, Homo sapiens
cccaggcagtgtgtgcatgcgt

SEQ ID NO: 8240257 - DNA, 22 bp, Homo sapiens
cccaggcagtgctgatccctca

SEQ ID NO: 8240258 - DNA, 22 bp, Homo sapiens
cccaggcagtgctgatccctca

SEQ ID NO: 8240259 - DNA, 22 bp, Homo sapiens
cccaggcagtgctgatccctca

SEQ ID NO: 8240260 - DNA, 22 bp, Homo sapiens
cccaggcagtctggctctaaag

SEQ ID NO: 8240261 - DNA, 22 bp, Homo sapiens
tctgtggcagttctggttcatc

SEQ ID NO: 8240262 - DNA, 22 bp, Homo sapiens
tctgtggcatagtgcttgggaa

SEQ ID NO: 8240263 - DNA, 22 bp, Homo sapiens
tctgtggcatagtgcttgggaa

SEQ ID NO: 8240264 - DNA, 22 bp, Homo sapiens
tctgtggcatgaggaaataggc

SEQ ID NO: 8240265 - DNA, 22 bp, Homo sapiens
tctgtggcatgttgcacttgta

SEQ ID NO: 8240266 - DNA, 22 bp, Homo sapiens
tctgtggcatggtatctggagg

SEQ ID NO: 8240267 - DNA, 22 bp, Homo sapiens
tctgtggcatggtatctggagg

SEQ ID NO: 8240268 - DNA, 22 bp, Homo sapiens
tctgtggcccaagtgatggctg

SEQ ID NO: 8240269 - DNA, 23 bp, Homo sapiens
tctgtggccccttcgccccactc

SEQ ID NO: 8240270 - DNA, 22 bp, Homo sapiens
tctgtggcccaagtgatggctg

SEQ ID NO: 8240271 - DNA, 22 bp, Homo sapiens
tctgtggcctgcctcctcattt

SEQ ID NO: 8240272 - DNA, 22 bp, Homo sapiens
tctgtggcctgcctcctcattt

SEQ ID NO: 8240273 - DNA, 22 bp, Homo sapiens
tctgtggcctccttccacttac

SEQ ID NO: 8240274 - DNA, 22 bp, Homo sapiens
tctgtggcctgtgtccaagtgc

SEQ ID NO: 8240275 - DNA, 22 bp, Homo sapiens
tctgtggcctgtgtccaagtgc

SEQ ID NO: 8240276 - DNA, 19 bp, Homo sapiens
tctgtggccttccctgatg

SEQ ID NO: 8240277 - DNA, 21 bp, Homo sapiens
tctgtggcggactctaggccc

SEQ ID NO: 8240278 - DNA, 22 bp, Homo sapiens
tctgtggcgcatagttgtctct

SEQ ID NO: 8240279 - DNA, 21 bp, Homo sapiens
tctgtggcggactctaggccc

SEQ ID NO: 8240280 - DNA, 22 bp, Homo sapiens
cccagcctactctgccatagca

SEQ ID NO: 8240281 - DNA, 22 bp, Homo sapiens
cccagcctgtgacagccgtcct

SEQ ID NO: 8240282 - DNA, 22 bp, Homo sapiens
cccagcctgtgacagccgtcct

SEQ ID NO: 8240283 - DNA, 22 bp, Homo sapiens
cccagcctgtgacagccgtcct

SEQ ID NO: 8240284 - DNA, 22 bp, Homo sapiens
cccagcctgtgacagccgtcct

SEQ ID NO: 8240285 - DNA, 22 bp, Homo sapiens
cccagcctgtctttcccaatga

SEQ ID NO: 8240286 - DNA, 22 bp, Homo sapiens
cccagcctgtgacagccgtcct

SEQ ID NO: 8240287 - DNA, 22 bp, Homo sapiens
cccagcctgtctttcccaatga

SEQ ID NO: 8240288 - DNA, 22 bp, Homo sapiens
cccagcctgtctttcccaatga

SEQ ID NO: 8240289 - DNA, 22 bp, Homo sapiens
cccagccttccaccctggacta

SEQ ID NO: 8240290 - DNA, 22 bp, Homo sapiens
cccagcctttgcttcctggttc

SEQ ID NO: 8240291 - DNA, 22 bp, Homo sapiens
cccagcctttgcttcctggttc

SEQ ID NO: 8240292 - DNA, 22 bp, Homo sapiens
cccagcctttgcttcctggttc

SEQ ID NO: 8240293 - DNA, 22 bp, Homo sapiens
tgcagggatcctagctgaagag

SEQ ID NO: 8240294 - DNA, 22 bp, Homo sapiens
tgcagggagggcccagcaatct

SEQ ID NO: 8240295 - DNA, 22 bp, Homo sapiens
cccagctcttcaagtcaccccc

SEQ ID NO: 8240296 - DNA, 22 bp, Homo sapiens
cccagctccgagctccgagccg

SEQ ID NO: 8240297 - DNA, 22 bp, Homo sapiens
cccagctccgagctccgagccg

SEQ ID NO: 8240298 - DNA, 22 bp, Homo sapiens
cccagctccttacagggccgaa

SEQ ID NO: 8240299 - DNA, 22 bp, Homo sapiens
cccagctccttacagggccgaa

SEQ ID NO: 8240300 - DNA, 22 bp, Homo sapiens
tgcagggagctctggggtgcag

SEQ ID NO: 8240301 - DNA, 22 bp, Homo sapiens
tgcagggaccccgaggctctct

SEQ ID NO: 8240302 - DNA, 22 bp, Homo sapiens
tgcagggaccccgaggctctct

SEQ ID NO: 8240303 - DNA, 22 bp, Homo sapiens
tgcagggacacgaagacaaata

SEQ ID NO: 8240304 - DNA, 22 bp, Homo sapiens
tgcagggacacgaagacaaata

SEQ ID NO: 8240305 - DNA, 22 bp, Homo sapiens
tgcagggaatgcttgcagcatg

SEQ ID NO: 8240306 - DNA, 22 bp, Homo sapiens
tgcagggaatgcttgcagcatg

SEQ ID NO: 8240307 - DNA, 22 bp, Homo sapiens
tgcagggaatgcttgcagcatg

SEQ ID NO: 8240308 - DNA, 22 bp, Homo sapiens
tgcagggaatgcttgcagcatg

SEQ ID NO: 8240309 - DNA, 22 bp, Homo sapiens
tgcagggaatctgtggctggac

SEQ ID NO: 8240310 - DNA, 23 bp, Homo sapiens
cccagcgctgagccctgcaggca

SEQ ID NO: 8240311 - DNA, 22 bp, Homo sapiens
cccagcgagtttgccggtgaac

SEQ ID NO: 8240312 - DNA, 23 bp, Homo sapiens
cccagcgctgagccctgcaggca

SEQ ID NO: 8240313 - DNA, 22 bp, Homo sapiens
cccagcgagtttgccggtgaac

SEQ ID NO: 8240314 - DNA, 22 bp, Homo sapiens
cccagctcaagcagagagctaa

SEQ ID NO: 8240315 - DNA, 22 bp, Homo sapiens
cccagctcaagcagagagctaa

SEQ ID NO: 8240316 - DNA, 22 bp, Homo sapiens
cccagctacctctgctaggaga

SEQ ID NO: 8240317 - DNA, 23 bp, Homo sapiens
cccagctggaagttagaggacca

SEQ ID NO: 8240318 - DNA, 23 bp, Homo sapiens
cccagctgcagacaagggagggt

SEQ ID NO: 8240319 - DNA, 22 bp, Homo sapiens
cccagctgcacctctatggcct

SEQ ID NO: 8240320 - DNA, 17 bp, Homo sapiens
cccagctggcagtgccg

SEQ ID NO: 8240321 - DNA, 17 bp, Homo sapiens
cccagctggcagtgccg

SEQ ID NO: 8240322 - DNA, 17 bp, Homo sapiens
cccagctggcagtgccg

SEQ ID NO: 8240323 - DNA, 18 bp, Homo sapiens
cccagctggtgggtcagt

SEQ ID NO: 8240324 - DNA, 22 bp, Homo sapiens
cccagctgtggcagaggccggg

SEQ ID NO: 8240325 - DNA, 22 bp, Homo sapiens
cccagctcttcctgggagctaa

SEQ ID NO: 8240326 - DNA, 22 bp, Homo sapiens
cccagctcttttagcggcatct

SEQ ID NO: 8240327 - DNA, 22 bp, Homo sapiens
cccagctcttcctgggagctaa

SEQ ID NO: 8240328 - DNA, 22 bp, Homo sapiens
cccagctcttcaagtcaccccc

SEQ ID NO: 8240329 - DNA, 22 bp, Homo sapiens
cccagctcttcaagtcaccccc

SEQ ID NO: 8240330 - DNA, 22 bp, Homo sapiens
cccagctgatttttgcagagat

SEQ ID NO: 8240331 - DNA, 22 bp, Homo sapiens
cccagctgatttttgcagagat

SEQ ID NO: 8240332 - DNA, 22 bp, Homo sapiens
tgcatcagaggatagctgcagt

SEQ ID NO: 8240333 - DNA, 22 bp, Homo sapiens
tgcatcagaggatagctgcagt

SEQ ID NO: 8240334 - DNA, 22 bp, Homo sapiens
tgcatgtttctgtatgttaatg

SEQ ID NO: 8240335 - DNA, 22 bp, Homo sapiens
tgcatcacaggcaagcaaggct

SEQ ID NO: 8240336 - DNA, 22 bp, Homo sapiens
tgcatcacccttgaaccatcca

SEQ ID NO: 8240337 - DNA, 22 bp, Homo sapiens
tgcattaagtgtctgcatatgg

SEQ ID NO: 8240338 - DNA, 22 bp, Homo sapiens
tgcattaaggccattgaaattt

SEQ ID NO: 8240339 - DNA, 23 bp, Homo sapiens
cccagctttcccactgccgagag

SEQ ID NO: 8240340 - DNA, 22 bp, Homo sapiens
cccagcttgcgggcggcaggag

SEQ ID NO: 8240341 - DNA, 22 bp, Homo sapiens
cccagcttgcccaggactgagg

SEQ ID NO: 8240342 - DNA, 22 bp, Homo sapiens
cccagcttgcaaatgggttgct

SEQ ID NO: 8240343 - DNA, 22 bp, Homo sapiens
cccagcttctgagggggccttg

SEQ ID NO: 8240344 - DNA, 22 bp, Homo sapiens
cccagcttctgagggggccttg

SEQ ID NO: 8240345 - DNA, 18 bp, Homo sapiens
cccagcttagcgcccctc

SEQ ID NO: 8240346 - DNA, 19 bp, Homo sapiens
cccagcttgaccacctgct

SEQ ID NO: 8240347 - DNA, 19 bp, Homo sapiens
cccagcttgaccacctgct

SEQ ID NO: 8240348 - DNA, 23 bp, Homo sapiens
cccagctttcccactgccgagag

SEQ ID NO: 8240349 - DNA, 23 bp, Homo sapiens
cccagctttcccactgccgagag

SEQ ID NO: 8240350 - DNA, 22 bp, Homo sapiens
cccaggaaaagcagtgccagca

SEQ ID NO: 8240351 - DNA, 22 bp, Homo sapiens
cccaggaaacccgaaggcgacc

SEQ ID NO: 8240352 - DNA, 22 bp, Homo sapiens
cccaggaaagtggaggcggctg

SEQ ID NO: 8240353 - DNA, 22 bp, Homo sapiens
cccctctggtcaaccagtcaca

SEQ ID NO: 8240354 - DNA, 23 bp, Homo sapiens
cccctctggtggctcagctcctg

SEQ ID NO: 8240355 - DNA, 20 bp, Homo sapiens
ccctaggaacgcagcaggag

SEQ ID NO: 8240356 - DNA, 22 bp, Homo sapiens
cccctcctggccacactgtcag

SEQ ID NO: 8240357 - DNA, 22 bp, Homo sapiens
cccctctccctcacttatcaat

SEQ ID NO: 8240358 - DNA, 22 bp, Homo sapiens
cccctctccctcacttatcaat

SEQ ID NO: 8240359 - DNA, 22 bp, Homo sapiens
cccctcctgcagcacctttctt

SEQ ID NO: 8240360 - DNA, 22 bp, Homo sapiens
cccctcctgcagcacctttctt

SEQ ID NO: 8240361 - DNA, 22 bp, Homo sapiens
cccctcctggccacactgtcag

SEQ ID NO: 8240362 - DNA, 22 bp, Homo sapiens
cccctcctggccacactgtcag

SEQ ID NO: 8240363 - DNA, 22 bp, Homo sapiens
cccctcattctctgagctagtt

SEQ ID NO: 8240364 - DNA, 22 bp, Homo sapiens
cccctccctgacctggttgggc

SEQ ID NO: 8240365 - DNA, 22 bp, Homo sapiens
cccctccctgacctggttgggc

SEQ ID NO: 8240366 - DNA, 19 bp, Homo sapiens
ccctcaggtctgagcagtc

SEQ ID NO: 8240367 - DNA, 22 bp, Homo sapiens
ccctcaggagatgtcagctgga

SEQ ID NO: 8240368 - DNA, 22 bp, Homo sapiens
ccctcagcttctccctgcagct

SEQ ID NO: 8240369 - DNA, 22 bp, Homo sapiens
ccctcagcttctccctgcagct

SEQ ID NO: 8240370 - DNA, 22 bp, Homo sapiens
ccctaggcccaaagggtgacat

SEQ ID NO: 8240371 - DNA, 22 bp, Homo sapiens
ccctcagcttctccctgcagct

SEQ ID NO: 8240372 - DNA, 22 bp, Homo sapiens
ccctcagcttctccctgcagct

SEQ ID NO: 8240373 - DNA, 22 bp, Homo sapiens
cccccacctgaggacagtctta

SEQ ID NO: 8240374 - DNA, 22 bp, Homo sapiens
cccccagatgcgagccatagcc

SEQ ID NO: 8240375 - DNA, 22 bp, Homo sapiens
cccccagccagcagtgctcagc

SEQ ID NO: 8240376 - DNA, 22 bp, Homo sapiens
cccccagctctgctgggtcccg

SEQ ID NO: 8240377 - DNA, 22 bp, Homo sapiens
cccccagctctgctgggtcccg

SEQ ID NO: 8240378 - DNA, 22 bp, Homo sapiens
cccccaccgtgttcctgctcgg

SEQ ID NO: 8240379 - DNA, 22 bp, Homo sapiens
cccccaccgtgttcctgctcgg

SEQ ID NO: 8240380 - DNA, 22 bp, Homo sapiens
cccccaaggccaggctgagacc

SEQ ID NO: 8240381 - DNA, 22 bp, Homo sapiens
cccctcaggtacccgtgcagca

SEQ ID NO: 8240382 - DNA, 21 bp, Homo sapiens
cccctcatacactctccttgc

SEQ ID NO: 8240383 - DNA, 22 bp, Homo sapiens
cccctcattcatgtccttgctt

SEQ ID NO: 8240384 - DNA, 22 bp, Homo sapiens
ccccctggcaggctggcctctc

SEQ ID NO: 8240385 - DNA, 22 bp, Homo sapiens
ccccgccctgcgcggggataac

SEQ ID NO: 8240386 - DNA, 16 bp, Homo sapiens
cccctcaggaagtaca

SEQ ID NO: 8240387 - DNA, 17 bp, Homo sapiens
cccctacctccgtttga

SEQ ID NO: 8240388 - DNA, 22 bp, Homo sapiens
cccccagtctgaacagcagctg

SEQ ID NO: 8240389 - DNA, 22 bp, Homo sapiens
cccccaggctctgacacaggag

SEQ ID NO: 8240390 - DNA, 22 bp, Homo sapiens
cccccaggctctgacacaggag

SEQ ID NO: 8240391 - DNA, 22 bp, Homo sapiens
cccccaggctctgacacaggag

SEQ ID NO: 8240392 - DNA, 22 bp, Homo sapiens
tgctgcagatcagctgagtcct

SEQ ID NO: 8240393 - DNA, 22 bp, Homo sapiens
tgctgcagatcagctgagtcct

SEQ ID NO: 8240394 - DNA, 22 bp, Homo sapiens
tgctgcagcggcatggtctttg

SEQ ID NO: 8240395 - DNA, 22 bp, Homo sapiens
tgctgcagctaaggtgaggtgc

SEQ ID NO: 8240396 - DNA, 22 bp, Homo sapiens
tgctgcagcagtgcgggcagct

SEQ ID NO: 8240397 - DNA, 22 bp, Homo sapiens
ccccacctgtgcgtctgccgca

SEQ ID NO: 8240398 - DNA, 22 bp, Homo sapiens
ccccaccttgcaattgttccct

SEQ ID NO: 8240399 - DNA, 22 bp, Homo sapiens
tgctgcaggaattctcaaggga

SEQ ID NO: 8240400 - DNA, 22 bp, Homo sapiens
tgctgcaggaattctcaaggga

SEQ ID NO: 8240401 - DNA, 22 bp, Homo sapiens
tgctgcagctttgtcacatgca

SEQ ID NO: 8240402 - DNA, 22 bp, Homo sapiens
tgctgcaggaacttaagaagct

SEQ ID NO: 8240403 - DNA, 22 bp, Homo sapiens
ccccagccagcaggacctctga

SEQ ID NO: 8240404 - DNA, 22 bp, Homo sapiens
ccccagccagcaggacctctga

SEQ ID NO: 8240405 - DNA, 22 bp, Homo sapiens
ccccagccagcaggacctctga

SEQ ID NO: 8240406 - DNA, 22 bp, Homo sapiens
ccccagcagcacctggggcagt

SEQ ID NO: 8240407 - DNA, 22 bp, Homo sapiens
ccccagcagactcagggcaggt

SEQ ID NO: 8240408 - DNA, 22 bp, Homo sapiens
ccccagccagcaggacctctga

SEQ ID NO: 8240409 - DNA, 22 bp, Homo sapiens
ccccagcatatcatggtttcgt

SEQ ID NO: 8240410 - DNA, 18 bp, Homo sapiens
ccccagcagtgtggtgcc

SEQ ID NO: 8240411 - DNA, 22 bp, Homo sapiens
ccccagcaggaatacaggggtc

SEQ ID NO: 8240412 - DNA, 22 bp, Homo sapiens
ccccagctcagtgcagggacat

SEQ ID NO: 8240413 - DNA, 22 bp, Homo sapiens
tgctggagacatagcaggcagc

SEQ ID NO: 8240414 - DNA, 22 bp, Homo sapiens
tgctggagacatagcaggcagc

SEQ ID NO: 8240415 - DNA, 22 bp, Homo sapiens
tgctggagacctgcttgcacca

SEQ ID NO: 8240416 - DNA, 22 bp, Homo sapiens
tgctggagacatagcaggcagc

SEQ ID NO: 8240417 - DNA, 22 bp, Homo sapiens
tgctggagactcactcaggtgc

SEQ ID NO: 8240418 - DNA, 22 bp, Homo sapiens
tgctggagactcactcaggtgc

SEQ ID NO: 8240419 - DNA, 22 bp, Homo sapiens
tgctggagacctgcttgcacca

SEQ ID NO: 8240420 - DNA, 22 bp, Homo sapiens
tgctggagacctgcttgcacca

SEQ ID NO: 8240421 - DNA, 22 bp, Homo sapiens
ccccagccttccatgggaattg

SEQ ID NO: 8240422 - DNA, 22 bp, Homo sapiens
ccccagccttccatgggaattg

SEQ ID NO: 8240423 - DNA, 22 bp, Homo sapiens
ccccagcccacaagcatattaa

SEQ ID NO: 8240424 - DNA, 23 bp, Homo sapiens
tgctggagacaagtgtgagaagg

SEQ ID NO: 8240425 - DNA, 22 bp, Homo sapiens
tgctggagacatagcaggcagc

SEQ ID NO: 8240426 - DNA, 23 bp, Homo sapiens
tgctggagacaagtgtgagaagg

SEQ ID NO: 8240427 - DNA, 22 bp, Homo sapiens
tgctggagcaacattattgtgc

SEQ ID NO: 8240428 - DNA, 22 bp, Homo sapiens
tgctggagcatctgagagcatc

SEQ ID NO: 8240429 - DNA, 22 bp, Homo sapiens
tgctggagcatctgagagcatc

SEQ ID NO: 8240430 - DNA, 22 bp, Homo sapiens
tgctggagcatctgagagcatc

SEQ ID NO: 8240431 - DNA, 22 bp, Homo sapiens
tgctggagcccaggcggccttt

SEQ ID NO: 8240432 - DNA, 22 bp, Homo sapiens
tgctggagcatctgagagcatc

SEQ ID NO: 8240433 - DNA, 22 bp, Homo sapiens
ccccaggcctgttggatggcgc

SEQ ID NO: 8240434 - DNA, 22 bp, Homo sapiens
ccccaggcctgttggatggcgc

SEQ ID NO: 8240435 - DNA, 22 bp, Homo sapiens
tgctggagatcattaatgttca

SEQ ID NO: 8240436 - DNA, 22 bp, Homo sapiens
tgctggagaggaaggtggggtc

SEQ ID NO: 8240437 - DNA, 22 bp, Homo sapiens
tgctggagatgaaagggccctg

SEQ ID NO: 8240438 - DNA, 22 bp, Homo sapiens
tgctggagatgaaagggccctg

SEQ ID NO: 8240439 - DNA, 22 bp, Homo sapiens
tgctggagatgaaagggccctg

SEQ ID NO: 8240440 - DNA, 22 bp, Homo sapiens
tgctggagaggaaggtggggtc

SEQ ID NO: 8240441 - DNA, 22 bp, Homo sapiens
tgctggagagctagttctgcag

SEQ ID NO: 8240442 - DNA, 22 bp, Homo sapiens
tgctggagagctagttctgcag

SEQ ID NO: 8240443 - DNA, 22 bp, Homo sapiens
tgctggagagccttggccaagg

SEQ ID NO: 8240444 - DNA, 20 bp, Homo sapiens
tgctgcagacagggccattg

SEQ ID NO: 8240445 - DNA, 22 bp, Homo sapiens
tgctgcagaaattctgtgagga

SEQ ID NO: 8240446 - DNA, 22 bp, Homo sapiens
tgctgcagaaattctgtgagga

SEQ ID NO: 8240447 - DNA, 22 bp, Homo sapiens
tgctgcacagcccgctggccca

SEQ ID NO: 8240448 - DNA, 22 bp, Homo sapiens
tgctgcaagtatttattctggg

SEQ ID NO: 8240449 - DNA, 22 bp, Homo sapiens
tgctgcacaattggaaagtatc

SEQ ID NO: 8240450 - DNA, 22 bp, Homo sapiens
tgctgaccttgttctgtgagga

SEQ ID NO: 8240451 - DNA, 22 bp, Homo sapiens
tgctgacctaaattgaggaaga

SEQ ID NO: 8240452 - DNA, 22 bp, Homo sapiens
tgctgaagttcttcccctaatg

SEQ ID NO: 8240453 - DNA, 19 bp, Homo sapiens
tgctgaagttgtcagtctg

SEQ ID NO: 8240454 - DNA, 22 bp, Homo sapiens
tgctgaataataagattactca

SEQ ID NO: 8240455 - DNA, 22 bp, Homo sapiens
tgctgaatgggatatgttgagc

SEQ ID NO: 8240456 - DNA, 21 bp, Homo sapiens
tgctgacatcaggtctgctat

SEQ ID NO: 8240457 - DNA, 21 bp, Homo sapiens
tgctgacatcaggtctgctat

SEQ ID NO: 8240458 - DNA, 22 bp, Homo sapiens
cccagggaggtagcaggagaaa

SEQ ID NO: 8240459 - DNA, 22 bp, Homo sapiens
cccagggaggtagcaggagaaa

SEQ ID NO: 8240460 - DNA, 22 bp, Homo sapiens
cccagggatgtggcagatgtta

SEQ ID NO: 8240461 - DNA, 22 bp, Homo sapiens
cccagggatgtggcagatgtta

SEQ ID NO: 8240462 - DNA, 22 bp, Homo sapiens
tgctgaagtccatctgtttgac

SEQ ID NO: 8240463 - DNA, 22 bp, Homo sapiens
tgctgaagtccatctgtttgac

SEQ ID NO: 8240464 - DNA, 22 bp, Homo sapiens
tgctgaagtccaagagctccaa

SEQ ID NO: 8240465 - DNA, 22 bp, Homo sapiens
tgctgaagttactagagactat

SEQ ID NO: 8240466 - DNA, 23 bp, Homo sapiens
tgctgaagtgttggccctgccca

SEQ ID NO: 8240467 - DNA, 23 bp, Homo sapiens
tgctgaagtgttggccctgccca

SEQ ID NO: 8240468 - DNA, 22 bp, Homo sapiens
cccagggattataaaggtgaaa

SEQ ID NO: 8240469 - DNA, 22 bp, Homo sapiens
tgctctggagtggcttgtgcac

SEQ ID NO: 8240470 - DNA, 22 bp, Homo sapiens
tgctcccagctgtaggaatgtt

SEQ ID NO: 8240471 - DNA, 22 bp, Homo sapiens
tgctcccagctgtaggaatgtt

SEQ ID NO: 8240472 - DNA, 22 bp, Homo sapiens
tgctcccacactactcggaggc

SEQ ID NO: 8240473 - DNA, 22 bp, Homo sapiens
tgctcccacactactcggaggc

SEQ ID NO: 8240474 - DNA, 22 bp, Homo sapiens
tgctcccacactactcggaggc

SEQ ID NO: 8240475 - DNA, 22 bp, Homo sapiens
tgctcccaaacgacctactgtg

SEQ ID NO: 8240476 - DNA, 22 bp, Homo sapiens
cccagggagagcgcggaggcgg

SEQ ID NO: 8240477 - DNA, 22 bp, Homo sapiens
cccagggactcgggattctagg

SEQ ID NO: 8240478 - DNA, 22 bp, Homo sapiens
cccagggagagcgcggaggcgg

SEQ ID NO: 8240479 - DNA, 22 bp, Homo sapiens
cccagggaggcccaggctctgc

SEQ ID NO: 8240480 - DNA, 22 bp, Homo sapiens
cccagggaggcccaggctctgc

SEQ ID NO: 8240481 - DNA, 22 bp, Homo sapiens
cccagggaggcccaggctctgc

SEQ ID NO: 8240482 - DNA, 23 bp, Homo sapiens
tgctccaggtacagaactccagg

SEQ ID NO: 8240483 - DNA, 22 bp, Homo sapiens
tgctccaggtgtgcctctcatg

SEQ ID NO: 8240484 - DNA, 22 bp, Homo sapiens
tgctccaggtgtgcctctcatg

SEQ ID NO: 8240485 - DNA, 22 bp, Homo sapiens
tgctccagggctgccagaccct

SEQ ID NO: 8240486 - DNA, 22 bp, Homo sapiens
tgctccaggtgtgcctctcatg

SEQ ID NO: 8240487 - DNA, 22 bp, Homo sapiens
tgctccagtgagctggccatcc

SEQ ID NO: 8240488 - DNA, 22 bp, Homo sapiens
tgctccagtgagctggccatcc

SEQ ID NO: 8240489 - DNA, 22 bp, Homo sapiens
tgctccagtgagctggccatcc

SEQ ID NO: 8240490 - DNA, 22 bp, Homo sapiens
tgctccagtgagctggccatcc

SEQ ID NO: 8240491 - DNA, 22 bp, Homo sapiens
tgctcccaaacgacctactgtg

SEQ ID NO: 8240492 - DNA, 22 bp, Homo sapiens
tgctcccaaacctgacaggctc

SEQ ID NO: 8240493 - DNA, 22 bp, Homo sapiens
tgctcccaaacctgacaggctc

SEQ ID NO: 8240494 - DNA, 19 bp, Homo sapiens
tgctccattgaggtgtctc

SEQ ID NO: 8240495 - DNA, 22 bp, Homo sapiens
tgctccatgcgctcggccggcg

SEQ ID NO: 8240496 - DNA, 22 bp, Homo sapiens
tgctccatgcgctcggccggcg

SEQ ID NO: 8240497 - DNA, 22 bp, Homo sapiens
tgctccatctctcgtggttcca

SEQ ID NO: 8240498 - DNA, 22 bp, Homo sapiens
tgctccatctctcgtggttcca

SEQ ID NO: 8240499 - DNA, 22 bp, Homo sapiens
tgctccagtgcctgccccacag

SEQ ID NO: 8240500 - DNA, 22 bp, Homo sapiens
tgctccagtgcctgccccacag

SEQ ID NO: 8240501 - DNA, 22 bp, Homo sapiens
tgctccagtgcctgccccacag

SEQ ID NO: 8240502 - DNA, 22 bp, Homo sapiens
cccaggctcctgactcattcta

SEQ ID NO: 8240503 - DNA, 22 bp, Homo sapiens
cccaggctcctgactcattcta

SEQ ID NO: 8240504 - DNA, 22 bp, Homo sapiens
cccaggctcctgactcattcta

SEQ ID NO: 8240505 - DNA, 22 bp, Homo sapiens
cccaggctcctgactcattcta

SEQ ID NO: 8240506 - DNA, 22 bp, Homo sapiens
cccaggctcctgctgtgttgac

SEQ ID NO: 8240507 - DNA, 22 bp, Homo sapiens
cccaggctcctgctgtgttgac

SEQ ID NO: 8240508 - DNA, 22 bp, Homo sapiens
cccaggctcctgctgtgttgac

SEQ ID NO: 8240509 - DNA, 22 bp, Homo sapiens
cccaggctcctgactcattcta

SEQ ID NO: 8240510 - DNA, 21 bp, Homo sapiens
cccaggctgaattaaaaatat

SEQ ID NO: 8240511 - DNA, 21 bp, Homo sapiens
cccaggctgaattaaaaatat

SEQ ID NO: 8240512 - DNA, 21 bp, Homo sapiens
cccaggctgaattaaaaatat

SEQ ID NO: 8240513 - DNA, 22 bp, Homo sapiens
cccaggctcttatgtgacttgc

SEQ ID NO: 8240514 - DNA, 22 bp, Homo sapiens
cccaggctcttatgtgacttgc

SEQ ID NO: 8240515 - DNA, 21 bp, Homo sapiens
tgctcagtaaatgctgagtga

SEQ ID NO: 8240516 - DNA, 22 bp, Homo sapiens
tgctcagtagcagtgtgctgct

SEQ ID NO: 8240517 - DNA, 22 bp, Homo sapiens
tgctccagggctgccagaccct

SEQ ID NO: 8240518 - DNA, 22 bp, Homo sapiens
tgcctgggagtgaccaagactc

SEQ ID NO: 8240519 - DNA, 22 bp, Homo sapiens
tgcctgggagtgaccaagactc

SEQ ID NO: 8240520 - DNA, 22 bp, Homo sapiens
tgcctgggagtgaccaagactc

SEQ ID NO: 8240521 - DNA, 22 bp, Homo sapiens
tgcctgggactctgttatcttg

SEQ ID NO: 8240522 - DNA, 22 bp, Homo sapiens
tgcctgggacatgctgtggact

SEQ ID NO: 8240523 - DNA, 20 bp, Homo sapiens
tgcctgggaaggcgtggagg

SEQ ID NO: 8240524 - DNA, 20 bp, Homo sapiens
tgcctgggaaggcgtggagg

SEQ ID NO: 8240525 - DNA, 20 bp, Homo sapiens
tgcctgggaaggcgtggagg

SEQ ID NO: 8240526 - DNA, 22 bp, Homo sapiens
tgcctgctcttaccactctccc

SEQ ID NO: 8240527 - DNA, 22 bp, Homo sapiens
tgcctgctcttgagacttacaa

SEQ ID NO: 8240528 - DNA, 22 bp, Homo sapiens
tgcctgggatctgtgccctttg

SEQ ID NO: 8240529 - DNA, 22 bp, Homo sapiens
tgcctgggcctctgaggaaggc

SEQ ID NO: 8240530 - DNA, 22 bp, Homo sapiens
tgcctgggatctgtgccctttg

SEQ ID NO: 8240531 - DNA, 22 bp, Homo sapiens
tgcctgggccttcccacctctg

SEQ ID NO: 8240532 - DNA, 22 bp, Homo sapiens
tgcctgggccttcccacctctg

SEQ ID NO: 8240533 - DNA, 22 bp, Homo sapiens
cccaggctcctagaggcccaga

SEQ ID NO: 8240534 - DNA, 22 bp, Homo sapiens
cccaggctcctagaggcccaga

SEQ ID NO: 8240535 - DNA, 22 bp, Homo sapiens
cccaggctcctagaggcccaga

SEQ ID NO: 8240536 - DNA, 22 bp, Homo sapiens
cccaggctcctagaggcccaga

SEQ ID NO: 8240537 - DNA, 22 bp, Homo sapiens
tgcctgggctcaccgcctcttt

SEQ ID NO: 8240538 - DNA, 22 bp, Homo sapiens
tgcctgggccttcccacctctg

SEQ ID NO: 8240539 - DNA, 22 bp, Homo sapiens
tgcctgggccttcccacctctg

SEQ ID NO: 8240540 - DNA, 22 bp, Homo sapiens
tggtaggagatatggtctccga

SEQ ID NO: 8240541 - DNA, 22 bp, Homo sapiens
tggtagggacactatgcagaaa

SEQ ID NO: 8240542 - DNA, 22 bp, Homo sapiens
tggtagggacactatgcagaaa

SEQ ID NO: 8240543 - DNA, 21 bp, Homo sapiens
cctctgtgctaaagggctccc

SEQ ID NO: 8240544 - DNA, 22 bp, Homo sapiens
cctctgtgctttgtccagcctc

SEQ ID NO: 8240545 - DNA, 22 bp, Homo sapiens
cctctgtggccctgactctctt

SEQ ID NO: 8240546 - DNA, 22 bp, Homo sapiens
cctctgtgctttgtccagcctc

SEQ ID NO: 8240547 - DNA, 22 bp, Homo sapiens
cctctgtgctttgtccagcctc

SEQ ID NO: 8240548 - DNA, 22 bp, Homo sapiens
cctctgtgcctcgtgtcctctg

SEQ ID NO: 8240549 - DNA, 21 bp, Homo sapiens
tggtccctttcagagtctgga

SEQ ID NO: 8240550 - DNA, 22 bp, Homo sapiens
tggtccctttctactgagcaca

SEQ ID NO: 8240551 - DNA, 22 bp, Homo sapiens
tggtccctgatctaatgtctca

SEQ ID NO: 8240552 - DNA, 22 bp, Homo sapiens
tggtccctagtgtgggagcttg

SEQ ID NO: 8240553 - DNA, 22 bp, Homo sapiens
tggtccagtttagcattgagtg

SEQ ID NO: 8240554 - DNA, 22 bp, Homo sapiens
tggtcccattgttctgcccagg

SEQ ID NO: 8240555 - DNA, 22 bp, Homo sapiens
tggtccctaaagatgtctacat

SEQ ID NO: 8240556 - DNA, 22 bp, Homo sapiens
tggtccctaaagatgtctacat

SEQ ID NO: 8240557 - DNA, 20 bp, Homo sapiens
tggtcctcacaggtcctccc

SEQ ID NO: 8240558 - DNA, 22 bp, Homo sapiens
cctgccagtgaagctgacgggc

SEQ ID NO: 8240559 - DNA, 22 bp, Homo sapiens
cctgccagtgaagctgacgggc

SEQ ID NO: 8240560 - DNA, 22 bp, Homo sapiens
tggtcctagccagggctctgct

SEQ ID NO: 8240561 - DNA, 22 bp, Homo sapiens
cctgccagtgcctcccactggt

SEQ ID NO: 8240562 - DNA, 22 bp, Homo sapiens
cctgccagtgcctcccactggt

SEQ ID NO: 8240563 - DNA, 22 bp, Homo sapiens
cctgccagtgcctcccactggt

SEQ ID NO: 8240564 - DNA, 22 bp, Homo sapiens
cctgcccacagagagggtgcat

SEQ ID NO: 8240565 - DNA, 22 bp, Homo sapiens
cctgcccacagagagggtgcat

SEQ ID NO: 8240566 - DNA, 22 bp, Homo sapiens
cctgcccacagagagggtgcat

SEQ ID NO: 8240567 - DNA, 22 bp, Homo sapiens
cctgcccacagagagggtgcat

SEQ ID NO: 8240568 - DNA, 22 bp, Homo sapiens
cctgcccactccaggagcaact

SEQ ID NO: 8240569 - DNA, 22 bp, Homo sapiens
cctgcccactccaggagcaact

SEQ ID NO: 8240570 - DNA, 22 bp, Homo sapiens
cctgcccacacagcaattttaa

SEQ ID NO: 8240571 - DNA, 18 bp, Homo sapiens
tggtgcctttcactcttc

SEQ ID NO: 8240572 - DNA, 22 bp, Homo sapiens
tggtgccttgggcctacagcgc

SEQ ID NO: 8240573 - DNA, 22 bp, Homo sapiens
tggtgctgataatggcaggatt

SEQ ID NO: 8240574 - DNA, 22 bp, Homo sapiens
tggtgctgagatgaagtgctcc

SEQ ID NO: 8240575 - DNA, 22 bp, Homo sapiens
tggtgctgacagttctgagtgc

SEQ ID NO: 8240576 - DNA, 22 bp, Homo sapiens
tggtgctgacagttctgagtgc

SEQ ID NO: 8240577 - DNA, 22 bp, Homo sapiens
tggtgctgagatgaagtgctcc

SEQ ID NO: 8240578 - DNA, 22 bp, Homo sapiens
tggtgctgacagttctgagtgc

SEQ ID NO: 8240579 - DNA, 17 bp, Homo sapiens
cctgcccagagacagat

SEQ ID NO: 8240580 - DNA, 22 bp, Homo sapiens
tggtctttaaggtagctgtcat

SEQ ID NO: 8240581 - DNA, 22 bp, Homo sapiens
tggtcttagctggaaggaggga

SEQ ID NO: 8240582 - DNA, 22 bp, Homo sapiens
cctgcccactgcccggtcagcc

SEQ ID NO: 8240583 - DNA, 22 bp, Homo sapiens
cctgcccactgcccggtcagcc

SEQ ID NO: 8240584 - DNA, 17 bp, Homo sapiens
cctgcccagagacagat

SEQ ID NO: 8240585 - DNA, 17 bp, Homo sapiens
cctgcccagagacagat

SEQ ID NO: 8240586 - DNA, 22 bp, Homo sapiens
tggtgctgccaggctcctgcca

SEQ ID NO: 8240587 - DNA, 22 bp, Homo sapiens
tggtgctgccaggctcctgcca

SEQ ID NO: 8240588 - DNA, 22 bp, Homo sapiens
tggtgctgccaggctcctgcca

SEQ ID NO: 8240589 - DNA, 22 bp, Homo sapiens
tggtgctgccacctcctctgct

SEQ ID NO: 8240590 - DNA, 22 bp, Homo sapiens
tggtgctgataatggcaggatt

SEQ ID NO: 8240591 - DNA, 22 bp, Homo sapiens
tggtgctgcaggtgggcacagt

SEQ ID NO: 8240592 - DNA, 22 bp, Homo sapiens
tggtgctgcaggtgggcacagt

SEQ ID NO: 8240593 - DNA, 22 bp, Homo sapiens
tggtgctgccacctcctctgct

SEQ ID NO: 8240594 - DNA, 22 bp, Homo sapiens
tggtggccccctcaagtctttg

SEQ ID NO: 8240595 - DNA, 16 bp, Homo sapiens
tggtggccatagttat

SEQ ID NO: 8240596 - DNA, 22 bp, Homo sapiens
tggtgctgtggaggggcagaag

SEQ ID NO: 8240597 - DNA, 22 bp, Homo sapiens
tggtgctgtggaggggcagaag

SEQ ID NO: 8240598 - DNA, 22 bp, Homo sapiens
tggtgctgtgatacgaggcact

SEQ ID NO: 8240599 - DNA, 22 bp, Homo sapiens
tggtgctgtgatacgaggcact

SEQ ID NO: 8240600 - DNA, 22 bp, Homo sapiens
tggtgctgtctactttgtgcag

SEQ ID NO: 8240601 - DNA, 22 bp, Homo sapiens
tggtgctggtgccacgcccctt

SEQ ID NO: 8240602 - DNA, 22 bp, Homo sapiens
tggtgctgtctactttgtgcag

SEQ ID NO: 8240603 - DNA, 19 bp, Homo sapiens
tggtgctggcctcccatgg

SEQ ID NO: 8240604 - DNA, 22 bp, Homo sapiens
tggtgctgcctcagatgcctta

SEQ ID NO: 8240605 - DNA, 22 bp, Homo sapiens
tggtgctgcctcagatgcctta

SEQ ID NO: 8240606 - DNA, 22 bp, Homo sapiens
tggtgctgcctcagatgcctta

SEQ ID NO: 8240607 - DNA, 22 bp, Homo sapiens
tggtgctgcctcagatgcctta

SEQ ID NO: 8240608 - DNA, 22 bp, Homo sapiens
tggtggcttctgaggatggcga

SEQ ID NO: 8240609 - DNA, 22 bp, Homo sapiens
tggtggcttctgaggatggcga

SEQ ID NO: 8240610 - DNA, 22 bp, Homo sapiens
tggtggcttctgaggatggcga

SEQ ID NO: 8240611 - DNA, 23 bp, Homo sapiens
tggtggcttgtggtggccaccag

SEQ ID NO: 8240612 - DNA, 23 bp, Homo sapiens
tggtggcttgtggtggccaccag

SEQ ID NO: 8240613 - DNA, 22 bp, Homo sapiens
tggtggctgtaagggagagaag

SEQ ID NO: 8240614 - DNA, 22 bp, Homo sapiens
tggtggctgttgcagaactgag

SEQ ID NO: 8240615 - DNA, 22 bp, Homo sapiens
tggtggctgttgcagaactgag

SEQ ID NO: 8240616 - DNA, 22 bp, Homo sapiens
tggtggctgtaagggagagaag

SEQ ID NO: 8240617 - DNA, 22 bp, Homo sapiens
tggtggctgtaagggagagaag

SEQ ID NO: 8240618 - DNA, 17 bp, Homo sapiens
tggtggctggagtcagg

SEQ ID NO: 8240619 - DNA, 17 bp, Homo sapiens
tggtggctggagtcagg

SEQ ID NO: 8240620 - DNA, 22 bp, Homo sapiens
tggtggctgctccctgccttga

SEQ ID NO: 8240621 - DNA, 17 bp, Homo sapiens
tggtggctggagtcagg

SEQ ID NO: 8240622 - DNA, 22 bp, Homo sapiens
tggtggctgctccctgccttga

SEQ ID NO: 8240623 - DNA, 22 bp, Homo sapiens
tggtggctcacacctgtaatcc

SEQ ID NO: 8240624 - DNA, 22 bp, Homo sapiens
tggtggctcacgtctgtaatct

SEQ ID NO: 8240625 - DNA, 22 bp, Homo sapiens
tggtggccttgatggcatctgc

SEQ ID NO: 8240626 - DNA, 22 bp, Homo sapiens
tggtggccgaagccctctctca

SEQ ID NO: 8240627 - DNA, 22 bp, Homo sapiens
tggtggctaccaggtcctgggg

SEQ ID NO: 8240628 - DNA, 22 bp, Homo sapiens
cctggagacctgatggcagcgg

SEQ ID NO: 8240629 - DNA, 22 bp, Homo sapiens
cctggagacctgatggcagcgg

SEQ ID NO: 8240630 - DNA, 22 bp, Homo sapiens
cctggagacctgatggcagcgg

SEQ ID NO: 8240631 - DNA, 22 bp, Homo sapiens
cctggagacctgatggcagcgg

SEQ ID NO: 8240632 - DNA, 22 bp, Homo sapiens
cctggagacccacttctgccaa

SEQ ID NO: 8240633 - DNA, 22 bp, Homo sapiens
cctggagacgaggctggaccat

SEQ ID NO: 8240634 - DNA, 22 bp, Homo sapiens
cctggagacgaggctggaccat

SEQ ID NO: 8240635 - DNA, 22 bp, Homo sapiens
cctggagacgaggctggaccat

SEQ ID NO: 8240636 - DNA, 22 bp, Homo sapiens
cctggagacgaggctggaccat

SEQ ID NO: 8240637 - DNA, 22 bp, Homo sapiens
cctggagagagaggccaactgc

SEQ ID NO: 8240638 - DNA, 22 bp, Homo sapiens
tgtaaacatatcagactttctt

SEQ ID NO: 8240639 - DNA, 22 bp, Homo sapiens
cctggagagctcgggccaggca

SEQ ID NO: 8240640 - DNA, 22 bp, Homo sapiens
cctggagagagaggccaactgc

SEQ ID NO: 8240641 - DNA, 22 bp, Homo sapiens
cctggagagctcgggccaggca

SEQ ID NO: 8240642 - DNA, 22 bp, Homo sapiens
tgtaaacagccccatggagagc

SEQ ID NO: 8240643 - DNA, 21 bp, Homo sapiens
cctggactgggagcagcactg

SEQ ID NO: 8240644 - DNA, 22 bp, Homo sapiens
cctggactgtgtcctgtggtca

SEQ ID NO: 8240645 - DNA, 22 bp, Homo sapiens
cctggactcagaggtgctggtg

SEQ ID NO: 8240646 - DNA, 22 bp, Homo sapiens
cctggaaacacatgatgatgaa

SEQ ID NO: 8240647 - DNA, 22 bp, Homo sapiens
tggtgggacatctgaggagagg

SEQ ID NO: 8240648 - DNA, 21 bp, Homo sapiens
cctggagacaaagacagggtg

SEQ ID NO: 8240649 - DNA, 21 bp, Homo sapiens
cctggagacaaagacagggtg

SEQ ID NO: 8240650 - DNA, 22 bp, Homo sapiens
cctggagacccacttctgccaa

SEQ ID NO: 8240651 - DNA, 22 bp, Homo sapiens
cctggagaccagaggatacttc

SEQ ID NO: 8240652 - DNA, 22 bp, Homo sapiens
cctggagaccagaggatacttc

SEQ ID NO: 8240653 - DNA, 21 bp, Homo sapiens
cctggagacaaagacagggtg

SEQ ID NO: 8240654 - DNA, 21 bp, Homo sapiens
cctggagacaaagacagggtg

SEQ ID NO: 8240655 - DNA, 22 bp, Homo sapiens
tgtaggagtccaatcaggagac

SEQ ID NO: 8240656 - DNA, 21 bp, Homo sapiens
tgtaggaggcaagcctgtctc

SEQ ID NO: 8240657 - DNA, 22 bp, Homo sapiens
tgtaggcatattcatagagttg

SEQ ID NO: 8240658 - DNA, 22 bp, Homo sapiens
tgtaggcatgaaggctctatag

SEQ ID NO: 8240659 - DNA, 23 bp, Homo sapiens
tgtaggctaagtcccataaatca

SEQ ID NO: 8240660 - DNA, 22 bp, Homo sapiens
tgtagggagagggagttgcacc

SEQ ID NO: 8240661 - DNA, 22 bp, Homo sapiens
tgtagggaggaaagggctcttg

SEQ ID NO: 8240662 - DNA, 22 bp, Homo sapiens
tgtagggagaagagaggcacct

SEQ ID NO: 8240663 - DNA, 22 bp, Homo sapiens
tgtagggacttggcgatcactt

SEQ ID NO: 8240664 - DNA, 22 bp, Homo sapiens
tgtagggacttggcgatcactt

SEQ ID NO: 8240665 - DNA, 22 bp, Homo sapiens
tgtagggactgaggctggagag

SEQ ID NO: 8240666 - DNA, 22 bp, Homo sapiens
tgtagggactgaggctggagag

SEQ ID NO: 8240667 - DNA, 22 bp, Homo sapiens
tgtagggaggaagggttggaaa

SEQ ID NO: 8240668 - DNA, 22 bp, Homo sapiens
tgtaggtcaagtccattgtgct

SEQ ID NO: 8240669 - DNA, 22 bp, Homo sapiens
tgtaggtagatcccatgtaaga

SEQ ID NO: 8240670 - DNA, 22 bp, Homo sapiens
tgtaggtaagttcgtagatttg

SEQ ID NO: 8240671 - DNA, 22 bp, Homo sapiens
tgtaggtcagtttgttcatgtt

SEQ ID NO: 8240672 - DNA, 22 bp, Homo sapiens
tgtaggtctcagtgtctgagct

SEQ ID NO: 8240673 - DNA, 22 bp, Homo sapiens
tgtaggtctcagtgtctgagct

SEQ ID NO: 8240674 - DNA, 22 bp, Homo sapiens
tgtaaacatatgtatgtatgta

SEQ ID NO: 8240675 - DNA, 22 bp, Homo sapiens
tgtaaactgcttctcaccaagg

SEQ ID NO: 8240676 - DNA, 22 bp, Homo sapiens
tgtaaactagggctgataaggg

SEQ ID NO: 8240677 - DNA, 23 bp, Homo sapiens
tgtaaaccattttgcatcccatg

SEQ ID NO: 8240678 - DNA, 22 bp, Homo sapiens
tgtaaactgtagaaaatacttt

SEQ ID NO: 8240679 - DNA, 22 bp, Homo sapiens
tgtaaagaaatagcatttgtag

SEQ ID NO: 8240680 - DNA, 22 bp, Homo sapiens
tgtaccaaacccatcataacta

SEQ ID NO: 8240681 - DNA, 23 bp, Homo sapiens
tgtaccaggagtttcagcagact

SEQ ID NO: 8240682 - DNA, 22 bp, Homo sapiens
cctggagcacatggcaggaggc

SEQ ID NO: 8240683 - DNA, 22 bp, Homo sapiens
cctggagcacatggcaggaggc

SEQ ID NO: 8240684 - DNA, 22 bp, Homo sapiens
cctggagcacatggcaggaggc

SEQ ID NO: 8240685 - DNA, 22 bp, Homo sapiens
cctggagcacatggcaggaggc

SEQ ID NO: 8240686 - DNA, 22 bp, Homo sapiens
cctggaggtggaggttgcagtg

SEQ ID NO: 8240687 - DNA, 22 bp, Homo sapiens
cctggaggtggaggttgcagtg

SEQ ID NO: 8240688 - DNA, 22 bp, Homo sapiens
cctggcacatagcaacccctcc

SEQ ID NO: 8240689 - DNA, 22 bp, Homo sapiens
cctggcacatagtgggcatgca

SEQ ID NO: 8240690 - DNA, 22 bp, Homo sapiens
cctggagcacatggcaggaggc

SEQ ID NO: 8240691 - DNA, 22 bp, Homo sapiens
cctggagcacagcccagtccca

SEQ ID NO: 8240692 - DNA, 22 bp, Homo sapiens
cctggagcaaaaatctaaggag

SEQ ID NO: 8240693 - DNA, 22 bp, Homo sapiens
cctggagcaaaaatctaaggag

SEQ ID NO: 8240694 - DNA, 22 bp, Homo sapiens
cctggagatttcttcaagcttt

SEQ ID NO: 8240695 - DNA, 22 bp, Homo sapiens
cctggagatttcttcaagcttt

SEQ ID NO: 8240696 - DNA, 22 bp, Homo sapiens
cctggagattatttggtccaat

SEQ ID NO: 8240697 - DNA, 22 bp, Homo sapiens
cctggagattatttggtccaat

SEQ ID NO: 8240698 - DNA, 22 bp, Homo sapiens
tgtagtccaggaattgtgtctg

SEQ ID NO: 8240699 - DNA, 22 bp, Homo sapiens
tgtagtagcattcacgaagtgt

SEQ ID NO: 8240700 - DNA, 22 bp, Homo sapiens
tgtagtaaacactattctgatc

SEQ ID NO: 8240701 - DNA, 22 bp, Homo sapiens
tgtagtgtggcctatctttgcc

SEQ ID NO: 8240702 - DNA, 22 bp, Homo sapiens
tgtagtgaggaaagactggttg

SEQ ID NO: 8240703 - DNA, 22 bp, Homo sapiens
cctggagaggcgctgcagagga

SEQ ID NO: 8240704 - DNA, 22 bp, Homo sapiens
cctggagaggagaaagggccca

SEQ ID NO: 8240705 - DNA, 22 bp, Homo sapiens
cctggagagctcgggccaggca

SEQ ID NO: 8240706 - DNA, 22 bp, Homo sapiens
cctggagagctcgggccaggca

SEQ ID NO: 8240707 - DNA, 22 bp, Homo sapiens
cctggagaggcgctgcagagga

SEQ ID NO: 8240708 - DNA, 22 bp, Homo sapiens
cctggagaggcgctgcagagga

SEQ ID NO: 8240709 - DNA, 22 bp, Homo sapiens
tgtcatgggcatttattgaggg

SEQ ID NO: 8240710 - DNA, 22 bp, Homo sapiens
tgtcatggacagattagatgag

SEQ ID NO: 8240711 - DNA, 22 bp, Homo sapiens
tgtcatgtggcaattaaagcag

SEQ ID NO: 8240712 - DNA, 22 bp, Homo sapiens
tgtcatgtggcaattaaagcag

SEQ ID NO: 8240713 - DNA, 22 bp, Homo sapiens
tgtcatgtataagacactgtgt

SEQ ID NO: 8240714 - DNA, 22 bp, Homo sapiens
tgtcatgtagcattttatgtct

SEQ ID NO: 8240715 - DNA, 22 bp, Homo sapiens
tgtcatgtagcattttatgtct

SEQ ID NO: 8240716 - DNA, 22 bp, Homo sapiens
tgtcatgtaacctttctgagcc

SEQ ID NO: 8240717 - DNA, 22 bp, Homo sapiens
tgtcatgtaaagagtaaatggt

SEQ ID NO: 8240718 - DNA, 22 bp, Homo sapiens
tgtcatgtaaagagtaaatggt

SEQ ID NO: 8240719 - DNA, 22 bp, Homo sapiens
tgtcatggtctgtaaggagccc

SEQ ID NO: 8240720 - DNA, 22 bp, Homo sapiens
tgtcatggtatttgtgagctgc

SEQ ID NO: 8240721 - DNA, 22 bp, Homo sapiens
tgtcatgggtctaaacattgat

SEQ ID NO: 8240722 - DNA, 22 bp, Homo sapiens
tgtatgtttctaaatgattgct

SEQ ID NO: 8240723 - DNA, 22 bp, Homo sapiens
tgtattatgattgttgttcatg

SEQ ID NO: 8240724 - DNA, 22 bp, Homo sapiens
tgtattcagggacatatatgta

SEQ ID NO: 8240725 - DNA, 21 bp, Homo sapiens
tgtcagctccctgtcctgtgt

SEQ ID NO: 8240726 - DNA, 22 bp, Homo sapiens
tgtatgtgtatgtacatatgca

SEQ ID NO: 8240727 - DNA, 22 bp, Homo sapiens
tgtatgtgtcctaattcaagca

SEQ ID NO: 8240728 - DNA, 22 bp, Homo sapiens
tgtatgtgtggatagatgtata

SEQ ID NO: 8240729 - DNA, 22 bp, Homo sapiens
tgtatgtgtatgtacatatgca

SEQ ID NO: 8240730 - DNA, 22 bp, Homo sapiens
tgtatgtgcaatgtttatatgt

SEQ ID NO: 8240731 - DNA, 22 bp, Homo sapiens
tgtatgtgcttgagaaggtggg

SEQ ID NO: 8240732 - DNA, 22 bp, Homo sapiens
tgtatgtatgtatgtatttggg

SEQ ID NO: 8240733 - DNA, 22 bp, Homo sapiens
tgtatgtattggtcagggttct

SEQ ID NO: 8240734 - DNA, 22 bp, Homo sapiens
tgtatgtattttgctaggctga

SEQ ID NO: 8240735 - DNA, 22 bp, Homo sapiens
cctggcagacagcactgaagct

SEQ ID NO: 8240736 - DNA, 22 bp, Homo sapiens
cctggcagactgtgagggcagg

SEQ ID NO: 8240737 - DNA, 22 bp, Homo sapiens
tgtatgtatgcatcttttatgt

SEQ ID NO: 8240738 - DNA, 22 bp, Homo sapiens
tgtatgtatgcatcttttatgt

SEQ ID NO: 8240739 - DNA, 22 bp, Homo sapiens
tgtatgtatgaataagcaagat

SEQ ID NO: 8240740 - DNA, 22 bp, Homo sapiens
tgtatgtatacactgatcatca

SEQ ID NO: 8240741 - DNA, 22 bp, Homo sapiens
cctggcagacagcactgaagct

SEQ ID NO: 8240742 - DNA, 22 bp, Homo sapiens
cctggcagacagcactgaagct

SEQ ID NO: 8240743 - DNA, 22 bp, Homo sapiens
cctggcagaatattaaagtgca

SEQ ID NO: 8240744 - DNA, 22 bp, Homo sapiens
cctggcagacagcactgaagct

SEQ ID NO: 8240745 - DNA, 22 bp, Homo sapiens
cctggcagaatattaaagtgca

SEQ ID NO: 8240746 - DNA, 21 bp, Homo sapiens
cctggcagaagcctgatatgc

SEQ ID NO: 8240747 - DNA, 21 bp, Homo sapiens
cctggcagaagcctgatatgc

SEQ ID NO: 8240748 - DNA, 21 bp, Homo sapiens
cctggcagaagcctgatatgc

SEQ ID NO: 8240749 - DNA, 21 bp, Homo sapiens
cctggcagaagcctgatatgc

SEQ ID NO: 8240750 - DNA, 21 bp, Homo sapiens
cctggcactggcctgctgagc

SEQ ID NO: 8240751 - DNA, 22 bp, Homo sapiens
cctggcagaaagagttacacct

SEQ ID NO: 8240752 - DNA, 22 bp, Homo sapiens
cctggcagaaagagttacacct

SEQ ID NO: 8240753 - DNA, 22 bp, Homo sapiens
cctggcactgctgaagtcctgg

SEQ ID NO: 8240754 - DNA, 22 bp, Homo sapiens
cctggcacgaagggctgaggtt

SEQ ID NO: 8240755 - DNA, 22 bp, Homo sapiens
cctggcactgaccaggcactga

SEQ ID NO: 8240756 - DNA, 22 bp, Homo sapiens
cctggcacatgatagatgctca

SEQ ID NO: 8240757 - DNA, 22 bp, Homo sapiens
cctggcacatgatagatgctca

SEQ ID NO: 8240758 - DNA, 22 bp, Homo sapiens
cctggcacatagtgggcatgca

SEQ ID NO: 8240759 - DNA, 22 bp, Homo sapiens
cctggcaccttcacagactact

SEQ ID NO: 8240760 - DNA, 22 bp, Homo sapiens
cctggcacctgtgttttctgga

SEQ ID NO: 8240761 - DNA, 22 bp, Homo sapiens
cctggcacgaagggctgaggtt

SEQ ID NO: 8240762 - DNA, 22 bp, Homo sapiens
tgtctctgggtgattcagtcct

SEQ ID NO: 8240763 - DNA, 22 bp, Homo sapiens
tgtctctgggtgattcagtcct

SEQ ID NO: 8240764 - DNA, 22 bp, Homo sapiens
tgtctctgggtgattcagtcct

SEQ ID NO: 8240765 - DNA, 22 bp, Homo sapiens
tgtctctggtattaggtgaaaa

SEQ ID NO: 8240766 - DNA, 22 bp, Homo sapiens
tgtctctgtcttccagggctgt

SEQ ID NO: 8240767 - DNA, 22 bp, Homo sapiens
tgtctctgtctcccaggttgtg

SEQ ID NO: 8240768 - DNA, 22 bp, Homo sapiens
tgtctctgtgagatctgacgat

SEQ ID NO: 8240769 - DNA, 22 bp, Homo sapiens
tgtctctgtgagatctgacgat

SEQ ID NO: 8240770 - DNA, 22 bp, Homo sapiens
tgtctctgtgagatctgacgat

SEQ ID NO: 8240771 - DNA, 22 bp, Homo sapiens
tgtctctgtgagatctgacgat

SEQ ID NO: 8240772 - DNA, 22 bp, Homo sapiens
tgtctcagtacactccgatgtt

SEQ ID NO: 8240773 - DNA, 22 bp, Homo sapiens
tgtctcaggtacatgcgtcctg

SEQ ID NO: 8240774 - DNA, 19 bp, Homo sapiens
tgtctcagtgtcccttcct

SEQ ID NO: 8240775 - DNA, 19 bp, Homo sapiens
tgtctcagtgtcccttcct

SEQ ID NO: 8240776 - DNA, 22 bp, Homo sapiens
tgtctcagttcccttctctgga

SEQ ID NO: 8240777 - DNA, 22 bp, Homo sapiens
tgtctcatctcttaaccccact

SEQ ID NO: 8240778 - DNA, 22 bp, Homo sapiens
tgtctcttgagtttgttttaat

SEQ ID NO: 8240779 - DNA, 22 bp, Homo sapiens
tgtctcttgagctgcctgatgc

SEQ ID NO: 8240780 - DNA, 18 bp, Homo sapiens
tgtctcttcttatgtggg

SEQ ID NO: 8240781 - DNA, 18 bp, Homo sapiens
tgtctcttcttatgtggg

SEQ ID NO: 8240782 - DNA, 22 bp, Homo sapiens
tgtctcttctgcctccagctgt

SEQ ID NO: 8240783 - DNA, 22 bp, Homo sapiens
tgtctcttggattgcttgctct

SEQ ID NO: 8240784 - DNA, 22 bp, Homo sapiens
tgtctcttggattgcttgctct

SEQ ID NO: 8240785 - DNA, 22 bp, Homo sapiens
tgtctcttggagggtctagtga

SEQ ID NO: 8240786 - DNA, 22 bp, Homo sapiens
tgtctcttggagggtctagtga

SEQ ID NO: 8240787 - DNA, 22 bp, Homo sapiens
tgtctctgtgcatttgtgcttc

SEQ ID NO: 8240788 - DNA, 22 bp, Homo sapiens
tgtctctgtgcatttgtgcttc

SEQ ID NO: 8240789 - DNA, 22 bp, Homo sapiens
tgtctctgtgcatttgtgcttc

SEQ ID NO: 8240790 - DNA, 22 bp, Homo sapiens
tgtctcttcagcccatggcttc

SEQ ID NO: 8240791 - DNA, 22 bp, Homo sapiens
tgtctcttcagcccatggcttc

SEQ ID NO: 8240792 - DNA, 22 bp, Homo sapiens
tgtctcttactttgattcttgg

SEQ ID NO: 8240793 - DNA, 22 bp, Homo sapiens
tgtctcttactttgattcttgg

SEQ ID NO: 8240794 - DNA, 22 bp, Homo sapiens
tgtcctggccaaggccttgctt

SEQ ID NO: 8240795 - DNA, 22 bp, Homo sapiens
tgtcctggccaaggccttgctt

SEQ ID NO: 8240796 - DNA, 22 bp, Homo sapiens
tgtcctggatcatgcctctgaa

SEQ ID NO: 8240797 - DNA, 21 bp, Homo sapiens
tgtctcaatcagaagtcatta

SEQ ID NO: 8240798 - DNA, 18 bp, Homo sapiens
tgtctcaggctgaaacag

SEQ ID NO: 8240799 - DNA, 22 bp, Homo sapiens
tgtctcaggggcattgaaataa

SEQ ID NO: 8240800 - DNA, 22 bp, Homo sapiens
tgtctcagatacgccatcaagg

SEQ ID NO: 8240801 - DNA, 22 bp, Homo sapiens
tgtctcaggcccaagccagtaa

SEQ ID NO: 8240802 - DNA, 22 bp, Homo sapiens
tgtctcagaatggctcataata

SEQ ID NO: 8240803 - DNA, 22 bp, Homo sapiens
tgtctcagagtgttgtattaga

SEQ ID NO: 8240804 - DNA, 22 bp, Homo sapiens
tgtctcagagtatccctgaact

SEQ ID NO: 8240805 - DNA, 22 bp, Homo sapiens
tgtctcagagtgttgtattaga

SEQ ID NO: 8240806 - DNA, 22 bp, Homo sapiens
tgtcctctccaacagcctctgt

SEQ ID NO: 8240807 - DNA, 22 bp, Homo sapiens
tgtcctctaattggcctcttgc

SEQ ID NO: 8240808 - DNA, 22 bp, Homo sapiens
tgtcctcttccagtgctccttc

SEQ ID NO: 8240809 - DNA, 22 bp, Homo sapiens
tgtcctcttccagtgctccttc

SEQ ID NO: 8240810 - DNA, 22 bp, Homo sapiens
tgtcctctgttaggggatagcg

SEQ ID NO: 8240811 - DNA, 22 bp, Homo sapiens
tgtcctctgttaggggatagcg

SEQ ID NO: 8240812 - DNA, 22 bp, Homo sapiens
tgtcctgcaagccctaatgaat

SEQ ID NO: 8240813 - DNA, 22 bp, Homo sapiens
tgtcctcttccagtgctccttc

SEQ ID NO: 8240814 - DNA, 22 bp, Homo sapiens
tgtcctgcaagccctaatgaat

SEQ ID NO: 8240815 - DNA, 22 bp, Homo sapiens
tgtcctggagacacaaggtggt

SEQ ID NO: 8240816 - DNA, 22 bp, Homo sapiens
tgtcctggagacacaaggtggt

SEQ ID NO: 8240817 - DNA, 22 bp, Homo sapiens
tgtcctggagttataatgcctg

SEQ ID NO: 8240818 - DNA, 22 bp, Homo sapiens
tgtcctggagtgcttgggggaa

SEQ ID NO: 8240819 - DNA, 22 bp, Homo sapiens
tgtcctggagtgcttgggggaa

SEQ ID NO: 8240820 - DNA, 22 bp, Homo sapiens
tgtcctggatcatgcctctgaa

SEQ ID NO: 8240821 - DNA, 22 bp, Homo sapiens
tgtcctggatcatgcctctgaa

SEQ ID NO: 8240822 - DNA, 22 bp, Homo sapiens
tgtcctggagttataatgcctg

SEQ ID NO: 8240823 - DNA, 22 bp, Homo sapiens
tgtcctggaaaaatggagagtt

SEQ ID NO: 8240824 - DNA, 22 bp, Homo sapiens
tgtcctggaaaaatggagagtt

SEQ ID NO: 8240825 - DNA, 22 bp, Homo sapiens
tgtcctggaaaaatggagagtt

SEQ ID NO: 8240826 - DNA, 22 bp, Homo sapiens
tgtcctggacaacagcccctag

SEQ ID NO: 8240827 - DNA, 22 bp, Homo sapiens
tgtcctggacaacagcccctag

SEQ ID NO: 8240828 - DNA, 22 bp, Homo sapiens
tgtcctggagacacaaggtggt

SEQ ID NO: 8240829 - DNA, 22 bp, Homo sapiens
cctggctcccggaacagggtct

SEQ ID NO: 8240830 - DNA, 22 bp, Homo sapiens
cctggcctggcactccctctgc

SEQ ID NO: 8240831 - DNA, 22 bp, Homo sapiens
cctggcctggcactccctctgc

SEQ ID NO: 8240832 - DNA, 22 bp, Homo sapiens
cctggcctggcactccctctgc

SEQ ID NO: 8240833 - DNA, 22 bp, Homo sapiens
cctggcctgctcggctcttaag

SEQ ID NO: 8240834 - DNA, 22 bp, Homo sapiens
cctggccttaagggcagggagc

SEQ ID NO: 8240835 - DNA, 22 bp, Homo sapiens
cctggcctgtgaatctgagagc

SEQ ID NO: 8240836 - DNA, 22 bp, Homo sapiens
cctggcctgtgaatctgagagc

SEQ ID NO: 8240837 - DNA, 22 bp, Homo sapiens
cctggcccagggactttcgcct

SEQ ID NO: 8240838 - DNA, 22 bp, Homo sapiens
cctggcccacatggcttctccc

SEQ ID NO: 8240839 - DNA, 22 bp, Homo sapiens
cctggccctggaatagggcagg

SEQ ID NO: 8240840 - DNA, 19 bp, Homo sapiens
cctggccctgctgcgcggg

SEQ ID NO: 8240841 - DNA, 19 bp, Homo sapiens
cctggccctgctgcgcggg

SEQ ID NO: 8240842 - DNA, 22 bp, Homo sapiens
cctggcctcgtgctcacggctc

SEQ ID NO: 8240843 - DNA, 22 bp, Homo sapiens
cctggcctcctggccttctcat

SEQ ID NO: 8240844 - DNA, 22 bp, Homo sapiens
cctggcctcagcctagggctga

SEQ ID NO: 8240845 - DNA, 22 bp, Homo sapiens
cctggcctcagacagagggtgg

SEQ ID NO: 8240846 - DNA, 22 bp, Homo sapiens
cctggcctcagacagagggtgg

SEQ ID NO: 8240847 - DNA, 22 bp, Homo sapiens
cctggccgcggagcccttccag

SEQ ID NO: 8240848 - DNA, 22 bp, Homo sapiens
cctggccggtatcccacctcct

SEQ ID NO: 8240849 - DNA, 22 bp, Homo sapiens
cctggccgcggagcccttccag

SEQ ID NO: 8240850 - DNA, 22 bp, Homo sapiens
cctggctccctgcacagggctc

SEQ ID NO: 8240851 - DNA, 22 bp, Homo sapiens
cctggctccggttcaagggaaa

SEQ ID NO: 8240852 - DNA, 22 bp, Homo sapiens
cctggctcctgcctctgcaggg

SEQ ID NO: 8240853 - DNA, 22 bp, Homo sapiens
cctggctcctgcctctgcaggg

SEQ ID NO: 8240854 - DNA, 22 bp, Homo sapiens
cctggctcctgcacagatcttt

SEQ ID NO: 8240855 - DNA, 22 bp, Homo sapiens
cctggctctctgcagatcctgg

SEQ ID NO: 8240856 - DNA, 22 bp, Homo sapiens
cctggctctctgcagatcctgg

SEQ ID NO: 8240857 - DNA, 22 bp, Homo sapiens
cctggctctctgcagatcctgg

SEQ ID NO: 8240858 - DNA, 22 bp, Homo sapiens
cctggctctctgcagatcctgg

SEQ ID NO: 8240859 - DNA, 22 bp, Homo sapiens
cctggctcgctgacctcagggg

SEQ ID NO: 8240860 - DNA, 22 bp, Homo sapiens
cctggctcgctgacctcagggg

SEQ ID NO: 8240861 - DNA, 22 bp, Homo sapiens
tgtcccagatcacaggagggga

SEQ ID NO: 8240862 - DNA, 22 bp, Homo sapiens
tgtcccagatcacaggagggga

SEQ ID NO: 8240863 - DNA, 22 bp, Homo sapiens
tgtcccagatactggacataga

SEQ ID NO: 8240864 - DNA, 23 bp, Homo sapiens
tgtcccagagggagggataggct

SEQ ID NO: 8240865 - DNA, 19 bp, Homo sapiens
tgtcccagactccgtgtct

SEQ ID NO: 8240866 - DNA, 22 bp, Homo sapiens
tgtcccagacataagtggacat

SEQ ID NO: 8240867 - DNA, 22 bp, Homo sapiens
tgtcccagacacagtatgcgct

SEQ ID NO: 8240868 - DNA, 22 bp, Homo sapiens
tgtcctccagcagcatggtatg

SEQ ID NO: 8240869 - DNA, 22 bp, Homo sapiens
tgtcctccaggacctgcagggc

SEQ ID NO: 8240870 - DNA, 22 bp, Homo sapiens
tgtcctcgtccgcctcgaactc

SEQ ID NO: 8240871 - DNA, 22 bp, Homo sapiens
tgtcctcatcttttccagaaat

SEQ ID NO: 8240872 - DNA, 22 bp, Homo sapiens
tgtcctcatcttttccagaaat

SEQ ID NO: 8240873 - DNA, 22 bp, Homo sapiens
tgtcctcatcctccagtctgtc

SEQ ID NO: 8240874 - DNA, 22 bp, Homo sapiens
tgtcctcatcctccagtctgtc

SEQ ID NO: 8240875 - DNA, 22 bp, Homo sapiens
tgtcccagcactttgggagtct

SEQ ID NO: 8240876 - DNA, 22 bp, Homo sapiens
tgtccatacctttacctgtgta

SEQ ID NO: 8240877 - DNA, 22 bp, Homo sapiens
tgtccagtgattctcatgagcc

SEQ ID NO: 8240878 - DNA, 22 bp, Homo sapiens
tgtccagtgattctcatgagcc

SEQ ID NO: 8240879 - DNA, 19 bp, Homo sapiens
tgtccagtgatgtcaagga

SEQ ID NO: 8240880 - DNA, 22 bp, Homo sapiens
tgtccagtgatgccaagatgaa

SEQ ID NO: 8240881 - DNA, 22 bp, Homo sapiens
cctggcccacatggcttctccc

SEQ ID NO: 8240882 - DNA, 22 bp, Homo sapiens
tgtccagtccttggggtgctgt

SEQ ID NO: 8240883 - DNA, 22 bp, Homo sapiens
cctggcccacatggcttctccc

SEQ ID NO: 8240884 - DNA, 17 bp, Homo sapiens
tgtccatttgcctggag

SEQ ID NO: 8240885 - DNA, 22 bp, Homo sapiens
tgtccatggggaaggggaagtg

SEQ ID NO: 8240886 - DNA, 18 bp, Homo sapiens
tgtccatgttgttcctga

SEQ ID NO: 8240887 - DNA, 22 bp, Homo sapiens
tgtccatggggaaggggaagtg

SEQ ID NO: 8240888 - DNA, 22 bp, Homo sapiens
tgtccatgggcgtcaggcagga

SEQ ID NO: 8240889 - DNA, 22 bp, Homo sapiens
tgtccatggagaagctcagggc

SEQ ID NO: 8240890 - DNA, 22 bp, Homo sapiens
tgtccatctccatcgagtcctc

SEQ ID NO: 8240891 - DNA, 22 bp, Homo sapiens
tgtccatctgtcttagtacaaa

SEQ ID NO: 8240892 - DNA, 22 bp, Homo sapiens
tgtccatgcgtatccagggagc

SEQ ID NO: 8240893 - DNA, 22 bp, Homo sapiens
tgtccatggagaagctcagggc

SEQ ID NO: 8240894 - DNA, 22 bp, Homo sapiens
cctggcagtggtgaagaagagg

SEQ ID NO: 8240895 - DNA, 22 bp, Homo sapiens
cctggcagtggtgaagaagagg

SEQ ID NO: 8240896 - DNA, 22 bp, Homo sapiens
cctggcagttcatcaaatggca

SEQ ID NO: 8240897 - DNA, 22 bp, Homo sapiens
cctggcagttcatcaaatggca

SEQ ID NO: 8240898 - DNA, 22 bp, Homo sapiens
cctggcagttcatcaaatggca

SEQ ID NO: 8240899 - DNA, 22 bp, Homo sapiens
cctggcagttttgcccaggatt

SEQ ID NO: 8240900 - DNA, 22 bp, Homo sapiens
cctggcagttttgcccaggatt

SEQ ID NO: 8240901 - DNA, 22 bp, Homo sapiens
cctggcagttttgcccaggatt

SEQ ID NO: 8240902 - DNA, 22 bp, Homo sapiens
cctggcagttttgcccaggatt

SEQ ID NO: 8240903 - DNA, 22 bp, Homo sapiens
cctggcagttttgcccaggatt

SEQ ID NO: 8240904 - DNA, 22 bp, Homo sapiens
cctggcagttttgcccaggatt

SEQ ID NO: 8240905 - DNA, 22 bp, Homo sapiens
cctggcatgtcctcctggcatg

SEQ ID NO: 8240906 - DNA, 22 bp, Homo sapiens
cctggcatgtcctcctggcatg

SEQ ID NO: 8240907 - DNA, 22 bp, Homo sapiens
cctggccagcgccggctgctcg

SEQ ID NO: 8240908 - DNA, 22 bp, Homo sapiens
cctggccatagggcccaggaaa

SEQ ID NO: 8240909 - DNA, 22 bp, Homo sapiens
cctggccatagggcccaggaaa

SEQ ID NO: 8240910 - DNA, 22 bp, Homo sapiens
cctggccatagggcccaggaaa

SEQ ID NO: 8240911 - DNA, 22 bp, Homo sapiens
cctggccagtttccaggccctg

SEQ ID NO: 8240912 - DNA, 22 bp, Homo sapiens
cctggccagtttccaggccctg

SEQ ID NO: 8240913 - DNA, 22 bp, Homo sapiens
cctggccagtttccaggccctg

SEQ ID NO: 8240914 - DNA, 22 bp, Homo sapiens
cctggccagtttccaggccctg

SEQ ID NO: 8240915 - DNA, 22 bp, Homo sapiens
cctggccagtttccaggccctg

SEQ ID NO: 8240916 - DNA, 22 bp, Homo sapiens
cctggccagtttccaggccctg

SEQ ID NO: 8240917 - DNA, 22 bp, Homo sapiens
cctggccaggctctcagcactg

SEQ ID NO: 8240918 - DNA, 22 bp, Homo sapiens
cctggccaggctccaagtactg

SEQ ID NO: 8240919 - DNA, 22 bp, Homo sapiens
cctggcagactgtgagggcagg

SEQ ID NO: 8240920 - DNA, 22 bp, Homo sapiens
cctggcagactgtgagggcagg

SEQ ID NO: 8240921 - DNA, 23 bp, Homo sapiens
cctggcagcaaacgaggaggtta

SEQ ID NO: 8240922 - DNA, 23 bp, Homo sapiens
cctggcagcaaacgaggaggtta

SEQ ID NO: 8240923 - DNA, 22 bp, Homo sapiens
cctggcagactgtgagggcagg

SEQ ID NO: 8240924 - DNA, 23 bp, Homo sapiens
cctggcagcaaacgaggaggtta

SEQ ID NO: 8240925 - DNA, 21 bp, Homo sapiens
tgtcatgtttttccaggcatc

SEQ ID NO: 8240926 - DNA, 22 bp, Homo sapiens
tgtcatgtgcggggaggtgaag

SEQ ID NO: 8240927 - DNA, 22 bp, Homo sapiens
tgtcatgtgttcttaaatacat

SEQ ID NO: 8240928 - DNA, 22 bp, Homo sapiens
tgtcatgtttcatgtttgtagg

SEQ ID NO: 8240929 - DNA, 22 bp, Homo sapiens
tgtcattatttgcctactgact

SEQ ID NO: 8240930 - DNA, 22 bp, Homo sapiens
cctggcagcattggtagagatt

SEQ ID NO: 8240931 - DNA, 22 bp, Homo sapiens
cctggcagcattggtagagatt

SEQ ID NO: 8240932 - DNA, 22 bp, Homo sapiens
cctggcagcaggtgggcccgtg

SEQ ID NO: 8240933 - DNA, 22 bp, Homo sapiens
cctggcagcattggtagagatt

SEQ ID NO: 8240934 - DNA, 18 bp, Homo sapiens
cctggcagccatgcgcgc

SEQ ID NO: 8240935 - DNA, 22 bp, Homo sapiens
cctggcagctgtttggcttggc

SEQ ID NO: 8240936 - DNA, 18 bp, Homo sapiens
cctggcagccatgcgcgc

SEQ ID NO: 8240937 - DNA, 18 bp, Homo sapiens
cctggcagccatgcgcgc

SEQ ID NO: 8240938 - DNA, 18 bp, Homo sapiens
cctggcagccatgcgcgc

SEQ ID NO: 8240939 - DNA, 18 bp, Homo sapiens
cctggcagccatgcgcgc

SEQ ID NO: 8240940 - DNA, 22 bp, Homo sapiens
cctggcagcaggtgggcccgtg

SEQ ID NO: 8240941 - DNA, 22 bp, Homo sapiens
cctggcagcaggtgggcccgtg

SEQ ID NO: 8240942 - DNA, 22 bp, Homo sapiens
cctggcagcaggtgggcccgtg

SEQ ID NO: 8240943 - DNA, 22 bp, Homo sapiens
cctggcagcaggtgggcccgtg

SEQ ID NO: 8240944 - DNA, 22 bp, Homo sapiens
cctggcagcagcacatgccttc

SEQ ID NO: 8240945 - DNA, 22 bp, Homo sapiens
cctggcagcagcacatgccttc

SEQ ID NO: 8240946 - DNA, 22 bp, Homo sapiens
cctggcagcagcacatgccttc

SEQ ID NO: 8240947 - DNA, 23 bp, Homo sapiens
cctggcagcaaacgaggaggtta

SEQ ID NO: 8240948 - DNA, 23 bp, Homo sapiens
cctggcagcaaacgaggaggtta

SEQ ID NO: 8240949 - DNA, 22 bp, Homo sapiens
cctggcagcagcacatgccttc

SEQ ID NO: 8240950 - DNA, 22 bp, Homo sapiens
cctggcaggcaagaggaaggga

SEQ ID NO: 8240951 - DNA, 22 bp, Homo sapiens
cctggcaggcaagaggaaggga

SEQ ID NO: 8240952 - DNA, 22 bp, Homo sapiens
cctggcaggactgttgtaagaa

SEQ ID NO: 8240953 - DNA, 22 bp, Homo sapiens
cctggcaggactgttgtaagaa

SEQ ID NO: 8240954 - DNA, 22 bp, Homo sapiens
cctggcaggcaagaggaaggga

SEQ ID NO: 8240955 - DNA, 22 bp, Homo sapiens
cctggcaggcaagaggaaggga

SEQ ID NO: 8240956 - DNA, 22 bp, Homo sapiens
cctggcaggcccctcctggatt

SEQ ID NO: 8240957 - DNA, 22 bp, Homo sapiens
cctggcaggcaagaggaaggga

SEQ ID NO: 8240958 - DNA, 22 bp, Homo sapiens
cctggcaggcccctcctggatt

SEQ ID NO: 8240959 - DNA, 22 bp, Homo sapiens
cctggcaggcccctcctggatt

SEQ ID NO: 8240960 - DNA, 22 bp, Homo sapiens
cctggcaggcccctcctggatt

SEQ ID NO: 8240961 - DNA, 20 bp, Homo sapiens
cctggcaggcgggttactta

SEQ ID NO: 8240962 - DNA, 22 bp, Homo sapiens
cctggcaggctggggacagtgc

SEQ ID NO: 8240963 - DNA, 20 bp, Homo sapiens
cctggcaggcgggttactta

SEQ ID NO: 8240964 - DNA, 20 bp, Homo sapiens
cctggcaggcgggttactta

SEQ ID NO: 8240965 - DNA, 22 bp, Homo sapiens
cctggcaggctggggacagtgc

SEQ ID NO: 8240966 - DNA, 22 bp, Homo sapiens
cctggcaggctggggacagtgc

SEQ ID NO: 8240967 - DNA, 22 bp, Homo sapiens
cctggcaggctggggacagtgc

SEQ ID NO: 8240968 - DNA, 22 bp, Homo sapiens
cctggcaggctggggacagtgc

SEQ ID NO: 8240969 - DNA, 22 bp, Homo sapiens
cctggcaggttacaaccagtta

SEQ ID NO: 8240970 - DNA, 22 bp, Homo sapiens
cctggcaggttacaaccagtta

SEQ ID NO: 8240971 - DNA, 22 bp, Homo sapiens
cctggcaggttacaaccagtta

SEQ ID NO: 8240972 - DNA, 22 bp, Homo sapiens
cctggcaggttacaaccagtta

SEQ ID NO: 8240973 - DNA, 22 bp, Homo sapiens
cctggcaggttacaaccagtta

SEQ ID NO: 8240974 - DNA, 22 bp, Homo sapiens
cctggcaggtggcgccctcggc

SEQ ID NO: 8240975 - DNA, 22 bp, Homo sapiens
cctggcaggtggcgccctcggc

SEQ ID NO: 8240976 - DNA, 22 bp, Homo sapiens
cctggcagtcaggggagtcctt

SEQ ID NO: 8240977 - DNA, 22 bp, Homo sapiens
cctggcagtcaggggagtcctt

SEQ ID NO: 8240978 - DNA, 22 bp, Homo sapiens
cctggcagtcaggggagtcctt

SEQ ID NO: 8240979 - DNA, 22 bp, Homo sapiens
cctggcagtcaggggagtcctt

SEQ ID NO: 8240980 - DNA, 22 bp, Homo sapiens
cctggcagtcaggggagtcctt

SEQ ID NO: 8240981 - DNA, 22 bp, Homo sapiens
cctggcaggtagcattgaggag

SEQ ID NO: 8240982 - DNA, 22 bp, Homo sapiens
cctggcagggctgcagtaatgg

SEQ ID NO: 8240983 - DNA, 22 bp, Homo sapiens
cctggcagggctgcagtaatgg

SEQ ID NO: 8240984 - DNA, 22 bp, Homo sapiens
cctggcaggtagcattgaggag

SEQ ID NO: 8240985 - DNA, 22 bp, Homo sapiens
cctggcaggtggaggttgcagt

SEQ ID NO: 8240986 - DNA, 22 bp, Homo sapiens
cctggcagggctgcagtaatgg

SEQ ID NO: 8240987 - DNA, 22 bp, Homo sapiens
cctggcagggctgcagtaatgg

SEQ ID NO: 8240988 - DNA, 22 bp, Homo sapiens
cctggcaggtagcattgaggag

SEQ ID NO: 8240989 - DNA, 22 bp, Homo sapiens
cctggcaggtggcgccctcggc

SEQ ID NO: 8240990 - DNA, 22 bp, Homo sapiens
cctggcaggtggaggttgcagt

SEQ ID NO: 8240991 - DNA, 22 bp, Homo sapiens
cctggcaggtggaggttgcagt

SEQ ID NO: 8240992 - DNA, 22 bp, Homo sapiens
tgtctgtctgcacagctcatgg

SEQ ID NO: 8240993 - DNA, 23 bp, Homo sapiens
tgtctgtcatggaatttcaaggt

SEQ ID NO: 8240994 - DNA, 17 bp, Homo sapiens
tgtctgtcatcagttcc

SEQ ID NO: 8240995 - DNA, 20 bp, Homo sapiens
tgtctgtatgcagtcatata

SEQ ID NO: 8240996 - DNA, 22 bp, Homo sapiens
tgtctgtcagatattaagtttc

SEQ ID NO: 8240997 - DNA, 22 bp, Homo sapiens
tgtctgtattgaggtgcatatt

SEQ ID NO: 8240998 - DNA, 23 bp, Homo sapiens
tgtctggttcatgcttattttgg

SEQ ID NO: 8240999 - DNA, 22 bp, Homo sapiens
tgtctggtttgaagtccatgat

SEQ ID NO: 8241000 - DNA, 23 bp, Homo sapiens
tgtctggtttcttttatttagca

SEQ ID NO: 8241001 - DNA, 22 bp, Homo sapiens
tgtctgtaaggtgtttatgtta

SEQ ID NO: 8241002 - DNA, 22 bp, Homo sapiens
tgtctggtgggttgacaggcag

SEQ ID NO: 8241003 - DNA, 22 bp, Homo sapiens
tgtctggtgggttgacaggcag

SEQ ID NO: 8241004 - DNA, 22 bp, Homo sapiens
tgtctttagagtcacaaaacca

SEQ ID NO: 8241005 - DNA, 22 bp, Homo sapiens
tgtctgtctttagtgagattgc

SEQ ID NO: 8241006 - DNA, 22 bp, Homo sapiens
tgtctgtctgtccttctcatta

SEQ ID NO: 8241007 - DNA, 22 bp, Homo sapiens
tgtctttagttgcttagatttg

SEQ ID NO: 8241008 - DNA, 22 bp, Homo sapiens
tgtctttagccacttgcctctt

SEQ ID NO: 8241009 - DNA, 19 bp, Homo sapiens
cctggctctgagcccagcc

SEQ ID NO: 8241010 - DNA, 22 bp, Homo sapiens
cctggctctgaagtccacatca

SEQ ID NO: 8241011 - DNA, 22 bp, Homo sapiens
cctggctcttcgggagtttgtt

SEQ ID NO: 8241012 - DNA, 22 bp, Homo sapiens
cctggctcttcgggagtttgtt

SEQ ID NO: 8241013 - DNA, 23 bp, Homo sapiens
cctggctgacctgaaggtgtagt

SEQ ID NO: 8241014 - DNA, 22 bp, Homo sapiens
cctggctgacagcttaattcca

SEQ ID NO: 8241015 - DNA, 23 bp, Homo sapiens
cctggctgacctgaaggtgtagt

SEQ ID NO: 8241016 - DNA, 22 bp, Homo sapiens
cctggctgaaccaatgaagtgg

SEQ ID NO: 8241017 - DNA, 22 bp, Homo sapiens
cctggctgacagcttaattcca

SEQ ID NO: 8241018 - DNA, 22 bp, Homo sapiens
cctggctgaacaaagtccctcc

SEQ ID NO: 8241019 - DNA, 22 bp, Homo sapiens
cctggctgaacaaagtccctcc

SEQ ID NO: 8241020 - DNA, 22 bp, Homo sapiens
cctggctgaacaaagtccctcc

SEQ ID NO: 8241021 - DNA, 22 bp, Homo sapiens
cctggctgaacaaagtccctcc

SEQ ID NO: 8241022 - DNA, 22 bp, Homo sapiens
cctggctgaacaaagtccctcc

SEQ ID NO: 8241023 - DNA, 22 bp, Homo sapiens
cctggctgaacaaagtccctcc

SEQ ID NO: 8241024 - DNA, 22 bp, Homo sapiens
tgtctgggttttgggtcatatt

SEQ ID NO: 8241025 - DNA, 22 bp, Homo sapiens
tgtctgggggttctgaaagctg

SEQ ID NO: 8241026 - DNA, 23 bp, Homo sapiens
tgtctggggcgccagaagagaga

SEQ ID NO: 8241027 - DNA, 21 bp, Homo sapiens
cctggctgcacagttgctggt

SEQ ID NO: 8241028 - DNA, 22 bp, Homo sapiens
tgtctggggaactgtgcatcca

SEQ ID NO: 8241029 - DNA, 21 bp, Homo sapiens
cctggctgcacagttgctggt

SEQ ID NO: 8241030 - DNA, 21 bp, Homo sapiens
cctggctgcacagttgctggt

SEQ ID NO: 8241031 - DNA, 22 bp, Homo sapiens
cctggctgaggggccaaggacc

SEQ ID NO: 8241032 - DNA, 21 bp, Homo sapiens
cctggctgcacagttgctggt

SEQ ID NO: 8241033 - DNA, 22 bp, Homo sapiens
cctggctgaggggccaaggacc

SEQ ID NO: 8241034 - DNA, 22 bp, Homo sapiens
cctggctgaggggccaaggacc

SEQ ID NO: 8241035 - DNA, 22 bp, Homo sapiens
cctggctgagggacctcgggta

SEQ ID NO: 8241036 - DNA, 22 bp, Homo sapiens
cctggctgaggggccaaggacc

SEQ ID NO: 8241037 - DNA, 22 bp, Homo sapiens
cctggctgagcctccaggaaga

SEQ ID NO: 8241038 - DNA, 22 bp, Homo sapiens
cctggctgagggacctcgggta

SEQ ID NO: 8241039 - DNA, 23 bp, Homo sapiens
cctggctgacctgaaggtgtagt

SEQ ID NO: 8241040 - DNA, 22 bp, Homo sapiens
cctggctgagggacctcgggta

SEQ ID NO: 8241041 - DNA, 22 bp, Homo sapiens
tgtgagggttttaagggaatga

SEQ ID NO: 8241042 - DNA, 21 bp, Homo sapiens
cctggctgcacagttgctggt

SEQ ID NO: 8241043 - DNA, 22 bp, Homo sapiens
tgtgaggtaacgctgctctgtt

SEQ ID NO: 8241044 - DNA, 21 bp, Homo sapiens
cctggctgcacagttgctggt

SEQ ID NO: 8241045 - DNA, 20 bp, Homo sapiens
cctggctgcattcaggacgg

SEQ ID NO: 8241046 - DNA, 22 bp, Homo sapiens
cctggctgcagtttttgcagaa

SEQ ID NO: 8241047 - DNA, 22 bp, Homo sapiens
tgtgagggttttaagggaatga

SEQ ID NO: 8241048 - DNA, 22 bp, Homo sapiens
tgtgaggctacctgccagggtc

SEQ ID NO: 8241049 - DNA, 22 bp, Homo sapiens
tgtgaggcgaggccagtgagct

SEQ ID NO: 8241050 - DNA, 22 bp, Homo sapiens
tgtgaggatggagttctacagg

SEQ ID NO: 8241051 - DNA, 22 bp, Homo sapiens
tgtgaggcgaggccagtgagct

SEQ ID NO: 8241052 - DNA, 22 bp, Homo sapiens
tgtgaggcctctgcaggagcag

SEQ ID NO: 8241053 - DNA, 22 bp, Homo sapiens
tgtgaggcctagacagcctggg

SEQ ID NO: 8241054 - DNA, 22 bp, Homo sapiens
tgtgaggcctctgcaggagcag

SEQ ID NO: 8241055 - DNA, 22 bp, Homo sapiens
tgtgagcagagacatgaaaagc

SEQ ID NO: 8241056 - DNA, 20 bp, Homo sapiens
tgtgagcagatgctgagtga

SEQ ID NO: 8241057 - DNA, 22 bp, Homo sapiens
tgtgaggaacaggactagagca

SEQ ID NO: 8241058 - DNA, 22 bp, Homo sapiens
tgtgagcttaggacagggctat

SEQ ID NO: 8241059 - DNA, 20 bp, Homo sapiens
tgtgaggagcatggccgctg

SEQ ID NO: 8241060 - DNA, 22 bp, Homo sapiens
tgtgaggacattggaggactca

SEQ ID NO: 8241061 - DNA, 22 bp, Homo sapiens
tgtgaggacattggaggactca

SEQ ID NO: 8241062 - DNA, 22 bp, Homo sapiens
tgtgaggataaaaaggaaggag

SEQ ID NO: 8241063 - DNA, 22 bp, Homo sapiens
tgtgaggagtaggctgagggtg

SEQ ID NO: 8241064 - DNA, 23 bp, Homo sapiens
tgtgaaggtgggtccaagggctg

SEQ ID NO: 8241065 - DNA, 22 bp, Homo sapiens
tgtgaaggtaaggaggggcaag

SEQ ID NO: 8241066 - DNA, 22 bp, Homo sapiens
tgtgaaggcagcagctctgtcc

SEQ ID NO: 8241067 - DNA, 22 bp, Homo sapiens
tgtgaaggcagagccagtgaaa

SEQ ID NO: 8241068 - DNA, 22 bp, Homo sapiens
tgtgaaggagatgaagggagtg

SEQ ID NO: 8241069 - DNA, 22 bp, Homo sapiens
tgtgaagctggatcctggagct

SEQ ID NO: 8241070 - DNA, 22 bp, Homo sapiens
tgtgaaggagcatgcagagggg

SEQ ID NO: 8241071 - DNA, 22 bp, Homo sapiens
tgtgaaggcagagccagtgaaa

SEQ ID NO: 8241072 - DNA, 22 bp, Homo sapiens
tgtgaaggcagagccagtgaaa

SEQ ID NO: 8241073 - DNA, 22 bp, Homo sapiens
tgtgaagagtagacatgtggtg

SEQ ID NO: 8241074 - DNA, 22 bp, Homo sapiens
tgtgaagatcagggtcctagag

SEQ ID NO: 8241075 - DNA, 22 bp, Homo sapiens
tgtgaagatttggcatgcagaa

SEQ ID NO: 8241076 - DNA, 22 bp, Homo sapiens
tgtgaagatagctgttacatct

SEQ ID NO: 8241077 - DNA, 22 bp, Homo sapiens
tgtgaagcatagattctgtaga

SEQ ID NO: 8241078 - DNA, 22 bp, Homo sapiens
tgtgaagcatagattctgtaga

SEQ ID NO: 8241079 - DNA, 22 bp, Homo sapiens
tgtgaagcatagattctgtaga

SEQ ID NO: 8241080 - DNA, 20 bp, Homo sapiens
tgtgaagcaggagggtggtt

SEQ ID NO: 8241081 - DNA, 22 bp, Homo sapiens
tgtgaagcatagattctgtaga

SEQ ID NO: 8241082 - DNA, 22 bp, Homo sapiens
tgtgaagaattaatgtgaatca

SEQ ID NO: 8241083 - DNA, 22 bp, Homo sapiens
tgtgaacttaagattccttatc

SEQ ID NO: 8241084 - DNA, 22 bp, Homo sapiens
tgtgaagagagtaataaagtca

SEQ ID NO: 8241085 - DNA, 22 bp, Homo sapiens
tgtgaagaattaatgtgaatca

SEQ ID NO: 8241086 - DNA, 22 bp, Homo sapiens
tgtgaagaattaatgtgaatca

SEQ ID NO: 8241087 - DNA, 22 bp, Homo sapiens
tgtctttggaatatttagctga

SEQ ID NO: 8241088 - DNA, 22 bp, Homo sapiens
tgtctttggaatatttagctga

SEQ ID NO: 8241089 - DNA, 22 bp, Homo sapiens
tgtctttggaatatttagctga

SEQ ID NO: 8241090 - DNA, 22 bp, Homo sapiens
tgtctttggaatatttagctga

SEQ ID NO: 8241091 - DNA, 18 bp, Homo sapiens
tgtctttggaccactgaa

SEQ ID NO: 8241092 - DNA, 21 bp, Homo sapiens
tgtctttggcctcattcccag

SEQ ID NO: 8241093 - DNA, 22 bp, Homo sapiens
tgtctttctatctctagattta

SEQ ID NO: 8241094 - DNA, 22 bp, Homo sapiens
tgtctttctgacccaaggtagt

SEQ ID NO: 8241095 - DNA, 22 bp, Homo sapiens
tgtctttctgcaccacctcaca

SEQ ID NO: 8241096 - DNA, 22 bp, Homo sapiens
tgtctttctatctctagattta

SEQ ID NO: 8241097 - DNA, 20 bp, Homo sapiens
tgtctttccatggctggatc

SEQ ID NO: 8241098 - DNA, 20 bp, Homo sapiens
cctgggaaggcagccccagc

SEQ ID NO: 8241099 - DNA, 22 bp, Homo sapiens
cctgggaagcccatagcagctt

SEQ ID NO: 8241100 - DNA, 20 bp, Homo sapiens
cctgggaaggcagccccagc

SEQ ID NO: 8241101 - DNA, 22 bp, Homo sapiens
cctgggaagagctgacaggagg

SEQ ID NO: 8241102 - DNA, 22 bp, Homo sapiens
cctgggaagagctgacaggagg

SEQ ID NO: 8241103 - DNA, 22 bp, Homo sapiens
cctgggaagaccggcagtgggg

SEQ ID NO: 8241104 - DNA, 22 bp, Homo sapiens
cctgggaagcccatagcagctt

SEQ ID NO: 8241105 - DNA, 22 bp, Homo sapiens
cctgggagagccatctgtggcc

SEQ ID NO: 8241106 - DNA, 22 bp, Homo sapiens
cctgggagagccatctgtggcc

SEQ ID NO: 8241107 - DNA, 22 bp, Homo sapiens
cctgggagagccatctgtggcc

SEQ ID NO: 8241108 - DNA, 22 bp, Homo sapiens
cctgggagagctgcccgggtga

SEQ ID NO: 8241109 - DNA, 22 bp, Homo sapiens
cctgggagagtctgtggtctcc

SEQ ID NO: 8241110 - DNA, 22 bp, Homo sapiens
cctgggagagtctgtggtctcc

SEQ ID NO: 8241111 - DNA, 22 bp, Homo sapiens
cctgggagagtctgtggtctcc

SEQ ID NO: 8241112 - DNA, 22 bp, Homo sapiens
cctgggagagctgcccgggtga

SEQ ID NO: 8241113 - DNA, 22 bp, Homo sapiens
cctgggagagtctgtggtctcc

SEQ ID NO: 8241114 - DNA, 22 bp, Homo sapiens
cctgggagccgactgactgtgc

SEQ ID NO: 8241115 - DNA, 22 bp, Homo sapiens
cctgggagccgactgactgtgc

SEQ ID NO: 8241116 - DNA, 22 bp, Homo sapiens
cctgggagccgactgactgtgc

SEQ ID NO: 8241117 - DNA, 22 bp, Homo sapiens
cctgggagctgtggaaaggctg

SEQ ID NO: 8241118 - DNA, 22 bp, Homo sapiens
tgtgccaggcacttgcccaggc

SEQ ID NO: 8241119 - DNA, 22 bp, Homo sapiens
tgtgccaggcacttgcccaggc

SEQ ID NO: 8241120 - DNA, 22 bp, Homo sapiens
tgtgccagcctctggctgtgtc

SEQ ID NO: 8241121 - DNA, 22 bp, Homo sapiens
tgtgccagcctctggctgtgtc

SEQ ID NO: 8241122 - DNA, 22 bp, Homo sapiens
tgtgccagcctctggctgtgtc

SEQ ID NO: 8241123 - DNA, 22 bp, Homo sapiens
tgtgccagcctctggctgtgtc

SEQ ID NO: 8241124 - DNA, 22 bp, Homo sapiens
cctgggagccaagcctctgtgt

SEQ ID NO: 8241125 - DNA, 21 bp, Homo sapiens
cctgggagatcagctgccttc

SEQ ID NO: 8241126 - DNA, 22 bp, Homo sapiens
cctgggagccaagcctctgtgt

SEQ ID NO: 8241127 - DNA, 22 bp, Homo sapiens
cctgggagccaagcctctgtgt

SEQ ID NO: 8241128 - DNA, 22 bp, Homo sapiens
cctgggagccaagcctctgtgt

SEQ ID NO: 8241129 - DNA, 21 bp, Homo sapiens
cctgggagatcagctgccttc

SEQ ID NO: 8241130 - DNA, 21 bp, Homo sapiens
cctgggagatcagctgccttc

SEQ ID NO: 8241131 - DNA, 21 bp, Homo sapiens
cctgggagatcagctgccttc

SEQ ID NO: 8241132 - DNA, 21 bp, Homo sapiens
cctgggagatcagctgccttc

SEQ ID NO: 8241133 - DNA, 21 bp, Homo sapiens
cctgggagatcagctgccttc

SEQ ID NO: 8241134 - DNA, 22 bp, Homo sapiens
tgtgcttctctttctcacttaa

SEQ ID NO: 8241135 - DNA, 22 bp, Homo sapiens
tgtgcttctcacatcactgttg

SEQ ID NO: 8241136 - DNA, 22 bp, Homo sapiens
tgtgcttctgcagagactattt

SEQ ID NO: 8241137 - DNA, 22 bp, Homo sapiens
tgtgcttctgcagagactattt

SEQ ID NO: 8241138 - DNA, 22 bp, Homo sapiens
tgtgcttactttgaattatata

SEQ ID NO: 8241139 - DNA, 22 bp, Homo sapiens
tgtgcccattccacttgagtac

SEQ ID NO: 8241140 - DNA, 22 bp, Homo sapiens
tgtgcccattccacttgagtac

SEQ ID NO: 8241141 - DNA, 22 bp, Homo sapiens
tgtgctgggaaatggcaggata

SEQ ID NO: 8241142 - DNA, 22 bp, Homo sapiens
tgtgctgggaaatggcaggata

SEQ ID NO: 8241143 - DNA, 22 bp, Homo sapiens
tgtgctgggagatagagggagg

SEQ ID NO: 8241144 - DNA, 22 bp, Homo sapiens
tgtgctgggagatagagggagg

SEQ ID NO: 8241145 - DNA, 22 bp, Homo sapiens
tgtgctggggtccagctgagcc

SEQ ID NO: 8241146 - DNA, 22 bp, Homo sapiens
tgtgctggtacatgtgaggatg

SEQ ID NO: 8241147 - DNA, 22 bp, Homo sapiens
tgtgctggggtccagctgagcc

SEQ ID NO: 8241148 - DNA, 22 bp, Homo sapiens
tgtgctggggtccagctgagcc

SEQ ID NO: 8241149 - DNA, 22 bp, Homo sapiens
tgtgctggggtccagctgagcc

SEQ ID NO: 8241150 - DNA, 22 bp, Homo sapiens
tgtgctggggtccagctgagcc

SEQ ID NO: 8241151 - DNA, 20 bp, Homo sapiens
tgtgcccaatgtccaggttc

SEQ ID NO: 8241152 - DNA, 22 bp, Homo sapiens
tgtgcccattacacagaggcat

SEQ ID NO: 8241153 - DNA, 22 bp, Homo sapiens
tgtgcccattacacagaggcat

SEQ ID NO: 8241154 - DNA, 22 bp, Homo sapiens
tgtgcccatccctctggagtgt

SEQ ID NO: 8241155 - DNA, 22 bp, Homo sapiens
tgtgcccatccctctggagtgt

SEQ ID NO: 8241156 - DNA, 22 bp, Homo sapiens
tgtgccagtgccttgggtatta

SEQ ID NO: 8241157 - DNA, 22 bp, Homo sapiens
tgtgccagtcatccagatgtgt

SEQ ID NO: 8241158 - DNA, 22 bp, Homo sapiens
tgtgccaggggccgcttgcctt

SEQ ID NO: 8241159 - DNA, 22 bp, Homo sapiens
tgtgccagggcctccaaaagcc

SEQ ID NO: 8241160 - DNA, 22 bp, Homo sapiens
tgtgccagttttgtctaagccc

SEQ ID NO: 8241161 - DNA, 22 bp, Homo sapiens
tgtgccagttttgtctaagccc

SEQ ID NO: 8241162 - DNA, 22 bp, Homo sapiens
tgtgccagttttgtctaagccc

SEQ ID NO: 8241163 - DNA, 23 bp, Homo sapiens
tgtgccattgaggctgaggctca

SEQ ID NO: 8241164 - DNA, 22 bp, Homo sapiens
tgtgcccaacgtgcaggtttgt

SEQ ID NO: 8241165 - DNA, 23 bp, Homo sapiens
tgtgccattgaggctgaggctca

SEQ ID NO: 8241166 - DNA, 22 bp, Homo sapiens
cctggctttgaccttgctgttt

SEQ ID NO: 8241167 - DNA, 22 bp, Homo sapiens
cctgggaacagcagagtcctgg

SEQ ID NO: 8241168 - DNA, 22 bp, Homo sapiens
cctgggaaagtgaggtcattat

SEQ ID NO: 8241169 - DNA, 22 bp, Homo sapiens
cctgggaaagtgaggtcattat

SEQ ID NO: 8241170 - DNA, 23 bp, Homo sapiens
cctgggaaaactgctgatcttgc

SEQ ID NO: 8241171 - DNA, 22 bp, Homo sapiens
cctgggaagaccggcagtgggg

SEQ ID NO: 8241172 - DNA, 22 bp, Homo sapiens
cctgggaagaccggcagtgggg

SEQ ID NO: 8241173 - DNA, 22 bp, Homo sapiens
cctgggaacagtgggttggctc

SEQ ID NO: 8241174 - DNA, 18 bp, Homo sapiens
cctggcttttctacttgc

SEQ ID NO: 8241175 - DNA, 23 bp, Homo sapiens
cctgggaaaactgctgatcttgc

SEQ ID NO: 8241176 - DNA, 22 bp, Homo sapiens
cctggctgtggcggtgctctca

SEQ ID NO: 8241177 - DNA, 22 bp, Homo sapiens
cctggctgtggcggtgctctca

SEQ ID NO: 8241178 - DNA, 22 bp, Homo sapiens
cctggctgtggcggtgctctca

SEQ ID NO: 8241179 - DNA, 22 bp, Homo sapiens
cctggctgtggcggtgctctca

SEQ ID NO: 8241180 - DNA, 22 bp, Homo sapiens
cctggctgtttatttcggggct

SEQ ID NO: 8241181 - DNA, 22 bp, Homo sapiens
cctggctgtttatttcggggct

SEQ ID NO: 8241182 - DNA, 22 bp, Homo sapiens
cctggctgtgtgaccttggcaa

SEQ ID NO: 8241183 - DNA, 22 bp, Homo sapiens
cctggctgtgtgaccttggcaa

SEQ ID NO: 8241184 - DNA, 22 bp, Homo sapiens
cctggctgtgtgaccttggcaa

SEQ ID NO: 8241185 - DNA, 22 bp, Homo sapiens
cctggctgtttgagcggggaat

SEQ ID NO: 8241186 - DNA, 22 bp, Homo sapiens
cctggctgtttgagcggggaat

SEQ ID NO: 8241187 - DNA, 22 bp, Homo sapiens
cctggctgtttgagcggggaat

SEQ ID NO: 8241188 - DNA, 22 bp, Homo sapiens
cctggctgcccatggaccctct

SEQ ID NO: 8241189 - DNA, 22 bp, Homo sapiens
cctggctgcccatggaccctct

SEQ ID NO: 8241190 - DNA, 22 bp, Homo sapiens
cctggctgcccatggaccctct

SEQ ID NO: 8241191 - DNA, 22 bp, Homo sapiens
cctggctgcattttgctggatg

SEQ ID NO: 8241192 - DNA, 22 bp, Homo sapiens
cctggctgcattttgctggatg

SEQ ID NO: 8241193 - DNA, 22 bp, Homo sapiens
cctggctgcattttgctggatg

SEQ ID NO: 8241194 - DNA, 22 bp, Homo sapiens
cctggctgcattttgctggatg

SEQ ID NO: 8241195 - DNA, 22 bp, Homo sapiens
cctggctgcattttgctggatg

SEQ ID NO: 8241196 - DNA, 20 bp, Homo sapiens
cctggctgcattcaggacgg

SEQ ID NO: 8241197 - DNA, 22 bp, Homo sapiens
cctggctgcattttgctggatg

SEQ ID NO: 8241198 - DNA, 20 bp, Homo sapiens
cctggctgcattcaggacgg

SEQ ID NO: 8241199 - DNA, 20 bp, Homo sapiens
cctggctgcattcaggacgg

SEQ ID NO: 8241200 - DNA, 22 bp, Homo sapiens
cctggctgccttgtgttgatct

SEQ ID NO: 8241201 - DNA, 22 bp, Homo sapiens
cctggctgccgagtgtgcagcg

SEQ ID NO: 8241202 - DNA, 22 bp, Homo sapiens
cctggctgccttgtgttgatct

SEQ ID NO: 8241203 - DNA, 22 bp, Homo sapiens
cctggctgctatagcagcatgt

SEQ ID NO: 8241204 - DNA, 22 bp, Homo sapiens
cctggctgctatagcagcatgt

SEQ ID NO: 8241205 - DNA, 22 bp, Homo sapiens
cctggctgctatagcagcatgt

SEQ ID NO: 8241206 - DNA, 22 bp, Homo sapiens
cctggctgctatagcagcatgt

SEQ ID NO: 8241207 - DNA, 22 bp, Homo sapiens
cctggctgccgagtgtgcagcg

SEQ ID NO: 8241208 - DNA, 22 bp, Homo sapiens
cctggctgcccatggaccctct

SEQ ID NO: 8241209 - DNA, 22 bp, Homo sapiens
cctggctgcccatggaccctct

SEQ ID NO: 8241210 - DNA, 22 bp, Homo sapiens
cctggctgccgagtgtgcagcg

SEQ ID NO: 8241211 - DNA, 22 bp, Homo sapiens
cctggctgccgagtgtgcagcg

SEQ ID NO: 8241212 - DNA, 22 bp, Homo sapiens
cctggctgtgcatgtttctatg

SEQ ID NO: 8241213 - DNA, 22 bp, Homo sapiens
cctggctgtgcattgccggccc

SEQ ID NO: 8241214 - DNA, 19 bp, Homo sapiens
cctggctgtgaagcctgca

SEQ ID NO: 8241215 - DNA, 19 bp, Homo sapiens
cctggctgtgaagcctgca

SEQ ID NO: 8241216 - DNA, 22 bp, Homo sapiens
cctggctgtgcatgtttctatg

SEQ ID NO: 8241217 - DNA, 19 bp, Homo sapiens
cctggctgtgaagcctgca

SEQ ID NO: 8241218 - DNA, 23 bp, Homo sapiens
cctggctgtggatttgggcctgc

SEQ ID NO: 8241219 - DNA, 22 bp, Homo sapiens
cctggctgtgcattgccggccc

SEQ ID NO: 8241220 - DNA, 23 bp, Homo sapiens
cctggctgtggatttgggcctgc

SEQ ID NO: 8241221 - DNA, 23 bp, Homo sapiens
cctggctgtggatttgggcctgc

SEQ ID NO: 8241222 - DNA, 23 bp, Homo sapiens
cctggctgtggatttgggcctgc

SEQ ID NO: 8241223 - DNA, 22 bp, Homo sapiens
cctggctgtcgttttgtgaaat

SEQ ID NO: 8241224 - DNA, 19 bp, Homo sapiens
cctggctgtgaagcctgca

SEQ ID NO: 8241225 - DNA, 22 bp, Homo sapiens
cctggctggttgtctgattcta

SEQ ID NO: 8241226 - DNA, 22 bp, Homo sapiens
cctggctgctgtcactgaccat

SEQ ID NO: 8241227 - DNA, 22 bp, Homo sapiens
cctggctggttgtctgattcta

SEQ ID NO: 8241228 - DNA, 22 bp, Homo sapiens
cctggctgctatagcagcatgt

SEQ ID NO: 8241229 - DNA, 22 bp, Homo sapiens
cctggctgctctgatgagcgcc

SEQ ID NO: 8241230 - DNA, 22 bp, Homo sapiens
cctggctgctgtcactgaccat

SEQ ID NO: 8241231 - DNA, 19 bp, Homo sapiens
tgtgtgggtttagagtagt

SEQ ID NO: 8241232 - DNA, 22 bp, Homo sapiens
tgtgtgggtggtaaggaaggcc

SEQ ID NO: 8241233 - DNA, 22 bp, Homo sapiens
tgtgtggtgaagcagagatgct

SEQ ID NO: 8241234 - DNA, 19 bp, Homo sapiens
tgtgtggttggtgaaactc

SEQ ID NO: 8241235 - DNA, 19 bp, Homo sapiens
tgtgtggttggtgaaactc

SEQ ID NO: 8241236 - DNA, 22 bp, Homo sapiens
tgtgtgtaaggaagctttatgg

SEQ ID NO: 8241237 - DNA, 22 bp, Homo sapiens
tgtgtgtataataatgtctgca

SEQ ID NO: 8241238 - DNA, 22 bp, Homo sapiens
tgtgtgtataataatgtctgca

SEQ ID NO: 8241239 - DNA, 22 bp, Homo sapiens
tgtgtgtcagtcttgtttaggg

SEQ ID NO: 8241240 - DNA, 22 bp, Homo sapiens
tgtgtgtatatgcatttatcta

SEQ ID NO: 8241241 - DNA, 22 bp, Homo sapiens
tgtgtgtatatgcatttatcta

SEQ ID NO: 8241242 - DNA, 22 bp, Homo sapiens
tgtgtgtatatgcatttatcta

SEQ ID NO: 8241243 - DNA, 22 bp, Homo sapiens
tgtgtgtatgtttacttttcct

SEQ ID NO: 8241244 - DNA, 21 bp, Homo sapiens
tgtgtgtatgcacacacatgc

SEQ ID NO: 8241245 - DNA, 22 bp, Homo sapiens
tgtgtgtctgcacatgtataat

SEQ ID NO: 8241246 - DNA, 22 bp, Homo sapiens
tgtgtgtcatttagggtggagc

SEQ ID NO: 8241247 - DNA, 22 bp, Homo sapiens
tgtgtgtctggaagctcaggga

SEQ ID NO: 8241248 - DNA, 22 bp, Homo sapiens
tgtgtgtctggaagctcaggga

SEQ ID NO: 8241249 - DNA, 22 bp, Homo sapiens
cctgggcctctcaaagtgctgg

SEQ ID NO: 8241250 - DNA, 22 bp, Homo sapiens
cctgggctttggaacagtactt

SEQ ID NO: 8241251 - DNA, 22 bp, Homo sapiens
cctgggctttgctggcaaggcc

SEQ ID NO: 8241252 - DNA, 22 bp, Homo sapiens
cctgggctttggaacagtactt

SEQ ID NO: 8241253 - DNA, 22 bp, Homo sapiens
cctgggctttgctggcaaggcc

SEQ ID NO: 8241254 - DNA, 22 bp, Homo sapiens
cctggggaagtcacttctcttt

SEQ ID NO: 8241255 - DNA, 22 bp, Homo sapiens
cctggggaagtcacttctcttt

SEQ ID NO: 8241256 - DNA, 22 bp, Homo sapiens
cctggggaagtcacttctcttt

SEQ ID NO: 8241257 - DNA, 22 bp, Homo sapiens
cctggggaatagagtcaagggg

SEQ ID NO: 8241258 - DNA, 22 bp, Homo sapiens
cctggggaatagagtcaagggg

SEQ ID NO: 8241259 - DNA, 22 bp, Homo sapiens
cctggggaatcttgcaggggaa

SEQ ID NO: 8241260 - DNA, 22 bp, Homo sapiens
cctggggaatcttgcaggggaa

SEQ ID NO: 8241261 - DNA, 22 bp, Homo sapiens
cctgggcttccacgagcagagg

SEQ ID NO: 8241262 - DNA, 22 bp, Homo sapiens
cctgggctcaagtgatcctcct

SEQ ID NO: 8241263 - DNA, 22 bp, Homo sapiens
cctgggctcaagcgatcttgtc

SEQ ID NO: 8241264 - DNA, 22 bp, Homo sapiens
cctgggctttgctggcaaggcc

SEQ ID NO: 8241265 - DNA, 22 bp, Homo sapiens
cctgggcttccacgagcagagg

SEQ ID NO: 8241266 - DNA, 22 bp, Homo sapiens
cctgggcttccacgagcagagg

SEQ ID NO: 8241267 - DNA, 22 bp, Homo sapiens
cctgggctttgctggcaaggcc

SEQ ID NO: 8241268 - DNA, 20 bp, Homo sapiens
cctgggctcaaagcatcctc

SEQ ID NO: 8241269 - DNA, 20 bp, Homo sapiens
cctgggctcaaagcatcctc

SEQ ID NO: 8241270 - DNA, 20 bp, Homo sapiens
cctgggctcaaagcatcctc

SEQ ID NO: 8241271 - DNA, 20 bp, Homo sapiens
cctgggctcaaagcatcctc

SEQ ID NO: 8241272 - DNA, 22 bp, Homo sapiens
cctgggccttgacctcgtgggc

SEQ ID NO: 8241273 - DNA, 23 bp, Homo sapiens
tgtgttctcacacagatgcagta

SEQ ID NO: 8241274 - DNA, 22 bp, Homo sapiens
cctggggctccagagcagcgga

SEQ ID NO: 8241275 - DNA, 22 bp, Homo sapiens
cctggggctccagagcagcgga

SEQ ID NO: 8241276 - DNA, 22 bp, Homo sapiens
cctggggctccagagcagcgga

SEQ ID NO: 8241277 - DNA, 22 bp, Homo sapiens
cctggggctccagagcagcgga

SEQ ID NO: 8241278 - DNA, 19 bp, Homo sapiens
cctgggtccactcagacta

SEQ ID NO: 8241279 - DNA, 19 bp, Homo sapiens
cctgggtccactcagacta

SEQ ID NO: 8241280 - DNA, 22 bp, Homo sapiens
tgtgttcatttaactgttcttt

SEQ ID NO: 8241281 - DNA, 22 bp, Homo sapiens
tgtgttcctgcctggctctggt

SEQ ID NO: 8241282 - DNA, 22 bp, Homo sapiens
tgtgttccttaaaggatgggca

SEQ ID NO: 8241283 - DNA, 22 bp, Homo sapiens
tgtgttctatggttcagggtgg

SEQ ID NO: 8241284 - DNA, 22 bp, Homo sapiens
tgtgttcaatccctagtctcag

SEQ ID NO: 8241285 - DNA, 22 bp, Homo sapiens
tgtgttcaatccctagtctcag

SEQ ID NO: 8241286 - DNA, 22 bp, Homo sapiens
cctggggagaagagcttccccc

SEQ ID NO: 8241287 - DNA, 22 bp, Homo sapiens
cctggggacctgcctcagccct

SEQ ID NO: 8241288 - DNA, 22 bp, Homo sapiens
cctggggacctgcctcagccct

SEQ ID NO: 8241289 - DNA, 22 bp, Homo sapiens
cctggggacctgcctcagccct

SEQ ID NO: 8241290 - DNA, 22 bp, Homo sapiens
tgtgttcagaatttgctgcttt

SEQ ID NO: 8241291 - DNA, 23 bp, Homo sapiens
tgtgttcagtcaaggatcagagt

SEQ ID NO: 8241292 - DNA, 22 bp, Homo sapiens
cctgggtgacagagtgagacct

SEQ ID NO: 8241293 - DNA, 22 bp, Homo sapiens
cctgggtgatgtgctgccctcg

SEQ ID NO: 8241294 - DNA, 22 bp, Homo sapiens
cctgggtgacccgtgagcgtcc

SEQ ID NO: 8241295 - DNA, 22 bp, Homo sapiens
cctgggtgcccggcccttctct

SEQ ID NO: 8241296 - DNA, 22 bp, Homo sapiens
cctgggtgatgtgctgccctcg

SEQ ID NO: 8241297 - DNA, 22 bp, Homo sapiens
cctgggtgatgtgctgccctcg

SEQ ID NO: 8241298 - DNA, 22 bp, Homo sapiens
cctgggtgatgtgctgccctcg

SEQ ID NO: 8241299 - DNA, 22 bp, Homo sapiens
cctgggtgacagagtgagacct

SEQ ID NO: 8241300 - DNA, 22 bp, Homo sapiens
cctgggtgacagagtgagacct

SEQ ID NO: 8241301 - DNA, 22 bp, Homo sapiens
cctgggtgaaatctctcctgca

SEQ ID NO: 8241302 - DNA, 22 bp, Homo sapiens
cctgggtgaatgatattctaaa

SEQ ID NO: 8241303 - DNA, 22 bp, Homo sapiens
cctgggtgacagagtgagacct

SEQ ID NO: 8241304 - DNA, 22 bp, Homo sapiens
cctgggtgaaatctctcctgca

SEQ ID NO: 8241305 - DNA, 22 bp, Homo sapiens
cctgggtgaaatctctcctgca

SEQ ID NO: 8241306 - DNA, 22 bp, Homo sapiens
cctgggtgaaatctctcctgca

SEQ ID NO: 8241307 - DNA, 22 bp, Homo sapiens
cctgggtgaaatagtcctcaag

SEQ ID NO: 8241308 - DNA, 22 bp, Homo sapiens
cctgggtgaaatagtcctcaag

SEQ ID NO: 8241309 - DNA, 22 bp, Homo sapiens
cctgggtctcctcctgctggct

SEQ ID NO: 8241310 - DNA, 22 bp, Homo sapiens
cctgggtcccagccaggctttg

SEQ ID NO: 8241311 - DNA, 22 bp, Homo sapiens
cctgggtcttcagtctgctggt

SEQ ID NO: 8241312 - DNA, 22 bp, Homo sapiens
cctgggtcttcagtctgctggt

SEQ ID NO: 8241313 - DNA, 22 bp, Homo sapiens
cctgggtcttggttcatgctct

SEQ ID NO: 8241314 - DNA, 22 bp, Homo sapiens
cctgggtcttggttcatgctct

SEQ ID NO: 8241315 - DNA, 22 bp, Homo sapiens
cctgggtctgtattggtaggta

SEQ ID NO: 8241316 - DNA, 20 bp, Homo sapiens
tgtggaaaaacagaagcaga

SEQ ID NO: 8241317 - DNA, 20 bp, Homo sapiens
tgtggaaaaacagaagcaga

SEQ ID NO: 8241318 - DNA, 22 bp, Homo sapiens
tgtgcttttctctgctcctgga

SEQ ID NO: 8241319 - DNA, 22 bp, Homo sapiens
tgtgcttcttgcagctcctgta

SEQ ID NO: 8241320 - DNA, 22 bp, Homo sapiens
tgtgctttcaaagttaagtaaa

SEQ ID NO: 8241321 - DNA, 22 bp, Homo sapiens
tgtgctttcaaagttaagtaaa

SEQ ID NO: 8241322 - DNA, 22 bp, Homo sapiens
tgtggcagctggaggtggagaa

SEQ ID NO: 8241323 - DNA, 22 bp, Homo sapiens
tgtggcagctggaggtggagaa

SEQ ID NO: 8241324 - DNA, 22 bp, Homo sapiens
tgtggaaaaaccacaagtttgg

SEQ ID NO: 8241325 - DNA, 20 bp, Homo sapiens
tgtggcaggatgagggcgga

SEQ ID NO: 8241326 - DNA, 20 bp, Homo sapiens
tgtggcaggatgagggcgga

SEQ ID NO: 8241327 - DNA, 22 bp, Homo sapiens
tgtggcaggaagagcttctgag

SEQ ID NO: 8241328 - DNA, 22 bp, Homo sapiens
tgtggcaggaagagcttctgag

SEQ ID NO: 8241329 - DNA, 22 bp, Homo sapiens
tgtggcaggaagagcttctgag

SEQ ID NO: 8241330 - DNA, 22 bp, Homo sapiens
tgtggcagggatactgaggcag

SEQ ID NO: 8241331 - DNA, 22 bp, Homo sapiens
tgtggcagggatactgaggcag

SEQ ID NO: 8241332 - DNA, 22 bp, Homo sapiens
tgtggctgctcaggtgcagacc

SEQ ID NO: 8241333 - DNA, 22 bp, Homo sapiens
tgtggctgctcaggtgcagacc

SEQ ID NO: 8241334 - DNA, 21 bp, Homo sapiens
tgtggctgcctctggccctgg

SEQ ID NO: 8241335 - DNA, 21 bp, Homo sapiens
tgtggctgcctctggccctgg

SEQ ID NO: 8241336 - DNA, 22 bp, Homo sapiens
tgtggcagggatactgaggcag

SEQ ID NO: 8241337 - DNA, 22 bp, Homo sapiens
tgtggcaggcattctgaggctg

SEQ ID NO: 8241338 - DNA, 22 bp, Homo sapiens
tgtggcaggcattctgaggctg

SEQ ID NO: 8241339 - DNA, 22 bp, Homo sapiens
tgtggcaggcattctgaggctg

SEQ ID NO: 8241340 - DNA, 20 bp, Homo sapiens
tgtggcaggatgagggcgga

SEQ ID NO: 8241341 - DNA, 22 bp, Homo sapiens
tgtggcaggcaagatgtacaga

SEQ ID NO: 8241342 - DNA, 22 bp, Homo sapiens
cctgggaggcagaggttgcagt

SEQ ID NO: 8241343 - DNA, 22 bp, Homo sapiens
cctgggaggcagaggttgcagt

SEQ ID NO: 8241344 - DNA, 19 bp, Homo sapiens
cctgggaggcggaggttgc

SEQ ID NO: 8241345 - DNA, 22 bp, Homo sapiens
cctgggagctgtggaaaggctg

SEQ ID NO: 8241346 - DNA, 17 bp, Homo sapiens
cctgggaggagttatga

SEQ ID NO: 8241347 - DNA, 22 bp, Homo sapiens
cctgggaggcagaggttgcagt

SEQ ID NO: 8241348 - DNA, 22 bp, Homo sapiens
cctgggaggcagaggttgcagt

SEQ ID NO: 8241349 - DNA, 22 bp, Homo sapiens
cctgggagctgtggaaaggctg

SEQ ID NO: 8241350 - DNA, 22 bp, Homo sapiens
cctgggagctgtggaaaggctg

SEQ ID NO: 8241351 - DNA, 22 bp, Homo sapiens
cctgggagctgtggaaaggctg

SEQ ID NO: 8241352 - DNA, 22 bp, Homo sapiens
cctgggagctgtggaaaggctg

SEQ ID NO: 8241353 - DNA, 22 bp, Homo sapiens
cctgggagctgtggaaaggctg

SEQ ID NO: 8241354 - DNA, 22 bp, Homo sapiens
tgtggcttttgctagctttgca

SEQ ID NO: 8241355 - DNA, 22 bp, Homo sapiens
tgtggcttttgctagctttgca

SEQ ID NO: 8241356 - DNA, 22 bp, Homo sapiens
tgtggctgttgaggaccccaag

SEQ ID NO: 8241357 - DNA, 22 bp, Homo sapiens
tgtggctgttgaggaccccaag

SEQ ID NO: 8241358 - DNA, 22 bp, Homo sapiens
tgtggctgtggatgctttccag

SEQ ID NO: 8241359 - DNA, 22 bp, Homo sapiens
tgtggctgtggatgctttccag

SEQ ID NO: 8241360 - DNA, 22 bp, Homo sapiens
tgtggctgtgtccacctgctgc

SEQ ID NO: 8241361 - DNA, 22 bp, Homo sapiens
tgtggctgtggttttcataaat

SEQ ID NO: 8241362 - DNA, 22 bp, Homo sapiens
tgtggctgtgtccacctgctgc

SEQ ID NO: 8241363 - DNA, 22 bp, Homo sapiens
tgtggctgtctgttctcctagg

SEQ ID NO: 8241364 - DNA, 18 bp, Homo sapiens
tgtggctggtccacactg

SEQ ID NO: 8241365 - DNA, 22 bp, Homo sapiens
tgtggctggtctccgagcgtcg

SEQ ID NO: 8241366 - DNA, 22 bp, Homo sapiens
tgtggctgtctgttctcctagg

SEQ ID NO: 8241367 - DNA, 22 bp, Homo sapiens
tgtggctgtgccgtcacacgtg

SEQ ID NO: 8241368 - DNA, 22 bp, Homo sapiens
tgtggctgctcctgggtggtca

SEQ ID NO: 8241369 - DNA, 22 bp, Homo sapiens
tgtggctgctcctgggtggtca

SEQ ID NO: 8241370 - DNA, 22 bp, Homo sapiens
tgtggctgctcctgggtggtca

SEQ ID NO: 8241371 - DNA, 22 bp, Homo sapiens
tgtggctgctcctgggtggtca

SEQ ID NO: 8241372 - DNA, 22 bp, Homo sapiens
tgtggctggattgattttacct

SEQ ID NO: 8241373 - DNA, 15 bp, Homo sapiens
tgtggctggctcctg

SEQ ID NO: 8241374 - DNA, 22 bp, Homo sapiens
tgtggctgggaagaaggtaact

SEQ ID NO: 8241375 - DNA, 18 bp, Homo sapiens
tgtggctggtccacactg

SEQ ID NO: 8241376 - DNA, 22 bp, Homo sapiens
tgtggctgggctaataggcaaa

SEQ ID NO: 8241377 - DNA, 22 bp, Homo sapiens
cctgggaggcggaggttgcagt

SEQ ID NO: 8241378 - DNA, 22 bp, Homo sapiens
cctgggaggcggaggttgcagg

SEQ ID NO: 8241379 - DNA, 22 bp, Homo sapiens
cctgggaggcggaggttgcagg

SEQ ID NO: 8241380 - DNA, 22 bp, Homo sapiens
cctgggaggcggaggttgcagt

SEQ ID NO: 8241381 - DNA, 22 bp, Homo sapiens
cctgggaggcggaggttgcagt

SEQ ID NO: 8241382 - DNA, 19 bp, Homo sapiens
cctgggaggcggaggttgc

SEQ ID NO: 8241383 - DNA, 22 bp, Homo sapiens
cctgggaggcggaggttgcagg

SEQ ID NO: 8241384 - DNA, 19 bp, Homo sapiens
cctgggaggcggaggttgc

SEQ ID NO: 8241385 - DNA, 19 bp, Homo sapiens
cctgggaggcggaggttgc

SEQ ID NO: 8241386 - DNA, 22 bp, Homo sapiens
cctgggaggcggaggttgcagg

SEQ ID NO: 8241387 - DNA, 22 bp, Homo sapiens
cctgggaggcggaggttgcagt

SEQ ID NO: 8241388 - DNA, 22 bp, Homo sapiens
cctgggcaatatagtgaggccc

SEQ ID NO: 8241389 - DNA, 22 bp, Homo sapiens
cctgggcagcctgctcaaggac

SEQ ID NO: 8241390 - DNA, 22 bp, Homo sapiens
cctgggccctcaccgccggtgg

SEQ ID NO: 8241391 - DNA, 22 bp, Homo sapiens
cctgggcatctcatgcacctgc

SEQ ID NO: 8241392 - DNA, 22 bp, Homo sapiens
cctgggcatctcatgcacctgc

SEQ ID NO: 8241393 - DNA, 22 bp, Homo sapiens
cctgggcatctcatgcacctgc

SEQ ID NO: 8241394 - DNA, 22 bp, Homo sapiens
cctgggcatctcatgcacctgc

SEQ ID NO: 8241395 - DNA, 23 bp, Homo sapiens
cctgggcattggctgcagcttct

SEQ ID NO: 8241396 - DNA, 23 bp, Homo sapiens
cctgggcattggctgcagcttct

SEQ ID NO: 8241397 - DNA, 21 bp, Homo sapiens
cctgggccaaattccctggac

SEQ ID NO: 8241398 - DNA, 22 bp, Homo sapiens
tgtggggcagctagccggcctg

SEQ ID NO: 8241399 - DNA, 22 bp, Homo sapiens
cctgggcctcacccagctcttg

SEQ ID NO: 8241400 - DNA, 22 bp, Homo sapiens
cctgggcctcacccagctcttg

SEQ ID NO: 8241401 - DNA, 22 bp, Homo sapiens
cctgggcctcacccagctcttg

SEQ ID NO: 8241402 - DNA, 22 bp, Homo sapiens
tgtggggctgtcaggcaactgg

SEQ ID NO: 8241403 - DNA, 22 bp, Homo sapiens
tgtggggctccctggcagcctg

SEQ ID NO: 8241404 - DNA, 22 bp, Homo sapiens
tgtggggcctcgtgctagctgg

SEQ ID NO: 8241405 - DNA, 22 bp, Homo sapiens
tgtggggccaaagcccagccac

SEQ ID NO: 8241406 - DNA, 21 bp, Homo sapiens
tgtgtgggcatatctgctgca

SEQ ID NO: 8241407 - DNA, 21 bp, Homo sapiens
tgtgtgggcatatctgctgca

SEQ ID NO: 8241408 - DNA, 21 bp, Homo sapiens
tgtgtgggcatatctgctgca

SEQ ID NO: 8241409 - DNA, 22 bp, Homo sapiens
tgtgtctgtcctcggttgatgc

SEQ ID NO: 8241410 - DNA, 22 bp, Homo sapiens
tgtgtctgtcctcggttgatgc

SEQ ID NO: 8241411 - DNA, 22 bp, Homo sapiens
tgtgtgggcatgcttttaattt

SEQ ID NO: 8241412 - DNA, 22 bp, Homo sapiens
tgtgtgggcgaagacagccttt

SEQ ID NO: 8241413 - DNA, 22 bp, Homo sapiens
tgtgtgggtacagatgattgtt

SEQ ID NO: 8241414 - DNA, 22 bp, Homo sapiens
tgtgtggggaaggaaggagctg

SEQ ID NO: 8241415 - DNA, 22 bp, Homo sapiens
tgtggggctgtggtgttcttct

SEQ ID NO: 8241416 - DNA, 22 bp, Homo sapiens
tgtggggcttacaaaggcagat

SEQ ID NO: 8241417 - DNA, 22 bp, Homo sapiens
tgtgggggtacacgtacacatg

SEQ ID NO: 8241418 - DNA, 22 bp, Homo sapiens
tgtgggggtacacgtacacatg

SEQ ID NO: 8241419 - DNA, 22 bp, Homo sapiens
tgtgggggtacacgtacacatg

SEQ ID NO: 8241420 - DNA, 22 bp, Homo sapiens
gttggcacttcataatatgaaa

SEQ ID NO: 8241421 - DNA, 22 bp, Homo sapiens
gttggcacttagccccagtcta

SEQ ID NO: 8241422 - DNA, 22 bp, Homo sapiens
gttggcatagtcttttataatt

SEQ ID NO: 8241423 - DNA, 19 bp, Homo sapiens
gttggcactgaaaatggct

SEQ ID NO: 8241424 - DNA, 22 bp, Homo sapiens
gttggctatgagagctttagtg

SEQ ID NO: 8241425 - DNA, 22 bp, Homo sapiens
gttggctatgagagctttagtg

SEQ ID NO: 8241426 - DNA, 22 bp, Homo sapiens
gttggctatgagagctttagtg

SEQ ID NO: 8241427 - DNA, 22 bp, Homo sapiens
gttggccattaattggaggaca

SEQ ID NO: 8241428 - DNA, 22 bp, Homo sapiens
caggaaaggtagtcacaatgta

SEQ ID NO: 8241429 - DNA, 22 bp, Homo sapiens
caggaaaggtagtcacaatgta

SEQ ID NO: 8241430 - DNA, 22 bp, Homo sapiens
caggaaaggtgtgtcatgatgg

SEQ ID NO: 8241431 - DNA, 22 bp, Homo sapiens
caggaaagggatgggctgccac

SEQ ID NO: 8241432 - DNA, 22 bp, Homo sapiens
caggaaaggtagtcacaatgta

SEQ ID NO: 8241433 - DNA, 22 bp, Homo sapiens
caggaaagccgagtgccatagg

SEQ ID NO: 8241434 - DNA, 22 bp, Homo sapiens
caggaaagccgagtgccatagg

SEQ ID NO: 8241435 - DNA, 22 bp, Homo sapiens
caggaaagccgagtgccatagg

SEQ ID NO: 8241436 - DNA, 22 bp, Homo sapiens
caggaaagtctgtaaaggaacc

SEQ ID NO: 8241437 - DNA, 22 bp, Homo sapiens
caggaaatggggtttagttatt

SEQ ID NO: 8241438 - DNA, 22 bp, Homo sapiens
caggaaatagttcagtcaaact

SEQ ID NO: 8241439 - DNA, 22 bp, Homo sapiens
caggaacaatatctgtcctggt

SEQ ID NO: 8241440 - DNA, 22 bp, Homo sapiens
gttcttcagattccatttcagt

SEQ ID NO: 8241441 - DNA, 22 bp, Homo sapiens
gttcttcagattccatttcagt

SEQ ID NO: 8241442 - DNA, 22 bp, Homo sapiens
gttcttcagaggggaaagaacc

SEQ ID NO: 8241443 - DNA, 22 bp, Homo sapiens
gttcttcagccctcaggtccta

SEQ ID NO: 8241444 - DNA, 22 bp, Homo sapiens
gttgctgattaacactttgagt

SEQ ID NO: 8241445 - DNA, 22 bp, Homo sapiens
gttgctggaagctatggtccag

SEQ ID NO: 8241446 - DNA, 21 bp, Homo sapiens
gttctgttgactgtgggcatc

SEQ ID NO: 8241447 - DNA, 19 bp, Homo sapiens
gttctgtgtcctggaggaa

SEQ ID NO: 8241448 - DNA, 22 bp, Homo sapiens
gttctgtctgagcaccacagga

SEQ ID NO: 8241449 - DNA, 22 bp, Homo sapiens
gttcttcaaagtgacaactaaa

SEQ ID NO: 8241450 - DNA, 22 bp, Homo sapiens
gttcttcacatttcattgagga

SEQ ID NO: 8241451 - DNA, 22 bp, Homo sapiens
gttcttcaaagtgacaactaaa

SEQ ID NO: 8241452 - DNA, 22 bp, Homo sapiens
gttctgggagatcttgagcttc

SEQ ID NO: 8241453 - DNA, 22 bp, Homo sapiens
gttctgggtgatgaggttggct

SEQ ID NO: 8241454 - DNA, 22 bp, Homo sapiens
gttctgtactccaagctcttcc

SEQ ID NO: 8241455 - DNA, 22 bp, Homo sapiens
gttctgtctgagcaccacagga

SEQ ID NO: 8241456 - DNA, 22 bp, Homo sapiens
gttctgtcacacactggtactt

SEQ ID NO: 8241457 - DNA, 22 bp, Homo sapiens
gttctgtagtcatagagcaatt

SEQ ID NO: 8241458 - DNA, 22 bp, Homo sapiens
gttcacaggttctctttctaag

SEQ ID NO: 8241459 - DNA, 22 bp, Homo sapiens
gttcacagtgttttctttgcat

SEQ ID NO: 8241460 - DNA, 20 bp, Homo sapiens
gttcacaggcttcctttcag

SEQ ID NO: 8241461 - DNA, 22 bp, Homo sapiens
gttcccaggccctgggctctcc

SEQ ID NO: 8241462 - DNA, 22 bp, Homo sapiens
gttcccatcagggatgagggtg

SEQ ID NO: 8241463 - DNA, 22 bp, Homo sapiens
gttccccttgtgttgttgccca

SEQ ID NO: 8241464 - DNA, 22 bp, Homo sapiens
gttcccatacagtatcagtgct

SEQ ID NO: 8241465 - DNA, 22 bp, Homo sapiens
gttccctttcgtatggactggg

SEQ ID NO: 8241466 - DNA, 21 bp, Homo sapiens
gttcccttattggggcaggca

SEQ ID NO: 8241467 - DNA, 22 bp, Homo sapiens
gttcctaaatctggaggacctc

SEQ ID NO: 8241468 - DNA, 22 bp, Homo sapiens
gttcctaaccagcagagaaaca

SEQ ID NO: 8241469 - DNA, 22 bp, Homo sapiens
gttcctaaatttgaaggacttt

SEQ ID NO: 8241470 - DNA, 22 bp, Homo sapiens
gttcctaagctgtggccctgga

SEQ ID NO: 8241471 - DNA, 22 bp, Homo sapiens
gttcctaagcactgtgcattct

SEQ ID NO: 8241472 - DNA, 22 bp, Homo sapiens
gttcctgagaaataaagagaga

SEQ ID NO: 8241473 - DNA, 22 bp, Homo sapiens
gttcctggcattgtcagcggcc

SEQ ID NO: 8241474 - DNA, 22 bp, Homo sapiens
gttcctggcattgtcagcggcc

SEQ ID NO: 8241475 - DNA, 22 bp, Homo sapiens
gttctggagtggtgccaggcct

SEQ ID NO: 8241476 - DNA, 22 bp, Homo sapiens
caggaagattgtggaggtggtt

SEQ ID NO: 8241477 - DNA, 22 bp, Homo sapiens
caggaagattgtggaggtggtt

SEQ ID NO: 8241478 - DNA, 22 bp, Homo sapiens
caggaagattgtggaggtggtt

SEQ ID NO: 8241479 - DNA, 22 bp, Homo sapiens
caggaagattgtggaggtggtt

SEQ ID NO: 8241480 - DNA, 22 bp, Homo sapiens
caggaagcaagtgattttcttg

SEQ ID NO: 8241481 - DNA, 22 bp, Homo sapiens
caggaagcacagtgaggagacc

SEQ ID NO: 8241482 - DNA, 22 bp, Homo sapiens
caggaagcacagtgaggagacc

SEQ ID NO: 8241483 - DNA, 22 bp, Homo sapiens
caggaagcacagtgaggagacc

SEQ ID NO: 8241484 - DNA, 22 bp, Homo sapiens
caggaagcaccagcccggcccc

SEQ ID NO: 8241485 - DNA, 22 bp, Homo sapiens
caggaagattagaccaagagct

SEQ ID NO: 8241486 - DNA, 22 bp, Homo sapiens
caggaagattagaccaagagct

SEQ ID NO: 8241487 - DNA, 22 bp, Homo sapiens
caggaagattagaccaagagct

SEQ ID NO: 8241488 - DNA, 22 bp, Homo sapiens
gtttacagagacagaaagtagt

SEQ ID NO: 8241489 - DNA, 18 bp, Homo sapiens
gtttacacattctagaaa

SEQ ID NO: 8241490 - DNA, 22 bp, Homo sapiens
gtttacactccaggctggggtg

SEQ ID NO: 8241491 - DNA, 22 bp, Homo sapiens
gtttacagtggcttcattggat

SEQ ID NO: 8241492 - DNA, 22 bp, Homo sapiens
gtttacagtggcttcattggat

SEQ ID NO: 8241493 - DNA, 22 bp, Homo sapiens
gtttacagtactcacttgcatt

SEQ ID NO: 8241494 - DNA, 22 bp, Homo sapiens
gtttacagtactcacttgcatt

SEQ ID NO: 8241495 - DNA, 22 bp, Homo sapiens
gtttacatgcatgcaagaatga

SEQ ID NO: 8241496 - DNA, 22 bp, Homo sapiens
gtttacatattttaattggtga

SEQ ID NO: 8241497 - DNA, 22 bp, Homo sapiens
gtttacatgcagaaaatcaatg

SEQ ID NO: 8241498 - DNA, 22 bp, Homo sapiens
gtttacatgcagaaaatcaatg

SEQ ID NO: 8241499 - DNA, 23 bp, Homo sapiens
caggaagcagatggggtagaaga

SEQ ID NO: 8241500 - DNA, 22 bp, Homo sapiens
gtttacaacatcttgtccttca

SEQ ID NO: 8241501 - DNA, 22 bp, Homo sapiens
gtttacaacatgccaactgggc

SEQ ID NO: 8241502 - DNA, 21 bp, Homo sapiens
gtttacaaggctttgctcctg

SEQ ID NO: 8241503 - DNA, 22 bp, Homo sapiens
gtttacaacatgccaactgggc

SEQ ID NO: 8241504 - DNA, 22 bp, Homo sapiens
gtttacacataactcctatcaa

SEQ ID NO: 8241505 - DNA, 21 bp, Homo sapiens
gtttacaaggctttgctcctg

SEQ ID NO: 8241506 - DNA, 22 bp, Homo sapiens
caggaagagaacatggaggctg

SEQ ID NO: 8241507 - DNA, 22 bp, Homo sapiens
caggaacatttaaccacagggt

SEQ ID NO: 8241508 - DNA, 22 bp, Homo sapiens
caggaagaggacaggcttcccc

SEQ ID NO: 8241509 - DNA, 22 bp, Homo sapiens
caggaagaggtatcaccgagca

SEQ ID NO: 8241510 - DNA, 22 bp, Homo sapiens
caggaagaggtatcaccgagca

SEQ ID NO: 8241511 - DNA, 22 bp, Homo sapiens
caggaagaggtatcaccgagca

SEQ ID NO: 8241512 - DNA, 22 bp, Homo sapiens
caggaacagctgacctgacaat

SEQ ID NO: 8241513 - DNA, 22 bp, Homo sapiens
caggaacagggtgtcctggcag

SEQ ID NO: 8241514 - DNA, 22 bp, Homo sapiens
caggaacagctgacctgacaat

SEQ ID NO: 8241515 - DNA, 22 bp, Homo sapiens
caggaacacaagttcagggatg

SEQ ID NO: 8241516 - DNA, 22 bp, Homo sapiens
gtttcaaagcacagctcacatt

SEQ ID NO: 8241517 - DNA, 22 bp, Homo sapiens
gtttattgggtattgtggagcc

SEQ ID NO: 8241518 - DNA, 22 bp, Homo sapiens
gtttattgggtattgtggagcc

SEQ ID NO: 8241519 - DNA, 22 bp, Homo sapiens
gtttattgggtattgtggagcc

SEQ ID NO: 8241520 - DNA, 22 bp, Homo sapiens
gtttattgggtattgtggagcc

SEQ ID NO: 8241521 - DNA, 22 bp, Homo sapiens
gtttattgggtattgtggagcc

SEQ ID NO: 8241522 - DNA, 22 bp, Homo sapiens
gtttattgataaaagctggaca

SEQ ID NO: 8241523 - DNA, 22 bp, Homo sapiens
gtttattgataaaagctggaca

SEQ ID NO: 8241524 - DNA, 22 bp, Homo sapiens
gtttattcttcagcaacatctg

SEQ ID NO: 8241525 - DNA, 22 bp, Homo sapiens
gtttattccagcaatctgctta

SEQ ID NO: 8241526 - DNA, 22 bp, Homo sapiens
gtttattcttcagcaacatctg

SEQ ID NO: 8241527 - DNA, 22 bp, Homo sapiens
gtttattcttcagcaacatctg

SEQ ID NO: 8241528 - DNA, 22 bp, Homo sapiens
gtttattcttcagcaacatctg

SEQ ID NO: 8241529 - DNA, 22 bp, Homo sapiens
gtttattgataaaagctggaca

SEQ ID NO: 8241530 - DNA, 22 bp, Homo sapiens
gtttattgggtattgtggagcc

SEQ ID NO: 8241531 - DNA, 22 bp, Homo sapiens
gtttattgataaaagctggaca

SEQ ID NO: 8241532 - DNA, 22 bp, Homo sapiens
gtttattgataaaagctggaca

SEQ ID NO: 8241533 - DNA, 22 bp, Homo sapiens
gtttattgataaaagctggaca

SEQ ID NO: 8241534 - DNA, 22 bp, Homo sapiens
gtttattgataaaagctggaca

SEQ ID NO: 8241535 - DNA, 22 bp, Homo sapiens
gtttattattcaacttcatgtt

SEQ ID NO: 8241536 - DNA, 22 bp, Homo sapiens
gtttattatacaacaaaagcta

SEQ ID NO: 8241537 - DNA, 22 bp, Homo sapiens
gtttattattcaacttcatgtt

SEQ ID NO: 8241538 - DNA, 22 bp, Homo sapiens
gtttattattcaacttcatgtt

SEQ ID NO: 8241539 - DNA, 22 bp, Homo sapiens
gtttattattcaacttcatgtt

SEQ ID NO: 8241540 - DNA, 22 bp, Homo sapiens
gtttattccagcaatctgctta

SEQ ID NO: 8241541 - DNA, 22 bp, Homo sapiens
gtttattccagcaatctgctta

SEQ ID NO: 8241542 - DNA, 22 bp, Homo sapiens
gtttattccagcaatctgctta

SEQ ID NO: 8241543 - DNA, 22 bp, Homo sapiens
gtttacatgtaatgtgttattg

SEQ ID NO: 8241544 - DNA, 22 bp, Homo sapiens
gtttacatgtaatgtgttattg

SEQ ID NO: 8241545 - DNA, 22 bp, Homo sapiens
gtttacatgtactcattatact

SEQ ID NO: 8241546 - DNA, 18 bp, Homo sapiens
gtttacattactgaatag

SEQ ID NO: 8241547 - DNA, 22 bp, Homo sapiens
gtttcctgaaaagtaagggaca

SEQ ID NO: 8241548 - DNA, 22 bp, Homo sapiens
gtttcctatggctgctgcagga

SEQ ID NO: 8241549 - DNA, 22 bp, Homo sapiens
gtttcctataactcaggcacca

SEQ ID NO: 8241550 - DNA, 20 bp, Homo sapiens
gtttcctatttacctcctca

SEQ ID NO: 8241551 - DNA, 22 bp, Homo sapiens
gtttcctatgtccattgaggga

SEQ ID NO: 8241552 - DNA, 22 bp, Homo sapiens
gtttcctgactgtggaattata

SEQ ID NO: 8241553 - DNA, 22 bp, Homo sapiens
gtttcctgcacacgtgttatat

SEQ ID NO: 8241554 - DNA, 22 bp, Homo sapiens
gtttgcatttattagtcttctg

SEQ ID NO: 8241555 - DNA, 22 bp, Homo sapiens
gtgtttggtcagacgtccgggg

SEQ ID NO: 8241556 - DNA, 22 bp, Homo sapiens
gtgtgtgtatatatacacacac

SEQ ID NO: 8241557 - DNA, 22 bp, Homo sapiens
gtgtgtgtatatatacacacac

SEQ ID NO: 8241558 - DNA, 22 bp, Homo sapiens
gtgtgtgtactctgtatataaa

SEQ ID NO: 8241559 - DNA, 22 bp, Homo sapiens
gtgtgtgtactctgtatataaa

SEQ ID NO: 8241560 - DNA, 22 bp, Homo sapiens
gtgttttaagaaagaagctcag

SEQ ID NO: 8241561 - DNA, 22 bp, Homo sapiens
gtgttttagtgctgctgagctg

SEQ ID NO: 8241562 - DNA, 22 bp, Homo sapiens
gtgttttatggagtcataacgt

SEQ ID NO: 8241563 - DNA, 22 bp, Homo sapiens
gtgttttatggagtcataacgt

SEQ ID NO: 8241564 - DNA, 22 bp, Homo sapiens
gtgtgtgcaagaggtttattga

SEQ ID NO: 8241565 - DNA, 22 bp, Homo sapiens
gtgtgtctttcatttcatgagg

SEQ ID NO: 8241566 - DNA, 22 bp, Homo sapiens
gtgtgtctttataagaagaggg

SEQ ID NO: 8241567 - DNA, 20 bp, Homo sapiens
gtgtgtgctccatgcatgct

SEQ ID NO: 8241568 - DNA, 22 bp, Homo sapiens
gtgtgtgccaactttatgtgca

SEQ ID NO: 8241569 - DNA, 22 bp, Homo sapiens
gtgtgtgccatcaagagctttc

SEQ ID NO: 8241570 - DNA, 22 bp, Homo sapiens
gtgtgtgccaactttatgtgca

SEQ ID NO: 8241571 - DNA, 22 bp, Homo sapiens
gtgtgtgtactctgtatataaa

SEQ ID NO: 8241572 - DNA, 22 bp, Homo sapiens
gtgtgtggggccttcgggtcct

SEQ ID NO: 8241573 - DNA, 22 bp, Homo sapiens
gtgtgtggggccttcgggtcct

SEQ ID NO: 8241574 - DNA, 22 bp, Homo sapiens
gtgtgtgctccccaggagagct

SEQ ID NO: 8241575 - DNA, 22 bp, Homo sapiens
gtgtgtggaaagttttccatgg

SEQ ID NO: 8241576 - DNA, 22 bp, Homo sapiens
gtgttttggccattagtgtgat

SEQ ID NO: 8241577 - DNA, 22 bp, Homo sapiens
gtgttttattggtgcagtcaga

SEQ ID NO: 8241578 - DNA, 22 bp, Homo sapiens
gtgttttctctccagcaggcag

SEQ ID NO: 8241579 - DNA, 22 bp, Homo sapiens
gtgttttattggtgcagtcaga

SEQ ID NO: 8241580 - DNA, 22 bp, Homo sapiens
gttaaacaataactggcacaca

SEQ ID NO: 8241581 - DNA, 22 bp, Homo sapiens
gttaaacaagctggacactgaa

SEQ ID NO: 8241582 - DNA, 22 bp, Homo sapiens
gttaaacagttacatgtgctgg

SEQ ID NO: 8241583 - DNA, 20 bp, Homo sapiens
gttaaaagagtaatttgagg

SEQ ID NO: 8241584 - DNA, 22 bp, Homo sapiens
gttaaacaagctggacactgaa

SEQ ID NO: 8241585 - DNA, 22 bp, Homo sapiens
gttaaacagttacatgtgctgg

SEQ ID NO: 8241586 - DNA, 22 bp, Homo sapiens
gttaaacagttacatgtgctgg

SEQ ID NO: 8241587 - DNA, 22 bp, Homo sapiens
gttacaaatgccaaagctgaga

SEQ ID NO: 8241588 - DNA, 22 bp, Homo sapiens
gttacaaatgccaaagctgaga

SEQ ID NO: 8241589 - DNA, 22 bp, Homo sapiens
gttaaagagtttggctttcttc

SEQ ID NO: 8241590 - DNA, 22 bp, Homo sapiens
gttacaatgttcttcagttctg

SEQ ID NO: 8241591 - DNA, 22 bp, Homo sapiens
gttacaatgtccttacatgaaa

SEQ ID NO: 8241592 - DNA, 22 bp, Homo sapiens
gttacaagtgttcgagagtgac

SEQ ID NO: 8241593 - DNA, 22 bp, Homo sapiens
gttacaatgtccttacatgaaa

SEQ ID NO: 8241594 - DNA, 22 bp, Homo sapiens
gttacaatgttcttcagttctg

SEQ ID NO: 8241595 - DNA, 22 bp, Homo sapiens
gttacacagctaagcttctcct

SEQ ID NO: 8241596 - DNA, 22 bp, Homo sapiens
gttacacacaatatatcctaaa

SEQ ID NO: 8241597 - DNA, 22 bp, Homo sapiens
gttacagtgcttggcaataagt

SEQ ID NO: 8241598 - DNA, 22 bp, Homo sapiens
gttacagtgcatgtggcttctg

SEQ ID NO: 8241599 - DNA, 22 bp, Homo sapiens
gttacagtgagaagatagccta

SEQ ID NO: 8241600 - DNA, 22 bp, Homo sapiens
gttacagtgcatgtggcttctg

SEQ ID NO: 8241601 - DNA, 22 bp, Homo sapiens
gttacagtcaggagatattttg

SEQ ID NO: 8241602 - DNA, 22 bp, Homo sapiens
gttacagtcaggagatattttg

SEQ ID NO: 8241603 - DNA, 22 bp, Homo sapiens
gttacagtgagaagatagccta

SEQ ID NO: 8241604 - DNA, 22 bp, Homo sapiens
gttacaaatgtaaattctgggg

SEQ ID NO: 8241605 - DNA, 22 bp, Homo sapiens
gttacaagtgagatttaggaga

SEQ ID NO: 8241606 - DNA, 22 bp, Homo sapiens
gttacaaatgtaaattctgggg

SEQ ID NO: 8241607 - DNA, 22 bp, Homo sapiens
cagcttccacagacttggctcg

SEQ ID NO: 8241608 - DNA, 22 bp, Homo sapiens
cagcttccacagacttggctcg

SEQ ID NO: 8241609 - DNA, 22 bp, Homo sapiens
cagcttccatctccactgccct

SEQ ID NO: 8241610 - DNA, 22 bp, Homo sapiens
cagcttcccttggctgagcaga

SEQ ID NO: 8241611 - DNA, 22 bp, Homo sapiens
cagcttccccccgggcttgaga

SEQ ID NO: 8241612 - DNA, 22 bp, Homo sapiens
cagcttcccttggctgagcaga

SEQ ID NO: 8241613 - DNA, 22 bp, Homo sapiens
cagcttcccttggctgagcaga

SEQ ID NO: 8241614 - DNA, 22 bp, Homo sapiens
cagcttcccttggctgagcaga

SEQ ID NO: 8241615 - DNA, 22 bp, Homo sapiens
cagcttctaaagtgtgaagcca

SEQ ID NO: 8241616 - DNA, 22 bp, Homo sapiens
cagcttctaaagtgtgaagcca

SEQ ID NO: 8241617 - DNA, 21 bp, Homo sapiens
gtgtgtctaatgtagtggaaa

SEQ ID NO: 8241618 - DNA, 21 bp, Homo sapiens
gtgtgtctaatgtagtggaaa

SEQ ID NO: 8241619 - DNA, 22 bp, Homo sapiens
cagcttcccttggctgagcaga

SEQ ID NO: 8241620 - DNA, 22 bp, Homo sapiens
gtgtgtcttgaccaggatcgga

SEQ ID NO: 8241621 - DNA, 22 bp, Homo sapiens
gtgtgtctgaagttgagtagac

SEQ ID NO: 8241622 - DNA, 22 bp, Homo sapiens
gtgtgtctgaagttgagtagac

SEQ ID NO: 8241623 - DNA, 22 bp, Homo sapiens
gtgtgtctgaagttgagtagac

SEQ ID NO: 8241624 - DNA, 22 bp, Homo sapiens
cagcttcaactgcacagtcaac

SEQ ID NO: 8241625 - DNA, 22 bp, Homo sapiens
cagcttcaactgcacagtcaac

SEQ ID NO: 8241626 - DNA, 22 bp, Homo sapiens
cagctgtgtatgagagcatgct

SEQ ID NO: 8241627 - DNA, 22 bp, Homo sapiens
cagctgttgtgtatcaggcaga

SEQ ID NO: 8241628 - DNA, 22 bp, Homo sapiens
cagcttcagggacagcttcttt

SEQ ID NO: 8241629 - DNA, 22 bp, Homo sapiens
cagcttcagggacagcttcttt

SEQ ID NO: 8241630 - DNA, 22 bp, Homo sapiens
cagcttcatgacaaacagtttt

SEQ ID NO: 8241631 - DNA, 22 bp, Homo sapiens
cagcttcatgacaaacagtttt

SEQ ID NO: 8241632 - DNA, 20 bp, Homo sapiens
cagcttcaatgtcagcttga

SEQ ID NO: 8241633 - DNA, 22 bp, Homo sapiens
cagcttcaactgcacagtcaac

SEQ ID NO: 8241634 - DNA, 22 bp, Homo sapiens
cagctgtgattcctgctgtcca

SEQ ID NO: 8241635 - DNA, 22 bp, Homo sapiens
cagctgtgatatgcctgcctga

SEQ ID NO: 8241636 - DNA, 22 bp, Homo sapiens
cagctgtgagcagccagttgcc

SEQ ID NO: 8241637 - DNA, 22 bp, Homo sapiens
cagctgtgctgattgctcagta

SEQ ID NO: 8241638 - DNA, 22 bp, Homo sapiens
cagctgtgctagaagccacgaa

SEQ ID NO: 8241639 - DNA, 22 bp, Homo sapiens
cagctgtgattcctgctgtcca

SEQ ID NO: 8241640 - DNA, 22 bp, Homo sapiens
cagctgtgctgtattaagctct

SEQ ID NO: 8241641 - DNA, 22 bp, Homo sapiens
cagctgtggagatggggtgcat

SEQ ID NO: 8241642 - DNA, 22 bp, Homo sapiens
cagctgtggagggaggaaatgc

SEQ ID NO: 8241643 - DNA, 22 bp, Homo sapiens
cagctgtgggcctgacgtggca

SEQ ID NO: 8241644 - DNA, 22 bp, Homo sapiens
cagctgtggggagcttgggcca

SEQ ID NO: 8241645 - DNA, 22 bp, Homo sapiens
cagctgtgggcctgacgtggca

SEQ ID NO: 8241646 - DNA, 22 bp, Homo sapiens
cagctgtggctgccactgctcc

SEQ ID NO: 8241647 - DNA, 22 bp, Homo sapiens
cagctgtgggcctgacgtggca

SEQ ID NO: 8241648 - DNA, 22 bp, Homo sapiens
cagctgtgtaaacacatgtgta

SEQ ID NO: 8241649 - DNA, 22 bp, Homo sapiens
cagctgtgtaaacacatgtgta

SEQ ID NO: 8241650 - DNA, 22 bp, Homo sapiens
cagctgtgtatgagagcatgct

SEQ ID NO: 8241651 - DNA, 20 bp, Homo sapiens
cagcttggatgagaggctga

SEQ ID NO: 8241652 - DNA, 20 bp, Homo sapiens
cagcttggatgagaggctga

SEQ ID NO: 8241653 - DNA, 22 bp, Homo sapiens
cagcttgggtcaggtgcctgct

SEQ ID NO: 8241654 - DNA, 22 bp, Homo sapiens
cagcttggcgaatgtaggtatg

SEQ ID NO: 8241655 - DNA, 22 bp, Homo sapiens
cagcttctgctatcgaacatct

SEQ ID NO: 8241656 - DNA, 22 bp, Homo sapiens
cagcttctgagcaagccagggg

SEQ ID NO: 8241657 - DNA, 22 bp, Homo sapiens
cagcttctgagcaagccagggg

SEQ ID NO: 8241658 - DNA, 22 bp, Homo sapiens
cagcttctgagcaagccagggg

SEQ ID NO: 8241659 - DNA, 21 bp, Homo sapiens
cagcttctgaaggtgtaggaa

SEQ ID NO: 8241660 - DNA, 21 bp, Homo sapiens
cagcttctgaaggtgtaggaa

SEQ ID NO: 8241661 - DNA, 22 bp, Homo sapiens
cagcttctcgggagcgcatgtg

SEQ ID NO: 8241662 - DNA, 22 bp, Homo sapiens
cagcttctcgggagcgcatgtg

SEQ ID NO: 8241663 - DNA, 22 bp, Homo sapiens
cagcttctccattcttctggct

SEQ ID NO: 8241664 - DNA, 22 bp, Homo sapiens
cagcttctccggcctggtgcgg

SEQ ID NO: 8241665 - DNA, 22 bp, Homo sapiens
cagcttctccggcctggtgcgg

SEQ ID NO: 8241666 - DNA, 22 bp, Homo sapiens
cagcttctatttatctttgtgt

SEQ ID NO: 8241667 - DNA, 22 bp, Homo sapiens
cagcttctatttatctttgtgt

SEQ ID NO: 8241668 - DNA, 22 bp, Homo sapiens
cagcttctagcatcggctttga

SEQ ID NO: 8241669 - DNA, 22 bp, Homo sapiens
cagcttctatttatctttgtgt

SEQ ID NO: 8241670 - DNA, 22 bp, Homo sapiens
cagcttctccagatgaccctca

SEQ ID NO: 8241671 - DNA, 22 bp, Homo sapiens
cagcttctccagatgaccctca

SEQ ID NO: 8241672 - DNA, 22 bp, Homo sapiens
cagcttctcagaaagctgaggt

SEQ ID NO: 8241673 - DNA, 22 bp, Homo sapiens
cagcttctcagaaagctgaggt

SEQ ID NO: 8241674 - DNA, 22 bp, Homo sapiens
cagcttctcagaaagctgaggt

SEQ ID NO: 8241675 - DNA, 22 bp, Homo sapiens
gttattctattaatgtgattgt

SEQ ID NO: 8241676 - DNA, 22 bp, Homo sapiens
gttattctattaatgtgattgt

SEQ ID NO: 8241677 - DNA, 18 bp, Homo sapiens
gttattctctctgcagta

SEQ ID NO: 8241678 - DNA, 22 bp, Homo sapiens
gttattctttgtatggtacatc

SEQ ID NO: 8241679 - DNA, 22 bp, Homo sapiens
gttattctgcgatgcaatcctg

SEQ ID NO: 8241680 - DNA, 22 bp, Homo sapiens
gttattctgccaaacttccaca

SEQ ID NO: 8241681 - DNA, 21 bp, Homo sapiens
gttattgacctccaggctggc

SEQ ID NO: 8241682 - DNA, 22 bp, Homo sapiens
gttattgactctcttgtggctt

SEQ ID NO: 8241683 - DNA, 21 bp, Homo sapiens
gttattgacctccaggctggc

SEQ ID NO: 8241684 - DNA, 22 bp, Homo sapiens
gttattgacatgtattaagcac

SEQ ID NO: 8241685 - DNA, 22 bp, Homo sapiens
gttattgacatgtattaagcac

SEQ ID NO: 8241686 - DNA, 22 bp, Homo sapiens
gttattcttttatagcaataca

SEQ ID NO: 8241687 - DNA, 22 bp, Homo sapiens
gttattcttttatagcaataca

SEQ ID NO: 8241688 - DNA, 22 bp, Homo sapiens
gttattgagacatagagttatg

SEQ ID NO: 8241689 - DNA, 22 bp, Homo sapiens
gttattgactctcttgtggctt

SEQ ID NO: 8241690 - DNA, 22 bp, Homo sapiens
gttattgaggtggagtctcact

SEQ ID NO: 8241691 - DNA, 22 bp, Homo sapiens
gttattgagacatagagttatg

SEQ ID NO: 8241692 - DNA, 22 bp, Homo sapiens
cagcttctaccatcaggaaatt

SEQ ID NO: 8241693 - DNA, 22 bp, Homo sapiens
gttattgaggtggagtctcact

SEQ ID NO: 8241694 - DNA, 22 bp, Homo sapiens
gttacagtttgggcttgattca

SEQ ID NO: 8241695 - DNA, 22 bp, Homo sapiens
gttacagtttgggcttgattca

SEQ ID NO: 8241696 - DNA, 22 bp, Homo sapiens
gttacagtgggtttggggccca

SEQ ID NO: 8241697 - DNA, 22 bp, Homo sapiens
gttacagtttgggcttgattca

SEQ ID NO: 8241698 - DNA, 22 bp, Homo sapiens
gttacagtgggtttggggccca

SEQ ID NO: 8241699 - DNA, 22 bp, Homo sapiens
gttacagtgcttggcaataagt

SEQ ID NO: 8241700 - DNA, 22 bp, Homo sapiens
gttattaaagtatttgatgtta

SEQ ID NO: 8241701 - DNA, 22 bp, Homo sapiens
gttattcaatggcttataagga

SEQ ID NO: 8241702 - DNA, 22 bp, Homo sapiens
gttattcaacttgtgtctctta

SEQ ID NO: 8241703 - DNA, 22 bp, Homo sapiens
caggaaaatggaatcacctgta

SEQ ID NO: 8241704 - DNA, 23 bp, Homo sapiens
cagctttcagggctttagggaag

SEQ ID NO: 8241705 - DNA, 22 bp, Homo sapiens
cagctttatttcacgtgtttgt

SEQ ID NO: 8241706 - DNA, 22 bp, Homo sapiens
cagctttattgaggtataattg

SEQ ID NO: 8241707 - DNA, 22 bp, Homo sapiens
cagctttctttccataaggttt

SEQ ID NO: 8241708 - DNA, 22 bp, Homo sapiens
cagctttcttccttctgtctgt

SEQ ID NO: 8241709 - DNA, 22 bp, Homo sapiens
cagctttctctggtttcaagat

SEQ ID NO: 8241710 - DNA, 22 bp, Homo sapiens
cagctttctgtctcatgactga

SEQ ID NO: 8241711 - DNA, 22 bp, Homo sapiens
cagctttaggactcataataaa

SEQ ID NO: 8241712 - DNA, 22 bp, Homo sapiens
cagctttaggactcataataaa

SEQ ID NO: 8241713 - DNA, 22 bp, Homo sapiens
cagctttaggactcataataaa

SEQ ID NO: 8241714 - DNA, 20 bp, Homo sapiens
cagctttagatctttgatta

SEQ ID NO: 8241715 - DNA, 22 bp, Homo sapiens
cagctttagtaacccactgctc

SEQ ID NO: 8241716 - DNA, 17 bp, Homo sapiens
cagctttatgctactgt

SEQ ID NO: 8241717 - DNA, 17 bp, Homo sapiens
cagctttatgctactgt

SEQ ID NO: 8241718 - DNA, 22 bp, Homo sapiens
cagctttagtaacccactgctc

SEQ ID NO: 8241719 - DNA, 22 bp, Homo sapiens
cagctttattaatgattgtctt

SEQ ID NO: 8241720 - DNA, 16 bp, Homo sapiens
cagctttatgtcagtg

SEQ ID NO: 8241721 - DNA, 22 bp, Homo sapiens
cagctttaccaatatttggaaa

SEQ ID NO: 8241722 - DNA, 22 bp, Homo sapiens
cagctttacctttaggagtaac

SEQ ID NO: 8241723 - DNA, 22 bp, Homo sapiens
cagcttgttttatttggggacc

SEQ ID NO: 8241724 - DNA, 22 bp, Homo sapiens
cagctttagagaaaacatattt

SEQ ID NO: 8241725 - DNA, 22 bp, Homo sapiens
cagctttagagaaaacatattt

SEQ ID NO: 8241726 - DNA, 22 bp, Homo sapiens
cagcttgtattgaagctatacc

SEQ ID NO: 8241727 - DNA, 22 bp, Homo sapiens
cagcttgttaccaagggtggct

SEQ ID NO: 8241728 - DNA, 22 bp, Homo sapiens
cagcttgttaccgagggagggt

SEQ ID NO: 8241729 - DNA, 22 bp, Homo sapiens
caggaaagagctgccaggcagg

SEQ ID NO: 8241730 - DNA, 22 bp, Homo sapiens
caggaaagagctgccaggcagg

SEQ ID NO: 8241731 - DNA, 22 bp, Homo sapiens
gttcacagaaattgtgtacctc

SEQ ID NO: 8241732 - DNA, 21 bp, Homo sapiens
caggaaagaaaacgtacatat

SEQ ID NO: 8241733 - DNA, 21 bp, Homo sapiens
caggaaactgaggccatgggg

SEQ ID NO: 8241734 - DNA, 21 bp, Homo sapiens
caggaaagaaaacgtacatat

SEQ ID NO: 8241735 - DNA, 22 bp, Homo sapiens
caggaaagaaatgagaacacca

SEQ ID NO: 8241736 - DNA, 22 bp, Homo sapiens
caggaaagagagctattcactt

SEQ ID NO: 8241737 - DNA, 22 bp, Homo sapiens
caggaaagagctgccaggcagg

SEQ ID NO: 8241738 - DNA, 22 bp, Homo sapiens
caggaaagaaatgagaacacca

SEQ ID NO: 8241739 - DNA, 22 bp, Homo sapiens
caggaaaatgtcaatggaaagc

SEQ ID NO: 8241740 - DNA, 22 bp, Homo sapiens
caggaaacaaagccttgctcat

SEQ ID NO: 8241741 - DNA, 19 bp, Homo sapiens
caggaaacacctactgcta

SEQ ID NO: 8241742 - DNA, 19 bp, Homo sapiens
caggaaacacctactgcta

SEQ ID NO: 8241743 - DNA, 22 bp, Homo sapiens
cagctcttttttgcagcagctg

SEQ ID NO: 8241744 - DNA, 22 bp, Homo sapiens
cagctctttgagtattccattt

SEQ ID NO: 8241745 - DNA, 22 bp, Homo sapiens
cagctgaaagaaggaagtgtca

SEQ ID NO: 8241746 - DNA, 22 bp, Homo sapiens
cagctgaagaaagagtggttag

SEQ ID NO: 8241747 - DNA, 22 bp, Homo sapiens
cagctgaacatgtagagcatct

SEQ ID NO: 8241748 - DNA, 22 bp, Homo sapiens
cagctcttcctagccatgccac

SEQ ID NO: 8241749 - DNA, 22 bp, Homo sapiens
cagctcttcctagccatgccac

SEQ ID NO: 8241750 - DNA, 22 bp, Homo sapiens
cagctcttggagcctccagtaa

SEQ ID NO: 8241751 - DNA, 22 bp, Homo sapiens
cagctcttggagcctccagtaa

SEQ ID NO: 8241752 - DNA, 22 bp, Homo sapiens
cagctcttcagagtgagcaatg

SEQ ID NO: 8241753 - DNA, 22 bp, Homo sapiens
cagctcttagagggagacagac

SEQ ID NO: 8241754 - DNA, 22 bp, Homo sapiens
cagctcttaacacagcttgtat

SEQ ID NO: 8241755 - DNA, 22 bp, Homo sapiens
cagctcttcctaccctagttgg

SEQ ID NO: 8241756 - DNA, 22 bp, Homo sapiens
cagctcttccctcttcttgtag

SEQ ID NO: 8241757 - DNA, 22 bp, Homo sapiens
cagctcttcagtgcctgagata

SEQ ID NO: 8241758 - DNA, 22 bp, Homo sapiens
cagctctgttcatagatggtgc

SEQ ID NO: 8241759 - DNA, 22 bp, Homo sapiens
cagctctgttcatagatggtgc

SEQ ID NO: 8241760 - DNA, 22 bp, Homo sapiens
cagctctgttcaaactatccag

SEQ ID NO: 8241761 - DNA, 22 bp, Homo sapiens
cagctcttaacacagcttgtat

SEQ ID NO: 8241762 - DNA, 22 bp, Homo sapiens
cagctctgttgccctggaaacg

SEQ ID NO: 8241763 - DNA, 22 bp, Homo sapiens
cagctctgttgccaaagtgggc

SEQ ID NO: 8241764 - DNA, 22 bp, Homo sapiens
cagctctgttgccaaagtgggc

SEQ ID NO: 8241765 - DNA, 23 bp, Homo sapiens
cagctgaagcagcctgggctgga

SEQ ID NO: 8241766 - DNA, 22 bp, Homo sapiens
cagctgaagagaggtgctgagt

SEQ ID NO: 8241767 - DNA, 22 bp, Homo sapiens
cagctgagcatcactagtctgg

SEQ ID NO: 8241768 - DNA, 22 bp, Homo sapiens
cagctgagctcccaggccatca

SEQ ID NO: 8241769 - DNA, 22 bp, Homo sapiens
cagctgagctcccaggccatca

SEQ ID NO: 8241770 - DNA, 22 bp, Homo sapiens
cagctgagcatcactagtctgg

SEQ ID NO: 8241771 - DNA, 22 bp, Homo sapiens
cagctgagctgccagactactg

SEQ ID NO: 8241772 - DNA, 22 bp, Homo sapiens
cagctgagctgccagactactg

SEQ ID NO: 8241773 - DNA, 22 bp, Homo sapiens
cagctgagctcccaggccatca

SEQ ID NO: 8241774 - DNA, 22 bp, Homo sapiens
cagctgaggtcaaagaagcagg

SEQ ID NO: 8241775 - DNA, 22 bp, Homo sapiens
cagctgaggtcaaagaagcagg

SEQ ID NO: 8241776 - DNA, 22 bp, Homo sapiens
cagctgaggaatactagatgta

SEQ ID NO: 8241777 - DNA, 22 bp, Homo sapiens
cagctgagctgccagactactg

SEQ ID NO: 8241778 - DNA, 22 bp, Homo sapiens
cagctgagctgccagactactg

SEQ ID NO: 8241779 - DNA, 22 bp, Homo sapiens
cagctgaggaatactagatgta

SEQ ID NO: 8241780 - DNA, 22 bp, Homo sapiens
cagctgagttactctgaggtct

SEQ ID NO: 8241781 - DNA, 22 bp, Homo sapiens
cagctgagttactctgaggtct

SEQ ID NO: 8241782 - DNA, 22 bp, Homo sapiens
cagctgagtttccaagtctgcc

SEQ ID NO: 8241783 - DNA, 22 bp, Homo sapiens
cagctgagtttccaagtctgcc

SEQ ID NO: 8241784 - DNA, 22 bp, Homo sapiens
cagctgagtggaccctagaggc

SEQ ID NO: 8241785 - DNA, 22 bp, Homo sapiens
cagctgagtggaccctagaggc

SEQ ID NO: 8241786 - DNA, 22 bp, Homo sapiens
cagctgagtggaccctagaggc

SEQ ID NO: 8241787 - DNA, 22 bp, Homo sapiens
cagctgagtctgaggttctttg

SEQ ID NO: 8241788 - DNA, 20 bp, Homo sapiens
gtggcctgtcctgttgtggg

SEQ ID NO: 8241789 - DNA, 20 bp, Homo sapiens
gtggcctgtcctgttgtggg

SEQ ID NO: 8241790 - DNA, 20 bp, Homo sapiens
gtggcctgtcctgttgtggg

SEQ ID NO: 8241791 - DNA, 20 bp, Homo sapiens
gtggcctgtcctgttgtggg

SEQ ID NO: 8241792 - DNA, 22 bp, Homo sapiens
gtggcctgtgctgtctccccaa

SEQ ID NO: 8241793 - DNA, 22 bp, Homo sapiens
gtggcctgtgctgtctccccaa

SEQ ID NO: 8241794 - DNA, 22 bp, Homo sapiens
gtggccttattatgtacaaaat

SEQ ID NO: 8241795 - DNA, 22 bp, Homo sapiens
gtggccttaagaaacaaacaac

SEQ ID NO: 8241796 - DNA, 22 bp, Homo sapiens
gtggcctgtcagaagccgtggg

SEQ ID NO: 8241797 - DNA, 22 bp, Homo sapiens
gtggcctgtcagaagccgtggg

SEQ ID NO: 8241798 - DNA, 22 bp, Homo sapiens
gtggcctgtcagaagccgtggg

SEQ ID NO: 8241799 - DNA, 22 bp, Homo sapiens
cagctgagtttccaagtctgcc

SEQ ID NO: 8241800 - DNA, 22 bp, Homo sapiens
cagctgagtttccaagtctgcc

SEQ ID NO: 8241801 - DNA, 22 bp, Homo sapiens
gtgggactcttctttggcagtg

SEQ ID NO: 8241802 - DNA, 22 bp, Homo sapiens
gtgggactcttctttggcagtg

SEQ ID NO: 8241803 - DNA, 22 bp, Homo sapiens
gtgggcaggaggccctgccctg

SEQ ID NO: 8241804 - DNA, 22 bp, Homo sapiens
gtgggacagcggggtgggacag

SEQ ID NO: 8241805 - DNA, 22 bp, Homo sapiens
gtgggacagcggggtgggacag

SEQ ID NO: 8241806 - DNA, 22 bp, Homo sapiens
gtgggacagctggagggtccct

SEQ ID NO: 8241807 - DNA, 22 bp, Homo sapiens
gtgggcaggccccaaagcaggg

SEQ ID NO: 8241808 - DNA, 22 bp, Homo sapiens
gtgggcaggccctaggcgattt

SEQ ID NO: 8241809 - DNA, 22 bp, Homo sapiens
gtgggcaggccctaggcgattt

SEQ ID NO: 8241810 - DNA, 22 bp, Homo sapiens
gtgggcaggccctaggcgattt

SEQ ID NO: 8241811 - DNA, 22 bp, Homo sapiens
gtgggcagggttgctttctccg

SEQ ID NO: 8241812 - DNA, 22 bp, Homo sapiens
gtgggcaggtaggcaccagcta

SEQ ID NO: 8241813 - DNA, 22 bp, Homo sapiens
gtgggcaggtaggcaccagcta

SEQ ID NO: 8241814 - DNA, 22 bp, Homo sapiens
gtgggcaggtaggcaccagcta

SEQ ID NO: 8241815 - DNA, 22 bp, Homo sapiens
gtgggcagtcatgaaatctaga

SEQ ID NO: 8241816 - DNA, 22 bp, Homo sapiens
gtgggcagtgcctgacggatga

SEQ ID NO: 8241817 - DNA, 22 bp, Homo sapiens
gtgggcagtgcctgacggatga

SEQ ID NO: 8241818 - DNA, 22 bp, Homo sapiens
gtggggagggagatgctgaagt

SEQ ID NO: 8241819 - DNA, 22 bp, Homo sapiens
gtggggagggagatgctgaagt

SEQ ID NO: 8241820 - DNA, 22 bp, Homo sapiens
gtggggagggagatgctgaagt

SEQ ID NO: 8241821 - DNA, 22 bp, Homo sapiens
gtgggcagtggggtcttctgcc

SEQ ID NO: 8241822 - DNA, 22 bp, Homo sapiens
gtgggcagtggtttgcgcggtc

SEQ ID NO: 8241823 - DNA, 22 bp, Homo sapiens
gtgggcagtggggtcttctgcc

SEQ ID NO: 8241824 - DNA, 22 bp, Homo sapiens
gtggccttgggcactgaccttg

SEQ ID NO: 8241825 - DNA, 22 bp, Homo sapiens
gtggccttggcttctaccctga

SEQ ID NO: 8241826 - DNA, 22 bp, Homo sapiens
gtggccttgctcacatgtccag

SEQ ID NO: 8241827 - DNA, 22 bp, Homo sapiens
gtggcctttcttgggctacaga

SEQ ID NO: 8241828 - DNA, 22 bp, Homo sapiens
gtggcgcagagggtggcagaga

SEQ ID NO: 8241829 - DNA, 22 bp, Homo sapiens
gtggccttttcaagtagggtat

SEQ ID NO: 8241830 - DNA, 22 bp, Homo sapiens
gtggccttttagaataaactct

SEQ ID NO: 8241831 - DNA, 22 bp, Homo sapiens
gtggcgcagagggtggcagaga

SEQ ID NO: 8241832 - DNA, 22 bp, Homo sapiens
gtggcgtgatctcggctcactg

SEQ ID NO: 8241833 - DNA, 22 bp, Homo sapiens
gtggctagaaaaatatgggtgc

SEQ ID NO: 8241834 - DNA, 22 bp, Homo sapiens
gtggctaggcccaacggcagga

SEQ ID NO: 8241835 - DNA, 22 bp, Homo sapiens
gtggctaggcccaacggcagga

SEQ ID NO: 8241836 - DNA, 22 bp, Homo sapiens
gtggcttctgcggtgtgcgcag

SEQ ID NO: 8241837 - DNA, 22 bp, Homo sapiens
gtggctagggacacagattgct

SEQ ID NO: 8241838 - DNA, 22 bp, Homo sapiens
gtggctagttggcagagaacag

SEQ ID NO: 8241839 - DNA, 22 bp, Homo sapiens
gtgggaagaacttcaagtggct

SEQ ID NO: 8241840 - DNA, 22 bp, Homo sapiens
gtgggaagaacttcaagtggct

SEQ ID NO: 8241841 - DNA, 22 bp, Homo sapiens
gtgggaagaacttcaagtggct

SEQ ID NO: 8241842 - DNA, 22 bp, Homo sapiens
gtgggaagtctctcggaggaag

SEQ ID NO: 8241843 - DNA, 22 bp, Homo sapiens
gtgggaagtctctcggaggaag

SEQ ID NO: 8241844 - DNA, 22 bp, Homo sapiens
gtggcttgtgtgggaagtgcag

SEQ ID NO: 8241845 - DNA, 22 bp, Homo sapiens
gtgggaagaacttcaagtggct

SEQ ID NO: 8241846 - DNA, 22 bp, Homo sapiens
gtggcttggaccagtcacagtg

SEQ ID NO: 8241847 - DNA, 22 bp, Homo sapiens
gtggcttgaccatccctgctac

SEQ ID NO: 8241848 - DNA, 22 bp, Homo sapiens
gtggcttcttctgccagaagga

SEQ ID NO: 8241849 - DNA, 22 bp, Homo sapiens
cagctctgtgcaggcctgggga

SEQ ID NO: 8241850 - DNA, 22 bp, Homo sapiens
cagctctgtgcaggcctgggga

SEQ ID NO: 8241851 - DNA, 22 bp, Homo sapiens
cagctctgtgtattttccccac

SEQ ID NO: 8241852 - DNA, 22 bp, Homo sapiens
cagctctgtgggagcgtatgtg

SEQ ID NO: 8241853 - DNA, 22 bp, Homo sapiens
cagctctgtgcaggcctgggga

SEQ ID NO: 8241854 - DNA, 22 bp, Homo sapiens
cagctctgggagtcccacccct

SEQ ID NO: 8241855 - DNA, 20 bp, Homo sapiens
cagctctgggaaagaggcca

SEQ ID NO: 8241856 - DNA, 22 bp, Homo sapiens
cagctctgggagtcccacccct

SEQ ID NO: 8241857 - DNA, 22 bp, Homo sapiens
cagctctggctttggggagctt

SEQ ID NO: 8241858 - DNA, 22 bp, Homo sapiens
cagctctggctattgaggacca

SEQ ID NO: 8241859 - DNA, 22 bp, Homo sapiens
cagctctggctattgaggacca

SEQ ID NO: 8241860 - DNA, 22 bp, Homo sapiens
cagctctggcgtcagggagcga

SEQ ID NO: 8241861 - DNA, 22 bp, Homo sapiens
cagctctggcgtcagggagcga

SEQ ID NO: 8241862 - DNA, 22 bp, Homo sapiens
cagctctggccagatctatcct

SEQ ID NO: 8241863 - DNA, 22 bp, Homo sapiens
cagctctggcagagcccaaccc

SEQ ID NO: 8241864 - DNA, 22 bp, Homo sapiens
cagctctggcagagcccaaccc

SEQ ID NO: 8241865 - DNA, 22 bp, Homo sapiens
cagctctgcttccttgtacagg

SEQ ID NO: 8241866 - DNA, 22 bp, Homo sapiens
cagctctggcagagcccaaccc

SEQ ID NO: 8241867 - DNA, 22 bp, Homo sapiens
cagctctgcttccttgtacagg

SEQ ID NO: 8241868 - DNA, 22 bp, Homo sapiens
cagctctgcttccttgtacagg

SEQ ID NO: 8241869 - DNA, 22 bp, Homo sapiens
cagctctgctggtggtgccagg

SEQ ID NO: 8241870 - DNA, 22 bp, Homo sapiens
cagctctgctggtggtgccagg

SEQ ID NO: 8241871 - DNA, 22 bp, Homo sapiens
gtggccattttttcctagcaca

SEQ ID NO: 8241872 - DNA, 22 bp, Homo sapiens
gtggcagtctcatctgtggctc

SEQ ID NO: 8241873 - DNA, 22 bp, Homo sapiens
gtggcaggttccgtagacagca

SEQ ID NO: 8241874 - DNA, 22 bp, Homo sapiens
gtggcaggttccgtagacagca

SEQ ID NO: 8241875 - DNA, 22 bp, Homo sapiens
gtggcaggttccgtagacagca

SEQ ID NO: 8241876 - DNA, 22 bp, Homo sapiens
gtggccaggcgtccgcgcggct

SEQ ID NO: 8241877 - DNA, 19 bp, Homo sapiens
gtggccagggcaggggctg

SEQ ID NO: 8241878 - DNA, 19 bp, Homo sapiens
gtggccagggcaggggctg

SEQ ID NO: 8241879 - DNA, 19 bp, Homo sapiens
gtggccagggcaggggctg

SEQ ID NO: 8241880 - DNA, 19 bp, Homo sapiens
gtggccagggcaggggctg

SEQ ID NO: 8241881 - DNA, 19 bp, Homo sapiens
gtggccagggcaggggctg

SEQ ID NO: 8241882 - DNA, 22 bp, Homo sapiens
gtggccaggccgactgccaggc

SEQ ID NO: 8241883 - DNA, 22 bp, Homo sapiens
gtggccaggccgactgccaggc

SEQ ID NO: 8241884 - DNA, 22 bp, Homo sapiens
gtggccagtcccgatgcttgtt

SEQ ID NO: 8241885 - DNA, 22 bp, Homo sapiens
gtggccaggtcagggacttgtg

SEQ ID NO: 8241886 - DNA, 22 bp, Homo sapiens
gtggccaggtcagggacttgtg

SEQ ID NO: 8241887 - DNA, 22 bp, Homo sapiens
gtggccagggcccacaggatga

SEQ ID NO: 8241888 - DNA, 22 bp, Homo sapiens
gtggccagggcccacaggatga

SEQ ID NO: 8241889 - DNA, 22 bp, Homo sapiens
gtggccaggtcagggacttgtg

SEQ ID NO: 8241890 - DNA, 22 bp, Homo sapiens
gtggccagggcccacaggatga

SEQ ID NO: 8241891 - DNA, 22 bp, Homo sapiens
gtggccagtgggaatgggctca

SEQ ID NO: 8241892 - DNA, 22 bp, Homo sapiens
gtggccagtgggaatgggctca

SEQ ID NO: 8241893 - DNA, 22 bp, Homo sapiens
gtggccagtgggaatgggctca

SEQ ID NO: 8241894 - DNA, 21 bp, Homo sapiens
gtggccagtgactacttattg

SEQ ID NO: 8241895 - DNA, 22 bp, Homo sapiens
gtggccagtgggaatgggctca

SEQ ID NO: 8241896 - DNA, 22 bp, Homo sapiens
gtggccagtgggaatgggctca

SEQ ID NO: 8241897 - DNA, 22 bp, Homo sapiens
gtggccatgtgcttgcagggta

SEQ ID NO: 8241898 - DNA, 22 bp, Homo sapiens
gtggccatctttggccctgact

SEQ ID NO: 8241899 - DNA, 22 bp, Homo sapiens
gtggccatttggaaggcaagta

SEQ ID NO: 8241900 - DNA, 22 bp, Homo sapiens
gtggccagtggtgggcgccctg

SEQ ID NO: 8241901 - DNA, 22 bp, Homo sapiens
gtggccagtggtgggcgccctg

SEQ ID NO: 8241902 - DNA, 22 bp, Homo sapiens
gtggcaggtcccattggagcag

SEQ ID NO: 8241903 - DNA, 22 bp, Homo sapiens
gtggcagggtgctcatcatgca

SEQ ID NO: 8241904 - DNA, 22 bp, Homo sapiens
gtggcaggtcccattggagcag

SEQ ID NO: 8241905 - DNA, 22 bp, Homo sapiens
gtggcaggtcccattggagcag

SEQ ID NO: 8241906 - DNA, 22 bp, Homo sapiens
gtggcaggtcccattggagcag

SEQ ID NO: 8241907 - DNA, 22 bp, Homo sapiens
gtggcaggtcccattggagcag

SEQ ID NO: 8241908 - DNA, 22 bp, Homo sapiens
gtggcaggtcccattggagcag

SEQ ID NO: 8241909 - DNA, 22 bp, Homo sapiens
gtggcagggtgctcatcatgca

SEQ ID NO: 8241910 - DNA, 22 bp, Homo sapiens
gtggcagggtgctcatcatgca

SEQ ID NO: 8241911 - DNA, 22 bp, Homo sapiens
gtggcagagccaaggctggagc

SEQ ID NO: 8241912 - DNA, 22 bp, Homo sapiens
gtggcagagccaaggctggagc

SEQ ID NO: 8241913 - DNA, 22 bp, Homo sapiens
gtggcagagccaaggctggagc

SEQ ID NO: 8241914 - DNA, 22 bp, Homo sapiens
gtggcaggtggagcctcctgca

SEQ ID NO: 8241915 - DNA, 22 bp, Homo sapiens
gtggcaggtggagcctcctgca

SEQ ID NO: 8241916 - DNA, 22 bp, Homo sapiens
gtggcaggtggagcctcctgca

SEQ ID NO: 8241917 - DNA, 22 bp, Homo sapiens
gtggcaggtggagcctcctgca

SEQ ID NO: 8241918 - DNA, 22 bp, Homo sapiens
gtggcaggttataagcatctca

SEQ ID NO: 8241919 - DNA, 22 bp, Homo sapiens
gtggcaggttataagcatctca

SEQ ID NO: 8241920 - DNA, 22 bp, Homo sapiens
gtggcaggttataagcatctca

SEQ ID NO: 8241921 - DNA, 22 bp, Homo sapiens
gtggcaggttataagcatctca

SEQ ID NO: 8241922 - DNA, 22 bp, Homo sapiens
gtggcaggttataagcatctca

SEQ ID NO: 8241923 - DNA, 22 bp, Homo sapiens
gtggcaggttataagcatctca

SEQ ID NO: 8241924 - DNA, 22 bp, Homo sapiens
gtggcaggttataagcatctca

SEQ ID NO: 8241925 - DNA, 22 bp, Homo sapiens
gtggcaggttccgtagacagca

SEQ ID NO: 8241926 - DNA, 22 bp, Homo sapiens
gtggcagaagagtaggatgggc

SEQ ID NO: 8241927 - DNA, 22 bp, Homo sapiens
gtggcagaagagtaggatgggc

SEQ ID NO: 8241928 - DNA, 22 bp, Homo sapiens
gtggcagaaatgggactttgag

SEQ ID NO: 8241929 - DNA, 22 bp, Homo sapiens
gtggcagaaatattcttgctct

SEQ ID NO: 8241930 - DNA, 22 bp, Homo sapiens
gtggcagagcaggagacaggac

SEQ ID NO: 8241931 - DNA, 22 bp, Homo sapiens
gtggcagagcaggagacaggac

SEQ ID NO: 8241932 - DNA, 22 bp, Homo sapiens
gtggcagagcaggagacaggac

SEQ ID NO: 8241933 - DNA, 22 bp, Homo sapiens
gtggcagagagcaagtgtctga

SEQ ID NO: 8241934 - DNA, 22 bp, Homo sapiens
gtggcagagaacaaggagaggt

SEQ ID NO: 8241935 - DNA, 22 bp, Homo sapiens
gtggcagaccttcccttctcct

SEQ ID NO: 8241936 - DNA, 22 bp, Homo sapiens
gtggcagagaacaaggagaggt

SEQ ID NO: 8241937 - DNA, 22 bp, Homo sapiens
gtggcagagaacaaggagaggt

SEQ ID NO: 8241938 - DNA, 22 bp, Homo sapiens
cagcccagccgagggcctggct

SEQ ID NO: 8241939 - DNA, 22 bp, Homo sapiens
cagcccagcgcaaacaactggc

SEQ ID NO: 8241940 - DNA, 22 bp, Homo sapiens
cagcccagcgcaaacaactggc

SEQ ID NO: 8241941 - DNA, 22 bp, Homo sapiens
cagcccagccgagggcctggct

SEQ ID NO: 8241942 - DNA, 22 bp, Homo sapiens
cagcccagccgagggcctggct

SEQ ID NO: 8241943 - DNA, 21 bp, Homo sapiens
cagcccagcttcttccccagt

SEQ ID NO: 8241944 - DNA, 21 bp, Homo sapiens
cagcccagcttcttccccagt

SEQ ID NO: 8241945 - DNA, 22 bp, Homo sapiens
cagcccagctgggatcacactc

SEQ ID NO: 8241946 - DNA, 22 bp, Homo sapiens
cagcccagctctgactaaccct

SEQ ID NO: 8241947 - DNA, 22 bp, Homo sapiens
cagcccaggccgacagttcctc

SEQ ID NO: 8241948 - DNA, 22 bp, Homo sapiens
cagcccaggccgacagttcctc

SEQ ID NO: 8241949 - DNA, 22 bp, Homo sapiens
cagcccaggactgcaggtgttt

SEQ ID NO: 8241950 - DNA, 22 bp, Homo sapiens
cagcccaggactgcaggtgttt

SEQ ID NO: 8241951 - DNA, 22 bp, Homo sapiens
cagcccaggccgacagttcctc

SEQ ID NO: 8241952 - DNA, 22 bp, Homo sapiens
gtggcagaaactggcagaggag

SEQ ID NO: 8241953 - DNA, 22 bp, Homo sapiens
gtggcactgtttcccacggaag

SEQ ID NO: 8241954 - DNA, 22 bp, Homo sapiens
gtggcagaaactggcagaggag

SEQ ID NO: 8241955 - DNA, 22 bp, Homo sapiens
gtggcactgggtgagtgagtga

SEQ ID NO: 8241956 - DNA, 22 bp, Homo sapiens
gtggcactggggtctagctggc

SEQ ID NO: 8241957 - DNA, 22 bp, Homo sapiens
gtggcactggtagttttaagat

SEQ ID NO: 8241958 - DNA, 22 bp, Homo sapiens
gtggcactggggtctagctggc

SEQ ID NO: 8241959 - DNA, 22 bp, Homo sapiens
gtggcactgggtgagtgagtga

SEQ ID NO: 8241960 - DNA, 22 bp, Homo sapiens
gtggcactggtagttttaagat

SEQ ID NO: 8241961 - DNA, 22 bp, Homo sapiens
gtggcactgtttcccacggaag

SEQ ID NO: 8241962 - DNA, 22 bp, Homo sapiens
gtggagccctgccttgctcatg

SEQ ID NO: 8241963 - DNA, 22 bp, Homo sapiens
gtggagccaggggctgtaggta

SEQ ID NO: 8241964 - DNA, 22 bp, Homo sapiens
gtggcactgatagtttcactct

SEQ ID NO: 8241965 - DNA, 22 bp, Homo sapiens
gtggcactgatagtttcactct

SEQ ID NO: 8241966 - DNA, 22 bp, Homo sapiens
gtggagccctgccttgctcatg

SEQ ID NO: 8241967 - DNA, 22 bp, Homo sapiens
cagctgcaggagaaacagaggc

SEQ ID NO: 8241968 - DNA, 22 bp, Homo sapiens
gtggggctgagtggagccagaa

SEQ ID NO: 8241969 - DNA, 22 bp, Homo sapiens
gtggggctgagtggagccagaa

SEQ ID NO: 8241970 - DNA, 22 bp, Homo sapiens
gtggggctgcttaggctgcgca

SEQ ID NO: 8241971 - DNA, 22 bp, Homo sapiens
gtggggctgcttaggctgcgca

SEQ ID NO: 8241972 - DNA, 22 bp, Homo sapiens
gtggggcggcagatgctccctg

SEQ ID NO: 8241973 - DNA, 22 bp, Homo sapiens
gtggggcatgcacgctgctcct

SEQ ID NO: 8241974 - DNA, 22 bp, Homo sapiens
gtggggcatgcacgctgctcct

SEQ ID NO: 8241975 - DNA, 22 bp, Homo sapiens
gtggggcagtggcctgggagca

SEQ ID NO: 8241976 - DNA, 22 bp, Homo sapiens
gtggggcagtggcctgggagca

SEQ ID NO: 8241977 - DNA, 22 bp, Homo sapiens
gtggggagtgttctgtgattgg

SEQ ID NO: 8241978 - DNA, 22 bp, Homo sapiens
cagctgcaggctgtgcaggaag

SEQ ID NO: 8241979 - DNA, 22 bp, Homo sapiens
cagctgccaagaatcttttcta

SEQ ID NO: 8241980 - DNA, 22 bp, Homo sapiens
cagctgccaagaatcttttcta

SEQ ID NO: 8241981 - DNA, 22 bp, Homo sapiens
cagctgccaagaatcttttcta

SEQ ID NO: 8241982 - DNA, 22 bp, Homo sapiens
cagctgccacaggactttctga

SEQ ID NO: 8241983 - DNA, 22 bp, Homo sapiens
cagctgccacaggactttctga

SEQ ID NO: 8241984 - DNA, 22 bp, Homo sapiens
cagctgccacacctctttctct

SEQ ID NO: 8241985 - DNA, 22 bp, Homo sapiens
cagctgccacaggactttctga

SEQ ID NO: 8241986 - DNA, 22 bp, Homo sapiens
cagctgccacttgctctcggct

SEQ ID NO: 8241987 - DNA, 22 bp, Homo sapiens
cagctgccacttgctctcggct

SEQ ID NO: 8241988 - DNA, 22 bp, Homo sapiens
cagctgccacttgctctcggct

SEQ ID NO: 8241989 - DNA, 22 bp, Homo sapiens
cagctgccacttgctctcggct

SEQ ID NO: 8241990 - DNA, 22 bp, Homo sapiens
cagctgcctgcaacacaagctt

SEQ ID NO: 8241991 - DNA, 22 bp, Homo sapiens
cagctgcctgcaacacaagctt

SEQ ID NO: 8241992 - DNA, 22 bp, Homo sapiens
cagctgcctgcaacacaagctt

SEQ ID NO: 8241993 - DNA, 20 bp, Homo sapiens
cagctgcctggctctgggat

SEQ ID NO: 8241994 - DNA, 22 bp, Homo sapiens
cagctgcctgcaacacaagctt

SEQ ID NO: 8241995 - DNA, 20 bp, Homo sapiens
cagctgcctggctctgggat

SEQ ID NO: 8241996 - DNA, 20 bp, Homo sapiens
cagctgcctggctctgggat

SEQ ID NO: 8241997 - DNA, 20 bp, Homo sapiens
cagctgcctggctctgggat

SEQ ID NO: 8241998 - DNA, 22 bp, Homo sapiens
cagctgcctgtattgtcctcat

SEQ ID NO: 8241999 - DNA, 22 bp, Homo sapiens
cagctgcctgtattgtcctcat

SEQ ID NO: 8242000 - DNA, 22 bp, Homo sapiens
cagctgcctgtattgtcctcat

SEQ ID NO: 8242001 - DNA, 22 bp, Homo sapiens
cagctgcctgtattgtcctcat

SEQ ID NO: 8242002 - DNA, 22 bp, Homo sapiens
cagctgcctatgacctagcctc

SEQ ID NO: 8242003 - DNA, 22 bp, Homo sapiens
cagctgcctatgacctagcctc

SEQ ID NO: 8242004 - DNA, 22 bp, Homo sapiens
cagctgcctatgacctagcctc

SEQ ID NO: 8242005 - DNA, 22 bp, Homo sapiens
cagctgcctatgacctagcctc

SEQ ID NO: 8242006 - DNA, 22 bp, Homo sapiens
cagctgcctatgacctagcctc

SEQ ID NO: 8242007 - DNA, 22 bp, Homo sapiens
cagctgcctatgacctagcctc

SEQ ID NO: 8242008 - DNA, 22 bp, Homo sapiens
cagctgcccctccagggctggg

SEQ ID NO: 8242009 - DNA, 22 bp, Homo sapiens
cagctgcccctccagggctggg

SEQ ID NO: 8242010 - DNA, 22 bp, Homo sapiens
cagctgcccctccagggctggg

SEQ ID NO: 8242011 - DNA, 22 bp, Homo sapiens
cagctgcccctccagggctggg

SEQ ID NO: 8242012 - DNA, 22 bp, Homo sapiens
cagctgcccctccagggctggg

SEQ ID NO: 8242013 - DNA, 22 bp, Homo sapiens
cagctgccctgccttgccctta

SEQ ID NO: 8242014 - DNA, 22 bp, Homo sapiens
cagctgccctgccttgccctta

SEQ ID NO: 8242015 - DNA, 22 bp, Homo sapiens
cagctgcccctccagggctggg

SEQ ID NO: 8242016 - DNA, 22 bp, Homo sapiens
cagctgctgaggaaggggttgg

SEQ ID NO: 8242017 - DNA, 22 bp, Homo sapiens
cagctgctgagaagcctccctt

SEQ ID NO: 8242018 - DNA, 22 bp, Homo sapiens
cagctgctcttctggcctgtca

SEQ ID NO: 8242019 - DNA, 22 bp, Homo sapiens
cagctgctcttctggcctgtca

SEQ ID NO: 8242020 - DNA, 22 bp, Homo sapiens
cagctgctctggtggtctctcc

SEQ ID NO: 8242021 - DNA, 22 bp, Homo sapiens
cagctgctctggtggtctctcc

SEQ ID NO: 8242022 - DNA, 22 bp, Homo sapiens
cagctgctgatggcctgacaga

SEQ ID NO: 8242023 - DNA, 22 bp, Homo sapiens
cagctgctctggtggtctctcc

SEQ ID NO: 8242024 - DNA, 19 bp, Homo sapiens
cagctgccttttctttgca

SEQ ID NO: 8242025 - DNA, 22 bp, Homo sapiens
cagctgccttctgcgggaagtc

SEQ ID NO: 8242026 - DNA, 22 bp, Homo sapiens
cagctgccttctgcgggaagtc

SEQ ID NO: 8242027 - DNA, 22 bp, Homo sapiens
cagctgcctgtctggaggcaat

SEQ ID NO: 8242028 - DNA, 22 bp, Homo sapiens
cagctgcctgtctggaggcaat

SEQ ID NO: 8242029 - DNA, 22 bp, Homo sapiens
cagctgcctgtattgtcctcat

SEQ ID NO: 8242030 - DNA, 22 bp, Homo sapiens
cagctgcctgtattgtcctcat

SEQ ID NO: 8242031 - DNA, 22 bp, Homo sapiens
cagctggccaatcagggcgccc

SEQ ID NO: 8242032 - DNA, 22 bp, Homo sapiens
cagctggccaatcagggcgccc

SEQ ID NO: 8242033 - DNA, 22 bp, Homo sapiens
cagctggccaatcagggcgccc

SEQ ID NO: 8242034 - DNA, 22 bp, Homo sapiens
cagctgcttctcctccagagct

SEQ ID NO: 8242035 - DNA, 22 bp, Homo sapiens
cagctgctgttcagttttgttt

SEQ ID NO: 8242036 - DNA, 22 bp, Homo sapiens
cagctgcttactagctgtgtga

SEQ ID NO: 8242037 - DNA, 22 bp, Homo sapiens
cagctgctgttcagttttgttt

SEQ ID NO: 8242038 - DNA, 22 bp, Homo sapiens
cagctgctgttcagttttgttt

SEQ ID NO: 8242039 - DNA, 22 bp, Homo sapiens
cagctgctgttcagttttgttt

SEQ ID NO: 8242040 - DNA, 22 bp, Homo sapiens
cagctgctgttactgcttatta

SEQ ID NO: 8242041 - DNA, 22 bp, Homo sapiens
cagctgctgttactgcttatta

SEQ ID NO: 8242042 - DNA, 22 bp, Homo sapiens
cagctgctgcccttggctgcag

SEQ ID NO: 8242043 - DNA, 22 bp, Homo sapiens
gtgggtggaggcgtcgagggca

SEQ ID NO: 8242044 - DNA, 22 bp, Homo sapiens
gtgggtggatcacctgaggtca

SEQ ID NO: 8242045 - DNA, 22 bp, Homo sapiens
gtgggtggatcacctgaggtca

SEQ ID NO: 8242046 - DNA, 22 bp, Homo sapiens
gtgggtggatcacctgaggtca

SEQ ID NO: 8242047 - DNA, 22 bp, Homo sapiens
cagctggctccacctctgggct

SEQ ID NO: 8242048 - DNA, 22 bp, Homo sapiens
cagctggctgcatgatgccaaa

SEQ ID NO: 8242049 - DNA, 22 bp, Homo sapiens
cagctggctgcatgatgccaaa

SEQ ID NO: 8242050 - DNA, 22 bp, Homo sapiens
cagctggctccacctctgggct

SEQ ID NO: 8242051 - DNA, 22 bp, Homo sapiens
cagctggctccacctctgggct

SEQ ID NO: 8242052 - DNA, 22 bp, Homo sapiens
cagctggctgcatgatgccaaa

SEQ ID NO: 8242053 - DNA, 22 bp, Homo sapiens
gtgggtggatcatgaggtcagg

SEQ ID NO: 8242054 - DNA, 22 bp, Homo sapiens
gtgggtggatcatgaggtcagg

SEQ ID NO: 8242055 - DNA, 22 bp, Homo sapiens
gtgggtggatcatgaggtcagg

SEQ ID NO: 8242056 - DNA, 22 bp, Homo sapiens
gtgggtggatcacctgaggtca

SEQ ID NO: 8242057 - DNA, 22 bp, Homo sapiens
gtgggtggatcacctgaggtca

SEQ ID NO: 8242058 - DNA, 22 bp, Homo sapiens
gtgggtggatcacctgaggtca

SEQ ID NO: 8242059 - DNA, 22 bp, Homo sapiens
gtgggtggatcatgaggtcagg

SEQ ID NO: 8242060 - DNA, 22 bp, Homo sapiens
cagctggcgcctggggaccaga

SEQ ID NO: 8242061 - DNA, 22 bp, Homo sapiens
cagctggcgactctcctcgatg

SEQ ID NO: 8242062 - DNA, 22 bp, Homo sapiens
cagctggcgactctcctcgatg

SEQ ID NO: 8242063 - DNA, 22 bp, Homo sapiens
cagctggcgggcagagccgcca

SEQ ID NO: 8242064 - DNA, 22 bp, Homo sapiens
cagctggcgcctggggaccaga

SEQ ID NO: 8242065 - DNA, 22 bp, Homo sapiens
cagctggcgcctggggaccaga

SEQ ID NO: 8242066 - DNA, 22 bp, Homo sapiens
cagctggcgtggagtgattgca

SEQ ID NO: 8242067 - DNA, 22 bp, Homo sapiens
cagctggctccacctctgggct

SEQ ID NO: 8242068 - DNA, 22 bp, Homo sapiens
cagctggcgggcagagccgcca

SEQ ID NO: 8242069 - DNA, 22 bp, Homo sapiens
cagctggcgggcagagccgcca

SEQ ID NO: 8242070 - DNA, 22 bp, Homo sapiens
cagctggcgggcagagccgcca

SEQ ID NO: 8242071 - DNA, 22 bp, Homo sapiens
cagctggccctttggtagcctt

SEQ ID NO: 8242072 - DNA, 22 bp, Homo sapiens
cagctggccctttggtagcctt

SEQ ID NO: 8242073 - DNA, 22 bp, Homo sapiens
cagctggcctgagcggtggcgg

SEQ ID NO: 8242074 - DNA, 22 bp, Homo sapiens
cagctggcctgatccctgtggc

SEQ ID NO: 8242075 - DNA, 22 bp, Homo sapiens
cagctggcctgagcggtggcgg

SEQ ID NO: 8242076 - DNA, 22 bp, Homo sapiens
cagctggcctgatccctgtggc

SEQ ID NO: 8242077 - DNA, 22 bp, Homo sapiens
cagctggcctgatccctgtggc

SEQ ID NO: 8242078 - DNA, 22 bp, Homo sapiens
cagctggccaatcagggcgccc

SEQ ID NO: 8242079 - DNA, 22 bp, Homo sapiens
cagctggccaatcagggcgccc

SEQ ID NO: 8242080 - DNA, 22 bp, Homo sapiens
cagctggccccacagtagaggc

SEQ ID NO: 8242081 - DNA, 22 bp, Homo sapiens
cagctggccctttggtagcctt

SEQ ID NO: 8242082 - DNA, 22 bp, Homo sapiens
cagctggccccacagtagaggc

SEQ ID NO: 8242083 - DNA, 22 bp, Homo sapiens
cagctggccccacagtagaggc

SEQ ID NO: 8242084 - DNA, 22 bp, Homo sapiens
gtgtgctcaagggcaggaacct

SEQ ID NO: 8242085 - DNA, 22 bp, Homo sapiens
gtgtgcctttcacacactggga

SEQ ID NO: 8242086 - DNA, 22 bp, Homo sapiens
gtgtgctgagtgactgtcatca

SEQ ID NO: 8242087 - DNA, 22 bp, Homo sapiens
gtgtgctgagtgactgtcatca

SEQ ID NO: 8242088 - DNA, 22 bp, Homo sapiens
gtgtggaaagagtggcctctca

SEQ ID NO: 8242089 - DNA, 22 bp, Homo sapiens
gtgtggaaagagtggcctctca

SEQ ID NO: 8242090 - DNA, 22 bp, Homo sapiens
gtgtgctgcccaactcgcagat

SEQ ID NO: 8242091 - DNA, 22 bp, Homo sapiens
gtgtgctgcccaactcgcagat

SEQ ID NO: 8242092 - DNA, 21 bp, Homo sapiens
gtgtgctgatacattggagaa

SEQ ID NO: 8242093 - DNA, 22 bp, Homo sapiens
cagctgggagctccattagata

SEQ ID NO: 8242094 - DNA, 22 bp, Homo sapiens
cagctggcttgtttgttcttga

SEQ ID NO: 8242095 - DNA, 22 bp, Homo sapiens
cagctgggagctccattagata

SEQ ID NO: 8242096 - DNA, 22 bp, Homo sapiens
cagctggctggtcagtgcacaa

SEQ ID NO: 8242097 - DNA, 22 bp, Homo sapiens
cagctggctggtcagtgcacaa

SEQ ID NO: 8242098 - DNA, 22 bp, Homo sapiens
cagctggctggtcagtgcacaa

SEQ ID NO: 8242099 - DNA, 22 bp, Homo sapiens
cagctggctggtcagtgcacaa

SEQ ID NO: 8242100 - DNA, 22 bp, Homo sapiens
cagctggctgcggtgaggggac

SEQ ID NO: 8242101 - DNA, 22 bp, Homo sapiens
gtgtggccgtgtatccatggct

SEQ ID NO: 8242102 - DNA, 22 bp, Homo sapiens
cagctggctgcggtgaggggac

SEQ ID NO: 8242103 - DNA, 22 bp, Homo sapiens
cagctggctgcggtgaggggac

SEQ ID NO: 8242104 - DNA, 22 bp, Homo sapiens
gtgtggcctcaacgggatgcaa

SEQ ID NO: 8242105 - DNA, 22 bp, Homo sapiens
gtgtggccgtgtatccatggct

SEQ ID NO: 8242106 - DNA, 22 bp, Homo sapiens
cagctggggagagacatggcag

SEQ ID NO: 8242107 - DNA, 22 bp, Homo sapiens
cagctggggagagacatggcag

SEQ ID NO: 8242108 - DNA, 22 bp, Homo sapiens
cagctggggcagccacgtgcgg

SEQ ID NO: 8242109 - DNA, 22 bp, Homo sapiens
cagctgggtgatcttgggcagg

SEQ ID NO: 8242110 - DNA, 22 bp, Homo sapiens
cagctgggtgatcttgggcagg

SEQ ID NO: 8242111 - DNA, 22 bp, Homo sapiens
cagctggggcagccacgtgcgg

SEQ ID NO: 8242112 - DNA, 22 bp, Homo sapiens
cagctggggcagccacgtgcgg

SEQ ID NO: 8242113 - DNA, 22 bp, Homo sapiens
cagctgggcctcctgagccctg

SEQ ID NO: 8242114 - DNA, 22 bp, Homo sapiens
cagctgggcctcctgagccctg

SEQ ID NO: 8242115 - DNA, 22 bp, Homo sapiens
cagctgggcctcctgagccctg

SEQ ID NO: 8242116 - DNA, 22 bp, Homo sapiens
cagctgggagctccattagata

SEQ ID NO: 8242117 - DNA, 22 bp, Homo sapiens
cagctgggagctccattagata

SEQ ID NO: 8242118 - DNA, 22 bp, Homo sapiens
cagctgggctaagagtagaggc

SEQ ID NO: 8242119 - DNA, 22 bp, Homo sapiens
cagctggggagagacatggcag

SEQ ID NO: 8242120 - DNA, 22 bp, Homo sapiens
cagctggggagagacatggcag

SEQ ID NO: 8242121 - DNA, 22 bp, Homo sapiens
cagctggggagagacatggcag

SEQ ID NO: 8242122 - DNA, 22 bp, Homo sapiens
cagctgtctaagttgagcagga

SEQ ID NO: 8242123 - DNA, 22 bp, Homo sapiens
cagctgtctgaagcaggagtcc

SEQ ID NO: 8242124 - DNA, 22 bp, Homo sapiens
cagctgtctcagggaggtgatc

SEQ ID NO: 8242125 - DNA, 22 bp, Homo sapiens
cagctgtctaagttgagcagga

SEQ ID NO: 8242126 - DNA, 22 bp, Homo sapiens
cagctgtctaagttgagcagga

SEQ ID NO: 8242127 - DNA, 22 bp, Homo sapiens
cagctgggtgatcttgggcagg

SEQ ID NO: 8242128 - DNA, 22 bp, Homo sapiens
cagctgtctggggagtgctcgc

SEQ ID NO: 8242129 - DNA, 22 bp, Homo sapiens
cagctgtctttgcacagtttag

SEQ ID NO: 8242130 - DNA, 22 bp, Homo sapiens
cagctgtgagcagccagttgcc

SEQ ID NO: 8242131 - DNA, 22 bp, Homo sapiens
cagctgtgacagccagttgatg

SEQ ID NO: 8242132 - DNA, 17 bp, Homo sapiens
cagctgtgagagcctta

SEQ ID NO: 8242133 - DNA, 22 bp, Homo sapiens
cagctgtgacagccagttgatg

SEQ ID NO: 8242134 - DNA, 22 bp, Homo sapiens
gtgggtgtggaactgtgagacc

SEQ ID NO: 8242135 - DNA, 22 bp, Homo sapiens
gtgggttcgtggtctcgctggc

SEQ ID NO: 8242136 - DNA, 22 bp, Homo sapiens
gtgtacagtaagtgaatctagg

SEQ ID NO: 8242137 - DNA, 22 bp, Homo sapiens
gtgtacagtaagtgaatctagg

SEQ ID NO: 8242138 - DNA, 22 bp, Homo sapiens
gtgtacaggatgactgtactta

SEQ ID NO: 8242139 - DNA, 22 bp, Homo sapiens
gtggtaggcacagagaacaaga

SEQ ID NO: 8242140 - DNA, 22 bp, Homo sapiens
gtgggtggggagctctctggag

SEQ ID NO: 8242141 - DNA, 22 bp, Homo sapiens
gtgggtggggagctctctggag

SEQ ID NO: 8242142 - DNA, 22 bp, Homo sapiens
gtgggtggggagctctctggag

SEQ ID NO: 8242143 - DNA, 22 bp, Homo sapiens
gtgggtggattccagcaacgct

SEQ ID NO: 8242144 - DNA, 22 bp, Homo sapiens
gtgggtggattccagcaacgct

SEQ ID NO: 8242145 - DNA, 22 bp, Homo sapiens
gtgggtggggagctctctggag

SEQ ID NO: 8242146 - DNA, 22 bp, Homo sapiens
gtgggtggggagctctctggag

SEQ ID NO: 8242147 - DNA, 22 bp, Homo sapiens
gtgggtggggagctctctggag

SEQ ID NO: 8242148 - DNA, 22 bp, Homo sapiens
gtgtacatagaattgtgctttg

SEQ ID NO: 8242149 - DNA, 22 bp, Homo sapiens
gtgtacatattgagtctgctga

SEQ ID NO: 8242150 - DNA, 22 bp, Homo sapiens
gtgtataacccaaatatgctgc

SEQ ID NO: 8242151 - DNA, 22 bp, Homo sapiens
gtgtataacccaaatatgctgc

SEQ ID NO: 8242152 - DNA, 19 bp, Homo sapiens
gtgtagctattggtcaaaa

SEQ ID NO: 8242153 - DNA, 22 bp, Homo sapiens
gtgtatctcatgttcttctctg

SEQ ID NO: 8242154 - DNA, 22 bp, Homo sapiens
gtgtatccttattcacacacat

SEQ ID NO: 8242155 - DNA, 22 bp, Homo sapiens
gtgtataactatctatctagta

SEQ ID NO: 8242156 - DNA, 22 bp, Homo sapiens
gtgtataactatctatctagta

SEQ ID NO: 8242157 - DNA, 22 bp, Homo sapiens
gtgtataatcctgcaaagggag

SEQ ID NO: 8242158 - DNA, 22 bp, Homo sapiens
gtgtataataatgtgagctaaa

SEQ ID NO: 8242159 - DNA, 22 bp, Homo sapiens
gtgtataatgctgtttgtacat

SEQ ID NO: 8242160 - DNA, 22 bp, Homo sapiens
gtgtataggtgtgtaaccaaaa

SEQ ID NO: 8242161 - DNA, 22 bp, Homo sapiens
gtgtataatgctttgaagatta

SEQ ID NO: 8242162 - DNA, 22 bp, Homo sapiens
gtgtctggcttatgggaactgg

SEQ ID NO: 8242163 - DNA, 20 bp, Homo sapiens
gtgtctggagtactagagag

SEQ ID NO: 8242164 - DNA, 22 bp, Homo sapiens
gtgtctggaacgggtggtactc

SEQ ID NO: 8242165 - DNA, 22 bp, Homo sapiens
gtgtctggaacgggtggtactc

SEQ ID NO: 8242166 - DNA, 22 bp, Homo sapiens
gtgtcaaatccactcctctttt

SEQ ID NO: 8242167 - DNA, 22 bp, Homo sapiens
gtgtattagtgagaaggaagat

SEQ ID NO: 8242168 - DNA, 22 bp, Homo sapiens
gtgtatgttctacttaatatta

SEQ ID NO: 8242169 - DNA, 22 bp, Homo sapiens
gtgtatgttctacttaatatta

SEQ ID NO: 8242170 - DNA, 22 bp, Homo sapiens
gtgtatgttctacttaatatta

SEQ ID NO: 8242171 - DNA, 22 bp, Homo sapiens
gtgtatgtgccttacattttat

SEQ ID NO: 8242172 - DNA, 19 bp, Homo sapiens
gtgtatgtaagttgtgagg

SEQ ID NO: 8242173 - DNA, 19 bp, Homo sapiens
gtgtatgtaagttgtgagg

SEQ ID NO: 8242174 - DNA, 22 bp, Homo sapiens
gtgtatgtgccttacattttat

SEQ ID NO: 8242175 - DNA, 22 bp, Homo sapiens
gtgtatgtgccttacattttat

SEQ ID NO: 8242176 - DNA, 22 bp, Homo sapiens
gtgtctttattcctctatgttt

SEQ ID NO: 8242177 - DNA, 22 bp, Homo sapiens
gtgtgaaagttcctaagactat

SEQ ID NO: 8242178 - DNA, 22 bp, Homo sapiens
gtgtgaaagttcctaagactat

SEQ ID NO: 8242179 - DNA, 22 bp, Homo sapiens
gtgtcttttgaggctgaccagt

SEQ ID NO: 8242180 - DNA, 22 bp, Homo sapiens
gtgtgagcagaaaccatgagta

SEQ ID NO: 8242181 - DNA, 22 bp, Homo sapiens
gtgtgagcaggtttgacctaag

SEQ ID NO: 8242182 - DNA, 22 bp, Homo sapiens
gtgtgagcagaaaccatgagta

SEQ ID NO: 8242183 - DNA, 22 bp, Homo sapiens
gtgtgagcatcaaagcctgtca

SEQ ID NO: 8242184 - DNA, 22 bp, Homo sapiens
gtgtgactagtcatgcctgaat

SEQ ID NO: 8242185 - DNA, 20 bp, Homo sapiens
gtgtgaagccctcaggagga

SEQ ID NO: 8242186 - DNA, 22 bp, Homo sapiens
gtgtgacccaaggacactctct

SEQ ID NO: 8242187 - DNA, 22 bp, Homo sapiens
caggagatgacagggaagaacc

SEQ ID NO: 8242188 - DNA, 22 bp, Homo sapiens
caggagatgacagggaagaacc

SEQ ID NO: 8242189 - DNA, 22 bp, Homo sapiens
caggagataaaagagatgcttt

SEQ ID NO: 8242190 - DNA, 22 bp, Homo sapiens
caggagatcttaggaattctta

SEQ ID NO: 8242191 - DNA, 22 bp, Homo sapiens
caggagataaaagagatgcttt

SEQ ID NO: 8242192 - DNA, 22 bp, Homo sapiens
caggagataaaagagatgcttt

SEQ ID NO: 8242193 - DNA, 22 bp, Homo sapiens
caggagatgtaagacttctgtt

SEQ ID NO: 8242194 - DNA, 22 bp, Homo sapiens
caggagatgtaagacttctgtt

SEQ ID NO: 8242195 - DNA, 22 bp, Homo sapiens
caggagatgtaagacttctgtt

SEQ ID NO: 8242196 - DNA, 22 bp, Homo sapiens
caggagatgtacctgtttttga

SEQ ID NO: 8242197 - DNA, 22 bp, Homo sapiens
caggagatgacagggaagaacc

SEQ ID NO: 8242198 - DNA, 22 bp, Homo sapiens
caggagatgcggtgtttgctct

SEQ ID NO: 8242199 - DNA, 23 bp, Homo sapiens
caggagatggctgctgtgtcagc

SEQ ID NO: 8242200 - DNA, 23 bp, Homo sapiens
caggagatggctgctgtgtcagc

SEQ ID NO: 8242201 - DNA, 22 bp, Homo sapiens
caggagagcccgggtccgggct

SEQ ID NO: 8242202 - DNA, 22 bp, Homo sapiens
caggagagcccgggtccgggct

SEQ ID NO: 8242203 - DNA, 22 bp, Homo sapiens
caggagagcccgggtccgggct

SEQ ID NO: 8242204 - DNA, 22 bp, Homo sapiens
caggagagatatgagtccccac

SEQ ID NO: 8242205 - DNA, 22 bp, Homo sapiens
caggagactcagcatccaggat

SEQ ID NO: 8242206 - DNA, 22 bp, Homo sapiens
caggagactcagcatccaggat

SEQ ID NO: 8242207 - DNA, 22 bp, Homo sapiens
caggagactcagcatccaggat

SEQ ID NO: 8242208 - DNA, 19 bp, Homo sapiens
caggagagcatgcactttg

SEQ ID NO: 8242209 - DNA, 22 bp, Homo sapiens
taaagcataatgaatatctaga

SEQ ID NO: 8242210 - DNA, 22 bp, Homo sapiens
taaagcagtgttgggtcggacg

SEQ ID NO: 8242211 - DNA, 22 bp, Homo sapiens
taaagcataatgaatatctaga

SEQ ID NO: 8242212 - DNA, 22 bp, Homo sapiens
taaagcataatgaatatctaga

SEQ ID NO: 8242213 - DNA, 22 bp, Homo sapiens
taaagcagtgtggttgtgtccc

SEQ ID NO: 8242214 - DNA, 22 bp, Homo sapiens
caggagctggatctccttgcgg

SEQ ID NO: 8242215 - DNA, 22 bp, Homo sapiens
caggagctcttaaggatgtgat

SEQ ID NO: 8242216 - DNA, 22 bp, Homo sapiens
caggagctcttaaggatgtgat

SEQ ID NO: 8242217 - DNA, 22 bp, Homo sapiens
caggagctctcatcgtcagggc

SEQ ID NO: 8242218 - DNA, 22 bp, Homo sapiens
caggagctggataggaccacaa

SEQ ID NO: 8242219 - DNA, 22 bp, Homo sapiens
caggagctggataggaccacaa

SEQ ID NO: 8242220 - DNA, 22 bp, Homo sapiens
caggagctcttaaggatgtgat

SEQ ID NO: 8242221 - DNA, 22 bp, Homo sapiens
caggagctcaagaccaccctgg

SEQ ID NO: 8242222 - DNA, 22 bp, Homo sapiens
caggagctcagatgacatctca

SEQ ID NO: 8242223 - DNA, 22 bp, Homo sapiens
caggagctcagatgacatctca

SEQ ID NO: 8242224 - DNA, 22 bp, Homo sapiens
caggagctactcaggttgggtt

SEQ ID NO: 8242225 - DNA, 22 bp, Homo sapiens
caggagctcaagaccaccctgg

SEQ ID NO: 8242226 - DNA, 22 bp, Homo sapiens
caggagctactcaggttgggtt

SEQ ID NO: 8242227 - DNA, 22 bp, Homo sapiens
caggagccttaggaaatacatc

SEQ ID NO: 8242228 - DNA, 22 bp, Homo sapiens
caggagcccgttgctccggcgg

SEQ ID NO: 8242229 - DNA, 22 bp, Homo sapiens
caggagccccaggctgacaata

SEQ ID NO: 8242230 - DNA, 22 bp, Homo sapiens
caggagcccgttgctccggcgg

SEQ ID NO: 8242231 - DNA, 22 bp, Homo sapiens
caggagccgccaggcacgttgg

SEQ ID NO: 8242232 - DNA, 22 bp, Homo sapiens
taaatatcacctggaattgtta

SEQ ID NO: 8242233 - DNA, 22 bp, Homo sapiens
taaatatcacctggaattgtta

SEQ ID NO: 8242234 - DNA, 22 bp, Homo sapiens
taaatatcagtccagctcttcc

SEQ ID NO: 8242235 - DNA, 22 bp, Homo sapiens
taaatatcagtccagctcttcc

SEQ ID NO: 8242236 - DNA, 22 bp, Homo sapiens
taaatatgcatgtatccttatc

SEQ ID NO: 8242237 - DNA, 22 bp, Homo sapiens
taaatatgcatgtatccttatc

SEQ ID NO: 8242238 - DNA, 22 bp, Homo sapiens
taaatcaagaatatcagcttgt

SEQ ID NO: 8242239 - DNA, 22 bp, Homo sapiens
taaatgcttagattcatagaaa

SEQ ID NO: 8242240 - DNA, 22 bp, Homo sapiens
taaatcaagaatatcagcttgt

SEQ ID NO: 8242241 - DNA, 22 bp, Homo sapiens
taaagtgagtacaaaatgaggg

SEQ ID NO: 8242242 - DNA, 18 bp, Homo sapiens
taaatatatttccccctt

SEQ ID NO: 8242243 - DNA, 18 bp, Homo sapiens
taaatatatttccccctt

SEQ ID NO: 8242244 - DNA, 18 bp, Homo sapiens
taaatatatttccccctt

SEQ ID NO: 8242245 - DNA, 22 bp, Homo sapiens
taaatagagaatcagcttggag

SEQ ID NO: 8242246 - DNA, 22 bp, Homo sapiens
taaatagagaatcagcttggag

SEQ ID NO: 8242247 - DNA, 22 bp, Homo sapiens
taaatagaatctaaactgctca

SEQ ID NO: 8242248 - DNA, 22 bp, Homo sapiens
taaatagaatctaaactgctca

SEQ ID NO: 8242249 - DNA, 22 bp, Homo sapiens
taaatagagaatcagcttggag

SEQ ID NO: 8242250 - DNA, 22 bp, Homo sapiens
taaatagagaatcagcttggag

SEQ ID NO: 8242251 - DNA, 22 bp, Homo sapiens
taaagcatttttgaaattatga

SEQ ID NO: 8242252 - DNA, 22 bp, Homo sapiens
taaagcatgtttcagtaaggtt

SEQ ID NO: 8242253 - DNA, 22 bp, Homo sapiens
taaagcatgtgttagaagtgca

SEQ ID NO: 8242254 - DNA, 22 bp, Homo sapiens
taaagccacgctggaaatcagg

SEQ ID NO: 8242255 - DNA, 22 bp, Homo sapiens
taaagccacgctggaaatcagg

SEQ ID NO: 8242256 - DNA, 22 bp, Homo sapiens
taaagccacttcattctagtct

SEQ ID NO: 8242257 - DNA, 17 bp, Homo sapiens
taaagccagtcaagtca

SEQ ID NO: 8242258 - DNA, 22 bp, Homo sapiens
taaagccatactgaaagccact

SEQ ID NO: 8242259 - DNA, 22 bp, Homo sapiens
taaagtcataagagtggatccg

SEQ ID NO: 8242260 - DNA, 22 bp, Homo sapiens
taaagtcagggagattgaggct

SEQ ID NO: 8242261 - DNA, 22 bp, Homo sapiens
taaagtcatctttaaacatgcc

SEQ ID NO: 8242262 - DNA, 22 bp, Homo sapiens
taaagtcagatatctgggttga

SEQ ID NO: 8242263 - DNA, 22 bp, Homo sapiens
taaagtcacagagcaggtgcaa

SEQ ID NO: 8242264 - DNA, 23 bp, Homo sapiens
taaagtcacatattagagtgagc

SEQ ID NO: 8242265 - DNA, 22 bp, Homo sapiens
taaagtcagagatccttggctt

SEQ ID NO: 8242266 - DNA, 22 bp, Homo sapiens
taaagtcatctttaaacatgcc

SEQ ID NO: 8242267 - DNA, 22 bp, Homo sapiens
taaagtcatctttaaacatgcc

SEQ ID NO: 8242268 - DNA, 22 bp, Homo sapiens
taaagtcatctttacatctttg

SEQ ID NO: 8242269 - DNA, 22 bp, Homo sapiens
caggagtttctattgttccaaa

SEQ ID NO: 8242270 - DNA, 22 bp, Homo sapiens
caggagtgttgattgctcagga

SEQ ID NO: 8242271 - DNA, 22 bp, Homo sapiens
caggagttcaaggttgcagtga

SEQ ID NO: 8242272 - DNA, 22 bp, Homo sapiens
caggagttcaaggttgcagtga

SEQ ID NO: 8242273 - DNA, 22 bp, Homo sapiens
taacaaagtaccatagattggg

SEQ ID NO: 8242274 - DNA, 22 bp, Homo sapiens
taacaaagtaccatagactgga

SEQ ID NO: 8242275 - DNA, 22 bp, Homo sapiens
taacaaaggttgccaaactaag

SEQ ID NO: 8242276 - DNA, 22 bp, Homo sapiens
caggagtggtgtgagggactcc

SEQ ID NO: 8242277 - DNA, 22 bp, Homo sapiens
caggagtgaaatgaggcccagg

SEQ ID NO: 8242278 - DNA, 22 bp, Homo sapiens
caggagtgagttggggtctaca

SEQ ID NO: 8242279 - DNA, 22 bp, Homo sapiens
caggagtgtctccacacagcaa

SEQ ID NO: 8242280 - DNA, 22 bp, Homo sapiens
caggagtgtctccacacagcaa

SEQ ID NO: 8242281 - DNA, 22 bp, Homo sapiens
caggagtgtctccacacagcaa

SEQ ID NO: 8242282 - DNA, 22 bp, Homo sapiens
caggagtggtgtgagggactcc

SEQ ID NO: 8242283 - DNA, 22 bp, Homo sapiens
caggagtggtgtgagggactcc

SEQ ID NO: 8242284 - DNA, 22 bp, Homo sapiens
caggagtggtgtgagggactcc

SEQ ID NO: 8242285 - DNA, 22 bp, Homo sapiens
caggagtgtcgggtcactaggt

SEQ ID NO: 8242286 - DNA, 22 bp, Homo sapiens
caggagtgtcgggtcactaggt

SEQ ID NO: 8242287 - DNA, 22 bp, Homo sapiens
caggagtggtgtgagggactcc

SEQ ID NO: 8242288 - DNA, 22 bp, Homo sapiens
caggagggggtggagtttcgcc

SEQ ID NO: 8242289 - DNA, 22 bp, Homo sapiens
caggagggcccgagactcttcc

SEQ ID NO: 8242290 - DNA, 22 bp, Homo sapiens
caggaggctcctagggctctgt

SEQ ID NO: 8242291 - DNA, 22 bp, Homo sapiens
caggaggctcctagggctctgt

SEQ ID NO: 8242292 - DNA, 22 bp, Homo sapiens
caggaggcccggccacagccca

SEQ ID NO: 8242293 - DNA, 22 bp, Homo sapiens
caggaggcccaaagggcgcaga

SEQ ID NO: 8242294 - DNA, 22 bp, Homo sapiens
caggaggcccaaagggcgcaga

SEQ ID NO: 8242295 - DNA, 22 bp, Homo sapiens
caggaggcccaaagggcgcaga

SEQ ID NO: 8242296 - DNA, 22 bp, Homo sapiens
caggaggcatcatggagcggac

SEQ ID NO: 8242297 - DNA, 22 bp, Homo sapiens
caggaggcatcatggagcggac

SEQ ID NO: 8242298 - DNA, 22 bp, Homo sapiens
caggaggccaactgtgggactt

SEQ ID NO: 8242299 - DNA, 22 bp, Homo sapiens
caggaggccaactgtgggactt

SEQ ID NO: 8242300 - DNA, 22 bp, Homo sapiens
taaatgtaaatggcgtcttgcg

SEQ ID NO: 8242301 - DNA, 22 bp, Homo sapiens
taaatgtaaatggcgtcttgcg

SEQ ID NO: 8242302 - DNA, 22 bp, Homo sapiens
taaatgtaccttctgccttact

SEQ ID NO: 8242303 - DNA, 22 bp, Homo sapiens
taaatgtaccttctgccttact

SEQ ID NO: 8242304 - DNA, 22 bp, Homo sapiens
taaatgtactgaggcaacagga

SEQ ID NO: 8242305 - DNA, 22 bp, Homo sapiens
taaatgtactgaggcaacagga

SEQ ID NO: 8242306 - DNA, 22 bp, Homo sapiens
taaatgtagtcaaaggagcctc

SEQ ID NO: 8242307 - DNA, 22 bp, Homo sapiens
taaatgtataggcactaaacct

SEQ ID NO: 8242308 - DNA, 22 bp, Homo sapiens
taaatgtataggcactaaacct

SEQ ID NO: 8242309 - DNA, 22 bp, Homo sapiens
taaatgtataggcactaaacct

SEQ ID NO: 8242310 - DNA, 22 bp, Homo sapiens
taaatgtataggcactaaacct

SEQ ID NO: 8242311 - DNA, 22 bp, Homo sapiens
taaatgtataggcactaaacct

SEQ ID NO: 8242312 - DNA, 22 bp, Homo sapiens
taaatgtagtcaaaggagcctc

SEQ ID NO: 8242313 - DNA, 21 bp, Homo sapiens
taaatgtgagcagggctgggc

SEQ ID NO: 8242314 - DNA, 22 bp, Homo sapiens
caggagctggatctccttgcgg

SEQ ID NO: 8242315 - DNA, 22 bp, Homo sapiens
caggagctgggtctggaagcag

SEQ ID NO: 8242316 - DNA, 22 bp, Homo sapiens
caggagcttctgcccatggcca

SEQ ID NO: 8242317 - DNA, 22 bp, Homo sapiens
caggagctttcttcccaaactt

SEQ ID NO: 8242318 - DNA, 22 bp, Homo sapiens
caggaggaaactggattcactt

SEQ ID NO: 8242319 - DNA, 22 bp, Homo sapiens
caggaggaaactggattcactt

SEQ ID NO: 8242320 - DNA, 22 bp, Homo sapiens
caggagcttctgcccatggcca

SEQ ID NO: 8242321 - DNA, 22 bp, Homo sapiens
caggagcttctgcccatggcca

SEQ ID NO: 8242322 - DNA, 22 bp, Homo sapiens
caggagctgggtctggaagcag

SEQ ID NO: 8242323 - DNA, 22 bp, Homo sapiens
caggaggcagaggttgcagcga

SEQ ID NO: 8242324 - DNA, 22 bp, Homo sapiens
caggaggcagaggttgcagcga

SEQ ID NO: 8242325 - DNA, 22 bp, Homo sapiens
caggaggcagaggatgcccagt

SEQ ID NO: 8242326 - DNA, 22 bp, Homo sapiens
caggaggaaatgtgaccctgct

SEQ ID NO: 8242327 - DNA, 22 bp, Homo sapiens
caggaggaaatgtgaccctgct

SEQ ID NO: 8242328 - DNA, 22 bp, Homo sapiens
caggaggaacaagaggttctgg

SEQ ID NO: 8242329 - DNA, 22 bp, Homo sapiens
caggaggaacaagaggttctgg

SEQ ID NO: 8242330 - DNA, 22 bp, Homo sapiens
caggaggaaagttccactcaac

SEQ ID NO: 8242331 - DNA, 22 bp, Homo sapiens
caggaggaaagttccactcaac

SEQ ID NO: 8242332 - DNA, 22 bp, Homo sapiens
caggaggaaagttccactcaac

SEQ ID NO: 8242333 - DNA, 22 bp, Homo sapiens
caggaggaaatgtgaccctgct

SEQ ID NO: 8242334 - DNA, 20 bp, Homo sapiens
caggaggcaaggtcaaggtc

SEQ ID NO: 8242335 - DNA, 22 bp, Homo sapiens
caggaggcagaggatgcccagt

SEQ ID NO: 8242336 - DNA, 22 bp, Homo sapiens
caggaggaagaactctgcaaca

SEQ ID NO: 8242337 - DNA, 22 bp, Homo sapiens
caggaggaagaactctgcaaca

SEQ ID NO: 8242338 - DNA, 22 bp, Homo sapiens
caggaggaacaagaggttctgg

SEQ ID NO: 8242339 - DNA, 22 bp, Homo sapiens
caggaggattgcttgaggccag

SEQ ID NO: 8242340 - DNA, 22 bp, Homo sapiens
caggaggattgcttgaggccag

SEQ ID NO: 8242341 - DNA, 22 bp, Homo sapiens
caggaggacatactggctcaca

SEQ ID NO: 8242342 - DNA, 22 bp, Homo sapiens
caggaggaagaactctgcaaca

SEQ ID NO: 8242343 - DNA, 22 bp, Homo sapiens
gttttctgtttcttaacggcat

SEQ ID NO: 8242344 - DNA, 22 bp, Homo sapiens
gttttctggcagttattcctta

SEQ ID NO: 8242345 - DNA, 22 bp, Homo sapiens
taaaaaacattactctgtcctg

SEQ ID NO: 8242346 - DNA, 22 bp, Homo sapiens
taaaaagtagtgagaatggcgc

SEQ ID NO: 8242347 - DNA, 22 bp, Homo sapiens
taaaaagcagctgagattttct

SEQ ID NO: 8242348 - DNA, 22 bp, Homo sapiens
taaaaagcagctgagattttct

SEQ ID NO: 8242349 - DNA, 19 bp, Homo sapiens
taaaaactgaaggaagcag

SEQ ID NO: 8242350 - DNA, 19 bp, Homo sapiens
taaaaactgaaggaagcag

SEQ ID NO: 8242351 - DNA, 22 bp, Homo sapiens
gttttctgattagcaaatctga

SEQ ID NO: 8242352 - DNA, 22 bp, Homo sapiens
gttttctgcctgaaggtgacca

SEQ ID NO: 8242353 - DNA, 22 bp, Homo sapiens
gttttctgccggtggtgggctc

SEQ ID NO: 8242354 - DNA, 19 bp, Homo sapiens
gttttctgatcttgccccc

SEQ ID NO: 8242355 - DNA, 22 bp, Homo sapiens
gttttctaccagggaagagagt

SEQ ID NO: 8242356 - DNA, 22 bp, Homo sapiens
gttttctcatctcctcaatggt

SEQ ID NO: 8242357 - DNA, 22 bp, Homo sapiens
gttttctcatctcctcaatggt

SEQ ID NO: 8242358 - DNA, 22 bp, Homo sapiens
gttttccttctcagccattgcc

SEQ ID NO: 8242359 - DNA, 22 bp, Homo sapiens
gttttcctgagcccagagatgc

SEQ ID NO: 8242360 - DNA, 22 bp, Homo sapiens
gttttcctgttgagtagtattc

SEQ ID NO: 8242361 - DNA, 22 bp, Homo sapiens
taaaatgacttcctccaacatc

SEQ ID NO: 8242362 - DNA, 22 bp, Homo sapiens
taaaatgacttcctccaacatc

SEQ ID NO: 8242363 - DNA, 22 bp, Homo sapiens
taaaatgacttcctccaacatc

SEQ ID NO: 8242364 - DNA, 22 bp, Homo sapiens
taaaatcattctggtgtcagta

SEQ ID NO: 8242365 - DNA, 22 bp, Homo sapiens
taaaatcattctggtgtcagta

SEQ ID NO: 8242366 - DNA, 22 bp, Homo sapiens
taaaatcattctggtgtcagta

SEQ ID NO: 8242367 - DNA, 22 bp, Homo sapiens
taaaatcatgacagattgacat

SEQ ID NO: 8242368 - DNA, 22 bp, Homo sapiens
taaaatcatgacagattgacat

SEQ ID NO: 8242369 - DNA, 22 bp, Homo sapiens
taaaatcagccgaccatggtgg

SEQ ID NO: 8242370 - DNA, 22 bp, Homo sapiens
taaaatcagccgaccatggtgg

SEQ ID NO: 8242371 - DNA, 22 bp, Homo sapiens
taaaatagcttatgtcttttga

SEQ ID NO: 8242372 - DNA, 22 bp, Homo sapiens
taaaatcaccaaaagcaggtgg

SEQ ID NO: 8242373 - DNA, 22 bp, Homo sapiens
taaaaatcttatgaatggcaag

SEQ ID NO: 8242374 - DNA, 22 bp, Homo sapiens
taaaaatcttatgaatggcaag

SEQ ID NO: 8242375 - DNA, 22 bp, Homo sapiens
taaaaatcttatgaatggcaag

SEQ ID NO: 8242376 - DNA, 22 bp, Homo sapiens
taaaaagtagtgagaatggcgc

SEQ ID NO: 8242377 - DNA, 22 bp, Homo sapiens
taaaaagttgaaaggacttatc

SEQ ID NO: 8242378 - DNA, 22 bp, Homo sapiens
taaaatagcttatgtcttttga

SEQ ID NO: 8242379 - DNA, 22 bp, Homo sapiens
taaaatagcttatgtcttttga

SEQ ID NO: 8242380 - DNA, 22 bp, Homo sapiens
taaaatagcttatgtcttttga

SEQ ID NO: 8242381 - DNA, 22 bp, Homo sapiens
taaaatagcatgtgcagtgaaa

SEQ ID NO: 8242382 - DNA, 22 bp, Homo sapiens
taaaatagccagtgcccctctg

SEQ ID NO: 8242383 - DNA, 22 bp, Homo sapiens
taaaatagcatgtgcagtgaaa

SEQ ID NO: 8242384 - DNA, 22 bp, Homo sapiens
taaaatagcatgtgcagtgaaa

SEQ ID NO: 8242385 - DNA, 22 bp, Homo sapiens
caggagactatggcccaaggcc

SEQ ID NO: 8242386 - DNA, 22 bp, Homo sapiens
caggagacctggtaagccaagt

SEQ ID NO: 8242387 - DNA, 22 bp, Homo sapiens
caggagacctggtaagccaagt

SEQ ID NO: 8242388 - DNA, 22 bp, Homo sapiens
caggagacctggtaagccaagt

SEQ ID NO: 8242389 - DNA, 22 bp, Homo sapiens
caggagacaagttagcagctga

SEQ ID NO: 8242390 - DNA, 22 bp, Homo sapiens
caggagacaagttagcagctga

SEQ ID NO: 8242391 - DNA, 22 bp, Homo sapiens
caggagacaagttagcagctga

SEQ ID NO: 8242392 - DNA, 22 bp, Homo sapiens
caggagacaagttagcagctga

SEQ ID NO: 8242393 - DNA, 22 bp, Homo sapiens
caggagaaggtttggagtgcag

SEQ ID NO: 8242394 - DNA, 22 bp, Homo sapiens
caggagaagtctctagggggtg

SEQ ID NO: 8242395 - DNA, 22 bp, Homo sapiens
caggagaagtctctagggggtg

SEQ ID NO: 8242396 - DNA, 22 bp, Homo sapiens
caggagaagtctctagggggtg

SEQ ID NO: 8242397 - DNA, 22 bp, Homo sapiens
caggagaaggtttggagtgcag

SEQ ID NO: 8242398 - DNA, 22 bp, Homo sapiens
caggagaaggtttggagtgcag

SEQ ID NO: 8242399 - DNA, 22 bp, Homo sapiens
caggagaaggtttggagtgcag

SEQ ID NO: 8242400 - DNA, 19 bp, Homo sapiens
caggacagtttgccaagaa

SEQ ID NO: 8242401 - DNA, 22 bp, Homo sapiens
caggacagttggcatctgctgc

SEQ ID NO: 8242402 - DNA, 19 bp, Homo sapiens
caggacagtttgccaagaa

SEQ ID NO: 8242403 - DNA, 19 bp, Homo sapiens
caggacagtttgccaagaa

SEQ ID NO: 8242404 - DNA, 19 bp, Homo sapiens
caggacagtttgccaagaa

SEQ ID NO: 8242405 - DNA, 22 bp, Homo sapiens
caggacagtttgctttgccctg

SEQ ID NO: 8242406 - DNA, 22 bp, Homo sapiens
caggacatcgtcatcatgggga

SEQ ID NO: 8242407 - DNA, 22 bp, Homo sapiens
caggaccaggcgttctgggctg

SEQ ID NO: 8242408 - DNA, 22 bp, Homo sapiens
caggacagtgcaggtccatcct

SEQ ID NO: 8242409 - DNA, 22 bp, Homo sapiens
caggacagttggcatctgctgc

SEQ ID NO: 8242410 - DNA, 22 bp, Homo sapiens
caggacagtgcaggtccatcct

SEQ ID NO: 8242411 - DNA, 22 bp, Homo sapiens
caggacagtgcaggtccatcct

SEQ ID NO: 8242412 - DNA, 22 bp, Homo sapiens
taaactatctgtgtttgaagtt

SEQ ID NO: 8242413 - DNA, 22 bp, Homo sapiens
taaactatctgtgtttgaagtt

SEQ ID NO: 8242414 - DNA, 22 bp, Homo sapiens
taaaatgatctctcatgttctt

SEQ ID NO: 8242415 - DNA, 22 bp, Homo sapiens
taaaatgacttcctccaacatc

SEQ ID NO: 8242416 - DNA, 22 bp, Homo sapiens
taaaatgacttcctccaacatc

SEQ ID NO: 8242417 - DNA, 22 bp, Homo sapiens
taaacatttgttattcttgttt

SEQ ID NO: 8242418 - DNA, 22 bp, Homo sapiens
taaaccaagtgtccatattagt

SEQ ID NO: 8242419 - DNA, 18 bp, Homo sapiens
taaaccagatgacagttg

SEQ ID NO: 8242420 - DNA, 22 bp, Homo sapiens
taaaccatgcagacagctccat

SEQ ID NO: 8242421 - DNA, 22 bp, Homo sapiens
taaaccatccatcccacctgtg

SEQ ID NO: 8242422 - DNA, 22 bp, Homo sapiens
taaaccatccatcccacctgtg

SEQ ID NO: 8242423 - DNA, 22 bp, Homo sapiens
taaaccattcagactgaaccac

SEQ ID NO: 8242424 - DNA, 22 bp, Homo sapiens
taaaccattcagactgaaccac

SEQ ID NO: 8242425 - DNA, 22 bp, Homo sapiens
taaaccatgcagacagctccat

SEQ ID NO: 8242426 - DNA, 22 bp, Homo sapiens
taaaccattcacatcccagaaa

SEQ ID NO: 8242427 - DNA, 22 bp, Homo sapiens
caggacagctgggccaccacca

SEQ ID NO: 8242428 - DNA, 22 bp, Homo sapiens
caggacagctgggccaccacca

SEQ ID NO: 8242429 - DNA, 22 bp, Homo sapiens
caggacactacagatgggaggg

SEQ ID NO: 8242430 - DNA, 22 bp, Homo sapiens
caggacacttgttcttctctgc

SEQ ID NO: 8242431 - DNA, 22 bp, Homo sapiens
caggacacttgttcttctctgc

SEQ ID NO: 8242432 - DNA, 22 bp, Homo sapiens
caggacaggccctgtggggtct

SEQ ID NO: 8242433 - DNA, 22 bp, Homo sapiens
caggacaggccctgtggggtct

SEQ ID NO: 8242434 - DNA, 22 bp, Homo sapiens
caggacaggagtggggtcaaag

SEQ ID NO: 8242435 - DNA, 22 bp, Homo sapiens
caggacaggagtggggtcaaag

SEQ ID NO: 8242436 - DNA, 22 bp, Homo sapiens
caggacaggagtggggtcaaag

SEQ ID NO: 8242437 - DNA, 22 bp, Homo sapiens
caggacagtataggctttagga

SEQ ID NO: 8242438 - DNA, 22 bp, Homo sapiens
caggacaggccctgtggggtct

SEQ ID NO: 8242439 - DNA, 22 bp, Homo sapiens
caggacaggtgttctagatcag

SEQ ID NO: 8242440 - DNA, 22 bp, Homo sapiens
caggacagtgcaggtccatcct

SEQ ID NO: 8242441 - DNA, 22 bp, Homo sapiens
caggacagtgcaggtccatcct

SEQ ID NO: 8242442 - DNA, 22 bp, Homo sapiens
gttttccactggattgtttgga

SEQ ID NO: 8242443 - DNA, 22 bp, Homo sapiens
gttttccaggtaccttggtatt

SEQ ID NO: 8242444 - DNA, 22 bp, Homo sapiens
gttttccaggtaccttggtatt

SEQ ID NO: 8242445 - DNA, 22 bp, Homo sapiens
gttttccatggaggtctgacct

SEQ ID NO: 8242446 - DNA, 22 bp, Homo sapiens
gttttcctactgtatcatcaaa

SEQ ID NO: 8242447 - DNA, 18 bp, Homo sapiens
gttttccatttgttcctc

SEQ ID NO: 8242448 - DNA, 22 bp, Homo sapiens
gttttcctgaaactgatggtgt

SEQ ID NO: 8242449 - DNA, 22 bp, Homo sapiens
caggaatgccaaccagtgcatg

SEQ ID NO: 8242450 - DNA, 22 bp, Homo sapiens
caggaatgcattctagaatggc

SEQ ID NO: 8242451 - DNA, 22 bp, Homo sapiens
caggaatgatattcgaggagat

SEQ ID NO: 8242452 - DNA, 22 bp, Homo sapiens
caggaatgatctgctgagtgat

SEQ ID NO: 8242453 - DNA, 22 bp, Homo sapiens
caggaatgaggtcgtaagtgtc

SEQ ID NO: 8242454 - DNA, 19 bp, Homo sapiens
caggaatgaggtaatggct

SEQ ID NO: 8242455 - DNA, 22 bp, Homo sapiens
caggaatgagttctggtgctct

SEQ ID NO: 8242456 - DNA, 22 bp, Homo sapiens
caggaatgagttctggtgctct

SEQ ID NO: 8242457 - DNA, 22 bp, Homo sapiens
caggaatgggtgacagtcagct

SEQ ID NO: 8242458 - DNA, 22 bp, Homo sapiens
caggaatggaggcatttatgaa

SEQ ID NO: 8242459 - DNA, 22 bp, Homo sapiens
caggaatgccttcttcagccat

SEQ ID NO: 8242460 - DNA, 22 bp, Homo sapiens
caggaatgccaaccagtgcatg

SEQ ID NO: 8242461 - DNA, 18 bp, Homo sapiens
caggaatggatgggattt

SEQ ID NO: 8242462 - DNA, 22 bp, Homo sapiens
caggaatggttaatctaaagtg

SEQ ID NO: 8242463 - DNA, 22 bp, Homo sapiens
caggaatggttgggactatgtt

SEQ ID NO: 8242464 - DNA, 22 bp, Homo sapiens
caggaatgtatgatacagtggt

SEQ ID NO: 8242465 - DNA, 22 bp, Homo sapiens
caggaatgtagcagcgatggaa

SEQ ID NO: 8242466 - DNA, 22 bp, Homo sapiens
caggaatgtcccatccccttca

SEQ ID NO: 8242467 - DNA, 22 bp, Homo sapiens
caggaatgtccttgtcatttca

SEQ ID NO: 8242468 - DNA, 22 bp, Homo sapiens
caggaatgtgagggttccctgc

SEQ ID NO: 8242469 - DNA, 22 bp, Homo sapiens
caggaatgtttgtgctccttta

SEQ ID NO: 8242470 - DNA, 22 bp, Homo sapiens
caggaatgttgcatgtgatctt

SEQ ID NO: 8242471 - DNA, 22 bp, Homo sapiens
caggacaaagccctttgagaaa

SEQ ID NO: 8242472 - DNA, 22 bp, Homo sapiens
caggaattcatagcattgttct

SEQ ID NO: 8242473 - DNA, 22 bp, Homo sapiens
caggacacagggtgtggctgat

SEQ ID NO: 8242474 - DNA, 22 bp, Homo sapiens
caggacacagaataaggcagtt

SEQ ID NO: 8242475 - DNA, 21 bp, Homo sapiens
gtttggaacagaccctgggga

SEQ ID NO: 8242476 - DNA, 22 bp, Homo sapiens
gtttggggtctgcagagcggcg

SEQ ID NO: 8242477 - DNA, 22 bp, Homo sapiens
gtttggggagttcctttaggcc

SEQ ID NO: 8242478 - DNA, 22 bp, Homo sapiens
gtttggggtctgcagagcggcg

SEQ ID NO: 8242479 - DNA, 22 bp, Homo sapiens
caggaagctcttagcagtcacc

SEQ ID NO: 8242480 - DNA, 22 bp, Homo sapiens
caggaagctcttagcagtcacc

SEQ ID NO: 8242481 - DNA, 22 bp, Homo sapiens
caggaagccttccttgtctgct

SEQ ID NO: 8242482 - DNA, 22 bp, Homo sapiens
caggaagctagattttgttgct

SEQ ID NO: 8242483 - DNA, 22 bp, Homo sapiens
gtttgtatgaatgttttatgct

SEQ ID NO: 8242484 - DNA, 22 bp, Homo sapiens
caggaagcatctggctagctaa

SEQ ID NO: 8242485 - DNA, 22 bp, Homo sapiens
caggaagccacaggacaggtag

SEQ ID NO: 8242486 - DNA, 22 bp, Homo sapiens
caggaagccacaggacaggtag

SEQ ID NO: 8242487 - DNA, 22 bp, Homo sapiens
caggaagccacaggacaggtag

SEQ ID NO: 8242488 - DNA, 22 bp, Homo sapiens
caggaagccacaggacaggtag

SEQ ID NO: 8242489 - DNA, 23 bp, Homo sapiens
caggaagcagatggggtagaaga

SEQ ID NO: 8242490 - DNA, 23 bp, Homo sapiens
caggaagcagatggggtagaaga

SEQ ID NO: 8242491 - DNA, 22 bp, Homo sapiens
caggaagcagtagaacttttcc

SEQ ID NO: 8242492 - DNA, 22 bp, Homo sapiens
gtttgtatgaatgttttatgct

SEQ ID NO: 8242493 - DNA, 22 bp, Homo sapiens
caggaagtcgcagagctggggg

SEQ ID NO: 8242494 - DNA, 22 bp, Homo sapiens
caggaagtcgcagagctggggg

SEQ ID NO: 8242495 - DNA, 22 bp, Homo sapiens
caggaagtagagttggccagcc

SEQ ID NO: 8242496 - DNA, 22 bp, Homo sapiens
caggaagtgtgagggtggtgta

SEQ ID NO: 8242497 - DNA, 22 bp, Homo sapiens
caggaagtgtgagggtggtgta

SEQ ID NO: 8242498 - DNA, 22 bp, Homo sapiens
caggaagtggctgggctgggtt

SEQ ID NO: 8242499 - DNA, 22 bp, Homo sapiens
caggaagtgctcgctgtgggga

SEQ ID NO: 8242500 - DNA, 22 bp, Homo sapiens
caggaagtgcctggtgagagga

SEQ ID NO: 8242501 - DNA, 22 bp, Homo sapiens
caggaatgacccaacagtttca

SEQ ID NO: 8242502 - DNA, 22 bp, Homo sapiens
caggaatgaaaggtcagggttg

SEQ ID NO: 8242503 - DNA, 22 bp, Homo sapiens
caggaatgaaaggtcagggttg

SEQ ID NO: 8242504 - DNA, 22 bp, Homo sapiens
caggaatgactgcagatggggc

SEQ ID NO: 8242505 - DNA, 22 bp, Homo sapiens
caggaagtgtgcctgagcacct

SEQ ID NO: 8242506 - DNA, 22 bp, Homo sapiens
caggaagttgtgtgttcgaggc

SEQ ID NO: 8242507 - DNA, 22 bp, Homo sapiens
caggaagggggatccttggaag

SEQ ID NO: 8242508 - DNA, 22 bp, Homo sapiens
caggaaggaaagggtgtggaga

SEQ ID NO: 8242509 - DNA, 22 bp, Homo sapiens
caggaagctgtgaaggagacgg

SEQ ID NO: 8242510 - DNA, 22 bp, Homo sapiens
caggaagctgtgaaggagacgg

SEQ ID NO: 8242511 - DNA, 22 bp, Homo sapiens
caggaagctgtgaaggagacgg

SEQ ID NO: 8242512 - DNA, 22 bp, Homo sapiens
caggaagctgagctgcactgca

SEQ ID NO: 8242513 - DNA, 22 bp, Homo sapiens
caggaagctgagctgcactgca

SEQ ID NO: 8242514 - DNA, 22 bp, Homo sapiens
caggaagctgatgtctagtcat

SEQ ID NO: 8242515 - DNA, 22 bp, Homo sapiens
caggaagctggtcagatcctgt

SEQ ID NO: 8242516 - DNA, 22 bp, Homo sapiens
caggaagctgggtttccataca

SEQ ID NO: 8242517 - DNA, 22 bp, Homo sapiens
caggaagctgccggtgagcgag

SEQ ID NO: 8242518 - DNA, 22 bp, Homo sapiens
caggaagctgccggtgagcgag

SEQ ID NO: 8242519 - DNA, 22 bp, Homo sapiens
caggaagctgccggtgagcgag

SEQ ID NO: 8242520 - DNA, 22 bp, Homo sapiens
taagcaaagtttataaggctct

SEQ ID NO: 8242521 - DNA, 22 bp, Homo sapiens
taagcaaaggattttgatcttt

SEQ ID NO: 8242522 - DNA, 22 bp, Homo sapiens
taagattacagtgagaaataaa

SEQ ID NO: 8242523 - DNA, 22 bp, Homo sapiens
taagattacagtgagaaataaa

SEQ ID NO: 8242524 - DNA, 22 bp, Homo sapiens
taagatttttaaaatgtcctca

SEQ ID NO: 8242525 - DNA, 22 bp, Homo sapiens
taagacacattgagaaacacaa

SEQ ID NO: 8242526 - DNA, 22 bp, Homo sapiens
taagacacattggagtagatga

SEQ ID NO: 8242527 - DNA, 22 bp, Homo sapiens
taagacacattggagtagatga

SEQ ID NO: 8242528 - DNA, 22 bp, Homo sapiens
taagacacatgcgtacaagata

SEQ ID NO: 8242529 - DNA, 22 bp, Homo sapiens
taagacacattcatatctgtct

SEQ ID NO: 8242530 - DNA, 22 bp, Homo sapiens
taagacacagtccgcactctct

SEQ ID NO: 8242531 - DNA, 22 bp, Homo sapiens
taagacacatgcgtacaagata

SEQ ID NO: 8242532 - DNA, 23 bp, Homo sapiens
taagacacccgactccagagatg

SEQ ID NO: 8242533 - DNA, 22 bp, Homo sapiens
taagacacctctctgcccttca

SEQ ID NO: 8242534 - DNA, 22 bp, Homo sapiens
taagacacgggctgatctaaag

SEQ ID NO: 8242535 - DNA, 19 bp, Homo sapiens
taaggcagcagtgacaggc

SEQ ID NO: 8242536 - DNA, 22 bp, Homo sapiens
taaggcagccgctcagagaggt

SEQ ID NO: 8242537 - DNA, 19 bp, Homo sapiens
taaggcagcagtgacaggc

SEQ ID NO: 8242538 - DNA, 22 bp, Homo sapiens
caggcagaaattttgtttcatt

SEQ ID NO: 8242539 - DNA, 22 bp, Homo sapiens
caggcactttgctgggggcgca

SEQ ID NO: 8242540 - DNA, 22 bp, Homo sapiens
caggcactcagtctggatccct

SEQ ID NO: 8242541 - DNA, 22 bp, Homo sapiens
caggcacggtggctcatgcctg

SEQ ID NO: 8242542 - DNA, 22 bp, Homo sapiens
taagcaacaaatggtttctgat

SEQ ID NO: 8242543 - DNA, 22 bp, Homo sapiens
taagcaacaaggtgtttaaatt

SEQ ID NO: 8242544 - DNA, 22 bp, Homo sapiens
taaggcacacagttgctgcatg

SEQ ID NO: 8242545 - DNA, 22 bp, Homo sapiens
taaggcacccatgttcatacag

SEQ ID NO: 8242546 - DNA, 22 bp, Homo sapiens
taaggcaccataatatatttaa

SEQ ID NO: 8242547 - DNA, 22 bp, Homo sapiens
taaggcacttcaatgtttagaa

SEQ ID NO: 8242548 - DNA, 22 bp, Homo sapiens
taaggcacgcggtgaatgccaa

SEQ ID NO: 8242549 - DNA, 22 bp, Homo sapiens
taaggcagaaatatgagcaggg

SEQ ID NO: 8242550 - DNA, 22 bp, Homo sapiens
taaggcagaaatatgagcaggg

SEQ ID NO: 8242551 - DNA, 22 bp, Homo sapiens
taaggcagaaatatgagcaggg

SEQ ID NO: 8242552 - DNA, 22 bp, Homo sapiens
taaggcacctgtccaggctggg

SEQ ID NO: 8242553 - DNA, 22 bp, Homo sapiens
taaggcacgcataagagggggc

SEQ ID NO: 8242554 - DNA, 22 bp, Homo sapiens
taaggcacccgtgagctgccag

SEQ ID NO: 8242555 - DNA, 22 bp, Homo sapiens
taaggcacccttctgagtagag

SEQ ID NO: 8242556 - DNA, 17 bp, Homo sapiens
caggcacatgaagccag

SEQ ID NO: 8242557 - DNA, 17 bp, Homo sapiens
caggcacatgaagccag

SEQ ID NO: 8242558 - DNA, 22 bp, Homo sapiens
caggcacatgggagctcatcat

SEQ ID NO: 8242559 - DNA, 22 bp, Homo sapiens
caggcacatgggagctcatcat

SEQ ID NO: 8242560 - DNA, 22 bp, Homo sapiens
caggcacagtggggtcctctct

SEQ ID NO: 8242561 - DNA, 22 bp, Homo sapiens
caggcacagtgttgctgttcaa

SEQ ID NO: 8242562 - DNA, 22 bp, Homo sapiens
caggcacagtggggtcctctct

SEQ ID NO: 8242563 - DNA, 22 bp, Homo sapiens
caggcacagttccaagcatttt

SEQ ID NO: 8242564 - DNA, 22 bp, Homo sapiens
caggcaccaacttcctggggag

SEQ ID NO: 8242565 - DNA, 22 bp, Homo sapiens
caggcaccaacttcctggggag

SEQ ID NO: 8242566 - DNA, 22 bp, Homo sapiens
caggcaccaacttcctggggag

SEQ ID NO: 8242567 - DNA, 22 bp, Homo sapiens
caggcacatgggagctcatcat

SEQ ID NO: 8242568 - DNA, 19 bp, Homo sapiens
taagacacaaatgcaagcc

SEQ ID NO: 8242569 - DNA, 22 bp, Homo sapiens
taagacacaaatatcttttaca

SEQ ID NO: 8242570 - DNA, 22 bp, Homo sapiens
taagacacaaatatcttttaca

SEQ ID NO: 8242571 - DNA, 22 bp, Homo sapiens
caggcacagctaagactggcca

SEQ ID NO: 8242572 - DNA, 22 bp, Homo sapiens
caggcacagctaagactggcca

SEQ ID NO: 8242573 - DNA, 22 bp, Homo sapiens
caggcacagctaagactggcca

SEQ ID NO: 8242574 - DNA, 22 bp, Homo sapiens
caggcacagctgggcaattgcg

SEQ ID NO: 8242575 - DNA, 22 bp, Homo sapiens
caggcacaggggaatgtctttt

SEQ ID NO: 8242576 - DNA, 22 bp, Homo sapiens
caggcacagtggggtcctctct

SEQ ID NO: 8242577 - DNA, 22 bp, Homo sapiens
caggcacaggggaatgtctttt

SEQ ID NO: 8242578 - DNA, 22 bp, Homo sapiens
caggcacactgtctacactgag

SEQ ID NO: 8242579 - DNA, 22 bp, Homo sapiens
caggcacaatgagcgccatctt

SEQ ID NO: 8242580 - DNA, 22 bp, Homo sapiens
caggcacaagatcggctagata

SEQ ID NO: 8242581 - DNA, 22 bp, Homo sapiens
caggcacaagatcggctagata

SEQ ID NO: 8242582 - DNA, 22 bp, Homo sapiens
caggcacaagatcggctagata

SEQ ID NO: 8242583 - DNA, 22 bp, Homo sapiens
caggcacaagaagcaaatgtta

SEQ ID NO: 8242584 - DNA, 22 bp, Homo sapiens
caggcacaagatcggctagata

SEQ ID NO: 8242585 - DNA, 22 bp, Homo sapiens
caggcacaagatcggctagata

SEQ ID NO: 8242586 - DNA, 22 bp, Homo sapiens
caggcacaagatcggctagata

SEQ ID NO: 8242587 - DNA, 22 bp, Homo sapiens
caggatggtgtgagtgtgagga

SEQ ID NO: 8242588 - DNA, 22 bp, Homo sapiens
caggatgtgaggaggccatttg

SEQ ID NO: 8242589 - DNA, 22 bp, Homo sapiens
caggatggtggcatgatcagaa

SEQ ID NO: 8242590 - DNA, 22 bp, Homo sapiens
caggatggtgtgagtgtgagga

SEQ ID NO: 8242591 - DNA, 22 bp, Homo sapiens
caggatggtgtgagtgtgagga

SEQ ID NO: 8242592 - DNA, 22 bp, Homo sapiens
caggatggtgtgagtgtgagga

SEQ ID NO: 8242593 - DNA, 22 bp, Homo sapiens
caggatggtgtgagtgtgagga

SEQ ID NO: 8242594 - DNA, 22 bp, Homo sapiens
caggcaagatccagaggctgct

SEQ ID NO: 8242595 - DNA, 22 bp, Homo sapiens
caggatttcatacatctttact

SEQ ID NO: 8242596 - DNA, 19 bp, Homo sapiens
caggattgtttaaagcttt

SEQ ID NO: 8242597 - DNA, 22 bp, Homo sapiens
caggattgagcaaatggattat

SEQ ID NO: 8242598 - DNA, 22 bp, Homo sapiens
caggcaagatccagaggctgct

SEQ ID NO: 8242599 - DNA, 22 bp, Homo sapiens
caggcaagatccagaggctgct

SEQ ID NO: 8242600 - DNA, 22 bp, Homo sapiens
caggcaagatccagaggctgct

SEQ ID NO: 8242601 - DNA, 22 bp, Homo sapiens
caggcaagatccagaggctgct

SEQ ID NO: 8242602 - DNA, 22 bp, Homo sapiens
caggcaagattagagatgagca

SEQ ID NO: 8242603 - DNA, 22 bp, Homo sapiens
caggcaagatccagaggctgct

SEQ ID NO: 8242604 - DNA, 22 bp, Homo sapiens
caggcaagatccagaggctgct

SEQ ID NO: 8242605 - DNA, 22 bp, Homo sapiens
caggcaagattagagatgagca

SEQ ID NO: 8242606 - DNA, 22 bp, Homo sapiens
caggcaagattagagatgagca

SEQ ID NO: 8242607 - DNA, 22 bp, Homo sapiens
caggcaagattagagatgagca

SEQ ID NO: 8242608 - DNA, 22 bp, Homo sapiens
caggcaagcaaggggtcttgaa

SEQ ID NO: 8242609 - DNA, 22 bp, Homo sapiens
caggcaagcaaggggtcttgaa

SEQ ID NO: 8242610 - DNA, 22 bp, Homo sapiens
caggcaagcaaggggtcttgaa

SEQ ID NO: 8242611 - DNA, 22 bp, Homo sapiens
caggcaagcaaggggtcttgaa

SEQ ID NO: 8242612 - DNA, 22 bp, Homo sapiens
caggcaaggagctggctcaagt

SEQ ID NO: 8242613 - DNA, 22 bp, Homo sapiens
caggcaaggactctggtaattt

SEQ ID NO: 8242614 - DNA, 22 bp, Homo sapiens
caggcaagcacggtgaacctgg

SEQ ID NO: 8242615 - DNA, 22 bp, Homo sapiens
caggcaagcaaggggtcttgaa

SEQ ID NO: 8242616 - DNA, 22 bp, Homo sapiens
caggcaaggaggcactgaggga

SEQ ID NO: 8242617 - DNA, 22 bp, Homo sapiens
caggcaaggagctggctcaagt

SEQ ID NO: 8242618 - DNA, 22 bp, Homo sapiens
caggcaaggagctggctcaagt

SEQ ID NO: 8242619 - DNA, 22 bp, Homo sapiens
caggcaaggaggcactgaggga

SEQ ID NO: 8242620 - DNA, 22 bp, Homo sapiens
caggcaaggaggcactgaggga

SEQ ID NO: 8242621 - DNA, 22 bp, Homo sapiens
caggcaaggaggcactgaggga

SEQ ID NO: 8242622 - DNA, 22 bp, Homo sapiens
caggcaaggaggcactgaggga

SEQ ID NO: 8242623 - DNA, 22 bp, Homo sapiens
caggcacaaatttctagataag

SEQ ID NO: 8242624 - DNA, 22 bp, Homo sapiens
caggcacaaatttctagataag

SEQ ID NO: 8242625 - DNA, 22 bp, Homo sapiens
caggcacaaatttctagataag

SEQ ID NO: 8242626 - DNA, 22 bp, Homo sapiens
caggcaagttcatttccaggca

SEQ ID NO: 8242627 - DNA, 22 bp, Homo sapiens
caggcaataaagggttggttgg

SEQ ID NO: 8242628 - DNA, 22 bp, Homo sapiens
caggcacaaaaggaccccagca

SEQ ID NO: 8242629 - DNA, 22 bp, Homo sapiens
caggatgatgagtagagtgtga

SEQ ID NO: 8242630 - DNA, 21 bp, Homo sapiens
caggatgatgggaaggtggtg

SEQ ID NO: 8242631 - DNA, 20 bp, Homo sapiens
caggatgattggacacgatg

SEQ ID NO: 8242632 - DNA, 22 bp, Homo sapiens
caggatgcagtgggacccaggg

SEQ ID NO: 8242633 - DNA, 22 bp, Homo sapiens
caggatgcactaggaaccaggg

SEQ ID NO: 8242634 - DNA, 22 bp, Homo sapiens
caggatgctgaaaacacgagga

SEQ ID NO: 8242635 - DNA, 22 bp, Homo sapiens
caggatgctgaaaacacgagga

SEQ ID NO: 8242636 - DNA, 22 bp, Homo sapiens
caggatgctgaaaacacgagga

SEQ ID NO: 8242637 - DNA, 22 bp, Homo sapiens
caggatggtctcgatctcctga

SEQ ID NO: 8242638 - DNA, 22 bp, Homo sapiens
caggatggtctcgatctcctga

SEQ ID NO: 8242639 - DNA, 22 bp, Homo sapiens
caggatggagagtgaggggtca

SEQ ID NO: 8242640 - DNA, 22 bp, Homo sapiens
caggatggtcttcatttggctc

SEQ ID NO: 8242641 - DNA, 22 bp, Homo sapiens
caggatggtcttcatttggctc

SEQ ID NO: 8242642 - DNA, 22 bp, Homo sapiens
caggatggtctcgatctcctga

SEQ ID NO: 8242643 - DNA, 22 bp, Homo sapiens
caggatggtctcgatctcctga

SEQ ID NO: 8242644 - DNA, 22 bp, Homo sapiens
caggatggtggcatgatcagaa

SEQ ID NO: 8242645 - DNA, 22 bp, Homo sapiens
caggatggtggcatgatcagaa

SEQ ID NO: 8242646 - DNA, 22 bp, Homo sapiens
caggatggtcttcatttggctc

SEQ ID NO: 8242647 - DNA, 19 bp, Homo sapiens
caggatgatcccatgacac

SEQ ID NO: 8242648 - DNA, 22 bp, Homo sapiens
caggatgaggtagaggcagata

SEQ ID NO: 8242649 - DNA, 18 bp, Homo sapiens
caggatgagtgatgggga

SEQ ID NO: 8242650 - DNA, 18 bp, Homo sapiens
caggatgagtgatgggga

SEQ ID NO: 8242651 - DNA, 22 bp, Homo sapiens
caggatgaggtagaggcagata

SEQ ID NO: 8242652 - DNA, 22 bp, Homo sapiens
caggatgaggtagaggcagata

SEQ ID NO: 8242653 - DNA, 22 bp, Homo sapiens
caggatgaagggcaaaggcaag

SEQ ID NO: 8242654 - DNA, 22 bp, Homo sapiens
caggatgagaggcccagggaag

SEQ ID NO: 8242655 - DNA, 22 bp, Homo sapiens
caggatgagaggcccagggaag

SEQ ID NO: 8242656 - DNA, 22 bp, Homo sapiens
caggatgaagggcaaaggcaag

SEQ ID NO: 8242657 - DNA, 19 bp, Homo sapiens
taacttgtagatatgaagt

SEQ ID NO: 8242658 - DNA, 22 bp, Homo sapiens
taacttgagctctcagtgctat

SEQ ID NO: 8242659 - DNA, 22 bp, Homo sapiens
taacttgtgttacattactctt

SEQ ID NO: 8242660 - DNA, 16 bp, Homo sapiens
taacatttttaaaagg

SEQ ID NO: 8242661 - DNA, 16 bp, Homo sapiens
taacatttttaaaagg

SEQ ID NO: 8242662 - DNA, 16 bp, Homo sapiens
taacatttttaaaagg

SEQ ID NO: 8242663 - DNA, 22 bp, Homo sapiens
taacttctttggtttaaagaga

SEQ ID NO: 8242664 - DNA, 22 bp, Homo sapiens
taacatttaaatttttcacata

SEQ ID NO: 8242665 - DNA, 22 bp, Homo sapiens
taacatttaaatttttcacata

SEQ ID NO: 8242666 - DNA, 22 bp, Homo sapiens
taacatttagaaagtgtccatt

SEQ ID NO: 8242667 - DNA, 22 bp, Homo sapiens
taacatttagaaagtgtccatt

SEQ ID NO: 8242668 - DNA, 22 bp, Homo sapiens
taacatttgctgtctcctatgt

SEQ ID NO: 8242669 - DNA, 22 bp, Homo sapiens
taacatttgctgtctcctatgt

SEQ ID NO: 8242670 - DNA, 22 bp, Homo sapiens
taacatttgctgtctcctatgt

SEQ ID NO: 8242671 - DNA, 22 bp, Homo sapiens
taacatttcggtgacagtggga

SEQ ID NO: 8242672 - DNA, 22 bp, Homo sapiens
taacatttcggtgacagtggga

SEQ ID NO: 8242673 - DNA, 21 bp, Homo sapiens
taacttttgtgcctatcttgt

SEQ ID NO: 8242674 - DNA, 22 bp, Homo sapiens
taactttgagaactttctggtg

SEQ ID NO: 8242675 - DNA, 22 bp, Homo sapiens
taactttagtgtatgaggtaag

SEQ ID NO: 8242676 - DNA, 22 bp, Homo sapiens
taactttagtgtatgaggtaag

SEQ ID NO: 8242677 - DNA, 22 bp, Homo sapiens
taactttaggaataggtaatct

SEQ ID NO: 8242678 - DNA, 22 bp, Homo sapiens
taacattgtcagttcaactgct

SEQ ID NO: 8242679 - DNA, 22 bp, Homo sapiens
taacagaagttgttcattgtgg

SEQ ID NO: 8242680 - DNA, 22 bp, Homo sapiens
taacattaggtagacataagcc

SEQ ID NO: 8242681 - DNA, 22 bp, Homo sapiens
taacattaggtagacataagcc

SEQ ID NO: 8242682 - DNA, 22 bp, Homo sapiens
taacattaggtagacataagcc

SEQ ID NO: 8242683 - DNA, 22 bp, Homo sapiens
taacagaagatgaaacttcttt

SEQ ID NO: 8242684 - DNA, 22 bp, Homo sapiens
taacaactgctgaggtatttga

SEQ ID NO: 8242685 - DNA, 22 bp, Homo sapiens
taacaagagcacctgggaatgg

SEQ ID NO: 8242686 - DNA, 22 bp, Homo sapiens
taacaagtcattttaaattatg

SEQ ID NO: 8242687 - DNA, 22 bp, Homo sapiens
taacaagtcattttaaattatg

SEQ ID NO: 8242688 - DNA, 21 bp, Homo sapiens
taacaagtctgcatacattca

SEQ ID NO: 8242689 - DNA, 22 bp, Homo sapiens
taacaagtcattttatcagcag

SEQ ID NO: 8242690 - DNA, 22 bp, Homo sapiens
taacaagtttcatttatagaat

SEQ ID NO: 8242691 - DNA, 22 bp, Homo sapiens
taacaagtttcatttatagaat

SEQ ID NO: 8242692 - DNA, 21 bp, Homo sapiens
taacaagtctgcatacattca

SEQ ID NO: 8242693 - DNA, 22 bp, Homo sapiens
taacaagatgtcactcctgtcc

SEQ ID NO: 8242694 - DNA, 22 bp, Homo sapiens
taacagaaacagataagtgtaa

SEQ ID NO: 8242695 - DNA, 22 bp, Homo sapiens
taacagaaaggctcaggtgctc

SEQ ID NO: 8242696 - DNA, 22 bp, Homo sapiens
taacactttggattaaaattct

SEQ ID NO: 8242697 - DNA, 22 bp, Homo sapiens
taacagaaaagaactgagtttg

SEQ ID NO: 8242698 - DNA, 22 bp, Homo sapiens
taacactttggattaaaattct

SEQ ID NO: 8242699 - DNA, 22 bp, Homo sapiens
taacaatacccattctaattac

SEQ ID NO: 8242700 - DNA, 22 bp, Homo sapiens
taacaatacccattctaattac

SEQ ID NO: 8242701 - DNA, 22 bp, Homo sapiens
taacactgtgtctgccatatcc

SEQ ID NO: 8242702 - DNA, 22 bp, Homo sapiens
taacacttcagatgattttgtt

SEQ ID NO: 8242703 - DNA, 22 bp, Homo sapiens
caggcagctgaggactttgcta

SEQ ID NO: 8242704 - DNA, 22 bp, Homo sapiens
caggcagctgaggactttgcta

SEQ ID NO: 8242705 - DNA, 22 bp, Homo sapiens
caggcagctgcgacaagagagc

SEQ ID NO: 8242706 - DNA, 22 bp, Homo sapiens
caggcagctgaggactttgcta

SEQ ID NO: 8242707 - DNA, 22 bp, Homo sapiens
caggcagctgaggactttgcta

SEQ ID NO: 8242708 - DNA, 22 bp, Homo sapiens
caggcagctgcgacaagagagc

SEQ ID NO: 8242709 - DNA, 22 bp, Homo sapiens
caggcagctgggtcaccgtccc

SEQ ID NO: 8242710 - DNA, 22 bp, Homo sapiens
caggcagctgggtcaccgtccc

SEQ ID NO: 8242711 - DNA, 22 bp, Homo sapiens
caggcagctgggtcaccgtccc

SEQ ID NO: 8242712 - DNA, 22 bp, Homo sapiens
caggcaggagacatttggttgg

SEQ ID NO: 8242713 - DNA, 22 bp, Homo sapiens
caggcagctgctgggttcagcc

SEQ ID NO: 8242714 - DNA, 22 bp, Homo sapiens
caggcagctgctgggttcagcc

SEQ ID NO: 8242715 - DNA, 22 bp, Homo sapiens
caggcagctgctgggttcagcc

SEQ ID NO: 8242716 - DNA, 22 bp, Homo sapiens
caggcagctgctgggttcagcc

SEQ ID NO: 8242717 - DNA, 22 bp, Homo sapiens
caggcagctgctgggttcagcc

SEQ ID NO: 8242718 - DNA, 23 bp, Homo sapiens
caggcaggatgaggactacactc

SEQ ID NO: 8242719 - DNA, 23 bp, Homo sapiens
caggcaggatgaggactacactc

SEQ ID NO: 8242720 - DNA, 23 bp, Homo sapiens
caggcaggatgaggactacactc

SEQ ID NO: 8242721 - DNA, 23 bp, Homo sapiens
caggcaggatgaggactacactc

SEQ ID NO: 8242722 - DNA, 23 bp, Homo sapiens
caggcaggatgaggactacactc

SEQ ID NO: 8242723 - DNA, 22 bp, Homo sapiens
caggcagggagccactgtataa

SEQ ID NO: 8242724 - DNA, 22 bp, Homo sapiens
caggcagggagccactgtataa

SEQ ID NO: 8242725 - DNA, 22 bp, Homo sapiens
caggcagggagccactgtataa

SEQ ID NO: 8242726 - DNA, 22 bp, Homo sapiens
caggcaggctgctttttgttca

SEQ ID NO: 8242727 - DNA, 22 bp, Homo sapiens
caggcaggagacatttggttgg

SEQ ID NO: 8242728 - DNA, 22 bp, Homo sapiens
caggcaggagaggaggatttct

SEQ ID NO: 8242729 - DNA, 22 bp, Homo sapiens
caggcaggagaggaggatttct

SEQ ID NO: 8242730 - DNA, 22 bp, Homo sapiens
caggcaggagaggaggatttct

SEQ ID NO: 8242731 - DNA, 22 bp, Homo sapiens
caggcaggagaggaggatttct

SEQ ID NO: 8242732 - DNA, 22 bp, Homo sapiens
caggcaggagccagggattcca

SEQ ID NO: 8242733 - DNA, 23 bp, Homo sapiens
caggcaggatgaggactacactc

SEQ ID NO: 8242734 - DNA, 22 bp, Homo sapiens
caggcaggagccagggattcca

SEQ ID NO: 8242735 - DNA, 22 bp, Homo sapiens
caggcaggagccagggattcca

SEQ ID NO: 8242736 - DNA, 22 bp, Homo sapiens
caggcaggagccagggattcca

SEQ ID NO: 8242737 - DNA, 22 bp, Homo sapiens
caggcagcctgagggatctggg

SEQ ID NO: 8242738 - DNA, 22 bp, Homo sapiens
caggcagccaggggacctgtcc

SEQ ID NO: 8242739 - DNA, 22 bp, Homo sapiens
caggcagcctgcggtctgcaca

SEQ ID NO: 8242740 - DNA, 22 bp, Homo sapiens
caggcagctctaatggaaagtg

SEQ ID NO: 8242741 - DNA, 22 bp, Homo sapiens
caggcagcctgagggatctggg

SEQ ID NO: 8242742 - DNA, 22 bp, Homo sapiens
caggcagcctgagggatctggg

SEQ ID NO: 8242743 - DNA, 22 bp, Homo sapiens
caggcagcctgagggatctggg

SEQ ID NO: 8242744 - DNA, 22 bp, Homo sapiens
caggcagctctaatggaaagtg

SEQ ID NO: 8242745 - DNA, 22 bp, Homo sapiens
caggcagctctgcttttcctaa

SEQ ID NO: 8242746 - DNA, 22 bp, Homo sapiens
caggcagctctgcttttcctaa

SEQ ID NO: 8242747 - DNA, 22 bp, Homo sapiens
caggcagctgactgtcagatat

SEQ ID NO: 8242748 - DNA, 22 bp, Homo sapiens
caggcagctgactgtcagatat

SEQ ID NO: 8242749 - DNA, 22 bp, Homo sapiens
caggcagcatttactctgatga

SEQ ID NO: 8242750 - DNA, 22 bp, Homo sapiens
caggcagcatcagtctgctgta

SEQ ID NO: 8242751 - DNA, 22 bp, Homo sapiens
caggcagcatcagtctgctgta

SEQ ID NO: 8242752 - DNA, 22 bp, Homo sapiens
caggcagccaggggacctgtcc

SEQ ID NO: 8242753 - DNA, 22 bp, Homo sapiens
caggcagccaggggacctgtcc

SEQ ID NO: 8242754 - DNA, 22 bp, Homo sapiens
caggcagcatttactctgatga

SEQ ID NO: 8242755 - DNA, 22 bp, Homo sapiens
caggcagcagccactctggtat

SEQ ID NO: 8242756 - DNA, 22 bp, Homo sapiens
caggcagcagccactctggtat

SEQ ID NO: 8242757 - DNA, 22 bp, Homo sapiens
caggcagcagccactctggtat

SEQ ID NO: 8242758 - DNA, 22 bp, Homo sapiens
caggcagcaggagccctgctcg

SEQ ID NO: 8242759 - DNA, 22 bp, Homo sapiens
caggcagcaggagccctgctcg

SEQ ID NO: 8242760 - DNA, 22 bp, Homo sapiens
caggcagcaggagccctgctcg

SEQ ID NO: 8242761 - DNA, 22 bp, Homo sapiens
caggcagcaggagccctgctcg

SEQ ID NO: 8242762 - DNA, 22 bp, Homo sapiens
caggcagcaggagccctgctcg

SEQ ID NO: 8242763 - DNA, 22 bp, Homo sapiens
taattgtatggagaaggctgca

SEQ ID NO: 8242764 - DNA, 22 bp, Homo sapiens
taattgtgggaaggcttttaat

SEQ ID NO: 8242765 - DNA, 22 bp, Homo sapiens
taattgtggctggatttgagaa

SEQ ID NO: 8242766 - DNA, 22 bp, Homo sapiens
taatttaattccatggattcta

SEQ ID NO: 8242767 - DNA, 22 bp, Homo sapiens
taatttaattccatggattcta

SEQ ID NO: 8242768 - DNA, 22 bp, Homo sapiens
taatttacttgcaaataacaat

SEQ ID NO: 8242769 - DNA, 22 bp, Homo sapiens
taatttacagagatacagtcag

SEQ ID NO: 8242770 - DNA, 22 bp, Homo sapiens
taatttacagagatacagtcag

SEQ ID NO: 8242771 - DNA, 22 bp, Homo sapiens
caggcagagccaatcgtggggt

SEQ ID NO: 8242772 - DNA, 22 bp, Homo sapiens
taatgttagtatgtaatcttat

SEQ ID NO: 8242773 - DNA, 22 bp, Homo sapiens
taatgttagtatgtaatcttat

SEQ ID NO: 8242774 - DNA, 22 bp, Homo sapiens
taatgttagtatgtaatcttat

SEQ ID NO: 8242775 - DNA, 22 bp, Homo sapiens
caggcagagcaactggtccaga

SEQ ID NO: 8242776 - DNA, 22 bp, Homo sapiens
caggcagagcaactggtccaga

SEQ ID NO: 8242777 - DNA, 22 bp, Homo sapiens
caggcagagcaactggtccaga

SEQ ID NO: 8242778 - DNA, 22 bp, Homo sapiens
caggcagagcaactggtccaga

SEQ ID NO: 8242779 - DNA, 22 bp, Homo sapiens
caggcagagcaactggtccaga

SEQ ID NO: 8242780 - DNA, 22 bp, Homo sapiens
caggcagaaggaagtaccaggc

SEQ ID NO: 8242781 - DNA, 22 bp, Homo sapiens
caggcagaaggaagtaccaggc

SEQ ID NO: 8242782 - DNA, 22 bp, Homo sapiens
caggcagaaggaagtaccaggc

SEQ ID NO: 8242783 - DNA, 22 bp, Homo sapiens
caggcagaaggaagtaccaggc

SEQ ID NO: 8242784 - DNA, 22 bp, Homo sapiens
caggcagaatgaccgacctcgc

SEQ ID NO: 8242785 - DNA, 22 bp, Homo sapiens
caggcagaatgagattacttca

SEQ ID NO: 8242786 - DNA, 22 bp, Homo sapiens
caggcagaaattttgtttcatt

SEQ ID NO: 8242787 - DNA, 22 bp, Homo sapiens
caggcagaaattttgtttcatt

SEQ ID NO: 8242788 - DNA, 22 bp, Homo sapiens
caggcagaaggaagtaccaggc

SEQ ID NO: 8242789 - DNA, 22 bp, Homo sapiens
caggcagaagaagtggaaggac

SEQ ID NO: 8242790 - DNA, 17 bp, Homo sapiens
caggcagacatgtaagc

SEQ ID NO: 8242791 - DNA, 17 bp, Homo sapiens
caggcagacatgtaagc

SEQ ID NO: 8242792 - DNA, 22 bp, Homo sapiens
caggcagactttgagaatgatg

SEQ ID NO: 8242793 - DNA, 22 bp, Homo sapiens
caggcagagcaactggtccaga

SEQ ID NO: 8242794 - DNA, 22 bp, Homo sapiens
caggcagagaggagcatttaat

SEQ ID NO: 8242795 - DNA, 22 bp, Homo sapiens
caggcagagaggagcatttaat

SEQ ID NO: 8242796 - DNA, 22 bp, Homo sapiens
caggcagagacgtcagtgtagg

SEQ ID NO: 8242797 - DNA, 22 bp, Homo sapiens
caggcagagacgtcagtgtagg

SEQ ID NO: 8242798 - DNA, 22 bp, Homo sapiens
caggcagagacgtcagtgtagg

SEQ ID NO: 8242799 - DNA, 22 bp, Homo sapiens
caggcagagaccctctcctaaa

SEQ ID NO: 8242800 - DNA, 22 bp, Homo sapiens
caggcagagaccctctcctaaa

SEQ ID NO: 8242801 - DNA, 22 bp, Homo sapiens
tacaggggtaacagtggggaat

SEQ ID NO: 8242802 - DNA, 22 bp, Homo sapiens
tacagggtataggtacagatga

SEQ ID NO: 8242803 - DNA, 22 bp, Homo sapiens
tacagggtataggtacagatga

SEQ ID NO: 8242804 - DNA, 22 bp, Homo sapiens
tacagggtattcaagggtagtt

SEQ ID NO: 8242805 - DNA, 22 bp, Homo sapiens
tacaggtagaaatgaagccaga

SEQ ID NO: 8242806 - DNA, 22 bp, Homo sapiens
tacaggtaaaattatcagaaac

SEQ ID NO: 8242807 - DNA, 22 bp, Homo sapiens
tacaggtaaatgcaaacagctc

SEQ ID NO: 8242808 - DNA, 22 bp, Homo sapiens
tacaggtagagtctctagttta

SEQ ID NO: 8242809 - DNA, 20 bp, Homo sapiens
tacaatacacatgcatatga

SEQ ID NO: 8242810 - DNA, 22 bp, Homo sapiens
tacaagtttatccatcattgtt

SEQ ID NO: 8242811 - DNA, 21 bp, Homo sapiens
tacaagttgcttttgaagtcc

SEQ ID NO: 8242812 - DNA, 22 bp, Homo sapiens
tacaagttccattttgaaagtg

SEQ ID NO: 8242813 - DNA, 22 bp, Homo sapiens
tacaagttgcagaaagttgttt

SEQ ID NO: 8242814 - DNA, 21 bp, Homo sapiens
tacaagttgcttttgaagtcc

SEQ ID NO: 8242815 - DNA, 22 bp, Homo sapiens
tacagcttaaaaaagccaactt

SEQ ID NO: 8242816 - DNA, 22 bp, Homo sapiens
tacagggattgttttaatcacc

SEQ ID NO: 8242817 - DNA, 22 bp, Homo sapiens
tacaagtgctagcagatattgt

SEQ ID NO: 8242818 - DNA, 22 bp, Homo sapiens
tacaagtatgttttaaaatgtt

SEQ ID NO: 8242819 - DNA, 22 bp, Homo sapiens
tacaagtgtttgagaggtggac

SEQ ID NO: 8242820 - DNA, 22 bp, Homo sapiens
tacaagtgtggctcctctgtct

SEQ ID NO: 8242821 - DNA, 16 bp, Homo sapiens
tacaagtgttagggaa

SEQ ID NO: 8242822 - DNA, 22 bp, Homo sapiens
tacaagttgcagaaagttgttt

SEQ ID NO: 8242823 - DNA, 22 bp, Homo sapiens
tacaagttccattttgaaagtg

SEQ ID NO: 8242824 - DNA, 22 bp, Homo sapiens
tacaagtgtgcaccaccatgtc

SEQ ID NO: 8242825 - DNA, 22 bp, Homo sapiens
tacaagtgtgcaccaccatgtc

SEQ ID NO: 8242826 - DNA, 22 bp, Homo sapiens
tacaagtgtaagcttgtgagac

SEQ ID NO: 8242827 - DNA, 22 bp, Homo sapiens
tacaagtggagttaggaagttt

SEQ ID NO: 8242828 - DNA, 22 bp, Homo sapiens
tacaagtatgttttaaaatgtt

SEQ ID NO: 8242829 - DNA, 20 bp, Homo sapiens
tacaagtacattatagttat

SEQ ID NO: 8242830 - DNA, 22 bp, Homo sapiens
tacaagtaaattgtagatacca

SEQ ID NO: 8242831 - DNA, 20 bp, Homo sapiens
tacaagtacattatagttat

SEQ ID NO: 8242832 - DNA, 22 bp, Homo sapiens
tacaagggagattattcatatt

SEQ ID NO: 8242833 - DNA, 22 bp, Homo sapiens
tacaaactaacatgtctcatcc

SEQ ID NO: 8242834 - DNA, 22 bp, Homo sapiens
caggcagggagccactgtataa

SEQ ID NO: 8242835 - DNA, 22 bp, Homo sapiens
caggcagggagccactgtataa

SEQ ID NO: 8242836 - DNA, 22 bp, Homo sapiens
tacaaatgaaccaactttgatg

SEQ ID NO: 8242837 - DNA, 22 bp, Homo sapiens
tacaaactccgaagtttgtacc

SEQ ID NO: 8242838 - DNA, 22 bp, Homo sapiens
tacaaactccgaagtttgtacc

SEQ ID NO: 8242839 - DNA, 22 bp, Homo sapiens
tacaaatgaaccaactttgatg

SEQ ID NO: 8242840 - DNA, 22 bp, Homo sapiens
tacaaatgaaccaactttgatg

SEQ ID NO: 8242841 - DNA, 22 bp, Homo sapiens
tacaaatgagttgtatgaacca

SEQ ID NO: 8242842 - DNA, 22 bp, Homo sapiens
tacaaatgagttgtatgaacca

SEQ ID NO: 8242843 - DNA, 22 bp, Homo sapiens
tacaaatgaccatagccactta

SEQ ID NO: 8242844 - DNA, 22 bp, Homo sapiens
tacaaatgaccatagccactta

SEQ ID NO: 8242845 - DNA, 22 bp, Homo sapiens
tacaaatgcctgacacacagat

SEQ ID NO: 8242846 - DNA, 22 bp, Homo sapiens
tacaaatgcctgacacacagat

SEQ ID NO: 8242847 - DNA, 22 bp, Homo sapiens
tacaaatgagttgtatgaacca

SEQ ID NO: 8242848 - DNA, 22 bp, Homo sapiens
tacaaatgtattttattttggt

SEQ ID NO: 8242849 - DNA, 22 bp, Homo sapiens
tacaaatgtattttattttggt

SEQ ID NO: 8242850 - DNA, 22 bp, Homo sapiens
tacaaatgggttaaaatatagt

SEQ ID NO: 8242851 - DNA, 22 bp, Homo sapiens
tacaaatggttgaatggatgaa

SEQ ID NO: 8242852 - DNA, 22 bp, Homo sapiens
tacaaatgggttaaaatatagt

SEQ ID NO: 8242853 - DNA, 20 bp, Homo sapiens
tacaaattttccatgtttcc

SEQ ID NO: 8242854 - DNA, 22 bp, Homo sapiens
tacaaattaatgggcatgttta

SEQ ID NO: 8242855 - DNA, 22 bp, Homo sapiens
tacaaggcaaatccatgatgtc

SEQ ID NO: 8242856 - DNA, 22 bp, Homo sapiens
tacaaggaaaattttatagtaa

SEQ ID NO: 8242857 - DNA, 22 bp, Homo sapiens
tacaaggaaaatcttgaagtac

SEQ ID NO: 8242858 - DNA, 20 bp, Homo sapiens
tacaaattttccatgtttcc

SEQ ID NO: 8242859 - DNA, 19 bp, Homo sapiens
tacaagcttttttggcagg

SEQ ID NO: 8242860 - DNA, 19 bp, Homo sapiens
tacaagcttttttggcagg

SEQ ID NO: 8242861 - DNA, 22 bp, Homo sapiens
tacaagcttttgtgtataaatg

SEQ ID NO: 8242862 - DNA, 22 bp, Homo sapiens
caggccctgggcaggcacagag

SEQ ID NO: 8242863 - DNA, 22 bp, Homo sapiens
caggccctgggcaggcacagag

SEQ ID NO: 8242864 - DNA, 22 bp, Homo sapiens
caggccctgggcaggatcagcc

SEQ ID NO: 8242865 - DNA, 22 bp, Homo sapiens
caggccctgggcaggatcagcc

SEQ ID NO: 8242866 - DNA, 22 bp, Homo sapiens
caggccctgggcaggatcagcc

SEQ ID NO: 8242867 - DNA, 22 bp, Homo sapiens
caggccctgggcaggatcagcc

SEQ ID NO: 8242868 - DNA, 22 bp, Homo sapiens
caggccctggcagggctgagtc

SEQ ID NO: 8242869 - DNA, 22 bp, Homo sapiens
caggccctggcagggctgagtc

SEQ ID NO: 8242870 - DNA, 22 bp, Homo sapiens
caggccctggcagggctgagtc

SEQ ID NO: 8242871 - DNA, 19 bp, Homo sapiens
caggccctggacccatctg

SEQ ID NO: 8242872 - DNA, 22 bp, Homo sapiens
caggccctggcagggctgagtc

SEQ ID NO: 8242873 - DNA, 22 bp, Homo sapiens
tacagtttgttacattgttagt

SEQ ID NO: 8242874 - DNA, 22 bp, Homo sapiens
tacagtttgttacattgttagt

SEQ ID NO: 8242875 - DNA, 22 bp, Homo sapiens
tacagtttgttacattgttagt

SEQ ID NO: 8242876 - DNA, 22 bp, Homo sapiens
caggccggccggccccagctct

SEQ ID NO: 8242877 - DNA, 22 bp, Homo sapiens
caggccctttcctgggcatagg

SEQ ID NO: 8242878 - DNA, 22 bp, Homo sapiens
caggccctgtgctgggtgatgt

SEQ ID NO: 8242879 - DNA, 22 bp, Homo sapiens
caggccctttcctgggcatagg

SEQ ID NO: 8242880 - DNA, 22 bp, Homo sapiens
caggccctttcctgggcatagg

SEQ ID NO: 8242881 - DNA, 22 bp, Homo sapiens
caggccctttcctgggcatagg

SEQ ID NO: 8242882 - DNA, 18 bp, Homo sapiens
caggccctgtctggcctc

SEQ ID NO: 8242883 - DNA, 22 bp, Homo sapiens
caggccctgggcaggcacagag

SEQ ID NO: 8242884 - DNA, 18 bp, Homo sapiens
caggccctgtctggcctc

SEQ ID NO: 8242885 - DNA, 18 bp, Homo sapiens
caggccctgtctggcctc

SEQ ID NO: 8242886 - DNA, 18 bp, Homo sapiens
caggccctgtctggcctc

SEQ ID NO: 8242887 - DNA, 18 bp, Homo sapiens
caggccctgtctggcctc

SEQ ID NO: 8242888 - DNA, 22 bp, Homo sapiens
tacaggtggatcactagtatag

SEQ ID NO: 8242889 - DNA, 22 bp, Homo sapiens
tacaggtgctctacagacagga

SEQ ID NO: 8242890 - DNA, 22 bp, Homo sapiens
tacaggtgctctacagacagga

SEQ ID NO: 8242891 - DNA, 22 bp, Homo sapiens
tacaggtggatcactagtatag

SEQ ID NO: 8242892 - DNA, 22 bp, Homo sapiens
tacaggtgctctacagacagga

SEQ ID NO: 8242893 - DNA, 22 bp, Homo sapiens
tacaggttacacttttaaaagt

SEQ ID NO: 8242894 - DNA, 22 bp, Homo sapiens
tacaggtggtaaaaatattgtt

SEQ ID NO: 8242895 - DNA, 22 bp, Homo sapiens
tacagtaaatgtggtagaaact

SEQ ID NO: 8242896 - DNA, 22 bp, Homo sapiens
tacagtaaagctgctatgaatt

SEQ ID NO: 8242897 - DNA, 19 bp, Homo sapiens
caggccctggacccatctg

SEQ ID NO: 8242898 - DNA, 22 bp, Homo sapiens
caggccctggcagggctgagtc

SEQ ID NO: 8242899 - DNA, 19 bp, Homo sapiens
caggccctggacccatctg

SEQ ID NO: 8242900 - DNA, 22 bp, Homo sapiens
caggccctgctgctgagacctt

SEQ ID NO: 8242901 - DNA, 22 bp, Homo sapiens
caggccctgctgctgagacctt

SEQ ID NO: 8242902 - DNA, 22 bp, Homo sapiens
tacagtaacatgttgtacaagc

SEQ ID NO: 8242903 - DNA, 22 bp, Homo sapiens
tacatatttgtctttgtactgt

SEQ ID NO: 8242904 - DNA, 22 bp, Homo sapiens
tacatcaaatcaatgttccagt

SEQ ID NO: 8242905 - DNA, 22 bp, Homo sapiens
tacatcatgaaagcatacatca

SEQ ID NO: 8242906 - DNA, 22 bp, Homo sapiens
tacatcatgaaagcatacatca

SEQ ID NO: 8242907 - DNA, 22 bp, Homo sapiens
tacatcatgaaagcatacatca

SEQ ID NO: 8242908 - DNA, 22 bp, Homo sapiens
tacatcatgaaagcatacatca

SEQ ID NO: 8242909 - DNA, 22 bp, Homo sapiens
tacatcatgaaagcatacatca

SEQ ID NO: 8242910 - DNA, 22 bp, Homo sapiens
tacatgtgcacgtgtgactttg

SEQ ID NO: 8242911 - DNA, 22 bp, Homo sapiens
tacatgtgatcagaaagtgaaa

SEQ ID NO: 8242912 - DNA, 22 bp, Homo sapiens
tacatgtgatcagaaagtgaaa

SEQ ID NO: 8242913 - DNA, 22 bp, Homo sapiens
tacatgtgatcagaaagtgaaa

SEQ ID NO: 8242914 - DNA, 21 bp, Homo sapiens
tacatcatgctacttctctga

SEQ ID NO: 8242915 - DNA, 22 bp, Homo sapiens
tacatgtggccagaaatttgag

SEQ ID NO: 8242916 - DNA, 22 bp, Homo sapiens
tacatgtggagttttctagtca

SEQ ID NO: 8242917 - DNA, 22 bp, Homo sapiens
tacatgtggagttttctagtca

SEQ ID NO: 8242918 - DNA, 22 bp, Homo sapiens
tacatgtggagttttctagtca

SEQ ID NO: 8242919 - DNA, 22 bp, Homo sapiens
tacatgtgctgggttcttggcc

SEQ ID NO: 8242920 - DNA, 22 bp, Homo sapiens
tacatgtgctatttgttttgta

SEQ ID NO: 8242921 - DNA, 22 bp, Homo sapiens
tacatgtggagataactgaagc

SEQ ID NO: 8242922 - DNA, 22 bp, Homo sapiens
tacatatgtatttgtgtatacg

SEQ ID NO: 8242923 - DNA, 22 bp, Homo sapiens
tacatatgtaaacatgtataaa

SEQ ID NO: 8242924 - DNA, 22 bp, Homo sapiens
tacatatgtaaacatgtataaa

SEQ ID NO: 8242925 - DNA, 22 bp, Homo sapiens
tacatatgtaaacatgtataaa

SEQ ID NO: 8242926 - DNA, 22 bp, Homo sapiens
tacatatgagttcgttctatgc

SEQ ID NO: 8242927 - DNA, 22 bp, Homo sapiens
tacatatgtaaacatgtataaa

SEQ ID NO: 8242928 - DNA, 22 bp, Homo sapiens
tacatattgtccatagttgctt

SEQ ID NO: 8242929 - DNA, 22 bp, Homo sapiens
tacatattcaacgttcagtatt

SEQ ID NO: 8242930 - DNA, 22 bp, Homo sapiens
tacatattcaacgttcagtatt

SEQ ID NO: 8242931 - DNA, 22 bp, Homo sapiens
tacatatttgtctttgtactgt

SEQ ID NO: 8242932 - DNA, 22 bp, Homo sapiens
tacatattgtccatagttgctt

SEQ ID NO: 8242933 - DNA, 22 bp, Homo sapiens
ccagaggtgctctttggaagtg

SEQ ID NO: 8242934 - DNA, 19 bp, Homo sapiens
ccagatgagcagctgagat

SEQ ID NO: 8242935 - DNA, 22 bp, Homo sapiens
ccagatgagaccacactgctgg

SEQ ID NO: 8242936 - DNA, 22 bp, Homo sapiens
ccagatcttcttttcagtgtct

SEQ ID NO: 8242937 - DNA, 21 bp, Homo sapiens
ccagatcctgcttcctcaccc

SEQ ID NO: 8242938 - DNA, 17 bp, Homo sapiens
ccagatcccagtcctta

SEQ ID NO: 8242939 - DNA, 22 bp, Homo sapiens
ccagatccctgtttgcctctgg

SEQ ID NO: 8242940 - DNA, 17 bp, Homo sapiens
ccagatcccagtcctta

SEQ ID NO: 8242941 - DNA, 22 bp, Homo sapiens
ccagatatcactgccgtgttgt

SEQ ID NO: 8242942 - DNA, 22 bp, Homo sapiens
ccagatatcactgccgtgttgt

SEQ ID NO: 8242943 - DNA, 22 bp, Homo sapiens
ccagatggaaatgatgttctca

SEQ ID NO: 8242944 - DNA, 22 bp, Homo sapiens
ccagatggaaatgatgttctca

SEQ ID NO: 8242945 - DNA, 22 bp, Homo sapiens
ccagatgggctttagcaaatga

SEQ ID NO: 8242946 - DNA, 22 bp, Homo sapiens
ccagatgggccaggggtttgtt

SEQ ID NO: 8242947 - DNA, 22 bp, Homo sapiens
ccagatgggttacttcaagcaa

SEQ ID NO: 8242948 - DNA, 22 bp, Homo sapiens
ccagatgggccaggggtttgtt

SEQ ID NO: 8242949 - DNA, 19 bp, Homo sapiens
tctctctgtacattagata

SEQ ID NO: 8242950 - DNA, 19 bp, Homo sapiens
tctctctgtacattagata

SEQ ID NO: 8242951 - DNA, 22 bp, Homo sapiens
ccagatggtttgcatgggaggg

SEQ ID NO: 8242952 - DNA, 22 bp, Homo sapiens
ccagatggtccagagtctagcc

SEQ ID NO: 8242953 - DNA, 22 bp, Homo sapiens
ccagatggtgcctgtcagaagg

SEQ ID NO: 8242954 - DNA, 22 bp, Homo sapiens
ccagatggtgcctgtcagaagg

SEQ ID NO: 8242955 - DNA, 22 bp, Homo sapiens
ccagatggtccagagtctagcc

SEQ ID NO: 8242956 - DNA, 22 bp, Homo sapiens
ccagatggtatagtagggagag

SEQ ID NO: 8242957 - DNA, 22 bp, Homo sapiens
ccagaggagatgcctcctctgt

SEQ ID NO: 8242958 - DNA, 22 bp, Homo sapiens
ccagaggagatgcctcctctgt

SEQ ID NO: 8242959 - DNA, 22 bp, Homo sapiens
ccagaggagcaggctggctcca

SEQ ID NO: 8242960 - DNA, 22 bp, Homo sapiens
ccagaggacttgggggctgaat

SEQ ID NO: 8242961 - DNA, 22 bp, Homo sapiens
ccagaggacttgggggctgaat

SEQ ID NO: 8242962 - DNA, 22 bp, Homo sapiens
ccagaggacttgggggctgaat

SEQ ID NO: 8242963 - DNA, 22 bp, Homo sapiens
ccagaggagcatggccttgaga

SEQ ID NO: 8242964 - DNA, 22 bp, Homo sapiens
ccagaggagggctctgatgagg

SEQ ID NO: 8242965 - DNA, 22 bp, Homo sapiens
ccagaggagggctctgatgagg

SEQ ID NO: 8242966 - DNA, 22 bp, Homo sapiens
ccagaggaggggggtctttctg

SEQ ID NO: 8242967 - DNA, 22 bp, Homo sapiens
ccagaggagttgaggctttggg

SEQ ID NO: 8242968 - DNA, 22 bp, Homo sapiens
ccagaggagttgaggctttggg

SEQ ID NO: 8242969 - DNA, 18 bp, Homo sapiens
tctctaccagaagtgacg

SEQ ID NO: 8242970 - DNA, 22 bp, Homo sapiens
tctctagacatggggaatgtca

SEQ ID NO: 8242971 - DNA, 22 bp, Homo sapiens
tctctacataacctcaatactc

SEQ ID NO: 8242972 - DNA, 22 bp, Homo sapiens
ccagaggacttgggggctgaat

SEQ ID NO: 8242973 - DNA, 19 bp, Homo sapiens
ccagaggactgttaatgaa

SEQ ID NO: 8242974 - DNA, 22 bp, Homo sapiens
tctctaattcaaccagacactt

SEQ ID NO: 8242975 - DNA, 22 bp, Homo sapiens
tctctacaaaaattagcatgca

SEQ ID NO: 8242976 - DNA, 22 bp, Homo sapiens
tctctaaagcactttaaccaca

SEQ ID NO: 8242977 - DNA, 22 bp, Homo sapiens
tctctaaagatatttatggcaa

SEQ ID NO: 8242978 - DNA, 20 bp, Homo sapiens
tctctaaagcacctggacta

SEQ ID NO: 8242979 - DNA, 22 bp, Homo sapiens
tctctaaagcctggaagaggag

SEQ ID NO: 8242980 - DNA, 22 bp, Homo sapiens
tctctaaagtagaaaagacccc

SEQ ID NO: 8242981 - DNA, 22 bp, Homo sapiens
tctctaaatacagatgtcatgg

SEQ ID NO: 8242982 - DNA, 22 bp, Homo sapiens
tctctaaataacacttattgaa

SEQ ID NO: 8242983 - DNA, 22 bp, Homo sapiens
tctctaaatacagatgtcatgg

SEQ ID NO: 8242984 - DNA, 22 bp, Homo sapiens
tctctaaatctggttcacttgc

SEQ ID NO: 8242985 - DNA, 22 bp, Homo sapiens
tctctaaatacagatgtcatgg

SEQ ID NO: 8242986 - DNA, 22 bp, Homo sapiens
tctctaaatctggttcacttgc

SEQ ID NO: 8242987 - DNA, 22 bp, Homo sapiens
tctctaaatgattgtgtactcc

SEQ ID NO: 8242988 - DNA, 19 bp, Homo sapiens
tctctaaatggtctttcac

SEQ ID NO: 8242989 - DNA, 22 bp, Homo sapiens
tctctaaatgctctcccatccc

SEQ ID NO: 8242990 - DNA, 20 bp, Homo sapiens
tctctaacatgaatgctatc

SEQ ID NO: 8242991 - DNA, 22 bp, Homo sapiens
tctctaaatgttgggggaaatg

SEQ ID NO: 8242992 - DNA, 22 bp, Homo sapiens
tctcccaagtgaccaggaaaga

SEQ ID NO: 8242993 - DNA, 22 bp, Homo sapiens
tctcccaagtgaccaggaaaga

SEQ ID NO: 8242994 - DNA, 22 bp, Homo sapiens
tctcccaaggcacagaaagagt

SEQ ID NO: 8242995 - DNA, 22 bp, Homo sapiens
tctcctgggaggacaaggaagg

SEQ ID NO: 8242996 - DNA, 22 bp, Homo sapiens
tctcctgggaggacaaggaagg

SEQ ID NO: 8242997 - DNA, 19 bp, Homo sapiens
tctccagtttattcttcca

SEQ ID NO: 8242998 - DNA, 19 bp, Homo sapiens
tctccagttgctttcaggg

SEQ ID NO: 8242999 - DNA, 22 bp, Homo sapiens
tctcccaacatgtggaggtcag

SEQ ID NO: 8243000 - DNA, 21 bp, Homo sapiens
tctcccaaggaggtcctgagg

SEQ ID NO: 8243001 - DNA, 21 bp, Homo sapiens
tctcccaaggaggtcctgagg

SEQ ID NO: 8243002 - DNA, 22 bp, Homo sapiens
tctcccaaggcacagaaagagt

SEQ ID NO: 8243003 - DNA, 21 bp, Homo sapiens
tctcccaaggaggtcctgagg

SEQ ID NO: 8243004 - DNA, 22 bp, Homo sapiens
ccagaggaaaaatatctcccta

SEQ ID NO: 8243005 - DNA, 22 bp, Homo sapiens
ccagaggaattgggaaacatgt

SEQ ID NO: 8243006 - DNA, 22 bp, Homo sapiens
ccagaggaattgggaaacatgt

SEQ ID NO: 8243007 - DNA, 19 bp, Homo sapiens
ccagaggactgttaatgaa

SEQ ID NO: 8243008 - DNA, 22 bp, Homo sapiens
tctccagtgaatctcctcctgg

SEQ ID NO: 8243009 - DNA, 20 bp, Homo sapiens
ccagacagcacctgcctggt

SEQ ID NO: 8243010 - DNA, 22 bp, Homo sapiens
ccagacagcagttaaaggacat

SEQ ID NO: 8243011 - DNA, 22 bp, Homo sapiens
ccagacaggaacacacatctcc

SEQ ID NO: 8243012 - DNA, 22 bp, Homo sapiens
ccagacagcagttaaaggacat

SEQ ID NO: 8243013 - DNA, 20 bp, Homo sapiens
ccagacagcacctgcctggt

SEQ ID NO: 8243014 - DNA, 20 bp, Homo sapiens
ccagacagcacctgcctggt

SEQ ID NO: 8243015 - DNA, 20 bp, Homo sapiens
ccagacagcacctgcctggt

SEQ ID NO: 8243016 - DNA, 22 bp, Homo sapiens
ccagagcctgctgagccccatt

SEQ ID NO: 8243017 - DNA, 22 bp, Homo sapiens
ccagacaggggctgttcctgct

SEQ ID NO: 8243018 - DNA, 22 bp, Homo sapiens
ccagacaggaacacacatctcc

SEQ ID NO: 8243019 - DNA, 22 bp, Homo sapiens
ccagacaggaacacacatctcc

SEQ ID NO: 8243020 - DNA, 22 bp, Homo sapiens
ccagagctgatgggcccagggt

SEQ ID NO: 8243021 - DNA, 22 bp, Homo sapiens
ccagagctgatgggcccagggt

SEQ ID NO: 8243022 - DNA, 20 bp, Homo sapiens
ccagagctgatggctgcccg

SEQ ID NO: 8243023 - DNA, 21 bp, Homo sapiens
ccagagcctgctgagccccct

SEQ ID NO: 8243024 - DNA, 22 bp, Homo sapiens
ccagagcctgctgagccccatt

SEQ ID NO: 8243025 - DNA, 18 bp, Homo sapiens
ccagagctggctcctcgc

SEQ ID NO: 8243026 - DNA, 18 bp, Homo sapiens
ccagagctggctcctcgc

SEQ ID NO: 8243027 - DNA, 22 bp, Homo sapiens
ccagagcttcggggcggctgta

SEQ ID NO: 8243028 - DNA, 22 bp, Homo sapiens
ccagagcttcggggcggctgta

SEQ ID NO: 8243029 - DNA, 22 bp, Homo sapiens
ccagagcttgacgtgcaacgga

SEQ ID NO: 8243030 - DNA, 22 bp, Homo sapiens
ccagagcttgacgtgcaacgga

SEQ ID NO: 8243031 - DNA, 22 bp, Homo sapiens
ccagagctgcatccagcaggtt

SEQ ID NO: 8243032 - DNA, 22 bp, Homo sapiens
ccagagctgcatccagcaggtt

SEQ ID NO: 8243033 - DNA, 22 bp, Homo sapiens
ccagagctgcatccagcaggtt

SEQ ID NO: 8243034 - DNA, 22 bp, Homo sapiens
ccagagctgcatccagcaggtt

SEQ ID NO: 8243035 - DNA, 22 bp, Homo sapiens
ccagagctgcatccagcaggtt

SEQ ID NO: 8243036 - DNA, 22 bp, Homo sapiens
ccagagctgcatccagcaggtt

SEQ ID NO: 8243037 - DNA, 22 bp, Homo sapiens
ccagagctgattcctgggactt

SEQ ID NO: 8243038 - DNA, 22 bp, Homo sapiens
ccagagctgattcctgggactt

SEQ ID NO: 8243039 - DNA, 22 bp, Homo sapiens
ccagagctgattcctgggactt

SEQ ID NO: 8243040 - DNA, 22 bp, Homo sapiens
ccagagctgattcctgggactt

SEQ ID NO: 8243041 - DNA, 22 bp, Homo sapiens
ccagagctgatgggcccagggt

SEQ ID NO: 8243042 - DNA, 22 bp, Homo sapiens
ccactgagtacccgatggctgc

SEQ ID NO: 8243043 - DNA, 22 bp, Homo sapiens
ccactgagtacccgatggctgc

SEQ ID NO: 8243044 - DNA, 22 bp, Homo sapiens
ccactgccagccgcccggaggc

SEQ ID NO: 8243045 - DNA, 22 bp, Homo sapiens
ccactgcactccagccttggca

SEQ ID NO: 8243046 - DNA, 22 bp, Homo sapiens
ccactgcacttcagcctgggtg

SEQ ID NO: 8243047 - DNA, 23 bp, Homo sapiens
ccactgatgcattttctctctgt

SEQ ID NO: 8243048 - DNA, 22 bp, Homo sapiens
ccactgaggcaggcagtatcta

SEQ ID NO: 8243049 - DNA, 22 bp, Homo sapiens
ccactgaggaacatgggctcca

SEQ ID NO: 8243050 - DNA, 22 bp, Homo sapiens
ccactgagcagtagctgcgtcg

SEQ ID NO: 8243051 - DNA, 21 bp, Homo sapiens
ccactgagcattgttatgaag

SEQ ID NO: 8243052 - DNA, 19 bp, Homo sapiens
ccactgaggcttggttctt

SEQ ID NO: 8243053 - DNA, 19 bp, Homo sapiens
ccactgaggcttggttctt

SEQ ID NO: 8243054 - DNA, 22 bp, Homo sapiens
ccactgaggggtcatggtggga

SEQ ID NO: 8243055 - DNA, 22 bp, Homo sapiens
ccactgaggttttgtggttatg

SEQ ID NO: 8243056 - DNA, 22 bp, Homo sapiens
ccactgcctgacttagatgaca

SEQ ID NO: 8243057 - DNA, 22 bp, Homo sapiens
ccagaaaactctacatgcttgt

SEQ ID NO: 8243058 - DNA, 22 bp, Homo sapiens
ccactgccagctttgtcctccc

SEQ ID NO: 8243059 - DNA, 22 bp, Homo sapiens
ccactgccatgggctaggcatg

SEQ ID NO: 8243060 - DNA, 22 bp, Homo sapiens
ccactgccccctgaagaccagg

SEQ ID NO: 8243061 - DNA, 22 bp, Homo sapiens
ccactgcccaccccgacgtcta

SEQ ID NO: 8243062 - DNA, 22 bp, Homo sapiens
ccactgcccaccccgacgtcta

SEQ ID NO: 8243063 - DNA, 22 bp, Homo sapiens
ccactgccgatgttccatcttg

SEQ ID NO: 8243064 - DNA, 22 bp, Homo sapiens
ccactgccgtgggccttgggga

SEQ ID NO: 8243065 - DNA, 22 bp, Homo sapiens
ccagaataggagtaataaaacc

SEQ ID NO: 8243066 - DNA, 22 bp, Homo sapiens
ccagaatctcaatacctttcaa

SEQ ID NO: 8243067 - DNA, 22 bp, Homo sapiens
ccagaatctcaatacctttcaa

SEQ ID NO: 8243068 - DNA, 22 bp, Homo sapiens
ccagaagtgtctatcaagatgt

SEQ ID NO: 8243069 - DNA, 22 bp, Homo sapiens
ccagaagtcaagtaagatgaag

SEQ ID NO: 8243070 - DNA, 22 bp, Homo sapiens
ccagaagtcaggaatgagtctt

SEQ ID NO: 8243071 - DNA, 22 bp, Homo sapiens
ccagaagggctattgcagtgac

SEQ ID NO: 8243072 - DNA, 20 bp, Homo sapiens
ccagaaggtaggatggaaca

SEQ ID NO: 8243073 - DNA, 22 bp, Homo sapiens
ccagaagcacctccttttgtgc

SEQ ID NO: 8243074 - DNA, 20 bp, Homo sapiens
ccagaagcactcttcatgtt

SEQ ID NO: 8243075 - DNA, 22 bp, Homo sapiens
ccagaagcacctccttttgtgc

SEQ ID NO: 8243076 - DNA, 20 bp, Homo sapiens
ccagaagcactcttcatgtt

SEQ ID NO: 8243077 - DNA, 22 bp, Homo sapiens
ccagaagcaaaacagacagttt

SEQ ID NO: 8243078 - DNA, 22 bp, Homo sapiens
ccagaagaggacacagtgtgga

SEQ ID NO: 8243079 - DNA, 22 bp, Homo sapiens
ccagaagagatcacagttcttg

SEQ ID NO: 8243080 - DNA, 22 bp, Homo sapiens
ccagaaaaggagctgcaggatg

SEQ ID NO: 8243081 - DNA, 22 bp, Homo sapiens
ccagaagctatgttttagataa

SEQ ID NO: 8243082 - DNA, 22 bp, Homo sapiens
ccagaagccctttgtttgttgt

SEQ ID NO: 8243083 - DNA, 22 bp, Homo sapiens
ccagaagcagagcctgaggcag

SEQ ID NO: 8243084 - DNA, 21 bp, Homo sapiens
ccagaagctgcttgcaggcta

SEQ ID NO: 8243085 - DNA, 21 bp, Homo sapiens
ccagaagctgcttgcaggcta

SEQ ID NO: 8243086 - DNA, 22 bp, Homo sapiens
ccagaagcttcaaggagattct

SEQ ID NO: 8243087 - DNA, 22 bp, Homo sapiens
ccagaagcttctacacaggaga

SEQ ID NO: 8243088 - DNA, 22 bp, Homo sapiens
ccagaagcttctacacaggaga

SEQ ID NO: 8243089 - DNA, 22 bp, Homo sapiens
ccagaaggcggagattgcagtg

SEQ ID NO: 8243090 - DNA, 23 bp, Homo sapiens
ccagaaggagccacactccttgc

SEQ ID NO: 8243091 - DNA, 22 bp, Homo sapiens
ccacagtctagctagaaggcat

SEQ ID NO: 8243092 - DNA, 22 bp, Homo sapiens
ccacagtccgggctggcaggac

SEQ ID NO: 8243093 - DNA, 22 bp, Homo sapiens
ccacagtccgggctggcaggac

SEQ ID NO: 8243094 - DNA, 16 bp, Homo sapiens
ccacctgcagctctca

SEQ ID NO: 8243095 - DNA, 22 bp, Homo sapiens
ccacagtgagttctgtactctg

SEQ ID NO: 8243096 - DNA, 16 bp, Homo sapiens
ccacctgcagctctca

SEQ ID NO: 8243097 - DNA, 22 bp, Homo sapiens
ccacagtgagtgtcatacttgg

SEQ ID NO: 8243098 - DNA, 22 bp, Homo sapiens
ccacagtgacacgggctggccc

SEQ ID NO: 8243099 - DNA, 22 bp, Homo sapiens
ccacagtgacacgggctggccc

SEQ ID NO: 8243100 - DNA, 22 bp, Homo sapiens
ccactctgattggtcacctctg

SEQ ID NO: 8243101 - DNA, 23 bp, Homo sapiens
ccactctcccaccatatctgtat

SEQ ID NO: 8243102 - DNA, 23 bp, Homo sapiens
ccactctcccaccatatctgtat

SEQ ID NO: 8243103 - DNA, 22 bp, Homo sapiens
ccactctttactgttgggtttt

SEQ ID NO: 8243104 - DNA, 22 bp, Homo sapiens
ccactcttgaatcaagagctca

SEQ ID NO: 8243105 - DNA, 22 bp, Homo sapiens
ccactgacacagacaaggcctg

SEQ ID NO: 8243106 - DNA, 22 bp, Homo sapiens
ccactgactccaggagctgagg

SEQ ID NO: 8243107 - DNA, 17 bp, Homo sapiens
ccactgactctgacttc

SEQ ID NO: 8243108 - DNA, 22 bp, Homo sapiens
ccactgagaccttttggaggag

SEQ ID NO: 8243109 - DNA, 22 bp, Homo sapiens
tcctggtgaggctagaagtgtc

SEQ ID NO: 8243110 - DNA, 22 bp, Homo sapiens
tcctggtgaggctagaagtgtc

SEQ ID NO: 8243111 - DNA, 22 bp, Homo sapiens
tcctggtgaggactccaagata

SEQ ID NO: 8243112 - DNA, 20 bp, Homo sapiens
tcctggtcatgtggctgggc

SEQ ID NO: 8243113 - DNA, 23 bp, Homo sapiens
tcctggtgacatgcctgagcatc

SEQ ID NO: 8243114 - DNA, 22 bp, Homo sapiens
tcctggtgcctggagctctcca

SEQ ID NO: 8243115 - DNA, 19 bp, Homo sapiens
tcctggtgcttgacactga

SEQ ID NO: 8243116 - DNA, 22 bp, Homo sapiens
tcctggggagggttctggctcc

SEQ ID NO: 8243117 - DNA, 22 bp, Homo sapiens
tcctggtctacactgcattggg

SEQ ID NO: 8243118 - DNA, 23 bp, Homo sapiens
tcctggtgacatgcctgagcatc

SEQ ID NO: 8243119 - DNA, 18 bp, Homo sapiens
tcctggtggagaagtggt

SEQ ID NO: 8243120 - DNA, 18 bp, Homo sapiens
tcctggtggagaagtggt

SEQ ID NO: 8243121 - DNA, 22 bp, Homo sapiens
tcctggtgcttgtatttgaagt

SEQ ID NO: 8243122 - DNA, 22 bp, Homo sapiens
ccacagggtcagccactctgca

SEQ ID NO: 8243123 - DNA, 22 bp, Homo sapiens
ccacaggggtctctgtagctga

SEQ ID NO: 8243124 - DNA, 22 bp, Homo sapiens
tcctggtggatagaagccaagg

SEQ ID NO: 8243125 - DNA, 22 bp, Homo sapiens
ccacagggtgtcatcagcttga

SEQ ID NO: 8243126 - DNA, 22 bp, Homo sapiens
ccacagggtgtcatcagcttga

SEQ ID NO: 8243127 - DNA, 22 bp, Homo sapiens
ccacagggtgtcatcagcttga

SEQ ID NO: 8243128 - DNA, 22 bp, Homo sapiens
ccacagggtgtcatcagcttga

SEQ ID NO: 8243129 - DNA, 22 bp, Homo sapiens
ccacaggtacggattgaggacc

SEQ ID NO: 8243130 - DNA, 22 bp, Homo sapiens
catttagaaaatgataaccctt

SEQ ID NO: 8243131 - DNA, 22 bp, Homo sapiens
catttacagcagactgatgaaa

SEQ ID NO: 8243132 - DNA, 22 bp, Homo sapiens
catttacagcagactgatgaaa

SEQ ID NO: 8243133 - DNA, 22 bp, Homo sapiens
catttacacttctaaccacaag

SEQ ID NO: 8243134 - DNA, 17 bp, Homo sapiens
tccaggcagcaactgag

SEQ ID NO: 8243135 - DNA, 17 bp, Homo sapiens
tccaggcagcaactgag

SEQ ID NO: 8243136 - DNA, 17 bp, Homo sapiens
tccaggcagcaactgag

SEQ ID NO: 8243137 - DNA, 20 bp, Homo sapiens
tccaggcagacagctatggg

SEQ ID NO: 8243138 - DNA, 22 bp, Homo sapiens
tccaggcactatatatactttt

SEQ ID NO: 8243139 - DNA, 23 bp, Homo sapiens
tccaggcacgcatttcttctagc

SEQ ID NO: 8243140 - DNA, 22 bp, Homo sapiens
tccaggcacagagttggtcagt

SEQ ID NO: 8243141 - DNA, 22 bp, Homo sapiens
catttagtcaaggacacgtggc

SEQ ID NO: 8243142 - DNA, 22 bp, Homo sapiens
catttagttatactaaaacatt

SEQ ID NO: 8243143 - DNA, 22 bp, Homo sapiens
catttagttatactaaaacatt

SEQ ID NO: 8243144 - DNA, 22 bp, Homo sapiens
catttagttttgcagtagcagg

SEQ ID NO: 8243145 - DNA, 22 bp, Homo sapiens
catttagagaagattacaagga

SEQ ID NO: 8243146 - DNA, 22 bp, Homo sapiens
catttagagaagattacaagga

SEQ ID NO: 8243147 - DNA, 22 bp, Homo sapiens
catttagaagtcttagaactat

SEQ ID NO: 8243148 - DNA, 19 bp, Homo sapiens
catttagaagtacatatta

SEQ ID NO: 8243149 - DNA, 19 bp, Homo sapiens
catttagaagtacatatta

SEQ ID NO: 8243150 - DNA, 20 bp, Homo sapiens
catttagaaattggcatgga

SEQ ID NO: 8243151 - DNA, 22 bp, Homo sapiens
catttatataaaatgtccagaa

SEQ ID NO: 8243152 - DNA, 22 bp, Homo sapiens
catttatataaaatgtccagaa

SEQ ID NO: 8243153 - DNA, 22 bp, Homo sapiens
catttatataaaatgtccagaa

SEQ ID NO: 8243154 - DNA, 22 bp, Homo sapiens
catttattagttagttcgatgt

SEQ ID NO: 8243155 - DNA, 22 bp, Homo sapiens
tcccagggcactcaccctccct

SEQ ID NO: 8243156 - DNA, 22 bp, Homo sapiens
catttattagttagttcgatgt

SEQ ID NO: 8243157 - DNA, 22 bp, Homo sapiens
catttattagttagttcgatgt

SEQ ID NO: 8243158 - DNA, 22 bp, Homo sapiens
tcccagggcactcaccctccct

SEQ ID NO: 8243159 - DNA, 22 bp, Homo sapiens
tcccagggcagctgtccagaag

SEQ ID NO: 8243160 - DNA, 22 bp, Homo sapiens
tcccagggcagctgtccagaag

SEQ ID NO: 8243161 - DNA, 21 bp, Homo sapiens
tcccagggccaggtgccatca

SEQ ID NO: 8243162 - DNA, 21 bp, Homo sapiens
tcccagggccaggtgccatca

SEQ ID NO: 8243163 - DNA, 21 bp, Homo sapiens
tcccagggccaggtgccatca

SEQ ID NO: 8243164 - DNA, 21 bp, Homo sapiens
tcccagggccaggtgccatca

SEQ ID NO: 8243165 - DNA, 22 bp, Homo sapiens
tcccagggccgcaaacgagttt

SEQ ID NO: 8243166 - DNA, 22 bp, Homo sapiens
tcccagggctctagagtgctgg

SEQ ID NO: 8243167 - DNA, 22 bp, Homo sapiens
tcccagggctctagagtgctgg

SEQ ID NO: 8243168 - DNA, 22 bp, Homo sapiens
tcccagggctctagagtgctgg

SEQ ID NO: 8243169 - DNA, 22 bp, Homo sapiens
tcccagggcttttctcatgctt

SEQ ID NO: 8243170 - DNA, 22 bp, Homo sapiens
tcccagggcttttctcatgctt

SEQ ID NO: 8243171 - DNA, 22 bp, Homo sapiens
tcccagggcttttctcatgctt

SEQ ID NO: 8243172 - DNA, 22 bp, Homo sapiens
tcccagggcttttctcatgctt

SEQ ID NO: 8243173 - DNA, 22 bp, Homo sapiens
tcccagggggatgaacactgcc

SEQ ID NO: 8243174 - DNA, 22 bp, Homo sapiens
tcccagggggatgaacactgcc

SEQ ID NO: 8243175 - DNA, 22 bp, Homo sapiens
tcccagggtcagtggtgaggcc

SEQ ID NO: 8243176 - DNA, 22 bp, Homo sapiens
catttctcactccagcaacttt

SEQ ID NO: 8243177 - DNA, 22 bp, Homo sapiens
catttctcactccagcaacttt

SEQ ID NO: 8243178 - DNA, 22 bp, Homo sapiens
tccctgctcagctcacctggca

SEQ ID NO: 8243179 - DNA, 22 bp, Homo sapiens
tccctgctaattggaatgtata

SEQ ID NO: 8243180 - DNA, 22 bp, Homo sapiens
tccctgctgagagtgctctccc

SEQ ID NO: 8243181 - DNA, 22 bp, Homo sapiens
tccctgctcagctcacctggca

SEQ ID NO: 8243182 - DNA, 22 bp, Homo sapiens
tccctgctcagctcacctggca

SEQ ID NO: 8243183 - DNA, 22 bp, Homo sapiens
tccctgctgcactcacacctac

SEQ ID NO: 8243184 - DNA, 22 bp, Homo sapiens
tccctgctgcactcacacctac

SEQ ID NO: 8243185 - DNA, 22 bp, Homo sapiens
tccctgctgagagtgctctccc

SEQ ID NO: 8243186 - DNA, 22 bp, Homo sapiens
tccctgctgagagtgctctccc

SEQ ID NO: 8243187 - DNA, 22 bp, Homo sapiens
tccctgctgagagtgctctccc

SEQ ID NO: 8243188 - DNA, 22 bp, Homo sapiens
tccctgctgggagatgacctta

SEQ ID NO: 8243189 - DNA, 22 bp, Homo sapiens
tccctgctgcactcacacctac

SEQ ID NO: 8243190 - DNA, 22 bp, Homo sapiens
tccctgcttgctctcagccctt

SEQ ID NO: 8243191 - DNA, 15 bp, Homo sapiens
tccctgctggtcaaa

SEQ ID NO: 8243192 - DNA, 22 bp, Homo sapiens
tccctgcttgctctcagccctt

SEQ ID NO: 8243193 - DNA, 21 bp, Homo sapiens
tccctgctttctggcccagtc

SEQ ID NO: 8243194 - DNA, 21 bp, Homo sapiens
tccctgctttctggcccagtc

SEQ ID NO: 8243195 - DNA, 22 bp, Homo sapiens
tccctgcttggaatgaccctta

SEQ ID NO: 8243196 - DNA, 22 bp, Homo sapiens
tccctgcttggaatgaccctta

SEQ ID NO: 8243197 - DNA, 22 bp, Homo sapiens
tccctgcttggaatgaccctta

SEQ ID NO: 8243198 - DNA, 22 bp, Homo sapiens
ccaaagtgatatgtgctgtaag

SEQ ID NO: 8243199 - DNA, 22 bp, Homo sapiens
ccaaagtgatatgtgctgtaag

SEQ ID NO: 8243200 - DNA, 22 bp, Homo sapiens
ccaaagtgctaggattacaggc

SEQ ID NO: 8243201 - DNA, 22 bp, Homo sapiens
ccaaagtgctgggattacaggt

SEQ ID NO: 8243202 - DNA, 22 bp, Homo sapiens
ccaaagtgctgggattacaggc

SEQ ID NO: 8243203 - DNA, 22 bp, Homo sapiens
ccaaagtgctgagattacaggt

SEQ ID NO: 8243204 - DNA, 22 bp, Homo sapiens
ccaaagtgctaggattacaggt

SEQ ID NO: 8243205 - DNA, 22 bp, Homo sapiens
ccaaaagcagctgtctgtgaat

SEQ ID NO: 8243206 - DNA, 22 bp, Homo sapiens
ccaaaagcagctgtctgtgaat

SEQ ID NO: 8243207 - DNA, 21 bp, Homo sapiens
tccctgctttctggcccagtc

SEQ ID NO: 8243208 - DNA, 22 bp, Homo sapiens
ccaaagtattaaatcttagcaa

SEQ ID NO: 8243209 - DNA, 23 bp, Homo sapiens
ccaaaagcgagtctgttgttccc

SEQ ID NO: 8243210 - DNA, 22 bp, Homo sapiens
catttgctgtaatgacaataag

SEQ ID NO: 8243211 - DNA, 22 bp, Homo sapiens
catttgctgtattttcagattc

SEQ ID NO: 8243212 - DNA, 22 bp, Homo sapiens
catttgctgtattttcagattc

SEQ ID NO: 8243213 - DNA, 22 bp, Homo sapiens
tccctgcctgacagcacccacc

SEQ ID NO: 8243214 - DNA, 22 bp, Homo sapiens
tccctgcctgacagcacccacc

SEQ ID NO: 8243215 - DNA, 22 bp, Homo sapiens
tccctgcctgacagcacccacc

SEQ ID NO: 8243216 - DNA, 22 bp, Homo sapiens
tccctgcctgacagcacccacc

SEQ ID NO: 8243217 - DNA, 22 bp, Homo sapiens
catttgctagcaggccttttat

SEQ ID NO: 8243218 - DNA, 22 bp, Homo sapiens
catttgctctgtgtcagtggca

SEQ ID NO: 8243219 - DNA, 22 bp, Homo sapiens
catttgctgaggccttcagagg

SEQ ID NO: 8243220 - DNA, 22 bp, Homo sapiens
catttgctctgtgtcagtggca

SEQ ID NO: 8243221 - DNA, 22 bp, Homo sapiens
catttgctggagatggaccaca

SEQ ID NO: 8243222 - DNA, 22 bp, Homo sapiens
catttgatcctcacaacaatct

SEQ ID NO: 8243223 - DNA, 22 bp, Homo sapiens
catttgaattgttctgtgggaa

SEQ ID NO: 8243224 - DNA, 22 bp, Homo sapiens
catttgattactaaagataatt

SEQ ID NO: 8243225 - DNA, 22 bp, Homo sapiens
catttgaactaataactgtgct

SEQ ID NO: 8243226 - DNA, 22 bp, Homo sapiens
catttgaacctggatgttctta

SEQ ID NO: 8243227 - DNA, 22 bp, Homo sapiens
catttctcataatattagcact

SEQ ID NO: 8243228 - DNA, 22 bp, Homo sapiens
catttctcataatattagcact

SEQ ID NO: 8243229 - DNA, 22 bp, Homo sapiens
tcctgcagttacatcccagcca

SEQ ID NO: 8243230 - DNA, 22 bp, Homo sapiens
tcctgcagttacatcccagcca

SEQ ID NO: 8243231 - DNA, 22 bp, Homo sapiens
tcctgcagtgtgtctcctgcac

SEQ ID NO: 8243232 - DNA, 22 bp, Homo sapiens
tcctgcagtgtgtctcctgcac

SEQ ID NO: 8243233 - DNA, 22 bp, Homo sapiens
tcctgcagtgtgtctcctgcac

SEQ ID NO: 8243234 - DNA, 22 bp, Homo sapiens
ccacacagggggatgagttatt

SEQ ID NO: 8243235 - DNA, 22 bp, Homo sapiens
ccacacagggggatgagttatt

SEQ ID NO: 8243236 - DNA, 22 bp, Homo sapiens
ccacaagtttcagcacccagag

SEQ ID NO: 8243237 - DNA, 22 bp, Homo sapiens
ccacaaaactgtgtgtcaaaga

SEQ ID NO: 8243238 - DNA, 19 bp, Homo sapiens
ccacaaaattattttagtt

SEQ ID NO: 8243239 - DNA, 19 bp, Homo sapiens
ccacaaaattattttagtt

SEQ ID NO: 8243240 - DNA, 22 bp, Homo sapiens
ccacaaagaatgggggaagcat

SEQ ID NO: 8243241 - DNA, 22 bp, Homo sapiens
ccacaagactctgtcagcataa

SEQ ID NO: 8243242 - DNA, 22 bp, Homo sapiens
ccaagggcgcctccgttccccc

SEQ ID NO: 8243243 - DNA, 22 bp, Homo sapiens
tcctcccacataggacaatggg

SEQ ID NO: 8243244 - DNA, 22 bp, Homo sapiens
tcctcccacataggacaatggg

SEQ ID NO: 8243245 - DNA, 22 bp, Homo sapiens
tcctcccacataggacaatggg

SEQ ID NO: 8243246 - DNA, 22 bp, Homo sapiens
tcctcccaacttttccatctca

SEQ ID NO: 8243247 - DNA, 22 bp, Homo sapiens
tcctcccaacttttccatctca

SEQ ID NO: 8243248 - DNA, 22 bp, Homo sapiens
tcctcccaacttttccatctca

SEQ ID NO: 8243249 - DNA, 22 bp, Homo sapiens
tcctcccaacttttccatctca

SEQ ID NO: 8243250 - DNA, 22 bp, Homo sapiens
tcctcccaacttttccatctca

SEQ ID NO: 8243251 - DNA, 22 bp, Homo sapiens
tcctccccaaagcccagcctgg

SEQ ID NO: 8243252 - DNA, 22 bp, Homo sapiens
tcctccccaaagcccagcctgg

SEQ ID NO: 8243253 - DNA, 22 bp, Homo sapiens
ccaagggagactgtgagacctc

SEQ ID NO: 8243254 - DNA, 17 bp, Homo sapiens
tcctccccgcagttgca

SEQ ID NO: 8243255 - DNA, 20 bp, Homo sapiens
tcctcccccacctttgcagc

SEQ ID NO: 8243256 - DNA, 20 bp, Homo sapiens
tcctcccccacctttgcagc

SEQ ID NO: 8243257 - DNA, 23 bp, Homo sapiens
tcctcccaaatttcagcctcatt

SEQ ID NO: 8243258 - DNA, 23 bp, Homo sapiens
tcctcccaaatttcagcctcatt

SEQ ID NO: 8243259 - DNA, 23 bp, Homo sapiens
tcctcccaaatttcagcctcatt

SEQ ID NO: 8243260 - DNA, 23 bp, Homo sapiens
tcctcccaaatttcagcctcatt

SEQ ID NO: 8243261 - DNA, 22 bp, Homo sapiens
ccaaataatatttcagaaccat

SEQ ID NO: 8243262 - DNA, 22 bp, Homo sapiens
ccaaagtgtgggagaagaggta

SEQ ID NO: 8243263 - DNA, 22 bp, Homo sapiens
ccaaagtgctgggattcaggca

SEQ ID NO: 8243264 - DNA, 22 bp, Homo sapiens
ccaaagtgctggggttacaggc

SEQ ID NO: 8243265 - DNA, 22 bp, Homo sapiens
ccaaagtgtgggagaagaggta

SEQ ID NO: 8243266 - DNA, 22 bp, Homo sapiens
ccaaatattaacaaagtaattt

SEQ ID NO: 8243267 - DNA, 22 bp, Homo sapiens
ccaaatattaacaaagtaattt

SEQ ID NO: 8243268 - DNA, 18 bp, Homo sapiens
ccacagcagagttcttac

SEQ ID NO: 8243269 - DNA, 22 bp, Homo sapiens
ccacagcatgcaggcctgacac

SEQ ID NO: 8243270 - DNA, 22 bp, Homo sapiens
ccacagcatgcaggcctgacac

SEQ ID NO: 8243271 - DNA, 22 bp, Homo sapiens
ccacagcatgcaggcctgacac

SEQ ID NO: 8243272 - DNA, 22 bp, Homo sapiens
ccacagcatgcaggcctgacac

SEQ ID NO: 8243273 - DNA, 22 bp, Homo sapiens
ccacagagttacaaaacagtca

SEQ ID NO: 8243274 - DNA, 22 bp, Homo sapiens
ccacagagttacaaaacagtca

SEQ ID NO: 8243275 - DNA, 22 bp, Homo sapiens
ccacagagttgatgcaataaga

SEQ ID NO: 8243276 - DNA, 22 bp, Homo sapiens
ccacagattatttctaaacagg

SEQ ID NO: 8243277 - DNA, 23 bp, Homo sapiens
ccacagctatagggtagtgcagt

SEQ ID NO: 8243278 - DNA, 23 bp, Homo sapiens
ccacagctatagggtagtgcagt

SEQ ID NO: 8243279 - DNA, 22 bp, Homo sapiens
ccacagctgaaagcagaggctc

SEQ ID NO: 8243280 - DNA, 17 bp, Homo sapiens
ccacagcctggcacttg

SEQ ID NO: 8243281 - DNA, 22 bp, Homo sapiens
ccacagctagggcaatctgatt

SEQ ID NO: 8243282 - DNA, 22 bp, Homo sapiens
ccacagctagggcaatctgatt

SEQ ID NO: 8243283 - DNA, 22 bp, Homo sapiens
ccacagccattccagggaggct

SEQ ID NO: 8243284 - DNA, 22 bp, Homo sapiens
ccacagccattccagggaggct

SEQ ID NO: 8243285 - DNA, 17 bp, Homo sapiens
ccacagcctggcacttg

SEQ ID NO: 8243286 - DNA, 19 bp, Homo sapiens
ccacagcctgctgtcttcc

SEQ ID NO: 8243287 - DNA, 20 bp, Homo sapiens
tcctgcagttcctaggaggg

SEQ ID NO: 8243288 - DNA, 20 bp, Homo sapiens
tcctgcagttcctaggaggg

SEQ ID NO: 8243289 - DNA, 20 bp, Homo sapiens
tcctgcagttcctaggaggg

SEQ ID NO: 8243290 - DNA, 22 bp, Homo sapiens
tcctgccaaagcatgtactggg

SEQ ID NO: 8243291 - DNA, 22 bp, Homo sapiens
tcctgccacaggtgataactgg

SEQ ID NO: 8243292 - DNA, 17 bp, Homo sapiens
tcctgccacctgtcagg

SEQ ID NO: 8243293 - DNA, 22 bp, Homo sapiens
tcctgccagcaggaggtggcag

SEQ ID NO: 8243294 - DNA, 22 bp, Homo sapiens
tcctgccagcaggaggtggcag

SEQ ID NO: 8243295 - DNA, 22 bp, Homo sapiens
tcctgccaggagatggtagcca

SEQ ID NO: 8243296 - DNA, 22 bp, Homo sapiens
tcctgccagctggggctgcttc

SEQ ID NO: 8243297 - DNA, 22 bp, Homo sapiens
tcctgcccacagctgctggaca

SEQ ID NO: 8243298 - DNA, 22 bp, Homo sapiens
tcctgcccacagctgctggaca

SEQ ID NO: 8243299 - DNA, 22 bp, Homo sapiens
ccacagagtcttccttctcttc

SEQ ID NO: 8243300 - DNA, 22 bp, Homo sapiens
ccacagagtccgcatttgaggc

SEQ ID NO: 8243301 - DNA, 20 bp, Homo sapiens
ccacagaggacagggctgtg

SEQ ID NO: 8243302 - DNA, 20 bp, Homo sapiens
ccacagaggacagggctgtg

SEQ ID NO: 8243303 - DNA, 22 bp, Homo sapiens
ccacagaggacaactgcctggc

SEQ ID NO: 8243304 - DNA, 22 bp, Homo sapiens
ccacagaggacaactgcctggc

SEQ ID NO: 8243305 - DNA, 19 bp, Homo sapiens
tcctgcccaccagccaggg

SEQ ID NO: 8243306 - DNA, 22 bp, Homo sapiens
ccacagaatcgctagtggagca

SEQ ID NO: 8243307 - DNA, 19 bp, Homo sapiens
tcctgcccaccagccaggg

SEQ ID NO: 8243308 - DNA, 22 bp, Homo sapiens
ccacagaatgatgacacttcag

SEQ ID NO: 8243309 - DNA, 22 bp, Homo sapiens
ccacagaggacaactgcctggc

SEQ ID NO: 8243310 - DNA, 22 bp, Homo sapiens
ccacagaatgatgacacttcag

SEQ ID NO: 8243311 - DNA, 22 bp, Homo sapiens
ccacagaggacaactgcctggc

SEQ ID NO: 8243312 - DNA, 22 bp, Homo sapiens
ccacagaggacaactgcctggc

SEQ ID NO: 8243313 - DNA, 21 bp, Homo sapiens
ccagcctcagatcagggagct

SEQ ID NO: 8243314 - DNA, 22 bp, Homo sapiens
ccagcctcatcatattcctgct

SEQ ID NO: 8243315 - DNA, 22 bp, Homo sapiens
tctgatagataccatgaggcaa

SEQ ID NO: 8243316 - DNA, 22 bp, Homo sapiens
tctgataatgtgcttcgtgacc

SEQ ID NO: 8243317 - DNA, 22 bp, Homo sapiens
tctgatactgcaaaaatgtagg

SEQ ID NO: 8243318 - DNA, 22 bp, Homo sapiens
tctgataggtggtagaaggagg

SEQ ID NO: 8243319 - DNA, 22 bp, Homo sapiens
tctgatataaaagtgacattca

SEQ ID NO: 8243320 - DNA, 22 bp, Homo sapiens
tctgataggtggtagaaggagg

SEQ ID NO: 8243321 - DNA, 22 bp, Homo sapiens
tctgataatgtgcttcgtgacc

SEQ ID NO: 8243322 - DNA, 22 bp, Homo sapiens
tctgataatggacttctcatct

SEQ ID NO: 8243323 - DNA, 22 bp, Homo sapiens
tctgataatggacttctcatct

SEQ ID NO: 8243324 - DNA, 22 bp, Homo sapiens
ccagcctggagggcagtggtgg

SEQ ID NO: 8243325 - DNA, 22 bp, Homo sapiens
ccagcctggggaggcagcttct

SEQ ID NO: 8243326 - DNA, 22 bp, Homo sapiens
ccagcctggagggcagtggtgg

SEQ ID NO: 8243327 - DNA, 22 bp, Homo sapiens
ccagcctggagggcagtggtgg

SEQ ID NO: 8243328 - DNA, 22 bp, Homo sapiens
ccagcctggagggcagtggtgg

SEQ ID NO: 8243329 - DNA, 22 bp, Homo sapiens
tctgataaatgccatctttttg

SEQ ID NO: 8243330 - DNA, 22 bp, Homo sapiens
tctgataaataacatttggaaa

SEQ ID NO: 8243331 - DNA, 22 bp, Homo sapiens
tctgataaatgccatctttttg

SEQ ID NO: 8243332 - DNA, 22 bp, Homo sapiens
tctgataacaaccatgtctggc

SEQ ID NO: 8243333 - DNA, 22 bp, Homo sapiens
tctgagtttaggaccaggctga

SEQ ID NO: 8243334 - DNA, 20 bp, Homo sapiens
tctgataaaaactactccat

SEQ ID NO: 8243335 - DNA, 22 bp, Homo sapiens
tctgataaataacatttggaaa

SEQ ID NO: 8243336 - DNA, 22 bp, Homo sapiens
tctgataacaaccatgtctggc

SEQ ID NO: 8243337 - DNA, 22 bp, Homo sapiens
tctgataactctggccccaggc

SEQ ID NO: 8243338 - DNA, 22 bp, Homo sapiens
tctgataagacagctgatttga

SEQ ID NO: 8243339 - DNA, 20 bp, Homo sapiens
tctgataactggttgtgatt

SEQ ID NO: 8243340 - DNA, 22 bp, Homo sapiens
tctgataagacagctgatttga

SEQ ID NO: 8243341 - DNA, 23 bp, Homo sapiens
tctgataagggagagggaagcag

SEQ ID NO: 8243342 - DNA, 22 bp, Homo sapiens
tctgataagtggtgtatactgt

SEQ ID NO: 8243343 - DNA, 22 bp, Homo sapiens
tctgataagtggtgtatactgt

SEQ ID NO: 8243344 - DNA, 22 bp, Homo sapiens
tctgagtgatgttgagtcagaa

SEQ ID NO: 8243345 - DNA, 22 bp, Homo sapiens
tctgagtgagtgtaggcctgac

SEQ ID NO: 8243346 - DNA, 22 bp, Homo sapiens
ccagctagtaagcacctgcatc

SEQ ID NO: 8243347 - DNA, 22 bp, Homo sapiens
ccagcgcttcccatcagggagg

SEQ ID NO: 8243348 - DNA, 23 bp, Homo sapiens
ccagctcatccattacctctctt

SEQ ID NO: 8243349 - DNA, 23 bp, Homo sapiens
ccagctcatccattacctctctt

SEQ ID NO: 8243350 - DNA, 22 bp, Homo sapiens
ccagctcagggtcacatggcac

SEQ ID NO: 8243351 - DNA, 22 bp, Homo sapiens
ccagctccaagtttgggcatca

SEQ ID NO: 8243352 - DNA, 22 bp, Homo sapiens
ccagctccactgtcagatgaga

SEQ ID NO: 8243353 - DNA, 22 bp, Homo sapiens
ccagctccactgtcagatgaga

SEQ ID NO: 8243354 - DNA, 22 bp, Homo sapiens
ccagctccagcatagccaccat

SEQ ID NO: 8243355 - DNA, 22 bp, Homo sapiens
ccagctccactgtcagatgaga

SEQ ID NO: 8243356 - DNA, 22 bp, Homo sapiens
ccagctccagcatagccaccat

SEQ ID NO: 8243357 - DNA, 21 bp, Homo sapiens
ccagctccaggaccttggatc

SEQ ID NO: 8243358 - DNA, 22 bp, Homo sapiens
ccagcctgggtgttagaagaca

SEQ ID NO: 8243359 - DNA, 22 bp, Homo sapiens
ccagcctggggaggcagcttct

SEQ ID NO: 8243360 - DNA, 22 bp, Homo sapiens
ccagcctgggtgttagaagaca

SEQ ID NO: 8243361 - DNA, 22 bp, Homo sapiens
ccagcctgggtgttagaagaca

SEQ ID NO: 8243362 - DNA, 22 bp, Homo sapiens
ccagcctggttcagaattggct

SEQ ID NO: 8243363 - DNA, 22 bp, Homo sapiens
ccagcctggttcagaattggct

SEQ ID NO: 8243364 - DNA, 22 bp, Homo sapiens
ccagccttctgagctgcctgga

SEQ ID NO: 8243365 - DNA, 22 bp, Homo sapiens
ccagccttctgagctgcctgga

SEQ ID NO: 8243366 - DNA, 22 bp, Homo sapiens
ccagccttcacctgctctggtc

SEQ ID NO: 8243367 - DNA, 22 bp, Homo sapiens
ccagcctggttcagaattggct

SEQ ID NO: 8243368 - DNA, 22 bp, Homo sapiens
ccagccttgcaccgagccagcc

SEQ ID NO: 8243369 - DNA, 22 bp, Homo sapiens
ccagccttgcaccgagccagcc

SEQ ID NO: 8243370 - DNA, 22 bp, Homo sapiens
ccagccttgactgccccagcac

SEQ ID NO: 8243371 - DNA, 23 bp, Homo sapiens
ccagcgctcactcagagcatgtt

SEQ ID NO: 8243372 - DNA, 23 bp, Homo sapiens
ccagcgctcactcagagcatgtt

SEQ ID NO: 8243373 - DNA, 23 bp, Homo sapiens
ccagcgctcactcagagcatgtt

SEQ ID NO: 8243374 - DNA, 23 bp, Homo sapiens
ccagcgctcactcagagcatgtt

SEQ ID NO: 8243375 - DNA, 19 bp, Homo sapiens
tctgcctctggtcaggctc

SEQ ID NO: 8243376 - DNA, 22 bp, Homo sapiens
tctgcctcgctaacagcagcca

SEQ ID NO: 8243377 - DNA, 22 bp, Homo sapiens
tctgcctcgctaacagcagcca

SEQ ID NO: 8243378 - DNA, 22 bp, Homo sapiens
tctgcctcgctaacagcagcca

SEQ ID NO: 8243379 - DNA, 22 bp, Homo sapiens
tctgcctcctgcttgtcccgac

SEQ ID NO: 8243380 - DNA, 22 bp, Homo sapiens
tctgccaggaagaaagcacaat

SEQ ID NO: 8243381 - DNA, 22 bp, Homo sapiens
tctgcctcctgcttgtcccgac

SEQ ID NO: 8243382 - DNA, 20 bp, Homo sapiens
tctgccactgcactctgccc

SEQ ID NO: 8243383 - DNA, 22 bp, Homo sapiens
tctgccactgtgatgcatgata

SEQ ID NO: 8243384 - DNA, 22 bp, Homo sapiens
tctgccactgtgatgcatgata

SEQ ID NO: 8243385 - DNA, 22 bp, Homo sapiens
tctgccagaagttctgagagta

SEQ ID NO: 8243386 - DNA, 22 bp, Homo sapiens
tctgccagacctgactcagtag

SEQ ID NO: 8243387 - DNA, 22 bp, Homo sapiens
tctgccagacctgactcagtag

SEQ ID NO: 8243388 - DNA, 22 bp, Homo sapiens
tctgccagcaccatgatccttc

SEQ ID NO: 8243389 - DNA, 22 bp, Homo sapiens
ccagctccaggactgggagctg

SEQ ID NO: 8243390 - DNA, 22 bp, Homo sapiens
ccagctccaggactgggagctg

SEQ ID NO: 8243391 - DNA, 21 bp, Homo sapiens
ccagctccaggaccttggatc

SEQ ID NO: 8243392 - DNA, 22 bp, Homo sapiens
ccagctcctcttcccagtgtca

SEQ ID NO: 8243393 - DNA, 23 bp, Homo sapiens
ccagctccgtgagcctcgggctc

SEQ ID NO: 8243394 - DNA, 22 bp, Homo sapiens
ccagctcctcttgtctctagca

SEQ ID NO: 8243395 - DNA, 22 bp, Homo sapiens
ccagctcctcttgtctctagca

SEQ ID NO: 8243396 - DNA, 22 bp, Homo sapiens
ccagctcctcttcccagtgtca

SEQ ID NO: 8243397 - DNA, 22 bp, Homo sapiens
ccagctctcagcgggagactca

SEQ ID NO: 8243398 - DNA, 22 bp, Homo sapiens
ccagctctcagcgggagactca

SEQ ID NO: 8243399 - DNA, 22 bp, Homo sapiens
ccagctctagccccatgtggct

SEQ ID NO: 8243400 - DNA, 22 bp, Homo sapiens
ccagctctagccccatgtggct

SEQ ID NO: 8243401 - DNA, 22 bp, Homo sapiens
ccagctcctgggtcttagtcag

SEQ ID NO: 8243402 - DNA, 22 bp, Homo sapiens
ccagctccttctgtctgtggag

SEQ ID NO: 8243403 - DNA, 22 bp, Homo sapiens
ccagctccttctgtctgtggag

SEQ ID NO: 8243404 - DNA, 22 bp, Homo sapiens
ccagctccttctgtctgtggag

SEQ ID NO: 8243405 - DNA, 22 bp, Homo sapiens
ccagctccttctgtctgtggag

SEQ ID NO: 8243406 - DNA, 22 bp, Homo sapiens
ccagctctaaacggctctgtgg

SEQ ID NO: 8243407 - DNA, 22 bp, Homo sapiens
ccagctctaaacggctctgtgg

SEQ ID NO: 8243408 - DNA, 22 bp, Homo sapiens
ccagccataaacccagatgact

SEQ ID NO: 8243409 - DNA, 22 bp, Homo sapiens
ccagccataaacccagatgact

SEQ ID NO: 8243410 - DNA, 22 bp, Homo sapiens
ccagccagtcccgcatgaccgc

SEQ ID NO: 8243411 - DNA, 22 bp, Homo sapiens
ccagccagtccagcattggtgt

SEQ ID NO: 8243412 - DNA, 22 bp, Homo sapiens
ccagccagtccagcattggtgt

SEQ ID NO: 8243413 - DNA, 22 bp, Homo sapiens
ccagccagtcccgcatgaccgc

SEQ ID NO: 8243414 - DNA, 22 bp, Homo sapiens
ccagccagtcccgcatgaccgc

SEQ ID NO: 8243415 - DNA, 22 bp, Homo sapiens
tctgaaatctaatgctctgtgg

SEQ ID NO: 8243416 - DNA, 22 bp, Homo sapiens
tctgaaatcctttatcttggct

SEQ ID NO: 8243417 - DNA, 22 bp, Homo sapiens
tctgaaatcctttatcttggct

SEQ ID NO: 8243418 - DNA, 22 bp, Homo sapiens
tctgaaatctgtaagcactagc

SEQ ID NO: 8243419 - DNA, 22 bp, Homo sapiens
tctgaaatctgtaagcactagc

SEQ ID NO: 8243420 - DNA, 22 bp, Homo sapiens
ccagccactgggccactgccag

SEQ ID NO: 8243421 - DNA, 22 bp, Homo sapiens
tctgaaatatattttgagtgtt

SEQ ID NO: 8243422 - DNA, 22 bp, Homo sapiens
tctgaaatattggtaatacttt

SEQ ID NO: 8243423 - DNA, 22 bp, Homo sapiens
tctgaaatatattttgagtgtt

SEQ ID NO: 8243424 - DNA, 22 bp, Homo sapiens
tctgaaataggcttcttttggt

SEQ ID NO: 8243425 - DNA, 22 bp, Homo sapiens
tctgaaataggagccatgtaga

SEQ ID NO: 8243426 - DNA, 22 bp, Homo sapiens
tctgaaataggaaagcaaatgg

SEQ ID NO: 8243427 - DNA, 22 bp, Homo sapiens
tctcttggggaaagagaagaat

SEQ ID NO: 8243428 - DNA, 22 bp, Homo sapiens
tctcttggggaaagagaagaat

SEQ ID NO: 8243429 - DNA, 22 bp, Homo sapiens
tctcttggtgatagtctttctt

SEQ ID NO: 8243430 - DNA, 22 bp, Homo sapiens
tctcttggtacacagatgatca

SEQ ID NO: 8243431 - DNA, 22 bp, Homo sapiens
tctcttgtaatttaaaaaatct

SEQ ID NO: 8243432 - DNA, 22 bp, Homo sapiens
tctcttgggaggaaagagagaa

SEQ ID NO: 8243433 - DNA, 22 bp, Homo sapiens
tctcttggaggttcttcctgtt

SEQ ID NO: 8243434 - DNA, 22 bp, Homo sapiens
tctcttggaggttcttcctgtt

SEQ ID NO: 8243435 - DNA, 22 bp, Homo sapiens
tctcttggacatgtggctctgc

SEQ ID NO: 8243436 - DNA, 18 bp, Homo sapiens
tctcttgcatcttctgta

SEQ ID NO: 8243437 - DNA, 22 bp, Homo sapiens
tctcttggaacacttgctctta

SEQ ID NO: 8243438 - DNA, 18 bp, Homo sapiens
tctcttgcatcttctgta

SEQ ID NO: 8243439 - DNA, 22 bp, Homo sapiens
tctcttggaacacttgctctta

SEQ ID NO: 8243440 - DNA, 22 bp, Homo sapiens
tctcttaataagtaaatactga

SEQ ID NO: 8243441 - DNA, 22 bp, Homo sapiens
tctcttgagctcagttctgatg

SEQ ID NO: 8243442 - DNA, 23 bp, Homo sapiens
tctctcttagctatgcttatggc

SEQ ID NO: 8243443 - DNA, 23 bp, Homo sapiens
tctctcttagctatgcttatggc

SEQ ID NO: 8243444 - DNA, 22 bp, Homo sapiens
tctctctgtgacagctttgctg

SEQ ID NO: 8243445 - DNA, 22 bp, Homo sapiens
tctctctgtgacagctttgctg

SEQ ID NO: 8243446 - DNA, 23 bp, Homo sapiens
tctctcttagctatgcttatggc

SEQ ID NO: 8243447 - DNA, 22 bp, Homo sapiens
tctctcttcaacccttaactag

SEQ ID NO: 8243448 - DNA, 22 bp, Homo sapiens
tctctcttcaacccttaactag

SEQ ID NO: 8243449 - DNA, 22 bp, Homo sapiens
tctctcttcaacccttaactag

SEQ ID NO: 8243450 - DNA, 22 bp, Homo sapiens
tctctcttcagagataccttgc

SEQ ID NO: 8243451 - DNA, 22 bp, Homo sapiens
tctctcttctttgttaagaatg

SEQ ID NO: 8243452 - DNA, 22 bp, Homo sapiens
tctctcttgaagtattagctag

SEQ ID NO: 8243453 - DNA, 22 bp, Homo sapiens
tctctcttctttgttaagaatg

SEQ ID NO: 8243454 - DNA, 22 bp, Homo sapiens
tctctcttctttgttaagaatg

SEQ ID NO: 8243455 - DNA, 22 bp, Homo sapiens
tctctcttcatgcttttagaat

SEQ ID NO: 8243456 - DNA, 22 bp, Homo sapiens
tctctcttcagagataccttgc

SEQ ID NO: 8243457 - DNA, 22 bp, Homo sapiens
tctctcttcatgcttttagaat

SEQ ID NO: 8243458 - DNA, 22 bp, Homo sapiens
tctctcttcatgcttttagaat

SEQ ID NO: 8243459 - DNA, 22 bp, Homo sapiens
tctctcttgaagtattagctag

SEQ ID NO: 8243460 - DNA, 22 bp, Homo sapiens
tctctcttgtcaccccatctgc

SEQ ID NO: 8243461 - DNA, 22 bp, Homo sapiens
tctctcttgaagtattagctag

SEQ ID NO: 8243462 - DNA, 22 bp, Homo sapiens
ccagcccaaacaagccgccttc

SEQ ID NO: 8243463 - DNA, 22 bp, Homo sapiens
ccagcccaaacaagccgccttc

SEQ ID NO: 8243464 - DNA, 19 bp, Homo sapiens
ccagcccatagtccatcac

SEQ ID NO: 8243465 - DNA, 21 bp, Homo sapiens
ccagcccagctgtgtcccagc

SEQ ID NO: 8243466 - DNA, 21 bp, Homo sapiens
ccagcccagcctccttctctt

SEQ ID NO: 8243467 - DNA, 22 bp, Homo sapiens
ccagccccgggaacctggccgt

SEQ ID NO: 8243468 - DNA, 22 bp, Homo sapiens
ccagccccgggaacctggccgt

SEQ ID NO: 8243469 - DNA, 22 bp, Homo sapiens
ccagccccgggccttaccgtgc

SEQ ID NO: 8243470 - DNA, 22 bp, Homo sapiens
ccagcccctatcctcgctccac

SEQ ID NO: 8243471 - DNA, 22 bp, Homo sapiens
ccagcccctatcctcgctccac

SEQ ID NO: 8243472 - DNA, 22 bp, Homo sapiens
ccagcccctatcctcgctccac

SEQ ID NO: 8243473 - DNA, 22 bp, Homo sapiens
ccagcccgaatccctggccagg

SEQ ID NO: 8243474 - DNA, 22 bp, Homo sapiens
ccagcccgaatccctaaagcaa

SEQ ID NO: 8243475 - DNA, 22 bp, Homo sapiens
ccagccctacagtatcacctgt

SEQ ID NO: 8243476 - DNA, 22 bp, Homo sapiens
ccagccctacagtatcacctgt

SEQ ID NO: 8243477 - DNA, 22 bp, Homo sapiens
ccagccctacagtatcacctgt

SEQ ID NO: 8243478 - DNA, 19 bp, Homo sapiens
ccagcccatagtccatcac

SEQ ID NO: 8243479 - DNA, 22 bp, Homo sapiens
ccagcccatgcccttatagcat

SEQ ID NO: 8243480 - DNA, 22 bp, Homo sapiens
ccagccccgggaacctggccgt

SEQ ID NO: 8243481 - DNA, 22 bp, Homo sapiens
ccagccctcactgaggcctctc

SEQ ID NO: 8243482 - DNA, 22 bp, Homo sapiens
ccagccctacagtatcacctgt

SEQ ID NO: 8243483 - DNA, 22 bp, Homo sapiens
ccagccctcactgaggcctctc

SEQ ID NO: 8243484 - DNA, 22 bp, Homo sapiens
tctgagagtctctgaggcagat

SEQ ID NO: 8243485 - DNA, 22 bp, Homo sapiens
ccagccctcactgaggcctctc

SEQ ID NO: 8243486 - DNA, 22 bp, Homo sapiens
tctgagatccttgtgttgtttt

SEQ ID NO: 8243487 - DNA, 22 bp, Homo sapiens
tctgaggacagtgctgtgcctg

SEQ ID NO: 8243488 - DNA, 22 bp, Homo sapiens
tctgaggcaaacagaggagtgt

SEQ ID NO: 8243489 - DNA, 22 bp, Homo sapiens
tctgaggcagcttgccactcta

SEQ ID NO: 8243490 - DNA, 22 bp, Homo sapiens
tctgaggacctactgaagagtt

SEQ ID NO: 8243491 - DNA, 22 bp, Homo sapiens
tctgaggagttgggccagtgct

SEQ ID NO: 8243492 - DNA, 22 bp, Homo sapiens
tctgaggttttcatgttttctg

SEQ ID NO: 8243493 - DNA, 22 bp, Homo sapiens
tctgaggttgaactttgcaaag

SEQ ID NO: 8243494 - DNA, 22 bp, Homo sapiens
tctgaggttttcatgttttctg

SEQ ID NO: 8243495 - DNA, 22 bp, Homo sapiens
tctgaggttccctcaactacct

SEQ ID NO: 8243496 - DNA, 22 bp, Homo sapiens
tctgaggttgaactttgcaaag

SEQ ID NO: 8243497 - DNA, 22 bp, Homo sapiens
tctgaggttctgttttcaactg

SEQ ID NO: 8243498 - DNA, 22 bp, Homo sapiens
tctgaggcccctgggcaggatg

SEQ ID NO: 8243499 - DNA, 22 bp, Homo sapiens
tctgaggcccctgggcaggatg

SEQ ID NO: 8243500 - DNA, 22 bp, Homo sapiens
tctgaggccccagccctgcaca

SEQ ID NO: 8243501 - DNA, 22 bp, Homo sapiens
tctgaggcataacctgttctgc

SEQ ID NO: 8243502 - DNA, 22 bp, Homo sapiens
tctgaggcataacctgttctgc

SEQ ID NO: 8243503 - DNA, 22 bp, Homo sapiens
tctgaggcatacccaggccccc

SEQ ID NO: 8243504 - DNA, 22 bp, Homo sapiens
tctgaggcatttaattatgacc

SEQ ID NO: 8243505 - DNA, 22 bp, Homo sapiens
tctgaggcatacccaggccccc

SEQ ID NO: 8243506 - DNA, 22 bp, Homo sapiens
tctgaggcatacccaggccccc

SEQ ID NO: 8243507 - DNA, 22 bp, Homo sapiens
tctgaggcccagttcaactctt

SEQ ID NO: 8243508 - DNA, 21 bp, Homo sapiens
tctggagctgcaggctgggca

SEQ ID NO: 8243509 - DNA, 19 bp, Homo sapiens
tctggagctgatgcaggtg

SEQ ID NO: 8243510 - DNA, 19 bp, Homo sapiens
tctggagctgatgcaggtg

SEQ ID NO: 8243511 - DNA, 22 bp, Homo sapiens
tctggagctggagggcaaggca

SEQ ID NO: 8243512 - DNA, 22 bp, Homo sapiens
tctggagcttcctcatttacag

SEQ ID NO: 8243513 - DNA, 22 bp, Homo sapiens
tctggagctgggggcttagtat

SEQ ID NO: 8243514 - DNA, 22 bp, Homo sapiens
tctggaggcaggctgccaggat

SEQ ID NO: 8243515 - DNA, 22 bp, Homo sapiens
tctggaggcaggctgccaggat

SEQ ID NO: 8243516 - DNA, 22 bp, Homo sapiens
tctggctcataggaaggccatt

SEQ ID NO: 8243517 - DNA, 22 bp, Homo sapiens
tctggctcatacaagcctgcaa

SEQ ID NO: 8243518 - DNA, 22 bp, Homo sapiens
tctggctcatacaagcctgcaa

SEQ ID NO: 8243519 - DNA, 22 bp, Homo sapiens
tctggagcttgtttcagatggt

SEQ ID NO: 8243520 - DNA, 22 bp, Homo sapiens
tctggagcttgtttcagatggt

SEQ ID NO: 8243521 - DNA, 22 bp, Homo sapiens
tctggagcttgtttcagatggt

SEQ ID NO: 8243522 - DNA, 22 bp, Homo sapiens
tctggagcttgaagctttggtt

SEQ ID NO: 8243523 - DNA, 22 bp, Homo sapiens
tctggagcttgaagctttggtt

SEQ ID NO: 8243524 - DNA, 22 bp, Homo sapiens
tctggcttcaagtcccagctct

SEQ ID NO: 8243525 - DNA, 22 bp, Homo sapiens
tctggctgttttagatgagctc

SEQ ID NO: 8243526 - DNA, 22 bp, Homo sapiens
tctggctgttgttaggttcctg

SEQ ID NO: 8243527 - DNA, 22 bp, Homo sapiens
tctggctgttttagatgagctc

SEQ ID NO: 8243528 - DNA, 22 bp, Homo sapiens
tctggctgttaggcctgacctt

SEQ ID NO: 8243529 - DNA, 22 bp, Homo sapiens
tctggctgttgttaggttcctg

SEQ ID NO: 8243530 - DNA, 22 bp, Homo sapiens
tctggctgttaggcctgacctt

SEQ ID NO: 8243531 - DNA, 22 bp, Homo sapiens
tctggcttcagtagggttcact

SEQ ID NO: 8243532 - DNA, 23 bp, Homo sapiens
tctggcttccagtgggttcaacc

SEQ ID NO: 8243533 - DNA, 22 bp, Homo sapiens
tctggcttctcctagagcaatg

SEQ ID NO: 8243534 - DNA, 22 bp, Homo sapiens
tctggcttctcctagagcaatg

SEQ ID NO: 8243535 - DNA, 22 bp, Homo sapiens
tctggcttcgcagctcccagcc

SEQ ID NO: 8243536 - DNA, 22 bp, Homo sapiens
tctggcttctgcaggattacta

SEQ ID NO: 8243537 - DNA, 22 bp, Homo sapiens
tctggcttggacacaatcttcc

SEQ ID NO: 8243538 - DNA, 22 bp, Homo sapiens
tctggcttgtctcagggtctga

SEQ ID NO: 8243539 - DNA, 22 bp, Homo sapiens
ccagctggtttatattccccac

SEQ ID NO: 8243540 - DNA, 22 bp, Homo sapiens
ccagctgtgctgttggcttgtc

SEQ ID NO: 8243541 - DNA, 22 bp, Homo sapiens
ccagcttcatgggcatgcacca

SEQ ID NO: 8243542 - DNA, 22 bp, Homo sapiens
ccagcttaaaaccatttattta

SEQ ID NO: 8243543 - DNA, 22 bp, Homo sapiens
ccagctgtttctgatgctaggc

SEQ ID NO: 8243544 - DNA, 22 bp, Homo sapiens
ccagctgtttctgatgctaggc

SEQ ID NO: 8243545 - DNA, 18 bp, Homo sapiens
ccagctgtgcagcatctg

SEQ ID NO: 8243546 - DNA, 22 bp, Homo sapiens
ccagctgtgccggggacctggg

SEQ ID NO: 8243547 - DNA, 22 bp, Homo sapiens
tctgcgttgctcacgctgggag

SEQ ID NO: 8243548 - DNA, 22 bp, Homo sapiens
tctgcggtccccttctcgccct

SEQ ID NO: 8243549 - DNA, 22 bp, Homo sapiens
tctgcgcgctgctggtaccgaa

SEQ ID NO: 8243550 - DNA, 22 bp, Homo sapiens
tctgccttttcactgccactaa

SEQ ID NO: 8243551 - DNA, 22 bp, Homo sapiens
tctgcctttgctttggctgtca

SEQ ID NO: 8243552 - DNA, 22 bp, Homo sapiens
tctgcctttgctttggctgtca

SEQ ID NO: 8243553 - DNA, 22 bp, Homo sapiens
tctgcctttctcaagggcaaaa

SEQ ID NO: 8243554 - DNA, 22 bp, Homo sapiens
tctgcctttgtggtcgggagaa

SEQ ID NO: 8243555 - DNA, 22 bp, Homo sapiens
tctgccttttactagctggatg

SEQ ID NO: 8243556 - DNA, 22 bp, Homo sapiens
tctgcctttcccaggctactgt

SEQ ID NO: 8243557 - DNA, 22 bp, Homo sapiens
tctgcctttcccaggctactgt

SEQ ID NO: 8243558 - DNA, 22 bp, Homo sapiens
tctgcctttcacacagacggcc

SEQ ID NO: 8243559 - DNA, 22 bp, Homo sapiens
tctgccttgtttgagctttgac

SEQ ID NO: 8243560 - DNA, 22 bp, Homo sapiens
tctgccttgttgcaggcgctat

SEQ ID NO: 8243561 - DNA, 19 bp, Homo sapiens
tctgcctctggtcaggctc

SEQ ID NO: 8243562 - DNA, 19 bp, Homo sapiens
tctgcctctggtcaggctc

SEQ ID NO: 8243563 - DNA, 22 bp, Homo sapiens
tctgcctctttcaggcctggca

SEQ ID NO: 8243564 - DNA, 22 bp, Homo sapiens
tctgcctgaaccactcttggag

SEQ ID NO: 8243565 - DNA, 22 bp, Homo sapiens
tctgcctgaaccactcttggag

SEQ ID NO: 8243566 - DNA, 22 bp, Homo sapiens
tctgcctgaaccactcttggag

SEQ ID NO: 8243567 - DNA, 22 bp, Homo sapiens
tctgcctgaatctcttagaaca

SEQ ID NO: 8243568 - DNA, 22 bp, Homo sapiens
tctgcctgaaccactcttggag

SEQ ID NO: 8243569 - DNA, 22 bp, Homo sapiens
tctgccttgccgaattccaggc

SEQ ID NO: 8243570 - DNA, 22 bp, Homo sapiens
tctgcctgagaagtggggtgcc

SEQ ID NO: 8243571 - DNA, 22 bp, Homo sapiens
tctgccttgccgaattccaggc

SEQ ID NO: 8243572 - DNA, 22 bp, Homo sapiens
tctgccttggaaatttcaacag

SEQ ID NO: 8243573 - DNA, 22 bp, Homo sapiens
tctgccttggcaaccacagctt

SEQ ID NO: 8243574 - DNA, 21 bp, Homo sapiens
tctggagccctaagctgagaa

SEQ ID NO: 8243575 - DNA, 22 bp, Homo sapiens
ccagctggttaaaatagagaaa

SEQ ID NO: 8243576 - DNA, 22 bp, Homo sapiens
ccagctggtgttccttaggacc

SEQ ID NO: 8243577 - DNA, 22 bp, Homo sapiens
ccagctggttaaaatagagaaa

SEQ ID NO: 8243578 - DNA, 22 bp, Homo sapiens
ccagctggttaaaatagagaaa

SEQ ID NO: 8243579 - DNA, 22 bp, Homo sapiens
ccagctggttaaaatagagaaa

SEQ ID NO: 8243580 - DNA, 22 bp, Homo sapiens
ccagctggtgttccttaggacc

SEQ ID NO: 8243581 - DNA, 22 bp, Homo sapiens
ccagctggtgttccttaggacc

SEQ ID NO: 8243582 - DNA, 22 bp, Homo sapiens
ccagctggtctgtgctcatgtt

SEQ ID NO: 8243583 - DNA, 22 bp, Homo sapiens
ccagctggtctgtgctcatgtt

SEQ ID NO: 8243584 - DNA, 22 bp, Homo sapiens
ccagctggtctgtgctcatgtt

SEQ ID NO: 8243585 - DNA, 22 bp, Homo sapiens
ccagctggtgttccttaggacc

SEQ ID NO: 8243586 - DNA, 22 bp, Homo sapiens
ccagctggtgggtctttctctg

SEQ ID NO: 8243587 - DNA, 22 bp, Homo sapiens
ccagctggtgacatccccaacc

SEQ ID NO: 8243588 - DNA, 22 bp, Homo sapiens
ccagctggtaagtgatggagcc

SEQ ID NO: 8243589 - DNA, 22 bp, Homo sapiens
ccagctggtaagtgatggagcc

SEQ ID NO: 8243590 - DNA, 22 bp, Homo sapiens
ccagctggggaagtggggcata

SEQ ID NO: 8243591 - DNA, 22 bp, Homo sapiens
ccagctggggaagtggggcata

SEQ ID NO: 8243592 - DNA, 22 bp, Homo sapiens
ccagctgggtccctgctggggc

SEQ ID NO: 8243593 - DNA, 22 bp, Homo sapiens
ccagctgggattaagggaaaat

SEQ ID NO: 8243594 - DNA, 22 bp, Homo sapiens
ccagctgggattaagggaaaat

SEQ ID NO: 8243595 - DNA, 22 bp, Homo sapiens
ccagctgctttttgtcacatgg

SEQ ID NO: 8243596 - DNA, 22 bp, Homo sapiens
ccagctgcttgggaaaatgtct

SEQ ID NO: 8243597 - DNA, 22 bp, Homo sapiens
ccagctgcttgggaaaatgtct

SEQ ID NO: 8243598 - DNA, 22 bp, Homo sapiens
tctgtcagcccctcagctgtca

SEQ ID NO: 8243599 - DNA, 22 bp, Homo sapiens
tctgtcacttttatttactgaa

SEQ ID NO: 8243600 - DNA, 22 bp, Homo sapiens
tctgtcacttattaagatggat

SEQ ID NO: 8243601 - DNA, 22 bp, Homo sapiens
tctgtcacttaagaattgccta

SEQ ID NO: 8243602 - DNA, 19 bp, Homo sapiens
tctgtcactgggggtattc

SEQ ID NO: 8243603 - DNA, 23 bp, Homo sapiens
tctgtcactttctgctgtggagt

SEQ ID NO: 8243604 - DNA, 23 bp, Homo sapiens
tctgtcactttctgctgtggagt

SEQ ID NO: 8243605 - DNA, 23 bp, Homo sapiens
tctgtcactttctgctgtggagt

SEQ ID NO: 8243606 - DNA, 22 bp, Homo sapiens
tctgtcacttattaagatggat

SEQ ID NO: 8243607 - DNA, 23 bp, Homo sapiens
tctgtcacctatggctgctcttc

SEQ ID NO: 8243608 - DNA, 22 bp, Homo sapiens
tctgtcactattggccagaaca

SEQ ID NO: 8243609 - DNA, 22 bp, Homo sapiens
tctgtcactccctgatgatgaa

SEQ ID NO: 8243610 - DNA, 22 bp, Homo sapiens
tctgtcactctagagatggcag

SEQ ID NO: 8243611 - DNA, 22 bp, Homo sapiens
tctgtcactgagctcaggattc

SEQ ID NO: 8243612 - DNA, 22 bp, Homo sapiens
tctgtcactgagctcaggattc

SEQ ID NO: 8243613 - DNA, 23 bp, Homo sapiens
tctgtcacctatggctgctcttc

SEQ ID NO: 8243614 - DNA, 22 bp, Homo sapiens
tctgtcaccgagggcatccaaa

SEQ ID NO: 8243615 - DNA, 22 bp, Homo sapiens
tctgtcacccgagcaggcgaga

SEQ ID NO: 8243616 - DNA, 22 bp, Homo sapiens
tctgtcaccgagggcatccaaa

SEQ ID NO: 8243617 - DNA, 22 bp, Homo sapiens
tctgtcacccgagcaggcgaga

SEQ ID NO: 8243618 - DNA, 22 bp, Homo sapiens
tctgtcacccctgtttctggct

SEQ ID NO: 8243619 - DNA, 22 bp, Homo sapiens
ccaggaggcggaggttgcagcg

SEQ ID NO: 8243620 - DNA, 22 bp, Homo sapiens
tctgtcacccaggctggagtgc

SEQ ID NO: 8243621 - DNA, 22 bp, Homo sapiens
ccaggaggcggaggttgcagcg

SEQ ID NO: 8243622 - DNA, 22 bp, Homo sapiens
ccaggaggcggaggttgcagcg

SEQ ID NO: 8243623 - DNA, 22 bp, Homo sapiens
ccaggaggcggaaggtacagtg

SEQ ID NO: 8243624 - DNA, 22 bp, Homo sapiens
ccaggaggcggaaggtacagtg

SEQ ID NO: 8243625 - DNA, 22 bp, Homo sapiens
ccaggaggcggaaggtacagtg

SEQ ID NO: 8243626 - DNA, 22 bp, Homo sapiens
ccaggaggcagaagttgcagtg

SEQ ID NO: 8243627 - DNA, 22 bp, Homo sapiens
ccaggaggcagaggttacagtg

SEQ ID NO: 8243628 - DNA, 22 bp, Homo sapiens
ccaggaggcggaaggtacagtg

SEQ ID NO: 8243629 - DNA, 22 bp, Homo sapiens
ccaggaggcggaaggtacagtg

SEQ ID NO: 8243630 - DNA, 22 bp, Homo sapiens
ccaggaggcagaggttgtagtg

SEQ ID NO: 8243631 - DNA, 21 bp, Homo sapiens
tctgtctggttttagagtggc

SEQ ID NO: 8243632 - DNA, 22 bp, Homo sapiens
tctgtcagcccctcagctgtca

SEQ ID NO: 8243633 - DNA, 22 bp, Homo sapiens
tctgtcatccaggctggaatat

SEQ ID NO: 8243634 - DNA, 22 bp, Homo sapiens
tctgtctgggtgcctcgagtac

SEQ ID NO: 8243635 - DNA, 22 bp, Homo sapiens
tctgtcatcaaatatgctttct

SEQ ID NO: 8243636 - DNA, 17 bp, Homo sapiens
tctgtctgtggtccact

SEQ ID NO: 8243637 - DNA, 18 bp, Homo sapiens
tctgtctgtgttgtcttt

SEQ ID NO: 8243638 - DNA, 18 bp, Homo sapiens
tctgtctgtgttgtcttt

SEQ ID NO: 8243639 - DNA, 23 bp, Homo sapiens
tctgtctgtgtatgtgcagaaag

SEQ ID NO: 8243640 - DNA, 22 bp, Homo sapiens
tctgtcttagccatctcaggct

SEQ ID NO: 8243641 - DNA, 22 bp, Homo sapiens
tctgtcttggccagccatctgg

SEQ ID NO: 8243642 - DNA, 23 bp, Homo sapiens
tctgtcttgtttaggccactgtt

SEQ ID NO: 8243643 - DNA, 22 bp, Homo sapiens
tctgtcttctgtagctaataat

SEQ ID NO: 8243644 - DNA, 22 bp, Homo sapiens
tctgtggcaaacacagtgacca

SEQ ID NO: 8243645 - DNA, 19 bp, Homo sapiens
tctgtggcacctgggaggg

SEQ ID NO: 8243646 - DNA, 22 bp, Homo sapiens
tctgtggcaaacacagtgacca

SEQ ID NO: 8243647 - DNA, 19 bp, Homo sapiens
tctgtggcacctgggaggg

SEQ ID NO: 8243648 - DNA, 22 bp, Homo sapiens
tctgtggcacgattgcactgca

SEQ ID NO: 8243649 - DNA, 20 bp, Homo sapiens
tctgtggcaggtggcgcttg

SEQ ID NO: 8243650 - DNA, 21 bp, Homo sapiens
tctgtggcagcatgatgaggt

SEQ ID NO: 8243651 - DNA, 18 bp, Homo sapiens
tctgtggcagcagtgcac

SEQ ID NO: 8243652 - DNA, 18 bp, Homo sapiens
tctgtggcagcagtgcac

SEQ ID NO: 8243653 - DNA, 22 bp, Homo sapiens
tctgtggcacgattgcactgca

SEQ ID NO: 8243654 - DNA, 22 bp, Homo sapiens
ccaggaagatttattttggctt

SEQ ID NO: 8243655 - DNA, 22 bp, Homo sapiens
ccaggaagatttattttggctt

SEQ ID NO: 8243656 - DNA, 22 bp, Homo sapiens
ccaggaagcataatgtagtggg

SEQ ID NO: 8243657 - DNA, 22 bp, Homo sapiens
ccaggaagcataatgtagtggg

SEQ ID NO: 8243658 - DNA, 23 bp, Homo sapiens
ccaggaagaggccatccacagtc

SEQ ID NO: 8243659 - DNA, 23 bp, Homo sapiens
ccaggaagaggccatccacagtc

SEQ ID NO: 8243660 - DNA, 23 bp, Homo sapiens
ccaggaagaggccatccacagtc

SEQ ID NO: 8243661 - DNA, 23 bp, Homo sapiens
ccaggaagaggccatccacagtc

SEQ ID NO: 8243662 - DNA, 22 bp, Homo sapiens
ccaggaagcctcagatgctgag

SEQ ID NO: 8243663 - DNA, 22 bp, Homo sapiens
ccaggaagcataatgtagtggg

SEQ ID NO: 8243664 - DNA, 22 bp, Homo sapiens
ccaggaagcctcagatgctgag

SEQ ID NO: 8243665 - DNA, 22 bp, Homo sapiens
ccaggaagcctcagatgctgag

SEQ ID NO: 8243666 - DNA, 22 bp, Homo sapiens
ccaggaagcctcagatgctgag

SEQ ID NO: 8243667 - DNA, 22 bp, Homo sapiens
ccaggaagcctcagatgctgag

SEQ ID NO: 8243668 - DNA, 22 bp, Homo sapiens
ccaggaagcctgtgtctctgga

SEQ ID NO: 8243669 - DNA, 22 bp, Homo sapiens
ccaggaagcctgtgtctctgga

SEQ ID NO: 8243670 - DNA, 22 bp, Homo sapiens
ccaggaagcctgtgtctctgga

SEQ ID NO: 8243671 - DNA, 22 bp, Homo sapiens
ccaggaagcctgtgtctctgga

SEQ ID NO: 8243672 - DNA, 22 bp, Homo sapiens
ccagcttcggcaagcagacttt

SEQ ID NO: 8243673 - DNA, 22 bp, Homo sapiens
ccagcttctctctgatgcagct

SEQ ID NO: 8243674 - DNA, 22 bp, Homo sapiens
ccagcttctccttatgtcctca

SEQ ID NO: 8243675 - DNA, 22 bp, Homo sapiens
ccagcttctccttatgtcctca

SEQ ID NO: 8243676 - DNA, 22 bp, Homo sapiens
ccaggaaatagtgctgtgatct

SEQ ID NO: 8243677 - DNA, 22 bp, Homo sapiens
ccaggaagacacatgctcatcc

SEQ ID NO: 8243678 - DNA, 22 bp, Homo sapiens
ccaggaagacacatgctcatcc

SEQ ID NO: 8243679 - DNA, 22 bp, Homo sapiens
ccaggaagacacatgctcatcc

SEQ ID NO: 8243680 - DNA, 22 bp, Homo sapiens
ccaggaagaaacagtctttata

SEQ ID NO: 8243681 - DNA, 22 bp, Homo sapiens
ccaggaagaaacagtctttata

SEQ ID NO: 8243682 - DNA, 22 bp, Homo sapiens
ccaggaggcaatatcaagtcca

SEQ ID NO: 8243683 - DNA, 22 bp, Homo sapiens
ccaggaggcaatatcaagtcca

SEQ ID NO: 8243684 - DNA, 22 bp, Homo sapiens
ccaggaggcagaagttgcagtg

SEQ ID NO: 8243685 - DNA, 22 bp, Homo sapiens
ccaggaggcagaagttgcagtg

SEQ ID NO: 8243686 - DNA, 22 bp, Homo sapiens
ccaggaggcagaagttgcagtg

SEQ ID NO: 8243687 - DNA, 22 bp, Homo sapiens
ccaggaggcagaagttgcagtg

SEQ ID NO: 8243688 - DNA, 22 bp, Homo sapiens
ccaggagcgcgtgaacaggctg

SEQ ID NO: 8243689 - DNA, 22 bp, Homo sapiens
ccaggagcctgggccaggctgg

SEQ ID NO: 8243690 - DNA, 21 bp, Homo sapiens
ccaggaaggactgagctccct

SEQ ID NO: 8243691 - DNA, 21 bp, Homo sapiens
ccaggaaggactgagctccct

SEQ ID NO: 8243692 - DNA, 21 bp, Homo sapiens
ccaggaaggactgagctccct

SEQ ID NO: 8243693 - DNA, 21 bp, Homo sapiens
ccaggaaggactgagctccct

SEQ ID NO: 8243694 - DNA, 21 bp, Homo sapiens
ccaggaaggactgagctccct

SEQ ID NO: 8243695 - DNA, 22 bp, Homo sapiens
ccaggagcgcgtgaacaggctg

SEQ ID NO: 8243696 - DNA, 22 bp, Homo sapiens
ccaggagcgcgtgaacaggctg

SEQ ID NO: 8243697 - DNA, 22 bp, Homo sapiens
ccaggaagcggtgagggctgcc

SEQ ID NO: 8243698 - DNA, 22 bp, Homo sapiens
ccaggaagcggtgagggctgcc

SEQ ID NO: 8243699 - DNA, 22 bp, Homo sapiens
ccaggaagcggtgagggctgcc

SEQ ID NO: 8243700 - DNA, 22 bp, Homo sapiens
ccaggaagcggtgagggctgcc

SEQ ID NO: 8243701 - DNA, 22 bp, Homo sapiens
ccaggaagcctttttctttgac

SEQ ID NO: 8243702 - DNA, 22 bp, Homo sapiens
ccaggaagcctttttctttgac

SEQ ID NO: 8243703 - DNA, 22 bp, Homo sapiens
ccaggaagctgtgagattccaa

SEQ ID NO: 8243704 - DNA, 22 bp, Homo sapiens
ccaggaaggaagcaggggtttc

SEQ ID NO: 8243705 - DNA, 22 bp, Homo sapiens
ccaggaagctgtgagattccaa

SEQ ID NO: 8243706 - DNA, 22 bp, Homo sapiens
ccaggaaggaagcaggggtttc

SEQ ID NO: 8243707 - DNA, 22 bp, Homo sapiens
ccaggaaggaagcaggggtttc

SEQ ID NO: 8243708 - DNA, 22 bp, Homo sapiens
ccaggaagctgtctgatatgaa

SEQ ID NO: 8243709 - DNA, 22 bp, Homo sapiens
ccaggaagctgtctgatatgaa

SEQ ID NO: 8243710 - DNA, 22 bp, Homo sapiens
ccaggaagctctgctccacggg

SEQ ID NO: 8243711 - DNA, 22 bp, Homo sapiens
ccaggaagctctgctccacggg

SEQ ID NO: 8243712 - DNA, 22 bp, Homo sapiens
ccaggaagctctgctccacggg

SEQ ID NO: 8243713 - DNA, 22 bp, Homo sapiens
tacatgttatttcactattggt

SEQ ID NO: 8243714 - DNA, 17 bp, Homo sapiens
tacatgtgtatctgatt

SEQ ID NO: 8243715 - DNA, 22 bp, Homo sapiens
tacatgtgttctgtttcaagtt

SEQ ID NO: 8243716 - DNA, 22 bp, Homo sapiens
tacatgtgttctgtttcaagtt

SEQ ID NO: 8243717 - DNA, 22 bp, Homo sapiens
tacatgtgttctgtttcaagtt

SEQ ID NO: 8243718 - DNA, 22 bp, Homo sapiens
tagttttagtcccattttacag

SEQ ID NO: 8243719 - DNA, 22 bp, Homo sapiens
tagttttagtcccattttacag

SEQ ID NO: 8243720 - DNA, 17 bp, Homo sapiens
tacatgtgtatctgatt

SEQ ID NO: 8243721 - DNA, 22 bp, Homo sapiens
tacatgtggtagggagggcagt

SEQ ID NO: 8243722 - DNA, 22 bp, Homo sapiens
tacatgtggtagggagggcagt

SEQ ID NO: 8243723 - DNA, 22 bp, Homo sapiens
tacatgtgggttaaaaacactc

SEQ ID NO: 8243724 - DNA, 22 bp, Homo sapiens
tacatgtggccagaaatttgag

SEQ ID NO: 8243725 - DNA, 22 bp, Homo sapiens
tataagaagtgaagaagagtta

SEQ ID NO: 8243726 - DNA, 22 bp, Homo sapiens
tataagatacttggcatagtgc

SEQ ID NO: 8243727 - DNA, 22 bp, Homo sapiens
tataagaaattgccaacctgtt

SEQ ID NO: 8243728 - DNA, 22 bp, Homo sapiens
tataagaaacaaggcaaatttt

SEQ ID NO: 8243729 - DNA, 22 bp, Homo sapiens
tataatctggttttattaagag

SEQ ID NO: 8243730 - DNA, 22 bp, Homo sapiens
tataattagtaaatggcagatt

SEQ ID NO: 8243731 - DNA, 22 bp, Homo sapiens
tataatattccttgttgtaggt

SEQ ID NO: 8243732 - DNA, 22 bp, Homo sapiens
tataatccattcattgatttct

SEQ ID NO: 8243733 - DNA, 22 bp, Homo sapiens
tataatattccttgttgtaggt

SEQ ID NO: 8243734 - DNA, 22 bp, Homo sapiens
tataagcacatccttgactgat

SEQ ID NO: 8243735 - DNA, 22 bp, Homo sapiens
tataagtagttgttgaagactt

SEQ ID NO: 8243736 - DNA, 22 bp, Homo sapiens
tataagtctggcatatgtatgc

SEQ ID NO: 8243737 - DNA, 22 bp, Homo sapiens
tataagtgacagattatccaaa

SEQ ID NO: 8243738 - DNA, 22 bp, Homo sapiens
tataagtagttgttgaagactt

SEQ ID NO: 8243739 - DNA, 22 bp, Homo sapiens
tataagtgacagattatccaaa

SEQ ID NO: 8243740 - DNA, 22 bp, Homo sapiens
tataagtgtagtttcaaatgtt

SEQ ID NO: 8243741 - DNA, 22 bp, Homo sapiens
tataagtggagattagggaaca

SEQ ID NO: 8243742 - DNA, 22 bp, Homo sapiens
tataatatgaggcaggagtgat

SEQ ID NO: 8243743 - DNA, 22 bp, Homo sapiens
caggggcaggtgtgagatcatc

SEQ ID NO: 8243744 - DNA, 22 bp, Homo sapiens
caggggcaggtgtgagatcatc

SEQ ID NO: 8243745 - DNA, 22 bp, Homo sapiens
caggggccaagggtccagacct

SEQ ID NO: 8243746 - DNA, 22 bp, Homo sapiens
caggggccaagggtccagacct

SEQ ID NO: 8243747 - DNA, 22 bp, Homo sapiens
caggggccggctgtccgtgccc

SEQ ID NO: 8243748 - DNA, 22 bp, Homo sapiens
caggggccggctgtccgtgccc

SEQ ID NO: 8243749 - DNA, 22 bp, Homo sapiens
caggggcctggctgtctaggaa

SEQ ID NO: 8243750 - DNA, 22 bp, Homo sapiens
caggggccaggctgtctgctgt

SEQ ID NO: 8243751 - DNA, 22 bp, Homo sapiens
caggggccaggctgtctgctgt

SEQ ID NO: 8243752 - DNA, 22 bp, Homo sapiens
caggggccaggctgtctgctgt

SEQ ID NO: 8243753 - DNA, 22 bp, Homo sapiens
cagggtgcttccgtggagctgt

SEQ ID NO: 8243754 - DNA, 22 bp, Homo sapiens
cagggtggaaaagctagttgga

SEQ ID NO: 8243755 - DNA, 22 bp, Homo sapiens
cagggtggaaaagctagttgga

SEQ ID NO: 8243756 - DNA, 22 bp, Homo sapiens
cagggtggaaaagctagttgga

SEQ ID NO: 8243757 - DNA, 22 bp, Homo sapiens
cagggtggaagctgtagagtgg

SEQ ID NO: 8243758 - DNA, 22 bp, Homo sapiens
cagggtggaagctgtagagtgg

SEQ ID NO: 8243759 - DNA, 22 bp, Homo sapiens
cagggtggaagctgtagagtgg

SEQ ID NO: 8243760 - DNA, 22 bp, Homo sapiens
cagggtggaacaggcaatactt

SEQ ID NO: 8243761 - DNA, 22 bp, Homo sapiens
caggggcctggctgtctaggaa

SEQ ID NO: 8243762 - DNA, 22 bp, Homo sapiens
cagggtcttggcgccatcaccc

SEQ ID NO: 8243763 - DNA, 22 bp, Homo sapiens
cagggtcttggcgccatcaccc

SEQ ID NO: 8243764 - DNA, 22 bp, Homo sapiens
cagggtcttggcgccatcaccc

SEQ ID NO: 8243765 - DNA, 22 bp, Homo sapiens
cagggtctgctacacttggcaa

SEQ ID NO: 8243766 - DNA, 22 bp, Homo sapiens
cagggtctgatggtcctcactt

SEQ ID NO: 8243767 - DNA, 22 bp, Homo sapiens
caggggcctgtcctggcttctg

SEQ ID NO: 8243768 - DNA, 22 bp, Homo sapiens
cagggtcttataaggccaattt

SEQ ID NO: 8243769 - DNA, 22 bp, Homo sapiens
caggtctgcagacagggccatg

SEQ ID NO: 8243770 - DNA, 22 bp, Homo sapiens
caggtctgcagacagggccatg

SEQ ID NO: 8243771 - DNA, 22 bp, Homo sapiens
caggtctggcatcagctgtgtg

SEQ ID NO: 8243772 - DNA, 22 bp, Homo sapiens
caggtctgcaggctggagtcca

SEQ ID NO: 8243773 - DNA, 17 bp, Homo sapiens
caggtctgaggccaggc

SEQ ID NO: 8243774 - DNA, 22 bp, Homo sapiens
caggtctggcatcagctgtgtg

SEQ ID NO: 8243775 - DNA, 22 bp, Homo sapiens
caggtctggcatcagctgtgtg

SEQ ID NO: 8243776 - DNA, 22 bp, Homo sapiens
caggtctggcatcagctgtgtg

SEQ ID NO: 8243777 - DNA, 22 bp, Homo sapiens
tatctatgctgcttcagttaag

SEQ ID NO: 8243778 - DNA, 22 bp, Homo sapiens
tatctatgtgctctgacctctc

SEQ ID NO: 8243779 - DNA, 22 bp, Homo sapiens
tatctatgtgctctgacctctc

SEQ ID NO: 8243780 - DNA, 22 bp, Homo sapiens
tatctatgtgctctgacctctc

SEQ ID NO: 8243781 - DNA, 22 bp, Homo sapiens
tatctatgtggtgatcttattt

SEQ ID NO: 8243782 - DNA, 22 bp, Homo sapiens
tatctattccaaatatcagcgt

SEQ ID NO: 8243783 - DNA, 22 bp, Homo sapiens
caggtccagaaaccaaaggatt

SEQ ID NO: 8243784 - DNA, 22 bp, Homo sapiens
caggtccacggcgcccaggggt

SEQ ID NO: 8243785 - DNA, 22 bp, Homo sapiens
caggtccaccatgcctcaagcc

SEQ ID NO: 8243786 - DNA, 22 bp, Homo sapiens
caggtccagaaaccaaaggatt

SEQ ID NO: 8243787 - DNA, 22 bp, Homo sapiens
caggtctccagctcagggtcca

SEQ ID NO: 8243788 - DNA, 22 bp, Homo sapiens
caggtctccagctcagggtcca

SEQ ID NO: 8243789 - DNA, 22 bp, Homo sapiens
caggtctcgggttcagcagtga

SEQ ID NO: 8243790 - DNA, 22 bp, Homo sapiens
caggtctcccatcccctctgtt

SEQ ID NO: 8243791 - DNA, 22 bp, Homo sapiens
caggtctcccatcccctctgtt

SEQ ID NO: 8243792 - DNA, 22 bp, Homo sapiens
caggtctcttttgtcacaccac

SEQ ID NO: 8243793 - DNA, 22 bp, Homo sapiens
caggtctctgcagcccctctgt

SEQ ID NO: 8243794 - DNA, 22 bp, Homo sapiens
caggtctcttttgtcacaccac

SEQ ID NO: 8243795 - DNA, 22 bp, Homo sapiens
caggtctgaagagtcacatgcc

SEQ ID NO: 8243796 - DNA, 22 bp, Homo sapiens
caggtctgaagagtcacatgcc

SEQ ID NO: 8243797 - DNA, 22 bp, Homo sapiens
caggtctcttttgtcacaccac

SEQ ID NO: 8243798 - DNA, 22 bp, Homo sapiens
caggtctctcccaagctacaat

SEQ ID NO: 8243799 - DNA, 22 bp, Homo sapiens
caggtctcgggttcagcagtga

SEQ ID NO: 8243800 - DNA, 22 bp, Homo sapiens
caggtctcgggttcagcagtga

SEQ ID NO: 8243801 - DNA, 22 bp, Homo sapiens
caggtctgaagagtcacatgcc

SEQ ID NO: 8243802 - DNA, 22 bp, Homo sapiens
caggtctgaagagtcacatgcc

SEQ ID NO: 8243803 - DNA, 17 bp, Homo sapiens
caggtctgaggccaggc

SEQ ID NO: 8243804 - DNA, 22 bp, Homo sapiens
caggtctgaagagtcacatgcc

SEQ ID NO: 8243805 - DNA, 17 bp, Homo sapiens
caggtctgaggccaggc

SEQ ID NO: 8243806 - DNA, 22 bp, Homo sapiens
cagggtggcacatcacagcatt

SEQ ID NO: 8243807 - DNA, 22 bp, Homo sapiens
cagggtggcactcagcgcatct

SEQ ID NO: 8243808 - DNA, 22 bp, Homo sapiens
cagggtggcactcagcgcatct

SEQ ID NO: 8243809 - DNA, 22 bp, Homo sapiens
cagggtggcactcagcgcatct

SEQ ID NO: 8243810 - DNA, 22 bp, Homo sapiens
cagggtggcactcagcgcatct

SEQ ID NO: 8243811 - DNA, 22 bp, Homo sapiens
tatacagatggaaagatacaca

SEQ ID NO: 8243812 - DNA, 22 bp, Homo sapiens
tatacagatggaaagatacaca

SEQ ID NO: 8243813 - DNA, 22 bp, Homo sapiens
tatacagatatctaagatgtaa

SEQ ID NO: 8243814 - DNA, 22 bp, Homo sapiens
tatacagatatctaagatgtaa

SEQ ID NO: 8243815 - DNA, 22 bp, Homo sapiens
tatacagatggaaagatacaca

SEQ ID NO: 8243816 - DNA, 22 bp, Homo sapiens
tatacagatggaaagatacaca

SEQ ID NO: 8243817 - DNA, 22 bp, Homo sapiens
cagggtggaagctgtagagtgg

SEQ ID NO: 8243818 - DNA, 22 bp, Homo sapiens
cagggtggaatggaatgctggc

SEQ ID NO: 8243819 - DNA, 22 bp, Homo sapiens
cagggtggaatggaatgctggc

SEQ ID NO: 8243820 - DNA, 22 bp, Homo sapiens
cagggtggcacatcacagcatt

SEQ ID NO: 8243821 - DNA, 22 bp, Homo sapiens
cagggtggcacatcacagcatt

SEQ ID NO: 8243822 - DNA, 22 bp, Homo sapiens
tatacagttaagtttcttcagt

SEQ ID NO: 8243823 - DNA, 22 bp, Homo sapiens
tatacagtcttttgctatattc

SEQ ID NO: 8243824 - DNA, 23 bp, Homo sapiens
tatacagtctccaggcagtcctt

SEQ ID NO: 8243825 - DNA, 22 bp, Homo sapiens
tatacagtatcttttgaaggca

SEQ ID NO: 8243826 - DNA, 22 bp, Homo sapiens
tatacagatttctgggcaatct

SEQ ID NO: 8243827 - DNA, 22 bp, Homo sapiens
tatacagattaacagatttaaa

SEQ ID NO: 8243828 - DNA, 22 bp, Homo sapiens
tatacagatggaaagatacaca

SEQ ID NO: 8243829 - DNA, 22 bp, Homo sapiens
tatacagatggaaagatacaca

SEQ ID NO: 8243830 - DNA, 22 bp, Homo sapiens
tatacagattaacagatttaaa

SEQ ID NO: 8243831 - DNA, 22 bp, Homo sapiens
caggtctgtattaacagagggt

SEQ ID NO: 8243832 - DNA, 22 bp, Homo sapiens
caggtctgtattaacagagggt

SEQ ID NO: 8243833 - DNA, 22 bp, Homo sapiens
caggtctgtattaacagagggt

SEQ ID NO: 8243834 - DNA, 18 bp, Homo sapiens
caggtctgtctgcctccc

SEQ ID NO: 8243835 - DNA, 22 bp, Homo sapiens
caggtctgtttccatcagtgct

SEQ ID NO: 8243836 - DNA, 22 bp, Homo sapiens
caggtctgtttccatcagtgct

SEQ ID NO: 8243837 - DNA, 22 bp, Homo sapiens
caggtctgtttccatcagtgct

SEQ ID NO: 8243838 - DNA, 22 bp, Homo sapiens
caggtctgtttccatcagtgct

SEQ ID NO: 8243839 - DNA, 22 bp, Homo sapiens
caggtctgttttcaaggtcagt

SEQ ID NO: 8243840 - DNA, 22 bp, Homo sapiens
caggtgaaaaagcaaccatatt

SEQ ID NO: 8243841 - DNA, 22 bp, Homo sapiens
tatgtacatgttaaagggcaaa

SEQ ID NO: 8243842 - DNA, 22 bp, Homo sapiens
tatggccatgatggccaattgg

SEQ ID NO: 8243843 - DNA, 22 bp, Homo sapiens
tatggctaattctttactgacc

SEQ ID NO: 8243844 - DNA, 22 bp, Homo sapiens
tatggctactacgaataatgct

SEQ ID NO: 8243845 - DNA, 22 bp, Homo sapiens
tatggcatttagaaatgtcaga

SEQ ID NO: 8243846 - DNA, 22 bp, Homo sapiens
tatggccaatcgggtggacgcc

SEQ ID NO: 8243847 - DNA, 22 bp, Homo sapiens
tatggccacagcttgtttgcaa

SEQ ID NO: 8243848 - DNA, 22 bp, Homo sapiens
tatggccacaatggggagaaac

SEQ ID NO: 8243849 - DNA, 17 bp, Homo sapiens
tatggctgtgtttgtgc

SEQ ID NO: 8243850 - DNA, 22 bp, Homo sapiens
tatggctgttacagctgggaga

SEQ ID NO: 8243851 - DNA, 17 bp, Homo sapiens
tatggctgtgtttgtgc

SEQ ID NO: 8243852 - DNA, 22 bp, Homo sapiens
tatggctgtggtgatctcattt

SEQ ID NO: 8243853 - DNA, 22 bp, Homo sapiens
tatggctgaggcctccgtggcc

SEQ ID NO: 8243854 - DNA, 22 bp, Homo sapiens
tatggctgctgttttgctacaa

SEQ ID NO: 8243855 - DNA, 22 bp, Homo sapiens
tatggctggaatactgaaaggc

SEQ ID NO: 8243856 - DNA, 22 bp, Homo sapiens
tatggctggaatactgaaaggc

SEQ ID NO: 8243857 - DNA, 22 bp, Homo sapiens
tatggctgtattctatgttact

SEQ ID NO: 8243858 - DNA, 15 bp, Homo sapiens
tatggctgtaaagct

SEQ ID NO: 8243859 - DNA, 22 bp, Homo sapiens
caggtctggtgagagaacagtt

SEQ ID NO: 8243860 - DNA, 21 bp, Homo sapiens
caggtctggtgaacactctca

SEQ ID NO: 8243861 - DNA, 22 bp, Homo sapiens
caggtctgggttgatggcctgg

SEQ ID NO: 8243862 - DNA, 21 bp, Homo sapiens
caggtctggtgaacactctca

SEQ ID NO: 8243863 - DNA, 22 bp, Homo sapiens
tatctggttcctttgaggagat

SEQ ID NO: 8243864 - DNA, 22 bp, Homo sapiens
tatggataggtttcaagaatgc

SEQ ID NO: 8243865 - DNA, 22 bp, Homo sapiens
tatggagattcaaaagcatctt

SEQ ID NO: 8243866 - DNA, 22 bp, Homo sapiens
tatggagattcaaaagcatctt

SEQ ID NO: 8243867 - DNA, 22 bp, Homo sapiens
tatggcaagatgacatgttctc

SEQ ID NO: 8243868 - DNA, 22 bp, Homo sapiens
tatggcaagagaatcaactgaa

SEQ ID NO: 8243869 - DNA, 22 bp, Homo sapiens
tatggcaagagaatcaactgaa

SEQ ID NO: 8243870 - DNA, 22 bp, Homo sapiens
tatggcaaaactctttatccaa

SEQ ID NO: 8243871 - DNA, 22 bp, Homo sapiens
tatggcaatatgtatcaagatc

SEQ ID NO: 8243872 - DNA, 22 bp, Homo sapiens
tatggcaagatgacatgttctc

SEQ ID NO: 8243873 - DNA, 22 bp, Homo sapiens
tatggcaattgtctaagtttta

SEQ ID NO: 8243874 - DNA, 22 bp, Homo sapiens
tatggcagaggagaggcactag

SEQ ID NO: 8243875 - DNA, 22 bp, Homo sapiens
tatggcagaggagaggcactag

SEQ ID NO: 8243876 - DNA, 19 bp, Homo sapiens
tatggcaggccgaggcact

SEQ ID NO: 8243877 - DNA, 22 bp, Homo sapiens
tatggcagttacccttgatgat

SEQ ID NO: 8243878 - DNA, 23 bp, Homo sapiens
tatctcagaggaatgtagttact

SEQ ID NO: 8243879 - DNA, 17 bp, Homo sapiens
tatctcatacaattata

SEQ ID NO: 8243880 - DNA, 17 bp, Homo sapiens
tatctcatacaattata

SEQ ID NO: 8243881 - DNA, 22 bp, Homo sapiens
tatctcattttattgcaaatgt

SEQ ID NO: 8243882 - DNA, 22 bp, Homo sapiens
tatctctaggctgccacttaaa

SEQ ID NO: 8243883 - DNA, 22 bp, Homo sapiens
tatctctagcgcacagaagaaa

SEQ ID NO: 8243884 - DNA, 17 bp, Homo sapiens
tatctctgcttcatggt

SEQ ID NO: 8243885 - DNA, 22 bp, Homo sapiens
tatctctgtaaaagaaatcaca

SEQ ID NO: 8243886 - DNA, 22 bp, Homo sapiens
tatctgattaatcagtgctttg

SEQ ID NO: 8243887 - DNA, 22 bp, Homo sapiens
tatctgaatcagttaggactct

SEQ ID NO: 8243888 - DNA, 22 bp, Homo sapiens
tatctgacaaaccctgtgccca

SEQ ID NO: 8243889 - DNA, 22 bp, Homo sapiens
tatctctttcattttagagtca

SEQ ID NO: 8243890 - DNA, 22 bp, Homo sapiens
tatctcttgtctgttttgcaaa

SEQ ID NO: 8243891 - DNA, 22 bp, Homo sapiens
tatctctttattgacaataaaa

SEQ ID NO: 8243892 - DNA, 22 bp, Homo sapiens
tatgtactaactttcattctag

SEQ ID NO: 8243893 - DNA, 23 bp, Homo sapiens
tatgtgcatatgtgtaagaatac

SEQ ID NO: 8243894 - DNA, 22 bp, Homo sapiens
tatgtgcattatctagttcatt

SEQ ID NO: 8243895 - DNA, 19 bp, Homo sapiens
tatgtgcatgtgtgcatat

SEQ ID NO: 8243896 - DNA, 22 bp, Homo sapiens
tatgtgtaatcatatctgatac

SEQ ID NO: 8243897 - DNA, 22 bp, Homo sapiens
tatgtgtaatcaaacacatgct

SEQ ID NO: 8243898 - DNA, 22 bp, Homo sapiens
tatgtgtaatcaaacacatgct

SEQ ID NO: 8243899 - DNA, 22 bp, Homo sapiens
tatgtgtaatcaaacacatgct

SEQ ID NO: 8243900 - DNA, 22 bp, Homo sapiens
tatgtgtaagctgtttatcttt

SEQ ID NO: 8243901 - DNA, 22 bp, Homo sapiens
tatgtgtaaccttgtgatttat

SEQ ID NO: 8243902 - DNA, 22 bp, Homo sapiens
tatgtggccttttatgtctgac

SEQ ID NO: 8243903 - DNA, 22 bp, Homo sapiens
tatgtgtatacctatacatgtg

SEQ ID NO: 8243904 - DNA, 22 bp, Homo sapiens
tatgtgtatatctgtatgtgca

SEQ ID NO: 8243905 - DNA, 22 bp, Homo sapiens
tatgtgtatacctatacatgtg

SEQ ID NO: 8243906 - DNA, 22 bp, Homo sapiens
tatgtgtactcgttaaatattt

SEQ ID NO: 8243907 - DNA, 22 bp, Homo sapiens
tatgtttttaagagaatgcatt

SEQ ID NO: 8243908 - DNA, 22 bp, Homo sapiens
tatgtttttaagagaatgcatt

SEQ ID NO: 8243909 - DNA, 22 bp, Homo sapiens
tatgtttttaagagaatgcatt

SEQ ID NO: 8243910 - DNA, 22 bp, Homo sapiens
tatgtttttaagagaatgcatt

SEQ ID NO: 8243911 - DNA, 22 bp, Homo sapiens
tatgtttttaagagaatgcatt

SEQ ID NO: 8243912 - DNA, 22 bp, Homo sapiens
tatgttttaggaattaattgtt

SEQ ID NO: 8243913 - DNA, 22 bp, Homo sapiens
tatgttttaggaattaattgtt

SEQ ID NO: 8243914 - DNA, 22 bp, Homo sapiens
tatgtttgttatcacaactagg

SEQ ID NO: 8243915 - DNA, 22 bp, Homo sapiens
tatgttttaggaattaattgtt

SEQ ID NO: 8243916 - DNA, 22 bp, Homo sapiens
tatgtgtattgagcattgttac

SEQ ID NO: 8243917 - DNA, 22 bp, Homo sapiens
tatgtgtcaaaccattcatctg

SEQ ID NO: 8243918 - DNA, 22 bp, Homo sapiens
tatgtgtatttagttctataca

SEQ ID NO: 8243919 - DNA, 22 bp, Homo sapiens
tatgtgtcctaagcaatcatcc

SEQ ID NO: 8243920 - DNA, 22 bp, Homo sapiens
tatgtgtcccttggtgtagcaa

SEQ ID NO: 8243921 - DNA, 22 bp, Homo sapiens
tatgtgtccctgctactcaaca

SEQ ID NO: 8243922 - DNA, 22 bp, Homo sapiens
tatgtgtcaaaccattcatctg

SEQ ID NO: 8243923 - DNA, 22 bp, Homo sapiens
tatgtgtccctgctactcaaca

SEQ ID NO: 8243924 - DNA, 22 bp, Homo sapiens
tatgtgtattgagcattgttac

SEQ ID NO: 8243925 - DNA, 22 bp, Homo sapiens
tatgtgtatgttcattcatgca

SEQ ID NO: 8243926 - DNA, 22 bp, Homo sapiens
tatgtgtatgttcattcatgca

SEQ ID NO: 8243927 - DNA, 22 bp, Homo sapiens
tatgtgtatgtacatacataca

SEQ ID NO: 8243928 - DNA, 22 bp, Homo sapiens
tatgtgtatgtacatacataca

SEQ ID NO: 8243929 - DNA, 22 bp, Homo sapiens
tatgtgtatgtacatacataca

SEQ ID NO: 8243930 - DNA, 19 bp, Homo sapiens
tatgtgtatatgtatctgt

SEQ ID NO: 8243931 - DNA, 19 bp, Homo sapiens
tatgtgtatatgtatctgt

SEQ ID NO: 8243932 - DNA, 22 bp, Homo sapiens
tatgtttttcagacgtcctaca

SEQ ID NO: 8243933 - DNA, 22 bp, Homo sapiens
tatgtttttcagacgtcctaca

SEQ ID NO: 8243934 - DNA, 22 bp, Homo sapiens
tatgtttttcaagtgcacacta

SEQ ID NO: 8243935 - DNA, 22 bp, Homo sapiens
tatgtttttcaagtgcacacta

SEQ ID NO: 8243936 - DNA, 22 bp, Homo sapiens
tattaaagggaagttatgcatg

SEQ ID NO: 8243937 - DNA, 22 bp, Homo sapiens
tattaaagggaagttatgcatg

SEQ ID NO: 8243938 - DNA, 22 bp, Homo sapiens
tattaaagagagaatcatcatc

SEQ ID NO: 8243939 - DNA, 22 bp, Homo sapiens
tattaaatatatctgttagttg

SEQ ID NO: 8243940 - DNA, 22 bp, Homo sapiens
tattaaatatatctgttagttg

SEQ ID NO: 8243941 - DNA, 22 bp, Homo sapiens
tattaaatatatctgttagttg

SEQ ID NO: 8243942 - DNA, 22 bp, Homo sapiens
tattaaatatatctgttagttg

SEQ ID NO: 8243943 - DNA, 22 bp, Homo sapiens
tattaaatatatctgttagttg

SEQ ID NO: 8243944 - DNA, 22 bp, Homo sapiens
tattcctggtgttggctgggtc

SEQ ID NO: 8243945 - DNA, 22 bp, Homo sapiens
tattaaatatatctgttagttg

SEQ ID NO: 8243946 - DNA, 22 bp, Homo sapiens
tattcctcctttctgctcagcc

SEQ ID NO: 8243947 - DNA, 22 bp, Homo sapiens
tattggaaggaagcaagagagg

SEQ ID NO: 8243948 - DNA, 22 bp, Homo sapiens
tattggaaggaagcaagagagg

SEQ ID NO: 8243949 - DNA, 22 bp, Homo sapiens
tattggaaggcattagtgaata

SEQ ID NO: 8243950 - DNA, 22 bp, Homo sapiens
tattgctttcagttgctttgag

SEQ ID NO: 8243951 - DNA, 22 bp, Homo sapiens
tattgcttaaaaaatatgtgag

SEQ ID NO: 8243952 - DNA, 22 bp, Homo sapiens
tattgctggaaaatggtgtgat

SEQ ID NO: 8243953 - DNA, 22 bp, Homo sapiens
tattgctgaggattgaggcttg

SEQ ID NO: 8243954 - DNA, 22 bp, Homo sapiens
tattgctcctacagtcaatttc

SEQ ID NO: 8243955 - DNA, 22 bp, Homo sapiens
tattgcgaatgtggtgataaat

SEQ ID NO: 8243956 - DNA, 22 bp, Homo sapiens
tcaccatcaggataaaatctca

SEQ ID NO: 8243957 - DNA, 22 bp, Homo sapiens
tcaccataggaacacagtcaga

SEQ ID NO: 8243958 - DNA, 22 bp, Homo sapiens
tcaccatacataaattacattg

SEQ ID NO: 8243959 - DNA, 22 bp, Homo sapiens
tcacccaagaccatcggaagtg

SEQ ID NO: 8243960 - DNA, 22 bp, Homo sapiens
tcaccagggagcttgtcctctg

SEQ ID NO: 8243961 - DNA, 22 bp, Homo sapiens
tcacattgaatggaagaataga

SEQ ID NO: 8243962 - DNA, 22 bp, Homo sapiens
tcacattgaatggaagaataga

SEQ ID NO: 8243963 - DNA, 22 bp, Homo sapiens
tcacattgccattagttcagtt

SEQ ID NO: 8243964 - DNA, 22 bp, Homo sapiens
cagtgctgttgtaagctcattg

SEQ ID NO: 8243965 - DNA, 22 bp, Homo sapiens
cagtgctgttgtaagctcattg

SEQ ID NO: 8243966 - DNA, 22 bp, Homo sapiens
cagtgctgttgtaagctcattg

SEQ ID NO: 8243967 - DNA, 22 bp, Homo sapiens
tcaccaggctggaatgcagtgg

SEQ ID NO: 8243968 - DNA, 22 bp, Homo sapiens
tcaccaggctcctgttaagatg

SEQ ID NO: 8243969 - DNA, 22 bp, Homo sapiens
tcaccaggctagagtgcagtgg

SEQ ID NO: 8243970 - DNA, 22 bp, Homo sapiens
tcaccaggctggagtgcagtgg

SEQ ID NO: 8243971 - DNA, 22 bp, Homo sapiens
tcaccaggctggagtgcagtgg

SEQ ID NO: 8243972 - DNA, 22 bp, Homo sapiens
tcaccaggctggaatgcagtgg

SEQ ID NO: 8243973 - DNA, 19 bp, Homo sapiens
cagtgctgttcattcagtg

SEQ ID NO: 8243974 - DNA, 19 bp, Homo sapiens
cagtgctgttcattcagtg

SEQ ID NO: 8243975 - DNA, 22 bp, Homo sapiens
cagtgctgttgggcccagagag

SEQ ID NO: 8243976 - DNA, 22 bp, Homo sapiens
cagtgctgttgggcccagagag

SEQ ID NO: 8243977 - DNA, 22 bp, Homo sapiens
cagtgctgttgggcccagagag

SEQ ID NO: 8243978 - DNA, 22 bp, Homo sapiens
cagtgctgttgggcccagagag

SEQ ID NO: 8243979 - DNA, 22 bp, Homo sapiens
cagtgctgttaataaacacaaa

SEQ ID NO: 8243980 - DNA, 18 bp, Homo sapiens
cagtgctgttaacagtga

SEQ ID NO: 8243981 - DNA, 18 bp, Homo sapiens
cagtgctgttaacagtga

SEQ ID NO: 8243982 - DNA, 22 bp, Homo sapiens
cagtgctgtgtttgctgcctgg

SEQ ID NO: 8243983 - DNA, 22 bp, Homo sapiens
cagtgctgtgctggaagctgtt

SEQ ID NO: 8243984 - DNA, 22 bp, Homo sapiens
cagtgctgtgctggaagctgtt

SEQ ID NO: 8243985 - DNA, 22 bp, Homo sapiens
cagtgctgtgctggaagctgtt

SEQ ID NO: 8243986 - DNA, 22 bp, Homo sapiens
cagtgctgtgtttgctgcctgg

SEQ ID NO: 8243987 - DNA, 22 bp, Homo sapiens
cagtgctgtgtttgctgcctgg

SEQ ID NO: 8243988 - DNA, 22 bp, Homo sapiens
cagtgctgtgctggaagctgtt

SEQ ID NO: 8243989 - DNA, 23 bp, Homo sapiens
cagtgctggttctgcctgtgggg

SEQ ID NO: 8243990 - DNA, 23 bp, Homo sapiens
cagtgctggttctgcctgtgggg

SEQ ID NO: 8243991 - DNA, 23 bp, Homo sapiens
cagtgctggttctgcctgtgggg

SEQ ID NO: 8243992 - DNA, 23 bp, Homo sapiens
cagtgctggttctgcctgtgggg

SEQ ID NO: 8243993 - DNA, 23 bp, Homo sapiens
cagtgctggttctgcctgtgggg

SEQ ID NO: 8243994 - DNA, 22 bp, Homo sapiens
cagtgctggtgtaggctgacca

SEQ ID NO: 8243995 - DNA, 22 bp, Homo sapiens
cagtgcagaggccagggaggat

SEQ ID NO: 8243996 - DNA, 22 bp, Homo sapiens
cagtgcagaggccagggaggat

SEQ ID NO: 8243997 - DNA, 19 bp, Homo sapiens
cagtgcccgacgcaggtct

SEQ ID NO: 8243998 - DNA, 22 bp, Homo sapiens
cagtgctcctgatgtacccttg

SEQ ID NO: 8243999 - DNA, 19 bp, Homo sapiens
cagtgcccaccctagcaca

SEQ ID NO: 8244000 - DNA, 22 bp, Homo sapiens
cagtgctgacagggaggaacct

SEQ ID NO: 8244001 - DNA, 22 bp, Homo sapiens
cagtgctgcatctccatgccag

SEQ ID NO: 8244002 - DNA, 22 bp, Homo sapiens
cagtgctgcaggcgcctgcggt

SEQ ID NO: 8244003 - DNA, 22 bp, Homo sapiens
cagtgctgcaggcgcctgcggt

SEQ ID NO: 8244004 - DNA, 22 bp, Homo sapiens
cagtgctgagagcctggccagg

SEQ ID NO: 8244005 - DNA, 22 bp, Homo sapiens
cagtgctgagagcctggccagg

SEQ ID NO: 8244006 - DNA, 22 bp, Homo sapiens
cagtgctgagagcctggccagg

SEQ ID NO: 8244007 - DNA, 22 bp, Homo sapiens
cagtgctgagagcctggccagg

SEQ ID NO: 8244008 - DNA, 22 bp, Homo sapiens
cagtgctgcaggcgcctgcggt

SEQ ID NO: 8244009 - DNA, 22 bp, Homo sapiens
cagtgctgcaggcgcctgcggt

SEQ ID NO: 8244010 - DNA, 22 bp, Homo sapiens
cagtgctggctgttaggacagt

SEQ ID NO: 8244011 - DNA, 22 bp, Homo sapiens
cagtgctggctgttaggacagt

SEQ ID NO: 8244012 - DNA, 22 bp, Homo sapiens
cagtgctgggcagaggagagcg

SEQ ID NO: 8244013 - DNA, 22 bp, Homo sapiens
cagtgctggtgtaggctgacca

SEQ ID NO: 8244014 - DNA, 22 bp, Homo sapiens
cagtgctggaggggtgcttgca

SEQ ID NO: 8244015 - DNA, 22 bp, Homo sapiens
cagtgctggaggggtgcttgca

SEQ ID NO: 8244016 - DNA, 22 bp, Homo sapiens
cagtgctggaggggtgcttgca

SEQ ID NO: 8244017 - DNA, 22 bp, Homo sapiens
cagtgctggaggctggagggaa

SEQ ID NO: 8244018 - DNA, 22 bp, Homo sapiens
cagtgctgctctctgtaagaga

SEQ ID NO: 8244019 - DNA, 21 bp, Homo sapiens
cagtgctgcctaatagggagt

SEQ ID NO: 8244020 - DNA, 22 bp, Homo sapiens
tcactcaatggtatcaggaggt

SEQ ID NO: 8244021 - DNA, 22 bp, Homo sapiens
tcactcaatatcccagtggggc

SEQ ID NO: 8244022 - DNA, 22 bp, Homo sapiens
tcactcaagcatctacagggat

SEQ ID NO: 8244023 - DNA, 22 bp, Homo sapiens
tcactcagatgttaaagggctt

SEQ ID NO: 8244024 - DNA, 22 bp, Homo sapiens
tcactcagcctgcctggttcct

SEQ ID NO: 8244025 - DNA, 22 bp, Homo sapiens
tcactcagctagcttcaggagc

SEQ ID NO: 8244026 - DNA, 22 bp, Homo sapiens
tcactcagcattcactgggcct

SEQ ID NO: 8244027 - DNA, 22 bp, Homo sapiens
tcactcagatgttaaagggctt

SEQ ID NO: 8244028 - DNA, 22 bp, Homo sapiens
tcactcagagatagcctcattt

SEQ ID NO: 8244029 - DNA, 22 bp, Homo sapiens
tcactcagagatagcctcattt

SEQ ID NO: 8244030 - DNA, 22 bp, Homo sapiens
tcacccagactgtctgactctt

SEQ ID NO: 8244031 - DNA, 22 bp, Homo sapiens
tcactcatattatctctccaca

SEQ ID NO: 8244032 - DNA, 18 bp, Homo sapiens
tcactcatagacatctat

SEQ ID NO: 8244033 - DNA, 22 bp, Homo sapiens
tcactcagtttttggcctctgc

SEQ ID NO: 8244034 - DNA, 18 bp, Homo sapiens
tcactcatagacatctat

SEQ ID NO: 8244035 - DNA, 22 bp, Homo sapiens
tcactcatattatctctccaca

SEQ ID NO: 8244036 - DNA, 22 bp, Homo sapiens
tcactccatagcttaactcttt

SEQ ID NO: 8244037 - DNA, 22 bp, Homo sapiens
tcactccatagcttaactcttt

SEQ ID NO: 8244038 - DNA, 22 bp, Homo sapiens
tcactcaggttcatgtctttgt

SEQ ID NO: 8244039 - DNA, 22 bp, Homo sapiens
tcactcaggttcatgtctttgt

SEQ ID NO: 8244040 - DNA, 22 bp, Homo sapiens
tcactcaggctggagtgcagtg

SEQ ID NO: 8244041 - DNA, 22 bp, Homo sapiens
tcactccatctttgctactggt

SEQ ID NO: 8244042 - DNA, 22 bp, Homo sapiens
tcactccatctttgctactggt

SEQ ID NO: 8244043 - DNA, 22 bp, Homo sapiens
tcactcctcaggctagcatcat

SEQ ID NO: 8244044 - DNA, 22 bp, Homo sapiens
tcacttcccagacggggtggca

SEQ ID NO: 8244045 - DNA, 22 bp, Homo sapiens
tcagaaaggttgagtcatgtgc

SEQ ID NO: 8244046 - DNA, 22 bp, Homo sapiens
tcagaaaggttgagtcatgtgc

SEQ ID NO: 8244047 - DNA, 22 bp, Homo sapiens
tcacttctgaaggtagttggca

SEQ ID NO: 8244048 - DNA, 22 bp, Homo sapiens
tcagaaagtgaactgttgacat

SEQ ID NO: 8244049 - DNA, 23 bp, Homo sapiens
tcagaacaatgccttaggggcat

SEQ ID NO: 8244050 - DNA, 23 bp, Homo sapiens
tcagaacaatgccttaggggcat

SEQ ID NO: 8244051 - DNA, 21 bp, Homo sapiens
tcagaacaattccatgcctcc

SEQ ID NO: 8244052 - DNA, 21 bp, Homo sapiens
tcagaacaattccatgcctcc

SEQ ID NO: 8244053 - DNA, 22 bp, Homo sapiens
tcagaagctaaatttgatattt

SEQ ID NO: 8244054 - DNA, 22 bp, Homo sapiens
tcagaaatttaggctggacttg

SEQ ID NO: 8244055 - DNA, 23 bp, Homo sapiens
tcagaacaatgccttaggggcat

SEQ ID NO: 8244056 - DNA, 22 bp, Homo sapiens
tcagaagctgggtctcagaagc

SEQ ID NO: 8244057 - DNA, 22 bp, Homo sapiens
tcagaagctggtgtcctttgaa

SEQ ID NO: 8244058 - DNA, 22 bp, Homo sapiens
tcagaaggaagttagagtatgg

SEQ ID NO: 8244059 - DNA, 19 bp, Homo sapiens
tcagaaggcaggagaggcc

SEQ ID NO: 8244060 - DNA, 22 bp, Homo sapiens
tcagaaatagtctttaaaatga

SEQ ID NO: 8244061 - DNA, 22 bp, Homo sapiens
tcagaaatgatcgttattcatt

SEQ ID NO: 8244062 - DNA, 22 bp, Homo sapiens
tcagaaatgtaagctgatgact

SEQ ID NO: 8244063 - DNA, 22 bp, Homo sapiens
tcagaaatagtctttaaaatga

SEQ ID NO: 8244064 - DNA, 22 bp, Homo sapiens
tcagaaataatgaatgatgggg

SEQ ID NO: 8244065 - DNA, 22 bp, Homo sapiens
tcagaaataatgaatgatgggg

SEQ ID NO: 8244066 - DNA, 22 bp, Homo sapiens
tcagaaagtgaactgttgacat

SEQ ID NO: 8244067 - DNA, 22 bp, Homo sapiens
tcagaaataatgaatgatgggg

SEQ ID NO: 8244068 - DNA, 22 bp, Homo sapiens
tcagaaataatgaatgatgggg

SEQ ID NO: 8244069 - DNA, 21 bp, Homo sapiens
tatttagttttacaaatgtgg

SEQ ID NO: 8244070 - DNA, 22 bp, Homo sapiens
tatttagttatctttcataaaa

SEQ ID NO: 8244071 - DNA, 22 bp, Homo sapiens
tatttagaatgcgtgtacgtgt

SEQ ID NO: 8244072 - DNA, 22 bp, Homo sapiens
tatttagatgcatttggattgc

SEQ ID NO: 8244073 - DNA, 20 bp, Homo sapiens
tatttagattcaagtatgga

SEQ ID NO: 8244074 - DNA, 22 bp, Homo sapiens
tatttagaacagacaatagaaa

SEQ ID NO: 8244075 - DNA, 22 bp, Homo sapiens
tatttagaacagacaatagaaa

SEQ ID NO: 8244076 - DNA, 22 bp, Homo sapiens
tatttacttttaaattgagaac

SEQ ID NO: 8244077 - DNA, 19 bp, Homo sapiens
tatttacttcttgattgca

SEQ ID NO: 8244078 - DNA, 22 bp, Homo sapiens
tatttaccctggcagctgtagc

SEQ ID NO: 8244079 - DNA, 22 bp, Homo sapiens
tatttacctagagccctctatc

SEQ ID NO: 8244080 - DNA, 22 bp, Homo sapiens
tatttactgtatttgaagttga

SEQ ID NO: 8244081 - DNA, 22 bp, Homo sapiens
tatttactgtatttgaagttga

SEQ ID NO: 8244082 - DNA, 22 bp, Homo sapiens
tatttactgtatttgaagttga

SEQ ID NO: 8244083 - DNA, 20 bp, Homo sapiens
tatttacaacttagagcctc

SEQ ID NO: 8244084 - DNA, 20 bp, Homo sapiens
tatttacaacttagagcctc

SEQ ID NO: 8244085 - DNA, 20 bp, Homo sapiens
tatttacaacttagagcctc

SEQ ID NO: 8244086 - DNA, 20 bp, Homo sapiens
tatttacaacttagagcctc

SEQ ID NO: 8244087 - DNA, 20 bp, Homo sapiens
tatttacaacttagagcctc

SEQ ID NO: 8244088 - DNA, 20 bp, Homo sapiens
tatttacaacttagagcctc

SEQ ID NO: 8244089 - DNA, 20 bp, Homo sapiens
tatttacaacttagagcctc

SEQ ID NO: 8244090 - DNA, 20 bp, Homo sapiens
tatttacaacttagagcctc

SEQ ID NO: 8244091 - DNA, 22 bp, Homo sapiens
tattggagaggtcttgggtaga

SEQ ID NO: 8244092 - DNA, 22 bp, Homo sapiens
tattggaatttagttagagaat

SEQ ID NO: 8244093 - DNA, 22 bp, Homo sapiens
tattggaggaaaccaagaagaa

SEQ ID NO: 8244094 - DNA, 22 bp, Homo sapiens
tattggagtactgcgagctgcc

SEQ ID NO: 8244095 - DNA, 22 bp, Homo sapiens
tattggagttggtaagaagtca

SEQ ID NO: 8244096 - DNA, 22 bp, Homo sapiens
tattggatgaagaaaggaagga

SEQ ID NO: 8244097 - DNA, 22 bp, Homo sapiens
tattggatgattcacttggcag

SEQ ID NO: 8244098 - DNA, 22 bp, Homo sapiens
cagtcctggggaccaggctgag

SEQ ID NO: 8244099 - DNA, 22 bp, Homo sapiens
cagtcctgggcaggtcaggcca

SEQ ID NO: 8244100 - DNA, 22 bp, Homo sapiens
cagtcctgggcaggtcaggcca

SEQ ID NO: 8244101 - DNA, 22 bp, Homo sapiens
cagtcctgggcaggtcaggcca

SEQ ID NO: 8244102 - DNA, 22 bp, Homo sapiens
cagtcctctcactcaggccttt

SEQ ID NO: 8244103 - DNA, 22 bp, Homo sapiens
cagtcctctcactcaggccttt

SEQ ID NO: 8244104 - DNA, 22 bp, Homo sapiens
cagtcctctcactcaggccttt

SEQ ID NO: 8244105 - DNA, 22 bp, Homo sapiens
cagtcctgggcacagccctggg

SEQ ID NO: 8244106 - DNA, 22 bp, Homo sapiens
cagtcctctctgtgtctgcacc

SEQ ID NO: 8244107 - DNA, 22 bp, Homo sapiens
cagtcctctctgtgtctgcacc

SEQ ID NO: 8244108 - DNA, 22 bp, Homo sapiens
cagtcctggggaccaggctgag

SEQ ID NO: 8244109 - DNA, 22 bp, Homo sapiens
cagtcctggggaccaggctgag

SEQ ID NO: 8244110 - DNA, 20 bp, Homo sapiens
cagtcctgtccctgctgccc

SEQ ID NO: 8244111 - DNA, 22 bp, Homo sapiens
cagtcctgggtgcagcaggaaa

SEQ ID NO: 8244112 - DNA, 22 bp, Homo sapiens
cagtcctgggtgcagcaggaaa

SEQ ID NO: 8244113 - DNA, 22 bp, Homo sapiens
cagtcctgtgtcccttggtggg

SEQ ID NO: 8244114 - DNA, 22 bp, Homo sapiens
cagtcctgtgtcccttggtggg

SEQ ID NO: 8244115 - DNA, 22 bp, Homo sapiens
cagtcctgttcctggagtagtt

SEQ ID NO: 8244116 - DNA, 22 bp, Homo sapiens
cagtccttgctatgaccctgag

SEQ ID NO: 8244117 - DNA, 22 bp, Homo sapiens
cagtgatttttacagtaaggaa

SEQ ID NO: 8244118 - DNA, 22 bp, Homo sapiens
cagtgatttttacagtaaggaa

SEQ ID NO: 8244119 - DNA, 22 bp, Homo sapiens
cagtgcaaactccctgaggtgg

SEQ ID NO: 8244120 - DNA, 22 bp, Homo sapiens
cagtgcaacagattcgagaagc

SEQ ID NO: 8244121 - DNA, 22 bp, Homo sapiens
cagtgattttaaactatggatg

SEQ ID NO: 8244122 - DNA, 22 bp, Homo sapiens
cagtgattttaaactatggatg

SEQ ID NO: 8244123 - DNA, 22 bp, Homo sapiens
cagtgattttggtctgccttag

SEQ ID NO: 8244124 - DNA, 22 bp, Homo sapiens
cagtgattttggtctgccttag

SEQ ID NO: 8244125 - DNA, 22 bp, Homo sapiens
cagtgattttctcagaacttga

SEQ ID NO: 8244126 - DNA, 22 bp, Homo sapiens
cagtgattttctcagaacttga

SEQ ID NO: 8244127 - DNA, 22 bp, Homo sapiens
cagtgattcaggtctccagttt

SEQ ID NO: 8244128 - DNA, 22 bp, Homo sapiens
cagtgattcagactcatcattt

SEQ ID NO: 8244129 - DNA, 22 bp, Homo sapiens
cagtgattcaggtctccagttt

SEQ ID NO: 8244130 - DNA, 22 bp, Homo sapiens
cagtgattcaggtgcctgttgg

SEQ ID NO: 8244131 - DNA, 22 bp, Homo sapiens
cagtgattgtactgttgtgcct

SEQ ID NO: 8244132 - DNA, 22 bp, Homo sapiens
cagtgatttcagaatggattat

SEQ ID NO: 8244133 - DNA, 22 bp, Homo sapiens
cagtgatggatatggagaagtc

SEQ ID NO: 8244134 - DNA, 22 bp, Homo sapiens
cagtgatgtttctgcatcagag

SEQ ID NO: 8244135 - DNA, 22 bp, Homo sapiens
cagtgattaagatacccaggct

SEQ ID NO: 8244136 - DNA, 22 bp, Homo sapiens
cagtgattaaaacatgacagcc

SEQ ID NO: 8244137 - DNA, 19 bp, Homo sapiens
cagtgattaattcatctta

SEQ ID NO: 8244138 - DNA, 22 bp, Homo sapiens
cagtgattaagatacccaggct

SEQ ID NO: 8244139 - DNA, 19 bp, Homo sapiens
cagtgattaattcatctta

SEQ ID NO: 8244140 - DNA, 22 bp, Homo sapiens
cagtgattattgattgcattca

SEQ ID NO: 8244141 - DNA, 22 bp, Homo sapiens
cagtgattattgattgcattca

SEQ ID NO: 8244142 - DNA, 22 bp, Homo sapiens
cagtgattactgtgcttttggt

SEQ ID NO: 8244143 - DNA, 22 bp, Homo sapiens
cagtgattcagactcatcattt

SEQ ID NO: 8244144 - DNA, 22 bp, Homo sapiens
cagtgattcacgcccttgggcc

SEQ ID NO: 8244145 - DNA, 22 bp, Homo sapiens
cagtgcaacttttgcctcccgg

SEQ ID NO: 8244146 - DNA, 20 bp, Homo sapiens
cagtgcaactgaagaactga

SEQ ID NO: 8244147 - DNA, 22 bp, Homo sapiens
cagtgcaatgcagatgacacca

SEQ ID NO: 8244148 - DNA, 22 bp, Homo sapiens
cagtgcaattacaagctaattc

SEQ ID NO: 8244149 - DNA, 22 bp, Homo sapiens
cagtgcacgggccagtcctgcc

SEQ ID NO: 8244150 - DNA, 22 bp, Homo sapiens
cagtgcagaacacatggaaaat

SEQ ID NO: 8244151 - DNA, 22 bp, Homo sapiens
cagtgcagacgtggagggggca

SEQ ID NO: 8244152 - DNA, 22 bp, Homo sapiens
cagtgcagacgtggagggggca

SEQ ID NO: 8244153 - DNA, 17 bp, Homo sapiens
cagtgcagagccctttc

SEQ ID NO: 8244154 - DNA, 17 bp, Homo sapiens
cagtgcagagccctttc

SEQ ID NO: 8244155 - DNA, 22 bp, Homo sapiens
cagtgcagaggccagggaggat

SEQ ID NO: 8244156 - DNA, 22 bp, Homo sapiens
cagtgcagacgtggagggggca

SEQ ID NO: 8244157 - DNA, 22 bp, Homo sapiens
cagtctcctgggggctgttgtt

SEQ ID NO: 8244158 - DNA, 20 bp, Homo sapiens
cagtgaggaggtgctggggg

SEQ ID NO: 8244159 - DNA, 20 bp, Homo sapiens
cagtgaggaggtgctggggg

SEQ ID NO: 8244160 - DNA, 20 bp, Homo sapiens
cagtgaggaggtgctggggg

SEQ ID NO: 8244161 - DNA, 22 bp, Homo sapiens
cagtctccgccagctcctcaca

SEQ ID NO: 8244162 - DNA, 22 bp, Homo sapiens
cagtctccaaatcagtctgaat

SEQ ID NO: 8244163 - DNA, 22 bp, Homo sapiens
cagtctccaaatcagtctgaat

SEQ ID NO: 8244164 - DNA, 22 bp, Homo sapiens
cagtctccaaatcagtctgaat

SEQ ID NO: 8244165 - DNA, 22 bp, Homo sapiens
cagtctccaaatcaatctgaat

SEQ ID NO: 8244166 - DNA, 22 bp, Homo sapiens
cagtctcaccctggaggcccca

SEQ ID NO: 8244167 - DNA, 22 bp, Homo sapiens
cagtctacctttcagacattga

SEQ ID NO: 8244168 - DNA, 22 bp, Homo sapiens
cagtctaatctgttactcatta

SEQ ID NO: 8244169 - DNA, 18 bp, Homo sapiens
cagtctaattcccttccc

SEQ ID NO: 8244170 - DNA, 22 bp, Homo sapiens
cagtctaacttcacagcctgga

SEQ ID NO: 8244171 - DNA, 22 bp, Homo sapiens
cagtctaagactcacgccaaga

SEQ ID NO: 8244172 - DNA, 22 bp, Homo sapiens
cagtctaagttaatttccacaa

SEQ ID NO: 8244173 - DNA, 22 bp, Homo sapiens
cagtgagtaagtagacagctta

SEQ ID NO: 8244174 - DNA, 22 bp, Homo sapiens
cagtgagtaagtagacagctta

SEQ ID NO: 8244175 - DNA, 22 bp, Homo sapiens
cagtgaggtggatggatggcct

SEQ ID NO: 8244176 - DNA, 22 bp, Homo sapiens
cagtgagttgtgctgaggacca

SEQ ID NO: 8244177 - DNA, 22 bp, Homo sapiens
cagtgagtgtgggaagtctctg

SEQ ID NO: 8244178 - DNA, 17 bp, Homo sapiens
cagtgatcattacatta

SEQ ID NO: 8244179 - DNA, 22 bp, Homo sapiens
cagtgaggtggatggatggcct

SEQ ID NO: 8244180 - DNA, 22 bp, Homo sapiens
cagtgagggcccccttccaggt

SEQ ID NO: 8244181 - DNA, 22 bp, Homo sapiens
cagtgaggtagacagctttttc

SEQ ID NO: 8244182 - DNA, 22 bp, Homo sapiens
cagtgagggcccccttccaggt

SEQ ID NO: 8244183 - DNA, 21 bp, Homo sapiens
cagtgaggtccccagcctagg

SEQ ID NO: 8244184 - DNA, 22 bp, Homo sapiens
catccactagaatgacagagtt

SEQ ID NO: 8244185 - DNA, 22 bp, Homo sapiens
catcatcttgaatgactgtgat

SEQ ID NO: 8244186 - DNA, 22 bp, Homo sapiens
catcatcttgaatgactgtgat

SEQ ID NO: 8244187 - DNA, 22 bp, Homo sapiens
catcatctggcttttagaaaaa

SEQ ID NO: 8244188 - DNA, 22 bp, Homo sapiens
catcatctggcttttagaaaaa

SEQ ID NO: 8244189 - DNA, 22 bp, Homo sapiens
catccagaccgtgccatgctgc

SEQ ID NO: 8244190 - DNA, 22 bp, Homo sapiens
catccagggcagccatggcctg

SEQ ID NO: 8244191 - DNA, 22 bp, Homo sapiens
catccatagattgagagatggt

SEQ ID NO: 8244192 - DNA, 22 bp, Homo sapiens
catccagtggtcagggaagttg

SEQ ID NO: 8244193 - DNA, 22 bp, Homo sapiens
catccagggcagccatggcctg

SEQ ID NO: 8244194 - DNA, 23 bp, Homo sapiens
catccaggagctgagtctgactg

SEQ ID NO: 8244195 - DNA, 22 bp, Homo sapiens
catcacagggggctagaagtct

SEQ ID NO: 8244196 - DNA, 22 bp, Homo sapiens
catcacagggggctagaagtct

SEQ ID NO: 8244197 - DNA, 22 bp, Homo sapiens
catcacaggtcctgatgacatt

SEQ ID NO: 8244198 - DNA, 22 bp, Homo sapiens
catcacatctactataagtgat

SEQ ID NO: 8244199 - DNA, 22 bp, Homo sapiens
catcacatcaaacctactctca

SEQ ID NO: 8244200 - DNA, 22 bp, Homo sapiens
catcacatcagtgtgaacagtt

SEQ ID NO: 8244201 - DNA, 22 bp, Homo sapiens
catcacatcagtgtgaacagtt

SEQ ID NO: 8244202 - DNA, 19 bp, Homo sapiens
catcacatggtctgatgaa

SEQ ID NO: 8244203 - DNA, 22 bp, Homo sapiens
catcacatgcctatcatgagct

SEQ ID NO: 8244204 - DNA, 22 bp, Homo sapiens
catcacatgcctatcatgagct

SEQ ID NO: 8244205 - DNA, 22 bp, Homo sapiens
catcatcacctgctatacgatc

SEQ ID NO: 8244206 - DNA, 22 bp, Homo sapiens
catcatctggcttttagaaaaa

SEQ ID NO: 8244207 - DNA, 22 bp, Homo sapiens
catcacatgtaggcagcatcac

SEQ ID NO: 8244208 - DNA, 22 bp, Homo sapiens
catcacatgcctatcatgagct

SEQ ID NO: 8244209 - DNA, 22 bp, Homo sapiens
catcacatgtaggcagcatcac

SEQ ID NO: 8244210 - DNA, 19 bp, Homo sapiens
catcacatggtctgatgaa

SEQ ID NO: 8244211 - DNA, 22 bp, Homo sapiens
catcacatgtaggcagcatcac

SEQ ID NO: 8244212 - DNA, 19 bp, Homo sapiens
tcagggccatgagcgccac

SEQ ID NO: 8244213 - DNA, 22 bp, Homo sapiens
tcagggcccagagctcaggcaa

SEQ ID NO: 8244214 - DNA, 22 bp, Homo sapiens
tcagggcccagagctcaggcaa

SEQ ID NO: 8244215 - DNA, 22 bp, Homo sapiens
tcagggccatcttttgcctcaa

SEQ ID NO: 8244216 - DNA, 22 bp, Homo sapiens
tcagggccaggactaggatgag

SEQ ID NO: 8244217 - DNA, 22 bp, Homo sapiens
tcagggccacgcggaggtgacg

SEQ ID NO: 8244218 - DNA, 22 bp, Homo sapiens
tcagggccatcttttgcctcaa

SEQ ID NO: 8244219 - DNA, 22 bp, Homo sapiens
tcagggcccagtctgtgcatct

SEQ ID NO: 8244220 - DNA, 22 bp, Homo sapiens
tcagggcattcaagaggcctgg

SEQ ID NO: 8244221 - DNA, 22 bp, Homo sapiens
tcagggcattcaagaggcctgg

SEQ ID NO: 8244222 - DNA, 22 bp, Homo sapiens
tcagggcattcaagaggcctgg

SEQ ID NO: 8244223 - DNA, 22 bp, Homo sapiens
tcagggcatgtatgtttcttta

SEQ ID NO: 8244224 - DNA, 22 bp, Homo sapiens
tcagggcattcaagaggcctgg

SEQ ID NO: 8244225 - DNA, 22 bp, Homo sapiens
tcagggcatgtatgtttcttta

SEQ ID NO: 8244226 - DNA, 20 bp, Homo sapiens
tcagggcatgggacagcccc

SEQ ID NO: 8244227 - DNA, 20 bp, Homo sapiens
tcagggcatgggacagcccc

SEQ ID NO: 8244228 - DNA, 20 bp, Homo sapiens
tcagggcatgggacagcccc

SEQ ID NO: 8244229 - DNA, 22 bp, Homo sapiens
catatgtatttctcataattag

SEQ ID NO: 8244230 - DNA, 22 bp, Homo sapiens
catatgtatttctcataattag

SEQ ID NO: 8244231 - DNA, 20 bp, Homo sapiens
catatggaaagatattgttc

SEQ ID NO: 8244232 - DNA, 22 bp, Homo sapiens
catatgtactgtttgctttcaa

SEQ ID NO: 8244233 - DNA, 22 bp, Homo sapiens
catatgtatttctcataattag

SEQ ID NO: 8244234 - DNA, 22 bp, Homo sapiens
catatgtatttctcataattag

SEQ ID NO: 8244235 - DNA, 20 bp, Homo sapiens
tcagggcatgggacagcccc

SEQ ID NO: 8244236 - DNA, 22 bp, Homo sapiens
tcagggcatggctgcacttggc

SEQ ID NO: 8244237 - DNA, 22 bp, Homo sapiens
tcagggcatggctgcacttggc

SEQ ID NO: 8244238 - DNA, 22 bp, Homo sapiens
catatattatggactgcagaat

SEQ ID NO: 8244239 - DNA, 22 bp, Homo sapiens
catatattctggttttcactgg

SEQ ID NO: 8244240 - DNA, 22 bp, Homo sapiens
catatattctggttttcactgg

SEQ ID NO: 8244241 - DNA, 22 bp, Homo sapiens
catatattctggttttcactgg

SEQ ID NO: 8244242 - DNA, 20 bp, Homo sapiens
catatatacctagaagtgga

SEQ ID NO: 8244243 - DNA, 22 bp, Homo sapiens
catatatgtagatgtatgtgaa

SEQ ID NO: 8244244 - DNA, 22 bp, Homo sapiens
catatatgtagatgtatgtgaa

SEQ ID NO: 8244245 - DNA, 22 bp, Homo sapiens
catatatgtgcagaccacttga

SEQ ID NO: 8244246 - DNA, 20 bp, Homo sapiens
catatatacctagaagtgga

SEQ ID NO: 8244247 - DNA, 20 bp, Homo sapiens
catatatacctagaagtgga

SEQ ID NO: 8244248 - DNA, 20 bp, Homo sapiens
catatatacctagaagtgga

SEQ ID NO: 8244249 - DNA, 20 bp, Homo sapiens
catatatacctagaagtgga

SEQ ID NO: 8244250 - DNA, 20 bp, Homo sapiens
catatatacctagaagtgga

SEQ ID NO: 8244251 - DNA, 22 bp, Homo sapiens
catatacttttctatagctttc

SEQ ID NO: 8244252 - DNA, 22 bp, Homo sapiens
catatactgcatacatatgtgt

SEQ ID NO: 8244253 - DNA, 22 bp, Homo sapiens
catatacttttctatagctttc

SEQ ID NO: 8244254 - DNA, 22 bp, Homo sapiens
catatacttttctatagctttc

SEQ ID NO: 8244255 - DNA, 20 bp, Homo sapiens
catatatacctagaagtgga

SEQ ID NO: 8244256 - DNA, 22 bp, Homo sapiens
catatactgcatacatatgtgt

SEQ ID NO: 8244257 - DNA, 22 bp, Homo sapiens
catatcatttgcttataaatct

SEQ ID NO: 8244258 - DNA, 22 bp, Homo sapiens
catatcttctgacatgatcagg

SEQ ID NO: 8244259 - DNA, 22 bp, Homo sapiens
catatgaaatatgagttgaaca

SEQ ID NO: 8244260 - DNA, 23 bp, Homo sapiens
catatgaaagtagacactttcca

SEQ ID NO: 8244261 - DNA, 22 bp, Homo sapiens
catatgaagttcaacagagatg

SEQ ID NO: 8244262 - DNA, 22 bp, Homo sapiens
catatgaagatgtctttttgta

SEQ ID NO: 8244263 - DNA, 23 bp, Homo sapiens
catatgaattttagaggcagttt

SEQ ID NO: 8244264 - DNA, 22 bp, Homo sapiens
tcaggaagttgaggcgtagaga

SEQ ID NO: 8244265 - DNA, 22 bp, Homo sapiens
tcaggaagttgaggcgtagaga

SEQ ID NO: 8244266 - DNA, 22 bp, Homo sapiens
tcaggaagtggtaaaggatgtt

SEQ ID NO: 8244267 - DNA, 22 bp, Homo sapiens
tcaggaagtggtaaaggatgtt

SEQ ID NO: 8244268 - DNA, 22 bp, Homo sapiens
tcaggaagtggtaaaggatgtt

SEQ ID NO: 8244269 - DNA, 22 bp, Homo sapiens
tcaggaagtgctgaggctgctt

SEQ ID NO: 8244270 - DNA, 22 bp, Homo sapiens
tcaggaagtgctgaggctgctt

SEQ ID NO: 8244271 - DNA, 22 bp, Homo sapiens
tcaggaagtctcaattagctac

SEQ ID NO: 8244272 - DNA, 22 bp, Homo sapiens
tcaggaagtctcaattagctac

SEQ ID NO: 8244273 - DNA, 22 bp, Homo sapiens
tcaggaagtgcctaggctggcc

SEQ ID NO: 8244274 - DNA, 22 bp, Homo sapiens
tcaggaagtgcctaggctggcc

SEQ ID NO: 8244275 - DNA, 22 bp, Homo sapiens
tcaggaagtgcctaggctggcc

SEQ ID NO: 8244276 - DNA, 22 bp, Homo sapiens
tcaggaagtgctgaggctgctt

SEQ ID NO: 8244277 - DNA, 22 bp, Homo sapiens
tcaggaagtgctgaggctgctt

SEQ ID NO: 8244278 - DNA, 22 bp, Homo sapiens
catagacaaagatcagaagagt

SEQ ID NO: 8244279 - DNA, 22 bp, Homo sapiens
catagaatggattgacaagatt

SEQ ID NO: 8244280 - DNA, 22 bp, Homo sapiens
catagaatggattgacaagatt

SEQ ID NO: 8244281 - DNA, 22 bp, Homo sapiens
catataaatacaacatgtgtta

SEQ ID NO: 8244282 - DNA, 19 bp, Homo sapiens
tcaggaagttgatgaggtg

SEQ ID NO: 8244283 - DNA, 19 bp, Homo sapiens
tcaggaagttgatgaggtg

SEQ ID NO: 8244284 - DNA, 19 bp, Homo sapiens
tcaggaagttgatgaggtg

SEQ ID NO: 8244285 - DNA, 22 bp, Homo sapiens
catatacacttccacctctgtg

SEQ ID NO: 8244286 - DNA, 22 bp, Homo sapiens
catatacacttccacctctgtg

SEQ ID NO: 8244287 - DNA, 22 bp, Homo sapiens
catataattacctaccagctgg

SEQ ID NO: 8244288 - DNA, 22 bp, Homo sapiens
catataatgtttgaagatgtgg

SEQ ID NO: 8244289 - DNA, 22 bp, Homo sapiens
catataatgtttgaagatgtgg

SEQ ID NO: 8244290 - DNA, 22 bp, Homo sapiens
tcagaagggaaacacaagtgac

SEQ ID NO: 8244291 - DNA, 22 bp, Homo sapiens
tcagaagtactgtgctacaata

SEQ ID NO: 8244292 - DNA, 22 bp, Homo sapiens
tcagaaggtttttagcaaagga

SEQ ID NO: 8244293 - DNA, 22 bp, Homo sapiens
cagtttctgtggtctcttttca

SEQ ID NO: 8244294 - DNA, 22 bp, Homo sapiens
cagtttctgggcgttcacaggt

SEQ ID NO: 8244295 - DNA, 22 bp, Homo sapiens
cagtttatatgagggtatcaag

SEQ ID NO: 8244296 - DNA, 22 bp, Homo sapiens
cagtttatatgagggtatcaag

SEQ ID NO: 8244297 - DNA, 22 bp, Homo sapiens
cagtttatatgagggtatcaag

SEQ ID NO: 8244298 - DNA, 22 bp, Homo sapiens
cagtttatatgtcagagctgta

SEQ ID NO: 8244299 - DNA, 22 bp, Homo sapiens
cagtttatatgtcagagctgta

SEQ ID NO: 8244300 - DNA, 22 bp, Homo sapiens
cagtttctctcatacatatttg

SEQ ID NO: 8244301 - DNA, 22 bp, Homo sapiens
cagtttatatgtcagagctgta

SEQ ID NO: 8244302 - DNA, 22 bp, Homo sapiens
cagtttatatgtcagagctgta

SEQ ID NO: 8244303 - DNA, 22 bp, Homo sapiens
cagtttctgaggttccaggttt

SEQ ID NO: 8244304 - DNA, 22 bp, Homo sapiens
cagtttctctcatacatatttg

SEQ ID NO: 8244305 - DNA, 22 bp, Homo sapiens
cagtttctgagccctgtcattt

SEQ ID NO: 8244306 - DNA, 22 bp, Homo sapiens
tcagcagtggctctcatgcagt

SEQ ID NO: 8244307 - DNA, 19 bp, Homo sapiens
tcagcccaggctgggaagc

SEQ ID NO: 8244308 - DNA, 19 bp, Homo sapiens
cagtttgtccagaggggac

SEQ ID NO: 8244309 - DNA, 22 bp, Homo sapiens
cagtttcttcatcagttaagca

SEQ ID NO: 8244310 - DNA, 22 bp, Homo sapiens
cagtttcttcaattcagacact

SEQ ID NO: 8244311 - DNA, 22 bp, Homo sapiens
cagtttcttcatcagttaagca

SEQ ID NO: 8244312 - DNA, 22 bp, Homo sapiens
cagtttcttcaattcagacact

SEQ ID NO: 8244313 - DNA, 22 bp, Homo sapiens
cagtttcttcaattcagacact

SEQ ID NO: 8244314 - DNA, 22 bp, Homo sapiens
cagtttcttcaattcagacact

SEQ ID NO: 8244315 - DNA, 22 bp, Homo sapiens
cagtttcttctattttgaacta

SEQ ID NO: 8244316 - DNA, 22 bp, Homo sapiens
cagtttcttcatctgcagaatc

SEQ ID NO: 8244317 - DNA, 22 bp, Homo sapiens
cagtttcttcatctgcagaatc

SEQ ID NO: 8244318 - DNA, 22 bp, Homo sapiens
cagtttcttaagactgagatct

SEQ ID NO: 8244319 - DNA, 22 bp, Homo sapiens
cagtttcttaagactgagatct

SEQ ID NO: 8244320 - DNA, 22 bp, Homo sapiens
cagtttctgttttaaatagcag

SEQ ID NO: 8244321 - DNA, 22 bp, Homo sapiens
cagtttcttagtgacacaaatc

SEQ ID NO: 8244322 - DNA, 22 bp, Homo sapiens
cagtttcttatcttcaaaattg

SEQ ID NO: 8244323 - DNA, 22 bp, Homo sapiens
tcagctgcagtttcacaagcac

SEQ ID NO: 8244324 - DNA, 22 bp, Homo sapiens
tcagctgcagtttcacaagcac

SEQ ID NO: 8244325 - DNA, 22 bp, Homo sapiens
cataatttttttaagtcagaac

SEQ ID NO: 8244326 - DNA, 22 bp, Homo sapiens
cataatttttttaagtcagaac

SEQ ID NO: 8244327 - DNA, 22 bp, Homo sapiens
cataatttttttaagtcagaac

SEQ ID NO: 8244328 - DNA, 22 bp, Homo sapiens
cataatttttttaagtcagaac

SEQ ID NO: 8244329 - DNA, 22 bp, Homo sapiens
catacattttgcatatttacca

SEQ ID NO: 8244330 - DNA, 22 bp, Homo sapiens
catacatttatacacatctatg

SEQ ID NO: 8244331 - DNA, 22 bp, Homo sapiens
catacattgctcattcagtatc

SEQ ID NO: 8244332 - DNA, 22 bp, Homo sapiens
tcaggaagtataatcagattca

SEQ ID NO: 8244333 - DNA, 22 bp, Homo sapiens
catacttttgccctgacattct

SEQ ID NO: 8244334 - DNA, 22 bp, Homo sapiens
catactttttagatctgccttc

SEQ ID NO: 8244335 - DNA, 22 bp, Homo sapiens
catactttttagatctgccttc

SEQ ID NO: 8244336 - DNA, 22 bp, Homo sapiens
catacattttgcatatttacca

SEQ ID NO: 8244337 - DNA, 22 bp, Homo sapiens
catactattactaggagcagga

SEQ ID NO: 8244338 - DNA, 22 bp, Homo sapiens
catactttctttttcacgcata

SEQ ID NO: 8244339 - DNA, 22 bp, Homo sapiens
catactttgggataagagtgga

SEQ ID NO: 8244340 - DNA, 22 bp, Homo sapiens
tcagccctggcactgtctccca

SEQ ID NO: 8244341 - DNA, 22 bp, Homo sapiens
tcagccctgggacccagggatg

SEQ ID NO: 8244342 - DNA, 22 bp, Homo sapiens
tcagccctgggacccagggatg

SEQ ID NO: 8244343 - DNA, 22 bp, Homo sapiens
tcagccctggcactgtctccca

SEQ ID NO: 8244344 - DNA, 22 bp, Homo sapiens
tcagccctagcctcagtccagg

SEQ ID NO: 8244345 - DNA, 22 bp, Homo sapiens
tcagccctagcctcagtccagg

SEQ ID NO: 8244346 - DNA, 22 bp, Homo sapiens
tcagcccgggttcgcaaacact

SEQ ID NO: 8244347 - DNA, 20 bp, Homo sapiens
tcagccctgagtccaggctg

SEQ ID NO: 8244348 - DNA, 22 bp, Homo sapiens
tcagccctgaggacagaggcag

SEQ ID NO: 8244349 - DNA, 22 bp, Homo sapiens
tcagccctgaggacagaggcag

SEQ ID NO: 8244350 - DNA, 22 bp, Homo sapiens
tcagccccacggggtcagccaa

SEQ ID NO: 8244351 - DNA, 22 bp, Homo sapiens
tcagccccacggggtcagccaa

SEQ ID NO: 8244352 - DNA, 22 bp, Homo sapiens
tcagccccacggggtcagccaa

SEQ ID NO: 8244353 - DNA, 22 bp, Homo sapiens
tcagcccgaggtcaggatgggg

SEQ ID NO: 8244354 - DNA, 22 bp, Homo sapiens
tcagcccttcctggagctttta

SEQ ID NO: 8244355 - DNA, 19 bp, Homo sapiens
tcagctctggggtcagtgg

SEQ ID NO: 8244356 - DNA, 22 bp, Homo sapiens
tcagccctgggcttcctcatgg

SEQ ID NO: 8244357 - DNA, 22 bp, Homo sapiens
tcagccctgggcttcctcatgg

SEQ ID NO: 8244358 - DNA, 20 bp, Homo sapiens
tcagctctgtgcctgggatg

SEQ ID NO: 8244359 - DNA, 22 bp, Homo sapiens
tcagctcttaaccctctggcct

SEQ ID NO: 8244360 - DNA, 22 bp, Homo sapiens
tcagctctgttttgagtggaac

SEQ ID NO: 8244361 - DNA, 22 bp, Homo sapiens
tcagctcttaaccctctggcct

SEQ ID NO: 8244362 - DNA, 22 bp, Homo sapiens
tcagctcttccccccagccagg

SEQ ID NO: 8244363 - DNA, 22 bp, Homo sapiens
tcagctcttccccccagccagg

SEQ ID NO: 8244364 - DNA, 22 bp, Homo sapiens
tcagctgcactgttctgaccca

SEQ ID NO: 8244365 - DNA, 22 bp, Homo sapiens
tcagctgagctccagctcatag

SEQ ID NO: 8244366 - DNA, 22 bp, Homo sapiens
tcatgggcagctactggttccc

SEQ ID NO: 8244367 - DNA, 22 bp, Homo sapiens
tcatggggtgacagaagggagg

SEQ ID NO: 8244368 - DNA, 22 bp, Homo sapiens
tcatggttcatgagtgtccttt

SEQ ID NO: 8244369 - DNA, 22 bp, Homo sapiens
tcatggttggagattgagggca

SEQ ID NO: 8244370 - DNA, 22 bp, Homo sapiens
tcatggttcatgagtgtccttt

SEQ ID NO: 8244371 - DNA, 22 bp, Homo sapiens
tcatgtatttgtgatagatgac

SEQ ID NO: 8244372 - DNA, 22 bp, Homo sapiens
tcatgtacatgtaagtcagaaa

SEQ ID NO: 8244373 - DNA, 22 bp, Homo sapiens
tcatttgttctcattctctact

SEQ ID NO: 8244374 - DNA, 18 bp, Homo sapiens
tcatttgttttgcatgaa

SEQ ID NO: 8244375 - DNA, 17 bp, Homo sapiens
tcatttgttgtgactag

SEQ ID NO: 8244376 - DNA, 22 bp, Homo sapiens
tcatttatttgactttggagtg

SEQ ID NO: 8244377 - DNA, 22 bp, Homo sapiens
tcatttcaagttctgacagcta

SEQ ID NO: 8244378 - DNA, 22 bp, Homo sapiens
tcatttcaagttctgacagcta

SEQ ID NO: 8244379 - DNA, 19 bp, Homo sapiens
tcatgtctctcatctgtga

SEQ ID NO: 8244380 - DNA, 22 bp, Homo sapiens
tcatgtcagtttcttctataaa

SEQ ID NO: 8244381 - DNA, 18 bp, Homo sapiens
tcatgtcactgtgctccc

SEQ ID NO: 8244382 - DNA, 22 bp, Homo sapiens
catgatacttgaatttggaagg

SEQ ID NO: 8244383 - DNA, 22 bp, Homo sapiens
catgatacttgacatttgcgat

SEQ ID NO: 8244384 - DNA, 22 bp, Homo sapiens
catgatataaagtagtagataa

SEQ ID NO: 8244385 - DNA, 22 bp, Homo sapiens
catgataggtatttaattaaat

SEQ ID NO: 8244386 - DNA, 20 bp, Homo sapiens
catgatacttggaagggctt

SEQ ID NO: 8244387 - DNA, 22 bp, Homo sapiens
catgatgttatctaaatctggt

SEQ ID NO: 8244388 - DNA, 22 bp, Homo sapiens
catgatgttaggcaggatacta

SEQ ID NO: 8244389 - DNA, 23 bp, Homo sapiens
catgatgttaactttgttatgct

SEQ ID NO: 8244390 - DNA, 23 bp, Homo sapiens
catgatgttaactttgttatgct

SEQ ID NO: 8244391 - DNA, 22 bp, Homo sapiens
catgatggatgtgcacttcgct

SEQ ID NO: 8244392 - DNA, 22 bp, Homo sapiens
catgatctggtcctactgtggg

SEQ ID NO: 8244393 - DNA, 22 bp, Homo sapiens
catgatctggtcctactgtggg

SEQ ID NO: 8244394 - DNA, 23 bp, Homo sapiens
catgatatttatcttccctgggt

SEQ ID NO: 8244395 - DNA, 22 bp, Homo sapiens
catgagaatgaagaagacttaa

SEQ ID NO: 8244396 - DNA, 22 bp, Homo sapiens
catgagttcaaaatgcctgcct

SEQ ID NO: 8244397 - DNA, 22 bp, Homo sapiens
catgagtgtgccagtctgatat

SEQ ID NO: 8244398 - DNA, 22 bp, Homo sapiens
catgagttttttagttcatgca

SEQ ID NO: 8244399 - DNA, 22 bp, Homo sapiens
tcagtttatttcttgttccaca

SEQ ID NO: 8244400 - DNA, 22 bp, Homo sapiens
catgagaaggttttggcatata

SEQ ID NO: 8244401 - DNA, 22 bp, Homo sapiens
catgagaatgaagaagacttaa

SEQ ID NO: 8244402 - DNA, 22 bp, Homo sapiens
tcagtttatggtctagttcatg

SEQ ID NO: 8244403 - DNA, 22 bp, Homo sapiens
tcagtttataaattgtatttag

SEQ ID NO: 8244404 - DNA, 22 bp, Homo sapiens
tcagtttataaattgtatttag

SEQ ID NO: 8244405 - DNA, 22 bp, Homo sapiens
tcagtttagatgcatttgtcgt

SEQ ID NO: 8244406 - DNA, 22 bp, Homo sapiens
tcagtttagatgcatttgtcgt

SEQ ID NO: 8244407 - DNA, 22 bp, Homo sapiens
tcagtttagagttatttaatct

SEQ ID NO: 8244408 - DNA, 22 bp, Homo sapiens
tcagtttaatacccagatgcct

SEQ ID NO: 8244409 - DNA, 22 bp, Homo sapiens
tcagtttaagatgactaacaat

SEQ ID NO: 8244410 - DNA, 22 bp, Homo sapiens
tcagtttaatacccagatgcct

SEQ ID NO: 8244411 - DNA, 22 bp, Homo sapiens
tcaggtgggagtagaatgctag

SEQ ID NO: 8244412 - DNA, 22 bp, Homo sapiens
tcaggtgggagtagaatgctag

SEQ ID NO: 8244413 - DNA, 22 bp, Homo sapiens
tcaggtgggacctgctaggaca

SEQ ID NO: 8244414 - DNA, 22 bp, Homo sapiens
tcaggtgggcagtgggttgagc

SEQ ID NO: 8244415 - DNA, 22 bp, Homo sapiens
tcaggtgggcagtgggttgagc

SEQ ID NO: 8244416 - DNA, 22 bp, Homo sapiens
tcaggtgggcagtgggttgagc

SEQ ID NO: 8244417 - DNA, 22 bp, Homo sapiens
tcaggtgggcgttccggtgcgg

SEQ ID NO: 8244418 - DNA, 22 bp, Homo sapiens
tcaggtgggcgttccggtgcgg

SEQ ID NO: 8244419 - DNA, 22 bp, Homo sapiens
tcaggtgggcgttccggtgcgg

SEQ ID NO: 8244420 - DNA, 22 bp, Homo sapiens
tcaggtgggtctacaattagtt

SEQ ID NO: 8244421 - DNA, 22 bp, Homo sapiens
tcaggtggtcctaagtgccatc

SEQ ID NO: 8244422 - DNA, 22 bp, Homo sapiens
tcaggtggtcctaagtgccatc

SEQ ID NO: 8244423 - DNA, 22 bp, Homo sapiens
tcaggtgggtctacaattagtt

SEQ ID NO: 8244424 - DNA, 22 bp, Homo sapiens
tcaggtgtaggttgttcagttt

SEQ ID NO: 8244425 - DNA, 22 bp, Homo sapiens
tcaggtgtaggttgttcagttt

SEQ ID NO: 8244426 - DNA, 22 bp, Homo sapiens
tcaggtggtcctaagtgccatc

SEQ ID NO: 8244427 - DNA, 22 bp, Homo sapiens
tcaggtgtaggttgttcagttt

SEQ ID NO: 8244428 - DNA, 22 bp, Homo sapiens
catctttaacaatttacaatgt

SEQ ID NO: 8244429 - DNA, 22 bp, Homo sapiens
catctttaacaatttacaatgt

SEQ ID NO: 8244430 - DNA, 22 bp, Homo sapiens
catctttaaaatgggaacaaca

SEQ ID NO: 8244431 - DNA, 22 bp, Homo sapiens
tcaggtggcttggagggggacg

SEQ ID NO: 8244432 - DNA, 22 bp, Homo sapiens
tcaggtggcttggagggggacg

SEQ ID NO: 8244433 - DNA, 22 bp, Homo sapiens
tcaggtgggacctgctaggaca

SEQ ID NO: 8244434 - DNA, 22 bp, Homo sapiens
tcaggtgggacctgctaggaca

SEQ ID NO: 8244435 - DNA, 22 bp, Homo sapiens
tcaggtggcttcggggagtggc

SEQ ID NO: 8244436 - DNA, 22 bp, Homo sapiens
tcaggtggcttcggggagtggc

SEQ ID NO: 8244437 - DNA, 22 bp, Homo sapiens
tcaggtggcttggagggggacg

SEQ ID NO: 8244438 - DNA, 22 bp, Homo sapiens
tcaggtggcttcggggagtggc

SEQ ID NO: 8244439 - DNA, 22 bp, Homo sapiens
tcaggtggcttcggggagtggc

SEQ ID NO: 8244440 - DNA, 22 bp, Homo sapiens
tcaggtggctggttgctggcta

SEQ ID NO: 8244441 - DNA, 22 bp, Homo sapiens
tcaggtggctggttgctggcta

SEQ ID NO: 8244442 - DNA, 22 bp, Homo sapiens
tcaggtggctggttgctggcta

SEQ ID NO: 8244443 - DNA, 22 bp, Homo sapiens
catccctgtcgtcaagtctctg

SEQ ID NO: 8244444 - DNA, 22 bp, Homo sapiens
catccctgccctcatgcctata

SEQ ID NO: 8244445 - DNA, 22 bp, Homo sapiens
catccctgggcgggacactctt

SEQ ID NO: 8244446 - DNA, 22 bp, Homo sapiens
catccatagcttgatctgttcc

SEQ ID NO: 8244447 - DNA, 22 bp, Homo sapiens
catccatagcctcaataaatag

SEQ ID NO: 8244448 - DNA, 22 bp, Homo sapiens
catccatcacaagtttgttcat

SEQ ID NO: 8244449 - DNA, 22 bp, Homo sapiens
catccatatgaggcacattggt

SEQ ID NO: 8244450 - DNA, 22 bp, Homo sapiens
catcccctgatgctcttgagta

SEQ ID NO: 8244451 - DNA, 22 bp, Homo sapiens
catccccagagcagttccacta

SEQ ID NO: 8244452 - DNA, 22 bp, Homo sapiens
catccccaattagcgcccagct

SEQ ID NO: 8244453 - DNA, 22 bp, Homo sapiens
catccccagagcagttccacta

SEQ ID NO: 8244454 - DNA, 22 bp, Homo sapiens
tcagttcttgggctgctaggac

SEQ ID NO: 8244455 - DNA, 22 bp, Homo sapiens
tcagttctttatttcacagtga

SEQ ID NO: 8244456 - DNA, 20 bp, Homo sapiens
tcagtttaaatcctggcttt

SEQ ID NO: 8244457 - DNA, 21 bp, Homo sapiens
tcagttgccaaagtgatgtca

SEQ ID NO: 8244458 - DNA, 22 bp, Homo sapiens
tcagttgctaaatggtgtagtg

SEQ ID NO: 8244459 - DNA, 22 bp, Homo sapiens
catctttagttattgaatatag

SEQ ID NO: 8244460 - DNA, 22 bp, Homo sapiens
catctttagttattgaatatag

SEQ ID NO: 8244461 - DNA, 22 bp, Homo sapiens
catctttagttattgaatatag

SEQ ID NO: 8244462 - DNA, 22 bp, Homo sapiens
catctttaacagaatggatttg

SEQ ID NO: 8244463 - DNA, 22 bp, Homo sapiens
catctttagggaccattattct

SEQ ID NO: 8244464 - DNA, 22 bp, Homo sapiens
catctttagggaccattattct

SEQ ID NO: 8244465 - DNA, 22 bp, Homo sapiens
catctttatttatatagacagg

SEQ ID NO: 8244466 - DNA, 22 bp, Homo sapiens
catctttatttatatagacagg

SEQ ID NO: 8244467 - DNA, 22 bp, Homo sapiens
catctttatttatatagacagg

SEQ ID NO: 8244468 - DNA, 22 bp, Homo sapiens
catctttatttatatagacagg

SEQ ID NO: 8244469 - DNA, 22 bp, Homo sapiens
catctttagttattgaatatag

SEQ ID NO: 8244470 - DNA, 22 bp, Homo sapiens
tcattttcccactgaagctgtc

SEQ ID NO: 8244471 - DNA, 22 bp, Homo sapiens
tcattttgcagagctgaggaac

SEQ ID NO: 8244472 - DNA, 22 bp, Homo sapiens
tcattttcaagtttgaacagga

SEQ ID NO: 8244473 - DNA, 22 bp, Homo sapiens
tcattttcaagtttgaacagga

SEQ ID NO: 8244474 - DNA, 22 bp, Homo sapiens
tcattttcacacataaatagca

SEQ ID NO: 8244475 - DNA, 22 bp, Homo sapiens
tcattttcacacataaatagca

SEQ ID NO: 8244476 - DNA, 22 bp, Homo sapiens
tcattttgtgccttatgaccgc

SEQ ID NO: 8244477 - DNA, 22 bp, Homo sapiens
tcattttgtgccttatgaccgc

SEQ ID NO: 8244478 - DNA, 18 bp, Homo sapiens
tcattttgtctgcctttg

SEQ ID NO: 8244479 - DNA, 18 bp, Homo sapiens
tcattttgtctgcctttg

SEQ ID NO: 8244480 - DNA, 22 bp, Homo sapiens
tcattttggggtttgtcatctt

SEQ ID NO: 8244481 - DNA, 22 bp, Homo sapiens
tcattttggggtttgtcatctt

SEQ ID NO: 8244482 - DNA, 22 bp, Homo sapiens
tcattttgcctgccatttgagt

SEQ ID NO: 8244483 - DNA, 22 bp, Homo sapiens
tcattttggccatgatacagac

SEQ ID NO: 8244484 - DNA, 22 bp, Homo sapiens
tcattttggccatgatacagac

SEQ ID NO: 8244485 - DNA, 16 bp, Homo sapiens
tcattttgagtgacag

SEQ ID NO: 8244486 - DNA, 22 bp, Homo sapiens
tcattttgcagagctgaggaac

SEQ ID NO: 8244487 - DNA, 22 bp, Homo sapiens
tcattttgcctgccatttgagt

SEQ ID NO: 8244488 - DNA, 23 bp, Homo sapiens
catgcaaacactattgcatttgg

SEQ ID NO: 8244489 - DNA, 22 bp, Homo sapiens
catgcaaacacgtaaacattca

SEQ ID NO: 8244490 - DNA, 22 bp, Homo sapiens
catgattttgtcttgtgttaat

SEQ ID NO: 8244491 - DNA, 22 bp, Homo sapiens
catgcaaatgtgctaatctgaa

SEQ ID NO: 8244492 - DNA, 22 bp, Homo sapiens
catgcaatttttggttctctat

SEQ ID NO: 8244493 - DNA, 22 bp, Homo sapiens
catgcaaaggtcaagatcagga

SEQ ID NO: 8244494 - DNA, 22 bp, Homo sapiens
catgcacaacatactcaagagg

SEQ ID NO: 8244495 - DNA, 22 bp, Homo sapiens
catgcacaacatactcaagagg

SEQ ID NO: 8244496 - DNA, 22 bp, Homo sapiens
catgcacaaaggtaagatgcgt

SEQ ID NO: 8244497 - DNA, 22 bp, Homo sapiens
catgcacacacagttctaatta

SEQ ID NO: 8244498 - DNA, 22 bp, Homo sapiens
catggccagccctgaggttcag

SEQ ID NO: 8244499 - DNA, 22 bp, Homo sapiens
catggccagccctgaggttcag

SEQ ID NO: 8244500 - DNA, 22 bp, Homo sapiens
catgcacaagggatgatgaaat

SEQ ID NO: 8244501 - DNA, 22 bp, Homo sapiens
catggctgaacactcagtgact

SEQ ID NO: 8244502 - DNA, 22 bp, Homo sapiens
catggccagccctgaggttcag

SEQ ID NO: 8244503 - DNA, 22 bp, Homo sapiens
catggccaggcacgcgcatagc

SEQ ID NO: 8244504 - DNA, 22 bp, Homo sapiens
catggctgaggcagaggactga

SEQ ID NO: 8244505 - DNA, 22 bp, Homo sapiens
catggctgaggcagaggactga

SEQ ID NO: 8244506 - DNA, 22 bp, Homo sapiens
catggctgaggcagaggactga

SEQ ID NO: 8244507 - DNA, 19 bp, Homo sapiens
catggctgccccatatagc

SEQ ID NO: 8244508 - DNA, 22 bp, Homo sapiens
catggctgcattggaatgggtt

SEQ ID NO: 8244509 - DNA, 22 bp, Homo sapiens
catggctgcattggaatgggtt

SEQ ID NO: 8244510 - DNA, 23 bp, Homo sapiens
catggctgatttcaagctaccac

SEQ ID NO: 8244511 - DNA, 23 bp, Homo sapiens
catggctgatttcaagctaccac

SEQ ID NO: 8244512 - DNA, 22 bp, Homo sapiens
catggctgcgagaagagtgggt

SEQ ID NO: 8244513 - DNA, 22 bp, Homo sapiens
catggctgcgagaagagtgggt

SEQ ID NO: 8244514 - DNA, 22 bp, Homo sapiens
catggctgcctgtggacactgc

SEQ ID NO: 8244515 - DNA, 22 bp, Homo sapiens
catggctgcgagaagagtgggt

SEQ ID NO: 8244516 - DNA, 19 bp, Homo sapiens
catggctgctgcttgggag

SEQ ID NO: 8244517 - DNA, 19 bp, Homo sapiens
catggctgctgcttgggag

SEQ ID NO: 8244518 - DNA, 22 bp, Homo sapiens
catggctgctggctcggtccct

SEQ ID NO: 8244519 - DNA, 22 bp, Homo sapiens
catggctgcgagaagagtgggt

SEQ ID NO: 8244520 - DNA, 19 bp, Homo sapiens
catggctgctgcttgggag

SEQ ID NO: 8244521 - DNA, 19 bp, Homo sapiens
catggctgctgcttgggag

SEQ ID NO: 8244522 - DNA, 22 bp, Homo sapiens
catggctggccagtgggagtgg

SEQ ID NO: 8244523 - DNA, 22 bp, Homo sapiens
catggctggccagtgggagtgg

SEQ ID NO: 8244524 - DNA, 22 bp, Homo sapiens
catggctggcacacagcaacca

SEQ ID NO: 8244525 - DNA, 22 bp, Homo sapiens
catggctgggagacggctgagg

SEQ ID NO: 8244526 - DNA, 22 bp, Homo sapiens
catggctggccagtgggagtgg

SEQ ID NO: 8244527 - DNA, 22 bp, Homo sapiens
catggctggccagtgggagtgg

SEQ ID NO: 8244528 - DNA, 22 bp, Homo sapiens
catggctggtgcacctctggga

SEQ ID NO: 8244529 - DNA, 22 bp, Homo sapiens
catggctgggagacggctgagg

SEQ ID NO: 8244530 - DNA, 22 bp, Homo sapiens
catggctggtgcacctctggga

SEQ ID NO: 8244531 - DNA, 22 bp, Homo sapiens
catggctggtgcacctctggga

SEQ ID NO: 8244532 - DNA, 20 bp, Homo sapiens
catggctgtgagcccacagg

SEQ ID NO: 8244533 - DNA, 20 bp, Homo sapiens
catggctgtgagcccacagg

SEQ ID NO: 8244534 - DNA, 20 bp, Homo sapiens
catggctgtgagcccacagg

SEQ ID NO: 8244535 - DNA, 22 bp, Homo sapiens
catggctttccagtcctccact

SEQ ID NO: 8244536 - DNA, 22 bp, Homo sapiens
catggctttccagtcctccact

SEQ ID NO: 8244537 - DNA, 22 bp, Homo sapiens
catgtgcagtgtaagacatgct

SEQ ID NO: 8244538 - DNA, 22 bp, Homo sapiens
catgtgcagtgtaagacatgct

SEQ ID NO: 8244539 - DNA, 22 bp, Homo sapiens
catgtgattacactaagaaggt

SEQ ID NO: 8244540 - DNA, 22 bp, Homo sapiens
catgtgagaaacagtgatgtcg

SEQ ID NO: 8244541 - DNA, 22 bp, Homo sapiens
catgtgcagactctgacaggct

SEQ ID NO: 8244542 - DNA, 19 bp, Homo sapiens
catgtgcacatgtgaatgc

SEQ ID NO: 8244543 - DNA, 22 bp, Homo sapiens
catgtctttgttatgctcacca

SEQ ID NO: 8244544 - DNA, 22 bp, Homo sapiens
catgtgaattccaaagctaggt

SEQ ID NO: 8244545 - DNA, 22 bp, Homo sapiens
catgtcttatttatgcttctta

SEQ ID NO: 8244546 - DNA, 22 bp, Homo sapiens
tccaggcaagggaggagcatgg

SEQ ID NO: 8244547 - DNA, 22 bp, Homo sapiens
tccaggcaaagtgctgggctgc

SEQ ID NO: 8244548 - DNA, 22 bp, Homo sapiens
tccaggcaaagtgctgggctgc

SEQ ID NO: 8244549 - DNA, 22 bp, Homo sapiens
tccaggcaaagtgctgggctgc

SEQ ID NO: 8244550 - DNA, 22 bp, Homo sapiens
tccaggcaaaaggaactgcttg

SEQ ID NO: 8244551 - DNA, 19 bp, Homo sapiens
catgtgcatgagcacagga

SEQ ID NO: 8244552 - DNA, 22 bp, Homo sapiens
tccaggcaaaaaccaactacag

SEQ ID NO: 8244553 - DNA, 22 bp, Homo sapiens
tccaggcaaaaaccaactacag

SEQ ID NO: 8244554 - DNA, 22 bp, Homo sapiens
catgggagctatctccatcact

SEQ ID NO: 8244555 - DNA, 22 bp, Homo sapiens
catgggaataaagttatttcaa

SEQ ID NO: 8244556 - DNA, 22 bp, Homo sapiens
tccagccaggatggcccaggga

SEQ ID NO: 8244557 - DNA, 22 bp, Homo sapiens
tccagccacttgcacagttaaa

SEQ ID NO: 8244558 - DNA, 22 bp, Homo sapiens
tccagcccacacctgaagctgg

SEQ ID NO: 8244559 - DNA, 22 bp, Homo sapiens
tccagcccacacctgaagctgg

SEQ ID NO: 8244560 - DNA, 22 bp, Homo sapiens
tccagccattcattatgacacc

SEQ ID NO: 8244561 - DNA, 22 bp, Homo sapiens
tccagccatatcttgtagccct

SEQ ID NO: 8244562 - DNA, 22 bp, Homo sapiens
tccagccatgcatgacaatcac

SEQ ID NO: 8244563 - DNA, 22 bp, Homo sapiens
tccagccatgactcggacagtg

SEQ ID NO: 8244564 - DNA, 22 bp, Homo sapiens
catgtacatgcctactatcaat

SEQ ID NO: 8244565 - DNA, 22 bp, Homo sapiens
catgtacatgcctactatcaat

SEQ ID NO: 8244566 - DNA, 22 bp, Homo sapiens
tccagcccagctcctctcagaa

SEQ ID NO: 8244567 - DNA, 22 bp, Homo sapiens
tccagcccagctcctctcagaa

SEQ ID NO: 8244568 - DNA, 22 bp, Homo sapiens
tccagcccagctcctctcagaa

SEQ ID NO: 8244569 - DNA, 20 bp, Homo sapiens
tccagcccagcagcctgaca

SEQ ID NO: 8244570 - DNA, 20 bp, Homo sapiens
tccagcccagcagcctgaca

SEQ ID NO: 8244571 - DNA, 18 bp, Homo sapiens
tccagcccacattttctg

SEQ ID NO: 8244572 - DNA, 22 bp, Homo sapiens
catgtctgagtcatggtacttc

SEQ ID NO: 8244573 - DNA, 22 bp, Homo sapiens
catgtacatgcctactatcaat

SEQ ID NO: 8244574 - DNA, 22 bp, Homo sapiens
catgtctgccaatttggaagga

SEQ ID NO: 8244575 - DNA, 22 bp, Homo sapiens
catgtcttatatcctgtcttca

SEQ ID NO: 8244576 - DNA, 23 bp, Homo sapiens
catgtctgctttcatgctacaac

SEQ ID NO: 8244577 - DNA, 23 bp, Homo sapiens
catgtctgctttcatgctacaac

SEQ ID NO: 8244578 - DNA, 22 bp, Homo sapiens
tgttttaagagcgcactttata

SEQ ID NO: 8244579 - DNA, 22 bp, Homo sapiens
tgttttaagctctagaagggga

SEQ ID NO: 8244580 - DNA, 22 bp, Homo sapiens
tgttttaagggtcaactgtcac

SEQ ID NO: 8244581 - DNA, 22 bp, Homo sapiens
tgttttaatctcccattgctct

SEQ ID NO: 8244582 - DNA, 22 bp, Homo sapiens
tgttttagctgacacatggagc

SEQ ID NO: 8244583 - DNA, 22 bp, Homo sapiens
tgttttagctgacacatggagc

SEQ ID NO: 8244584 - DNA, 22 bp, Homo sapiens
tgtttttgtctccttgtctgct

SEQ ID NO: 8244585 - DNA, 22 bp, Homo sapiens
tgttttatttctccaagaggga

SEQ ID NO: 8244586 - DNA, 22 bp, Homo sapiens
tgttttatttctccaagaggga

SEQ ID NO: 8244587 - DNA, 22 bp, Homo sapiens
tgttttatgagccatataacct

SEQ ID NO: 8244588 - DNA, 22 bp, Homo sapiens
tgttttatgagccatataacct

SEQ ID NO: 8244589 - DNA, 22 bp, Homo sapiens
tgttttatgagccatataacct

SEQ ID NO: 8244590 - DNA, 22 bp, Homo sapiens
tgttttatgagccatataacct

SEQ ID NO: 8244591 - DNA, 22 bp, Homo sapiens
tgttttatcaagatggcatgtc

SEQ ID NO: 8244592 - DNA, 22 bp, Homo sapiens
tgttttatcaagatggcatgtc

SEQ ID NO: 8244593 - DNA, 22 bp, Homo sapiens
tgttttatataagcagagcggt

SEQ ID NO: 8244594 - DNA, 22 bp, Homo sapiens
tgttttatataagcagagcggt

SEQ ID NO: 8244595 - DNA, 22 bp, Homo sapiens
tgtttgctctgactatcttgcg

SEQ ID NO: 8244596 - DNA, 22 bp, Homo sapiens
tgtttgctctgactatcttgcg

SEQ ID NO: 8244597 - DNA, 18 bp, Homo sapiens
tgtttatttttctcttac

SEQ ID NO: 8244598 - DNA, 18 bp, Homo sapiens
tgtttatttttctcttac

SEQ ID NO: 8244599 - DNA, 18 bp, Homo sapiens
tgtttatttttctcttac

SEQ ID NO: 8244600 - DNA, 18 bp, Homo sapiens
tgtttatttttctcttac

SEQ ID NO: 8244601 - DNA, 18 bp, Homo sapiens
tgtttatttttctcttac

SEQ ID NO: 8244602 - DNA, 18 bp, Homo sapiens
tgtttatttttctcttac

SEQ ID NO: 8244603 - DNA, 22 bp, Homo sapiens
tgtttgtggttataataagtat

SEQ ID NO: 8244604 - DNA, 22 bp, Homo sapiens
tgtttgtggttataataagtat

SEQ ID NO: 8244605 - DNA, 22 bp, Homo sapiens
tgtttgtgctgcctggtgggca

SEQ ID NO: 8244606 - DNA, 20 bp, Homo sapiens
tgtttgtgccagctttgtca

SEQ ID NO: 8244607 - DNA, 22 bp, Homo sapiens
tgtttggaaacactggcagaaa

SEQ ID NO: 8244608 - DNA, 23 bp, Homo sapiens
ttaaacactagttcgagtagcat

SEQ ID NO: 8244609 - DNA, 22 bp, Homo sapiens
ttaaacactggagctgggtgtt

SEQ ID NO: 8244610 - DNA, 22 bp, Homo sapiens
ttaaacacctgtctagtgtagc

SEQ ID NO: 8244611 - DNA, 22 bp, Homo sapiens
ttaaacacctgtctagtgtagc

SEQ ID NO: 8244612 - DNA, 22 bp, Homo sapiens
ttaaacacctgtctagtgtagc

SEQ ID NO: 8244613 - DNA, 22 bp, Homo sapiens
ttaaacaccacagcagtcccta

SEQ ID NO: 8244614 - DNA, 22 bp, Homo sapiens
ttaaacacctgtctagtgtagc

SEQ ID NO: 8244615 - DNA, 22 bp, Homo sapiens
ttaaacacactgagatttatgt

SEQ ID NO: 8244616 - DNA, 22 bp, Homo sapiens
ttaaacaccaagtgcaaaccac

SEQ ID NO: 8244617 - DNA, 22 bp, Homo sapiens
ttaaaatttccccaccatgtat

SEQ ID NO: 8244618 - DNA, 22 bp, Homo sapiens
ttaaacacactgagatttatgt

SEQ ID NO: 8244619 - DNA, 22 bp, Homo sapiens
ttaaacacactgagatttatgt

SEQ ID NO: 8244620 - DNA, 22 bp, Homo sapiens
ttaaaatttccccaccatgtat

SEQ ID NO: 8244621 - DNA, 22 bp, Homo sapiens
ttaaaatttccccaccatgtat

SEQ ID NO: 8244622 - DNA, 22 bp, Homo sapiens
ttaaaatttccccaccatgtat

SEQ ID NO: 8244623 - DNA, 22 bp, Homo sapiens
ttaaaatttccccaccatgtat

SEQ ID NO: 8244624 - DNA, 22 bp, Homo sapiens
ttaaaatgtacaggggaaagtg

SEQ ID NO: 8244625 - DNA, 22 bp, Homo sapiens
ttaaaatgtacaggggaaagtg

SEQ ID NO: 8244626 - DNA, 22 bp, Homo sapiens
ttaaaattatggcccatttgga

SEQ ID NO: 8244627 - DNA, 22 bp, Homo sapiens
ttaaaccatagtttaacataag

SEQ ID NO: 8244628 - DNA, 22 bp, Homo sapiens
ttaaaccatagtttaacataag

SEQ ID NO: 8244629 - DNA, 17 bp, Homo sapiens
ttaaaccataaagaagg

SEQ ID NO: 8244630 - DNA, 22 bp, Homo sapiens
ttaaaccatagtttaacataag

SEQ ID NO: 8244631 - DNA, 17 bp, Homo sapiens
ttaaaccataaagaagg

SEQ ID NO: 8244632 - DNA, 22 bp, Homo sapiens
ttaaacatttttgatgatcgat

SEQ ID NO: 8244633 - DNA, 22 bp, Homo sapiens
ttaaacatttttgatgatcgat

SEQ ID NO: 8244634 - DNA, 22 bp, Homo sapiens
ttaaacatttatggaggcagca

SEQ ID NO: 8244635 - DNA, 22 bp, Homo sapiens
ttaaacagtatatctgagcaag

SEQ ID NO: 8244636 - DNA, 22 bp, Homo sapiens
ttaaacagagtctgaaatgtaa

SEQ ID NO: 8244637 - DNA, 22 bp, Homo sapiens
ttaaacagacagtaaatgaaac

SEQ ID NO: 8244638 - DNA, 22 bp, Homo sapiens
ttaaacactgggggttaatgca

SEQ ID NO: 8244639 - DNA, 22 bp, Homo sapiens
ttaaaagaatcctgttatcctc

SEQ ID NO: 8244640 - DNA, 22 bp, Homo sapiens
ttaaaactgcaaatcctactga

SEQ ID NO: 8244641 - DNA, 22 bp, Homo sapiens
ttaaaactgcaaatcctactga

SEQ ID NO: 8244642 - DNA, 22 bp, Homo sapiens
ttaaaacagcgtgaatctggca

SEQ ID NO: 8244643 - DNA, 22 bp, Homo sapiens
ttaaaatgcagattatgactca

SEQ ID NO: 8244644 - DNA, 22 bp, Homo sapiens
ttaaaagagacttcctttgttt

SEQ ID NO: 8244645 - DNA, 22 bp, Homo sapiens
ttaaaagagacttcctttgttt

SEQ ID NO: 8244646 - DNA, 22 bp, Homo sapiens
ttaaaagacctgttgaggttag

SEQ ID NO: 8244647 - DNA, 22 bp, Homo sapiens
ttaaaatgcagattctgattca

SEQ ID NO: 8244648 - DNA, 22 bp, Homo sapiens
ttaaaatgcagattctgattca

SEQ ID NO: 8244649 - DNA, 22 bp, Homo sapiens
ttaaaatgcagattatgactca

SEQ ID NO: 8244650 - DNA, 22 bp, Homo sapiens
ttaaaaaccatcttcctttcct

SEQ ID NO: 8244651 - DNA, 20 bp, Homo sapiens
ttaaaaagagtcacaggaga

SEQ ID NO: 8244652 - DNA, 22 bp, Homo sapiens
ttaaaaatatgtagggcccgat

SEQ ID NO: 8244653 - DNA, 22 bp, Homo sapiens
ttaaaaatatgtagggcccgat

SEQ ID NO: 8244654 - DNA, 22 bp, Homo sapiens
tgtttttgttcaatgctaggtc

SEQ ID NO: 8244655 - DNA, 22 bp, Homo sapiens
tgttgactcaacactgtgggca

SEQ ID NO: 8244656 - DNA, 22 bp, Homo sapiens
tgttgactcaacactgtgggca

SEQ ID NO: 8244657 - DNA, 22 bp, Homo sapiens
tgttgagtatatacctacaagt

SEQ ID NO: 8244658 - DNA, 22 bp, Homo sapiens
tgttgaagataaagttctcatt

SEQ ID NO: 8244659 - DNA, 22 bp, Homo sapiens
tgttcttttctctaaactgata

SEQ ID NO: 8244660 - DNA, 22 bp, Homo sapiens
tgttgtactcaacagatgaatt

SEQ ID NO: 8244661 - DNA, 22 bp, Homo sapiens
tgttgtaatcattttatgaaaa

SEQ ID NO: 8244662 - DNA, 22 bp, Homo sapiens
tgttggtttaaaatgctgattt

SEQ ID NO: 8244663 - DNA, 22 bp, Homo sapiens
tgttggtgaagtctctctgctg

SEQ ID NO: 8244664 - DNA, 22 bp, Homo sapiens
tgttgtaaaatttgagatgtca

SEQ ID NO: 8244665 - DNA, 22 bp, Homo sapiens
tgttgggaattgtgagtaatgg

SEQ ID NO: 8244666 - DNA, 22 bp, Homo sapiens
tgttgttcagtctttgctggct

SEQ ID NO: 8244667 - DNA, 23 bp, Homo sapiens
tgttgtgactggatgctttgtcc

SEQ ID NO: 8244668 - DNA, 23 bp, Homo sapiens
tgttgtgactggatgctttgtcc

SEQ ID NO: 8244669 - DNA, 22 bp, Homo sapiens
tgttgttttctcatggagaata

SEQ ID NO: 8244670 - DNA, 22 bp, Homo sapiens
tgtttaaatagaacatactgca

SEQ ID NO: 8244671 - DNA, 22 bp, Homo sapiens
tgtttaaatagaacatactgca

SEQ ID NO: 8244672 - DNA, 22 bp, Homo sapiens
tgtttaaatagaacatactgca

SEQ ID NO: 8244673 - DNA, 22 bp, Homo sapiens
tgtttaaatagaacatactgca

SEQ ID NO: 8244674 - DNA, 22 bp, Homo sapiens
tgtttaagatccgtcagtcact

SEQ ID NO: 8244675 - DNA, 21 bp, Homo sapiens
tgtttactccctgcaagcacg

SEQ ID NO: 8244676 - DNA, 20 bp, Homo sapiens
tgtttactctagagggtaga

SEQ ID NO: 8244677 - DNA, 22 bp, Homo sapiens
tgtttactgcattctatttgct

SEQ ID NO: 8244678 - DNA, 22 bp, Homo sapiens
tgtttactcctgatatattttt

SEQ ID NO: 8244679 - DNA, 22 bp, Homo sapiens
tgtttattcatggctaatgaaa

SEQ ID NO: 8244680 - DNA, 22 bp, Homo sapiens
tgtttattcatggctaatgaaa

SEQ ID NO: 8244681 - DNA, 22 bp, Homo sapiens
tgtttattcatggctaatgaaa

SEQ ID NO: 8244682 - DNA, 22 bp, Homo sapiens
tgtttattcatggctaatgaaa

SEQ ID NO: 8244683 - DNA, 22 bp, Homo sapiens
tgtttatgtgtgtgcatatata

SEQ ID NO: 8244684 - DNA, 22 bp, Homo sapiens
tgtttattacagttcttggaat

SEQ ID NO: 8244685 - DNA, 22 bp, Homo sapiens
tgtttattacagttcttggaat

SEQ ID NO: 8244686 - DNA, 22 bp, Homo sapiens
tgtttattacagttcttggaat

SEQ ID NO: 8244687 - DNA, 22 bp, Homo sapiens
tgtttatgcatcgttaatacca

SEQ ID NO: 8244688 - DNA, 22 bp, Homo sapiens
tgtttatagggtctgtcacttg

SEQ ID NO: 8244689 - DNA, 22 bp, Homo sapiens
tgtttatagggtctgtcacttg

SEQ ID NO: 8244690 - DNA, 22 bp, Homo sapiens
tgtttatagggtctgtcacttg

SEQ ID NO: 8244691 - DNA, 22 bp, Homo sapiens
tgtttatagggtctgtcacttg

SEQ ID NO: 8244692 - DNA, 22 bp, Homo sapiens
tgtttatagggtctgtcacttg

SEQ ID NO: 8244693 - DNA, 22 bp, Homo sapiens
tgtttattgagtgcctactata

SEQ ID NO: 8244694 - DNA, 22 bp, Homo sapiens
tgtttattgagtgcctactata

SEQ ID NO: 8244695 - DNA, 22 bp, Homo sapiens
tgtttattgagtgcctactata

SEQ ID NO: 8244696 - DNA, 22 bp, Homo sapiens
tgtttattgagtgcctactata

SEQ ID NO: 8244697 - DNA, 18 bp, Homo sapiens
tgtttattctcctgacag

SEQ ID NO: 8244698 - DNA, 18 bp, Homo sapiens
tgtttattctcctgacag

SEQ ID NO: 8244699 - DNA, 18 bp, Homo sapiens
tgtttattctcctgacag

SEQ ID NO: 8244700 - DNA, 18 bp, Homo sapiens
tgtttattctcctgacag

SEQ ID NO: 8244701 - DNA, 18 bp, Homo sapiens
tgtttattctcctgacag

SEQ ID NO: 8244702 - DNA, 18 bp, Homo sapiens
tgtttattctcctgacag

SEQ ID NO: 8244703 - DNA, 22 bp, Homo sapiens
tgtttattgctgcaattgtgcc

SEQ ID NO: 8244704 - DNA, 22 bp, Homo sapiens
tgtttattttcaggatggattg

SEQ ID NO: 8244705 - DNA, 22 bp, Homo sapiens
tgtttattttcaggatggattg

SEQ ID NO: 8244706 - DNA, 22 bp, Homo sapiens
tgtttattttcaggatggattg

SEQ ID NO: 8244707 - DNA, 22 bp, Homo sapiens
tgtttattgctgcaattgtgcc

SEQ ID NO: 8244708 - DNA, 22 bp, Homo sapiens
tgtttattgctgcaattgtgcc

SEQ ID NO: 8244709 - DNA, 22 bp, Homo sapiens
tgtttattgctgcaattgtgcc

SEQ ID NO: 8244710 - DNA, 22 bp, Homo sapiens
tgtttattgctgcaattgtgcc

SEQ ID NO: 8244711 - DNA, 22 bp, Homo sapiens
tgtttattgcagtgctgggctg

SEQ ID NO: 8244712 - DNA, 22 bp, Homo sapiens
tgtttattgcagtgctgggctg

SEQ ID NO: 8244713 - DNA, 22 bp, Homo sapiens
tgttcttgagcctttagaccta

SEQ ID NO: 8244714 - DNA, 22 bp, Homo sapiens
tgttcttgagcctttagaccta

SEQ ID NO: 8244715 - DNA, 22 bp, Homo sapiens
tgttcttatggctatttctccc

SEQ ID NO: 8244716 - DNA, 22 bp, Homo sapiens
tgttcttgagcctttagaccta

SEQ ID NO: 8244717 - DNA, 22 bp, Homo sapiens
tgttcttgagcctttagaccta

SEQ ID NO: 8244718 - DNA, 22 bp, Homo sapiens
tgttcttgagcctttagaccta

SEQ ID NO: 8244719 - DNA, 22 bp, Homo sapiens
tgttcttgggaatcttacagtt

SEQ ID NO: 8244720 - DNA, 22 bp, Homo sapiens
tgttctttcagttagacacagt

SEQ ID NO: 8244721 - DNA, 22 bp, Homo sapiens
tgttcttttctctaaactgata

SEQ ID NO: 8244722 - DNA, 22 bp, Homo sapiens
tgttctttggcttcctttccgt

SEQ ID NO: 8244723 - DNA, 22 bp, Homo sapiens
tgttctttggcttcacagctct

SEQ ID NO: 8244724 - DNA, 22 bp, Homo sapiens
tgttctttggcttcacagctct

SEQ ID NO: 8244725 - DNA, 22 bp, Homo sapiens
tgttctttggcttcacagctct

SEQ ID NO: 8244726 - DNA, 22 bp, Homo sapiens
tgttctttgccagtgatttaat

SEQ ID NO: 8244727 - DNA, 22 bp, Homo sapiens
tgttctttgccagtgatttaat

SEQ ID NO: 8244728 - DNA, 22 bp, Homo sapiens
tgttctttggcttcacagctct

SEQ ID NO: 8244729 - DNA, 22 bp, Homo sapiens
tgttctttgctgttgatgtaga

SEQ ID NO: 8244730 - DNA, 22 bp, Homo sapiens
tgttcttagcatgcaaaatatg

SEQ ID NO: 8244731 - DNA, 22 bp, Homo sapiens
tgttcttaacttttgtgtatat

SEQ ID NO: 8244732 - DNA, 22 bp, Homo sapiens
tgttcttaacttttgtgtatat

SEQ ID NO: 8244733 - DNA, 17 bp, Homo sapiens
tgttctgttggaaagca

SEQ ID NO: 8244734 - DNA, 22 bp, Homo sapiens
tgttctgttttatggtagggaa

SEQ ID NO: 8244735 - DNA, 22 bp, Homo sapiens
tgttaggcccatctctgaaggt

SEQ ID NO: 8244736 - DNA, 22 bp, Homo sapiens
tgttaggagcttcctgggctga

SEQ ID NO: 8244737 - DNA, 22 bp, Homo sapiens
tgttactgagtaatgtatagat

SEQ ID NO: 8244738 - DNA, 18 bp, Homo sapiens
tgttactgagttatgttc

SEQ ID NO: 8244739 - DNA, 22 bp, Homo sapiens
tgttactgatttgatatacagt

SEQ ID NO: 8244740 - DNA, 22 bp, Homo sapiens
tgttactgtctcatcattggat

SEQ ID NO: 8244741 - DNA, 22 bp, Homo sapiens
tgttaaggagacacatgaaaaa

SEQ ID NO: 8244742 - DNA, 22 bp, Homo sapiens
tgttaagcgacatactgaagga

SEQ ID NO: 8244743 - DNA, 22 bp, Homo sapiens
tgttaacttgcaagctgaagaa

SEQ ID NO: 8244744 - DNA, 22 bp, Homo sapiens
tgttaaatgttttgctagtgtc

SEQ ID NO: 8244745 - DNA, 22 bp, Homo sapiens
tgttaaatgttcctttactgga

SEQ ID NO: 8244746 - DNA, 22 bp, Homo sapiens
tgttaaattgattcacctttct

SEQ ID NO: 8244747 - DNA, 18 bp, Homo sapiens
tgttaaatgaagatttgc

SEQ ID NO: 8244748 - DNA, 22 bp, Homo sapiens
tgttaaatgagattggaatttg

SEQ ID NO: 8244749 - DNA, 18 bp, Homo sapiens
tgttaaatgaagatttgc

SEQ ID NO: 8244750 - DNA, 22 bp, Homo sapiens
tgttaaatgtattatgtgttct

SEQ ID NO: 8244751 - DNA, 22 bp, Homo sapiens
tgttaaatgagattggaatttg

SEQ ID NO: 8244752 - DNA, 23 bp, Homo sapiens
tgtggctgagaaattgacaactt

SEQ ID NO: 8244753 - DNA, 22 bp, Homo sapiens
tgtggctgactcctggtcccca

SEQ ID NO: 8244754 - DNA, 22 bp, Homo sapiens
tgtggctgactcctggtcccca

SEQ ID NO: 8244755 - DNA, 19 bp, Homo sapiens
tgtggctgagcactcctta

SEQ ID NO: 8244756 - DNA, 22 bp, Homo sapiens
tgtggctgatcaaagcgctcag

SEQ ID NO: 8244757 - DNA, 19 bp, Homo sapiens
tgtggctgagcactcctta

SEQ ID NO: 8244758 - DNA, 22 bp, Homo sapiens
tgtggctgatcaaagcgctcag

SEQ ID NO: 8244759 - DNA, 22 bp, Homo sapiens
tgtggctctcctcctgctgccc

SEQ ID NO: 8244760 - DNA, 22 bp, Homo sapiens
tgtggctctgccccctggtaag

SEQ ID NO: 8244761 - DNA, 22 bp, Homo sapiens
tgtggctctgcctggcagtatt

SEQ ID NO: 8244762 - DNA, 22 bp, Homo sapiens
tgtggctctgcctggcagtatt

SEQ ID NO: 8244763 - DNA, 21 bp, Homo sapiens
tgtggctgacaccctttggga

SEQ ID NO: 8244764 - DNA, 21 bp, Homo sapiens
tgtggctgacaccctttggga

SEQ ID NO: 8244765 - DNA, 22 bp, Homo sapiens
tgtggctcggccagctgctgaa

SEQ ID NO: 8244766 - DNA, 22 bp, Homo sapiens
tgtggaagggacactggactgg

SEQ ID NO: 8244767 - DNA, 22 bp, Homo sapiens
tgtggaagaacttcttgcttgg

SEQ ID NO: 8244768 - DNA, 22 bp, Homo sapiens
tgtggaagaacactggccaggc

SEQ ID NO: 8244769 - DNA, 22 bp, Homo sapiens
tgtggaagaacactggccaggc

SEQ ID NO: 8244770 - DNA, 22 bp, Homo sapiens
tgtggaagaaacaagacacttt

SEQ ID NO: 8244771 - DNA, 22 bp, Homo sapiens
tgtggaactagtattgtcttaa

SEQ ID NO: 8244772 - DNA, 22 bp, Homo sapiens
tgtggacaccactgggactgga

SEQ ID NO: 8244773 - DNA, 22 bp, Homo sapiens
tgtggacaagatgccaattgat

SEQ ID NO: 8244774 - DNA, 22 bp, Homo sapiens
tgtggaatgggagtgagaagac

SEQ ID NO: 8244775 - DNA, 22 bp, Homo sapiens
tgtggccttgcagcctggaggt

SEQ ID NO: 8244776 - DNA, 22 bp, Homo sapiens
tgtggcctttcaaggatggaat

SEQ ID NO: 8244777 - DNA, 22 bp, Homo sapiens
tgtgggaggaacacagccagaa

SEQ ID NO: 8244778 - DNA, 22 bp, Homo sapiens
tgtgggaggaattagaatggga

SEQ ID NO: 8244779 - DNA, 22 bp, Homo sapiens
tgtgggaggaattagaatggga

SEQ ID NO: 8244780 - DNA, 22 bp, Homo sapiens
tgtgggaatcagccaggggggc

SEQ ID NO: 8244781 - DNA, 22 bp, Homo sapiens
tgtgggaatgacgaggaagagg

SEQ ID NO: 8244782 - DNA, 22 bp, Homo sapiens
tgtgggaatgacgaggaagagg

SEQ ID NO: 8244783 - DNA, 22 bp, Homo sapiens
tgtgggagaaggaagcaagctg

SEQ ID NO: 8244784 - DNA, 23 bp, Homo sapiens
tgtgggaatgttggagaggaaac

SEQ ID NO: 8244785 - DNA, 23 bp, Homo sapiens
tgtgggaatgttggagaggaaac

SEQ ID NO: 8244786 - DNA, 22 bp, Homo sapiens
tgtgggaaatgggagtggaaga

SEQ ID NO: 8244787 - DNA, 22 bp, Homo sapiens
tgtggctgccaccctgaagccg

SEQ ID NO: 8244788 - DNA, 22 bp, Homo sapiens
tgtgggaaatgggagtggaaga

SEQ ID NO: 8244789 - DNA, 22 bp, Homo sapiens
tgtgggaagagcagtggcagca

SEQ ID NO: 8244790 - DNA, 22 bp, Homo sapiens
tgtgggaagtttggagggaaag

SEQ ID NO: 8244791 - DNA, 22 bp, Homo sapiens
tgtgggaagtttggagggaaag

SEQ ID NO: 8244792 - DNA, 22 bp, Homo sapiens
tgtgggaagatgttgcaggaga

SEQ ID NO: 8244793 - DNA, 22 bp, Homo sapiens
tgtgggaagatgttgcaggaga

SEQ ID NO: 8244794 - DNA, 22 bp, Homo sapiens
tgtggctgcaggcgatggagga

SEQ ID NO: 8244795 - DNA, 22 bp, Homo sapiens
tgtggctgccaccctgaagccg

SEQ ID NO: 8244796 - DNA, 22 bp, Homo sapiens
tgtggctgcaggcgatggagga

SEQ ID NO: 8244797 - DNA, 22 bp, Homo sapiens
tgtggctgcaaaggaaggctgc

SEQ ID NO: 8244798 - DNA, 22 bp, Homo sapiens
tgtggctgcaaaggaaggctgc

SEQ ID NO: 8244799 - DNA, 22 bp, Homo sapiens
tgtggctgcaaaggaaggctgc

SEQ ID NO: 8244800 - DNA, 22 bp, Homo sapiens
tgtggctgcagacactggagcc

SEQ ID NO: 8244801 - DNA, 22 bp, Homo sapiens
tgtggctgcagacactggagcc

SEQ ID NO: 8244802 - DNA, 22 bp, Homo sapiens
tgtgggcaggcccgggtctgag

SEQ ID NO: 8244803 - DNA, 22 bp, Homo sapiens
tgtgggcctcagcaggactcca

SEQ ID NO: 8244804 - DNA, 22 bp, Homo sapiens
tgtgggcctgggaaggtgacac

SEQ ID NO: 8244805 - DNA, 20 bp, Homo sapiens
tgtgggcccttggctggcaa

SEQ ID NO: 8244806 - DNA, 22 bp, Homo sapiens
tgtgggctccccctcactctgt

SEQ ID NO: 8244807 - DNA, 23 bp, Homo sapiens
tgtgggcgcattgtaagggtagc

SEQ ID NO: 8244808 - DNA, 22 bp, Homo sapiens
tgtgggctctaatggcagcaga

SEQ ID NO: 8244809 - DNA, 22 bp, Homo sapiens
tgtgggctctaatggcagcaga

SEQ ID NO: 8244810 - DNA, 22 bp, Homo sapiens
tgtgggctccccctcactctgt

SEQ ID NO: 8244811 - DNA, 22 bp, Homo sapiens
tgtgggctccccctcactctgt

SEQ ID NO: 8244812 - DNA, 22 bp, Homo sapiens
tgtgggctgtactgagggcagg

SEQ ID NO: 8244813 - DNA, 22 bp, Homo sapiens
tgtgggctctaatggcagcaga

SEQ ID NO: 8244814 - DNA, 19 bp, Homo sapiens
tgtgggctgggaaatgtct

SEQ ID NO: 8244815 - DNA, 22 bp, Homo sapiens
tgtgggcactaatgacatgcag

SEQ ID NO: 8244816 - DNA, 19 bp, Homo sapiens
tgtgggcaagggatggcag

SEQ ID NO: 8244817 - DNA, 22 bp, Homo sapiens
tgtgggcaaagggtagctgggt

SEQ ID NO: 8244818 - DNA, 22 bp, Homo sapiens
tgtgggcaaagggtagctgggt

SEQ ID NO: 8244819 - DNA, 22 bp, Homo sapiens
tgtgggaggtctggaaggctcc

SEQ ID NO: 8244820 - DNA, 22 bp, Homo sapiens
tgtgggaggtctggaaggctcc

SEQ ID NO: 8244821 - DNA, 22 bp, Homo sapiens
tgtgggaggtctggaaggctcc

SEQ ID NO: 8244822 - DNA, 22 bp, Homo sapiens
tgtgggaggtctggaaggctcc

SEQ ID NO: 8244823 - DNA, 22 bp, Homo sapiens
tgtgggaggattcagaattggg

SEQ ID NO: 8244824 - DNA, 22 bp, Homo sapiens
tgtgggaggattcagaattggg

SEQ ID NO: 8244825 - DNA, 22 bp, Homo sapiens
tgtgggaggaattagaatggga

SEQ ID NO: 8244826 - DNA, 22 bp, Homo sapiens
tgtgggaggaattagaatggga

SEQ ID NO: 8244827 - DNA, 22 bp, Homo sapiens
tgtgtacaggccttgctagact

SEQ ID NO: 8244828 - DNA, 23 bp, Homo sapiens
tgtgtacatacatatgtacacac

SEQ ID NO: 8244829 - DNA, 22 bp, Homo sapiens
tgtgtacatatacacaaataca

SEQ ID NO: 8244830 - DNA, 22 bp, Homo sapiens
tgtgtacatatacacaaataca

SEQ ID NO: 8244831 - DNA, 22 bp, Homo sapiens
tgtgtacatatctatcctagat

SEQ ID NO: 8244832 - DNA, 22 bp, Homo sapiens
tgtgtacattgccttttaaagg

SEQ ID NO: 8244833 - DNA, 22 bp, Homo sapiens
tgtgtacatctcttctcacatt

SEQ ID NO: 8244834 - DNA, 22 bp, Homo sapiens
tgtgtacatctcttctcacatt

SEQ ID NO: 8244835 - DNA, 22 bp, Homo sapiens
tgtgtacatatctatcctagat

SEQ ID NO: 8244836 - DNA, 22 bp, Homo sapiens
tgtgtacatatctatcctagat

SEQ ID NO: 8244837 - DNA, 22 bp, Homo sapiens
tgtgtacaggaactgatcagat

SEQ ID NO: 8244838 - DNA, 22 bp, Homo sapiens
tgtgtacaggccttgctagact

SEQ ID NO: 8244839 - DNA, 22 bp, Homo sapiens
tgtgtacagcatggtccagcag

SEQ ID NO: 8244840 - DNA, 22 bp, Homo sapiens
tgtgtacacgagaggttatata

SEQ ID NO: 8244841 - DNA, 22 bp, Homo sapiens
tgtgtacagcaggatttctcaa

SEQ ID NO: 8244842 - DNA, 22 bp, Homo sapiens
tgtgtacacacagatatataca

SEQ ID NO: 8244843 - DNA, 22 bp, Homo sapiens
tgtgtacacacagatatataca

SEQ ID NO: 8244844 - DNA, 22 bp, Homo sapiens
tgtgtacacatgacaggcaccc

SEQ ID NO: 8244845 - DNA, 22 bp, Homo sapiens
tgtgtacacatgacaggcaccc

SEQ ID NO: 8244846 - DNA, 22 bp, Homo sapiens
tgtgtacaagagtgtttactgt

SEQ ID NO: 8244847 - DNA, 22 bp, Homo sapiens
tgtggggactgagtggaggctt

SEQ ID NO: 8244848 - DNA, 22 bp, Homo sapiens
tgtggggactgagtggaggctt

SEQ ID NO: 8244849 - DNA, 22 bp, Homo sapiens
tgtgtacacaatgattgcagag

SEQ ID NO: 8244850 - DNA, 23 bp, Homo sapiens
tgtgtacacaatagatgaggttt

SEQ ID NO: 8244851 - DNA, 23 bp, Homo sapiens
tgtgtacacaatagatgaggttt

SEQ ID NO: 8244852 - DNA, 22 bp, Homo sapiens
tgtgtacacaagtatatataca

SEQ ID NO: 8244853 - DNA, 22 bp, Homo sapiens
tgtgtacacaagtatatataca

SEQ ID NO: 8244854 - DNA, 22 bp, Homo sapiens
tgtgggctttggagtcaggaag

SEQ ID NO: 8244855 - DNA, 20 bp, Homo sapiens
tgtgggctttgaaatgtgtg

SEQ ID NO: 8244856 - DNA, 22 bp, Homo sapiens
tgtggggaagagtatgacttgg

SEQ ID NO: 8244857 - DNA, 22 bp, Homo sapiens
tgtggggacccatgccatgggc

SEQ ID NO: 8244858 - DNA, 22 bp, Homo sapiens
tgtggggacccatgccatgggc

SEQ ID NO: 8244859 - DNA, 22 bp, Homo sapiens
tgtggggacccatgccatgggc

SEQ ID NO: 8244860 - DNA, 22 bp, Homo sapiens
tgtggggactgagtggaggctt

SEQ ID NO: 8244861 - DNA, 22 bp, Homo sapiens
tgtggggactgagtggaggctt

SEQ ID NO: 8244862 - DNA, 22 bp, Homo sapiens
tgtggggactgagtggaggctt

SEQ ID NO: 8244863 - DNA, 22 bp, Homo sapiens
tgtggggactgagtggaggctt

SEQ ID NO: 8244864 - DNA, 22 bp, Homo sapiens
tgttaaaaattcagctctagat

SEQ ID NO: 8244865 - DNA, 22 bp, Homo sapiens
tgttaaacctagtacaggtcct

SEQ ID NO: 8244866 - DNA, 22 bp, Homo sapiens
tgttaaagtggataagctgaat

SEQ ID NO: 8244867 - DNA, 22 bp, Homo sapiens
tgttaaagtggataagctgaat

SEQ ID NO: 8244868 - DNA, 18 bp, Homo sapiens
tgttaaatgaagatttgc

SEQ ID NO: 8244869 - DNA, 19 bp, Homo sapiens
tgtgtgtttatatatgtat

SEQ ID NO: 8244870 - DNA, 19 bp, Homo sapiens
tgtgtgtttatatatgtat

SEQ ID NO: 8244871 - DNA, 19 bp, Homo sapiens
tgtgtgtttatatatgtat

SEQ ID NO: 8244872 - DNA, 22 bp, Homo sapiens
tgtgttaagtatttgatacact

SEQ ID NO: 8244873 - DNA, 22 bp, Homo sapiens
tgtgtgtgtttataaatctaaa

SEQ ID NO: 8244874 - DNA, 22 bp, Homo sapiens
tgtgtgtgtttataaatctaaa

SEQ ID NO: 8244875 - DNA, 22 bp, Homo sapiens
tgtgtgtgtttacagtttctca

SEQ ID NO: 8244876 - DNA, 22 bp, Homo sapiens
tgtgtgtgtttacagtttctca

SEQ ID NO: 8244877 - DNA, 22 bp, Homo sapiens
tgtgtgtgttcctcctcagcta

SEQ ID NO: 8244878 - DNA, 22 bp, Homo sapiens
tgtgtgtgtttacagtttctca

SEQ ID NO: 8244879 - DNA, 22 bp, Homo sapiens
tgtgtgttatcttagttcatct

SEQ ID NO: 8244880 - DNA, 22 bp, Homo sapiens
tgtgtgtgtttctgctcataca

SEQ ID NO: 8244881 - DNA, 22 bp, Homo sapiens
tgtgtgtgtttctgctcataca

SEQ ID NO: 8244882 - DNA, 22 bp, Homo sapiens
tgtgtgttattttcagccatta

SEQ ID NO: 8244883 - DNA, 22 bp, Homo sapiens
tgtgtgttggctggagagggct

SEQ ID NO: 8244884 - DNA, 22 bp, Homo sapiens
tgtgtgtgttcctcctcagcta

SEQ ID NO: 8244885 - DNA, 22 bp, Homo sapiens
tgtgtgtgtgcgcgcacgcata

SEQ ID NO: 8244886 - DNA, 22 bp, Homo sapiens
tgtgtgtgtcctcatttgcaga

SEQ ID NO: 8244887 - DNA, 22 bp, Homo sapiens
tgtgtgtgtcctcatttgcaga

SEQ ID NO: 8244888 - DNA, 22 bp, Homo sapiens
tgtgtgtgtgcgcgcacgcata

SEQ ID NO: 8244889 - DNA, 22 bp, Homo sapiens
tgtgtgtgtgcgcgcacgcata

SEQ ID NO: 8244890 - DNA, 20 bp, Homo sapiens
tgtgtgtgtacttctaaata

SEQ ID NO: 8244891 - DNA, 22 bp, Homo sapiens
tgtgtgtgtaaaagcatttata

SEQ ID NO: 8244892 - DNA, 20 bp, Homo sapiens
tgtgtgtgtacttctaaata

SEQ ID NO: 8244893 - DNA, 20 bp, Homo sapiens
tgtgtgtgtacttctaaata

SEQ ID NO: 8244894 - DNA, 23 bp, Homo sapiens
tgtgtgtgtattctacgcaaggt

SEQ ID NO: 8244895 - DNA, 23 bp, Homo sapiens
tgtgtgtgtattctacgcaaggt

SEQ ID NO: 8244896 - DNA, 22 bp, Homo sapiens
tgtgtgtgggcggaacggcccc

SEQ ID NO: 8244897 - DNA, 21 bp, Homo sapiens
tgtgtgtgcaggcacacacac

SEQ ID NO: 8244898 - DNA, 22 bp, Homo sapiens
tgtgtgtgggcggaacggcccc

SEQ ID NO: 8244899 - DNA, 22 bp, Homo sapiens
tgtgtgtggggaggcagcagat

SEQ ID NO: 8244900 - DNA, 22 bp, Homo sapiens
tgtgtgtggggaggcagcagat

SEQ ID NO: 8244901 - DNA, 22 bp, Homo sapiens
tgtgtgtggggaggcagcagat

SEQ ID NO: 8244902 - DNA, 22 bp, Homo sapiens
tgtgtgtgtaaaagcatttata

SEQ ID NO: 8244903 - DNA, 22 bp, Homo sapiens
tgtgtgtgcacgtgcgcgcgag

SEQ ID NO: 8244904 - DNA, 22 bp, Homo sapiens
tgtgtgtgcaggagagcaggtg

SEQ ID NO: 8244905 - DNA, 22 bp, Homo sapiens
tgtgtgtgcacgtgcgcgcgag

SEQ ID NO: 8244906 - DNA, 22 bp, Homo sapiens
tgtgtgtgcaggagagcaggtg

SEQ ID NO: 8244907 - DNA, 22 bp, Homo sapiens
tgtgtgtgcaggagagcaggtg

SEQ ID NO: 8244908 - DNA, 21 bp, Homo sapiens
tgtgtgtgcaggcacacacac

SEQ ID NO: 8244909 - DNA, 22 bp, Homo sapiens
tgtgtgggagcacgggctgttg

SEQ ID NO: 8244910 - DNA, 22 bp, Homo sapiens
tgtgtgggagcacgggctgttg

SEQ ID NO: 8244911 - DNA, 22 bp, Homo sapiens
tgtgtgggagcacgggctgttg

SEQ ID NO: 8244912 - DNA, 22 bp, Homo sapiens
tgtgtggattcatctcaaagag

SEQ ID NO: 8244913 - DNA, 22 bp, Homo sapiens
tgtgtggattcatctcaaagag

SEQ ID NO: 8244914 - DNA, 22 bp, Homo sapiens
tgtgtggattcatctcaaagag

SEQ ID NO: 8244915 - DNA, 22 bp, Homo sapiens
tgtgtggattcatctcaaagag

SEQ ID NO: 8244916 - DNA, 22 bp, Homo sapiens
tgtgtgctcgatggccctgcag

SEQ ID NO: 8244917 - DNA, 22 bp, Homo sapiens
tgtgtgtgacaacctagttcag

SEQ ID NO: 8244918 - DNA, 22 bp, Homo sapiens
tgtgtgtgacaacctagttcag

SEQ ID NO: 8244919 - DNA, 22 bp, Homo sapiens
tgtgtgtgacaacctagttcag

SEQ ID NO: 8244920 - DNA, 22 bp, Homo sapiens
tgtgtgtgaaccattgagggct

SEQ ID NO: 8244921 - DNA, 22 bp, Homo sapiens
tgtgtgtgaaccattgagggct

SEQ ID NO: 8244922 - DNA, 22 bp, Homo sapiens
tgtgtgtgaaccattgagggct

SEQ ID NO: 8244923 - DNA, 22 bp, Homo sapiens
tgtgtgtgagtcctggctttcc

SEQ ID NO: 8244924 - DNA, 22 bp, Homo sapiens
tgtgtgtgagtcctggctttcc

SEQ ID NO: 8244925 - DNA, 22 bp, Homo sapiens
tgtgtgtgactcatactagaac

SEQ ID NO: 8244926 - DNA, 22 bp, Homo sapiens
tgtgtgtgactcatactagaac

SEQ ID NO: 8244927 - DNA, 22 bp, Homo sapiens
tgtgtgtgagtcctggctttcc

SEQ ID NO: 8244928 - DNA, 22 bp, Homo sapiens
tgtgtgtgagtcctggctttcc

SEQ ID NO: 8244929 - DNA, 22 bp, Homo sapiens
tgtgtgtgagtcctggctttcc

SEQ ID NO: 8244930 - DNA, 22 bp, Homo sapiens
tgtgtgtgcacatgcatataca

SEQ ID NO: 8244931 - DNA, 22 bp, Homo sapiens
tgtgtgtgcacatgcatataca

SEQ ID NO: 8244932 - DNA, 22 bp, Homo sapiens
tgtgtgccagatacaagcactg

SEQ ID NO: 8244933 - DNA, 22 bp, Homo sapiens
tgtgtgcattcacatgcatgcc

SEQ ID NO: 8244934 - DNA, 22 bp, Homo sapiens
tgtgtcagaatttttgtggcaa

SEQ ID NO: 8244935 - DNA, 22 bp, Homo sapiens
tgtgtcagaggtagagatggca

SEQ ID NO: 8244936 - DNA, 22 bp, Homo sapiens
tgtgtcagaggtagagatggca

SEQ ID NO: 8244937 - DNA, 22 bp, Homo sapiens
tgtgtgcctgagccgtgcctgg

SEQ ID NO: 8244938 - DNA, 22 bp, Homo sapiens
tgtgtgctaatgtatgctctaa

SEQ ID NO: 8244939 - DNA, 22 bp, Homo sapiens
tgtgtgctaatgtatgctctaa

SEQ ID NO: 8244940 - DNA, 22 bp, Homo sapiens
tgtgtgcctgagccgtgcctgg

SEQ ID NO: 8244941 - DNA, 19 bp, Homo sapiens
tgtgtgccctcaccacata

SEQ ID NO: 8244942 - DNA, 22 bp, Homo sapiens
tgtgtgccccagatgagtagct

SEQ ID NO: 8244943 - DNA, 22 bp, Homo sapiens
tgtgtgccagggcatgcacagg

SEQ ID NO: 8244944 - DNA, 22 bp, Homo sapiens
tgtgtgccagcctacgaggagc

SEQ ID NO: 8244945 - DNA, 22 bp, Homo sapiens
tgtgtatttctggaacagacta

SEQ ID NO: 8244946 - DNA, 22 bp, Homo sapiens
tgtgtattaccattttacagct

SEQ ID NO: 8244947 - DNA, 21 bp, Homo sapiens
tgtgtcactaactagaggcta

SEQ ID NO: 8244948 - DNA, 22 bp, Homo sapiens
tgtgtcagaaatcagtgcctcg

SEQ ID NO: 8244949 - DNA, 22 bp, Homo sapiens
tgtgtcagaaatcagtgcctcg

SEQ ID NO: 8244950 - DNA, 22 bp, Homo sapiens
tgtgtcagaaggcaatggggat

SEQ ID NO: 8244951 - DNA, 22 bp, Homo sapiens
tgtgtcagaaggcaatggggat

SEQ ID NO: 8244952 - DNA, 22 bp, Homo sapiens
tgtgtcagaatttttgtggcaa

SEQ ID NO: 8244953 - DNA, 22 bp, Homo sapiens
tgtgtcagaagtacttttggaa

SEQ ID NO: 8244954 - DNA, 22 bp, Homo sapiens
tgtgtcagaagtacttttggaa

SEQ ID NO: 8244955 - DNA, 22 bp, Homo sapiens
tgtgtcaagacatttagtcatt

SEQ ID NO: 8244956 - DNA, 22 bp, Homo sapiens
tgtcttttctactgtaagcata

SEQ ID NO: 8244957 - DNA, 22 bp, Homo sapiens
tgtcttttgccaaagatcagtt

SEQ ID NO: 8244958 - DNA, 22 bp, Homo sapiens
tgtcttttgccaaagatcagtt

SEQ ID NO: 8244959 - DNA, 22 bp, Homo sapiens
tgtcttttgccaaagatcagtt

SEQ ID NO: 8244960 - DNA, 22 bp, Homo sapiens
tgtcttttagtttgtgagatct

SEQ ID NO: 8244961 - DNA, 22 bp, Homo sapiens
tgtcttttataactgacatata

SEQ ID NO: 8244962 - DNA, 22 bp, Homo sapiens
tgtcttttacctaatgagctgg

SEQ ID NO: 8244963 - DNA, 22 bp, Homo sapiens
tgtctttgttattgtggacagg

SEQ ID NO: 8244964 - DNA, 23 bp, Homo sapiens
tgtctttgttaggactgtgttta

SEQ ID NO: 8244965 - DNA, 22 bp, Homo sapiens
tgtctttgtgtacaggatcgcc

SEQ ID NO: 8244966 - DNA, 19 bp, Homo sapiens
tgtctttggtctgagtttc

SEQ ID NO: 8244967 - DNA, 19 bp, Homo sapiens
tgtctttggtctgagtttc

SEQ ID NO: 8244968 - DNA, 22 bp, Homo sapiens
tgtctttttactatgttcaatc

SEQ ID NO: 8244969 - DNA, 22 bp, Homo sapiens
tgtgaaaaaagttctagaagga

SEQ ID NO: 8244970 - DNA, 22 bp, Homo sapiens
tgtgaaaaaagttctagaagga

SEQ ID NO: 8244971 - DNA, 22 bp, Homo sapiens
tgtcttttggagcatctttctt

SEQ ID NO: 8244972 - DNA, 22 bp, Homo sapiens
tgtgaaaagggctttgtacaaa

SEQ ID NO: 8244973 - DNA, 22 bp, Homo sapiens
tgtgaaaagggctttgtacaaa

SEQ ID NO: 8244974 - DNA, 22 bp, Homo sapiens
tgtgaaaagggctttgtacaaa

SEQ ID NO: 8244975 - DNA, 22 bp, Homo sapiens
tgtgaaaagcgtgtgttctagg

SEQ ID NO: 8244976 - DNA, 22 bp, Homo sapiens
tgtgaaaagcgtgtgttctagg

SEQ ID NO: 8244977 - DNA, 22 bp, Homo sapiens
tgtgaaaagcaggctactttct

SEQ ID NO: 8244978 - DNA, 22 bp, Homo sapiens
tgtgaaaagcaggctactttct

SEQ ID NO: 8244979 - DNA, 22 bp, Homo sapiens
tgtcttcagtaaaatacactat

SEQ ID NO: 8244980 - DNA, 22 bp, Homo sapiens
tgtcttcagtaaaatacactat

SEQ ID NO: 8244981 - DNA, 22 bp, Homo sapiens
tgtcttcatctccatgcacaga

SEQ ID NO: 8244982 - DNA, 22 bp, Homo sapiens
tgtcttcatctccatgcacaga

SEQ ID NO: 8244983 - DNA, 21 bp, Homo sapiens
tgtcttcatatgagatggtgt

SEQ ID NO: 8244984 - DNA, 21 bp, Homo sapiens
tgtcttcatatgagatggtgt

SEQ ID NO: 8244985 - DNA, 22 bp, Homo sapiens
tgtcttcatctcagacacagtt

SEQ ID NO: 8244986 - DNA, 22 bp, Homo sapiens
tgtcttcattctgtatgtccag

SEQ ID NO: 8244987 - DNA, 23 bp, Homo sapiens
tgtcttcgactcctgcgtgcttc

SEQ ID NO: 8244988 - DNA, 22 bp, Homo sapiens
tgtcttcatggcggaacaactt

SEQ ID NO: 8244989 - DNA, 22 bp, Homo sapiens
tgtcttcatgcctgaaagaaga

SEQ ID NO: 8244990 - DNA, 22 bp, Homo sapiens
tgtcttcatggcggaacaactt

SEQ ID NO: 8244991 - DNA, 20 bp, Homo sapiens
tgtcttcattatggtgccct

SEQ ID NO: 8244992 - DNA, 22 bp, Homo sapiens
tgtcttcattccccatgaagtc

SEQ ID NO: 8244993 - DNA, 22 bp, Homo sapiens
tgtctttaaaattaaacacatc

SEQ ID NO: 8244994 - DNA, 23 bp, Homo sapiens
tgtcttggtttcttcaccctagt

SEQ ID NO: 8244995 - DNA, 22 bp, Homo sapiens
tgtcttgtctgtgagggcattg

SEQ ID NO: 8244996 - DNA, 22 bp, Homo sapiens
tgtcttctgtattcaagtctat

SEQ ID NO: 8244997 - DNA, 17 bp, Homo sapiens
tgtcttctgaagagagc

SEQ ID NO: 8244998 - DNA, 22 bp, Homo sapiens
tgtcttctaccttgacagcatt

SEQ ID NO: 8244999 - DNA, 22 bp, Homo sapiens
tgtcttctaccttgacagcatt

SEQ ID NO: 8245000 - DNA, 22 bp, Homo sapiens
tgtcttaatttccctttgtcat

SEQ ID NO: 8245001 - DNA, 22 bp, Homo sapiens
tgtcttaatttggatgatgttt

SEQ ID NO: 8245002 - DNA, 19 bp, Homo sapiens
tgtcttaattaactcagag

SEQ ID NO: 8245003 - DNA, 22 bp, Homo sapiens
tgtctgttattggtgtataaga

SEQ ID NO: 8245004 - DNA, 22 bp, Homo sapiens
tgtctgttattggtgtataaga

SEQ ID NO: 8245005 - DNA, 22 bp, Homo sapiens
tgtcttaaacttgtgggacttc

SEQ ID NO: 8245006 - DNA, 22 bp, Homo sapiens
tgtctgtgatttaggccagggc

SEQ ID NO: 8245007 - DNA, 22 bp, Homo sapiens
tgtctgtgatttaggccagggc

SEQ ID NO: 8245008 - DNA, 22 bp, Homo sapiens
tgtctgtggcaattgtgggtaa

SEQ ID NO: 8245009 - DNA, 22 bp, Homo sapiens
tgtctgtggcaattgtgggtaa

SEQ ID NO: 8245010 - DNA, 22 bp, Homo sapiens
tgtcttcaggagtaaatatcat

SEQ ID NO: 8245011 - DNA, 22 bp, Homo sapiens
tgtcttcaggagtaaatatcat

SEQ ID NO: 8245012 - DNA, 22 bp, Homo sapiens
tgtcttcagaattaagagtatg

SEQ ID NO: 8245013 - DNA, 22 bp, Homo sapiens
tgtcttcagaattaagagtatg

SEQ ID NO: 8245014 - DNA, 22 bp, Homo sapiens
tgtcttcagataggcattcttc

SEQ ID NO: 8245015 - DNA, 22 bp, Homo sapiens
tgtcttcacaaagcagaaggga

SEQ ID NO: 8245016 - DNA, 22 bp, Homo sapiens
tgtcttcacaaagcagaaggga

SEQ ID NO: 8245017 - DNA, 22 bp, Homo sapiens
tgtcttcacatgataagccatt

SEQ ID NO: 8245018 - DNA, 22 bp, Homo sapiens
tgtcttcacatgataagccatt

SEQ ID NO: 8245019 - DNA, 22 bp, Homo sapiens
tgtcttatgtagatactgagaa

SEQ ID NO: 8245020 - DNA, 22 bp, Homo sapiens
tgtctgtgacctctttggagcc

SEQ ID NO: 8245021 - DNA, 22 bp, Homo sapiens
tgtctgtgacctctttggagcc

SEQ ID NO: 8245022 - DNA, 22 bp, Homo sapiens
tgtctgtgacctcttaggcaag

SEQ ID NO: 8245023 - DNA, 22 bp, Homo sapiens
tgtctgtgacctcttaggcaag

SEQ ID NO: 8245024 - DNA, 22 bp, Homo sapiens
tgtctgtgacagacctttgcta

SEQ ID NO: 8245025 - DNA, 23 bp, Homo sapiens
tgtctggattcgactgtggttgg

SEQ ID NO: 8245026 - DNA, 22 bp, Homo sapiens
tgtctggattgctgagccccag

SEQ ID NO: 8245027 - DNA, 22 bp, Homo sapiens
tgtctggatgtctggagcatcg

SEQ ID NO: 8245028 - DNA, 20 bp, Homo sapiens
tgtctggatgtttaagcaga

SEQ ID NO: 8245029 - DNA, 23 bp, Homo sapiens
tgtctggctcatggtgggtctca

SEQ ID NO: 8245030 - DNA, 22 bp, Homo sapiens
tgtctgggagggacagggctac

SEQ ID NO: 8245031 - DNA, 22 bp, Homo sapiens
tgtctgggagggacagggctac

SEQ ID NO: 8245032 - DNA, 22 bp, Homo sapiens
tgtctgggagggacagggctac

SEQ ID NO: 8245033 - DNA, 22 bp, Homo sapiens
tgtctggatagagcctaggccc

SEQ ID NO: 8245034 - DNA, 23 bp, Homo sapiens
tgtctggagttttgcactgttgc

SEQ ID NO: 8245035 - DNA, 22 bp, Homo sapiens
tgtctggaggtcaggtcctggg

SEQ ID NO: 8245036 - DNA, 22 bp, Homo sapiens
tgtctggatcagtgggtgcttg

SEQ ID NO: 8245037 - DNA, 22 bp, Homo sapiens
tgtctggatggtggagattgag

SEQ ID NO: 8245038 - DNA, 22 bp, Homo sapiens
tgtctggatggtggagattgag

SEQ ID NO: 8245039 - DNA, 22 bp, Homo sapiens
tgtctggacattgacaatcatg

SEQ ID NO: 8245040 - DNA, 22 bp, Homo sapiens
tgtctggactgctcacagtacc

SEQ ID NO: 8245041 - DNA, 23 bp, Homo sapiens
tgtctggagagggcttgctctcc

SEQ ID NO: 8245042 - DNA, 22 bp, Homo sapiens
tgtctggaggggatgttatggt

SEQ ID NO: 8245043 - DNA, 22 bp, Homo sapiens
tgtctggagggctggctccctg

SEQ ID NO: 8245044 - DNA, 23 bp, Homo sapiens
tgtctggagcctgagcaggtgct

SEQ ID NO: 8245045 - DNA, 23 bp, Homo sapiens
tgtctggagcctgagcaggtgct

SEQ ID NO: 8245046 - DNA, 22 bp, Homo sapiens
tgtctggaagtaccagggaagc

SEQ ID NO: 8245047 - DNA, 22 bp, Homo sapiens
tgtctggaatttctattttgtc

SEQ ID NO: 8245048 - DNA, 22 bp, Homo sapiens
tgtctggaagggctatgtgacc

SEQ ID NO: 8245049 - DNA, 22 bp, Homo sapiens
tgtctggacagagattctcaat

SEQ ID NO: 8245050 - DNA, 22 bp, Homo sapiens
tgtctggacagagattctcaat

SEQ ID NO: 8245051 - DNA, 22 bp, Homo sapiens
tgtctggacattgacaatcatg

SEQ ID NO: 8245052 - DNA, 22 bp, Homo sapiens
tgtctgctggttgggagcttaa

SEQ ID NO: 8245053 - DNA, 19 bp, Homo sapiens
tgtctgctgatgactctat

SEQ ID NO: 8245054 - DNA, 19 bp, Homo sapiens
tgtctggaagagctgcagg

SEQ ID NO: 8245055 - DNA, 19 bp, Homo sapiens
tgtctggaagagctgcagg

SEQ ID NO: 8245056 - DNA, 19 bp, Homo sapiens
tgtctggaagagctgcagg

SEQ ID NO: 8245057 - DNA, 19 bp, Homo sapiens
tgtctggaagagctgcagg

SEQ ID NO: 8245058 - DNA, 22 bp, Homo sapiens
tgtctgcctgtctctgtgcaaa

SEQ ID NO: 8245059 - DNA, 21 bp, Homo sapiens
tgtctgcctgcttcttcactc

SEQ ID NO: 8245060 - DNA, 22 bp, Homo sapiens
tgtctgcctgcgggccggcaca

SEQ ID NO: 8245061 - DNA, 22 bp, Homo sapiens
tgtctgatgatagtgtctctcc

SEQ ID NO: 8245062 - DNA, 22 bp, Homo sapiens
tgtctgatcatgaggcagggct

SEQ ID NO: 8245063 - DNA, 22 bp, Homo sapiens
tgtctgagtgtgcctgggcatt

SEQ ID NO: 8245064 - DNA, 22 bp, Homo sapiens
tgtctgagtggtgcaaggctga

SEQ ID NO: 8245065 - DNA, 22 bp, Homo sapiens
tgtctgccaaagcttcctcctg

SEQ ID NO: 8245066 - DNA, 22 bp, Homo sapiens
tgtctgaggaagtcagcccttt

SEQ ID NO: 8245067 - DNA, 19 bp, Homo sapiens
tgtctgagtatgctgacaa

SEQ ID NO: 8245068 - DNA, 22 bp, Homo sapiens
tgtctgagactgttttactttc

SEQ ID NO: 8245069 - DNA, 22 bp, Homo sapiens
tgtctgagctggggcagacaga

SEQ ID NO: 8245070 - DNA, 22 bp, Homo sapiens
tgtctgagctgcacagaagtaa

SEQ ID NO: 8245071 - DNA, 22 bp, Homo sapiens
tgtctctttgggttcctcttgg

SEQ ID NO: 8245072 - DNA, 22 bp, Homo sapiens
tgtctctttgggttcctcttgg

SEQ ID NO: 8245073 - DNA, 22 bp, Homo sapiens
tgtctctttgggttcctcttgg

SEQ ID NO: 8245074 - DNA, 22 bp, Homo sapiens
tgtctcttttcaagctaccctt

SEQ ID NO: 8245075 - DNA, 22 bp, Homo sapiens
tgtctctgctttccttgcaggg

SEQ ID NO: 8245076 - DNA, 22 bp, Homo sapiens
tgtctctgctgcaccttctggg

SEQ ID NO: 8245077 - DNA, 22 bp, Homo sapiens
tgtctctgctttccttgcaggg

SEQ ID NO: 8245078 - DNA, 22 bp, Homo sapiens
tgtctctgctttccttgcaggg

SEQ ID NO: 8245079 - DNA, 22 bp, Homo sapiens
tgtctcttgttaatgattacta

SEQ ID NO: 8245080 - DNA, 22 bp, Homo sapiens
tgtctcttggctctatcactta

SEQ ID NO: 8245081 - DNA, 22 bp, Homo sapiens
tgtctctggcccatgagcagag

SEQ ID NO: 8245082 - DNA, 22 bp, Homo sapiens
tgtctctggcccatgagcagag

SEQ ID NO: 8245083 - DNA, 22 bp, Homo sapiens
tgtctctgaacagcttactaaa

SEQ ID NO: 8245084 - DNA, 22 bp, Homo sapiens
tgtctctgaaatatgtggctcc

SEQ ID NO: 8245085 - DNA, 22 bp, Homo sapiens
tgtctctgaactgggttttctt

SEQ ID NO: 8245086 - DNA, 22 bp, Homo sapiens
tgtctctgaagccccctccttt

SEQ ID NO: 8245087 - DNA, 19 bp, Homo sapiens
tgtctctgaaagatgagct

SEQ ID NO: 8245088 - DNA, 22 bp, Homo sapiens
tgtctctgaaatatgtggctcc

SEQ ID NO: 8245089 - DNA, 22 bp, Homo sapiens
tgtctctgaaatatgtggctcc

SEQ ID NO: 8245090 - DNA, 22 bp, Homo sapiens
tgtctctgaaatatgtggctcc

SEQ ID NO: 8245091 - DNA, 22 bp, Homo sapiens
tgtctctctgcccccattgctc

SEQ ID NO: 8245092 - DNA, 22 bp, Homo sapiens
tgtctctctagctcttggtttg

SEQ ID NO: 8245093 - DNA, 22 bp, Homo sapiens
tgtctctctgcccccattgctc

SEQ ID NO: 8245094 - DNA, 22 bp, Homo sapiens
tgtctctgagatgactcccacc

SEQ ID NO: 8245095 - DNA, 18 bp, Homo sapiens
tgtctctgaattccagtg

SEQ ID NO: 8245096 - DNA, 18 bp, Homo sapiens
tgtctctgaattccagtg

SEQ ID NO: 8245097 - DNA, 22 bp, Homo sapiens
tgtctctgaggtgagggtcagc

SEQ ID NO: 8245098 - DNA, 22 bp, Homo sapiens
tgtctctgaggtgagggtcagc

SEQ ID NO: 8245099 - DNA, 22 bp, Homo sapiens
tgtctctgataagtagttcagt

SEQ ID NO: 8245100 - DNA, 22 bp, Homo sapiens
tgtctctgccagctagcagaat

SEQ ID NO: 8245101 - DNA, 22 bp, Homo sapiens
tgtctctgataagtagttcagt

SEQ ID NO: 8245102 - DNA, 22 bp, Homo sapiens
tgtctctgccagctagcagaat

SEQ ID NO: 8245103 - DNA, 22 bp, Homo sapiens
tgtctctgctgcaccttctggg

SEQ ID NO: 8245104 - DNA, 22 bp, Homo sapiens
tgtctctgctgcaccttctggg

SEQ ID NO: 8245105 - DNA, 22 bp, Homo sapiens
tgtctctgccagctagcagaat

SEQ ID NO: 8245106 - DNA, 22 bp, Homo sapiens
tgtctaaatgaaaagagatgcc

SEQ ID NO: 8245107 - DNA, 22 bp, Homo sapiens
tgtctaaacttgttttatctca

SEQ ID NO: 8245108 - DNA, 22 bp, Homo sapiens
tgtctaaatgcaatggatttcc

SEQ ID NO: 8245109 - DNA, 22 bp, Homo sapiens
tgtcggccacgagggagccgcg

SEQ ID NO: 8245110 - DNA, 22 bp, Homo sapiens
tgtctaaacttgttttatctca

SEQ ID NO: 8245111 - DNA, 22 bp, Homo sapiens
tgtctaaatgcaatggatttcc

SEQ ID NO: 8245112 - DNA, 22 bp, Homo sapiens
tgtctaatggcaatttcatgtg

SEQ ID NO: 8245113 - DNA, 22 bp, Homo sapiens
tgtctacagaatgttaatattt

SEQ ID NO: 8245114 - DNA, 22 bp, Homo sapiens
tgtctacagaatgttaatattt

SEQ ID NO: 8245115 - DNA, 22 bp, Homo sapiens
tgtctagggcgagaatgtgtag

SEQ ID NO: 8245116 - DNA, 23 bp, Homo sapiens
tgtctaggatcagtcaggatgag

SEQ ID NO: 8245117 - DNA, 22 bp, Homo sapiens
tgtctagaaatgctgagtctca

SEQ ID NO: 8245118 - DNA, 22 bp, Homo sapiens
tgtctacttgggctctacagca

SEQ ID NO: 8245119 - DNA, 22 bp, Homo sapiens
tgtctccatagagtagcttgat

SEQ ID NO: 8245120 - DNA, 22 bp, Homo sapiens
tgtctccatagaagagactgca

SEQ ID NO: 8245121 - DNA, 22 bp, Homo sapiens
tgtctccatagaagagactgca

SEQ ID NO: 8245122 - DNA, 20 bp, Homo sapiens
tgtctccagggctgagtgga

SEQ ID NO: 8245123 - DNA, 20 bp, Homo sapiens
tgtctccagggctgagtgga

SEQ ID NO: 8245124 - DNA, 22 bp, Homo sapiens
tgtctccaccatcatcttacca

SEQ ID NO: 8245125 - DNA, 22 bp, Homo sapiens
tgtctccacaggtgtcagctca

SEQ ID NO: 8245126 - DNA, 22 bp, Homo sapiens
tgtctccacaggtgtcagctca

SEQ ID NO: 8245127 - DNA, 22 bp, Homo sapiens
tgtctatacctgatacagagtt

SEQ ID NO: 8245128 - DNA, 22 bp, Homo sapiens
tgtctccaactcactgtatact

SEQ ID NO: 8245129 - DNA, 22 bp, Homo sapiens
tgtctccaactcactgtatact

SEQ ID NO: 8245130 - DNA, 22 bp, Homo sapiens
tgtctatgcaatggaaggactg

SEQ ID NO: 8245131 - DNA, 22 bp, Homo sapiens
tgtctccaaaacaatctcagat

SEQ ID NO: 8245132 - DNA, 22 bp, Homo sapiens
tgtctccaaaacaatctcagat

SEQ ID NO: 8245133 - DNA, 22 bp, Homo sapiens
tgtctcctgggtcccttccacc

SEQ ID NO: 8245134 - DNA, 21 bp, Homo sapiens
tgtctcctgttggcacatggc

SEQ ID NO: 8245135 - DNA, 22 bp, Homo sapiens
tgtctcctgggtcccttccacc

SEQ ID NO: 8245136 - DNA, 22 bp, Homo sapiens
tgtctcctgagagctggacaga

SEQ ID NO: 8245137 - DNA, 20 bp, Homo sapiens
tgtctctcagtgtcagtgca

SEQ ID NO: 8245138 - DNA, 22 bp, Homo sapiens
tgtctctcatttagttttgcac

SEQ ID NO: 8245139 - DNA, 22 bp, Homo sapiens
tgtctctagggcaatgtgaact

SEQ ID NO: 8245140 - DNA, 22 bp, Homo sapiens
tgtctctagggcaatgtgaact

SEQ ID NO: 8245141 - DNA, 22 bp, Homo sapiens
tgtctctccacacagccagtgc

SEQ ID NO: 8245142 - DNA, 22 bp, Homo sapiens
tgtctctcctgatgatctggtg

SEQ ID NO: 8245143 - DNA, 20 bp, Homo sapiens
tgtctctcggttttgtgact

SEQ ID NO: 8245144 - DNA, 18 bp, Homo sapiens
tgtctctcctttctgtgt

SEQ ID NO: 8245145 - DNA, 18 bp, Homo sapiens
tgtctctcctttctgtgt

SEQ ID NO: 8245146 - DNA, 22 bp, Homo sapiens
tgtctcctcaactcatgctcga

SEQ ID NO: 8245147 - DNA, 22 bp, Homo sapiens
tgtctcctcatactgtcatatt

SEQ ID NO: 8245148 - DNA, 22 bp, Homo sapiens
tgtctcctcggctgtccagcca

SEQ ID NO: 8245149 - DNA, 22 bp, Homo sapiens
tgtctcctatttcctgctaagg

SEQ ID NO: 8245150 - DNA, 22 bp, Homo sapiens
tgtctcctcaactcatgctcga

SEQ ID NO: 8245151 - DNA, 22 bp, Homo sapiens
tgtctcctcaactcatgctcga

SEQ ID NO: 8245152 - DNA, 22 bp, Homo sapiens
tgtctcctcaactcatgctcga

SEQ ID NO: 8245153 - DNA, 22 bp, Homo sapiens
tgtctcctcaactcatgctcga

SEQ ID NO: 8245154 - DNA, 22 bp, Homo sapiens
tgtctcctactgcctgtggatc

SEQ ID NO: 8245155 - DNA, 22 bp, Homo sapiens
tgtctccatgtgatagtggcct

SEQ ID NO: 8245156 - DNA, 22 bp, Homo sapiens
tgtctccattttcaagtagcag

SEQ ID NO: 8245157 - DNA, 23 bp, Homo sapiens
tgtctccatctcattacttgggg

SEQ ID NO: 8245158 - DNA, 22 bp, Homo sapiens
tgtgctctgactttctcctggt

SEQ ID NO: 8245159 - DNA, 22 bp, Homo sapiens
tgtgctctgactttctcctggt

SEQ ID NO: 8245160 - DNA, 22 bp, Homo sapiens
tgtgctctgactttctcctggt

SEQ ID NO: 8245161 - DNA, 23 bp, Homo sapiens
tgtgctcccaaatgtaggtctat

SEQ ID NO: 8245162 - DNA, 22 bp, Homo sapiens
tgtgctccatcatccataatct

SEQ ID NO: 8245163 - DNA, 17 bp, Homo sapiens
tgtgctctctcactcag

SEQ ID NO: 8245164 - DNA, 22 bp, Homo sapiens
tgtgctctgaagagtgcatgtc

SEQ ID NO: 8245165 - DNA, 17 bp, Homo sapiens
tgtgctctctcactcag

SEQ ID NO: 8245166 - DNA, 22 bp, Homo sapiens
tgtgctcatggtccagcatggt

SEQ ID NO: 8245167 - DNA, 22 bp, Homo sapiens
tgtgctcagccaggggcaggcc

SEQ ID NO: 8245168 - DNA, 22 bp, Homo sapiens
tgtgctcatggtccagcatggt

SEQ ID NO: 8245169 - DNA, 22 bp, Homo sapiens
tgtgctcatggtccagcatggt

SEQ ID NO: 8245170 - DNA, 22 bp, Homo sapiens
tgtgctcatggtccagcatggt

SEQ ID NO: 8245171 - DNA, 22 bp, Homo sapiens
tgtgctaaggcagtctatcaca

SEQ ID NO: 8245172 - DNA, 22 bp, Homo sapiens
tgtgctaagtattttcttattt

SEQ ID NO: 8245173 - DNA, 22 bp, Homo sapiens
tgtgctgctgtgaataagacct

SEQ ID NO: 8245174 - DNA, 22 bp, Homo sapiens
tgtggaaaaaccacaagtttgg

SEQ ID NO: 8245175 - DNA, 23 bp, Homo sapiens
tgtgctggcatctcaggctttgg

SEQ ID NO: 8245176 - DNA, 22 bp, Homo sapiens
tgtggaaaagaataagggagat

SEQ ID NO: 8245177 - DNA, 22 bp, Homo sapiens
tgtggaaaagccccacaggact

SEQ ID NO: 8245178 - DNA, 22 bp, Homo sapiens
tgtggaaaattggaacgttcct

SEQ ID NO: 8245179 - DNA, 22 bp, Homo sapiens
tgtggaaagtggtctaagcaca

SEQ ID NO: 8245180 - DNA, 22 bp, Homo sapiens
tgtggaaagtcaagttccagga

SEQ ID NO: 8245181 - DNA, 22 bp, Homo sapiens
tgtgctcttctgttacttgtag

SEQ ID NO: 8245182 - DNA, 22 bp, Homo sapiens
tgtgctctggagttgccttcac

SEQ ID NO: 8245183 - DNA, 22 bp, Homo sapiens
tgtgctgctctcagtgacagcc

SEQ ID NO: 8245184 - DNA, 22 bp, Homo sapiens
tgtgctgacaagatcagaaggt

SEQ ID NO: 8245185 - DNA, 22 bp, Homo sapiens
tgtgctgagcaaatccatctgt

SEQ ID NO: 8245186 - DNA, 22 bp, Homo sapiens
tgtgccttctcagtcctgctca

SEQ ID NO: 8245187 - DNA, 22 bp, Homo sapiens
tgtgccttccctctgctgattt

SEQ ID NO: 8245188 - DNA, 22 bp, Homo sapiens
tgtgccttccctctgctgattt

SEQ ID NO: 8245189 - DNA, 22 bp, Homo sapiens
tgtgcctgttggtgtagacata

SEQ ID NO: 8245190 - DNA, 22 bp, Homo sapiens
tgtgcctgttggtgtagacata

SEQ ID NO: 8245191 - DNA, 22 bp, Homo sapiens
tgtgcctgttcccactttgcct

SEQ ID NO: 8245192 - DNA, 22 bp, Homo sapiens
tgtgcctgtcccgcattctggt

SEQ ID NO: 8245193 - DNA, 22 bp, Homo sapiens
tgtgcctgtcaccctcagagag

SEQ ID NO: 8245194 - DNA, 22 bp, Homo sapiens
tgtgcctgtcaccctcagagag

SEQ ID NO: 8245195 - DNA, 22 bp, Homo sapiens
tgtgcctggatctctgtgacaa

SEQ ID NO: 8245196 - DNA, 22 bp, Homo sapiens
tgtgcctggcattctgggcttc

SEQ ID NO: 8245197 - DNA, 22 bp, Homo sapiens
tgtgcctggcattctgggcttc

SEQ ID NO: 8245198 - DNA, 22 bp, Homo sapiens
tgtgcctggatctctgtgacaa

SEQ ID NO: 8245199 - DNA, 22 bp, Homo sapiens
tgtgcctggatctctgtgacaa

SEQ ID NO: 8245200 - DNA, 22 bp, Homo sapiens
tgtgcctggcattctgggcttc

SEQ ID NO: 8245201 - DNA, 22 bp, Homo sapiens
tgtgcctggcccagtggtgtca

SEQ ID NO: 8245202 - DNA, 22 bp, Homo sapiens
tgtgcctggcccagtggtgtca

SEQ ID NO: 8245203 - DNA, 22 bp, Homo sapiens
tgtgcctgatggtcacgtggcc

SEQ ID NO: 8245204 - DNA, 22 bp, Homo sapiens
tgtgcctgagttggctgagtac

SEQ ID NO: 8245205 - DNA, 22 bp, Homo sapiens
tgtgcctgagttggctgagtac

SEQ ID NO: 8245206 - DNA, 22 bp, Homo sapiens
tgtgcctgagttggctgagtac

SEQ ID NO: 8245207 - DNA, 22 bp, Homo sapiens
tgtgcctgagttggctgagtac

SEQ ID NO: 8245208 - DNA, 22 bp, Homo sapiens
tgtgcctgactaggtgaatcaa

SEQ ID NO: 8245209 - DNA, 22 bp, Homo sapiens
tgtgcagagcccacaggcagct

SEQ ID NO: 8245210 - DNA, 22 bp, Homo sapiens
tgtgcagagcccacaggcagct

SEQ ID NO: 8245211 - DNA, 22 bp, Homo sapiens
tgtgcagagtaaggcagctgtt

SEQ ID NO: 8245212 - DNA, 22 bp, Homo sapiens
tgtgcagctctagagccaagcc

SEQ ID NO: 8245213 - DNA, 20 bp, Homo sapiens
tgtgcaggagagtgaggctg

SEQ ID NO: 8245214 - DNA, 22 bp, Homo sapiens
tgtgcaggtgcaggaagggggc

SEQ ID NO: 8245215 - DNA, 22 bp, Homo sapiens
tgtgcagtgtgaccagggctgc

SEQ ID NO: 8245216 - DNA, 22 bp, Homo sapiens
tgtgcagtgtgaccagggctgc

SEQ ID NO: 8245217 - DNA, 22 bp, Homo sapiens
tgtgcagttcaaacccgtgttg

SEQ ID NO: 8245218 - DNA, 22 bp, Homo sapiens
tgtgcagggaagggcatgctat

SEQ ID NO: 8245219 - DNA, 22 bp, Homo sapiens
tgtgcagggaagggcatgctat

SEQ ID NO: 8245220 - DNA, 20 bp, Homo sapiens
tgtgcaggagagtgaggctg

SEQ ID NO: 8245221 - DNA, 20 bp, Homo sapiens
tgtgcaggagagtgaggctg

SEQ ID NO: 8245222 - DNA, 22 bp, Homo sapiens
tgtgcaatcatattttaaaatg

SEQ ID NO: 8245223 - DNA, 22 bp, Homo sapiens
tgtgcaatcatattttaaaatg

SEQ ID NO: 8245224 - DNA, 22 bp, Homo sapiens
tgtgcaaattaagtagattttc

SEQ ID NO: 8245225 - DNA, 22 bp, Homo sapiens
tgtgcaaagtgtacaaattaat

SEQ ID NO: 8245226 - DNA, 22 bp, Homo sapiens
tgtgcaaagtgtacaaattaat

SEQ ID NO: 8245227 - DNA, 22 bp, Homo sapiens
tgtgcaaagtgtacaaattaat

SEQ ID NO: 8245228 - DNA, 22 bp, Homo sapiens
tgtgcaataatcatagtgattt

SEQ ID NO: 8245229 - DNA, 22 bp, Homo sapiens
tgtgcaaattaagtagattttc

SEQ ID NO: 8245230 - DNA, 22 bp, Homo sapiens
tgtgcaaattaagtagattttc

SEQ ID NO: 8245231 - DNA, 22 bp, Homo sapiens
tgtgcaacatgagacagaacag

SEQ ID NO: 8245232 - DNA, 22 bp, Homo sapiens
tgtgcacatatactcatattcc

SEQ ID NO: 8245233 - DNA, 22 bp, Homo sapiens
tgtgcacataaaacagtactag

SEQ ID NO: 8245234 - DNA, 22 bp, Homo sapiens
tgtgcacaggaagctattctct

SEQ ID NO: 8245235 - DNA, 22 bp, Homo sapiens
tgtgcacaggaagctattctct

SEQ ID NO: 8245236 - DNA, 22 bp, Homo sapiens
tgtgcacataaaacagtactag

SEQ ID NO: 8245237 - DNA, 22 bp, Homo sapiens
tgtgcacaggaagctattctct

SEQ ID NO: 8245238 - DNA, 22 bp, Homo sapiens
tgtgcacattctaggactagta

SEQ ID NO: 8245239 - DNA, 22 bp, Homo sapiens
tgtgcacatatactcatattcc

SEQ ID NO: 8245240 - DNA, 22 bp, Homo sapiens
tgtgcacattctaggactagta

SEQ ID NO: 8245241 - DNA, 22 bp, Homo sapiens
tgtgccagaaaatatgctgagg

SEQ ID NO: 8245242 - DNA, 22 bp, Homo sapiens
tgtgccctcagaagagtacatc

SEQ ID NO: 8245243 - DNA, 19 bp, Homo sapiens
tgtgccccctccagcctgc

SEQ ID NO: 8245244 - DNA, 22 bp, Homo sapiens
tgtgccctgcctacatcacctt

SEQ ID NO: 8245245 - DNA, 20 bp, Homo sapiens
tgtgccctgcagacttcttt

SEQ ID NO: 8245246 - DNA, 22 bp, Homo sapiens
tgtgcctctgcctcatgccctg

SEQ ID NO: 8245247 - DNA, 19 bp, Homo sapiens
tgtgcctctatagcatgtg

SEQ ID NO: 8245248 - DNA, 22 bp, Homo sapiens
tgtgcctactgatagagccaag

SEQ ID NO: 8245249 - DNA, 22 bp, Homo sapiens
tgtgcctcaccctgctcttggc

SEQ ID NO: 8245250 - DNA, 17 bp, Homo sapiens
tgtgcatagaataatga

SEQ ID NO: 8245251 - DNA, 22 bp, Homo sapiens
tgtgcatattactacctactcc

SEQ ID NO: 8245252 - DNA, 22 bp, Homo sapiens
tgtgcatagactttcaccacct

SEQ ID NO: 8245253 - DNA, 22 bp, Homo sapiens
tgtgcagttttaagtggtctaa

SEQ ID NO: 8245254 - DNA, 22 bp, Homo sapiens
tgtgcagtttctatgttgtcca

SEQ ID NO: 8245255 - DNA, 22 bp, Homo sapiens
tgtgcatgcacatatatgttgc

SEQ ID NO: 8245256 - DNA, 20 bp, Homo sapiens
tgtgcatgaactgagggatt

SEQ ID NO: 8245257 - DNA, 22 bp, Homo sapiens
tgtgcatcttgcctggatgttt

SEQ ID NO: 8245258 - DNA, 22 bp, Homo sapiens
tgtgcatgtgtctttatagtag

SEQ ID NO: 8245259 - DNA, 22 bp, Homo sapiens
tgtgcatgttgcttgaactcct

SEQ ID NO: 8245260 - DNA, 23 bp, Homo sapiens
tgtgccaagcttagaaagaacct

SEQ ID NO: 8245261 - DNA, 22 bp, Homo sapiens
tgtgccaagatcaaacttttct

SEQ ID NO: 8245262 - DNA, 22 bp, Homo sapiens
tgtgccaagactatattgtgct

SEQ ID NO: 8245263 - DNA, 22 bp, Homo sapiens
tgtgacctcatcttaactggaa

SEQ ID NO: 8245264 - DNA, 22 bp, Homo sapiens
tgtgacgttgttctggattccc

SEQ ID NO: 8245265 - DNA, 17 bp, Homo sapiens
tgtgacattgggacatt

SEQ ID NO: 8245266 - DNA, 22 bp, Homo sapiens
tgtgacatgcaggaggtgctca

SEQ ID NO: 8245267 - DNA, 22 bp, Homo sapiens
tgtgactggttgggaagaggct

SEQ ID NO: 8245268 - DNA, 22 bp, Homo sapiens
tgtgactggcagaggtgtctgg

SEQ ID NO: 8245269 - DNA, 22 bp, Homo sapiens
tgtgactggcagaggtgtctgg

SEQ ID NO: 8245270 - DNA, 22 bp, Homo sapiens
tgtgactgaggctccaagctag

SEQ ID NO: 8245271 - DNA, 22 bp, Homo sapiens
tgtgactgcatttggagctggg

SEQ ID NO: 8245272 - DNA, 22 bp, Homo sapiens
tgtgactatcattctaaacatc

SEQ ID NO: 8245273 - DNA, 22 bp, Homo sapiens
tgtgactatcattctaaacatc

SEQ ID NO: 8245274 - DNA, 22 bp, Homo sapiens
tgtgactgaagtgtctagacct

SEQ ID NO: 8245275 - DNA, 22 bp, Homo sapiens
tgtgactaggcctgagctcttg

SEQ ID NO: 8245276 - DNA, 22 bp, Homo sapiens
tgtgactaggcctgagctcttg

SEQ ID NO: 8245277 - DNA, 22 bp, Homo sapiens
tgtgactgagctgcagagtgtc

SEQ ID NO: 8245278 - DNA, 22 bp, Homo sapiens
tgtgagagaagtgtgtgctccc

SEQ ID NO: 8245279 - DNA, 22 bp, Homo sapiens
tgtgagacgtgttagaacagtg

SEQ ID NO: 8245280 - DNA, 22 bp, Homo sapiens
tgtgagagctccatcctcatga

SEQ ID NO: 8245281 - DNA, 22 bp, Homo sapiens
tgtgagacaattgcatcagggc

SEQ ID NO: 8245282 - DNA, 22 bp, Homo sapiens
tgtgagacaggatttagagcag

SEQ ID NO: 8245283 - DNA, 22 bp, Homo sapiens
tgtgagaattcctgatcacagg

SEQ ID NO: 8245284 - DNA, 22 bp, Homo sapiens
tgtgagaagggcatgcagggag

SEQ ID NO: 8245285 - DNA, 22 bp, Homo sapiens
tgtgagaagggtgaggctttta

SEQ ID NO: 8245286 - DNA, 22 bp, Homo sapiens
tgtgactgtgctgtggagggag

SEQ ID NO: 8245287 - DNA, 19 bp, Homo sapiens
tgtgactggttgtctcgct

SEQ ID NO: 8245288 - DNA, 22 bp, Homo sapiens
tgtgactggttgtcccgctttc

SEQ ID NO: 8245289 - DNA, 22 bp, Homo sapiens
tgtgactggttgtcccgctttc

SEQ ID NO: 8245290 - DNA, 22 bp, Homo sapiens
tgtgacttaatccttgggtggg

SEQ ID NO: 8245291 - DNA, 22 bp, Homo sapiens
tgtgacttagggcaggtgagat

SEQ ID NO: 8245292 - DNA, 22 bp, Homo sapiens
tgtgacttgatgtttgcaccag

SEQ ID NO: 8245293 - DNA, 22 bp, Homo sapiens
tgtgagaaaatgattgcacagt

SEQ ID NO: 8245294 - DNA, 22 bp, Homo sapiens
tgtgagaagggcatgcagggag

SEQ ID NO: 8245295 - DNA, 22 bp, Homo sapiens
tgtgagaaaatgattgcacagt

SEQ ID NO: 8245296 - DNA, 22 bp, Homo sapiens
tgtgatttcactggtgacatgt

SEQ ID NO: 8245297 - DNA, 22 bp, Homo sapiens
tgtgatttcatctgaggccagg

SEQ ID NO: 8245298 - DNA, 22 bp, Homo sapiens
tgtgatttccagccattaaaaa

SEQ ID NO: 8245299 - DNA, 22 bp, Homo sapiens
tgtgatttattgaaaagagctt

SEQ ID NO: 8245300 - DNA, 22 bp, Homo sapiens
tgtgcaaagtgtacaaattaat

SEQ ID NO: 8245301 - DNA, 22 bp, Homo sapiens
tgtgattttcaaggtgactcaa

SEQ ID NO: 8245302 - DNA, 18 bp, Homo sapiens
tgtgatttggctggaaat

SEQ ID NO: 8245303 - DNA, 22 bp, Homo sapiens
tgtgatttccagccattaaaaa

SEQ ID NO: 8245304 - DNA, 22 bp, Homo sapiens
tgtgattttcgttatggcttgg

SEQ ID NO: 8245305 - DNA, 22 bp, Homo sapiens
tgtgcaaaataataaatcactg

SEQ ID NO: 8245306 - DNA, 22 bp, Homo sapiens
tgtgatttatgcatggggaagt

SEQ ID NO: 8245307 - DNA, 22 bp, Homo sapiens
tgtgatcaggtgatcatgtgag

SEQ ID NO: 8245308 - DNA, 22 bp, Homo sapiens
tgtgatgtcagtggtatcaaag

SEQ ID NO: 8245309 - DNA, 22 bp, Homo sapiens
tgtgatagaaagtatcacaagg

SEQ ID NO: 8245310 - DNA, 22 bp, Homo sapiens
tgtgatagatatgcacatagct

SEQ ID NO: 8245311 - DNA, 22 bp, Homo sapiens
tgtgatagatatgcacatagct

SEQ ID NO: 8245312 - DNA, 22 bp, Homo sapiens
tgtgatatttgagtattgtcaa

SEQ ID NO: 8245313 - DNA, 21 bp, Homo sapiens
tgtgataatactatatgctct

SEQ ID NO: 8245314 - DNA, 22 bp, Homo sapiens
tgtgataagttaaattaaacct

SEQ ID NO: 8245315 - DNA, 19 bp, Homo sapiens
tgtgataagcagaattcca

SEQ ID NO: 8245316 - DNA, 22 bp, Homo sapiens
tgtgagttattttcaggagttt

SEQ ID NO: 8245317 - DNA, 22 bp, Homo sapiens
tgtgagttcttattgctcatct

SEQ ID NO: 8245318 - DNA, 22 bp, Homo sapiens
tgtgagttcttagaaagtcagt

SEQ ID NO: 8245319 - DNA, 22 bp, Homo sapiens
tgtgataacttttacattttcg

SEQ ID NO: 8245320 - DNA, 22 bp, Homo sapiens
tgtgagtctaggtcagggtgtt

SEQ ID NO: 8245321 - DNA, 22 bp, Homo sapiens
tgtgagtagctgaagcagaaca

SEQ ID NO: 8245322 - DNA, 22 bp, Homo sapiens
tgtgagcactggctgggaaagt

SEQ ID NO: 8245323 - DNA, 22 bp, Homo sapiens
tgtgagagctgcttcagccagg

SEQ ID NO: 8245324 - DNA, 22 bp, Homo sapiens
tgtgagagctgcttcagccagg

SEQ ID NO: 8245325 - DNA, 19 bp, Homo sapiens
tgtgagaggctagctgccc

SEQ ID NO: 8245326 - DNA, 22 bp, Homo sapiens
tgtgagattttatttgatatgc

SEQ ID NO: 8245327 - DNA, 22 bp, Homo sapiens
tgtgagatacctgttcaaatta

SEQ ID NO: 8245328 - DNA, 22 bp, Homo sapiens
tgtgagcactatggctaggctc

SEQ ID NO: 8245329 - DNA, 22 bp, Homo sapiens
tgtgagcaagtgactggtgaga

SEQ ID NO: 8245330 - DNA, 21 bp, Homo sapiens
tgtgaaatagctatgctacat

SEQ ID NO: 8245331 - DNA, 22 bp, Homo sapiens
tgtgaaatattggcaatttcat

SEQ ID NO: 8245332 - DNA, 22 bp, Homo sapiens
tgtgaaatcaattagctgcaga

SEQ ID NO: 8245333 - DNA, 22 bp, Homo sapiens
tgtgaaatatttatatactcaa

SEQ ID NO: 8245334 - DNA, 22 bp, Homo sapiens
tgtgaaatattggcaatttcat

SEQ ID NO: 8245335 - DNA, 22 bp, Homo sapiens
tgtgaaatctgatgaattgacc

SEQ ID NO: 8245336 - DNA, 22 bp, Homo sapiens
tgtgaaatctgatgaattgacc

SEQ ID NO: 8245337 - DNA, 22 bp, Homo sapiens
tgtgaaatctgaactcaaagat

SEQ ID NO: 8245338 - DNA, 22 bp, Homo sapiens
tgtgaaatctgaactcaaagat

SEQ ID NO: 8245339 - DNA, 22 bp, Homo sapiens
tgtgaaatcacaggctatttag

SEQ ID NO: 8245340 - DNA, 22 bp, Homo sapiens
tgtgaaatcacaggctatttag

SEQ ID NO: 8245341 - DNA, 22 bp, Homo sapiens
tgtgaaatcaattagctgcaga

SEQ ID NO: 8245342 - DNA, 22 bp, Homo sapiens
tgtgaaaggggtcacagggaaa

SEQ ID NO: 8245343 - DNA, 22 bp, Homo sapiens
tgtgaaaggggtcacagggaaa

SEQ ID NO: 8245344 - DNA, 19 bp, Homo sapiens
tgtgaaagctagtgttctt

SEQ ID NO: 8245345 - DNA, 22 bp, Homo sapiens
tgtgaaagtcaaattaattgaa

SEQ ID NO: 8245346 - DNA, 21 bp, Homo sapiens
tgtgaaatagctatgctacat

SEQ ID NO: 8245347 - DNA, 22 bp, Homo sapiens
tgtgaaagatactaggcagagg

SEQ ID NO: 8245348 - DNA, 22 bp, Homo sapiens
tgtgaaatgtgtgtataattaa

SEQ ID NO: 8245349 - DNA, 22 bp, Homo sapiens
tgtgaaattacttaaaggaaat

SEQ ID NO: 8245350 - DNA, 22 bp, Homo sapiens
tgtgaaatgtgtgtataattaa

SEQ ID NO: 8245351 - DNA, 22 bp, Homo sapiens
tgtgaaattcttgaaatgcaca

SEQ ID NO: 8245352 - DNA, 18 bp, Homo sapiens
tgtgaacacatttttctg

SEQ ID NO: 8245353 - DNA, 22 bp, Homo sapiens
tgtgaacagtatgtcatttcac

SEQ ID NO: 8245354 - DNA, 22 bp, Homo sapiens
tgtgaacagtatgtcatttcac

SEQ ID NO: 8245355 - DNA, 18 bp, Homo sapiens
tgtgaacacatttttctg

SEQ ID NO: 8245356 - DNA, 23 bp, Homo sapiens
tgtgaaatttgaggtcagtgctt

SEQ ID NO: 8245357 - DNA, 22 bp, Homo sapiens
tgtgaaattgagaaactttcac

SEQ ID NO: 8245358 - DNA, 22 bp, Homo sapiens
tgtgaaattgaatgcccattgc

SEQ ID NO: 8245359 - DNA, 22 bp, Homo sapiens
tgtgaaattgagaaactttcac

SEQ ID NO: 8245360 - DNA, 22 bp, Homo sapiens
tgtgaaattgagaaactttcac

SEQ ID NO: 8245361 - DNA, 22 bp, Homo sapiens
tgtgaaatgaagataattcttg

SEQ ID NO: 8245362 - DNA, 22 bp, Homo sapiens
tgtgaaatgctatttccatgag

SEQ ID NO: 8245363 - DNA, 22 bp, Homo sapiens
tgtgaaatgtgtgtataattaa

SEQ ID NO: 8245364 - DNA, 22 bp, Homo sapiens
tgtgaaatgtggatgttaatag

SEQ ID NO: 8245365 - DNA, 22 bp, Homo sapiens
tgtgaaatgtggatgttaatag

SEQ ID NO: 8245366 - DNA, 22 bp, Homo sapiens
tgtgaaatgctatttccatgag

SEQ ID NO: 8245367 - DNA, 22 bp, Homo sapiens
tgtgaaatgagtatatttgaat

SEQ ID NO: 8245368 - DNA, 22 bp, Homo sapiens
tgtgaaatgaagataattcttg

SEQ ID NO: 8245369 - DNA, 22 bp, Homo sapiens
tgtgaaatgaagataattcttg

SEQ ID NO: 8245370 - DNA, 22 bp, Homo sapiens
tgtgaaatgctattgtgacaaa

SEQ ID NO: 8245371 - DNA, 22 bp, Homo sapiens
tgtgaaatgagtatatttgaat

SEQ ID NO: 8245372 - DNA, 22 bp, Homo sapiens
tgtgaaatgagtatatttgaat

SEQ ID NO: 8245373 - DNA, 22 bp, Homo sapiens
tgtgaacatttctggttatttg

SEQ ID NO: 8245374 - DNA, 22 bp, Homo sapiens
tgtgaacatttctggttatttg

SEQ ID NO: 8245375 - DNA, 22 bp, Homo sapiens
tgtgaagtccagagaagtcagg

SEQ ID NO: 8245376 - DNA, 22 bp, Homo sapiens
tgtgaatacagcatgtgcttct

SEQ ID NO: 8245377 - DNA, 22 bp, Homo sapiens
tgtgaataatgccgcaataaac

SEQ ID NO: 8245378 - DNA, 22 bp, Homo sapiens
tgtgaataccttgaattcatca

SEQ ID NO: 8245379 - DNA, 22 bp, Homo sapiens
tgtgaataccttgaattcatca

SEQ ID NO: 8245380 - DNA, 22 bp, Homo sapiens
tgtgaatacattggtagaagca

SEQ ID NO: 8245381 - DNA, 22 bp, Homo sapiens
tgtgaatagtgccgcaataaac

SEQ ID NO: 8245382 - DNA, 22 bp, Homo sapiens
tgtgaatagattgaagctttgg

SEQ ID NO: 8245383 - DNA, 22 bp, Homo sapiens
tgtgaatggacaattaaatcta

SEQ ID NO: 8245384 - DNA, 23 bp, Homo sapiens
tgtgaattgaggacatcaaaagc

SEQ ID NO: 8245385 - DNA, 22 bp, Homo sapiens
tgtgaatggacaattaaatcta

SEQ ID NO: 8245386 - DNA, 22 bp, Homo sapiens
tgtgacagatctctatacatga

SEQ ID NO: 8245387 - DNA, 22 bp, Homo sapiens
tgtgacagaattggtctgttct

SEQ ID NO: 8245388 - DNA, 22 bp, Homo sapiens
tgtgacagaattggtctgttct

SEQ ID NO: 8245389 - DNA, 22 bp, Homo sapiens
tgtgacaagcattgtatattgg

SEQ ID NO: 8245390 - DNA, 22 bp, Homo sapiens
tgtgacagccagtaaagtaagc

SEQ ID NO: 8245391 - DNA, 23 bp, Homo sapiens
tgtgacagggtcattgaaaaggg

SEQ ID NO: 8245392 - DNA, 23 bp, Homo sapiens
tgtgacagtgacaatactgactt

SEQ ID NO: 8245393 - DNA, 22 bp, Homo sapiens
tgtgacagtgccagcttcatag

SEQ ID NO: 8245394 - DNA, 22 bp, Homo sapiens
tgtgacagttagtttggtgtta

SEQ ID NO: 8245395 - DNA, 19 bp, Homo sapiens
tgtgacatcactgggcagc

SEQ ID NO: 8245396 - DNA, 22 bp, Homo sapiens
tgtgacatcgctgtgtctgttt

SEQ ID NO: 8245397 - DNA, 22 bp, Homo sapiens
tgtgacatcgctgtgtctgttt

SEQ ID NO: 8245398 - DNA, 22 bp, Homo sapiens
ttcaccatgtaaaccatgtggc

SEQ ID NO: 8245399 - DNA, 19 bp, Homo sapiens
ttcaccatgggactggagc

SEQ ID NO: 8245400 - DNA, 22 bp, Homo sapiens
ttcaccatgggatgacaacagt

SEQ ID NO: 8245401 - DNA, 22 bp, Homo sapiens
ttcaccatcattaacttcatgt

SEQ ID NO: 8245402 - DNA, 19 bp, Homo sapiens
ttcaccatctcaccaaacc

SEQ ID NO: 8245403 - DNA, 19 bp, Homo sapiens
ttcaccatctcaccaaacc

SEQ ID NO: 8245404 - DNA, 18 bp, Homo sapiens
ttcaccagtgtgatgggt

SEQ ID NO: 8245405 - DNA, 22 bp, Homo sapiens
ttcaccataatgcaaagtggga

SEQ ID NO: 8245406 - DNA, 22 bp, Homo sapiens
ttcaccagattttgtatagtca

SEQ ID NO: 8245407 - DNA, 19 bp, Homo sapiens
ttcacatttttgtggcact

SEQ ID NO: 8245408 - DNA, 22 bp, Homo sapiens
ttcacatttgaaaggaaagata

SEQ ID NO: 8245409 - DNA, 19 bp, Homo sapiens
ttcacattttgctctgagg

SEQ ID NO: 8245410 - DNA, 22 bp, Homo sapiens
ttcacatttgcccttatgtgtg

SEQ ID NO: 8245411 - DNA, 22 bp, Homo sapiens
ttcacattggtgatatgtttct

SEQ ID NO: 8245412 - DNA, 22 bp, Homo sapiens
ttcacattgtgcagattatggt

SEQ ID NO: 8245413 - DNA, 22 bp, Homo sapiens
ttcacattggttcttgatagct

SEQ ID NO: 8245414 - DNA, 22 bp, Homo sapiens
ttcacattggttcttgatagct

SEQ ID NO: 8245415 - DNA, 22 bp, Homo sapiens
ttcacattgtggttcatgtgaa

SEQ ID NO: 8245416 - DNA, 22 bp, Homo sapiens
ttcacattgtggttcatgtgaa

SEQ ID NO: 8245417 - DNA, 22 bp, Homo sapiens
ttcacattgtggttcatgtgaa

SEQ ID NO: 8245418 - DNA, 22 bp, Homo sapiens
ttatttcttgtctatgtagcca

SEQ ID NO: 8245419 - DNA, 22 bp, Homo sapiens
ttatttcttgtctatgtagcca

SEQ ID NO: 8245420 - DNA, 22 bp, Homo sapiens
ttatttcttgtctatgtagcca

SEQ ID NO: 8245421 - DNA, 22 bp, Homo sapiens
ttatttgaaaagaaggttacgt

SEQ ID NO: 8245422 - DNA, 22 bp, Homo sapiens
ttatttgaatgatggcacaatt

SEQ ID NO: 8245423 - DNA, 22 bp, Homo sapiens
ttatttcctctctaatagggta

SEQ ID NO: 8245424 - DNA, 22 bp, Homo sapiens
ttatttcctgacacagctgatt

SEQ ID NO: 8245425 - DNA, 22 bp, Homo sapiens
ttatttcctgacacagctgatt

SEQ ID NO: 8245426 - DNA, 22 bp, Homo sapiens
ttatttcctagggaatttgcct

SEQ ID NO: 8245427 - DNA, 22 bp, Homo sapiens
ttatttcctctctaatagggta

SEQ ID NO: 8245428 - DNA, 22 bp, Homo sapiens
ttatttcctgacacagctgatt

SEQ ID NO: 8245429 - DNA, 22 bp, Homo sapiens
ttatttcctaaatctctttgtt

SEQ ID NO: 8245430 - DNA, 22 bp, Homo sapiens
ttatttcctagggaatttgcct

SEQ ID NO: 8245431 - DNA, 22 bp, Homo sapiens
ttatttcctagggaatttgcct

SEQ ID NO: 8245432 - DNA, 22 bp, Homo sapiens
ttatttcctaaatctctttgtt

SEQ ID NO: 8245433 - DNA, 22 bp, Homo sapiens
ttatttcctctctaatagggta

SEQ ID NO: 8245434 - DNA, 20 bp, Homo sapiens
ttatttctcattctcctact

SEQ ID NO: 8245435 - DNA, 20 bp, Homo sapiens
ttatttctcattctcctact

SEQ ID NO: 8245436 - DNA, 22 bp, Homo sapiens
ttatttctactattttgcctga

SEQ ID NO: 8245437 - DNA, 22 bp, Homo sapiens
ttatttctactattttgcctga

SEQ ID NO: 8245438 - DNA, 22 bp, Homo sapiens
ttatttcctgacacagctgatt

SEQ ID NO: 8245439 - DNA, 22 bp, Homo sapiens
ttatttggatttagcttatcaa

SEQ ID NO: 8245440 - DNA, 22 bp, Homo sapiens
ttatttgctgatttcagtttca

SEQ ID NO: 8245441 - DNA, 22 bp, Homo sapiens
ttatttgcccatgtttagcaga

SEQ ID NO: 8245442 - DNA, 20 bp, Homo sapiens
ttatttgctctttatctgca

SEQ ID NO: 8245443 - DNA, 22 bp, Homo sapiens
ttatttgccagaatttctcttg

SEQ ID NO: 8245444 - DNA, 22 bp, Homo sapiens
ttatttgtaaggcagggccagt

SEQ ID NO: 8245445 - DNA, 22 bp, Homo sapiens
ttatttgtggcatatgagacga

SEQ ID NO: 8245446 - DNA, 22 bp, Homo sapiens
ttatttgtgaatcatttatcta

SEQ ID NO: 8245447 - DNA, 22 bp, Homo sapiens
ttatttgtaaaggtccatagta

SEQ ID NO: 8245448 - DNA, 22 bp, Homo sapiens
ttcagcccccaaagcctcattc

SEQ ID NO: 8245449 - DNA, 22 bp, Homo sapiens
ttcagcccaggagttggaggct

SEQ ID NO: 8245450 - DNA, 22 bp, Homo sapiens
ttcagcatttctgttgttggct

SEQ ID NO: 8245451 - DNA, 22 bp, Homo sapiens
ttcagcattggtatgaaaaccc

SEQ ID NO: 8245452 - DNA, 19 bp, Homo sapiens
ttcagcattatattctagc

SEQ ID NO: 8245453 - DNA, 22 bp, Homo sapiens
ttcagcatgggtgtgataaatg

SEQ ID NO: 8245454 - DNA, 22 bp, Homo sapiens
ttcagcatgggtgtgataaatg

SEQ ID NO: 8245455 - DNA, 22 bp, Homo sapiens
ttcagcatgaaaggatttgagt

SEQ ID NO: 8245456 - DNA, 22 bp, Homo sapiens
ttcagctcagcactgacaagat

SEQ ID NO: 8245457 - DNA, 22 bp, Homo sapiens
ttcagctcagtctgtgcagcag

SEQ ID NO: 8245458 - DNA, 22 bp, Homo sapiens
ttcagctcaacgcacttctgag

SEQ ID NO: 8245459 - DNA, 22 bp, Homo sapiens
ttcagcctgttcatgctgttgc

SEQ ID NO: 8245460 - DNA, 22 bp, Homo sapiens
ttcagctaaggagtttcactgt

SEQ ID NO: 8245461 - DNA, 21 bp, Homo sapiens
ttcagctctgcttcagggaat

SEQ ID NO: 8245462 - DNA, 22 bp, Homo sapiens
ttcagctctagtaagcagacac

SEQ ID NO: 8245463 - DNA, 21 bp, Homo sapiens
ttcagctcggtctggcatgat

SEQ ID NO: 8245464 - DNA, 22 bp, Homo sapiens
ttcagctccttatttctgagca

SEQ ID NO: 8245465 - DNA, 22 bp, Homo sapiens
ttcaggaagcctttcttggtct

SEQ ID NO: 8245466 - DNA, 22 bp, Homo sapiens
ttcaggaaggtcctatagcaga

SEQ ID NO: 8245467 - DNA, 22 bp, Homo sapiens
ttcaggaaggtcctatagcaga

SEQ ID NO: 8245468 - DNA, 22 bp, Homo sapiens
ttcaggaataattatcatatga

SEQ ID NO: 8245469 - DNA, 22 bp, Homo sapiens
ttcaggaataattatcatatga

SEQ ID NO: 8245470 - DNA, 22 bp, Homo sapiens
ttcagcttgctgactgcggcag

SEQ ID NO: 8245471 - DNA, 22 bp, Homo sapiens
ttcagcttgctgactgcggcag

SEQ ID NO: 8245472 - DNA, 22 bp, Homo sapiens
ttcagcttgctgactgcggcag

SEQ ID NO: 8245473 - DNA, 23 bp, Homo sapiens
ttcaggaaatgaatacagacaca

SEQ ID NO: 8245474 - DNA, 22 bp, Homo sapiens
ttcaggaaatgtctgcctacca

SEQ ID NO: 8245475 - DNA, 21 bp, Homo sapiens
ttcagcagtcctctagagata

SEQ ID NO: 8245476 - DNA, 22 bp, Homo sapiens
ttcactgctgggtgattgggtt

SEQ ID NO: 8245477 - DNA, 22 bp, Homo sapiens
ttcactgctacatccaggtgcc

SEQ ID NO: 8245478 - DNA, 22 bp, Homo sapiens
ttcactggtcctttataggaac

SEQ ID NO: 8245479 - DNA, 22 bp, Homo sapiens
ttcagcagcttttagtacattg

SEQ ID NO: 8245480 - DNA, 22 bp, Homo sapiens
ttcagcatctacatatttagaa

SEQ ID NO: 8245481 - DNA, 22 bp, Homo sapiens
ttcactgcagcccatgaaggga

SEQ ID NO: 8245482 - DNA, 22 bp, Homo sapiens
ttcactgaagtttcttccatgt

SEQ ID NO: 8245483 - DNA, 19 bp, Homo sapiens
ttcactaggtcacaaggtc

SEQ ID NO: 8245484 - DNA, 22 bp, Homo sapiens
ttcacctggcacatgtgagcct

SEQ ID NO: 8245485 - DNA, 22 bp, Homo sapiens
ttcaccctgagccccacctctg

SEQ ID NO: 8245486 - DNA, 22 bp, Homo sapiens
ttcaccccaaattcccagtgga

SEQ ID NO: 8245487 - DNA, 22 bp, Homo sapiens
ttcaccatttcccactaaacca

SEQ ID NO: 8245488 - DNA, 22 bp, Homo sapiens
ttcaccattctaagacattggt

SEQ ID NO: 8245489 - DNA, 22 bp, Homo sapiens
ttcaccatgttggccaggctgg

SEQ ID NO: 8245490 - DNA, 22 bp, Homo sapiens
ttcaccattacatacaaagatg

SEQ ID NO: 8245491 - DNA, 22 bp, Homo sapiens
ttccagaggcttgaggaaaatt

SEQ ID NO: 8245492 - DNA, 22 bp, Homo sapiens
ttccagaggcttcagggaagaa

SEQ ID NO: 8245493 - DNA, 22 bp, Homo sapiens
ttccagaggggaggtggcagcc

SEQ ID NO: 8245494 - DNA, 22 bp, Homo sapiens
ttccagaggttctcagccctgt

SEQ ID NO: 8245495 - DNA, 22 bp, Homo sapiens
ttccagaggttctcagccctgt

SEQ ID NO: 8245496 - DNA, 22 bp, Homo sapiens
ttccagaggttctcagccctgt

SEQ ID NO: 8245497 - DNA, 22 bp, Homo sapiens
ttccagagttgggggagtggtt

SEQ ID NO: 8245498 - DNA, 22 bp, Homo sapiens
ttccagagtgactgtgccactt

SEQ ID NO: 8245499 - DNA, 22 bp, Homo sapiens
ttccagagtctggttccatggt

SEQ ID NO: 8245500 - DNA, 22 bp, Homo sapiens
ttccagccagatttgctgggtt

SEQ ID NO: 8245501 - DNA, 22 bp, Homo sapiens
ttccagccagatttgctgggtt

SEQ ID NO: 8245502 - DNA, 22 bp, Homo sapiens
ttccagctaactcacatccctt

SEQ ID NO: 8245503 - DNA, 22 bp, Homo sapiens
ttccagctaactcacatccctt

SEQ ID NO: 8245504 - DNA, 22 bp, Homo sapiens
ttccagctaactcacatccctt

SEQ ID NO: 8245505 - DNA, 22 bp, Homo sapiens
ttccagctaactcacatccctt

SEQ ID NO: 8245506 - DNA, 22 bp, Homo sapiens
ttccagctaactcacatccctt

SEQ ID NO: 8245507 - DNA, 17 bp, Homo sapiens
ttccagcatgttactaa

SEQ ID NO: 8245508 - DNA, 17 bp, Homo sapiens
ttccagcatgttactaa

SEQ ID NO: 8245509 - DNA, 22 bp, Homo sapiens
ttccagcagggtacttgtaatt

SEQ ID NO: 8245510 - DNA, 22 bp, Homo sapiens
ttccagcagggtacttgtaatt

SEQ ID NO: 8245511 - DNA, 17 bp, Homo sapiens
ttccagcatgttactaa

SEQ ID NO: 8245512 - DNA, 22 bp, Homo sapiens
ttccagcaggcagacaggagat

SEQ ID NO: 8245513 - DNA, 22 bp, Homo sapiens
ttccagcagcgtgggagaagta

SEQ ID NO: 8245514 - DNA, 22 bp, Homo sapiens
ttccagcagcgtgggagaagta

SEQ ID NO: 8245515 - DNA, 22 bp, Homo sapiens
ttccagatgtttaagttctgct

SEQ ID NO: 8245516 - DNA, 22 bp, Homo sapiens
ttccagctaactcacatccctt

SEQ ID NO: 8245517 - DNA, 22 bp, Homo sapiens
ttccagctcttgaaggtgggat

SEQ ID NO: 8245518 - DNA, 22 bp, Homo sapiens
ttccagcttagagcatcatgtt

SEQ ID NO: 8245519 - DNA, 22 bp, Homo sapiens
ttccagcttgacttctacttaa

SEQ ID NO: 8245520 - DNA, 22 bp, Homo sapiens
ttccagcttgacttctacttaa

SEQ ID NO: 8245521 - DNA, 22 bp, Homo sapiens
ttccaggaaaacagttggaagt

SEQ ID NO: 8245522 - DNA, 22 bp, Homo sapiens
ttcatgttttattcagtaatta

SEQ ID NO: 8245523 - DNA, 22 bp, Homo sapiens
ttcatgttttattcagtaatta

SEQ ID NO: 8245524 - DNA, 22 bp, Homo sapiens
ttcatgtttgcctatttgactt

SEQ ID NO: 8245525 - DNA, 22 bp, Homo sapiens
ttcaggaatcaaccaagtcatt

SEQ ID NO: 8245526 - DNA, 23 bp, Homo sapiens
ttcattcaaaaggaaaagtcatg

SEQ ID NO: 8245527 - DNA, 23 bp, Homo sapiens
ttcattcaaaaggaaaagtcatg

SEQ ID NO: 8245528 - DNA, 22 bp, Homo sapiens
ttcattacattcaaaaggcatt

SEQ ID NO: 8245529 - DNA, 22 bp, Homo sapiens
ttcattcacccaggaaacatct

SEQ ID NO: 8245530 - DNA, 20 bp, Homo sapiens
ttcattcacgtagctgttga

SEQ ID NO: 8245531 - DNA, 20 bp, Homo sapiens
ttcattcacgtagctgttga

SEQ ID NO: 8245532 - DNA, 22 bp, Homo sapiens
ttcattcaggtgtatttatggg

SEQ ID NO: 8245533 - DNA, 22 bp, Homo sapiens
ttcattcagcacatatttattg

SEQ ID NO: 8245534 - DNA, 22 bp, Homo sapiens
ttcattcacccaggaaacatct

SEQ ID NO: 8245535 - DNA, 22 bp, Homo sapiens
ttcattcaaagaggcatccaag

SEQ ID NO: 8245536 - DNA, 22 bp, Homo sapiens
ttcattcaaggggttcctgatt

SEQ ID NO: 8245537 - DNA, 21 bp, Homo sapiens
ttcattcatggcataatatag

SEQ ID NO: 8245538 - DNA, 22 bp, Homo sapiens
ttcattcatggtcttctgagat

SEQ ID NO: 8245539 - DNA, 22 bp, Homo sapiens
ttcattcatggtcttctgagat

SEQ ID NO: 8245540 - DNA, 22 bp, Homo sapiens
ttcattcatctctaaaatgcct

SEQ ID NO: 8245541 - DNA, 22 bp, Homo sapiens
ttcattcatctctaaaatgcct

SEQ ID NO: 8245542 - DNA, 22 bp, Homo sapiens
ttcattcatcacatgcagctgg

SEQ ID NO: 8245543 - DNA, 22 bp, Homo sapiens
ttcattcagtgagactaggacg

SEQ ID NO: 8245544 - DNA, 22 bp, Homo sapiens
ttcattgagtggtttattctaa

SEQ ID NO: 8245545 - DNA, 22 bp, Homo sapiens
ttccagaggatctcaggtattt

SEQ ID NO: 8245546 - DNA, 22 bp, Homo sapiens
ttccagaggatctcaggtattt

SEQ ID NO: 8245547 - DNA, 22 bp, Homo sapiens
ttccagaggagtgattcagagg

SEQ ID NO: 8245548 - DNA, 23 bp, Homo sapiens
ttccagaggaagaagtcatgact

SEQ ID NO: 8245549 - DNA, 22 bp, Homo sapiens
ttccagaggaaagaaaatgact

SEQ ID NO: 8245550 - DNA, 22 bp, Homo sapiens
ttcattcttgtctttgtatagt

SEQ ID NO: 8245551 - DNA, 22 bp, Homo sapiens
ttcattcttgtctttgtatagt

SEQ ID NO: 8245552 - DNA, 22 bp, Homo sapiens
ttcattcattcatgaatgttaa

SEQ ID NO: 8245553 - DNA, 22 bp, Homo sapiens
ttcattcttttacatgtgaata

SEQ ID NO: 8245554 - DNA, 22 bp, Homo sapiens
ttcattgaaatgtttctagctg

SEQ ID NO: 8245555 - DNA, 22 bp, Homo sapiens
ttcattgaaccactttattctt

SEQ ID NO: 8245556 - DNA, 19 bp, Homo sapiens
ttcattctttctacttacc

SEQ ID NO: 8245557 - DNA, 22 bp, Homo sapiens
ttacaagacacagtgctgaagg

SEQ ID NO: 8245558 - DNA, 22 bp, Homo sapiens
ttacaactggtgaattttatgg

SEQ ID NO: 8245559 - DNA, 22 bp, Homo sapiens
ttacaactctgtcagtatagct

SEQ ID NO: 8245560 - DNA, 22 bp, Homo sapiens
ttacaactctgaactacagagg

SEQ ID NO: 8245561 - DNA, 22 bp, Homo sapiens
ttacaacctaattttactctcc

SEQ ID NO: 8245562 - DNA, 22 bp, Homo sapiens
ttacaactgggcttgtcagctt

SEQ ID NO: 8245563 - DNA, 22 bp, Homo sapiens
ttacaactgaagctaatgtgct

SEQ ID NO: 8245564 - DNA, 22 bp, Homo sapiens
ttacaactgaagctaatgtgct

SEQ ID NO: 8245565 - DNA, 17 bp, Homo sapiens
ttacaacgtcatctctg

SEQ ID NO: 8245566 - DNA, 23 bp, Homo sapiens
ttacaactatttgccatgttgtt

SEQ ID NO: 8245567 - DNA, 22 bp, Homo sapiens
ttacaacatatttagcttgatt

SEQ ID NO: 8245568 - DNA, 22 bp, Homo sapiens
ttacaacatatgataggagtct

SEQ ID NO: 8245569 - DNA, 17 bp, Homo sapiens
ttacaacaattcatgag

SEQ ID NO: 8245570 - DNA, 22 bp, Homo sapiens
ttacaacaccaggcagtatcct

SEQ ID NO: 8245571 - DNA, 22 bp, Homo sapiens
ttacaacaccaggcagtatcct

SEQ ID NO: 8245572 - DNA, 17 bp, Homo sapiens
ttacaacaattcatgag

SEQ ID NO: 8245573 - DNA, 17 bp, Homo sapiens
ttacaacaattcatgag

SEQ ID NO: 8245574 - DNA, 17 bp, Homo sapiens
ttacaacaattcatgag

SEQ ID NO: 8245575 - DNA, 22 bp, Homo sapiens
ttacaacaaaggcacgtgcatg

SEQ ID NO: 8245576 - DNA, 22 bp, Homo sapiens
ttacaacagacacatattctaa

SEQ ID NO: 8245577 - DNA, 22 bp, Homo sapiens
ttacaacagacacatattctaa

SEQ ID NO: 8245578 - DNA, 22 bp, Homo sapiens
ttacaacactacttatccttga

SEQ ID NO: 8245579 - DNA, 22 bp, Homo sapiens
ttacaacactacttatccttga

SEQ ID NO: 8245580 - DNA, 23 bp, Homo sapiens
ttacaacagtgtccatatttgta

SEQ ID NO: 8245581 - DNA, 22 bp, Homo sapiens
ttacaacagacacatattctaa

SEQ ID NO: 8245582 - DNA, 22 bp, Homo sapiens
ttacaaaggtagttttgtctat

SEQ ID NO: 8245583 - DNA, 22 bp, Homo sapiens
ttacaaagtgctgcaccatttt

SEQ ID NO: 8245584 - DNA, 21 bp, Homo sapiens
ttacaaagctacagatgttgc

SEQ ID NO: 8245585 - DNA, 22 bp, Homo sapiens
ttacaaagttctgagttcaaac

SEQ ID NO: 8245586 - DNA, 22 bp, Homo sapiens
ttacaaagtttaaggtggcact

SEQ ID NO: 8245587 - DNA, 22 bp, Homo sapiens
ttacaaagttctgagttcaaac

SEQ ID NO: 8245588 - DNA, 22 bp, Homo sapiens
ttacaaagtgttatgataaaca

SEQ ID NO: 8245589 - DNA, 22 bp, Homo sapiens
ttacaaagtgttatgataaaca

SEQ ID NO: 8245590 - DNA, 22 bp, Homo sapiens
ttacaaagttctgagttcaaac

SEQ ID NO: 8245591 - DNA, 22 bp, Homo sapiens
ttaattaactagccaaccacta

SEQ ID NO: 8245592 - DNA, 22 bp, Homo sapiens
ttaattaaattcatgagcattg

SEQ ID NO: 8245593 - DNA, 22 bp, Homo sapiens
ttaatgtgtgtacaggattttg

SEQ ID NO: 8245594 - DNA, 22 bp, Homo sapiens
ttaatgttttaagttatagaga

SEQ ID NO: 8245595 - DNA, 22 bp, Homo sapiens
ttaattaaattcatgagcattg

SEQ ID NO: 8245596 - DNA, 22 bp, Homo sapiens
ttaattaaattcatgagcattg

SEQ ID NO: 8245597 - DNA, 22 bp, Homo sapiens
ttaattaaattcatgagcattg

SEQ ID NO: 8245598 - DNA, 22 bp, Homo sapiens
ttaattaagagatactgcagta

SEQ ID NO: 8245599 - DNA, 22 bp, Homo sapiens
ttaattaattagttaagcatgt

SEQ ID NO: 8245600 - DNA, 20 bp, Homo sapiens
ttacaaagaggcatcgcttt

SEQ ID NO: 8245601 - DNA, 20 bp, Homo sapiens
ttacaaagaggcatcgcttt

SEQ ID NO: 8245602 - DNA, 22 bp, Homo sapiens
ttacaaagagaagttgtagaat

SEQ ID NO: 8245603 - DNA, 22 bp, Homo sapiens
ttacaaagagaagttgtagaat

SEQ ID NO: 8245604 - DNA, 22 bp, Homo sapiens
ttaaagagtctactgcacatcc

SEQ ID NO: 8245605 - DNA, 22 bp, Homo sapiens
ttaaagaggcatgggaatgtat

SEQ ID NO: 8245606 - DNA, 22 bp, Homo sapiens
ttaaagaggcaggttaaataat

SEQ ID NO: 8245607 - DNA, 23 bp, Homo sapiens
ttaaacttcagtgcagaacactc

SEQ ID NO: 8245608 - DNA, 22 bp, Homo sapiens
ttaaagagaactcaatgaatga

SEQ ID NO: 8245609 - DNA, 22 bp, Homo sapiens
ttaaagaatagtgcccctattg

SEQ ID NO: 8245610 - DNA, 22 bp, Homo sapiens
ttaataaagtatgaattggaaa

SEQ ID NO: 8245611 - DNA, 22 bp, Homo sapiens
ttaaagcaggcatcattcctca

SEQ ID NO: 8245612 - DNA, 22 bp, Homo sapiens
ttaaagcaggcatcattcctca

SEQ ID NO: 8245613 - DNA, 22 bp, Homo sapiens
ttaaagcaggcatcattcctca

SEQ ID NO: 8245614 - DNA, 22 bp, Homo sapiens
ttaaagcagtttgtatacatgg

SEQ ID NO: 8245615 - DNA, 22 bp, Homo sapiens
ttaaagcagtttgtatacatgg

SEQ ID NO: 8245616 - DNA, 22 bp, Homo sapiens
ttaaagcagtttgtatacatgg

SEQ ID NO: 8245617 - DNA, 22 bp, Homo sapiens
ttaaagcagtttgtatacatgg

SEQ ID NO: 8245618 - DNA, 22 bp, Homo sapiens
ttaaagcaacctcagccctctt

SEQ ID NO: 8245619 - DNA, 22 bp, Homo sapiens
ttaaagcaagtagaagcctgag

SEQ ID NO: 8245620 - DNA, 22 bp, Homo sapiens
ttaaagcaagtagaagcctgag

SEQ ID NO: 8245621 - DNA, 22 bp, Homo sapiens
ttaatacactatatgatcacat

SEQ ID NO: 8245622 - DNA, 22 bp, Homo sapiens
ttaatacactatatgatcacat

SEQ ID NO: 8245623 - DNA, 22 bp, Homo sapiens
ttaatacagaagcaagacactg

SEQ ID NO: 8245624 - DNA, 22 bp, Homo sapiens
ttaatacagaagcaagacactg

SEQ ID NO: 8245625 - DNA, 22 bp, Homo sapiens
ttaatacagaagcaagacactg

SEQ ID NO: 8245626 - DNA, 22 bp, Homo sapiens
ttaatacagtctccagaagtaa

SEQ ID NO: 8245627 - DNA, 22 bp, Homo sapiens
ttaatacagtctccagaagtaa

SEQ ID NO: 8245628 - DNA, 22 bp, Homo sapiens
ttaatacatttcagactgttat

SEQ ID NO: 8245629 - DNA, 18 bp, Homo sapiens
ttaatgtggcttactatg

SEQ ID NO: 8245630 - DNA, 22 bp, Homo sapiens
ttaatacatttcagactgttat

SEQ ID NO: 8245631 - DNA, 21 bp, Homo sapiens
ttaatgctatgcagaaaatct

SEQ ID NO: 8245632 - DNA, 22 bp, Homo sapiens
ttaatacaagcatatgcacaca

SEQ ID NO: 8245633 - DNA, 22 bp, Homo sapiens
ttaatacaagcatatgcacaca

SEQ ID NO: 8245634 - DNA, 22 bp, Homo sapiens
ttaatacaagcatatgcacaca

SEQ ID NO: 8245635 - DNA, 22 bp, Homo sapiens
ttaatacaactgttgtcactgg

SEQ ID NO: 8245636 - DNA, 22 bp, Homo sapiens
ttacaagatctttgaaggcaag

SEQ ID NO: 8245637 - DNA, 22 bp, Homo sapiens
ttacaagatgggaaagggaagt

SEQ ID NO: 8245638 - DNA, 22 bp, Homo sapiens
ttacaagatctttgaaggcaag

SEQ ID NO: 8245639 - DNA, 22 bp, Homo sapiens
ttacaagcagctacatatcaca

SEQ ID NO: 8245640 - DNA, 22 bp, Homo sapiens
ttacaagattgatttgcttggc

SEQ ID NO: 8245641 - DNA, 22 bp, Homo sapiens
ttacaagcagctacatatcaca

SEQ ID NO: 8245642 - DNA, 22 bp, Homo sapiens
ttacaagattaattattggagt

SEQ ID NO: 8245643 - DNA, 22 bp, Homo sapiens
ttacaagatgggaaagggaagt

SEQ ID NO: 8245644 - DNA, 22 bp, Homo sapiens
ttacaagataacctgatgctgt

SEQ ID NO: 8245645 - DNA, 22 bp, Homo sapiens
ttacaagacagtgtggtaaata

SEQ ID NO: 8245646 - DNA, 22 bp, Homo sapiens
ttacaagataacggagaaagca

SEQ ID NO: 8245647 - DNA, 22 bp, Homo sapiens
ttacaagataacggagaaagca

SEQ ID NO: 8245648 - DNA, 22 bp, Homo sapiens
ttacaagatatgtgagaactag

SEQ ID NO: 8245649 - DNA, 22 bp, Homo sapiens
ttacaagatatgtgagaactag

SEQ ID NO: 8245650 - DNA, 22 bp, Homo sapiens
ttacaatgggtatacttccatt

SEQ ID NO: 8245651 - DNA, 22 bp, Homo sapiens
ttacaatgggtatacttccatt

SEQ ID NO: 8245652 - DNA, 19 bp, Homo sapiens
ttacaatggtgattaggtt

SEQ ID NO: 8245653 - DNA, 22 bp, Homo sapiens
ttacaatgtaaggcatggttct

SEQ ID NO: 8245654 - DNA, 22 bp, Homo sapiens
ttacaattacttgatctcagct

SEQ ID NO: 8245655 - DNA, 22 bp, Homo sapiens
ttacaattacttgatctcagct

SEQ ID NO: 8245656 - DNA, 22 bp, Homo sapiens
ttacaattgagtctattgtatg

SEQ ID NO: 8245657 - DNA, 22 bp, Homo sapiens
ttacaattgagtctattgtatg

SEQ ID NO: 8245658 - DNA, 22 bp, Homo sapiens
ttacaattgagtctattgtatg

SEQ ID NO: 8245659 - DNA, 22 bp, Homo sapiens
ttacaatgcactcacctttaga

SEQ ID NO: 8245660 - DNA, 22 bp, Homo sapiens
ttacaatgcactcacctttaga

SEQ ID NO: 8245661 - DNA, 22 bp, Homo sapiens
ttacaatgatgggattcagcca

SEQ ID NO: 8245662 - DNA, 22 bp, Homo sapiens
ttacaagtactgaatatgattt

SEQ ID NO: 8245663 - DNA, 22 bp, Homo sapiens
ttacaagtactgaatatgattt

SEQ ID NO: 8245664 - DNA, 22 bp, Homo sapiens
ttacaaggaggatagcatttcc

SEQ ID NO: 8245665 - DNA, 22 bp, Homo sapiens
ttacaaggaggatagcatttcc

SEQ ID NO: 8245666 - DNA, 22 bp, Homo sapiens
ttacaaggtaagttgttaagtc

SEQ ID NO: 8245667 - DNA, 23 bp, Homo sapiens
ttacaaggctagaattccagcga

SEQ ID NO: 8245668 - DNA, 23 bp, Homo sapiens
ttacaaggaagtgcacagatggg

SEQ ID NO: 8245669 - DNA, 22 bp, Homo sapiens
ttacaagctaattgtttcagct

SEQ ID NO: 8245670 - DNA, 19 bp, Homo sapiens
ttacaagcattgaaagaaa

SEQ ID NO: 8245671 - DNA, 22 bp, Homo sapiens
ttacaagctaattgtttcagct

SEQ ID NO: 8245672 - DNA, 20 bp, Homo sapiens
ttacaagccttgttaaatct

SEQ ID NO: 8245673 - DNA, 22 bp, Homo sapiens
ttacacaaaaataagatatggc

SEQ ID NO: 8245674 - DNA, 22 bp, Homo sapiens
ttacacaaaaataagatatggc

SEQ ID NO: 8245675 - DNA, 22 bp, Homo sapiens
ttacacaaaaataagatatggc

SEQ ID NO: 8245676 - DNA, 22 bp, Homo sapiens
ttacacaaacacattccagata

SEQ ID NO: 8245677 - DNA, 22 bp, Homo sapiens
ttacacaaaagcaagtgtgtgt

SEQ ID NO: 8245678 - DNA, 22 bp, Homo sapiens
ttacacttttgacaaacctgag

SEQ ID NO: 8245679 - DNA, 20 bp, Homo sapiens
ttacactttgtagcattttt

SEQ ID NO: 8245680 - DNA, 22 bp, Homo sapiens
ttacagaatgtgccatttggtc

SEQ ID NO: 8245681 - DNA, 22 bp, Homo sapiens
ttacagaatgtgccatttggtc

SEQ ID NO: 8245682 - DNA, 22 bp, Homo sapiens
ttacagaatctactcgtggtga

SEQ ID NO: 8245683 - DNA, 22 bp, Homo sapiens
ttacagaaaaggggttgtcctt

SEQ ID NO: 8245684 - DNA, 22 bp, Homo sapiens
ttacagagataaactgtaagtg

SEQ ID NO: 8245685 - DNA, 22 bp, Homo sapiens
ttacagagcctcattttagaga

SEQ ID NO: 8245686 - DNA, 22 bp, Homo sapiens
ttacagagcctcattttagaga

SEQ ID NO: 8245687 - DNA, 22 bp, Homo sapiens
ttacagagaggtgattgtgaag

SEQ ID NO: 8245688 - DNA, 22 bp, Homo sapiens
ttacagagaggtgattgtgaag

SEQ ID NO: 8245689 - DNA, 22 bp, Homo sapiens
ttacagagaggtgattgtgaag

SEQ ID NO: 8245690 - DNA, 22 bp, Homo sapiens
ttacagagaggtgattgtgaag

SEQ ID NO: 8245691 - DNA, 17 bp, Homo sapiens
ttacagaggtaattaag

SEQ ID NO: 8245692 - DNA, 22 bp, Homo sapiens
ttacagaggcttccagggccca

SEQ ID NO: 8245693 - DNA, 17 bp, Homo sapiens
ttacagaggtaattaag

SEQ ID NO: 8245694 - DNA, 22 bp, Homo sapiens
ttacagagctcatttctaaggg

SEQ ID NO: 8245695 - DNA, 22 bp, Homo sapiens
ttacagagctgggtggagagag

SEQ ID NO: 8245696 - DNA, 22 bp, Homo sapiens
ttacagatactttgtaggcaag

SEQ ID NO: 8245697 - DNA, 22 bp, Homo sapiens
ttacagatactttgtaggcaag

SEQ ID NO: 8245698 - DNA, 22 bp, Homo sapiens
ttacagagtggtctggctatgt

SEQ ID NO: 8245699 - DNA, 22 bp, Homo sapiens
ttacagagttcgcacctggtgg

SEQ ID NO: 8245700 - DNA, 22 bp, Homo sapiens
ttacagagtagggaattgaagt

SEQ ID NO: 8245701 - DNA, 17 bp, Homo sapiens
ttacagaggtaattaag

SEQ ID NO: 8245702 - DNA, 22 bp, Homo sapiens
ttacagaggtatgtatgtctct

SEQ ID NO: 8245703 - DNA, 22 bp, Homo sapiens
ttacagagttcgcacctggtgg

SEQ ID NO: 8245704 - DNA, 22 bp, Homo sapiens
ttacagagtggtctggctatgt

SEQ ID NO: 8245705 - DNA, 22 bp, Homo sapiens
ttacagagtagtgcagaactca

SEQ ID NO: 8245706 - DNA, 22 bp, Homo sapiens
ttacagagtggtctggctatgt

SEQ ID NO: 8245707 - DNA, 22 bp, Homo sapiens
ttacatgatgatttcataaaca

SEQ ID NO: 8245708 - DNA, 22 bp, Homo sapiens
ttacatgggccatttagacatg

SEQ ID NO: 8245709 - DNA, 22 bp, Homo sapiens
ttacatgggcttgtgagtcctt

SEQ ID NO: 8245710 - DNA, 22 bp, Homo sapiens
ttacatgcttagagatgcatgc

SEQ ID NO: 8245711 - DNA, 22 bp, Homo sapiens
ttacagctagccaattatttag

SEQ ID NO: 8245712 - DNA, 23 bp, Homo sapiens
ttacagctaactgctgttattag

SEQ ID NO: 8245713 - DNA, 22 bp, Homo sapiens
ttacatgactcaatagaagggc

SEQ ID NO: 8245714 - DNA, 22 bp, Homo sapiens
ttacagcagtgggaaggagtca

SEQ ID NO: 8245715 - DNA, 17 bp, Homo sapiens
ttacagcagcaatagag

SEQ ID NO: 8245716 - DNA, 22 bp, Homo sapiens
ttacagcagcagggacagacta

SEQ ID NO: 8245717 - DNA, 22 bp, Homo sapiens
ttacagatggatctagcaaaat

SEQ ID NO: 8245718 - DNA, 22 bp, Homo sapiens
ttacagatcatcaaggtataat

SEQ ID NO: 8245719 - DNA, 22 bp, Homo sapiens
ttacagattaaaatgctgaggt

SEQ ID NO: 8245720 - DNA, 22 bp, Homo sapiens
ttacagattaaaatgctgaggt

SEQ ID NO: 8245721 - DNA, 22 bp, Homo sapiens
ttacagatgtttcaggaatact

SEQ ID NO: 8245722 - DNA, 18 bp, Homo sapiens
ttacagcagcaacaggaa

SEQ ID NO: 8245723 - DNA, 22 bp, Homo sapiens
ttacatgtttatgtggtacatg

SEQ ID NO: 8245724 - DNA, 22 bp, Homo sapiens
ttacatgtttatgggggtacat

SEQ ID NO: 8245725 - DNA, 22 bp, Homo sapiens
ttacatgtttacggatacactt

SEQ ID NO: 8245726 - DNA, 22 bp, Homo sapiens
ttacatgtttacggatacactt

SEQ ID NO: 8245727 - DNA, 22 bp, Homo sapiens
ttacatgtttatgtggtacatg

SEQ ID NO: 8245728 - DNA, 22 bp, Homo sapiens
ttacatgtttatgtggtacatg

SEQ ID NO: 8245729 - DNA, 22 bp, Homo sapiens
ttacatgtggagtctgattgca

SEQ ID NO: 8245730 - DNA, 22 bp, Homo sapiens
ttacatgtggtgtgaagaagag

SEQ ID NO: 8245731 - DNA, 23 bp, Homo sapiens
ttacatgtgtgcacacattctgg

SEQ ID NO: 8245732 - DNA, 22 bp, Homo sapiens
ttacatgttctcatacacagag

SEQ ID NO: 8245733 - DNA, 21 bp, Homo sapiens
ttacatggtttatcatatgga

SEQ ID NO: 8245734 - DNA, 21 bp, Homo sapiens
ttacatggtttatcatatgga

SEQ ID NO: 8245735 - DNA, 22 bp, Homo sapiens
ttacatgtaatctaaaataatt

SEQ ID NO: 8245736 - DNA, 22 bp, Homo sapiens
ttacatgtaatctaaaataatt

SEQ ID NO: 8245737 - DNA, 22 bp, Homo sapiens
ttacatgtacaaacaattctta

SEQ ID NO: 8245738 - DNA, 22 bp, Homo sapiens
ttacatgtactggtttgactta

SEQ ID NO: 8245739 - DNA, 22 bp, Homo sapiens
ttacatgtggagtctgattgca

SEQ ID NO: 8245740 - DNA, 22 bp, Homo sapiens
ttacatgtattttggaaaaagt

SEQ ID NO: 8245741 - DNA, 22 bp, Homo sapiens
ttacatgtggtgtgaagaagag

SEQ ID NO: 8245742 - DNA, 22 bp, Homo sapiens
ttacatttcccccttggaggct

SEQ ID NO: 8245743 - DNA, 22 bp, Homo sapiens
ttacatttggctatgtcctcta

SEQ ID NO: 8245744 - DNA, 22 bp, Homo sapiens
ttacattttagttaacctgtga

SEQ ID NO: 8245745 - DNA, 22 bp, Homo sapiens
ttacattttgcacagatgtccc

SEQ ID NO: 8245746 - DNA, 22 bp, Homo sapiens
ttacattttgcacagatgtccc

SEQ ID NO: 8245747 - DNA, 22 bp, Homo sapiens
ttattctgagagttgaagtaat

SEQ ID NO: 8245748 - DNA, 22 bp, Homo sapiens
ttattctgcacttttaaaatat

SEQ ID NO: 8245749 - DNA, 22 bp, Homo sapiens
ttattctgagagttgaagtaat

SEQ ID NO: 8245750 - DNA, 22 bp, Homo sapiens
ttattctgactaatgtataact

SEQ ID NO: 8245751 - DNA, 22 bp, Homo sapiens
ttattctcatctccctacttag

SEQ ID NO: 8245752 - DNA, 22 bp, Homo sapiens
ttattccaggcacagaaggagg

SEQ ID NO: 8245753 - DNA, 22 bp, Homo sapiens
ttattccattcagttcaacaag

SEQ ID NO: 8245754 - DNA, 22 bp, Homo sapiens
ttattccattcagttcaacaag

SEQ ID NO: 8245755 - DNA, 22 bp, Homo sapiens
ttattcagtgcatatattaaaa

SEQ ID NO: 8245756 - DNA, 22 bp, Homo sapiens
ttattattggtgagttaaggaa

SEQ ID NO: 8245757 - DNA, 22 bp, Homo sapiens
ttattcagggataacatccagg

SEQ ID NO: 8245758 - DNA, 22 bp, Homo sapiens
ttattattgattcgctctcaaa

SEQ ID NO: 8245759 - DNA, 22 bp, Homo sapiens
ttattattgattcgctctcaaa

SEQ ID NO: 8245760 - DNA, 22 bp, Homo sapiens
ttattattggtgagttaaggaa

SEQ ID NO: 8245761 - DNA, 22 bp, Homo sapiens
ttattcattaacagggaccaaa

SEQ ID NO: 8245762 - DNA, 22 bp, Homo sapiens
ttattccaagataggatagcat

SEQ ID NO: 8245763 - DNA, 22 bp, Homo sapiens
ttattctgtctttggtctcaat

SEQ ID NO: 8245764 - DNA, 22 bp, Homo sapiens
ttattctgttgcttttacagta

SEQ ID NO: 8245765 - DNA, 22 bp, Homo sapiens
ttattctgtgaacatggttaat

SEQ ID NO: 8245766 - DNA, 22 bp, Homo sapiens
ttattctggaggaagcaaatgg

SEQ ID NO: 8245767 - DNA, 22 bp, Homo sapiens
ttattctggaggaagcaaatgg

SEQ ID NO: 8245768 - DNA, 17 bp, Homo sapiens
ttattctggcatatgtg

SEQ ID NO: 8245769 - DNA, 22 bp, Homo sapiens
ttattctgtatttcaggtatgt

SEQ ID NO: 8245770 - DNA, 22 bp, Homo sapiens
ttattcttggatctgagtctct

SEQ ID NO: 8245771 - DNA, 22 bp, Homo sapiens
ttattcttcttctcttgccagg

SEQ ID NO: 8245772 - DNA, 18 bp, Homo sapiens
ttattcttccaggccacc

SEQ ID NO: 8245773 - DNA, 19 bp, Homo sapiens
ttattcttaaagtagctta

SEQ ID NO: 8245774 - DNA, 22 bp, Homo sapiens
ttattctgttgcttttacagta

SEQ ID NO: 8245775 - DNA, 22 bp, Homo sapiens
ttattctgttgcttttacagta

SEQ ID NO: 8245776 - DNA, 22 bp, Homo sapiens
ttatttcattgatttctaagac

SEQ ID NO: 8245777 - DNA, 22 bp, Homo sapiens
ttatttccaaactggatatacc

SEQ ID NO: 8245778 - DNA, 22 bp, Homo sapiens
ttatttcattgatttctaagac

SEQ ID NO: 8245779 - DNA, 22 bp, Homo sapiens
ttatttccaaactggatatacc

SEQ ID NO: 8245780 - DNA, 22 bp, Homo sapiens
ttatttccacaatgtggtaggg

SEQ ID NO: 8245781 - DNA, 22 bp, Homo sapiens
ttatttccaaactggatatacc

SEQ ID NO: 8245782 - DNA, 22 bp, Homo sapiens
ttatttccctgagggttgcagg

SEQ ID NO: 8245783 - DNA, 22 bp, Homo sapiens
ttatttcctaaatctctttgtt

SEQ ID NO: 8245784 - DNA, 22 bp, Homo sapiens
ttatttccctgagggttgcagg

SEQ ID NO: 8245785 - DNA, 22 bp, Homo sapiens
ttatttccagtccagaaattta

SEQ ID NO: 8245786 - DNA, 20 bp, Homo sapiens
ttatttccagtccaggtcct

SEQ ID NO: 8245787 - DNA, 22 bp, Homo sapiens
ttatttccacaatgtggtaggg

SEQ ID NO: 8245788 - DNA, 22 bp, Homo sapiens
ttatttccagtccagaaattta

SEQ ID NO: 8245789 - DNA, 22 bp, Homo sapiens
ttatttccagtccagaaattta

SEQ ID NO: 8245790 - DNA, 20 bp, Homo sapiens
ttatttccagtccaggtcct

SEQ ID NO: 8245791 - DNA, 22 bp, Homo sapiens
ttattcttggatctgagtctct

SEQ ID NO: 8245792 - DNA, 22 bp, Homo sapiens
ttattcttggatctgagtctct

SEQ ID NO: 8245793 - DNA, 22 bp, Homo sapiens
ttatttatggccctcacctgat

SEQ ID NO: 8245794 - DNA, 22 bp, Homo sapiens
ttatttatggccctcacctgat

SEQ ID NO: 8245795 - DNA, 22 bp, Homo sapiens
ttatttatgttaacagtcgaga

SEQ ID NO: 8245796 - DNA, 22 bp, Homo sapiens
ttatttatgttaacagtcgaga

SEQ ID NO: 8245797 - DNA, 22 bp, Homo sapiens
ttatcttggtgttttagtaatt

SEQ ID NO: 8245798 - DNA, 17 bp, Homo sapiens
ttatcttgctgtttcta

SEQ ID NO: 8245799 - DNA, 22 bp, Homo sapiens
ttatcttagaggtgattgtatt

SEQ ID NO: 8245800 - DNA, 22 bp, Homo sapiens
ttatcttggtgttttagtaatt

SEQ ID NO: 8245801 - DNA, 22 bp, Homo sapiens
ttatcttgtagagatattttcg

SEQ ID NO: 8245802 - DNA, 22 bp, Homo sapiens
ttatgaaaacaatcagtaggca

SEQ ID NO: 8245803 - DNA, 22 bp, Homo sapiens
ttatgacaggaaaatcacagaa

SEQ ID NO: 8245804 - DNA, 22 bp, Homo sapiens
ttatgaagttcctgttacagtg

SEQ ID NO: 8245805 - DNA, 19 bp, Homo sapiens
ttatgaatagcttcatcca

SEQ ID NO: 8245806 - DNA, 22 bp, Homo sapiens
ttatgatttgccacagattggt

SEQ ID NO: 8245807 - DNA, 22 bp, Homo sapiens
ttatgatttagaaagattcact

SEQ ID NO: 8245808 - DNA, 22 bp, Homo sapiens
ttatgatttgccacagattggt

SEQ ID NO: 8245809 - DNA, 22 bp, Homo sapiens
ttatgagactgttttacacact

SEQ ID NO: 8245810 - DNA, 22 bp, Homo sapiens
ttatgacatatgagtacaagta

SEQ ID NO: 8245811 - DNA, 22 bp, Homo sapiens
ttatgagatatttatactgctg

SEQ ID NO: 8245812 - DNA, 22 bp, Homo sapiens
ttatgagactgttttacacact

SEQ ID NO: 8245813 - DNA, 22 bp, Homo sapiens
ttatgatttgccacagattggt

SEQ ID NO: 8245814 - DNA, 22 bp, Homo sapiens
ttatgcaaagaaatagactaat

SEQ ID NO: 8245815 - DNA, 22 bp, Homo sapiens
ttatgcaaagaaatagactaat

SEQ ID NO: 8245816 - DNA, 22 bp, Homo sapiens
ttattattccccaagtcattat

SEQ ID NO: 8245817 - DNA, 22 bp, Homo sapiens
ttattattccccaagtcattat

SEQ ID NO: 8245818 - DNA, 22 bp, Homo sapiens
ttatctggtatagtggggaaga

SEQ ID NO: 8245819 - DNA, 22 bp, Homo sapiens
ttatctgtctatcaagactagc

SEQ ID NO: 8245820 - DNA, 22 bp, Homo sapiens
ttatctgtgatcctaaatgtct

SEQ ID NO: 8245821 - DNA, 19 bp, Homo sapiens
ttatctgtgttgcagtggt

SEQ ID NO: 8245822 - DNA, 22 bp, Homo sapiens
ttatctgttgttttagtacaat

SEQ ID NO: 8245823 - DNA, 22 bp, Homo sapiens
ttatctgtttaacaaagtatct

SEQ ID NO: 8245824 - DNA, 22 bp, Homo sapiens
ttatcttagaggtgattgtatt

SEQ ID NO: 8245825 - DNA, 22 bp, Homo sapiens
ttatatgtttctgtttggaggc

SEQ ID NO: 8245826 - DNA, 22 bp, Homo sapiens
ttatctggtatagtggggaaga

SEQ ID NO: 8245827 - DNA, 22 bp, Homo sapiens
ttatctgaaacttttgggacca

SEQ ID NO: 8245828 - DNA, 22 bp, Homo sapiens
ttatatgtttctgtttggaggc

SEQ ID NO: 8245829 - DNA, 22 bp, Homo sapiens
ttatatgtttctgtttggaggc

SEQ ID NO: 8245830 - DNA, 22 bp, Homo sapiens
ttatatgtttctgtttggaggc

SEQ ID NO: 8245831 - DNA, 22 bp, Homo sapiens
ttatatgtttctgtttggaggc

SEQ ID NO: 8245832 - DNA, 22 bp, Homo sapiens
ttatatgtatgcttataaacca

SEQ ID NO: 8245833 - DNA, 22 bp, Homo sapiens
ttatatgtatgcttataaacca

SEQ ID NO: 8245834 - DNA, 22 bp, Homo sapiens
ttagtgctaaatactcccacag

SEQ ID NO: 8245835 - DNA, 22 bp, Homo sapiens
ttagtgattacagatatataaa

SEQ ID NO: 8245836 - DNA, 22 bp, Homo sapiens
ttagtgcaccatcctgaggtgt

SEQ ID NO: 8245837 - DNA, 22 bp, Homo sapiens
ttagtgcattttaatagagatg

SEQ ID NO: 8245838 - DNA, 22 bp, Homo sapiens
ttagtgatgaagaattactagg

SEQ ID NO: 8245839 - DNA, 22 bp, Homo sapiens
ttagtgaatcacagagtacata

SEQ ID NO: 8245840 - DNA, 22 bp, Homo sapiens
ttagtgaatcacagagtacata

SEQ ID NO: 8245841 - DNA, 22 bp, Homo sapiens
ttagtgaaaagaaaatgagtgg

SEQ ID NO: 8245842 - DNA, 22 bp, Homo sapiens
ttagtgaaagtaatacaaagta

SEQ ID NO: 8245843 - DNA, 22 bp, Homo sapiens
ttagtgaaatgactgcataggt

SEQ ID NO: 8245844 - DNA, 22 bp, Homo sapiens
ttagtagtaagagtcatatgta

SEQ ID NO: 8245845 - DNA, 22 bp, Homo sapiens
ttagtcttcttccttatatgtt

SEQ ID NO: 8245846 - DNA, 22 bp, Homo sapiens
ttagtcttggtgagtcttggtt

SEQ ID NO: 8245847 - DNA, 22 bp, Homo sapiens
ttagtgaaaagaaaatgagtgg

SEQ ID NO: 8245848 - DNA, 22 bp, Homo sapiens
ttagatatgtttttgctaatgc

SEQ ID NO: 8245849 - DNA, 22 bp, Homo sapiens
ttagatatgtttttgctaatgc

SEQ ID NO: 8245850 - DNA, 22 bp, Homo sapiens
ttagataatgttattgtaattt

SEQ ID NO: 8245851 - DNA, 22 bp, Homo sapiens
ttagatcattttgaactaattt

SEQ ID NO: 8245852 - DNA, 22 bp, Homo sapiens
ttagatatgtttttgctaatgc

SEQ ID NO: 8245853 - DNA, 22 bp, Homo sapiens
ttagatcaatactaaagaagtt

SEQ ID NO: 8245854 - DNA, 22 bp, Homo sapiens
ttagaacatagcaacagaatta

SEQ ID NO: 8245855 - DNA, 22 bp, Homo sapiens
ttagaacaccattctatattac

SEQ ID NO: 8245856 - DNA, 22 bp, Homo sapiens
ttagaacatctgtgtctttatg

SEQ ID NO: 8245857 - DNA, 22 bp, Homo sapiens
ttagaacatctgtgtctttatg

SEQ ID NO: 8245858 - DNA, 22 bp, Homo sapiens
ttagaacatctctcttctgcca

SEQ ID NO: 8245859 - DNA, 22 bp, Homo sapiens
ttagaaaggttttgctctgaaa

SEQ ID NO: 8245860 - DNA, 22 bp, Homo sapiens
ttagaaaggagcttatttcttt

SEQ ID NO: 8245861 - DNA, 22 bp, Homo sapiens
ttacattttggggtaaggataa

SEQ ID NO: 8245862 - DNA, 22 bp, Homo sapiens
ttacattttgcacagatgtccc

SEQ ID NO: 8245863 - DNA, 22 bp, Homo sapiens
ttacattttgcacagatgtccc

SEQ ID NO: 8245864 - DNA, 22 bp, Homo sapiens
ttagaaatctgctgccatgcaa

SEQ ID NO: 8245865 - DNA, 22 bp, Homo sapiens
ttagaaatgtcacagatctgat

SEQ ID NO: 8245866 - DNA, 21 bp, Homo sapiens
ttagaacaatatttggtatag

SEQ ID NO: 8245867 - DNA, 22 bp, Homo sapiens
ttagaacaccattctatattac

SEQ ID NO: 8245868 - DNA, 22 bp, Homo sapiens
ttagcaaacaaatgaaatggtt

SEQ ID NO: 8245869 - DNA, 17 bp, Homo sapiens
ttagcaaaatagcactt

SEQ ID NO: 8245870 - DNA, 22 bp, Homo sapiens
ttagcaaaaatatctcatatta

SEQ ID NO: 8245871 - DNA, 22 bp, Homo sapiens
ttagatttatatgtgagaatgg

SEQ ID NO: 8245872 - DNA, 22 bp, Homo sapiens
ttagatgttcactctatccccc

SEQ ID NO: 8245873 - DNA, 22 bp, Homo sapiens
ttagatgtggacttatgttatt

SEQ ID NO: 8245874 - DNA, 22 bp, Homo sapiens
ttagatgtggctatatgatcgt

SEQ ID NO: 8245875 - DNA, 22 bp, Homo sapiens
ttagcagatttcatgtacattt

SEQ ID NO: 8245876 - DNA, 22 bp, Homo sapiens
ttagcagttgtgagaccctaga

SEQ ID NO: 8245877 - DNA, 22 bp, Homo sapiens
ttagcagcttttaaatggttct

SEQ ID NO: 8245878 - DNA, 22 bp, Homo sapiens
ttaggtattttgttatgtcagc

SEQ ID NO: 8245879 - DNA, 22 bp, Homo sapiens
ttagtaaataaagtctactttc

SEQ ID NO: 8245880 - DNA, 22 bp, Homo sapiens
ttaggtaaggatggtgacagta

SEQ ID NO: 8245881 - DNA, 22 bp, Homo sapiens
ttaggtaaggatggtgacagta

SEQ ID NO: 8245882 - DNA, 22 bp, Homo sapiens
ttaggtaagtaggatcaaaaaa

SEQ ID NO: 8245883 - DNA, 22 bp, Homo sapiens
ttaggtaaggatggtgacagta

SEQ ID NO: 8245884 - DNA, 22 bp, Homo sapiens
ttagtaaataaagtctactttc

SEQ ID NO: 8245885 - DNA, 22 bp, Homo sapiens
ttagtagaagacagataacaaa

SEQ ID NO: 8245886 - DNA, 22 bp, Homo sapiens
ttagtagattgtgatcagtact

SEQ ID NO: 8245887 - DNA, 22 bp, Homo sapiens
ttagtagaatgttatagcaatt

SEQ ID NO: 8245888 - DNA, 22 bp, Homo sapiens
ttagtacagaatcaaaagcaat

SEQ ID NO: 8245889 - DNA, 22 bp, Homo sapiens
ttagtacattgattcattatgt

SEQ ID NO: 8245890 - DNA, 22 bp, Homo sapiens
ttagtacattgattcattatgt

SEQ ID NO: 8245891 - DNA, 22 bp, Homo sapiens
ttagggaagcatggaggagatg

SEQ ID NO: 8245892 - DNA, 22 bp, Homo sapiens
ttagggaaggacagtgaagaaa

SEQ ID NO: 8245893 - DNA, 22 bp, Homo sapiens
ttagggaagtgttattctcagg

SEQ ID NO: 8245894 - DNA, 22 bp, Homo sapiens
ttaggaaggacttggattctgg

SEQ ID NO: 8245895 - DNA, 22 bp, Homo sapiens
ttagggttacaccagcctcctg

SEQ ID NO: 8245896 - DNA, 22 bp, Homo sapiens
ttagggagctcagtcctcagat

SEQ ID NO: 8245897 - DNA, 22 bp, Homo sapiens
ttagggagaaatgcttccctca

SEQ ID NO: 8245898 - DNA, 22 bp, Homo sapiens
ttagcatttcagtacacatgtt

SEQ ID NO: 8245899 - DNA, 22 bp, Homo sapiens
ttaggaagagctttcaatcact

SEQ ID NO: 8245900 - DNA, 22 bp, Homo sapiens
ttaggaagatgctttttctggg

SEQ ID NO: 8245901 - DNA, 22 bp, Homo sapiens
tgggtaggaccagaaatgcact

SEQ ID NO: 8245902 - DNA, 22 bp, Homo sapiens
tgggtagggacttagctggctg

SEQ ID NO: 8245903 - DNA, 22 bp, Homo sapiens
tgggtaggccaggaagcagtgt

SEQ ID NO: 8245904 - DNA, 22 bp, Homo sapiens
tgggtaggaatcgagtgtatgg

SEQ ID NO: 8245905 - DNA, 22 bp, Homo sapiens
tgggtaggccaggaagcagtgt

SEQ ID NO: 8245906 - DNA, 22 bp, Homo sapiens
tgggtaggccaggaagcagtgt

SEQ ID NO: 8245907 - DNA, 22 bp, Homo sapiens
tgggtagggacttagctggctg

SEQ ID NO: 8245908 - DNA, 22 bp, Homo sapiens
tgggtagggacttagctggctg

SEQ ID NO: 8245909 - DNA, 22 bp, Homo sapiens
tgggtagggacttagctggctg

SEQ ID NO: 8245910 - DNA, 22 bp, Homo sapiens
tgggtagggagctggaatccta

SEQ ID NO: 8245911 - DNA, 22 bp, Homo sapiens
tgggtaggggacgtggaagaaa

SEQ ID NO: 8245912 - DNA, 22 bp, Homo sapiens
tgggtaggggacgtggaagaaa

SEQ ID NO: 8245913 - DNA, 22 bp, Homo sapiens
tgggtaggggacgtggaagaaa

SEQ ID NO: 8245914 - DNA, 22 bp, Homo sapiens
tgggtaggggacgtggaagaaa

SEQ ID NO: 8245915 - DNA, 22 bp, Homo sapiens
tgggtagggcctgcgcctgtgc

SEQ ID NO: 8245916 - DNA, 22 bp, Homo sapiens
tgggtccagtgcagctgcgcgt

SEQ ID NO: 8245917 - DNA, 22 bp, Homo sapiens
tgggtccacttctgcactgtgg

SEQ ID NO: 8245918 - DNA, 22 bp, Homo sapiens
tgggtccacggaagacttaggg

SEQ ID NO: 8245919 - DNA, 22 bp, Homo sapiens
tgggtccacttctgcactgtgg

SEQ ID NO: 8245920 - DNA, 22 bp, Homo sapiens
tgggtccacttctgcactgtgg

SEQ ID NO: 8245921 - DNA, 22 bp, Homo sapiens
tggggttttaacatgttgccag

SEQ ID NO: 8245922 - DNA, 22 bp, Homo sapiens
tggggttgcctcccgccctgga

SEQ ID NO: 8245923 - DNA, 22 bp, Homo sapiens
tggggttgcctcccgccctgga

SEQ ID NO: 8245924 - DNA, 22 bp, Homo sapiens
tgggtaagaattgggggctctg

SEQ ID NO: 8245925 - DNA, 22 bp, Homo sapiens
tgggtaaggtactgtagatctg

SEQ ID NO: 8245926 - DNA, 23 bp, Homo sapiens
tggggttgaattgtagctgtgcc

SEQ ID NO: 8245927 - DNA, 23 bp, Homo sapiens
tggggttgaattgtagctgtgcc

SEQ ID NO: 8245928 - DNA, 23 bp, Homo sapiens
tggggttgaattgtagctgtgcc

SEQ ID NO: 8245929 - DNA, 22 bp, Homo sapiens
tggggttgaagaaaggatctag

SEQ ID NO: 8245930 - DNA, 22 bp, Homo sapiens
tggggttctttgtttcctgcct

SEQ ID NO: 8245931 - DNA, 23 bp, Homo sapiens
tggggttgaattgtagctgtgcc

SEQ ID NO: 8245932 - DNA, 22 bp, Homo sapiens
tggggttgaagaaaggatctag

SEQ ID NO: 8245933 - DNA, 22 bp, Homo sapiens
tgggtactcctattagttcagt

SEQ ID NO: 8245934 - DNA, 22 bp, Homo sapiens
tgggtagaaacaaggctggact

SEQ ID NO: 8245935 - DNA, 22 bp, Homo sapiens
tgggtagaaacaaggctggact

SEQ ID NO: 8245936 - DNA, 22 bp, Homo sapiens
tgggtagagcaggctggggctt

SEQ ID NO: 8245937 - DNA, 22 bp, Homo sapiens
tgggtagagacacagtctgggg

SEQ ID NO: 8245938 - DNA, 23 bp, Homo sapiens
tgggtagagctgcaaggacactg

SEQ ID NO: 8245939 - DNA, 22 bp, Homo sapiens
tgggtagcagggctgagctgtg

SEQ ID NO: 8245940 - DNA, 22 bp, Homo sapiens
tgggtaggaatcgagtgtatgg

SEQ ID NO: 8245941 - DNA, 20 bp, Homo sapiens
tgggtcctgcacattctcca

SEQ ID NO: 8245942 - DNA, 20 bp, Homo sapiens
tgggtcctgcacattctcca

SEQ ID NO: 8245943 - DNA, 20 bp, Homo sapiens
tgggtcctgcttcttcctga

SEQ ID NO: 8245944 - DNA, 22 bp, Homo sapiens
tgggtcctgtctccttgttctg

SEQ ID NO: 8245945 - DNA, 22 bp, Homo sapiens
tgggtcccttcagctctcatgg

SEQ ID NO: 8245946 - DNA, 22 bp, Homo sapiens
tgggtccctcatgagaggcatt

SEQ ID NO: 8245947 - DNA, 22 bp, Homo sapiens
tgggtccctcatgagaggcatt

SEQ ID NO: 8245948 - DNA, 22 bp, Homo sapiens
tgggtcccaggaaggaccagca

SEQ ID NO: 8245949 - DNA, 22 bp, Homo sapiens
tgggtcccaaactcctagaggt

SEQ ID NO: 8245950 - DNA, 22 bp, Homo sapiens
tgggtccatggaacagaggtgc

SEQ ID NO: 8245951 - DNA, 22 bp, Homo sapiens
tgggtctccagttcagggcagg

SEQ ID NO: 8245952 - DNA, 22 bp, Homo sapiens
tgggtccttgctgattgctgag

SEQ ID NO: 8245953 - DNA, 22 bp, Homo sapiens
tgggtccttgctaacttctatg

SEQ ID NO: 8245954 - DNA, 22 bp, Homo sapiens
tgggtccttcaaagctgggtct

SEQ ID NO: 8245955 - DNA, 22 bp, Homo sapiens
tgggtctcctgtgcctgggagg

SEQ ID NO: 8245956 - DNA, 22 bp, Homo sapiens
tgggggtgactatctcgggaat

SEQ ID NO: 8245957 - DNA, 21 bp, Homo sapiens
tgggggtgaggcctaggaatc

SEQ ID NO: 8245958 - DNA, 22 bp, Homo sapiens
tgggggtgaaagtctggacagt

SEQ ID NO: 8245959 - DNA, 22 bp, Homo sapiens
tgggggtgaaagtctggacagt

SEQ ID NO: 8245960 - DNA, 22 bp, Homo sapiens
tgggggtgaaagtctggacagt

SEQ ID NO: 8245961 - DNA, 22 bp, Homo sapiens
tggggggcacttcagcacaatg

SEQ ID NO: 8245962 - DNA, 22 bp, Homo sapiens
tggggggcatgaacctccacgg

SEQ ID NO: 8245963 - DNA, 18 bp, Homo sapiens
tggggggcttgtctgaag

SEQ ID NO: 8245964 - DNA, 22 bp, Homo sapiens
tgggggctgtgcacaggctcac

SEQ ID NO: 8245965 - DNA, 22 bp, Homo sapiens
tgggggctgtgcacaggctcac

SEQ ID NO: 8245966 - DNA, 22 bp, Homo sapiens
tgggggctgtgcacaggctcac

SEQ ID NO: 8245967 - DNA, 22 bp, Homo sapiens
tggggggatacttgctactggc

SEQ ID NO: 8245968 - DNA, 22 bp, Homo sapiens
tgggggtggttcttgcctccag

SEQ ID NO: 8245969 - DNA, 22 bp, Homo sapiens
tggggtcgagggttctctggca

SEQ ID NO: 8245970 - DNA, 20 bp, Homo sapiens
tggggtctagttggcctggg

SEQ ID NO: 8245971 - DNA, 20 bp, Homo sapiens
tggggtctagttggcctggg

SEQ ID NO: 8245972 - DNA, 22 bp, Homo sapiens
tggggtctgagtatctgcattt

SEQ ID NO: 8245973 - DNA, 22 bp, Homo sapiens
tggggtctgagtatctgcattt

SEQ ID NO: 8245974 - DNA, 22 bp, Homo sapiens
tggggtctggagttgcccatga

SEQ ID NO: 8245975 - DNA, 22 bp, Homo sapiens
tggggtgaatctttgttgtccg

SEQ ID NO: 8245976 - DNA, 22 bp, Homo sapiens
tggggtgaatctttgttgtccg

SEQ ID NO: 8245977 - DNA, 21 bp, Homo sapiens
tgggggtgaggcctaggaatc

SEQ ID NO: 8245978 - DNA, 21 bp, Homo sapiens
tgggggtgaggcctaggaatc

SEQ ID NO: 8245979 - DNA, 21 bp, Homo sapiens
tgggggtgaggcctaggaatc

SEQ ID NO: 8245980 - DNA, 22 bp, Homo sapiens
tgggggtgctgagaagacagga

SEQ ID NO: 8245981 - DNA, 22 bp, Homo sapiens
tgggggtgctgagaagacagga

SEQ ID NO: 8245982 - DNA, 22 bp, Homo sapiens
tgggggtgccctatgaggaagc

SEQ ID NO: 8245983 - DNA, 22 bp, Homo sapiens
tggggtgggcatgcgctgtcct

SEQ ID NO: 8245984 - DNA, 22 bp, Homo sapiens
tggggtgggcatgcgctgtcct

SEQ ID NO: 8245985 - DNA, 22 bp, Homo sapiens
tggggtgggcatgcgctgtcct

SEQ ID NO: 8245986 - DNA, 22 bp, Homo sapiens
tggggtggggttactcattctg

SEQ ID NO: 8245987 - DNA, 22 bp, Homo sapiens
tggggtggtaatacaccgttct

SEQ ID NO: 8245988 - DNA, 22 bp, Homo sapiens
tggggtggtgggaaccaagtag

SEQ ID NO: 8245989 - DNA, 22 bp, Homo sapiens
tggggtggtgggaaccaagtag

SEQ ID NO: 8245990 - DNA, 22 bp, Homo sapiens
tggggtggtaatacaccgttct

SEQ ID NO: 8245991 - DNA, 22 bp, Homo sapiens
tggggtggtaatacaccgttct

SEQ ID NO: 8245992 - DNA, 22 bp, Homo sapiens
tggggtgtgctcagagcagggg

SEQ ID NO: 8245993 - DNA, 22 bp, Homo sapiens
tggggtgtgagaagtagaggga

SEQ ID NO: 8245994 - DNA, 22 bp, Homo sapiens
tggggttacctacaagtctgag

SEQ ID NO: 8245995 - DNA, 17 bp, Homo sapiens
tggggtgttgaagggtt

SEQ ID NO: 8245996 - DNA, 22 bp, Homo sapiens
tggggtgtgctcagagcagggg

SEQ ID NO: 8245997 - DNA, 22 bp, Homo sapiens
tggggtgtgctcagagcagggg

SEQ ID NO: 8245998 - DNA, 22 bp, Homo sapiens
tggggtgagattcagatattca

SEQ ID NO: 8245999 - DNA, 22 bp, Homo sapiens
tggggtgacagtgcagtggtca

SEQ ID NO: 8246000 - DNA, 22 bp, Homo sapiens
tggggtgacagtgcagtggtca

SEQ ID NO: 8246001 - DNA, 22 bp, Homo sapiens
tggggtgaggcagccacattta

SEQ ID NO: 8246002 - DNA, 22 bp, Homo sapiens
tggggtgccgacagggagggca

SEQ ID NO: 8246003 - DNA, 22 bp, Homo sapiens
tggggtgccgacagggagggca

SEQ ID NO: 8246004 - DNA, 22 bp, Homo sapiens
tggggtggaacccttctgctgg

SEQ ID NO: 8246005 - DNA, 22 bp, Homo sapiens
tggggtggatagaaagtgatgt

SEQ ID NO: 8246006 - DNA, 22 bp, Homo sapiens
tggggtggaacccttctgctgg

SEQ ID NO: 8246007 - DNA, 22 bp, Homo sapiens
tggggtggaacccttctgctgg

SEQ ID NO: 8246008 - DNA, 22 bp, Homo sapiens
tggggtggaacccttctgctgg

SEQ ID NO: 8246009 - DNA, 22 bp, Homo sapiens
tggggtgggcatgcgctgtcct

SEQ ID NO: 8246010 - DNA, 22 bp, Homo sapiens
tggggtggatagaaagtgatgt

SEQ ID NO: 8246011 - DNA, 22 bp, Homo sapiens
tggggtggatagaaagtgatgt

SEQ ID NO: 8246012 - DNA, 22 bp, Homo sapiens
tggggtggatagaaagtgatgt

SEQ ID NO: 8246013 - DNA, 22 bp, Homo sapiens
tggtattacttctagacacaag

SEQ ID NO: 8246014 - DNA, 22 bp, Homo sapiens
tggtattctttctgtagatcat

SEQ ID NO: 8246015 - DNA, 22 bp, Homo sapiens
tggtatttcagcttttgtatct

SEQ ID NO: 8246016 - DNA, 22 bp, Homo sapiens
tggtatttcagcttttgtatct

SEQ ID NO: 8246017 - DNA, 22 bp, Homo sapiens
tggtcaaaccagttatctgtaa

SEQ ID NO: 8246018 - DNA, 22 bp, Homo sapiens
tggtcaaaagaaagctcagaac

SEQ ID NO: 8246019 - DNA, 22 bp, Homo sapiens
tggtcaagattacacactggtg

SEQ ID NO: 8246020 - DNA, 22 bp, Homo sapiens
tggtcacacatgtatctcaatg

SEQ ID NO: 8246021 - DNA, 22 bp, Homo sapiens
tggtcacacatgtatctcaatg

SEQ ID NO: 8246022 - DNA, 22 bp, Homo sapiens
tggtatggcctggagaatgcag

SEQ ID NO: 8246023 - DNA, 22 bp, Homo sapiens
tggtatggctaacgaggtcaag

SEQ ID NO: 8246024 - DNA, 22 bp, Homo sapiens
tggtatggtcaaagcctgtgta

SEQ ID NO: 8246025 - DNA, 22 bp, Homo sapiens
tggtatattttgctctatggtg

SEQ ID NO: 8246026 - DNA, 22 bp, Homo sapiens
tggtatattaactagtttcttc

SEQ ID NO: 8246027 - DNA, 22 bp, Homo sapiens
tggtatatgtgttagcacaagt

SEQ ID NO: 8246028 - DNA, 22 bp, Homo sapiens
tggtatatgcatggaggtatca

SEQ ID NO: 8246029 - DNA, 22 bp, Homo sapiens
tggtatatgcatggaggtatca

SEQ ID NO: 8246030 - DNA, 22 bp, Homo sapiens
tggtataagtaatcataattgc

SEQ ID NO: 8246031 - DNA, 22 bp, Homo sapiens
tggtataatacagtaagtgttg

SEQ ID NO: 8246032 - DNA, 22 bp, Homo sapiens
tggtatgaccgtggtgcaagca

SEQ ID NO: 8246033 - DNA, 22 bp, Homo sapiens
tggtagtcggcctcggtggctc

SEQ ID NO: 8246034 - DNA, 23 bp, Homo sapiens
tggtataaaaacagtacctacct

SEQ ID NO: 8246035 - DNA, 21 bp, Homo sapiens
tggtaggtactggcttcaggc

SEQ ID NO: 8246036 - DNA, 21 bp, Homo sapiens
tggtaggtactggcttcaggc

SEQ ID NO: 8246037 - DNA, 22 bp, Homo sapiens
tggtaaggttccagatctagaa

SEQ ID NO: 8246038 - DNA, 22 bp, Homo sapiens
tggtataaaaatttgtgaatgt

SEQ ID NO: 8246039 - DNA, 22 bp, Homo sapiens
tggtataaaactttttattgaa

SEQ ID NO: 8246040 - DNA, 22 bp, Homo sapiens
tggtataaaaatttgtgaatgt

SEQ ID NO: 8246041 - DNA, 22 bp, Homo sapiens
tggtataaaactttttattgaa

SEQ ID NO: 8246042 - DNA, 22 bp, Homo sapiens
tggtataaaagagtaaactatg

SEQ ID NO: 8246043 - DNA, 22 bp, Homo sapiens
tggtataaacagttactggaga

SEQ ID NO: 8246044 - DNA, 22 bp, Homo sapiens
tggtataagctgtgtcagagcc

SEQ ID NO: 8246045 - DNA, 22 bp, Homo sapiens
tggtataagtaatcataattgc

SEQ ID NO: 8246046 - DNA, 22 bp, Homo sapiens
tggtataatacagtaagtgttg

SEQ ID NO: 8246047 - DNA, 22 bp, Homo sapiens
tggtaaatgtctaacaatcact

SEQ ID NO: 8246048 - DNA, 22 bp, Homo sapiens
tggtaagaataggggctttgga

SEQ ID NO: 8246049 - DNA, 22 bp, Homo sapiens
tggtaaggattgtagaaacgaa

SEQ ID NO: 8246050 - DNA, 22 bp, Homo sapiens
tggtaaggcccagctggagtcc

SEQ ID NO: 8246051 - DNA, 22 bp, Homo sapiens
tggtaaggtcttcactcagatt

SEQ ID NO: 8246052 - DNA, 22 bp, Homo sapiens
tggtaagggtattatttcatcc

SEQ ID NO: 8246053 - DNA, 22 bp, Homo sapiens
tggtaaagttgattggtgctct

SEQ ID NO: 8246054 - DNA, 22 bp, Homo sapiens
tggtaaagtggcttcacagtgt

SEQ ID NO: 8246055 - DNA, 19 bp, Homo sapiens
tggtaaagactgtccccca

SEQ ID NO: 8246056 - DNA, 22 bp, Homo sapiens
tggtaaagaaatgtcagggcag

SEQ ID NO: 8246057 - DNA, 22 bp, Homo sapiens
tgggttaggaaggggtatcacc

SEQ ID NO: 8246058 - DNA, 22 bp, Homo sapiens
tgggttagattccgcgaagcag

SEQ ID NO: 8246059 - DNA, 22 bp, Homo sapiens
tgggttagggcctggtctctga

SEQ ID NO: 8246060 - DNA, 22 bp, Homo sapiens
tgggttaggaaggggtatcacc

SEQ ID NO: 8246061 - DNA, 22 bp, Homo sapiens
tgggttcgatgtatatgtagcc

SEQ ID NO: 8246062 - DNA, 22 bp, Homo sapiens
tgggttccctgacagcgatgct

SEQ ID NO: 8246063 - DNA, 22 bp, Homo sapiens
tgggttctttcacttctcagtt

SEQ ID NO: 8246064 - DNA, 22 bp, Homo sapiens
tgggttctttcacttctcagtt

SEQ ID NO: 8246065 - DNA, 22 bp, Homo sapiens
tgggttctttcacttctcagtt

SEQ ID NO: 8246066 - DNA, 22 bp, Homo sapiens
tgggttggaagcaggaggcacc

SEQ ID NO: 8246067 - DNA, 22 bp, Homo sapiens
tgggttcttaaagggctaggtt

SEQ ID NO: 8246068 - DNA, 19 bp, Homo sapiens
tgggttggaagggaatgaa

SEQ ID NO: 8246069 - DNA, 19 bp, Homo sapiens
tgggttggaagggaatgaa

SEQ ID NO: 8246070 - DNA, 22 bp, Homo sapiens
tgggttttccacatatgccatg

SEQ ID NO: 8246071 - DNA, 22 bp, Homo sapiens
tgggttttccatctatttactc

SEQ ID NO: 8246072 - DNA, 22 bp, Homo sapiens
tgggttgtaagagagtgcactt

SEQ ID NO: 8246073 - DNA, 19 bp, Homo sapiens
tgggttgtatctctaatgg

SEQ ID NO: 8246074 - DNA, 22 bp, Homo sapiens
tgggttgtcatgggtccaaccc

SEQ ID NO: 8246075 - DNA, 22 bp, Homo sapiens
tgggttgtcctctttctgttaa

SEQ ID NO: 8246076 - DNA, 22 bp, Homo sapiens
tgggtttaaactcaactctaaa

SEQ ID NO: 8246077 - DNA, 22 bp, Homo sapiens
tgggttgttccccaagtccaca

SEQ ID NO: 8246078 - DNA, 22 bp, Homo sapiens
tgggttgttgtgacagttacca

SEQ ID NO: 8246079 - DNA, 22 bp, Homo sapiens
tgggttgttcccatccaggccc

SEQ ID NO: 8246080 - DNA, 22 bp, Homo sapiens
tgggttgtctttgtctccactt

SEQ ID NO: 8246081 - DNA, 22 bp, Homo sapiens
tgggtgggagcgccctgtctgg

SEQ ID NO: 8246082 - DNA, 16 bp, Homo sapiens
tgggtgggaggagcgg

SEQ ID NO: 8246083 - DNA, 16 bp, Homo sapiens
tgggtgggaggagcgg

SEQ ID NO: 8246084 - DNA, 21 bp, Homo sapiens
tgggtgggcagagtctcttca

SEQ ID NO: 8246085 - DNA, 21 bp, Homo sapiens
tgggtgggcagagtctcttca

SEQ ID NO: 8246086 - DNA, 17 bp, Homo sapiens
tgggtggtagggagagg

SEQ ID NO: 8246087 - DNA, 22 bp, Homo sapiens
tgggtggtccaggctcagcaga

SEQ ID NO: 8246088 - DNA, 17 bp, Homo sapiens
tgggtggtagggagagg

SEQ ID NO: 8246089 - DNA, 22 bp, Homo sapiens
tgggtgtgagcccgggagccgc

SEQ ID NO: 8246090 - DNA, 22 bp, Homo sapiens
tgggtgtgagcccgggagccgc

SEQ ID NO: 8246091 - DNA, 22 bp, Homo sapiens
tgggtgtgcccagatggtgtcc

SEQ ID NO: 8246092 - DNA, 22 bp, Homo sapiens
tgggtgtgcccagatggtgtcc

SEQ ID NO: 8246093 - DNA, 22 bp, Homo sapiens
tgggtgtgcccagatggtgtcc

SEQ ID NO: 8246094 - DNA, 22 bp, Homo sapiens
tgggtgtgcccagatggtgtcc

SEQ ID NO: 8246095 - DNA, 22 bp, Homo sapiens
tgggtggttatagagatcaact

SEQ ID NO: 8246096 - DNA, 22 bp, Homo sapiens
tgggtggttgctgaggctcctt

SEQ ID NO: 8246097 - DNA, 22 bp, Homo sapiens
tgggtgtgaagtctgttggcct

SEQ ID NO: 8246098 - DNA, 23 bp, Homo sapiens
tgggtgctaatctgctctgtgga

SEQ ID NO: 8246099 - DNA, 22 bp, Homo sapiens
tgggtgctctgcgaccgtaggg

SEQ ID NO: 8246100 - DNA, 22 bp, Homo sapiens
tgggtgctctgcgaccgtaggg

SEQ ID NO: 8246101 - DNA, 22 bp, Homo sapiens
tgggtgccaacctctggtggcc

SEQ ID NO: 8246102 - DNA, 21 bp, Homo sapiens
tgggtgcaagctgcggatgct

SEQ ID NO: 8246103 - DNA, 21 bp, Homo sapiens
tgggtgcaagctgcggatgct

SEQ ID NO: 8246104 - DNA, 22 bp, Homo sapiens
tgggtgcaggatgagtgctggc

SEQ ID NO: 8246105 - DNA, 22 bp, Homo sapiens
tgggtgcatgtgagcacgtgca

SEQ ID NO: 8246106 - DNA, 22 bp, Homo sapiens
tgggtgcaggtcttgtgccagg

SEQ ID NO: 8246107 - DNA, 22 bp, Homo sapiens
tgggtgcttcgtcagctctgag

SEQ ID NO: 8246108 - DNA, 22 bp, Homo sapiens
tgggtgcttcgtcagctctgag

SEQ ID NO: 8246109 - DNA, 22 bp, Homo sapiens
tgggtgctctgcgaccgtaggg

SEQ ID NO: 8246110 - DNA, 22 bp, Homo sapiens
tgggtgctctgcttccctgcac

SEQ ID NO: 8246111 - DNA, 22 bp, Homo sapiens
tgggtggaataaatcagttctg

SEQ ID NO: 8246112 - DNA, 21 bp, Homo sapiens
tgggtggaagcgggaggccgc

SEQ ID NO: 8246113 - DNA, 22 bp, Homo sapiens
tgggtgagtgggaaaagcccag

SEQ ID NO: 8246114 - DNA, 22 bp, Homo sapiens
tgggtgagtggagggcattcta

SEQ ID NO: 8246115 - DNA, 22 bp, Homo sapiens
tgggtgagggacaaaagtttct

SEQ ID NO: 8246116 - DNA, 22 bp, Homo sapiens
tgggtgaggatgatgaggcagc

SEQ ID NO: 8246117 - DNA, 22 bp, Homo sapiens
tgggtgaggatgatgaggcagc

SEQ ID NO: 8246118 - DNA, 22 bp, Homo sapiens
tgggtgaggatgatgaggcagc

SEQ ID NO: 8246119 - DNA, 22 bp, Homo sapiens
tgggtgaggagaggctgtctaa

SEQ ID NO: 8246120 - DNA, 22 bp, Homo sapiens
tgggtgagcggctgcacacccg

SEQ ID NO: 8246121 - DNA, 22 bp, Homo sapiens
tgggtgaggatgatgaggcagc

SEQ ID NO: 8246122 - DNA, 22 bp, Homo sapiens
tgggtgaggagaggctgtctaa

SEQ ID NO: 8246123 - DNA, 22 bp, Homo sapiens
tgggtgagcggctgcacacccg

SEQ ID NO: 8246124 - DNA, 22 bp, Homo sapiens
tgggtgagccacaggagttgtc

SEQ ID NO: 8246125 - DNA, 22 bp, Homo sapiens
tgggtgagccacaggagttgtc

SEQ ID NO: 8246126 - DNA, 22 bp, Homo sapiens
tgggtgagccacaggagttgtc

SEQ ID NO: 8246127 - DNA, 20 bp, Homo sapiens
tgggtgagagtgtttgctct

SEQ ID NO: 8246128 - DNA, 20 bp, Homo sapiens
tggggcctgtttctgtggtt

SEQ ID NO: 8246129 - DNA, 20 bp, Homo sapiens
tggggcctgtttctgtggtt

SEQ ID NO: 8246130 - DNA, 22 bp, Homo sapiens
tggggctagaatcctgcaggaa

SEQ ID NO: 8246131 - DNA, 22 bp, Homo sapiens
tggggctcacctaggctggaag

SEQ ID NO: 8246132 - DNA, 22 bp, Homo sapiens
tggggctaaacacgcctggcct

SEQ ID NO: 8246133 - DNA, 22 bp, Homo sapiens
tggggctaaacacgcctggcct

SEQ ID NO: 8246134 - DNA, 22 bp, Homo sapiens
tggggctaacgagagagcagag

SEQ ID NO: 8246135 - DNA, 22 bp, Homo sapiens
tggggcctgaggtggagctgca

SEQ ID NO: 8246136 - DNA, 22 bp, Homo sapiens
tggggcctgaggtggagctgca

SEQ ID NO: 8246137 - DNA, 22 bp, Homo sapiens
tggggcctgaggtggagctgca

SEQ ID NO: 8246138 - DNA, 22 bp, Homo sapiens
tggggcctggtcagagctgcac

SEQ ID NO: 8246139 - DNA, 20 bp, Homo sapiens
tggggcctgtttctgtggtt

SEQ ID NO: 8246140 - DNA, 22 bp, Homo sapiens
tggggcctgtgacgggtccaga

SEQ ID NO: 8246141 - DNA, 22 bp, Homo sapiens
tggggcctgtgacgggtccaga

SEQ ID NO: 8246142 - DNA, 22 bp, Homo sapiens
tggggctggcacagtctctatt

SEQ ID NO: 8246143 - DNA, 22 bp, Homo sapiens
tggggctggcacagtctctatt

SEQ ID NO: 8246144 - DNA, 23 bp, Homo sapiens
tggggctgatggagacggaccag

SEQ ID NO: 8246145 - DNA, 22 bp, Homo sapiens
tggggctgaggagcctcactct

SEQ ID NO: 8246146 - DNA, 22 bp, Homo sapiens
tggggctgaggagcctcactct

SEQ ID NO: 8246147 - DNA, 23 bp, Homo sapiens
tggggctctggcaggcctgaggt

SEQ ID NO: 8246148 - DNA, 23 bp, Homo sapiens
tggggctctggcaggcctgaggt

SEQ ID NO: 8246149 - DNA, 22 bp, Homo sapiens
tggggctgaggagcctcactct

SEQ ID NO: 8246150 - DNA, 22 bp, Homo sapiens
tggggctgaggagcctcactct

SEQ ID NO: 8246151 - DNA, 22 bp, Homo sapiens
tggggctcacctaggctggaag

SEQ ID NO: 8246152 - DNA, 22 bp, Homo sapiens
tggggctcctcctggcaggagg

SEQ ID NO: 8246153 - DNA, 22 bp, Homo sapiens
tggggctctccacagtgtctca

SEQ ID NO: 8246154 - DNA, 22 bp, Homo sapiens
tggggccaggtggctgcaggtc

SEQ ID NO: 8246155 - DNA, 22 bp, Homo sapiens
tggggccagggaggaccagaca

SEQ ID NO: 8246156 - DNA, 22 bp, Homo sapiens
tggggccagggaggaccagaca

SEQ ID NO: 8246157 - DNA, 22 bp, Homo sapiens
tggggccagggaggaccagaca

SEQ ID NO: 8246158 - DNA, 22 bp, Homo sapiens
tggggccagcggggaggactca

SEQ ID NO: 8246159 - DNA, 22 bp, Homo sapiens
tggggccagcggggaggactca

SEQ ID NO: 8246160 - DNA, 22 bp, Homo sapiens
tggggccagcggggaggactca

SEQ ID NO: 8246161 - DNA, 22 bp, Homo sapiens
tggggccagcggggaggactca

SEQ ID NO: 8246162 - DNA, 22 bp, Homo sapiens
tggggccatctcacccactgtt

SEQ ID NO: 8246163 - DNA, 22 bp, Homo sapiens
tggggccaggtggctgcaggtc

SEQ ID NO: 8246164 - DNA, 22 bp, Homo sapiens
tggggccatctcacccactgtt

SEQ ID NO: 8246165 - DNA, 22 bp, Homo sapiens
tggggcctgaggtggagctgca

SEQ ID NO: 8246166 - DNA, 22 bp, Homo sapiens
tggggcctgaaaggttctcgcc

SEQ ID NO: 8246167 - DNA, 22 bp, Homo sapiens
tggggcctgaaaggttctcgcc

SEQ ID NO: 8246168 - DNA, 19 bp, Homo sapiens
tggggcctcctgtccctgg

SEQ ID NO: 8246169 - DNA, 19 bp, Homo sapiens
tggggcctcctgtccctgg

SEQ ID NO: 8246170 - DNA, 22 bp, Homo sapiens
tggggcagcagacctttcttgg

SEQ ID NO: 8246171 - DNA, 22 bp, Homo sapiens
tggggcagcagacctttcttgg

SEQ ID NO: 8246172 - DNA, 22 bp, Homo sapiens
tggggcagagtaggattttggc

SEQ ID NO: 8246173 - DNA, 22 bp, Homo sapiens
tggggcagagtaggattttggc

SEQ ID NO: 8246174 - DNA, 22 bp, Homo sapiens
tggggcagagtaggattttggc

SEQ ID NO: 8246175 - DNA, 22 bp, Homo sapiens
tggggccagagctgcagggagc

SEQ ID NO: 8246176 - DNA, 22 bp, Homo sapiens
tggggccagagatggggcgcag

SEQ ID NO: 8246177 - DNA, 22 bp, Homo sapiens
tggggccagagctgcagggagc

SEQ ID NO: 8246178 - DNA, 22 bp, Homo sapiens
tggggccagagctgcagggagc

SEQ ID NO: 8246179 - DNA, 22 bp, Homo sapiens
tggggccacagcctcctagctt

SEQ ID NO: 8246180 - DNA, 22 bp, Homo sapiens
tggggccacagcctcctagctt

SEQ ID NO: 8246181 - DNA, 22 bp, Homo sapiens
tggggcagcagacctttcttgg

SEQ ID NO: 8246182 - DNA, 22 bp, Homo sapiens
tggggccacagcctcctagctt

SEQ ID NO: 8246183 - DNA, 22 bp, Homo sapiens
tgggggagctcagtccagccca

SEQ ID NO: 8246184 - DNA, 22 bp, Homo sapiens
tgggggagcgacagacataatt

SEQ ID NO: 8246185 - DNA, 22 bp, Homo sapiens
tgggggagctcagtccagccca

SEQ ID NO: 8246186 - DNA, 22 bp, Homo sapiens
tgggggagccttcacagtagct

SEQ ID NO: 8246187 - DNA, 22 bp, Homo sapiens
tgggggagccttcacagtagct

SEQ ID NO: 8246188 - DNA, 22 bp, Homo sapiens
tgggggagccttcacagtagct

SEQ ID NO: 8246189 - DNA, 22 bp, Homo sapiens
tgggggagccttcacagtagct

SEQ ID NO: 8246190 - DNA, 22 bp, Homo sapiens
tgggggagccttcacagtagct

SEQ ID NO: 8246191 - DNA, 22 bp, Homo sapiens
tgggggagtatagtctggcctc

SEQ ID NO: 8246192 - DNA, 22 bp, Homo sapiens
tgggggagtatagtctggcctc

SEQ ID NO: 8246193 - DNA, 22 bp, Homo sapiens
tgggggagtatagtctggcctc

SEQ ID NO: 8246194 - DNA, 22 bp, Homo sapiens
tgggggagtatagtctggcctc

SEQ ID NO: 8246195 - DNA, 22 bp, Homo sapiens
tgggggagctcagtccagccca

SEQ ID NO: 8246196 - DNA, 22 bp, Homo sapiens
tgggggcacttcgaggtcgcct

SEQ ID NO: 8246197 - DNA, 22 bp, Homo sapiens
tgggggctagaacccagggatt

SEQ ID NO: 8246198 - DNA, 22 bp, Homo sapiens
tgggggctagaacccagggatt

SEQ ID NO: 8246199 - DNA, 22 bp, Homo sapiens
tgggggctccaggctccaggga

SEQ ID NO: 8246200 - DNA, 22 bp, Homo sapiens
tgggggctccaggctccaggga

SEQ ID NO: 8246201 - DNA, 22 bp, Homo sapiens
tgggggcagccaggctgtcaag

SEQ ID NO: 8246202 - DNA, 22 bp, Homo sapiens
tgggggcagccaggctgtcaag

SEQ ID NO: 8246203 - DNA, 22 bp, Homo sapiens
tgggggcatggaccagcctggc

SEQ ID NO: 8246204 - DNA, 22 bp, Homo sapiens
tggggctgtccttagtctgaga

SEQ ID NO: 8246205 - DNA, 22 bp, Homo sapiens
tggggctgtcccggtttggcga

SEQ ID NO: 8246206 - DNA, 22 bp, Homo sapiens
tggggctgtcccggtttggcga

SEQ ID NO: 8246207 - DNA, 22 bp, Homo sapiens
tggggctgtccttagtctgaga

SEQ ID NO: 8246208 - DNA, 22 bp, Homo sapiens
tggggctgtcccggtttggcga

SEQ ID NO: 8246209 - DNA, 22 bp, Homo sapiens
tggggctgtcccggtttggcga

SEQ ID NO: 8246210 - DNA, 22 bp, Homo sapiens
tggggctgtcccggtttggcga

SEQ ID NO: 8246211 - DNA, 22 bp, Homo sapiens
tggggctgtcccggtttggcga

SEQ ID NO: 8246212 - DNA, 22 bp, Homo sapiens
tggggctggggatcttgagcct

SEQ ID NO: 8246213 - DNA, 22 bp, Homo sapiens
tggggctggggatcttgagcct

SEQ ID NO: 8246214 - DNA, 22 bp, Homo sapiens
tggggctggggatcttgagcct

SEQ ID NO: 8246215 - DNA, 22 bp, Homo sapiens
tggggctggggatcttgagcct

SEQ ID NO: 8246216 - DNA, 22 bp, Homo sapiens
tggggctggggatcttgagcct

SEQ ID NO: 8246217 - DNA, 22 bp, Homo sapiens
tggggctggctattgtctccct

SEQ ID NO: 8246218 - DNA, 22 bp, Homo sapiens
tggggctggctattgtctccct

SEQ ID NO: 8246219 - DNA, 22 bp, Homo sapiens
tggggctggggatcttgagcct

SEQ ID NO: 8246220 - DNA, 22 bp, Homo sapiens
tggggctggctattgtctccct

SEQ ID NO: 8246221 - DNA, 22 bp, Homo sapiens
tggggctggctattgtctccct

SEQ ID NO: 8246222 - DNA, 22 bp, Homo sapiens
tggggctggctattgtctccct

SEQ ID NO: 8246223 - DNA, 22 bp, Homo sapiens
tgggggagattgtgcatctcta

SEQ ID NO: 8246224 - DNA, 22 bp, Homo sapiens
tgggggagattgtgcatctcta

SEQ ID NO: 8246225 - DNA, 22 bp, Homo sapiens
tgggggagattgtgcatctcta

SEQ ID NO: 8246226 - DNA, 22 bp, Homo sapiens
tgggggagatagagtctgatgg

SEQ ID NO: 8246227 - DNA, 22 bp, Homo sapiens
tgggggagatagagtctgatgg

SEQ ID NO: 8246228 - DNA, 22 bp, Homo sapiens
tgggggagattagagcttctta

SEQ ID NO: 8246229 - DNA, 22 bp, Homo sapiens
tgggggagattagagcttctta

SEQ ID NO: 8246230 - DNA, 22 bp, Homo sapiens
tgggggagagtttagatgattt

SEQ ID NO: 8246231 - DNA, 22 bp, Homo sapiens
tgggggagagtttagatgattt

SEQ ID NO: 8246232 - DNA, 22 bp, Homo sapiens
tgggggagagtgcaagcatgaa

SEQ ID NO: 8246233 - DNA, 22 bp, Homo sapiens
tggggctgtccttagtctgaga

SEQ ID NO: 8246234 - DNA, 22 bp, Homo sapiens
tggggctgtccttagtctgaga

SEQ ID NO: 8246235 - DNA, 22 bp, Homo sapiens
tgggggagagtgcaagcatgaa

SEQ ID NO: 8246236 - DNA, 22 bp, Homo sapiens
tgggggagagtgcaagcatgaa

SEQ ID NO: 8246237 - DNA, 22 bp, Homo sapiens
tgggggagagtgcaagcatgaa

SEQ ID NO: 8246238 - DNA, 22 bp, Homo sapiens
tggggaggaagtcagatttcag

SEQ ID NO: 8246239 - DNA, 22 bp, Homo sapiens
tggggacccggactcctgggtc

SEQ ID NO: 8246240 - DNA, 22 bp, Homo sapiens
tggggactgacagccaggcctc

SEQ ID NO: 8246241 - DNA, 22 bp, Homo sapiens
tggggaggaagtcagatttcag

SEQ ID NO: 8246242 - DNA, 22 bp, Homo sapiens
tggggaggaagtcagatttcag

SEQ ID NO: 8246243 - DNA, 22 bp, Homo sapiens
tggggacatagccagtctggct

SEQ ID NO: 8246244 - DNA, 22 bp, Homo sapiens
tggggacagggctcagcaattt

SEQ ID NO: 8246245 - DNA, 22 bp, Homo sapiens
tggggaggacgggcgccttcct

SEQ ID NO: 8246246 - DNA, 22 bp, Homo sapiens
tggggaggacgggcgccttcct

SEQ ID NO: 8246247 - DNA, 22 bp, Homo sapiens
tggggaggacgggcgccttcct

SEQ ID NO: 8246248 - DNA, 22 bp, Homo sapiens
tggggaggatatgtgagttatt

SEQ ID NO: 8246249 - DNA, 22 bp, Homo sapiens
tggggaggatatgtgagttatt

SEQ ID NO: 8246250 - DNA, 22 bp, Homo sapiens
tggggaggatatgtgagttatt

SEQ ID NO: 8246251 - DNA, 22 bp, Homo sapiens
tggggaggatatgtgagttatt

SEQ ID NO: 8246252 - DNA, 23 bp, Homo sapiens
tggggagggaagtcatttctgta

SEQ ID NO: 8246253 - DNA, 23 bp, Homo sapiens
tggggagggaagtcatttctgta

SEQ ID NO: 8246254 - DNA, 21 bp, Homo sapiens
tggggaggggacctgattatg

SEQ ID NO: 8246255 - DNA, 21 bp, Homo sapiens
tggggaggggacctgattatg

SEQ ID NO: 8246256 - DNA, 21 bp, Homo sapiens
tggggaggggacctgattatg

SEQ ID NO: 8246257 - DNA, 22 bp, Homo sapiens
tggggatgtaaatgaggtgata

SEQ ID NO: 8246258 - DNA, 22 bp, Homo sapiens
tggggatgtaaatgaggtgata

SEQ ID NO: 8246259 - DNA, 16 bp, Homo sapiens
tggggatggggaagag

SEQ ID NO: 8246260 - DNA, 22 bp, Homo sapiens
tggggatgtaaatgaggtgata

SEQ ID NO: 8246261 - DNA, 22 bp, Homo sapiens
tggggatgtaaatgaggtgata

SEQ ID NO: 8246262 - DNA, 22 bp, Homo sapiens
tggggatgaaacccaggcatct

SEQ ID NO: 8246263 - DNA, 20 bp, Homo sapiens
tggggagttgagcacgagca

SEQ ID NO: 8246264 - DNA, 20 bp, Homo sapiens
tggggagttgagcacgagca

SEQ ID NO: 8246265 - DNA, 22 bp, Homo sapiens
tggggatgaaacccaggcatct

SEQ ID NO: 8246266 - DNA, 22 bp, Homo sapiens
tggggatggatgaatctttgct

SEQ ID NO: 8246267 - DNA, 19 bp, Homo sapiens
tggggatgctgatgaccaa

SEQ ID NO: 8246268 - DNA, 19 bp, Homo sapiens
tggggatgctgatgaccaa

SEQ ID NO: 8246269 - DNA, 21 bp, Homo sapiens
tggggaggggacctgattatg

SEQ ID NO: 8246270 - DNA, 22 bp, Homo sapiens
tggggaggtaacaatttcaggc

SEQ ID NO: 8246271 - DNA, 22 bp, Homo sapiens
tggggaggtaacaatttcaggc

SEQ ID NO: 8246272 - DNA, 22 bp, Homo sapiens
tggggaggtaacaatttcaggc

SEQ ID NO: 8246273 - DNA, 22 bp, Homo sapiens
tggggaggttcgggaatcttgt

SEQ ID NO: 8246274 - DNA, 22 bp, Homo sapiens
tggggaggttcgggaatcttgt

SEQ ID NO: 8246275 - DNA, 22 bp, Homo sapiens
tggggaggttcgggaatcttgt

SEQ ID NO: 8246276 - DNA, 22 bp, Homo sapiens
tggggaggttcgggaatcttgt

SEQ ID NO: 8246277 - DNA, 22 bp, Homo sapiens
tggggagtcgctgcagagcgat

SEQ ID NO: 8246278 - DNA, 22 bp, Homo sapiens
tggggagtcgctgcagagcgat

SEQ ID NO: 8246279 - DNA, 22 bp, Homo sapiens
tggggaaggcggagcttgcagc

SEQ ID NO: 8246280 - DNA, 22 bp, Homo sapiens
tggggacacagagccaaactat

SEQ ID NO: 8246281 - DNA, 22 bp, Homo sapiens
tggggacaggagacttacagct

SEQ ID NO: 8246282 - DNA, 22 bp, Homo sapiens
tggggaagggcaccctggagac

SEQ ID NO: 8246283 - DNA, 22 bp, Homo sapiens
tggggaagggcaccctggagac

SEQ ID NO: 8246284 - DNA, 22 bp, Homo sapiens
tggggaagggcaccctggagac

SEQ ID NO: 8246285 - DNA, 22 bp, Homo sapiens
tggggaaaatgcttgtagtcag

SEQ ID NO: 8246286 - DNA, 22 bp, Homo sapiens
tggggaaactatttccttgtcc

SEQ ID NO: 8246287 - DNA, 22 bp, Homo sapiens
tggggaaactatttccttgtcc

SEQ ID NO: 8246288 - DNA, 22 bp, Homo sapiens
tggggaaactatttccttgtcc

SEQ ID NO: 8246289 - DNA, 22 bp, Homo sapiens
tggggaaagacattcatacagt

SEQ ID NO: 8246290 - DNA, 22 bp, Homo sapiens
tggggaaagacattcatacagt

SEQ ID NO: 8246291 - DNA, 22 bp, Homo sapiens
tggggaaagatagttttctcta

SEQ ID NO: 8246292 - DNA, 22 bp, Homo sapiens
tggggaaagatagttttctcta

SEQ ID NO: 8246293 - DNA, 22 bp, Homo sapiens
tggggaaaggagagcattattt

SEQ ID NO: 8246294 - DNA, 22 bp, Homo sapiens
tggggaaaggaaagttaacctg

SEQ ID NO: 8246295 - DNA, 22 bp, Homo sapiens
tggggaaaggaaagttaacctg

SEQ ID NO: 8246296 - DNA, 20 bp, Homo sapiens
tggggaaagccatcgatgag

SEQ ID NO: 8246297 - DNA, 20 bp, Homo sapiens
tggggaaagccatcgatgag

SEQ ID NO: 8246298 - DNA, 22 bp, Homo sapiens
tggggaaagggatggctcccgc

SEQ ID NO: 8246299 - DNA, 22 bp, Homo sapiens
tggggaaaggagagcattattt

SEQ ID NO: 8246300 - DNA, 22 bp, Homo sapiens
tggggaaagttcttgaaagtaa

SEQ ID NO: 8246301 - DNA, 22 bp, Homo sapiens
tggggaaagttcttgaaagtaa

SEQ ID NO: 8246302 - DNA, 22 bp, Homo sapiens
tggggaaagggatggctcccgc

SEQ ID NO: 8246303 - DNA, 22 bp, Homo sapiens
tggggaagacagcagacactgt

SEQ ID NO: 8246304 - DNA, 22 bp, Homo sapiens
tggggaaatgtcctgccttccc

SEQ ID NO: 8246305 - DNA, 22 bp, Homo sapiens
tggggaaatgtcctgccttccc

SEQ ID NO: 8246306 - DNA, 17 bp, Homo sapiens
tggggaagctcagattt

SEQ ID NO: 8246307 - DNA, 18 bp, Homo sapiens
tgggctgcctggcctctg

SEQ ID NO: 8246308 - DNA, 22 bp, Homo sapiens
tgggctggcgtggagagtttag

SEQ ID NO: 8246309 - DNA, 22 bp, Homo sapiens
tgggctggcgtggagagtttag

SEQ ID NO: 8246310 - DNA, 22 bp, Homo sapiens
tgggctggcgtggagagtttag

SEQ ID NO: 8246311 - DNA, 22 bp, Homo sapiens
tgggctggctgaacttcaacct

SEQ ID NO: 8246312 - DNA, 22 bp, Homo sapiens
tgggctggctgaacttcaacct

SEQ ID NO: 8246313 - DNA, 22 bp, Homo sapiens
tgggctggctgaacttcaacct

SEQ ID NO: 8246314 - DNA, 22 bp, Homo sapiens
tgggctggctgaggcattcact

SEQ ID NO: 8246315 - DNA, 22 bp, Homo sapiens
tgggctggctgaggcattcact

SEQ ID NO: 8246316 - DNA, 22 bp, Homo sapiens
tgggctggctgaggcattcact

SEQ ID NO: 8246317 - DNA, 22 bp, Homo sapiens
tgggctgtccagcacctgggct

SEQ ID NO: 8246318 - DNA, 22 bp, Homo sapiens
tgggctggtgagggatcattta

SEQ ID NO: 8246319 - DNA, 22 bp, Homo sapiens
tgggctggtgagggatcattta

SEQ ID NO: 8246320 - DNA, 22 bp, Homo sapiens
tgggctgtggagcacctttgca

SEQ ID NO: 8246321 - DNA, 22 bp, Homo sapiens
tgggcttaggtacctccctggt

SEQ ID NO: 8246322 - DNA, 22 bp, Homo sapiens
tgggctgtggagaggagctgga

SEQ ID NO: 8246323 - DNA, 22 bp, Homo sapiens
tgggctgtggagaggagctgga

SEQ ID NO: 8246324 - DNA, 22 bp, Homo sapiens
tgggctgtggagaggagctgga

SEQ ID NO: 8246325 - DNA, 22 bp, Homo sapiens
tgggcttcataattggtcctag

SEQ ID NO: 8246326 - DNA, 19 bp, Homo sapiens
tgggcttccccagggcaga

SEQ ID NO: 8246327 - DNA, 19 bp, Homo sapiens
tgggcttccccagggcaga

SEQ ID NO: 8246328 - DNA, 23 bp, Homo sapiens
tgggcttctgagaaagcacctaa

SEQ ID NO: 8246329 - DNA, 23 bp, Homo sapiens
tgggcttctgagaaagcacctaa

SEQ ID NO: 8246330 - DNA, 22 bp, Homo sapiens
tgggcttcctggagcctgtgct

SEQ ID NO: 8246331 - DNA, 22 bp, Homo sapiens
tgggcttggtttctaggtaggt

SEQ ID NO: 8246332 - DNA, 22 bp, Homo sapiens
tgggcttggtttctaggtaggt

SEQ ID NO: 8246333 - DNA, 22 bp, Homo sapiens
tgggcttggaaagctgctgtgc

SEQ ID NO: 8246334 - DNA, 22 bp, Homo sapiens
tgggcttctggagtggggcaga

SEQ ID NO: 8246335 - DNA, 22 bp, Homo sapiens
tgggcttctgatgttgagtgct

SEQ ID NO: 8246336 - DNA, 22 bp, Homo sapiens
tgggcttggaaagctgctgtgc

SEQ ID NO: 8246337 - DNA, 22 bp, Homo sapiens
tggggaaaagcgttaggagttc

SEQ ID NO: 8246338 - DNA, 22 bp, Homo sapiens
tggggaaaagcgttaggagttc

SEQ ID NO: 8246339 - DNA, 22 bp, Homo sapiens
tggggaaaacagaggaaattag

SEQ ID NO: 8246340 - DNA, 22 bp, Homo sapiens
tggggaaaacagaggaaattag

SEQ ID NO: 8246341 - DNA, 22 bp, Homo sapiens
tggggaaaatgcagaagattac

SEQ ID NO: 8246342 - DNA, 22 bp, Homo sapiens
tggggaaaatgcagaagattac

SEQ ID NO: 8246343 - DNA, 22 bp, Homo sapiens
tggggaaaatgcttgtagtcag

SEQ ID NO: 8246344 - DNA, 22 bp, Homo sapiens
tgggctctgaagtcagtctgct

SEQ ID NO: 8246345 - DNA, 22 bp, Homo sapiens
tgggctctctggcaggaaggct

SEQ ID NO: 8246346 - DNA, 22 bp, Homo sapiens
tgggctctctggcaggaaggct

SEQ ID NO: 8246347 - DNA, 22 bp, Homo sapiens
tgggctctctttacctcataac

SEQ ID NO: 8246348 - DNA, 22 bp, Homo sapiens
tgggctctcgtccctgcagaag

SEQ ID NO: 8246349 - DNA, 22 bp, Homo sapiens
tgggctctcgtccctgcagaag

SEQ ID NO: 8246350 - DNA, 22 bp, Homo sapiens
tgggctctctcacctggaggct

SEQ ID NO: 8246351 - DNA, 22 bp, Homo sapiens
tgggctctctcacctggaggct

SEQ ID NO: 8246352 - DNA, 22 bp, Homo sapiens
tgggctctcctggaggacaaca

SEQ ID NO: 8246353 - DNA, 22 bp, Homo sapiens
tgggctctcctggaggacaaca

SEQ ID NO: 8246354 - DNA, 22 bp, Homo sapiens
tgggctctcagtcagactggca

SEQ ID NO: 8246355 - DNA, 22 bp, Homo sapiens
tgggctctcacacatgttctga

SEQ ID NO: 8246356 - DNA, 22 bp, Homo sapiens
tgggctctcagtcagactggca

SEQ ID NO: 8246357 - DNA, 22 bp, Homo sapiens
tgggctctcacacatgttctga

SEQ ID NO: 8246358 - DNA, 22 bp, Homo sapiens
tgggctctattcagagtttttc

SEQ ID NO: 8246359 - DNA, 19 bp, Homo sapiens
tgggctctcaagagcggaa

SEQ ID NO: 8246360 - DNA, 22 bp, Homo sapiens
tgggctctcaaagtgcggcttg

SEQ ID NO: 8246361 - DNA, 22 bp, Homo sapiens
tgggctctcaaagtgcggcttg

SEQ ID NO: 8246362 - DNA, 22 bp, Homo sapiens
tgggctcagtctgcttggtcct

SEQ ID NO: 8246363 - DNA, 22 bp, Homo sapiens
tgggctctattcagagtttttc

SEQ ID NO: 8246364 - DNA, 22 bp, Homo sapiens
tgggctctggtttcctggctgg

SEQ ID NO: 8246365 - DNA, 22 bp, Homo sapiens
tgggctctgggtggcctgagca

SEQ ID NO: 8246366 - DNA, 22 bp, Homo sapiens
tgggctctgggtggcctgagca

SEQ ID NO: 8246367 - DNA, 22 bp, Homo sapiens
tgggctctgggtggcctgagca

SEQ ID NO: 8246368 - DNA, 22 bp, Homo sapiens
tgggctctgggtggcctgagca

SEQ ID NO: 8246369 - DNA, 22 bp, Homo sapiens
tgggctctggggaaactgtgat

SEQ ID NO: 8246370 - DNA, 22 bp, Homo sapiens
tgggctctggggaaactgtgat

SEQ ID NO: 8246371 - DNA, 22 bp, Homo sapiens
tgggctctggagggcctaggat

SEQ ID NO: 8246372 - DNA, 22 bp, Homo sapiens
tgggctctggagggcctaggat

SEQ ID NO: 8246373 - DNA, 22 bp, Homo sapiens
tgggctctggagggcctaggat

SEQ ID NO: 8246374 - DNA, 22 bp, Homo sapiens
tgggctctggagggcctaggat

SEQ ID NO: 8246375 - DNA, 22 bp, Homo sapiens
tgggctctggacaaacccttgc

SEQ ID NO: 8246376 - DNA, 22 bp, Homo sapiens
tgggctctggaattgagtggcc

SEQ ID NO: 8246377 - DNA, 22 bp, Homo sapiens
tgggctctgctgcgtaccagtt

SEQ ID NO: 8246378 - DNA, 22 bp, Homo sapiens
tgggctctgctgcgtaccagtt

SEQ ID NO: 8246379 - DNA, 22 bp, Homo sapiens
tgggctctgctgcgtaccagtt

SEQ ID NO: 8246380 - DNA, 22 bp, Homo sapiens
tgggctctgaagtcagtctgct

SEQ ID NO: 8246381 - DNA, 22 bp, Homo sapiens
tgggctctgaagtcagtctgct

SEQ ID NO: 8246382 - DNA, 22 bp, Homo sapiens
tgggctctgcatcagtgcccat

SEQ ID NO: 8246383 - DNA, 22 bp, Homo sapiens
tgggctgcaccctcagcctctg

SEQ ID NO: 8246384 - DNA, 22 bp, Homo sapiens
tgggctgcaccctcagcctctg

SEQ ID NO: 8246385 - DNA, 22 bp, Homo sapiens
tgggctgcaccctcagcctctg

SEQ ID NO: 8246386 - DNA, 22 bp, Homo sapiens
tgggctgcaggggttgagagct

SEQ ID NO: 8246387 - DNA, 22 bp, Homo sapiens
tgggctgcccaaggtggccatg

SEQ ID NO: 8246388 - DNA, 22 bp, Homo sapiens
tgggctgcccaaggtggccatg

SEQ ID NO: 8246389 - DNA, 22 bp, Homo sapiens
tgggctgccctgatggtcctca

SEQ ID NO: 8246390 - DNA, 22 bp, Homo sapiens
tgggctgaaatgctgtggacta

SEQ ID NO: 8246391 - DNA, 21 bp, Homo sapiens
tgggctctttaacccaggcac

SEQ ID NO: 8246392 - DNA, 21 bp, Homo sapiens
tgggctctttaacccaggcac

SEQ ID NO: 8246393 - DNA, 22 bp, Homo sapiens
tgggctctggtttcctggctgg

SEQ ID NO: 8246394 - DNA, 22 bp, Homo sapiens
tgggctctggtttcctggctgg

SEQ ID NO: 8246395 - DNA, 22 bp, Homo sapiens
tgggctctggtttcctggctgg

SEQ ID NO: 8246396 - DNA, 22 bp, Homo sapiens
tgggctctgtgccaggttggtg

SEQ ID NO: 8246397 - DNA, 22 bp, Homo sapiens
tgggctctgtgccaggttggtg

SEQ ID NO: 8246398 - DNA, 22 bp, Homo sapiens
tgggctcttcctatagtttata

SEQ ID NO: 8246399 - DNA, 22 bp, Homo sapiens
tgggctcttcagctttgatcag

SEQ ID NO: 8246400 - DNA, 22 bp, Homo sapiens
tgggctctgtgccaggttggtg

SEQ ID NO: 8246401 - DNA, 22 bp, Homo sapiens
tgggctgagtggcagccagagt

SEQ ID NO: 8246402 - DNA, 22 bp, Homo sapiens
tgggctgagtgtggaactagtt

SEQ ID NO: 8246403 - DNA, 20 bp, Homo sapiens
tgggctgaggatcaggtgcc

SEQ ID NO: 8246404 - DNA, 20 bp, Homo sapiens
tgggctgaggatcaggtgcc

SEQ ID NO: 8246405 - DNA, 22 bp, Homo sapiens
tgggctgagcactgaggaagga

SEQ ID NO: 8246406 - DNA, 22 bp, Homo sapiens
tgggctgagcactgaggaagga

SEQ ID NO: 8246407 - DNA, 22 bp, Homo sapiens
tgggctgagcactgaggaagga

SEQ ID NO: 8246408 - DNA, 22 bp, Homo sapiens
tgggctgaaatgctgtggacta

SEQ ID NO: 8246409 - DNA, 22 bp, Homo sapiens
tgggctcagggtcgaggacttt

SEQ ID NO: 8246410 - DNA, 22 bp, Homo sapiens
tgggctcagggaagcttggcct

SEQ ID NO: 8246411 - DNA, 22 bp, Homo sapiens
tgggctcagtctgcacctgcgg

SEQ ID NO: 8246412 - DNA, 22 bp, Homo sapiens
tgggctcaggaccccagaggcc

SEQ ID NO: 8246413 - DNA, 22 bp, Homo sapiens
tgggctcagctcccaagggaag

SEQ ID NO: 8246414 - DNA, 23 bp, Homo sapiens
tgggctcagcttccagtggggag

SEQ ID NO: 8246415 - DNA, 22 bp, Homo sapiens
tgggctcactggggcagggacc

SEQ ID NO: 8246416 - DNA, 22 bp, Homo sapiens
tgggctcactggggcagggacc

SEQ ID NO: 8246417 - DNA, 22 bp, Homo sapiens
tgggctcagccatgacctccac

SEQ ID NO: 8246418 - DNA, 21 bp, Homo sapiens
tgggctcagccccagccctgc

SEQ ID NO: 8246419 - DNA, 22 bp, Homo sapiens
tgggctcagcctcagtctgtgg

SEQ ID NO: 8246420 - DNA, 22 bp, Homo sapiens
tgggcgaggcccagggctgcgt

SEQ ID NO: 8246421 - DNA, 22 bp, Homo sapiens
tgggcgctgtgctcctctttgt

SEQ ID NO: 8246422 - DNA, 22 bp, Homo sapiens
tgggctactctgggagcctaac

SEQ ID NO: 8246423 - DNA, 22 bp, Homo sapiens
tgggcggtgtgcaggctctgct

SEQ ID NO: 8246424 - DNA, 21 bp, Homo sapiens
tgggcgcttgacctctgcact

SEQ ID NO: 8246425 - DNA, 22 bp, Homo sapiens
tgggctcaaactggaggttgtt

SEQ ID NO: 8246426 - DNA, 22 bp, Homo sapiens
tgggctagcagggaagagagac

SEQ ID NO: 8246427 - DNA, 22 bp, Homo sapiens
tgggctcaagtgatgctcctgt

SEQ ID NO: 8246428 - DNA, 22 bp, Homo sapiens
tgggctcaatctgcttctgttt

SEQ ID NO: 8246429 - DNA, 23 bp, Homo sapiens
tgggcgaggcaggagtggagcac

SEQ ID NO: 8246430 - DNA, 22 bp, Homo sapiens
tgggcgacagagcaagactccg

SEQ ID NO: 8246431 - DNA, 22 bp, Homo sapiens
tgggccttgctgagctatggag

SEQ ID NO: 8246432 - DNA, 22 bp, Homo sapiens
tgggcgacagagcaagactccg

SEQ ID NO: 8246433 - DNA, 22 bp, Homo sapiens
tgggccttgtcccctcagctgt

SEQ ID NO: 8246434 - DNA, 22 bp, Homo sapiens
tgggccttctaatctggtccct

SEQ ID NO: 8246435 - DNA, 22 bp, Homo sapiens
tgggccttctcaatgcactgga

SEQ ID NO: 8246436 - DNA, 22 bp, Homo sapiens
tgggccttacttggggctgact

SEQ ID NO: 8246437 - DNA, 22 bp, Homo sapiens
tgggcctgtttcccttcagggc

SEQ ID NO: 8246438 - DNA, 22 bp, Homo sapiens
tgggcctgttggggttgagtta

SEQ ID NO: 8246439 - DNA, 22 bp, Homo sapiens
tgggcctgtggggatcttgaag

SEQ ID NO: 8246440 - DNA, 22 bp, Homo sapiens
tgggcctgttggggttgagtta

SEQ ID NO: 8246441 - DNA, 22 bp, Homo sapiens
tgggcctgttgcctgagtccat

SEQ ID NO: 8246442 - DNA, 22 bp, Homo sapiens
tgggcctgtgatgctgggctat

SEQ ID NO: 8246443 - DNA, 22 bp, Homo sapiens
tgggcctgtgatgctgggctat

SEQ ID NO: 8246444 - DNA, 22 bp, Homo sapiens
tgggcctgggttcctcctgggc

SEQ ID NO: 8246445 - DNA, 22 bp, Homo sapiens
tgggcctgggttcctcctgggc

SEQ ID NO: 8246446 - DNA, 22 bp, Homo sapiens
tgggcctgggttcctcctgggc

SEQ ID NO: 8246447 - DNA, 22 bp, Homo sapiens
tgggcctgggttcctcctgggc

SEQ ID NO: 8246448 - DNA, 22 bp, Homo sapiens
tgggcctgtggcttggctctag

SEQ ID NO: 8246449 - DNA, 22 bp, Homo sapiens
tgggcctgtggcttggctctag

SEQ ID NO: 8246450 - DNA, 20 bp, Homo sapiens
tgggcctgtggcagaagtct

SEQ ID NO: 8246451 - DNA, 22 bp, Homo sapiens
tgggcctgtgatgctgggctat

SEQ ID NO: 8246452 - DNA, 20 bp, Homo sapiens
tgggcctgtggcagaagtct

SEQ ID NO: 8246453 - DNA, 20 bp, Homo sapiens
tgggcctgtggcagaagtct

SEQ ID NO: 8246454 - DNA, 20 bp, Homo sapiens
tgggcctgtggcagaagtct

SEQ ID NO: 8246455 - DNA, 22 bp, Homo sapiens
tgggccagggcacccagtccag

SEQ ID NO: 8246456 - DNA, 23 bp, Homo sapiens
tgggccagggagtccggtttctt

SEQ ID NO: 8246457 - DNA, 22 bp, Homo sapiens
tgggccaggcatgtgatcagca

SEQ ID NO: 8246458 - DNA, 22 bp, Homo sapiens
tgggccagctgaagtgccgccc

SEQ ID NO: 8246459 - DNA, 22 bp, Homo sapiens
tgggccaggcatgtgatcagca

SEQ ID NO: 8246460 - DNA, 22 bp, Homo sapiens
tgggccaggcatgtgatcagca

SEQ ID NO: 8246461 - DNA, 22 bp, Homo sapiens
tgggccaggcatgtgatcagca

SEQ ID NO: 8246462 - DNA, 22 bp, Homo sapiens
tgggccaggggcctcttctgat

SEQ ID NO: 8246463 - DNA, 22 bp, Homo sapiens
tgggccaggggcctcttctgat

SEQ ID NO: 8246464 - DNA, 22 bp, Homo sapiens
tgggccaggggcctcttctgat

SEQ ID NO: 8246465 - DNA, 22 bp, Homo sapiens
tgggccaggggcctcttctgat

SEQ ID NO: 8246466 - DNA, 22 bp, Homo sapiens
tgggccaggggcctcttctgat

SEQ ID NO: 8246467 - DNA, 22 bp, Homo sapiens
tgggccaggtctgtgtcagctg

SEQ ID NO: 8246468 - DNA, 22 bp, Homo sapiens
tgggccaggtctgtgtcagctg

SEQ ID NO: 8246469 - DNA, 22 bp, Homo sapiens
tgggccaggtctgtgtcagctg

SEQ ID NO: 8246470 - DNA, 22 bp, Homo sapiens
tgggccaggtctgtgtcagctg

SEQ ID NO: 8246471 - DNA, 22 bp, Homo sapiens
tgggccaggtgcagtgctttag

SEQ ID NO: 8246472 - DNA, 21 bp, Homo sapiens
tgggccagtagaaaggaaggc

SEQ ID NO: 8246473 - DNA, 17 bp, Homo sapiens
tgggccagtagaaggga

SEQ ID NO: 8246474 - DNA, 17 bp, Homo sapiens
tgggccagtagaaggga

SEQ ID NO: 8246475 - DNA, 17 bp, Homo sapiens
tgggccagtagaaggga

SEQ ID NO: 8246476 - DNA, 22 bp, Homo sapiens
tgggccagtccagccccaggga

SEQ ID NO: 8246477 - DNA, 22 bp, Homo sapiens
tgggccagtccagccccaggga

SEQ ID NO: 8246478 - DNA, 22 bp, Homo sapiens
tgggccagtagctactcgcaag

SEQ ID NO: 8246479 - DNA, 22 bp, Homo sapiens
tgggccagtagctactcgcaag

SEQ ID NO: 8246480 - DNA, 22 bp, Homo sapiens
tgggccagtccagccccaggga

SEQ ID NO: 8246481 - DNA, 22 bp, Homo sapiens
tgggccagtagctactcgcaag

SEQ ID NO: 8246482 - DNA, 22 bp, Homo sapiens
tgggccagtagctactcgcaag

SEQ ID NO: 8246483 - DNA, 22 bp, Homo sapiens
tgggccagtcctgcctaaggtg

SEQ ID NO: 8246484 - DNA, 22 bp, Homo sapiens
tgggccagtcctgcctaaggtg

SEQ ID NO: 8246485 - DNA, 22 bp, Homo sapiens
tgggccagttatttcacctctg

SEQ ID NO: 8246486 - DNA, 22 bp, Homo sapiens
tgggccagttatttcacctctg

SEQ ID NO: 8246487 - DNA, 22 bp, Homo sapiens
tgggccagttatttcacctctg

SEQ ID NO: 8246488 - DNA, 23 bp, Homo sapiens
tgggccagttctgttgaaagcca

SEQ ID NO: 8246489 - DNA, 22 bp, Homo sapiens
tgggccagttctttactcgtcc

SEQ ID NO: 8246490 - DNA, 22 bp, Homo sapiens
tgggccagttggaatggatact

SEQ ID NO: 8246491 - DNA, 22 bp, Homo sapiens
tgggccagttggaatggatact

SEQ ID NO: 8246492 - DNA, 22 bp, Homo sapiens
tgggccagttctttactcgtcc

SEQ ID NO: 8246493 - DNA, 22 bp, Homo sapiens
tgggccagttggtgactacaaa

SEQ ID NO: 8246494 - DNA, 22 bp, Homo sapiens
tgggccagttggtgactacaaa

SEQ ID NO: 8246495 - DNA, 22 bp, Homo sapiens
tgggccagtttctcattgaaat

SEQ ID NO: 8246496 - DNA, 22 bp, Homo sapiens
tgggccagttggtgactacaaa

SEQ ID NO: 8246497 - DNA, 19 bp, Homo sapiens
tgggcctcacaatgctccc

SEQ ID NO: 8246498 - DNA, 22 bp, Homo sapiens
tgggcctccgcatggcccagcg

SEQ ID NO: 8246499 - DNA, 22 bp, Homo sapiens
tgggcctccgcatggcccagcg

SEQ ID NO: 8246500 - DNA, 22 bp, Homo sapiens
tgggcctcctgccctggcctag

SEQ ID NO: 8246501 - DNA, 22 bp, Homo sapiens
tgggcctcctggaagaatgtgg

SEQ ID NO: 8246502 - DNA, 22 bp, Homo sapiens
tgggcctcctggaagaatgtgg

SEQ ID NO: 8246503 - DNA, 22 bp, Homo sapiens
tgggcctcctttccattcagag

SEQ ID NO: 8246504 - DNA, 22 bp, Homo sapiens
tgggcctcctttccattcagag

SEQ ID NO: 8246505 - DNA, 22 bp, Homo sapiens
tgggcctcatcttcaatgagtc

SEQ ID NO: 8246506 - DNA, 22 bp, Homo sapiens
tgggcctcagtttccttaggat

SEQ ID NO: 8246507 - DNA, 22 bp, Homo sapiens
tgggcctccaattccagcggga

SEQ ID NO: 8246508 - DNA, 23 bp, Homo sapiens
tgggcctctccacccttttctgt

SEQ ID NO: 8246509 - DNA, 22 bp, Homo sapiens
tgggcctcggagcacaggagac

SEQ ID NO: 8246510 - DNA, 22 bp, Homo sapiens
tgggcctctgtttcctcatctg

SEQ ID NO: 8246511 - DNA, 22 bp, Homo sapiens
tgggcctgaaggagctgcgccc

SEQ ID NO: 8246512 - DNA, 22 bp, Homo sapiens
tgggcctgaaggagctgcgccc

SEQ ID NO: 8246513 - DNA, 22 bp, Homo sapiens
tgggcctgagctcaccaggggc

SEQ ID NO: 8246514 - DNA, 22 bp, Homo sapiens
tgggcctgagtttgggaactgg

SEQ ID NO: 8246515 - DNA, 21 bp, Homo sapiens
tgggcctgattcccagggtca

SEQ ID NO: 8246516 - DNA, 21 bp, Homo sapiens
tgggcctgattcccagggtca

SEQ ID NO: 8246517 - DNA, 22 bp, Homo sapiens
tgggcctgagtttgggaactgg

SEQ ID NO: 8246518 - DNA, 22 bp, Homo sapiens
tgggcctgagctcaccaggggc

SEQ ID NO: 8246519 - DNA, 22 bp, Homo sapiens
tgggcctgagctcaccaggggc

SEQ ID NO: 8246520 - DNA, 22 bp, Homo sapiens
tgggcctgactcacctgcctcc

SEQ ID NO: 8246521 - DNA, 22 bp, Homo sapiens
tgggcctgacacttactaggga

SEQ ID NO: 8246522 - DNA, 22 bp, Homo sapiens
tgggcctgacacttactaggga

SEQ ID NO: 8246523 - DNA, 22 bp, Homo sapiens
tgggcctgactcacctgcctcc

SEQ ID NO: 8246524 - DNA, 20 bp, Homo sapiens
tgggcctgagcctgtgggct

SEQ ID NO: 8246525 - DNA, 22 bp, Homo sapiens
tgggcctgactcacctgcctcc

SEQ ID NO: 8246526 - DNA, 22 bp, Homo sapiens
tgggcctgactcacctgcctcc

SEQ ID NO: 8246527 - DNA, 22 bp, Homo sapiens
tgggcctgattcttgaatcctg

SEQ ID NO: 8246528 - DNA, 18 bp, Homo sapiens
tgggcctgcatcctagtc

SEQ ID NO: 8246529 - DNA, 18 bp, Homo sapiens
tgggcctgcatcctagtc

SEQ ID NO: 8246530 - DNA, 19 bp, Homo sapiens
tgggcctgcatctgggtct

SEQ ID NO: 8246531 - DNA, 22 bp, Homo sapiens
tgggcctgccccaggcttcagc

SEQ ID NO: 8246532 - DNA, 19 bp, Homo sapiens
tgggcctgcatctgggtct

SEQ ID NO: 8246533 - DNA, 22 bp, Homo sapiens
tgggcctgccccaggcttcagc

SEQ ID NO: 8246534 - DNA, 22 bp, Homo sapiens
tgggcctgggctcctgtcctct

SEQ ID NO: 8246535 - DNA, 22 bp, Homo sapiens
tgggcctggacaaggccactag

SEQ ID NO: 8246536 - DNA, 22 bp, Homo sapiens
tgggcctggacaaggccactag

SEQ ID NO: 8246537 - DNA, 22 bp, Homo sapiens
tgggcctgggctcctgtcctct

SEQ ID NO: 8246538 - DNA, 22 bp, Homo sapiens
tgggcctgctggggcattttca

SEQ ID NO: 8246539 - DNA, 23 bp, Homo sapiens
tgggcctggaaagccttagagag

SEQ ID NO: 8246540 - DNA, 23 bp, Homo sapiens
tgggcctggaaagccttagagag

SEQ ID NO: 8246541 - DNA, 22 bp, Homo sapiens
tgggcctgggctcctgtcctct

SEQ ID NO: 8246542 - DNA, 22 bp, Homo sapiens
tgggcctgggctggacagcctg

SEQ ID NO: 8246543 - DNA, 22 bp, Homo sapiens
tgggcctgggtctttgctgcca

SEQ ID NO: 8246544 - DNA, 22 bp, Homo sapiens
tgggcctggggcagcccaaatc

SEQ ID NO: 8246545 - DNA, 22 bp, Homo sapiens
tgggccaacaggaggtctagga

SEQ ID NO: 8246546 - DNA, 22 bp, Homo sapiens
tgggcagttgctcctcagaccc

SEQ ID NO: 8246547 - DNA, 22 bp, Homo sapiens
tgggcatcccgcgtctggctgc

SEQ ID NO: 8246548 - DNA, 22 bp, Homo sapiens
tgggcatcccgcgtctggctgc

SEQ ID NO: 8246549 - DNA, 23 bp, Homo sapiens
tgggcatctcctctgtgccaggc

SEQ ID NO: 8246550 - DNA, 22 bp, Homo sapiens
tgggcaggttgttatttgacat

SEQ ID NO: 8246551 - DNA, 22 bp, Homo sapiens
tgggcagtgggcctaggtgtga

SEQ ID NO: 8246552 - DNA, 22 bp, Homo sapiens
tgggcagggtctctgttatcag

SEQ ID NO: 8246553 - DNA, 22 bp, Homo sapiens
tgggcagggtctctgttatcag

SEQ ID NO: 8246554 - DNA, 22 bp, Homo sapiens
tgggcaggtgctattttccatg

SEQ ID NO: 8246555 - DNA, 22 bp, Homo sapiens
tgggcagggtctctgttatcag

SEQ ID NO: 8246556 - DNA, 22 bp, Homo sapiens
tgggcagggtctctgttatcag

SEQ ID NO: 8246557 - DNA, 22 bp, Homo sapiens
tgggcaggttgttatttgacat

SEQ ID NO: 8246558 - DNA, 19 bp, Homo sapiens
tgggcaggttcagtaatgg

SEQ ID NO: 8246559 - DNA, 19 bp, Homo sapiens
tgggcaggttcagtaatgg

SEQ ID NO: 8246560 - DNA, 22 bp, Homo sapiens
tgggcaggtgctattttccatg

SEQ ID NO: 8246561 - DNA, 19 bp, Homo sapiens
tgggcaggttcagtaatgg

SEQ ID NO: 8246562 - DNA, 19 bp, Homo sapiens
tgggcaggttcagtaatgg

SEQ ID NO: 8246563 - DNA, 22 bp, Homo sapiens
tgggccagcactgggtgctcat

SEQ ID NO: 8246564 - DNA, 22 bp, Homo sapiens
tgggccagcactgggtgctcat

SEQ ID NO: 8246565 - DNA, 22 bp, Homo sapiens
tgggccagcactgggtgctcat

SEQ ID NO: 8246566 - DNA, 22 bp, Homo sapiens
tgggccagctccctgcccctgg

SEQ ID NO: 8246567 - DNA, 22 bp, Homo sapiens
tgggccagctccctgcccctgg

SEQ ID NO: 8246568 - DNA, 22 bp, Homo sapiens
tgggccagctccctgcccctgg

SEQ ID NO: 8246569 - DNA, 22 bp, Homo sapiens
tgggccagctccctgcccctgg

SEQ ID NO: 8246570 - DNA, 22 bp, Homo sapiens
tgggccagctgaagtgccgccc

SEQ ID NO: 8246571 - DNA, 22 bp, Homo sapiens
tgggccagctgaagtgccgccc

SEQ ID NO: 8246572 - DNA, 22 bp, Homo sapiens
tgggccagctgaagtgccgccc

SEQ ID NO: 8246573 - DNA, 22 bp, Homo sapiens
tgggccaggatttcaagaccct

SEQ ID NO: 8246574 - DNA, 22 bp, Homo sapiens
tgggccaggatttcaagaccct

SEQ ID NO: 8246575 - DNA, 22 bp, Homo sapiens
tgggccagcaattgctgctcag

SEQ ID NO: 8246576 - DNA, 22 bp, Homo sapiens
tgggccagcaattgctgctcag

SEQ ID NO: 8246577 - DNA, 22 bp, Homo sapiens
tgggccagcactgggtgctcat

SEQ ID NO: 8246578 - DNA, 22 bp, Homo sapiens
tgggccagcactgggtgctcat

SEQ ID NO: 8246579 - DNA, 22 bp, Homo sapiens
tgggccacgggggtggagagct

SEQ ID NO: 8246580 - DNA, 22 bp, Homo sapiens
tgggccacgggggtggagagct

SEQ ID NO: 8246581 - DNA, 22 bp, Homo sapiens
tgggccacacacagaagaatca

SEQ ID NO: 8246582 - DNA, 22 bp, Homo sapiens
tgggccaagttaaatgccaggg

SEQ ID NO: 8246583 - DNA, 22 bp, Homo sapiens
tgggccacaagccatgggacca

SEQ ID NO: 8246584 - DNA, 22 bp, Homo sapiens
tgggcagggatctcttttgcaa

SEQ ID NO: 8246585 - DNA, 22 bp, Homo sapiens
tgggcagggatctcttttgcaa

SEQ ID NO: 8246586 - DNA, 22 bp, Homo sapiens
tgggcagggagctggaaccaca

SEQ ID NO: 8246587 - DNA, 22 bp, Homo sapiens
tgggcagggagctggaaccaca

SEQ ID NO: 8246588 - DNA, 22 bp, Homo sapiens
tgggcagggagctggaaccaca

SEQ ID NO: 8246589 - DNA, 22 bp, Homo sapiens
tgggcaggggccctgcttccgt

SEQ ID NO: 8246590 - DNA, 22 bp, Homo sapiens
tgggcagggatctcttttgcaa

SEQ ID NO: 8246591 - DNA, 22 bp, Homo sapiens
tgggcagggatctcttttgcaa

SEQ ID NO: 8246592 - DNA, 22 bp, Homo sapiens
tgggcaggggccctgcttccgt

SEQ ID NO: 8246593 - DNA, 22 bp, Homo sapiens
tgggcaggggccctgcttccgt

SEQ ID NO: 8246594 - DNA, 22 bp, Homo sapiens
tgggcaggggccctgcttccgt

SEQ ID NO: 8246595 - DNA, 19 bp, Homo sapiens
tgggcagctccctctgtcc

SEQ ID NO: 8246596 - DNA, 19 bp, Homo sapiens
tgggcagctccctctgtcc

SEQ ID NO: 8246597 - DNA, 23 bp, Homo sapiens
tgggcagcttctgcatgcccacc

SEQ ID NO: 8246598 - DNA, 23 bp, Homo sapiens
tgggcagcttctgcatgcccacc

SEQ ID NO: 8246599 - DNA, 19 bp, Homo sapiens
tgggcagctccctctgtcc

SEQ ID NO: 8246600 - DNA, 22 bp, Homo sapiens
tgggcagccatcccagcctctc

SEQ ID NO: 8246601 - DNA, 22 bp, Homo sapiens
tgggcagccatcccagcctctc

SEQ ID NO: 8246602 - DNA, 22 bp, Homo sapiens
tgggcagccatcccagcctctc

SEQ ID NO: 8246603 - DNA, 22 bp, Homo sapiens
tgggcagccatcccagcctctc

SEQ ID NO: 8246604 - DNA, 22 bp, Homo sapiens
tgggcaggagagaagctaaaga

SEQ ID NO: 8246605 - DNA, 22 bp, Homo sapiens
tgggcaggagagaagctaaaga

SEQ ID NO: 8246606 - DNA, 22 bp, Homo sapiens
tgggcaggagagaagctaaaga

SEQ ID NO: 8246607 - DNA, 23 bp, Homo sapiens
tgggcagcttctgcatgcccacc

SEQ ID NO: 8246608 - DNA, 22 bp, Homo sapiens
tgggcagggagctggaaccaca

SEQ ID NO: 8246609 - DNA, 22 bp, Homo sapiens
tgggcagggagctggaaccaca

SEQ ID NO: 8246610 - DNA, 22 bp, Homo sapiens
tgggcagggagctggaaccaca

SEQ ID NO: 8246611 - DNA, 22 bp, Homo sapiens
tgggcagggagctggaaccaca

SEQ ID NO: 8246612 - DNA, 22 bp, Homo sapiens
tgggcagattaatgcagtggct

SEQ ID NO: 8246613 - DNA, 21 bp, Homo sapiens
tgggcagatggcagtgtggct

SEQ ID NO: 8246614 - DNA, 22 bp, Homo sapiens
tgggcagatctttggtggctag

SEQ ID NO: 8246615 - DNA, 21 bp, Homo sapiens
tgggcagatggcagtgtggct

SEQ ID NO: 8246616 - DNA, 22 bp, Homo sapiens
tgggcagcaaagactgtgtgct

SEQ ID NO: 8246617 - DNA, 22 bp, Homo sapiens
tgggcagcaaagactgtgtgct

SEQ ID NO: 8246618 - DNA, 20 bp, Homo sapiens
tgggcagcactgctggctgg

SEQ ID NO: 8246619 - DNA, 20 bp, Homo sapiens
tgggcagcactgctggctgg

SEQ ID NO: 8246620 - DNA, 22 bp, Homo sapiens
tgggcagcagaaccaggccgac

SEQ ID NO: 8246621 - DNA, 22 bp, Homo sapiens
tgggcagcagaaccaggccgac

SEQ ID NO: 8246622 - DNA, 22 bp, Homo sapiens
tgggcagcagaaccaggccgac

SEQ ID NO: 8246623 - DNA, 22 bp, Homo sapiens
tgggcagcagaaccaggccgac

SEQ ID NO: 8246624 - DNA, 22 bp, Homo sapiens
tgggcagcagaaccaggccgac

SEQ ID NO: 8246625 - DNA, 22 bp, Homo sapiens
tgggcagcatcctccacagtca

SEQ ID NO: 8246626 - DNA, 22 bp, Homo sapiens
tgggcagcagcaaagccagact

SEQ ID NO: 8246627 - DNA, 22 bp, Homo sapiens
tgggcagcagcaaagccagact

SEQ ID NO: 8246628 - DNA, 22 bp, Homo sapiens
tgggcagcagcaaagccagact

SEQ ID NO: 8246629 - DNA, 22 bp, Homo sapiens
tgggaggcccaggcctggcagg

SEQ ID NO: 8246630 - DNA, 22 bp, Homo sapiens
tgggaggcccaggcctggcagg

SEQ ID NO: 8246631 - DNA, 22 bp, Homo sapiens
tgggaggcccaggcctggcagg

SEQ ID NO: 8246632 - DNA, 22 bp, Homo sapiens
tgggaggccgaggcaggtggat

SEQ ID NO: 8246633 - DNA, 22 bp, Homo sapiens
tgggaggccgaggcaggtggat

SEQ ID NO: 8246634 - DNA, 22 bp, Homo sapiens
tgggaggccgaggcaggtggat

SEQ ID NO: 8246635 - DNA, 22 bp, Homo sapiens
tgggaggcaggtaggtgatgat

SEQ ID NO: 8246636 - DNA, 22 bp, Homo sapiens
tgggaggcaggtaggtgatgat

SEQ ID NO: 8246637 - DNA, 22 bp, Homo sapiens
tgggaggcaggtaggtgatgat

SEQ ID NO: 8246638 - DNA, 22 bp, Homo sapiens
tgggaggcaggtaggtgatgat

SEQ ID NO: 8246639 - DNA, 22 bp, Homo sapiens
tgggaggccaaggcaggcggat

SEQ ID NO: 8246640 - DNA, 22 bp, Homo sapiens
tgggaggccaaggcaggcggat

SEQ ID NO: 8246641 - DNA, 22 bp, Homo sapiens
tgggaggccaaggcaggcggat

SEQ ID NO: 8246642 - DNA, 22 bp, Homo sapiens
tgggaggcttccagaccttgct

SEQ ID NO: 8246643 - DNA, 22 bp, Homo sapiens
tgggaggcttccagaccttgct

SEQ ID NO: 8246644 - DNA, 22 bp, Homo sapiens
tgggaggcttccagaccttgct

SEQ ID NO: 8246645 - DNA, 22 bp, Homo sapiens
tgggaggtctcttgcggcctag

SEQ ID NO: 8246646 - DNA, 22 bp, Homo sapiens
tgggaggcttccagaccttgct

SEQ ID NO: 8246647 - DNA, 22 bp, Homo sapiens
tgggaggcttccagaccttgct

SEQ ID NO: 8246648 - DNA, 22 bp, Homo sapiens
tgggaggtctcttgcggcctag

SEQ ID NO: 8246649 - DNA, 22 bp, Homo sapiens
tgggagtcagacagcctgagat

SEQ ID NO: 8246650 - DNA, 22 bp, Homo sapiens
tgggatgagaagtgcgagggtt

SEQ ID NO: 8246651 - DNA, 22 bp, Homo sapiens
tgggatgaatacaatgggatca

SEQ ID NO: 8246652 - DNA, 22 bp, Homo sapiens
tgggatgaatacaatgggatca

SEQ ID NO: 8246653 - DNA, 20 bp, Homo sapiens
tgggatcgaatcaagtctgt

SEQ ID NO: 8246654 - DNA, 22 bp, Homo sapiens
tgggatgagctatatagaaagt

SEQ ID NO: 8246655 - DNA, 22 bp, Homo sapiens
tgggatgaggcctctgttgtga

SEQ ID NO: 8246656 - DNA, 22 bp, Homo sapiens
tgggatataatctgaaaagtat

SEQ ID NO: 8246657 - DNA, 20 bp, Homo sapiens
tgggatcgaatcaagtctgt

SEQ ID NO: 8246658 - DNA, 22 bp, Homo sapiens
tgggatagtggccaggaccccc

SEQ ID NO: 8246659 - DNA, 22 bp, Homo sapiens
tgggatagtagctgagagacaa

SEQ ID NO: 8246660 - DNA, 22 bp, Homo sapiens
tgggatagtagctgagagacaa

SEQ ID NO: 8246661 - DNA, 22 bp, Homo sapiens
tgggagtgcacctgggacacga

SEQ ID NO: 8246662 - DNA, 22 bp, Homo sapiens
tgggagtgcacctgggacacga

SEQ ID NO: 8246663 - DNA, 22 bp, Homo sapiens
tgggagtgatacagtatggaat

SEQ ID NO: 8246664 - DNA, 22 bp, Homo sapiens
tgggagtgatacagtatggaat

SEQ ID NO: 8246665 - DNA, 22 bp, Homo sapiens
tgggagtgatacagtatggaat

SEQ ID NO: 8246666 - DNA, 22 bp, Homo sapiens
tgggagtgatacagtatggaat

SEQ ID NO: 8246667 - DNA, 18 bp, Homo sapiens
tgggagtgggagtggata

SEQ ID NO: 8246668 - DNA, 18 bp, Homo sapiens
tgggagtgggagtggata

SEQ ID NO: 8246669 - DNA, 22 bp, Homo sapiens
tgggatagtagctgagagacaa

SEQ ID NO: 8246670 - DNA, 22 bp, Homo sapiens
tgggatagggctattgctcaca

SEQ ID NO: 8246671 - DNA, 22 bp, Homo sapiens
tgggatagattgatggatagag

SEQ ID NO: 8246672 - DNA, 22 bp, Homo sapiens
tgggatgataggtaagtaatta

SEQ ID NO: 8246673 - DNA, 22 bp, Homo sapiens
tgggatgagggtgagccacatg

SEQ ID NO: 8246674 - DNA, 22 bp, Homo sapiens
tgggatgagggtgagccacatg

SEQ ID NO: 8246675 - DNA, 22 bp, Homo sapiens
tgggatgagttgttaggactga

SEQ ID NO: 8246676 - DNA, 18 bp, Homo sapiens
tgggatggagagtaactg

SEQ ID NO: 8246677 - DNA, 18 bp, Homo sapiens
tgggatggagagtaactg

SEQ ID NO: 8246678 - DNA, 23 bp, Homo sapiens
tgggatggattcaccagtgtgct

SEQ ID NO: 8246679 - DNA, 22 bp, Homo sapiens
tgggatggagcctgagtatagt

SEQ ID NO: 8246680 - DNA, 22 bp, Homo sapiens
tgggatggcatcctgggccttg

SEQ ID NO: 8246681 - DNA, 22 bp, Homo sapiens
tgggatggcatcctgggccttg

SEQ ID NO: 8246682 - DNA, 22 bp, Homo sapiens
tgggatggcatcctgggccttg

SEQ ID NO: 8246683 - DNA, 23 bp, Homo sapiens
tgggatggattcaccagtgtgct

SEQ ID NO: 8246684 - DNA, 23 bp, Homo sapiens
tgggatggattcaccagtgtgct

SEQ ID NO: 8246685 - DNA, 22 bp, Homo sapiens
tgggcagaggctctgaagtcca

SEQ ID NO: 8246686 - DNA, 22 bp, Homo sapiens
tgggcagagtcatacaggagac

SEQ ID NO: 8246687 - DNA, 22 bp, Homo sapiens
tgggcagaggctctgaagtcca

SEQ ID NO: 8246688 - DNA, 22 bp, Homo sapiens
tgggcagagtcgtggggaatag

SEQ ID NO: 8246689 - DNA, 22 bp, Homo sapiens
tgggcagagagtagaggcaacg

SEQ ID NO: 8246690 - DNA, 22 bp, Homo sapiens
tgggcacctgaggcctggcagg

SEQ ID NO: 8246691 - DNA, 22 bp, Homo sapiens
tgggcactatggctctgtgcac

SEQ ID NO: 8246692 - DNA, 22 bp, Homo sapiens
tgggcactatggctctgtgcac

SEQ ID NO: 8246693 - DNA, 21 bp, Homo sapiens
tgggcaccaaaacctaggagt

SEQ ID NO: 8246694 - DNA, 22 bp, Homo sapiens
tgggcaagtcacttctgtcttt

SEQ ID NO: 8246695 - DNA, 22 bp, Homo sapiens
tgggcaagggacaggcctggct

SEQ ID NO: 8246696 - DNA, 22 bp, Homo sapiens
tgggcaagtatcggactctgag

SEQ ID NO: 8246697 - DNA, 22 bp, Homo sapiens
tgggcacagaatagatggccca

SEQ ID NO: 8246698 - DNA, 22 bp, Homo sapiens
tgggcacagagtcccatctgcc

SEQ ID NO: 8246699 - DNA, 22 bp, Homo sapiens
tgggcacaaacatctgcctgtt

SEQ ID NO: 8246700 - DNA, 22 bp, Homo sapiens
tgggattcaccatgggcttcag

SEQ ID NO: 8246701 - DNA, 22 bp, Homo sapiens
tgggattcaccatgggcttcag

SEQ ID NO: 8246702 - DNA, 22 bp, Homo sapiens
tgggatgtggccatggttctct

SEQ ID NO: 8246703 - DNA, 22 bp, Homo sapiens
tgggatgtgtgctgcttagtcc

SEQ ID NO: 8246704 - DNA, 22 bp, Homo sapiens
tgggattcaccatgggcttcag

SEQ ID NO: 8246705 - DNA, 22 bp, Homo sapiens
tgggatgtggccatggttctct

SEQ ID NO: 8246706 - DNA, 22 bp, Homo sapiens
tgggatgggatctcgctgtgtc

SEQ ID NO: 8246707 - DNA, 21 bp, Homo sapiens
tgggatgggtctgggaccagc

SEQ ID NO: 8246708 - DNA, 22 bp, Homo sapiens
tgggatgggatctcgctgtgtc

SEQ ID NO: 8246709 - DNA, 22 bp, Homo sapiens
tgggatgggatctcgctgtgtc

SEQ ID NO: 8246710 - DNA, 22 bp, Homo sapiens
tgggatggcctttgaaagccag

SEQ ID NO: 8246711 - DNA, 22 bp, Homo sapiens
tgggatggcatcctgggccttg

SEQ ID NO: 8246712 - DNA, 22 bp, Homo sapiens
tgtcctgtgtctaggggtcttc

SEQ ID NO: 8246713 - DNA, 22 bp, Homo sapiens
tgtcctgtgtctaggggtcttc

SEQ ID NO: 8246714 - DNA, 22 bp, Homo sapiens
tgtcctgttcatggctctggac

SEQ ID NO: 8246715 - DNA, 22 bp, Homo sapiens
tgtcctgttatatgttgggtag

SEQ ID NO: 8246716 - DNA, 22 bp, Homo sapiens
tgtcctgttctggcgtgagtgg

SEQ ID NO: 8246717 - DNA, 22 bp, Homo sapiens
tgtccttatattgtggaagggg

SEQ ID NO: 8246718 - DNA, 22 bp, Homo sapiens
tgtcctgtgccaccttcctgag

SEQ ID NO: 8246719 - DNA, 22 bp, Homo sapiens
tgtcctgtgcactgtagcatgt

SEQ ID NO: 8246720 - DNA, 22 bp, Homo sapiens
tgtcctggtgctccaggtggct

SEQ ID NO: 8246721 - DNA, 22 bp, Homo sapiens
tgtcctggtgctccaggtggct

SEQ ID NO: 8246722 - DNA, 22 bp, Homo sapiens
tgtcctggtgctccaggtggct

SEQ ID NO: 8246723 - DNA, 22 bp, Homo sapiens
tgtcctggtgcttcttgggatt

SEQ ID NO: 8246724 - DNA, 22 bp, Homo sapiens
tgtcctggtgcttcttgggatt

SEQ ID NO: 8246725 - DNA, 21 bp, Homo sapiens
tgtcctggtcactgctctccc

SEQ ID NO: 8246726 - DNA, 21 bp, Homo sapiens
tgtcctggtcactgctctccc

SEQ ID NO: 8246727 - DNA, 22 bp, Homo sapiens
tgtcctgggtggatgcttcatt

SEQ ID NO: 8246728 - DNA, 22 bp, Homo sapiens
tgtcctggtgctccaggtggct

SEQ ID NO: 8246729 - DNA, 22 bp, Homo sapiens
tgtcctgggtccctgctagaag

SEQ ID NO: 8246730 - DNA, 22 bp, Homo sapiens
tgtcctgggtccctgctagaag

SEQ ID NO: 8246731 - DNA, 22 bp, Homo sapiens
tgtcctgggtccctgctagaag

SEQ ID NO: 8246732 - DNA, 22 bp, Homo sapiens
tgtcctgggtccctgctagaag

SEQ ID NO: 8246733 - DNA, 22 bp, Homo sapiens
tgtcctgggtggatgcttcatt

SEQ ID NO: 8246734 - DNA, 22 bp, Homo sapiens
tgtcctcaaggagcttcagtct

SEQ ID NO: 8246735 - DNA, 22 bp, Homo sapiens
tgtcctcacacgtagggagtaa

SEQ ID NO: 8246736 - DNA, 22 bp, Homo sapiens
tgtcctcaaggagcttcagtct

SEQ ID NO: 8246737 - DNA, 22 bp, Homo sapiens
tgtcctagatccagctgtgctg

SEQ ID NO: 8246738 - DNA, 22 bp, Homo sapiens
tgtcctagattggcctggagtt

SEQ ID NO: 8246739 - DNA, 22 bp, Homo sapiens
tgtcctagtcaatcctctggac

SEQ ID NO: 8246740 - DNA, 22 bp, Homo sapiens
tgtcctcacaggaatgaacttt

SEQ ID NO: 8246741 - DNA, 22 bp, Homo sapiens
tgtcctcacaggaatgaacttt

SEQ ID NO: 8246742 - DNA, 22 bp, Homo sapiens
tgtcctcacaggaatgaacttt

SEQ ID NO: 8246743 - DNA, 19 bp, Homo sapiens
tgtcctcacagagcataac

SEQ ID NO: 8246744 - DNA, 19 bp, Homo sapiens
tgtcctcacagagcataac

SEQ ID NO: 8246745 - DNA, 22 bp, Homo sapiens
tgtcctcaggacctggcacagt

SEQ ID NO: 8246746 - DNA, 22 bp, Homo sapiens
tgtcctcaggacctggcacagt

SEQ ID NO: 8246747 - DNA, 22 bp, Homo sapiens
tgtcctcacatggtggggagag

SEQ ID NO: 8246748 - DNA, 22 bp, Homo sapiens
tgtcctcagatatgtctactct

SEQ ID NO: 8246749 - DNA, 22 bp, Homo sapiens
tgtcctcagatatgtctactct

SEQ ID NO: 8246750 - DNA, 22 bp, Homo sapiens
tgtcctcacatggtggggagag

SEQ ID NO: 8246751 - DNA, 22 bp, Homo sapiens
tgtcctggcctccagaaagtcg

SEQ ID NO: 8246752 - DNA, 22 bp, Homo sapiens
tgtcctggcctccagaaagtcg

SEQ ID NO: 8246753 - DNA, 22 bp, Homo sapiens
tgtcctgggaaatcccttaggc

SEQ ID NO: 8246754 - DNA, 22 bp, Homo sapiens
tgtcctgggaaatcccttaggc

SEQ ID NO: 8246755 - DNA, 22 bp, Homo sapiens
tgtcctggcctccagaaagtcg

SEQ ID NO: 8246756 - DNA, 22 bp, Homo sapiens
tgtcctggccaaggccttgctt

SEQ ID NO: 8246757 - DNA, 22 bp, Homo sapiens
tgtcctggccaaggccttgctt

SEQ ID NO: 8246758 - DNA, 22 bp, Homo sapiens
tgtcctggccaaggccttgctt

SEQ ID NO: 8246759 - DNA, 22 bp, Homo sapiens
tgtcctggggcgacttggggcc

SEQ ID NO: 8246760 - DNA, 22 bp, Homo sapiens
tgtcctggggacaagaggccct

SEQ ID NO: 8246761 - DNA, 22 bp, Homo sapiens
tgtcctggggacaagaggccct

SEQ ID NO: 8246762 - DNA, 22 bp, Homo sapiens
tgtcctggggacaagaggccct

SEQ ID NO: 8246763 - DNA, 22 bp, Homo sapiens
tgtcctggggacaagaggccct

SEQ ID NO: 8246764 - DNA, 22 bp, Homo sapiens
tgtcctggggacaagaggccct

SEQ ID NO: 8246765 - DNA, 22 bp, Homo sapiens
tgtcctggggcgacttggggcc

SEQ ID NO: 8246766 - DNA, 22 bp, Homo sapiens
tgtcctgggtcaaatcctggtc

SEQ ID NO: 8246767 - DNA, 22 bp, Homo sapiens
tgtcctgggtcaaatcctggtc

SEQ ID NO: 8246768 - DNA, 22 bp, Homo sapiens
tgtcctgggtcaaatcctggtc

SEQ ID NO: 8246769 - DNA, 22 bp, Homo sapiens
tgtcctgggtcaaccaggtcga

SEQ ID NO: 8246770 - DNA, 22 bp, Homo sapiens
tgtcctgggtcaaccaggtcga

SEQ ID NO: 8246771 - DNA, 22 bp, Homo sapiens
tgtcctgggaggcggggtccag

SEQ ID NO: 8246772 - DNA, 22 bp, Homo sapiens
tgtcctgggaatgggatgcagt

SEQ ID NO: 8246773 - DNA, 22 bp, Homo sapiens
tgtcctgggaatgggatgcagt

SEQ ID NO: 8246774 - DNA, 22 bp, Homo sapiens
tgtcctgggaggcggggtccag

SEQ ID NO: 8246775 - DNA, 22 bp, Homo sapiens
tgtcctgggccggcgactggtc

SEQ ID NO: 8246776 - DNA, 22 bp, Homo sapiens
tgtcctgggccggcgactggtc

SEQ ID NO: 8246777 - DNA, 22 bp, Homo sapiens
tgtcctgggccggcgactggtc

SEQ ID NO: 8246778 - DNA, 22 bp, Homo sapiens
tgtcctgggccggcgactggtc

SEQ ID NO: 8246779 - DNA, 22 bp, Homo sapiens
tgtcctgggaactcacagtcca

SEQ ID NO: 8246780 - DNA, 22 bp, Homo sapiens
tgtcctgggaactcacagtcca

SEQ ID NO: 8246781 - DNA, 22 bp, Homo sapiens
tgtcctgggaatgggatgcagt

SEQ ID NO: 8246782 - DNA, 22 bp, Homo sapiens
tgtcctgggaatgggatgcagt

SEQ ID NO: 8246783 - DNA, 22 bp, Homo sapiens
tgtcccctgcccagggatggga

SEQ ID NO: 8246784 - DNA, 20 bp, Homo sapiens
tgtcccctagatcccagctc

SEQ ID NO: 8246785 - DNA, 22 bp, Homo sapiens
tgtcccctttctttccttcgta

SEQ ID NO: 8246786 - DNA, 22 bp, Homo sapiens
tgtcccctgcccagggatggga

SEQ ID NO: 8246787 - DNA, 22 bp, Homo sapiens
tgtcccctttacctccgcagcc

SEQ ID NO: 8246788 - DNA, 22 bp, Homo sapiens
tgtccctcattgacgctgtgcc

SEQ ID NO: 8246789 - DNA, 22 bp, Homo sapiens
tgtccctcattgacgctgtgcc

SEQ ID NO: 8246790 - DNA, 22 bp, Homo sapiens
tgtccctcattgacgctgtgcc

SEQ ID NO: 8246791 - DNA, 22 bp, Homo sapiens
tgtcccatggcttttctggtgg

SEQ ID NO: 8246792 - DNA, 22 bp, Homo sapiens
tgtcccatggataccaggctat

SEQ ID NO: 8246793 - DNA, 22 bp, Homo sapiens
tgtcccatggacacaacttctt

SEQ ID NO: 8246794 - DNA, 22 bp, Homo sapiens
tgtccccaaggttcagcccaca

SEQ ID NO: 8246795 - DNA, 20 bp, Homo sapiens
tgtccccaccaaaatttcat

SEQ ID NO: 8246796 - DNA, 22 bp, Homo sapiens
tgtccccaaggttcagcccaca

SEQ ID NO: 8246797 - DNA, 22 bp, Homo sapiens
tgtccccaaggttcagcccaca

SEQ ID NO: 8246798 - DNA, 22 bp, Homo sapiens
tgtccccacccaaatctcatct

SEQ ID NO: 8246799 - DNA, 22 bp, Homo sapiens
tgtccccacctaaatcttatct

SEQ ID NO: 8246800 - DNA, 22 bp, Homo sapiens
tgtccccaggtcctctgccgtc

SEQ ID NO: 8246801 - DNA, 22 bp, Homo sapiens
tgtccccagagcctgttcctgc

SEQ ID NO: 8246802 - DNA, 22 bp, Homo sapiens
tgtccccagcactcactctcca

SEQ ID NO: 8246803 - DNA, 18 bp, Homo sapiens
tgtccctgcaaataacat

SEQ ID NO: 8246804 - DNA, 22 bp, Homo sapiens
tgtccctgctgtacttagagca

SEQ ID NO: 8246805 - DNA, 18 bp, Homo sapiens
tgtccctgcaaataacat

SEQ ID NO: 8246806 - DNA, 18 bp, Homo sapiens
tgtccctgcaaataacat

SEQ ID NO: 8246807 - DNA, 22 bp, Homo sapiens
tgtccctctgaggcttccctgg

SEQ ID NO: 8246808 - DNA, 22 bp, Homo sapiens
tgtccctctgaggcttccctgg

SEQ ID NO: 8246809 - DNA, 22 bp, Homo sapiens
tgtccctgatccactggacccc

SEQ ID NO: 8246810 - DNA, 22 bp, Homo sapiens
tgtccctgatccactggacccc

SEQ ID NO: 8246811 - DNA, 22 bp, Homo sapiens
tgtccctggaactatggctcca

SEQ ID NO: 8246812 - DNA, 22 bp, Homo sapiens
tgtccctggaactatggctcca

SEQ ID NO: 8246813 - DNA, 22 bp, Homo sapiens
tgtccctggaactatggctcca

SEQ ID NO: 8246814 - DNA, 22 bp, Homo sapiens
tgtccctggactccaggagcca

SEQ ID NO: 8246815 - DNA, 22 bp, Homo sapiens
tgtccctggagcttctgtcccc

SEQ ID NO: 8246816 - DNA, 20 bp, Homo sapiens
tgtcctaatagacaagcaga

SEQ ID NO: 8246817 - DNA, 19 bp, Homo sapiens
tgtccctggtcaccagact

SEQ ID NO: 8246818 - DNA, 22 bp, Homo sapiens
tgtccctggagcttctgtcccc

SEQ ID NO: 8246819 - DNA, 22 bp, Homo sapiens
tgtcccagttcccagggttgct

SEQ ID NO: 8246820 - DNA, 22 bp, Homo sapiens
tgtcccagtcaaggctgtcatc

SEQ ID NO: 8246821 - DNA, 22 bp, Homo sapiens
tgtcccagtcaaggctgtcatc

SEQ ID NO: 8246822 - DNA, 22 bp, Homo sapiens
tgtcccagtttatctgggactg

SEQ ID NO: 8246823 - DNA, 22 bp, Homo sapiens
tgtcccagtttatctgggactg

SEQ ID NO: 8246824 - DNA, 22 bp, Homo sapiens
tgtcccagtttatctgggactg

SEQ ID NO: 8246825 - DNA, 22 bp, Homo sapiens
tgtcccagttttgcaggttaga

SEQ ID NO: 8246826 - DNA, 22 bp, Homo sapiens
tgtcccatggacacaacttctt

SEQ ID NO: 8246827 - DNA, 22 bp, Homo sapiens
tgtcccagggaaggcccagcac

SEQ ID NO: 8246828 - DNA, 22 bp, Homo sapiens
tgtcccagggaaggcccagcac

SEQ ID NO: 8246829 - DNA, 22 bp, Homo sapiens
tgtcccaggtcctagatgacca

SEQ ID NO: 8246830 - DNA, 22 bp, Homo sapiens
tgtcccagggaaggcccagcac

SEQ ID NO: 8246831 - DNA, 22 bp, Homo sapiens
tgtcccaggctgaagtacagtg

SEQ ID NO: 8246832 - DNA, 22 bp, Homo sapiens
tgtcccaggcctcatgttgcca

SEQ ID NO: 8246833 - DNA, 22 bp, Homo sapiens
tgtccaggtcagcagcagggac

SEQ ID NO: 8246834 - DNA, 22 bp, Homo sapiens
tgtccaggtggcctctgctgct

SEQ ID NO: 8246835 - DNA, 22 bp, Homo sapiens
tgtccaggtgtgtctaaagaga

SEQ ID NO: 8246836 - DNA, 22 bp, Homo sapiens
tgtcccagcagctgggttctct

SEQ ID NO: 8246837 - DNA, 22 bp, Homo sapiens
tgtccaggctcccttggtgctg

SEQ ID NO: 8246838 - DNA, 22 bp, Homo sapiens
tgtccagggatggggtcaggga

SEQ ID NO: 8246839 - DNA, 22 bp, Homo sapiens
tgtccaggcactgggactctag

SEQ ID NO: 8246840 - DNA, 22 bp, Homo sapiens
tgtccaggcactgggactctag

SEQ ID NO: 8246841 - DNA, 22 bp, Homo sapiens
tgtcacttcaggaatgcaggga

SEQ ID NO: 8246842 - DNA, 22 bp, Homo sapiens
tgtcactgtgctctgttcattt

SEQ ID NO: 8246843 - DNA, 18 bp, Homo sapiens
tgtcactggataatggtc

SEQ ID NO: 8246844 - DNA, 18 bp, Homo sapiens
tgtcactctggagcccag

SEQ ID NO: 8246845 - DNA, 22 bp, Homo sapiens
tgtcactcaagttccaatttac

SEQ ID NO: 8246846 - DNA, 22 bp, Homo sapiens
tgtcactcgctcagtccctgtg

SEQ ID NO: 8246847 - DNA, 19 bp, Homo sapiens
tgtcactgtcatggcccag

SEQ ID NO: 8246848 - DNA, 22 bp, Homo sapiens
tgtcactacatcataaatatat

SEQ ID NO: 8246849 - DNA, 22 bp, Homo sapiens
tgtcactcaagttccaatttac

SEQ ID NO: 8246850 - DNA, 21 bp, Homo sapiens
tgtcagaaataagcatgtgat

SEQ ID NO: 8246851 - DNA, 22 bp, Homo sapiens
tgtcactttttataggtgttga

SEQ ID NO: 8246852 - DNA, 22 bp, Homo sapiens
tgtcagaactctattgatgtcc

SEQ ID NO: 8246853 - DNA, 22 bp, Homo sapiens
tgtcactttgccttctggactt

SEQ ID NO: 8246854 - DNA, 22 bp, Homo sapiens
tgtcacttcaggaatgcaggga

SEQ ID NO: 8246855 - DNA, 21 bp, Homo sapiens
tgtcactttaagctagctcta

SEQ ID NO: 8246856 - DNA, 22 bp, Homo sapiens
tgtcacttggagaagctgatcc

SEQ ID NO: 8246857 - DNA, 22 bp, Homo sapiens
tgtcacttggagaagctgatcc

SEQ ID NO: 8246858 - DNA, 22 bp, Homo sapiens
tgtcaggttggttttcagagaa

SEQ ID NO: 8246859 - DNA, 22 bp, Homo sapiens
tgtcaggttctttaattctgca

SEQ ID NO: 8246860 - DNA, 22 bp, Homo sapiens
tgtcaggttctttaattctgca

SEQ ID NO: 8246861 - DNA, 22 bp, Homo sapiens
tgtcaggttcagtgattttact

SEQ ID NO: 8246862 - DNA, 22 bp, Homo sapiens
tgtcaggttcagtgattttact

SEQ ID NO: 8246863 - DNA, 18 bp, Homo sapiens
tgtcagtaaagtgacaga

SEQ ID NO: 8246864 - DNA, 22 bp, Homo sapiens
tgtcaggtttctccaacttata

SEQ ID NO: 8246865 - DNA, 22 bp, Homo sapiens
tgtcaggtttctccaacttata

SEQ ID NO: 8246866 - DNA, 22 bp, Homo sapiens
tgtcaggtttcagttaatggtt

SEQ ID NO: 8246867 - DNA, 22 bp, Homo sapiens
tgtcaggtttcagttaatggtt

SEQ ID NO: 8246868 - DNA, 22 bp, Homo sapiens
tgtcaggttggttttcagagaa

SEQ ID NO: 8246869 - DNA, 22 bp, Homo sapiens
tgtcaggtctctgtgatggtaa

SEQ ID NO: 8246870 - DNA, 22 bp, Homo sapiens
tgtcaggtctctgtgatggtaa

SEQ ID NO: 8246871 - DNA, 22 bp, Homo sapiens
tgtcaggtctacaaaaatgctg

SEQ ID NO: 8246872 - DNA, 22 bp, Homo sapiens
tgtcaggtctacaaaaatgctg

SEQ ID NO: 8246873 - DNA, 22 bp, Homo sapiens
tgtcaggtgacacactaggagc

SEQ ID NO: 8246874 - DNA, 15 bp, Homo sapiens
tgtcaggtgaatggt

SEQ ID NO: 8246875 - DNA, 15 bp, Homo sapiens
tgtcaggtgaatggt

SEQ ID NO: 8246876 - DNA, 22 bp, Homo sapiens
tgtcaggtctctgtgatggtaa

SEQ ID NO: 8246877 - DNA, 22 bp, Homo sapiens
tgtcaggtgacacactaggagc

SEQ ID NO: 8246878 - DNA, 22 bp, Homo sapiens
tgtcaggtgacacactaggagc

SEQ ID NO: 8246879 - DNA, 22 bp, Homo sapiens
tgtcaggtgacagtttttacca

SEQ ID NO: 8246880 - DNA, 22 bp, Homo sapiens
tgtcaggtgacagtttttacca

SEQ ID NO: 8246881 - DNA, 22 bp, Homo sapiens
tgtcaggttcaaatcttggtcc

SEQ ID NO: 8246882 - DNA, 22 bp, Homo sapiens
tgtcaggttcaaatcttggtcc

SEQ ID NO: 8246883 - DNA, 22 bp, Homo sapiens
tgtcaggtgcagcttggatgca

SEQ ID NO: 8246884 - DNA, 22 bp, Homo sapiens
tgtcaggtgcagcttggatgca

SEQ ID NO: 8246885 - DNA, 22 bp, Homo sapiens
tgtcaggtagagataatggggg

SEQ ID NO: 8246886 - DNA, 22 bp, Homo sapiens
tgtcaggtagtaggtagaaact

SEQ ID NO: 8246887 - DNA, 22 bp, Homo sapiens
tgtcaggtagtaggtagaaact

SEQ ID NO: 8246888 - DNA, 22 bp, Homo sapiens
tgtcaggtcagacttggttttt

SEQ ID NO: 8246889 - DNA, 22 bp, Homo sapiens
tgtcaggtcagacttggttttt

SEQ ID NO: 8246890 - DNA, 22 bp, Homo sapiens
tgtcaggtatgcaacagaatgc

SEQ ID NO: 8246891 - DNA, 22 bp, Homo sapiens
tgtcaggtatgcaacagaatgc

SEQ ID NO: 8246892 - DNA, 22 bp, Homo sapiens
tgtcaggtctaaaatgggtctc

SEQ ID NO: 8246893 - DNA, 22 bp, Homo sapiens
tgtcaggtctaaaatgggtctc

SEQ ID NO: 8246894 - DNA, 22 bp, Homo sapiens
tgtcaggtctaaaatgggtctc

SEQ ID NO: 8246895 - DNA, 22 bp, Homo sapiens
tgtcaggtcattgccatggaaa

SEQ ID NO: 8246896 - DNA, 22 bp, Homo sapiens
tgtcaggtcattgccatggaaa

SEQ ID NO: 8246897 - DNA, 22 bp, Homo sapiens
tgtcaggtcagtatttgatgcc

SEQ ID NO: 8246898 - DNA, 22 bp, Homo sapiens
tgtcaggtcagtatttgatgcc

SEQ ID NO: 8246899 - DNA, 19 bp, Homo sapiens
tgtcaggggtgtgctgtgc

SEQ ID NO: 8246900 - DNA, 23 bp, Homo sapiens
tgtcaggtaaggaaggattcact

SEQ ID NO: 8246901 - DNA, 22 bp, Homo sapiens
tgtcaggtagagataatggggg

SEQ ID NO: 8246902 - DNA, 23 bp, Homo sapiens
tgtcaggtaaggaaggattcact

SEQ ID NO: 8246903 - DNA, 22 bp, Homo sapiens
tgtcagggatttaaagacacaa

SEQ ID NO: 8246904 - DNA, 22 bp, Homo sapiens
tgtcatagtgtggtagcagtgg

SEQ ID NO: 8246905 - DNA, 22 bp, Homo sapiens
tgtcataatcagttttgcatgt

SEQ ID NO: 8246906 - DNA, 22 bp, Homo sapiens
tgtcagtttagttgaagaaaga

SEQ ID NO: 8246907 - DNA, 22 bp, Homo sapiens
tgtcagtgtgcaccgggaggcc

SEQ ID NO: 8246908 - DNA, 22 bp, Homo sapiens
tgtcagtgttttatgtgccctt

SEQ ID NO: 8246909 - DNA, 22 bp, Homo sapiens
tgtcagtgtatacatacagtat

SEQ ID NO: 8246910 - DNA, 22 bp, Homo sapiens
tgtcagtgtatacatacagtat

SEQ ID NO: 8246911 - DNA, 22 bp, Homo sapiens
tgtcagtggtcatagtagaaaa

SEQ ID NO: 8246912 - DNA, 22 bp, Homo sapiens
tgtcagtgtaactcttatagca

SEQ ID NO: 8246913 - DNA, 22 bp, Homo sapiens
tgtcagtgtctatgaagaattt

SEQ ID NO: 8246914 - DNA, 22 bp, Homo sapiens
tgtcagtgtctatgaagaattt

SEQ ID NO: 8246915 - DNA, 22 bp, Homo sapiens
tgtcagtgtctatgaagaattt

SEQ ID NO: 8246916 - DNA, 22 bp, Homo sapiens
tgtcagtgctatagtgggaata

SEQ ID NO: 8246917 - DNA, 22 bp, Homo sapiens
tgtcagtggacctggagaggcc

SEQ ID NO: 8246918 - DNA, 22 bp, Homo sapiens
tgtcagtggtaaggttgggagt

SEQ ID NO: 8246919 - DNA, 22 bp, Homo sapiens
tgtcagtggtcatagtagaaaa

SEQ ID NO: 8246920 - DNA, 22 bp, Homo sapiens
tgtcagtggtagacccagaggt

SEQ ID NO: 8246921 - DNA, 22 bp, Homo sapiens
tgtcagtgatttgtagggaatt

SEQ ID NO: 8246922 - DNA, 22 bp, Homo sapiens
tgtcagtgcacagatggttgat

SEQ ID NO: 8246923 - DNA, 19 bp, Homo sapiens
tgtcagtgatacatgcttt

SEQ ID NO: 8246924 - DNA, 20 bp, Homo sapiens
tgtcagtgcctgaggcacag

SEQ ID NO: 8246925 - DNA, 20 bp, Homo sapiens
tgtcagtgcctgaggcacag

SEQ ID NO: 8246926 - DNA, 19 bp, Homo sapiens
tgtcagtagttgtctaggg

SEQ ID NO: 8246927 - DNA, 22 bp, Homo sapiens
tgtcagtgaaaaattgtgatag

SEQ ID NO: 8246928 - DNA, 19 bp, Homo sapiens
tgtcagtagttgtctaggg

SEQ ID NO: 8246929 - DNA, 22 bp, Homo sapiens
tgtcagtgacagatttatgatc

SEQ ID NO: 8246930 - DNA, 22 bp, Homo sapiens
tgtcagtgaactggaaggcctg

SEQ ID NO: 8246931 - DNA, 22 bp, Homo sapiens
tgtcagtgagttagttgcaagt

SEQ ID NO: 8246932 - DNA, 22 bp, Homo sapiens
tgtcagtgagttagttgcaagt

SEQ ID NO: 8246933 - DNA, 22 bp, Homo sapiens
tgtcagtgacctagcacggtgc

SEQ ID NO: 8246934 - DNA, 22 bp, Homo sapiens
tgtcatgagttatttcatagga

SEQ ID NO: 8246935 - DNA, 22 bp, Homo sapiens
tgtcattccttcaatgtagata

SEQ ID NO: 8246936 - DNA, 22 bp, Homo sapiens
tgtcatctgaatttctcatcac

SEQ ID NO: 8246937 - DNA, 22 bp, Homo sapiens
tgtcatctcttgcaggaagcct

SEQ ID NO: 8246938 - DNA, 22 bp, Homo sapiens
tgtcatctggcctgattggtgt

SEQ ID NO: 8246939 - DNA, 22 bp, Homo sapiens
tgtcatctgtgttttgctggag

SEQ ID NO: 8246940 - DNA, 21 bp, Homo sapiens
tgtcatatttcaatacagttt

SEQ ID NO: 8246941 - DNA, 22 bp, Homo sapiens
tgtcatctcactgatatagatg

SEQ ID NO: 8246942 - DNA, 22 bp, Homo sapiens
tgtcatatagaatgttctatga

SEQ ID NO: 8246943 - DNA, 22 bp, Homo sapiens
tgtcatatgtaatatgttcatt

SEQ ID NO: 8246944 - DNA, 22 bp, Homo sapiens
tgtcatttattctcttattcta

SEQ ID NO: 8246945 - DNA, 22 bp, Homo sapiens
tgtcatttattctcttattcta

SEQ ID NO: 8246946 - DNA, 20 bp, Homo sapiens
tgtcatttatttatcaaatg

SEQ ID NO: 8246947 - DNA, 22 bp, Homo sapiens
tgtcatttattttgctgtctgt

SEQ ID NO: 8246948 - DNA, 22 bp, Homo sapiens
tgtcatttattctcttattcta

SEQ ID NO: 8246949 - DNA, 22 bp, Homo sapiens
tgtcatttatcttatagtaatc

SEQ ID NO: 8246950 - DNA, 22 bp, Homo sapiens
tgtcatttatgcttcttcagtg

SEQ ID NO: 8246951 - DNA, 22 bp, Homo sapiens
tgtcatttattctcttattcta

SEQ ID NO: 8246952 - DNA, 22 bp, Homo sapiens
tgtcatttagtcctctgtgtgt

SEQ ID NO: 8246953 - DNA, 22 bp, Homo sapiens
tgtcatttagtcctctgtgtgt

SEQ ID NO: 8246954 - DNA, 22 bp, Homo sapiens
tgtcatttaaagctttccagat

SEQ ID NO: 8246955 - DNA, 22 bp, Homo sapiens
tgtcattgttctgtttgttcct

SEQ ID NO: 8246956 - DNA, 22 bp, Homo sapiens
tgtcatttaaagctttccagat

SEQ ID NO: 8246957 - DNA, 20 bp, Homo sapiens
tgtcattggcgtggttggct

SEQ ID NO: 8246958 - DNA, 22 bp, Homo sapiens
tgtcattggtacaaattgattg

SEQ ID NO: 8246959 - DNA, 20 bp, Homo sapiens
tgtcattcttctttcacagg

SEQ ID NO: 8246960 - DNA, 22 bp, Homo sapiens
tgtcattttatgtatgtggtct

SEQ ID NO: 8246961 - DNA, 22 bp, Homo sapiens
tgtcattttcagcttatgcttc

SEQ ID NO: 8246962 - DNA, 22 bp, Homo sapiens
tgtcattttcagcttatgcttc

SEQ ID NO: 8246963 - DNA, 22 bp, Homo sapiens
tgtcattttctaatctgttgtc

SEQ ID NO: 8246964 - DNA, 22 bp, Homo sapiens
tgtcattttctaatctgttgtc

SEQ ID NO: 8246965 - DNA, 22 bp, Homo sapiens
tgtcattttctaatctgttgtc

SEQ ID NO: 8246966 - DNA, 22 bp, Homo sapiens
tgtcattttctaatctgttgtc

SEQ ID NO: 8246967 - DNA, 22 bp, Homo sapiens
tgtcattttcatcctaaggagc

SEQ ID NO: 8246968 - DNA, 22 bp, Homo sapiens
tgtcattttcatcctaaggagc

SEQ ID NO: 8246969 - DNA, 22 bp, Homo sapiens
tgtcattttctaatctgttgtc

SEQ ID NO: 8246970 - DNA, 22 bp, Homo sapiens
tgtcattttagtgcatcactca

SEQ ID NO: 8246971 - DNA, 22 bp, Homo sapiens
tgtcatttcctgaatgctgagt

SEQ ID NO: 8246972 - DNA, 22 bp, Homo sapiens
tgtcatttattttgctgtctgt

SEQ ID NO: 8246973 - DNA, 22 bp, Homo sapiens
tgtcatttcacaatatcactca

SEQ ID NO: 8246974 - DNA, 22 bp, Homo sapiens
tgtcatttcacaatatcactca

SEQ ID NO: 8246975 - DNA, 22 bp, Homo sapiens
tgtcatttcctgaatgctgagt

SEQ ID NO: 8246976 - DNA, 22 bp, Homo sapiens
tgtcattttctggttagttaat

SEQ ID NO: 8246977 - DNA, 22 bp, Homo sapiens
tgtcattttgtctcactgctat

SEQ ID NO: 8246978 - DNA, 22 bp, Homo sapiens
tgtccacatcactcacttgtca

SEQ ID NO: 8246979 - DNA, 22 bp, Homo sapiens
tgtccacatcactcacttgtca

SEQ ID NO: 8246980 - DNA, 22 bp, Homo sapiens
tgtccacatcactcacttgtca

SEQ ID NO: 8246981 - DNA, 22 bp, Homo sapiens
tgtccacatatgttgtttctga

SEQ ID NO: 8246982 - DNA, 22 bp, Homo sapiens
tgtccagccggagtcggttaga

SEQ ID NO: 8246983 - DNA, 22 bp, Homo sapiens
tgtccagctcgagacactatct

SEQ ID NO: 8246984 - DNA, 22 bp, Homo sapiens
tgtccagctcgagacactatct

SEQ ID NO: 8246985 - DNA, 22 bp, Homo sapiens
tgtccagcggcctggctgctga

SEQ ID NO: 8246986 - DNA, 22 bp, Homo sapiens
tgtccaggagtaaaaagacctg

SEQ ID NO: 8246987 - DNA, 22 bp, Homo sapiens
tgtccaggcactgggactctag

SEQ ID NO: 8246988 - DNA, 22 bp, Homo sapiens
tgtccaggaccctattctcact

SEQ ID NO: 8246989 - DNA, 22 bp, Homo sapiens
tgtccagcttttcccaccaagt

SEQ ID NO: 8246990 - DNA, 22 bp, Homo sapiens
tgtatgcttgagtgtgtatact

SEQ ID NO: 8246991 - DNA, 22 bp, Homo sapiens
tgtatgcataaaattatttaca

SEQ ID NO: 8246992 - DNA, 22 bp, Homo sapiens
tgtatgcacatatataggtaca

SEQ ID NO: 8246993 - DNA, 22 bp, Homo sapiens
tgtatgctttccaaaaatgctg

SEQ ID NO: 8246994 - DNA, 22 bp, Homo sapiens
tgtatgtaaagtttgtaataga

SEQ ID NO: 8246995 - DNA, 22 bp, Homo sapiens
tgtatgtaaagtttgtaataga

SEQ ID NO: 8246996 - DNA, 22 bp, Homo sapiens
tgtatgtaaagaaggatatttt

SEQ ID NO: 8246997 - DNA, 22 bp, Homo sapiens
tgtatgtatacacatagatacg

SEQ ID NO: 8246998 - DNA, 22 bp, Homo sapiens
tgtatttaattgtatcatcaca

SEQ ID NO: 8246999 - DNA, 22 bp, Homo sapiens
tgtatttaattgtatcatcaca

SEQ ID NO: 8247000 - DNA, 22 bp, Homo sapiens
tgtatttaattgtatcatcaca

SEQ ID NO: 8247001 - DNA, 20 bp, Homo sapiens
tgtatttaatgaaggctttt

SEQ ID NO: 8247002 - DNA, 20 bp, Homo sapiens
tgtatttaatgaaggctttt

SEQ ID NO: 8247003 - DNA, 20 bp, Homo sapiens
tgtatttaatgaaggctttt

SEQ ID NO: 8247004 - DNA, 22 bp, Homo sapiens
tgtatttagtccagtctctcat

SEQ ID NO: 8247005 - DNA, 22 bp, Homo sapiens
tgtatttagtccagtctctcat

SEQ ID NO: 8247006 - DNA, 22 bp, Homo sapiens
tgtatttaattgtatcatcaca

SEQ ID NO: 8247007 - DNA, 22 bp, Homo sapiens
tgtatttaattgtatcatcaca

SEQ ID NO: 8247008 - DNA, 22 bp, Homo sapiens
tgtatttatattagaatggttg

SEQ ID NO: 8247009 - DNA, 22 bp, Homo sapiens
tgtatttatattagaatggttg

SEQ ID NO: 8247010 - DNA, 22 bp, Homo sapiens
tgtatttagtccagtctctcat

SEQ ID NO: 8247011 - DNA, 22 bp, Homo sapiens
tgtatttaagctttacctaaaa

SEQ ID NO: 8247012 - DNA, 22 bp, Homo sapiens
tgtatttaagctttacctaaaa

SEQ ID NO: 8247013 - DNA, 22 bp, Homo sapiens
tgtatttaagctttacctaaaa

SEQ ID NO: 8247014 - DNA, 20 bp, Homo sapiens
tgtatttaatgaaggctttt

SEQ ID NO: 8247015 - DNA, 20 bp, Homo sapiens
tgtatttaatgaaggctttt

SEQ ID NO: 8247016 - DNA, 22 bp, Homo sapiens
tgtattgttataatttgtatgt

SEQ ID NO: 8247017 - DNA, 22 bp, Homo sapiens
tgtattgttataatttgtatgt

SEQ ID NO: 8247018 - DNA, 22 bp, Homo sapiens
tgtattgtaagtggttatatgc

SEQ ID NO: 8247019 - DNA, 22 bp, Homo sapiens
tgtattgaattgtgttatatct

SEQ ID NO: 8247020 - DNA, 22 bp, Homo sapiens
tgtattgaggattcatttttgt

SEQ ID NO: 8247021 - DNA, 20 bp, Homo sapiens
tgtattctttgctctccact

SEQ ID NO: 8247022 - DNA, 23 bp, Homo sapiens
tgtattgaaggtgtagtttgtag

SEQ ID NO: 8247023 - DNA, 23 bp, Homo sapiens
tgtattgaaggtgtagtttgtag

SEQ ID NO: 8247024 - DNA, 17 bp, Homo sapiens
tgtatttatcatgtcag

SEQ ID NO: 8247025 - DNA, 17 bp, Homo sapiens
tgtatttatcatgtcag

SEQ ID NO: 8247026 - DNA, 22 bp, Homo sapiens
tgtatttattcaggatgtaact

SEQ ID NO: 8247027 - DNA, 17 bp, Homo sapiens
tgtatttatcatgtcag

SEQ ID NO: 8247028 - DNA, 22 bp, Homo sapiens
tgtatttattcaggatgtaact

SEQ ID NO: 8247029 - DNA, 22 bp, Homo sapiens
tgtatttattcaggatgtaact

SEQ ID NO: 8247030 - DNA, 22 bp, Homo sapiens
tgtatttcaattttagcaccaa

SEQ ID NO: 8247031 - DNA, 22 bp, Homo sapiens
tgtatttattcttctggtgttt

SEQ ID NO: 8247032 - DNA, 22 bp, Homo sapiens
tgtatttattcttctggtgttt

SEQ ID NO: 8247033 - DNA, 22 bp, Homo sapiens
tgtatttattcttctggtgttt

SEQ ID NO: 8247034 - DNA, 22 bp, Homo sapiens
tgtatttattcaggatgtaact

SEQ ID NO: 8247035 - DNA, 22 bp, Homo sapiens
tgtatttattcaggatgtaact

SEQ ID NO: 8247036 - DNA, 22 bp, Homo sapiens
tgtatttattcaggatgtaact

SEQ ID NO: 8247037 - DNA, 22 bp, Homo sapiens
tgtatttgaaacagtgcatggg

SEQ ID NO: 8247038 - DNA, 22 bp, Homo sapiens
tgtatttcgctaggtactccct

SEQ ID NO: 8247039 - DNA, 18 bp, Homo sapiens
tgtatttctaacagctaa

SEQ ID NO: 8247040 - DNA, 22 bp, Homo sapiens
tgtatttctgctttctctagta

SEQ ID NO: 8247041 - DNA, 22 bp, Homo sapiens
tgtatttcctggtttagatcaa

SEQ ID NO: 8247042 - DNA, 22 bp, Homo sapiens
tgtattttctgaagataatcaa

SEQ ID NO: 8247043 - DNA, 22 bp, Homo sapiens
tgtattttctgaggagcattag

SEQ ID NO: 8247044 - DNA, 22 bp, Homo sapiens
tgtattttctgaggagcattag

SEQ ID NO: 8247045 - DNA, 22 bp, Homo sapiens
tgtattttctgaggagcattag

SEQ ID NO: 8247046 - DNA, 22 bp, Homo sapiens
tgtattttcagagtggcatttc

SEQ ID NO: 8247047 - DNA, 22 bp, Homo sapiens
tgtattttcagagtggcatttc

SEQ ID NO: 8247048 - DNA, 22 bp, Homo sapiens
tgtattttctgaagataatcaa

SEQ ID NO: 8247049 - DNA, 22 bp, Homo sapiens
tgtattttctgaagataatcaa

SEQ ID NO: 8247050 - DNA, 22 bp, Homo sapiens
tgtattttcagagtggcatttc

SEQ ID NO: 8247051 - DNA, 22 bp, Homo sapiens
tgtattttgtgaggatcactct

SEQ ID NO: 8247052 - DNA, 22 bp, Homo sapiens
tgtattttgtgaggatcactct

SEQ ID NO: 8247053 - DNA, 22 bp, Homo sapiens
tgtattttgtgaggatcactct

SEQ ID NO: 8247054 - DNA, 22 bp, Homo sapiens
tgtattttgagtccaatctcct

SEQ ID NO: 8247055 - DNA, 22 bp, Homo sapiens
tgtattttcttctggaagctta

SEQ ID NO: 8247056 - DNA, 22 bp, Homo sapiens
tgtattttctgaggagcattag

SEQ ID NO: 8247057 - DNA, 22 bp, Homo sapiens
tgtattttctgaggagcattag

SEQ ID NO: 8247058 - DNA, 22 bp, Homo sapiens
tgtattttcttctggaagctta

SEQ ID NO: 8247059 - DNA, 22 bp, Homo sapiens
tgtcaatgtgtacaggagctca

SEQ ID NO: 8247060 - DNA, 22 bp, Homo sapiens
tgtcaaatagtagaaagatggc

SEQ ID NO: 8247061 - DNA, 22 bp, Homo sapiens
tgtcacaaacatacattataga

SEQ ID NO: 8247062 - DNA, 22 bp, Homo sapiens
tgtcaattaaagtttgtaggtg

SEQ ID NO: 8247063 - DNA, 22 bp, Homo sapiens
tgtcaattatcaaggttcattt

SEQ ID NO: 8247064 - DNA, 22 bp, Homo sapiens
tgtcacaaaaatcagtaattgc

SEQ ID NO: 8247065 - DNA, 22 bp, Homo sapiens
tgtcacaacagaggaactgaat

SEQ ID NO: 8247066 - DNA, 22 bp, Homo sapiens
tgtcacaagtaactggcaatgc

SEQ ID NO: 8247067 - DNA, 22 bp, Homo sapiens
tgtcacaaggccatgaaaagaa

SEQ ID NO: 8247068 - DNA, 22 bp, Homo sapiens
tgtcacaatatcccaatctgcc

SEQ ID NO: 8247069 - DNA, 22 bp, Homo sapiens
tgtcacaatatcccaatctgcc

SEQ ID NO: 8247070 - DNA, 22 bp, Homo sapiens
tgtcacaatttatttctcttga

SEQ ID NO: 8247071 - DNA, 22 bp, Homo sapiens
tgtcacactgaccacatctgta

SEQ ID NO: 8247072 - DNA, 22 bp, Homo sapiens
tgtcacacctcgtttagcattc

SEQ ID NO: 8247073 - DNA, 22 bp, Homo sapiens
tgtcacacctcgtttagcattc

SEQ ID NO: 8247074 - DNA, 22 bp, Homo sapiens
tgtcacacttggtggttttggt

SEQ ID NO: 8247075 - DNA, 22 bp, Homo sapiens
tgtcacagagcaactatttctt

SEQ ID NO: 8247076 - DNA, 22 bp, Homo sapiens
tgtcaaaatgactttactacag

SEQ ID NO: 8247077 - DNA, 22 bp, Homo sapiens
tgtcaaacaccaacatttctcc

SEQ ID NO: 8247078 - DNA, 22 bp, Homo sapiens
tgtcaaagcctgaatcacatag

SEQ ID NO: 8247079 - DNA, 22 bp, Homo sapiens
tgtcaaaaccagcaattttgtt

SEQ ID NO: 8247080 - DNA, 22 bp, Homo sapiens
tgtcaaaaccagcaattttgtt

SEQ ID NO: 8247081 - DNA, 22 bp, Homo sapiens
tgtcaaaaataagagagattgt

SEQ ID NO: 8247082 - DNA, 22 bp, Homo sapiens
tgtatttttagacctttagacc

SEQ ID NO: 8247083 - DNA, 22 bp, Homo sapiens
tgtatttttagacctttagacc

SEQ ID NO: 8247084 - DNA, 22 bp, Homo sapiens
tgtatttttaggaatgcgctat

SEQ ID NO: 8247085 - DNA, 22 bp, Homo sapiens
tgtcaaaaagctgggacaagca

SEQ ID NO: 8247086 - DNA, 22 bp, Homo sapiens
tgtcaaaaataagagagattgt

SEQ ID NO: 8247087 - DNA, 22 bp, Homo sapiens
tgtatttttagacctttagacc

SEQ ID NO: 8247088 - DNA, 22 bp, Homo sapiens
tgtatttttagacctttagacc

SEQ ID NO: 8247089 - DNA, 22 bp, Homo sapiens
tgtcacagtctcgtgagcatct

SEQ ID NO: 8247090 - DNA, 22 bp, Homo sapiens
tgtcacagtctcgtgagcatct

SEQ ID NO: 8247091 - DNA, 22 bp, Homo sapiens
tgtcacagtttgtactttatag

SEQ ID NO: 8247092 - DNA, 22 bp, Homo sapiens
tgtcacagtttgtactttatag

SEQ ID NO: 8247093 - DNA, 21 bp, Homo sapiens
tgtcacagattctcagcttgc

SEQ ID NO: 8247094 - DNA, 21 bp, Homo sapiens
tgtcacagattctcagcttgc

SEQ ID NO: 8247095 - DNA, 22 bp, Homo sapiens
tgtcacagagcgtgcaacagaa

SEQ ID NO: 8247096 - DNA, 21 bp, Homo sapiens
tgtcacagattctcagcttgc

SEQ ID NO: 8247097 - DNA, 22 bp, Homo sapiens
tgtcacatgaagccaacatagc

SEQ ID NO: 8247098 - DNA, 22 bp, Homo sapiens
tgtcacatcaggtggtggctgt

SEQ ID NO: 8247099 - DNA, 22 bp, Homo sapiens
tgtcacatcaggggtgttgaca

SEQ ID NO: 8247100 - DNA, 22 bp, Homo sapiens
tgtcacagtgcacagctaagaa

SEQ ID NO: 8247101 - DNA, 22 bp, Homo sapiens
tgtcacataatttatctgtagg

SEQ ID NO: 8247102 - DNA, 22 bp, Homo sapiens
tgtcacataggcaaaatgtttt

SEQ ID NO: 8247103 - DNA, 22 bp, Homo sapiens
tgtcacataggcaaaatgtttt

SEQ ID NO: 8247104 - DNA, 22 bp, Homo sapiens
tgtcaccaagttgatgaatgca

SEQ ID NO: 8247105 - DNA, 22 bp, Homo sapiens
tgtcaccagttccaggaaataa

SEQ ID NO: 8247106 - DNA, 22 bp, Homo sapiens
tgtcaccagctgctcctcagga

SEQ ID NO: 8247107 - DNA, 22 bp, Homo sapiens
tgtcaccatgccagcttctgcc

SEQ ID NO: 8247108 - DNA, 22 bp, Homo sapiens
tgtcaccatgccagcttctgcc

SEQ ID NO: 8247109 - DNA, 22 bp, Homo sapiens
tgtcaccatgcgaggctaattt

SEQ ID NO: 8247110 - DNA, 22 bp, Homo sapiens
tgtcacctctttggctgcagct

SEQ ID NO: 8247111 - DNA, 22 bp, Homo sapiens
tgtcacctctttggctgcagct

SEQ ID NO: 8247112 - DNA, 22 bp, Homo sapiens
tgtcacattgaatatgatttat

SEQ ID NO: 8247113 - DNA, 22 bp, Homo sapiens
tgtcacattgaatatgatttat

SEQ ID NO: 8247114 - DNA, 23 bp, Homo sapiens
tgtcacatttagttggcattgtt

SEQ ID NO: 8247115 - DNA, 22 bp, Homo sapiens
tgtcacatgtttaatgtggact

SEQ ID NO: 8247116 - DNA, 22 bp, Homo sapiens
tgtcacatgtttaatgtggact

SEQ ID NO: 8247117 - DNA, 22 bp, Homo sapiens
tgtcacatgtgtggcatttttc

SEQ ID NO: 8247118 - DNA, 21 bp, Homo sapiens
tgtcacatgtggatggtattt

SEQ ID NO: 8247119 - DNA, 23 bp, Homo sapiens
tgtatacaccctgtgcatctggg

SEQ ID NO: 8247120 - DNA, 22 bp, Homo sapiens
tgtatacactatgctatatggt

SEQ ID NO: 8247121 - DNA, 22 bp, Homo sapiens
tgtatacactatgctatatggt

SEQ ID NO: 8247122 - DNA, 21 bp, Homo sapiens
tgtatacacacatatatgtac

SEQ ID NO: 8247123 - DNA, 21 bp, Homo sapiens
tgtatacacacatatatgtac

SEQ ID NO: 8247124 - DNA, 23 bp, Homo sapiens
tgtatacaccctgtgcatctggg

SEQ ID NO: 8247125 - DNA, 22 bp, Homo sapiens
tgtataaacttaagcaggaacc

SEQ ID NO: 8247126 - DNA, 22 bp, Homo sapiens
tgtataaaccatggacagcttt

SEQ ID NO: 8247127 - DNA, 22 bp, Homo sapiens
tgtataaacttaagcaggaacc

SEQ ID NO: 8247128 - DNA, 22 bp, Homo sapiens
tgtataaatttaaattcctgct

SEQ ID NO: 8247129 - DNA, 22 bp, Homo sapiens
tgtataaatttaaattcctgct

SEQ ID NO: 8247130 - DNA, 22 bp, Homo sapiens
tgtataaacttaagcaggaacc

SEQ ID NO: 8247131 - DNA, 22 bp, Homo sapiens
tgtatacaagtcgtgtaaactt

SEQ ID NO: 8247132 - DNA, 22 bp, Homo sapiens
tgtataagcctagtgaaatttc

SEQ ID NO: 8247133 - DNA, 22 bp, Homo sapiens
tgtataacttgtggttatgaat

SEQ ID NO: 8247134 - DNA, 22 bp, Homo sapiens
tgtataagcctagtgaaatttc

SEQ ID NO: 8247135 - DNA, 22 bp, Homo sapiens
tgtataacacgcagttgagagg

SEQ ID NO: 8247136 - DNA, 21 bp, Homo sapiens
tgtataacaactatgcaatgt

SEQ ID NO: 8247137 - DNA, 22 bp, Homo sapiens
tgtataactcttgttggagttt

SEQ ID NO: 8247138 - DNA, 22 bp, Homo sapiens
tgtatacaggcataagagatac

SEQ ID NO: 8247139 - DNA, 22 bp, Homo sapiens
tgtatacaggcataagagatac

SEQ ID NO: 8247140 - DNA, 22 bp, Homo sapiens
tgtatacaggattactcatagc

SEQ ID NO: 8247141 - DNA, 22 bp, Homo sapiens
tgtatacaggattactcatagc

SEQ ID NO: 8247142 - DNA, 22 bp, Homo sapiens
tgtatacatgtgttcatgcatg

SEQ ID NO: 8247143 - DNA, 22 bp, Homo sapiens
tgtatacattctcttgggtttg

SEQ ID NO: 8247144 - DNA, 22 bp, Homo sapiens
tgtatacatgtctgtgtgcaca

SEQ ID NO: 8247145 - DNA, 22 bp, Homo sapiens
tgtatacatgtgttcatgcatg

SEQ ID NO: 8247146 - DNA, 22 bp, Homo sapiens
tgtatagatgaggaagctgtta

SEQ ID NO: 8247147 - DNA, 22 bp, Homo sapiens
tgtatagagttggaagatgact

SEQ ID NO: 8247148 - DNA, 22 bp, Homo sapiens
tgtatataagcatttacttgtt

SEQ ID NO: 8247149 - DNA, 22 bp, Homo sapiens
tgtatagtttcttagttactga

SEQ ID NO: 8247150 - DNA, 22 bp, Homo sapiens
tgtatatacatacacacatgaa

SEQ ID NO: 8247151 - DNA, 22 bp, Homo sapiens
tgtatatacatacacacatgaa

SEQ ID NO: 8247152 - DNA, 22 bp, Homo sapiens
tgtatatacacactcccatgtt

SEQ ID NO: 8247153 - DNA, 22 bp, Homo sapiens
tgtatataagcatttacttgtt

SEQ ID NO: 8247154 - DNA, 22 bp, Homo sapiens
tgtatataagcatttacttgtt

SEQ ID NO: 8247155 - DNA, 22 bp, Homo sapiens
tgtatacatttaactagataga

SEQ ID NO: 8247156 - DNA, 22 bp, Homo sapiens
tgtatacatttaactagataga

SEQ ID NO: 8247157 - DNA, 22 bp, Homo sapiens
tgtatagagttggaagatgact

SEQ ID NO: 8247158 - DNA, 22 bp, Homo sapiens
tgtatacatttggtgcatattt

SEQ ID NO: 8247159 - DNA, 22 bp, Homo sapiens
tgtatcaagggtttatgtaagc

SEQ ID NO: 8247160 - DNA, 22 bp, Homo sapiens
tgtatcaatcatgtaatttggt

SEQ ID NO: 8247161 - DNA, 23 bp, Homo sapiens
tgtatctgtactattcctgcctc

SEQ ID NO: 8247162 - DNA, 22 bp, Homo sapiens
tgtatctttctactgtctagtt

SEQ ID NO: 8247163 - DNA, 22 bp, Homo sapiens
tgtatgaacctttaatatagtg

SEQ ID NO: 8247164 - DNA, 22 bp, Homo sapiens
tgtatgaaaaggaatagattga

SEQ ID NO: 8247165 - DNA, 22 bp, Homo sapiens
tgtatctgtttagcacccagcc

SEQ ID NO: 8247166 - DNA, 22 bp, Homo sapiens
tgtatgaagccagaatctgttt

SEQ ID NO: 8247167 - DNA, 22 bp, Homo sapiens
tgtatgaacctttaatatagtg

SEQ ID NO: 8247168 - DNA, 23 bp, Homo sapiens
tgtatgaatatgccacagtttaa

SEQ ID NO: 8247169 - DNA, 22 bp, Homo sapiens
tgtatgaatatgtattttcata

SEQ ID NO: 8247170 - DNA, 22 bp, Homo sapiens
tgtatgaatatgtattttcata

SEQ ID NO: 8247171 - DNA, 22 bp, Homo sapiens
tgtatgaatgggaaaaggaaac

SEQ ID NO: 8247172 - DNA, 22 bp, Homo sapiens
tgtatgaatctcatttgtttaa

SEQ ID NO: 8247173 - DNA, 22 bp, Homo sapiens
tgtatgaatctcatttgtttaa

SEQ ID NO: 8247174 - DNA, 22 bp, Homo sapiens
tgtatgaggcatacatcaggca

SEQ ID NO: 8247175 - DNA, 22 bp, Homo sapiens
tgtatgaggcatacatcaggca

SEQ ID NO: 8247176 - DNA, 22 bp, Homo sapiens
tgtatatgtgtattttatgaca

SEQ ID NO: 8247177 - DNA, 22 bp, Homo sapiens
tgtatatgtttgtatgtacaca

SEQ ID NO: 8247178 - DNA, 22 bp, Homo sapiens
tgtatatgtgatgtacatgtac

SEQ ID NO: 8247179 - DNA, 22 bp, Homo sapiens
tgtatatgtgatgtacatgtac

SEQ ID NO: 8247180 - DNA, 22 bp, Homo sapiens
tgtatatgtgcacatgtgcttc

SEQ ID NO: 8247181 - DNA, 22 bp, Homo sapiens
tgtatatgtgtattttatgaca

SEQ ID NO: 8247182 - DNA, 22 bp, Homo sapiens
tgtatatacatacacacatgaa

SEQ ID NO: 8247183 - DNA, 22 bp, Homo sapiens
tgtatatatttctttcattcta

SEQ ID NO: 8247184 - DNA, 22 bp, Homo sapiens
tgtatatatttctttcattcta

SEQ ID NO: 8247185 - DNA, 22 bp, Homo sapiens
tgtatatgagtctgagtgtaca

SEQ ID NO: 8247186 - DNA, 22 bp, Homo sapiens
tgtatatatttctttcattcta

SEQ ID NO: 8247187 - DNA, 22 bp, Homo sapiens
tgtatatgcactttccttatcc

SEQ ID NO: 8247188 - DNA, 20 bp, Homo sapiens
tgtatattttctggtgtaaa

SEQ ID NO: 8247189 - DNA, 22 bp, Homo sapiens
tgtatattgttctgtctcttca

SEQ ID NO: 8247190 - DNA, 22 bp, Homo sapiens
tgtatattgcctgagtctttcc

SEQ ID NO: 8247191 - DNA, 22 bp, Homo sapiens
tgtatcaaaccaaattaattct

SEQ ID NO: 8247192 - DNA, 22 bp, Homo sapiens
tgtatcaagggtttatgtaagc

SEQ ID NO: 8247193 - DNA, 22 bp, Homo sapiens
tgtagcatgtaaattggttatt

SEQ ID NO: 8247194 - DNA, 18 bp, Homo sapiens
tgtagctggaggccaggc

SEQ ID NO: 8247195 - DNA, 22 bp, Homo sapiens
tgtagctctccagccagcaagg

SEQ ID NO: 8247196 - DNA, 22 bp, Homo sapiens
tgtagctctccagccagcaagg

SEQ ID NO: 8247197 - DNA, 22 bp, Homo sapiens
tgtagctctccagccagcaagg

SEQ ID NO: 8247198 - DNA, 22 bp, Homo sapiens
tgtaggaatggattctagaagg

SEQ ID NO: 8247199 - DNA, 22 bp, Homo sapiens
tgtataaaccatggacagcttt

SEQ ID NO: 8247200 - DNA, 22 bp, Homo sapiens
tgtaggaagatataaaatatct

SEQ ID NO: 8247201 - DNA, 22 bp, Homo sapiens
tgtaggaaaaacaatgatctgc

SEQ ID NO: 8247202 - DNA, 22 bp, Homo sapiens
tgtaggaaaaacaatgatctgc

SEQ ID NO: 8247203 - DNA, 17 bp, Homo sapiens
tgtagcttctccttctc

SEQ ID NO: 8247204 - DNA, 17 bp, Homo sapiens
tgtagcttctccttctc

SEQ ID NO: 8247205 - DNA, 22 bp, Homo sapiens
tgtagatagtgatttatgacca

SEQ ID NO: 8247206 - DNA, 22 bp, Homo sapiens
tgtagatattaattattccttt

SEQ ID NO: 8247207 - DNA, 22 bp, Homo sapiens
tgtagatacacacatatagtgg

SEQ ID NO: 8247208 - DNA, 22 bp, Homo sapiens
tgtagcagtgtctaccacatta

SEQ ID NO: 8247209 - DNA, 18 bp, Homo sapiens
tgtagagccaggtttgcc

SEQ ID NO: 8247210 - DNA, 22 bp, Homo sapiens
tgtagacatgaccattaacatt

SEQ ID NO: 8247211 - DNA, 22 bp, Homo sapiens
tgtagaagttcttcaggagaat

SEQ ID NO: 8247212 - DNA, 22 bp, Homo sapiens
tgtagaagtaggagtcatctca

SEQ ID NO: 8247213 - DNA, 22 bp, Homo sapiens
tgtagaacaagaaaatctcagt

SEQ ID NO: 8247214 - DNA, 22 bp, Homo sapiens
tgtagaactgacattttggact

SEQ ID NO: 8247215 - DNA, 22 bp, Homo sapiens
tgtagaagctagcctggagcca

SEQ ID NO: 8247216 - DNA, 22 bp, Homo sapiens
tgtagaaattagtaagatcaac

SEQ ID NO: 8247217 - DNA, 22 bp, Homo sapiens
tgtagaaattagtaagatcaac

SEQ ID NO: 8247218 - DNA, 22 bp, Homo sapiens
tgtagaacctgtttattataga

SEQ ID NO: 8247219 - DNA, 22 bp, Homo sapiens
tgtagaaattagtaagatcaac

SEQ ID NO: 8247220 - DNA, 22 bp, Homo sapiens
tgtagaaattagtaagatcaac

SEQ ID NO: 8247221 - DNA, 22 bp, Homo sapiens
tgtagaaagctcttctgaaatc

SEQ ID NO: 8247222 - DNA, 22 bp, Homo sapiens
tgtagaaagaatatgtttcata

SEQ ID NO: 8247223 - DNA, 22 bp, Homo sapiens
tgtacttgaacttgactgtaga

SEQ ID NO: 8247224 - DNA, 22 bp, Homo sapiens
tgtacttattttatgtcagcac

SEQ ID NO: 8247225 - DNA, 22 bp, Homo sapiens
tgtacgcatgtgcatgcacacg

SEQ ID NO: 8247226 - DNA, 22 bp, Homo sapiens
tgtactaaggctgtgtagatgt

SEQ ID NO: 8247227 - DNA, 22 bp, Homo sapiens
tgtactaatgcatttaactaac

SEQ ID NO: 8247228 - DNA, 22 bp, Homo sapiens
tgtagaaaattggagcattcat

SEQ ID NO: 8247229 - DNA, 22 bp, Homo sapiens
tgtagaaactacacatgcaaca

SEQ ID NO: 8247230 - DNA, 18 bp, Homo sapiens
tgtagaaaagataggaat

SEQ ID NO: 8247231 - DNA, 18 bp, Homo sapiens
tgtagaaaagataggaat

SEQ ID NO: 8247232 - DNA, 22 bp, Homo sapiens
tggtttctgccctcagagctca

SEQ ID NO: 8247233 - DNA, 22 bp, Homo sapiens
tggtttctcccttcgcagtgag

SEQ ID NO: 8247234 - DNA, 22 bp, Homo sapiens
tggtttctgggtttgtctagga

SEQ ID NO: 8247235 - DNA, 22 bp, Homo sapiens
tggtttctcagactctttgcag

SEQ ID NO: 8247236 - DNA, 22 bp, Homo sapiens
tggtttctctgaactctacgac

SEQ ID NO: 8247237 - DNA, 22 bp, Homo sapiens
tggtttctcagactctttgcag

SEQ ID NO: 8247238 - DNA, 22 bp, Homo sapiens
tggtttctcagactctttgcag

SEQ ID NO: 8247239 - DNA, 22 bp, Homo sapiens
tggtttcatgagatgagaattt

SEQ ID NO: 8247240 - DNA, 22 bp, Homo sapiens
tggtttcatgagatgagaattt

SEQ ID NO: 8247241 - DNA, 22 bp, Homo sapiens
tggtttaacctgtctcttatta

SEQ ID NO: 8247242 - DNA, 22 bp, Homo sapiens
tggtttaaggacagagagccag

SEQ ID NO: 8247243 - DNA, 22 bp, Homo sapiens
tggttgtgtcacttagattaga

SEQ ID NO: 8247244 - DNA, 22 bp, Homo sapiens
tggtttataacatgtctcatga

SEQ ID NO: 8247245 - DNA, 22 bp, Homo sapiens
tggtttaatttccatttccttg

SEQ ID NO: 8247246 - DNA, 22 bp, Homo sapiens
tggtttacctggaaaagcgcat

SEQ ID NO: 8247247 - DNA, 22 bp, Homo sapiens
tggtttactctgtaaaccagga

SEQ ID NO: 8247248 - DNA, 22 bp, Homo sapiens
tggttcgtctcttttacagttc

SEQ ID NO: 8247249 - DNA, 22 bp, Homo sapiens
tggttccttctgcattttcagc

SEQ ID NO: 8247250 - DNA, 22 bp, Homo sapiens
tggttgcctctcagagattccg

SEQ ID NO: 8247251 - DNA, 22 bp, Homo sapiens
tggttgcattaactgagagggg

SEQ ID NO: 8247252 - DNA, 20 bp, Homo sapiens
tggttgaatttttagtgacc

SEQ ID NO: 8247253 - DNA, 22 bp, Homo sapiens
tggttgaatgtagcatttatgg

SEQ ID NO: 8247254 - DNA, 23 bp, Homo sapiens
tggttcttatgattttactacca

SEQ ID NO: 8247255 - DNA, 22 bp, Homo sapiens
tggttgaataagatagttttat

SEQ ID NO: 8247256 - DNA, 22 bp, Homo sapiens
tggttgaataagatagttttat

SEQ ID NO: 8247257 - DNA, 22 bp, Homo sapiens
tggttgtgctgagtttagtgca

SEQ ID NO: 8247258 - DNA, 22 bp, Homo sapiens
tggttgtggtcctccacatcgc

SEQ ID NO: 8247259 - DNA, 22 bp, Homo sapiens
tggttggggtctgcagccatcc

SEQ ID NO: 8247260 - DNA, 22 bp, Homo sapiens
tggttaaaatgcagattcagta

SEQ ID NO: 8247261 - DNA, 22 bp, Homo sapiens
tggtgtgtacatttttgcttct

SEQ ID NO: 8247262 - DNA, 22 bp, Homo sapiens
tggtgtggtccagtgacatact

SEQ ID NO: 8247263 - DNA, 22 bp, Homo sapiens
tggtgtgggcgtggcaggcaag

SEQ ID NO: 8247264 - DNA, 22 bp, Homo sapiens
tggtgtggggataagcactctg

SEQ ID NO: 8247265 - DNA, 22 bp, Homo sapiens
tggtgtggggataagcactctg

SEQ ID NO: 8247266 - DNA, 22 bp, Homo sapiens
tggtgtggggataagcactctg

SEQ ID NO: 8247267 - DNA, 22 bp, Homo sapiens
tggtgtgggcgtggcaggcaag

SEQ ID NO: 8247268 - DNA, 22 bp, Homo sapiens
tggtgtgggcgtggcaggcaag

SEQ ID NO: 8247269 - DNA, 22 bp, Homo sapiens
tggtgtgagcaggtcaagttca

SEQ ID NO: 8247270 - DNA, 22 bp, Homo sapiens
tggtgtgaggcgggagtgtagt

SEQ ID NO: 8247271 - DNA, 22 bp, Homo sapiens
tggtgtctcttagtacatagat

SEQ ID NO: 8247272 - DNA, 22 bp, Homo sapiens
tggtgtcactcaagcccggccg

SEQ ID NO: 8247273 - DNA, 22 bp, Homo sapiens
tggtgtcatgttggggtttatt

SEQ ID NO: 8247274 - DNA, 22 bp, Homo sapiens
tggtgtcctaagtggaaggaca

SEQ ID NO: 8247275 - DNA, 22 bp, Homo sapiens
tggtggtccacaaatgggtaca

SEQ ID NO: 8247276 - DNA, 22 bp, Homo sapiens
tggtggtctggctttatatcct

SEQ ID NO: 8247277 - DNA, 22 bp, Homo sapiens
tggtggtcatagcagaggccgt

SEQ ID NO: 8247278 - DNA, 22 bp, Homo sapiens
tggtggtcaaagccagtgttct

SEQ ID NO: 8247279 - DNA, 23 bp, Homo sapiens
tggtggtcagccctttctggagg

SEQ ID NO: 8247280 - DNA, 23 bp, Homo sapiens
tggtggggtcttggagacagcac

SEQ ID NO: 8247281 - DNA, 22 bp, Homo sapiens
tggtggggtcatcgtcagatgc

SEQ ID NO: 8247282 - DNA, 22 bp, Homo sapiens
tggtggggtcatcgtcagatgc

SEQ ID NO: 8247283 - DNA, 23 bp, Homo sapiens
tggtggggtcttggagacagcac

SEQ ID NO: 8247284 - DNA, 22 bp, Homo sapiens
tgtaaacaaatgcattcttgct

SEQ ID NO: 8247285 - DNA, 23 bp, Homo sapiens
tgtaaaatggggtagtgttacca

SEQ ID NO: 8247286 - DNA, 18 bp, Homo sapiens
tgtaaacactttcattct

SEQ ID NO: 8247287 - DNA, 22 bp, Homo sapiens
tgtaaacagccccatggagagc

SEQ ID NO: 8247288 - DNA, 18 bp, Homo sapiens
tgtaaacactttcattct

SEQ ID NO: 8247289 - DNA, 22 bp, Homo sapiens
tgtaaagtatctgtgagctctc

SEQ ID NO: 8247290 - DNA, 22 bp, Homo sapiens
tgtaaagtccaagatcaaagag

SEQ ID NO: 8247291 - DNA, 22 bp, Homo sapiens
tgtaaagtccaagatcaaagag

SEQ ID NO: 8247292 - DNA, 22 bp, Homo sapiens
tgtaaatcactgaactaaatga

SEQ ID NO: 8247293 - DNA, 22 bp, Homo sapiens
tgtaaatgaagtatgctttact

SEQ ID NO: 8247294 - DNA, 22 bp, Homo sapiens
tgtaaatggtcagataaaccta

SEQ ID NO: 8247295 - DNA, 20 bp, Homo sapiens
tgtaaataggcattgtagtt

SEQ ID NO: 8247296 - DNA, 22 bp, Homo sapiens
tgtaaatagttagcttgcctct

SEQ ID NO: 8247297 - DNA, 20 bp, Homo sapiens
tgtaaataggcattgtagtt

SEQ ID NO: 8247298 - DNA, 22 bp, Homo sapiens
tgtaaataatgcatgtaaatca

SEQ ID NO: 8247299 - DNA, 22 bp, Homo sapiens
tgtaaataatgcatgtaaatca

SEQ ID NO: 8247300 - DNA, 22 bp, Homo sapiens
tgtaaataatgcatgtaaatca

SEQ ID NO: 8247301 - DNA, 22 bp, Homo sapiens
tgtaaataatgcatgtaaatca

SEQ ID NO: 8247302 - DNA, 22 bp, Homo sapiens
tgtaaataatgcatgtaaatca

SEQ ID NO: 8247303 - DNA, 22 bp, Homo sapiens
tgtaaataatgcatgtaaatca

SEQ ID NO: 8247304 - DNA, 22 bp, Homo sapiens
tgtaaataattcctaggctttt

SEQ ID NO: 8247305 - DNA, 22 bp, Homo sapiens
tgtaaataatgcatgtaaatca

SEQ ID NO: 8247306 - DNA, 22 bp, Homo sapiens
tggttttaaaagatgtttgaga

SEQ ID NO: 8247307 - DNA, 22 bp, Homo sapiens
tggttttaaaaacatgctgcat

SEQ ID NO: 8247308 - DNA, 22 bp, Homo sapiens
tggtttgtatatgtttgtgaga

SEQ ID NO: 8247309 - DNA, 22 bp, Homo sapiens
tggtttctttccactctccacc

SEQ ID NO: 8247310 - DNA, 22 bp, Homo sapiens
tggtttctttccactctccacc

SEQ ID NO: 8247311 - DNA, 22 bp, Homo sapiens
tggttttgctaaaatagaaaga

SEQ ID NO: 8247312 - DNA, 22 bp, Homo sapiens
tggtttttggtgttcacagagg

SEQ ID NO: 8247313 - DNA, 22 bp, Homo sapiens
tggttttatttatgttgagtca

SEQ ID NO: 8247314 - DNA, 22 bp, Homo sapiens
tggttttcaacaagggcagcga

SEQ ID NO: 8247315 - DNA, 22 bp, Homo sapiens
tggttttagggaatcaatctat

SEQ ID NO: 8247316 - DNA, 20 bp, Homo sapiens
tggttttgccagaaatccct

SEQ ID NO: 8247317 - DNA, 22 bp, Homo sapiens
tggttttctggtggtggcagtg

SEQ ID NO: 8247318 - DNA, 22 bp, Homo sapiens
tggttttagagtatattcaggg

SEQ ID NO: 8247319 - DNA, 22 bp, Homo sapiens
tggttttagatgcctttactgc

SEQ ID NO: 8247320 - DNA, 22 bp, Homo sapiens
tggttttaaaagatgtttgaga

SEQ ID NO: 8247321 - DNA, 22 bp, Homo sapiens
tggttttagagtatattcaggg

SEQ ID NO: 8247322 - DNA, 22 bp, Homo sapiens
tggttttatttatgttgagtca

SEQ ID NO: 8247323 - DNA, 22 bp, Homo sapiens
tggttttagggaatcaatctat

SEQ ID NO: 8247324 - DNA, 22 bp, Homo sapiens
tggttttagagtatattcaggg

SEQ ID NO: 8247325 - DNA, 22 bp, Homo sapiens
tggttttagggaatcaatctat

SEQ ID NO: 8247326 - DNA, 22 bp, Homo sapiens
tgtaaaataattctccatgttt

SEQ ID NO: 8247327 - DNA, 22 bp, Homo sapiens
tgtaaaataattctccatgttt

SEQ ID NO: 8247328 - DNA, 22 bp, Homo sapiens
tgtaaaataattctccatgttt

SEQ ID NO: 8247329 - DNA, 22 bp, Homo sapiens
tgtaaaataccattccttgtca

SEQ ID NO: 8247330 - DNA, 22 bp, Homo sapiens
tgtaaaataccattccttgtca

SEQ ID NO: 8247331 - DNA, 22 bp, Homo sapiens
tgtaaaataccattccttgtca

SEQ ID NO: 8247332 - DNA, 23 bp, Homo sapiens
tgtaaaatggggtagtgttacca

SEQ ID NO: 8247333 - DNA, 23 bp, Homo sapiens
tgtaaaatggggtagtgttacca

SEQ ID NO: 8247334 - DNA, 22 bp, Homo sapiens
tgtaaaacaaaatttgtggaga

SEQ ID NO: 8247335 - DNA, 17 bp, Homo sapiens
tgtaaaacccagaggtc

SEQ ID NO: 8247336 - DNA, 22 bp, Homo sapiens
tgtaaaaagcccagccgctgag

SEQ ID NO: 8247337 - DNA, 22 bp, Homo sapiens
tgtaaaacaaaatttgtggaga

SEQ ID NO: 8247338 - DNA, 22 bp, Homo sapiens
tgtacagaggtgtacatatgat

SEQ ID NO: 8247339 - DNA, 22 bp, Homo sapiens
tgtacagagactaccattaata

SEQ ID NO: 8247340 - DNA, 22 bp, Homo sapiens
tgtacagactttgcagtgtgca

SEQ ID NO: 8247341 - DNA, 22 bp, Homo sapiens
tgtacagactttgcagtgtgca

SEQ ID NO: 8247342 - DNA, 22 bp, Homo sapiens
tgtacacatggtgtacactccc

SEQ ID NO: 8247343 - DNA, 22 bp, Homo sapiens
tgtacacattaagctctttaga

SEQ ID NO: 8247344 - DNA, 22 bp, Homo sapiens
tgtacacatgcccacttgaagc

SEQ ID NO: 8247345 - DNA, 22 bp, Homo sapiens
tgtacacatggtgtacactccc

SEQ ID NO: 8247346 - DNA, 22 bp, Homo sapiens
tgtacacatggtgtacactccc

SEQ ID NO: 8247347 - DNA, 22 bp, Homo sapiens
tgtacacatttattctctctca

SEQ ID NO: 8247348 - DNA, 22 bp, Homo sapiens
tgtacacatttattctctctca

SEQ ID NO: 8247349 - DNA, 22 bp, Homo sapiens
tgtacacatttttatgttaaca

SEQ ID NO: 8247350 - DNA, 22 bp, Homo sapiens
tgtacacattaagctctttaga

SEQ ID NO: 8247351 - DNA, 22 bp, Homo sapiens
tgtacagtattggtgttagtag

SEQ ID NO: 8247352 - DNA, 22 bp, Homo sapiens
tgtacagtcatgctttctgttc

SEQ ID NO: 8247353 - DNA, 19 bp, Homo sapiens
tgtacctgggtcatggtgc

SEQ ID NO: 8247354 - DNA, 22 bp, Homo sapiens
tgtacctggagagctcttggcc

SEQ ID NO: 8247355 - DNA, 22 bp, Homo sapiens
tgtacagataaagactgtaaat

SEQ ID NO: 8247356 - DNA, 22 bp, Homo sapiens
tgtacagataaagactgtaaat

SEQ ID NO: 8247357 - DNA, 22 bp, Homo sapiens
tgtacagatatcaggagtgagg

SEQ ID NO: 8247358 - DNA, 22 bp, Homo sapiens
tgtacagattgatcatggagag

SEQ ID NO: 8247359 - DNA, 22 bp, Homo sapiens
tgtacagggtgcagcgagcgga

SEQ ID NO: 8247360 - DNA, 22 bp, Homo sapiens
tgtacagtacatgtgtagtgat

SEQ ID NO: 8247361 - DNA, 22 bp, Homo sapiens
tgtacagtacatgtgtagtgat

SEQ ID NO: 8247362 - DNA, 22 bp, Homo sapiens
tgtacagtatatttcaaagcca

SEQ ID NO: 8247363 - DNA, 22 bp, Homo sapiens
tgtacagtacatgtgtagtgat

SEQ ID NO: 8247364 - DNA, 22 bp, Homo sapiens
tgtacagtaggaacttgttatt

SEQ ID NO: 8247365 - DNA, 22 bp, Homo sapiens
tgtacaatgccagggaacacca

SEQ ID NO: 8247366 - DNA, 22 bp, Homo sapiens
tgtacaaggccatctacatgct

SEQ ID NO: 8247367 - DNA, 22 bp, Homo sapiens
tgtacaaggccatctacatgct

SEQ ID NO: 8247368 - DNA, 22 bp, Homo sapiens
tgtacaaggccatctacatgct

SEQ ID NO: 8247369 - DNA, 23 bp, Homo sapiens
tgtacaagtacgacctctccctc

SEQ ID NO: 8247370 - DNA, 22 bp, Homo sapiens
tgtacaatagctattatctcca

SEQ ID NO: 8247371 - DNA, 22 bp, Homo sapiens
tgtacaaattcagttctagggt

SEQ ID NO: 8247372 - DNA, 22 bp, Homo sapiens
tgtacaaattcattgaactgta

SEQ ID NO: 8247373 - DNA, 22 bp, Homo sapiens
tgtacaaattcattgaactgta

SEQ ID NO: 8247374 - DNA, 22 bp, Homo sapiens
tgtacaaattcagttctagggt

SEQ ID NO: 8247375 - DNA, 22 bp, Homo sapiens
tgtacaaattcagttctagggt

SEQ ID NO: 8247376 - DNA, 22 bp, Homo sapiens
tgtacaaattcattgaactgta

SEQ ID NO: 8247377 - DNA, 22 bp, Homo sapiens
tgtacaagcaaatagaccttca

SEQ ID NO: 8247378 - DNA, 22 bp, Homo sapiens
tgtacaagaataattttatata

SEQ ID NO: 8247379 - DNA, 19 bp, Homo sapiens
tgtacaaggattatgcagg

SEQ ID NO: 8247380 - DNA, 19 bp, Homo sapiens
tgtacaaggattatgcagg

SEQ ID NO: 8247381 - DNA, 22 bp, Homo sapiens
tgtacacaattcttaacataca

SEQ ID NO: 8247382 - DNA, 22 bp, Homo sapiens
tgtacacaattcttaacataca

SEQ ID NO: 8247383 - DNA, 22 bp, Homo sapiens
tgtacacaatgtgcaggtttgt

SEQ ID NO: 8247384 - DNA, 22 bp, Homo sapiens
tgtacacaattcttaacataca

SEQ ID NO: 8247385 - DNA, 22 bp, Homo sapiens
tgtacacaattcttaacataca

SEQ ID NO: 8247386 - DNA, 22 bp, Homo sapiens
tgtacacatatcatttgtggga

SEQ ID NO: 8247387 - DNA, 22 bp, Homo sapiens
tgtacacagtatgaggcatctt

SEQ ID NO: 8247388 - DNA, 22 bp, Homo sapiens
tgtacacagtatgaggcatctt

SEQ ID NO: 8247389 - DNA, 22 bp, Homo sapiens
tgtacacacacgtgtgtatcta

SEQ ID NO: 8247390 - DNA, 22 bp, Homo sapiens
tgtacacacacgtgtgtatcta

SEQ ID NO: 8247391 - DNA, 22 bp, Homo sapiens
tgtacacaattcttaacataca

SEQ ID NO: 8247392 - DNA, 20 bp, Homo sapiens
tgtacacagtactttacaat

SEQ ID NO: 8247393 - DNA, 22 bp, Homo sapiens
tgtacacaacgtgcaggtttgt

SEQ ID NO: 8247394 - DNA, 22 bp, Homo sapiens
tgtacacaacctacagtctgct

SEQ ID NO: 8247395 - DNA, 22 bp, Homo sapiens
tgtacacaacctacagtctgct

SEQ ID NO: 8247396 - DNA, 23 bp, Homo sapiens
tgtaacaatttcatatacatgca

SEQ ID NO: 8247397 - DNA, 23 bp, Homo sapiens
tgtaacaatttcatatacatgca

SEQ ID NO: 8247398 - DNA, 22 bp, Homo sapiens
tgtaacaatttcttactattgt

SEQ ID NO: 8247399 - DNA, 22 bp, Homo sapiens
tgtaacaatttcttactattgt

SEQ ID NO: 8247400 - DNA, 22 bp, Homo sapiens
tgtaacaatttcttactattgt

SEQ ID NO: 8247401 - DNA, 22 bp, Homo sapiens
tgtaacaatttcttactattgt

SEQ ID NO: 8247402 - DNA, 22 bp, Homo sapiens
tgtaacagttataacaatgtgg

SEQ ID NO: 8247403 - DNA, 22 bp, Homo sapiens
tgtaacagctctccatgtgggg

SEQ ID NO: 8247404 - DNA, 22 bp, Homo sapiens
tgtaactaagcacattatctaa

SEQ ID NO: 8247405 - DNA, 22 bp, Homo sapiens
tgtaacctgactgctttgctct

SEQ ID NO: 8247406 - DNA, 22 bp, Homo sapiens
tgtaacatggttcttactctca

SEQ ID NO: 8247407 - DNA, 22 bp, Homo sapiens
tgtaacatatagcatgttcttg

SEQ ID NO: 8247408 - DNA, 23 bp, Homo sapiens
tgtaaattttgtagtcacatttt

SEQ ID NO: 8247409 - DNA, 22 bp, Homo sapiens
tgtaacaatgaatatagtgact

SEQ ID NO: 8247410 - DNA, 22 bp, Homo sapiens
tgtaacaaatacccttgaagtt

SEQ ID NO: 8247411 - DNA, 22 bp, Homo sapiens
tgtacaaaggtactttgatgtt

SEQ ID NO: 8247412 - DNA, 22 bp, Homo sapiens
tgtacaaaggtactttgatgtt

SEQ ID NO: 8247413 - DNA, 22 bp, Homo sapiens
tgtacaaagttaaacctatata

SEQ ID NO: 8247414 - DNA, 22 bp, Homo sapiens
tgtacaaagttaaacctatata

SEQ ID NO: 8247415 - DNA, 22 bp, Homo sapiens
tgtacaaagttaaacctatata

SEQ ID NO: 8247416 - DNA, 22 bp, Homo sapiens
tgtacaaagccagaactcccaa

SEQ ID NO: 8247417 - DNA, 22 bp, Homo sapiens
tgtacaaagagtatagctttga

SEQ ID NO: 8247418 - DNA, 22 bp, Homo sapiens
tgtacaaagccagaactcccaa

SEQ ID NO: 8247419 - DNA, 22 bp, Homo sapiens
tgtacaaagccagaactcccaa

SEQ ID NO: 8247420 - DNA, 22 bp, Homo sapiens
tgtaattttacgtgacacagtt

SEQ ID NO: 8247421 - DNA, 22 bp, Homo sapiens
tgtaagtagaacaacataatct

SEQ ID NO: 8247422 - DNA, 22 bp, Homo sapiens
tgtaaggtgctcatgtatttct

SEQ ID NO: 8247423 - DNA, 22 bp, Homo sapiens
tgtacaaagagtatagctttga

SEQ ID NO: 8247424 - DNA, 22 bp, Homo sapiens
tgtacaaaacaagatgggggta

SEQ ID NO: 8247425 - DNA, 22 bp, Homo sapiens
tgtacaaagagtatagctttga

SEQ ID NO: 8247426 - DNA, 22 bp, Homo sapiens
tgtacaaagagtatagctttga

SEQ ID NO: 8247427 - DNA, 22 bp, Homo sapiens
tgtaagaacaactgtcaaatgt

SEQ ID NO: 8247428 - DNA, 22 bp, Homo sapiens
tgtaagaaaagtaaatagtgac

SEQ ID NO: 8247429 - DNA, 22 bp, Homo sapiens
tgtaagaaaacctgtacaaaga

SEQ ID NO: 8247430 - DNA, 22 bp, Homo sapiens
tgtaagatatgagtacatgtaa

SEQ ID NO: 8247431 - DNA, 22 bp, Homo sapiens
tgtaagcttcaaatatctgtga

SEQ ID NO: 8247432 - DNA, 22 bp, Homo sapiens
tgtaagaataatgatttctaag

SEQ ID NO: 8247433 - DNA, 22 bp, Homo sapiens
tggtccttctgtcttccgcacc

SEQ ID NO: 8247434 - DNA, 22 bp, Homo sapiens
tggtccttgtggcttttcagta

SEQ ID NO: 8247435 - DNA, 22 bp, Homo sapiens
tggtccttgtaggcatttgagc

SEQ ID NO: 8247436 - DNA, 22 bp, Homo sapiens
tggtccttgtaggcatttgagc

SEQ ID NO: 8247437 - DNA, 22 bp, Homo sapiens
tggtcgaccagttggaaagtaa

SEQ ID NO: 8247438 - DNA, 22 bp, Homo sapiens
tggtcctttaagtctttctctg

SEQ ID NO: 8247439 - DNA, 23 bp, Homo sapiens
tggtctcacttggtaagatgaag

SEQ ID NO: 8247440 - DNA, 22 bp, Homo sapiens
tggtctctacggaggaaagctg

SEQ ID NO: 8247441 - DNA, 22 bp, Homo sapiens
tggtctctccatgccctccacc

SEQ ID NO: 8247442 - DNA, 23 bp, Homo sapiens
tggtctcagcctgtgagagctga

SEQ ID NO: 8247443 - DNA, 23 bp, Homo sapiens
tggtctcagcctgtgagagctga

SEQ ID NO: 8247444 - DNA, 22 bp, Homo sapiens
tggtctctgactctgaagaccc

SEQ ID NO: 8247445 - DNA, 22 bp, Homo sapiens
tggtctctgagccttcctgtgg

SEQ ID NO: 8247446 - DNA, 22 bp, Homo sapiens
tggtctctctcctgcaacaact

SEQ ID NO: 8247447 - DNA, 22 bp, Homo sapiens
tggtctctgagccttcctgtgg

SEQ ID NO: 8247448 - DNA, 22 bp, Homo sapiens
tggtctctgcaggccaggctca

SEQ ID NO: 8247449 - DNA, 22 bp, Homo sapiens
tggtctctgagccttcctgtgg

SEQ ID NO: 8247450 - DNA, 22 bp, Homo sapiens
tggtccttctctgcctgcagtg

SEQ ID NO: 8247451 - DNA, 22 bp, Homo sapiens
tggtccttcgtggtgcagttct

SEQ ID NO: 8247452 - DNA, 22 bp, Homo sapiens
tggtccttcgtggtgcagttct

SEQ ID NO: 8247453 - DNA, 22 bp, Homo sapiens
tggtcctggggtgcaggctgac

SEQ ID NO: 8247454 - DNA, 22 bp, Homo sapiens
tggtcctggggtgcaggctgac

SEQ ID NO: 8247455 - DNA, 22 bp, Homo sapiens
tggtcctggggatctgcagtga

SEQ ID NO: 8247456 - DNA, 22 bp, Homo sapiens
tggtgaggtcatagagaactgt

SEQ ID NO: 8247457 - DNA, 22 bp, Homo sapiens
tggtgatcagtcaactgtcttc

SEQ ID NO: 8247458 - DNA, 22 bp, Homo sapiens
tggtgcaaaactaattgcggtt

SEQ ID NO: 8247459 - DNA, 22 bp, Homo sapiens
tggtgcaagtctctgaggaggg

SEQ ID NO: 8247460 - DNA, 22 bp, Homo sapiens
tggtgcagacaggagccccgct

SEQ ID NO: 8247461 - DNA, 22 bp, Homo sapiens
tggtgcagacaggagccccgct

SEQ ID NO: 8247462 - DNA, 22 bp, Homo sapiens
tggtgcagatagtggtgtagta

SEQ ID NO: 8247463 - DNA, 22 bp, Homo sapiens
tggtgcagagagggatctaggg

SEQ ID NO: 8247464 - DNA, 22 bp, Homo sapiens
tggtctctgctgcagcttctca

SEQ ID NO: 8247465 - DNA, 22 bp, Homo sapiens
tggtctctgctgcagcttctca

SEQ ID NO: 8247466 - DNA, 22 bp, Homo sapiens
tggtctctgtaggctaccccat

SEQ ID NO: 8247467 - DNA, 19 bp, Homo sapiens
tggtctctgtctctttgca

SEQ ID NO: 8247468 - DNA, 22 bp, Homo sapiens
tggtgacacgaagtttgctatc

SEQ ID NO: 8247469 - DNA, 22 bp, Homo sapiens
tggtgacaccccatctctaaag

SEQ ID NO: 8247470 - DNA, 18 bp, Homo sapiens
tggtgaagggtggaggag

SEQ ID NO: 8247471 - DNA, 22 bp, Homo sapiens
tggtctctgtgctcgggcatgg

SEQ ID NO: 8247472 - DNA, 22 bp, Homo sapiens
tggtgactgggactggatatga

SEQ ID NO: 8247473 - DNA, 22 bp, Homo sapiens
tggtgacagcatggaagaagtg

SEQ ID NO: 8247474 - DNA, 22 bp, Homo sapiens
tggtcctgccccgtgcacagag

SEQ ID NO: 8247475 - DNA, 22 bp, Homo sapiens
tggtcctggaaggtcctgaggg

SEQ ID NO: 8247476 - DNA, 22 bp, Homo sapiens
tggtcctgcccacgcccatctg

SEQ ID NO: 8247477 - DNA, 22 bp, Homo sapiens
tggtcctggccttgaccccagg

SEQ ID NO: 8247478 - DNA, 22 bp, Homo sapiens
tggtcctggccttgaccccagg

SEQ ID NO: 8247479 - DNA, 22 bp, Homo sapiens
tggtcctggaaggtcctgaggg

SEQ ID NO: 8247480 - DNA, 22 bp, Homo sapiens
tggtcctggaaggtcctgaggg

SEQ ID NO: 8247481 - DNA, 22 bp, Homo sapiens
tggtcctggagagtgttccata

SEQ ID NO: 8247482 - DNA, 22 bp, Homo sapiens
tggtcctgagaatcctgtcctc

SEQ ID NO: 8247483 - DNA, 22 bp, Homo sapiens
tggtcctgagcaccagcctgac

SEQ ID NO: 8247484 - DNA, 22 bp, Homo sapiens
tggtcctgagcaccagcctgac

SEQ ID NO: 8247485 - DNA, 22 bp, Homo sapiens
tggtcctgagcaccagcctgac

SEQ ID NO: 8247486 - DNA, 22 bp, Homo sapiens
tggtcctgatcaccgctgggca

SEQ ID NO: 8247487 - DNA, 22 bp, Homo sapiens
tggtcctcaggttctctgtgcg

SEQ ID NO: 8247488 - DNA, 17 bp, Homo sapiens
tggtccaggtggagcca

SEQ ID NO: 8247489 - DNA, 17 bp, Homo sapiens
tggtccaggtggagcca

SEQ ID NO: 8247490 - DNA, 20 bp, Homo sapiens
tggtcctcacatgccatctt

SEQ ID NO: 8247491 - DNA, 22 bp, Homo sapiens
tggtccagggtgtagtacagag

SEQ ID NO: 8247492 - DNA, 22 bp, Homo sapiens
tggtccagcttgattctcttct

SEQ ID NO: 8247493 - DNA, 19 bp, Homo sapiens
tggtccagcttcttctcct

SEQ ID NO: 8247494 - DNA, 20 bp, Homo sapiens
tggtccaggacctggtgtcc

SEQ ID NO: 8247495 - DNA, 20 bp, Homo sapiens
tggtccaggacctggtgtcc

SEQ ID NO: 8247496 - DNA, 22 bp, Homo sapiens
tggtcaggattctcagcccttc

SEQ ID NO: 8247497 - DNA, 22 bp, Homo sapiens
tggtcaggggcttctgagctgt

SEQ ID NO: 8247498 - DNA, 22 bp, Homo sapiens
tggtcaggggcttctgagctgt

SEQ ID NO: 8247499 - DNA, 22 bp, Homo sapiens
tggtcaggggcttctgagctgt

SEQ ID NO: 8247500 - DNA, 22 bp, Homo sapiens
tggtcaggctgctctgcggcgt

SEQ ID NO: 8247501 - DNA, 22 bp, Homo sapiens
tggtcaggctgctctgcggcgt

SEQ ID NO: 8247502 - DNA, 22 bp, Homo sapiens
tggtcaggctgctctgcggcgt

SEQ ID NO: 8247503 - DNA, 19 bp, Homo sapiens
tggtcagatttcagaagtc

SEQ ID NO: 8247504 - DNA, 22 bp, Homo sapiens
tggtcagacaaaggagaatgtt

SEQ ID NO: 8247505 - DNA, 18 bp, Homo sapiens
tggtcactgtggatagtg

SEQ ID NO: 8247506 - DNA, 22 bp, Homo sapiens
tggtcacccctaaataggaaag

SEQ ID NO: 8247507 - DNA, 22 bp, Homo sapiens
tggtcacccactgggactgcgg

SEQ ID NO: 8247508 - DNA, 22 bp, Homo sapiens
tggtcacagtgtattgatcagg

SEQ ID NO: 8247509 - DNA, 22 bp, Homo sapiens
tggtcacccactgggactgcgg

SEQ ID NO: 8247510 - DNA, 22 bp, Homo sapiens
tggtccagaagatattcaacca

SEQ ID NO: 8247511 - DNA, 22 bp, Homo sapiens
tggtccagacatttctgaggta

SEQ ID NO: 8247512 - DNA, 22 bp, Homo sapiens
tggtccagactttgacctctca

SEQ ID NO: 8247513 - DNA, 22 bp, Homo sapiens
tggtccagatgccttggcttta

SEQ ID NO: 8247514 - DNA, 22 bp, Homo sapiens
tggtccagatgccttggcttta

SEQ ID NO: 8247515 - DNA, 22 bp, Homo sapiens
tggtccagaagatattcaacca

SEQ ID NO: 8247516 - DNA, 22 bp, Homo sapiens
tggtccacagggagtccgtgct

SEQ ID NO: 8247517 - DNA, 22 bp, Homo sapiens
tggtcatttttatttcagttgc

SEQ ID NO: 8247518 - DNA, 22 bp, Homo sapiens
tggtcaggtacctctggctgtc

SEQ ID NO: 8247519 - DNA, 22 bp, Homo sapiens
tggtcaggtacctctggctgtc

SEQ ID NO: 8247520 - DNA, 22 bp, Homo sapiens
tggtcaggtacctctggctgtc

SEQ ID NO: 8247521 - DNA, 22 bp, Homo sapiens
tggtcagtgtgacattttttaa

SEQ ID NO: 8247522 - DNA, 22 bp, Homo sapiens
tggtcagttgagcagaagggaa

SEQ ID NO: 8247523 - DNA, 23 bp, Homo sapiens
tggtcagtgccttgcatgtggga

SEQ ID NO: 8247524 - DNA, 22 bp, Homo sapiens
tggtcagttgcatcagagaagt

SEQ ID NO: 8247525 - DNA, 22 bp, Homo sapiens
tggtcagttgcatcagagaagt

SEQ ID NO: 8247526 - DNA, 22 bp, Homo sapiens
tggtcagttgtgactagaacac

SEQ ID NO: 8247527 - DNA, 22 bp, Homo sapiens
tggtcagttgcatcagagaagt

SEQ ID NO: 8247528 - DNA, 22 bp, Homo sapiens
tggtcatgtagtagagacagct

SEQ ID NO: 8247529 - DNA, 22 bp, Homo sapiens
tggtcatgtagtagagacagct

SEQ ID NO: 8247530 - DNA, 22 bp, Homo sapiens
tggtcagttgtgactagaacac

SEQ ID NO: 8247531 - DNA, 16 bp, Homo sapiens
tggtggggaggacagc

SEQ ID NO: 8247532 - DNA, 22 bp, Homo sapiens
tggtggggattccctccctggc

SEQ ID NO: 8247533 - DNA, 16 bp, Homo sapiens
tggtggggaggacagc

SEQ ID NO: 8247534 - DNA, 22 bp, Homo sapiens
tggtgggcacagtgcccaggct

SEQ ID NO: 8247535 - DNA, 22 bp, Homo sapiens
tggtgggcacagtgcccaggct

SEQ ID NO: 8247536 - DNA, 22 bp, Homo sapiens
tggtgggagtgagggcatgcca

SEQ ID NO: 8247537 - DNA, 22 bp, Homo sapiens
tggtgggagtgagggcatgcca

SEQ ID NO: 8247538 - DNA, 22 bp, Homo sapiens
tggtgggagtgagggcatgcca

SEQ ID NO: 8247539 - DNA, 22 bp, Homo sapiens
tggtgggagtgacgttgccttc

SEQ ID NO: 8247540 - DNA, 22 bp, Homo sapiens
tggtgggagtgacgttgccttc

SEQ ID NO: 8247541 - DNA, 22 bp, Homo sapiens
tggtgggagtgacgttgccttc

SEQ ID NO: 8247542 - DNA, 22 bp, Homo sapiens
tggtgggagtccgctgtgctgc

SEQ ID NO: 8247543 - DNA, 22 bp, Homo sapiens
tggtgggagtgagggcatgcca

SEQ ID NO: 8247544 - DNA, 22 bp, Homo sapiens
tggtgggagtgacgttgccttc

SEQ ID NO: 8247545 - DNA, 20 bp, Homo sapiens
tggtggccagtgctgcaggc

SEQ ID NO: 8247546 - DNA, 22 bp, Homo sapiens
tggtgggggaggctgtctagca

SEQ ID NO: 8247547 - DNA, 22 bp, Homo sapiens
tggtggggctttccttctgctt

SEQ ID NO: 8247548 - DNA, 22 bp, Homo sapiens
tggtggggtcatcgtcagatgc

SEQ ID NO: 8247549 - DNA, 22 bp, Homo sapiens
tggtgggggaggctgtctagca

SEQ ID NO: 8247550 - DNA, 22 bp, Homo sapiens
tggtgggggaggctgtctagca

SEQ ID NO: 8247551 - DNA, 22 bp, Homo sapiens
tggtgggggaggctgtctagca

SEQ ID NO: 8247552 - DNA, 22 bp, Homo sapiens
tggtgggggaggctgtctagca

SEQ ID NO: 8247553 - DNA, 22 bp, Homo sapiens
tggtggggattccctccctggc

SEQ ID NO: 8247554 - DNA, 22 bp, Homo sapiens
tggtggggccagacttcagctc

SEQ ID NO: 8247555 - DNA, 22 bp, Homo sapiens
tggtggggctttccttctgctt

SEQ ID NO: 8247556 - DNA, 22 bp, Homo sapiens
tggtggggctttccttctgctt

SEQ ID NO: 8247557 - DNA, 22 bp, Homo sapiens
tggtggggccagacttcagctc

SEQ ID NO: 8247558 - DNA, 19 bp, Homo sapiens
tggtggcaatgtcagctaa

SEQ ID NO: 8247559 - DNA, 22 bp, Homo sapiens
tggtggcaatgtcctggagaag

SEQ ID NO: 8247560 - DNA, 22 bp, Homo sapiens
tggtggcaatgtcctggagaag

SEQ ID NO: 8247561 - DNA, 19 bp, Homo sapiens
tggtggcaatgtcagctaa

SEQ ID NO: 8247562 - DNA, 22 bp, Homo sapiens
tggtggcaatgtcctggagaag

SEQ ID NO: 8247563 - DNA, 22 bp, Homo sapiens
tggtggcaatgtcctggagaag

SEQ ID NO: 8247564 - DNA, 22 bp, Homo sapiens
tggtggcacaagggagagaatc

SEQ ID NO: 8247565 - DNA, 22 bp, Homo sapiens
tggtggcacaagggagagaatc

SEQ ID NO: 8247566 - DNA, 22 bp, Homo sapiens
tggtggcacaagggagagaatc

SEQ ID NO: 8247567 - DNA, 22 bp, Homo sapiens
tggtggcagagcaagagctgga

SEQ ID NO: 8247568 - DNA, 22 bp, Homo sapiens
tggtggcagagcaagagctgga

SEQ ID NO: 8247569 - DNA, 23 bp, Homo sapiens
tggtggcagaagtagcagatgac

SEQ ID NO: 8247570 - DNA, 23 bp, Homo sapiens
tggtggcagaagtagcagatgac

SEQ ID NO: 8247571 - DNA, 22 bp, Homo sapiens
tggtggcactgacatcagacac

SEQ ID NO: 8247572 - DNA, 23 bp, Homo sapiens
tggtggcagaagtagcagatgac

SEQ ID NO: 8247573 - DNA, 22 bp, Homo sapiens
tggtggcactgacatcagacac

SEQ ID NO: 8247574 - DNA, 23 bp, Homo sapiens
tggtggcagaagtagcagatgac

SEQ ID NO: 8247575 - DNA, 22 bp, Homo sapiens
tggtggcatcagtgaagtacac

SEQ ID NO: 8247576 - DNA, 22 bp, Homo sapiens
tggtggcatcagtgaagtacac

SEQ ID NO: 8247577 - DNA, 22 bp, Homo sapiens
tggtggcatcactcagcctccc

SEQ ID NO: 8247578 - DNA, 22 bp, Homo sapiens
tggtggcatcaattgacttctc

SEQ ID NO: 8247579 - DNA, 22 bp, Homo sapiens
tggtggcagtgagaaggagagg

SEQ ID NO: 8247580 - DNA, 22 bp, Homo sapiens
tggtggcatgatagtgtgaatg

SEQ ID NO: 8247581 - DNA, 22 bp, Homo sapiens
tggtggccaattcacagggctc

SEQ ID NO: 8247582 - DNA, 20 bp, Homo sapiens
tggtggccagtgctgcaggc

SEQ ID NO: 8247583 - DNA, 22 bp, Homo sapiens
tggtggccacgtgggcgcgagc

SEQ ID NO: 8247584 - DNA, 20 bp, Homo sapiens
tggtggccagtgctgcaggc

SEQ ID NO: 8247585 - DNA, 22 bp, Homo sapiens
tggtggcagctgagtgtcaggt

SEQ ID NO: 8247586 - DNA, 22 bp, Homo sapiens
tggtggcagctgagtgtcaggt

SEQ ID NO: 8247587 - DNA, 22 bp, Homo sapiens
tggtggcagctgagtgtcaggt

SEQ ID NO: 8247588 - DNA, 22 bp, Homo sapiens
tggtggcagctgggacagaggt

SEQ ID NO: 8247589 - DNA, 22 bp, Homo sapiens
tggtggcagctgagtgtcaggt

SEQ ID NO: 8247590 - DNA, 22 bp, Homo sapiens
tggtggcagctgagtgtcaggt

SEQ ID NO: 8247591 - DNA, 22 bp, Homo sapiens
tggtggcagtctcctggctgtg

SEQ ID NO: 8247592 - DNA, 22 bp, Homo sapiens
tggtggcagtctcctggctgtg

SEQ ID NO: 8247593 - DNA, 22 bp, Homo sapiens
tggtggcagctgggacagaggt

SEQ ID NO: 8247594 - DNA, 22 bp, Homo sapiens
tggtggcagctgggacagaggt

SEQ ID NO: 8247595 - DNA, 22 bp, Homo sapiens
tggtggcagctgggacagaggt

SEQ ID NO: 8247596 - DNA, 22 bp, Homo sapiens
tggtgcagttcccagggccggg

SEQ ID NO: 8247597 - DNA, 22 bp, Homo sapiens
tggtgcagttcccagggccggg

SEQ ID NO: 8247598 - DNA, 22 bp, Homo sapiens
tggtgcagtccaaagggagcag

SEQ ID NO: 8247599 - DNA, 22 bp, Homo sapiens
tggtgcagttcccagggccggg

SEQ ID NO: 8247600 - DNA, 22 bp, Homo sapiens
tggtgcagttcccagggccggg

SEQ ID NO: 8247601 - DNA, 22 bp, Homo sapiens
tggtgcagtccaaagggagcag

SEQ ID NO: 8247602 - DNA, 22 bp, Homo sapiens
tggtgcagtccaaagggagcag

SEQ ID NO: 8247603 - DNA, 22 bp, Homo sapiens
tggtgcagtccaaagggagcag

SEQ ID NO: 8247604 - DNA, 22 bp, Homo sapiens
tggtgcagtccaaagggagcag

SEQ ID NO: 8247605 - DNA, 22 bp, Homo sapiens
tggtgcagtcattggcccaggg

SEQ ID NO: 8247606 - DNA, 22 bp, Homo sapiens
tggtgcagtcattggcccaggg

SEQ ID NO: 8247607 - DNA, 22 bp, Homo sapiens
tggtgccacttcttaggctggt

SEQ ID NO: 8247608 - DNA, 22 bp, Homo sapiens
tggtgccatcatagctcactgc

SEQ ID NO: 8247609 - DNA, 22 bp, Homo sapiens
tggtgccaccctccttcagctg

SEQ ID NO: 8247610 - DNA, 22 bp, Homo sapiens
tggtgcccactctggacccagc

SEQ ID NO: 8247611 - DNA, 22 bp, Homo sapiens
tggtgcccactccagacaccta

SEQ ID NO: 8247612 - DNA, 22 bp, Homo sapiens
tggtgcccatgtatcccttcac

SEQ ID NO: 8247613 - DNA, 22 bp, Homo sapiens
tggtgcaggccaagctgcgagc

SEQ ID NO: 8247614 - DNA, 22 bp, Homo sapiens
tggtgcaggagttggcagggac

SEQ ID NO: 8247615 - DNA, 22 bp, Homo sapiens
tggtgcaggagttggcagggac

SEQ ID NO: 8247616 - DNA, 22 bp, Homo sapiens
tggtgcagatgcaggtcactgg

SEQ ID NO: 8247617 - DNA, 22 bp, Homo sapiens
tggtgcagatagtggtgtagta

SEQ ID NO: 8247618 - DNA, 22 bp, Homo sapiens
tggtgcaggagttggcagggac

SEQ ID NO: 8247619 - DNA, 22 bp, Homo sapiens
tggtgcaggagttggcagggac

SEQ ID NO: 8247620 - DNA, 22 bp, Homo sapiens
tggtgcagtagagctgtctggg

SEQ ID NO: 8247621 - DNA, 22 bp, Homo sapiens
tggtgcagtcattggcccaggg

SEQ ID NO: 8247622 - DNA, 22 bp, Homo sapiens
tggtgcagtcattggcccaggg

SEQ ID NO: 8247623 - DNA, 22 bp, Homo sapiens
tggtgcagtcattggcccaggg

SEQ ID NO: 8247624 - DNA, 22 bp, Homo sapiens
tggtgcagtagaaggccgactt

SEQ ID NO: 8247625 - DNA, 22 bp, Homo sapiens
tggtgcagtagagctgtctggg

SEQ ID NO: 8247626 - DNA, 22 bp, Homo sapiens
tggtgcaggtgttgatgcagga

SEQ ID NO: 8247627 - DNA, 22 bp, Homo sapiens
tggtgcagtagaaggccgactt

SEQ ID NO: 8247628 - DNA, 22 bp, Homo sapiens
tggtgcagtagaaggccgactt

SEQ ID NO: 8247629 - DNA, 22 bp, Homo sapiens
tggtgcaggtgttgatgcagga

SEQ ID NO: 8247630 - DNA, 22 bp, Homo sapiens
tggtgcctccagctgcttctcc

SEQ ID NO: 8247631 - DNA, 21 bp, Homo sapiens
tggtgccttcagctgtctttt

SEQ ID NO: 8247632 - DNA, 21 bp, Homo sapiens
tggtgccttcagctgtctttt

SEQ ID NO: 8247633 - DNA, 22 bp, Homo sapiens
tggtggacaccgcagccatgaa

SEQ ID NO: 8247634 - DNA, 20 bp, Homo sapiens
tggtggactttggcatggct

SEQ ID NO: 8247635 - DNA, 22 bp, Homo sapiens
tggtggagacctcgctaacccc

SEQ ID NO: 8247636 - DNA, 22 bp, Homo sapiens
tggtggacctggcattgaacct

SEQ ID NO: 8247637 - DNA, 21 bp, Homo sapiens
tggtggaccagtgctgggaga

SEQ ID NO: 8247638 - DNA, 22 bp, Homo sapiens
tggtggagagacagtgtattgg

SEQ ID NO: 8247639 - DNA, 22 bp, Homo sapiens
tggtggagcctaggctaagtct

SEQ ID NO: 8247640 - DNA, 22 bp, Homo sapiens
tggtggagggaactatttccag

SEQ ID NO: 8247641 - DNA, 22 bp, Homo sapiens
tggtggagggaactatttccag

SEQ ID NO: 8247642 - DNA, 19 bp, Homo sapiens
tggtggaggccccatgttc

SEQ ID NO: 8247643 - DNA, 22 bp, Homo sapiens
tggtggagctgtggccacgacc

SEQ ID NO: 8247644 - DNA, 22 bp, Homo sapiens
tggtggagctgtggccacgacc

SEQ ID NO: 8247645 - DNA, 19 bp, Homo sapiens
tggtggaggtgcacctgac

SEQ ID NO: 8247646 - DNA, 19 bp, Homo sapiens
tggtggaggtgcacctgac

SEQ ID NO: 8247647 - DNA, 22 bp, Homo sapiens
tggtggaggtgcatttcggagc

SEQ ID NO: 8247648 - DNA, 19 bp, Homo sapiens
tggtggaggtgcacctgac

SEQ ID NO: 8247649 - DNA, 19 bp, Homo sapiens
tggtggaggtgcacctgac

SEQ ID NO: 8247650 - DNA, 21 bp, Homo sapiens
tggtggagtgtgctgagcatg

SEQ ID NO: 8247651 - DNA, 21 bp, Homo sapiens
tggtggagtgtgctgagcatg

SEQ ID NO: 8247652 - DNA, 21 bp, Homo sapiens
tggtggagtgtgctgagcatg

SEQ ID NO: 8247653 - DNA, 21 bp, Homo sapiens
tggtggagtgtgctgagcatg

SEQ ID NO: 8247654 - DNA, 21 bp, Homo sapiens
tggtggagtgtgctgagcatg

SEQ ID NO: 8247655 - DNA, 22 bp, Homo sapiens
tggtggagtttctctttcaaac

SEQ ID NO: 8247656 - DNA, 22 bp, Homo sapiens
tggtggcaaaagaggcaaagtg

SEQ ID NO: 8247657 - DNA, 22 bp, Homo sapiens
tggtggcaaagtacaaagtgac

SEQ ID NO: 8247658 - DNA, 22 bp, Homo sapiens
tggtggcaaatcaggacacttc

SEQ ID NO: 8247659 - DNA, 22 bp, Homo sapiens
tggtggcaacattgctggagtg

SEQ ID NO: 8247660 - DNA, 22 bp, Homo sapiens
tggtggcaacattgctggagtg

SEQ ID NO: 8247661 - DNA, 22 bp, Homo sapiens
tggtggcaacattgctggagtg

SEQ ID NO: 8247662 - DNA, 22 bp, Homo sapiens
tggtggcaacattgctggagtg

SEQ ID NO: 8247663 - DNA, 22 bp, Homo sapiens
tgctttggatctatttgctgag

SEQ ID NO: 8247664 - DNA, 22 bp, Homo sapiens
tgctttggccactagaattcag

SEQ ID NO: 8247665 - DNA, 22 bp, Homo sapiens
tgctttgggtctctctagtttc

SEQ ID NO: 8247666 - DNA, 21 bp, Homo sapiens
tgctttgggaattctcagtct

SEQ ID NO: 8247667 - DNA, 22 bp, Homo sapiens
tgctttgggtctctctagtttc

SEQ ID NO: 8247668 - DNA, 22 bp, Homo sapiens
tgctttgtgacagattagtttt

SEQ ID NO: 8247669 - DNA, 22 bp, Homo sapiens
tgctttgtgatatgctgtgtct

SEQ ID NO: 8247670 - DNA, 22 bp, Homo sapiens
tgcttttaagaacaatgctgct

SEQ ID NO: 8247671 - DNA, 22 bp, Homo sapiens
tgcttttagctagtaactagta

SEQ ID NO: 8247672 - DNA, 22 bp, Homo sapiens
tgcttttaggagattaaaatta

SEQ ID NO: 8247673 - DNA, 22 bp, Homo sapiens
tgcttttaggagattaaaatta

SEQ ID NO: 8247674 - DNA, 22 bp, Homo sapiens
tgcttttaggagattaaaatta

SEQ ID NO: 8247675 - DNA, 22 bp, Homo sapiens
tggaaaaactgagacttagaca

SEQ ID NO: 8247676 - DNA, 22 bp, Homo sapiens
tggaaaaaacccagactctaga

SEQ ID NO: 8247677 - DNA, 22 bp, Homo sapiens
tgctttttagtactgtcttatt

SEQ ID NO: 8247678 - DNA, 22 bp, Homo sapiens
tgctttttgcaccctttgccgt

SEQ ID NO: 8247679 - DNA, 22 bp, Homo sapiens
tgcttttatttaatatcttgca

SEQ ID NO: 8247680 - DNA, 19 bp, Homo sapiens
tggaaaatggattgaatca

SEQ ID NO: 8247681 - DNA, 22 bp, Homo sapiens
tggaaaatcaggggacattgat

SEQ ID NO: 8247682 - DNA, 19 bp, Homo sapiens
tggaaaatggattgaatca

SEQ ID NO: 8247683 - DNA, 22 bp, Homo sapiens
tggaaaatatttaggtgaatga

SEQ ID NO: 8247684 - DNA, 22 bp, Homo sapiens
tggaaaatatttaggtgaatga

SEQ ID NO: 8247685 - DNA, 21 bp, Homo sapiens
tggaaaacatttaaatagcaa

SEQ ID NO: 8247686 - DNA, 22 bp, Homo sapiens
tggaaaatgtgactattctaaa

SEQ ID NO: 8247687 - DNA, 19 bp, Homo sapiens
tggaaaatggattgaatca

SEQ ID NO: 8247688 - DNA, 22 bp, Homo sapiens
tggaaaattagtagtgaaaggc

SEQ ID NO: 8247689 - DNA, 22 bp, Homo sapiens
tggaaaatgtgactattctaaa

SEQ ID NO: 8247690 - DNA, 22 bp, Homo sapiens
tggaaaattagtagtgaaaggc

SEQ ID NO: 8247691 - DNA, 17 bp, Homo sapiens
tggaaacaaaacttatt

SEQ ID NO: 8247692 - DNA, 21 bp, Homo sapiens
tggaaagattcaaagaccagg

SEQ ID NO: 8247693 - DNA, 22 bp, Homo sapiens
tggaaagaggtagaggatctgg

SEQ ID NO: 8247694 - DNA, 22 bp, Homo sapiens
tggaaacaggagaatatcttct

SEQ ID NO: 8247695 - DNA, 22 bp, Homo sapiens
tggaaacacccacgcatgcata

SEQ ID NO: 8247696 - DNA, 22 bp, Homo sapiens
tggaaacacccacgcatgcata

SEQ ID NO: 8247697 - DNA, 22 bp, Homo sapiens
tggaaacactcaagcttatatt

SEQ ID NO: 8247698 - DNA, 22 bp, Homo sapiens
tggaaacactgcatgttcaccc

SEQ ID NO: 8247699 - DNA, 18 bp, Homo sapiens
tggaaattgaaacagaaa

SEQ ID NO: 8247700 - DNA, 18 bp, Homo sapiens
tggaaattgaaacagaaa

SEQ ID NO: 8247701 - DNA, 22 bp, Homo sapiens
tggaaatgtatttgggcatgcc

SEQ ID NO: 8247702 - DNA, 22 bp, Homo sapiens
tggaaatgtcaaaacctctgat

SEQ ID NO: 8247703 - DNA, 22 bp, Homo sapiens
tggaaatgtttcttgagctcag

SEQ ID NO: 8247704 - DNA, 22 bp, Homo sapiens
tggaaattaacttggtacatat

SEQ ID NO: 8247705 - DNA, 22 bp, Homo sapiens
tggaacaagacagcatagagct

SEQ ID NO: 8247706 - DNA, 22 bp, Homo sapiens
tggaagaaaattcaatcgagtt

SEQ ID NO: 8247707 - DNA, 23 bp, Homo sapiens
tggaagaaaatggtttggctgtg

SEQ ID NO: 8247708 - DNA, 22 bp, Homo sapiens
tggaacctaaaaatgtcattgc

SEQ ID NO: 8247709 - DNA, 22 bp, Homo sapiens
tggaacactttcagtagctatt

SEQ ID NO: 8247710 - DNA, 22 bp, Homo sapiens
tggaaagtgctctagactttct

SEQ ID NO: 8247711 - DNA, 22 bp, Homo sapiens
tggaaaggtaggatttcaagac

SEQ ID NO: 8247712 - DNA, 22 bp, Homo sapiens
tggaaaggtgtaaagcagaacc

SEQ ID NO: 8247713 - DNA, 22 bp, Homo sapiens
tggaaaggtgtaaagcagaacc

SEQ ID NO: 8247714 - DNA, 22 bp, Homo sapiens
tggaaagtctcttttgactgta

SEQ ID NO: 8247715 - DNA, 22 bp, Homo sapiens
tggaaaggacagttgctgatag

SEQ ID NO: 8247716 - DNA, 22 bp, Homo sapiens
tggaaaggacagttgctgatag

SEQ ID NO: 8247717 - DNA, 22 bp, Homo sapiens
tggaaagcagttcttagaatcg

SEQ ID NO: 8247718 - DNA, 22 bp, Homo sapiens
tggaaagggacttatgagttcc

SEQ ID NO: 8247719 - DNA, 22 bp, Homo sapiens
tggaaagggacttatgagttcc

SEQ ID NO: 8247720 - DNA, 22 bp, Homo sapiens
tggaaaggaggcttgtggaata

SEQ ID NO: 8247721 - DNA, 22 bp, Homo sapiens
tggaaaggaggcttgtggaata

SEQ ID NO: 8247722 - DNA, 22 bp, Homo sapiens
tggaaagggacttatgagttcc

SEQ ID NO: 8247723 - DNA, 22 bp, Homo sapiens
tggaaaggaggcttgtggaata

SEQ ID NO: 8247724 - DNA, 22 bp, Homo sapiens
tggaaaggacagttgctgatag

SEQ ID NO: 8247725 - DNA, 22 bp, Homo sapiens
tggaaatggatctgatgagtct

SEQ ID NO: 8247726 - DNA, 21 bp, Homo sapiens
tggaaatggaatactttggat

SEQ ID NO: 8247727 - DNA, 19 bp, Homo sapiens
tggaaatggaagctcagcc

SEQ ID NO: 8247728 - DNA, 19 bp, Homo sapiens
tggaaatggaagctcagcc

SEQ ID NO: 8247729 - DNA, 21 bp, Homo sapiens
tggaaatgagcgttcagcttt

SEQ ID NO: 8247730 - DNA, 22 bp, Homo sapiens
tggaaatgcctggcttcctgaa

SEQ ID NO: 8247731 - DNA, 23 bp, Homo sapiens
tggaaatctgggtgaggacagaa

SEQ ID NO: 8247732 - DNA, 22 bp, Homo sapiens
tggaaatattgggtaatagttg

SEQ ID NO: 8247733 - DNA, 22 bp, Homo sapiens
tggaaatatgctccattctttt

SEQ ID NO: 8247734 - DNA, 22 bp, Homo sapiens
tggaaatattgggtaatagttg

SEQ ID NO: 8247735 - DNA, 22 bp, Homo sapiens
tggaaatagctccagtttcatt

SEQ ID NO: 8247736 - DNA, 22 bp, Homo sapiens
tggaaatagatagtatcattca

SEQ ID NO: 8247737 - DNA, 22 bp, Homo sapiens
tgctttaacgctgagggtctca

SEQ ID NO: 8247738 - DNA, 22 bp, Homo sapiens
tgctttaccttcccagaaacca

SEQ ID NO: 8247739 - DNA, 22 bp, Homo sapiens
tgctttataaccatttctgtgg

SEQ ID NO: 8247740 - DNA, 22 bp, Homo sapiens
tgctttaccttccatttaagga

SEQ ID NO: 8247741 - DNA, 21 bp, Homo sapiens
tgcttgttctctgtccttgca

SEQ ID NO: 8247742 - DNA, 22 bp, Homo sapiens
tgcttgtgagagttttttcaga

SEQ ID NO: 8247743 - DNA, 22 bp, Homo sapiens
tgcttgttcatggcctagtggc

SEQ ID NO: 8247744 - DNA, 22 bp, Homo sapiens
tgctttaaaccatggatgtgag

SEQ ID NO: 8247745 - DNA, 22 bp, Homo sapiens
tgcttgaacaaggataaatttg

SEQ ID NO: 8247746 - DNA, 22 bp, Homo sapiens
tgcttgaaaggggtttcccagt

SEQ ID NO: 8247747 - DNA, 22 bp, Homo sapiens
tgcttgcaagagatgcaatgac

SEQ ID NO: 8247748 - DNA, 22 bp, Homo sapiens
tgcttgctcgccgcctgctgac

SEQ ID NO: 8247749 - DNA, 22 bp, Homo sapiens
tgcttgctccctcacactgtcc

SEQ ID NO: 8247750 - DNA, 22 bp, Homo sapiens
tgcttgctccctcacactgtcc

SEQ ID NO: 8247751 - DNA, 22 bp, Homo sapiens
tgcttgctatgcatcctgaact

SEQ ID NO: 8247752 - DNA, 19 bp, Homo sapiens
tgcttgcctgcctttccca

SEQ ID NO: 8247753 - DNA, 22 bp, Homo sapiens
tgcttgtcttcaggaatgctga

SEQ ID NO: 8247754 - DNA, 21 bp, Homo sapiens
tgcttgtctgcctagaggctt

SEQ ID NO: 8247755 - DNA, 22 bp, Homo sapiens
tgcttgtcttcaggattatggt

SEQ ID NO: 8247756 - DNA, 22 bp, Homo sapiens
tgcttctggagtaacagggtga

SEQ ID NO: 8247757 - DNA, 19 bp, Homo sapiens
tgcttctggaatgcaaggc

SEQ ID NO: 8247758 - DNA, 22 bp, Homo sapiens
tgcttctggggacaggctgcct

SEQ ID NO: 8247759 - DNA, 22 bp, Homo sapiens
tgcttctgggtaggcctcagga

SEQ ID NO: 8247760 - DNA, 22 bp, Homo sapiens
tgcttctgtttgtttctgtcat

SEQ ID NO: 8247761 - DNA, 22 bp, Homo sapiens
tgcttcttactcatatgctgat

SEQ ID NO: 8247762 - DNA, 22 bp, Homo sapiens
tgcttcttactcatatgctgat

SEQ ID NO: 8247763 - DNA, 22 bp, Homo sapiens
tgcttctttactataggcaatt

SEQ ID NO: 8247764 - DNA, 22 bp, Homo sapiens
tgcttcttcctccatgtgttct

SEQ ID NO: 8247765 - DNA, 22 bp, Homo sapiens
tgcttctttatgatgtatgatt

SEQ ID NO: 8247766 - DNA, 22 bp, Homo sapiens
tgcttctgggtcccagcctggc

SEQ ID NO: 8247767 - DNA, 22 bp, Homo sapiens
tgcttctgtctcttatgccttg

SEQ ID NO: 8247768 - DNA, 22 bp, Homo sapiens
tgctttatgttatcagaagggt

SEQ ID NO: 8247769 - DNA, 22 bp, Homo sapiens
tgctttattaagagagaaattt

SEQ ID NO: 8247770 - DNA, 22 bp, Homo sapiens
tgctttattcagggtttacccc

SEQ ID NO: 8247771 - DNA, 22 bp, Homo sapiens
tgctttattcccttctgatgtg

SEQ ID NO: 8247772 - DNA, 22 bp, Homo sapiens
tgctttattcagtctctgccat

SEQ ID NO: 8247773 - DNA, 22 bp, Homo sapiens
tgctttattgcatcagtgtggg

SEQ ID NO: 8247774 - DNA, 22 bp, Homo sapiens
tgctttattcgacatctggtag

SEQ ID NO: 8247775 - DNA, 22 bp, Homo sapiens
tgctttctctctaccccacttt

SEQ ID NO: 8247776 - DNA, 20 bp, Homo sapiens
tgctttgatggaaatacagc

SEQ ID NO: 8247777 - DNA, 22 bp, Homo sapiens
tgctttgaaagataatactgtc

SEQ ID NO: 8247778 - DNA, 20 bp, Homo sapiens
tgctttgatggaaatacagc

SEQ ID NO: 8247779 - DNA, 22 bp, Homo sapiens
tgctttctgctcttgtccacac

SEQ ID NO: 8247780 - DNA, 22 bp, Homo sapiens
tgctttctgtttttcatataat

SEQ ID NO: 8247781 - DNA, 22 bp, Homo sapiens
tgctttctttagctcctgagtc

SEQ ID NO: 8247782 - DNA, 22 bp, Homo sapiens
tgctttctttagctcctgagtc

SEQ ID NO: 8247783 - DNA, 22 bp, Homo sapiens
tgctttataggggattgcaggc

SEQ ID NO: 8247784 - DNA, 22 bp, Homo sapiens
tgctttatatctctcttcttag

SEQ ID NO: 8247785 - DNA, 22 bp, Homo sapiens
tgctttatagacaaggaagtag

SEQ ID NO: 8247786 - DNA, 22 bp, Homo sapiens
tgctttataacttagtttatgg

SEQ ID NO: 8247787 - DNA, 22 bp, Homo sapiens
tgctttatcaaagctatagtga

SEQ ID NO: 8247788 - DNA, 22 bp, Homo sapiens
tgctttatctgtgagaacctga

SEQ ID NO: 8247789 - DNA, 22 bp, Homo sapiens
tgctttatctgacttggcgctg

SEQ ID NO: 8247790 - DNA, 20 bp, Homo sapiens
tgctttatgctatactttgt

SEQ ID NO: 8247791 - DNA, 18 bp, Homo sapiens
tgctttatgcttatataa

SEQ ID NO: 8247792 - DNA, 18 bp, Homo sapiens
tgctttatgcttatataa

SEQ ID NO: 8247793 - DNA, 22 bp, Homo sapiens
tgctttatggatttgtgtcctg

SEQ ID NO: 8247794 - DNA, 22 bp, Homo sapiens
tgctttatggagcccatctcat

SEQ ID NO: 8247795 - DNA, 22 bp, Homo sapiens
tgctttatgttatcagaagggt

SEQ ID NO: 8247796 - DNA, 22 bp, Homo sapiens
tgctttatgtggctgatactca

SEQ ID NO: 8247797 - DNA, 21 bp, Homo sapiens
tgctttatgggaaaaatgtca

SEQ ID NO: 8247798 - DNA, 22 bp, Homo sapiens
tggacagagaggaaggccattt

SEQ ID NO: 8247799 - DNA, 22 bp, Homo sapiens
tggacagagaggaaggccattt

SEQ ID NO: 8247800 - DNA, 22 bp, Homo sapiens
tggacagcaaacatggagagaa

SEQ ID NO: 8247801 - DNA, 22 bp, Homo sapiens
tggacagagctgacagtatata

SEQ ID NO: 8247802 - DNA, 22 bp, Homo sapiens
tggacactggggcaggcgggag

SEQ ID NO: 8247803 - DNA, 22 bp, Homo sapiens
tggacactggggcaggcgggag

SEQ ID NO: 8247804 - DNA, 23 bp, Homo sapiens
tggacactgtgcggggactaggt

SEQ ID NO: 8247805 - DNA, 18 bp, Homo sapiens
tggacacatggcctgggt

SEQ ID NO: 8247806 - DNA, 18 bp, Homo sapiens
tggacacatggcctgggt

SEQ ID NO: 8247807 - DNA, 18 bp, Homo sapiens
tggacacatggcctgggt

SEQ ID NO: 8247808 - DNA, 22 bp, Homo sapiens
tggacacaatgttgccttaggg

SEQ ID NO: 8247809 - DNA, 22 bp, Homo sapiens
tggacaacatagtgagacctca

SEQ ID NO: 8247810 - DNA, 22 bp, Homo sapiens
tggacacacatgtatgtcagag

SEQ ID NO: 8247811 - DNA, 22 bp, Homo sapiens
tggacaggatagtgcagtacgc

SEQ ID NO: 8247812 - DNA, 22 bp, Homo sapiens
tggacaggatagtgcagtacgc

SEQ ID NO: 8247813 - DNA, 22 bp, Homo sapiens
tggacaggatctgagactgaga

SEQ ID NO: 8247814 - DNA, 22 bp, Homo sapiens
tggacaggatctgagactgaga

SEQ ID NO: 8247815 - DNA, 22 bp, Homo sapiens
tggacaggcaagcaagacatac

SEQ ID NO: 8247816 - DNA, 22 bp, Homo sapiens
tggacaggatctgagactgaga

SEQ ID NO: 8247817 - DNA, 23 bp, Homo sapiens
tggacaggacccccttcggaccc

SEQ ID NO: 8247818 - DNA, 22 bp, Homo sapiens
tggacaggatagtgcagtacgc

SEQ ID NO: 8247819 - DNA, 22 bp, Homo sapiens
tggacagcgaaagtgcctggga

SEQ ID NO: 8247820 - DNA, 22 bp, Homo sapiens
tggacagcgaaagtgcctggga

SEQ ID NO: 8247821 - DNA, 22 bp, Homo sapiens
tggacagccatgcaaatgagct

SEQ ID NO: 8247822 - DNA, 22 bp, Homo sapiens
tggacagcaaacatggagagaa

SEQ ID NO: 8247823 - DNA, 22 bp, Homo sapiens
tggaattatctgaagtgatttg

SEQ ID NO: 8247824 - DNA, 22 bp, Homo sapiens
tggaattaataggggatataca

SEQ ID NO: 8247825 - DNA, 22 bp, Homo sapiens
tggaatgttttcctaaatcaga

SEQ ID NO: 8247826 - DNA, 22 bp, Homo sapiens
tggacaacatagtgagacctca

SEQ ID NO: 8247827 - DNA, 22 bp, Homo sapiens
tggaatgttgggatttaagtgt

SEQ ID NO: 8247828 - DNA, 22 bp, Homo sapiens
tggaatgttgtgtataggtcag

SEQ ID NO: 8247829 - DNA, 22 bp, Homo sapiens
tggaatgtttccccagcctgca

SEQ ID NO: 8247830 - DNA, 23 bp, Homo sapiens
tggaatgtttcttgtactgaatg

SEQ ID NO: 8247831 - DNA, 22 bp, Homo sapiens
tggaatgtttgacttattcagt

SEQ ID NO: 8247832 - DNA, 19 bp, Homo sapiens
tggaatgttccaaggaggc

SEQ ID NO: 8247833 - DNA, 22 bp, Homo sapiens
tggaatgttatgatgatggtaa

SEQ ID NO: 8247834 - DNA, 22 bp, Homo sapiens
tggaatggaaacaaactgagga

SEQ ID NO: 8247835 - DNA, 22 bp, Homo sapiens
tggaatgttgataaacataggc

SEQ ID NO: 8247836 - DNA, 22 bp, Homo sapiens
tggaatgttgctctgccttgcg

SEQ ID NO: 8247837 - DNA, 22 bp, Homo sapiens
tggaatgttgcataagatctga

SEQ ID NO: 8247838 - DNA, 23 bp, Homo sapiens
tggaatgagctgggaagctgagc

SEQ ID NO: 8247839 - DNA, 22 bp, Homo sapiens
tggaatgagctggctaataacc

SEQ ID NO: 8247840 - DNA, 22 bp, Homo sapiens
tggaatgagtggctaagattca

SEQ ID NO: 8247841 - DNA, 22 bp, Homo sapiens
tggaatgatgactaggaattgt

SEQ ID NO: 8247842 - DNA, 22 bp, Homo sapiens
tggaatgcagtgggagcttacc

SEQ ID NO: 8247843 - DNA, 22 bp, Homo sapiens
tggaatgcatggctctgtgacg

SEQ ID NO: 8247844 - DNA, 22 bp, Homo sapiens
tggaatgcagtgggagcttacc

SEQ ID NO: 8247845 - DNA, 22 bp, Homo sapiens
tggaatggaaacaaactgagga

SEQ ID NO: 8247846 - DNA, 22 bp, Homo sapiens
tggaatggaaacaaactgagga

SEQ ID NO: 8247847 - DNA, 22 bp, Homo sapiens
tggaccccagacaagccagggt

SEQ ID NO: 8247848 - DNA, 22 bp, Homo sapiens
tggaccccctcaaggcagagct

SEQ ID NO: 8247849 - DNA, 23 bp, Homo sapiens
tggacctgaaccagtgcctctgt

SEQ ID NO: 8247850 - DNA, 22 bp, Homo sapiens
tggacctgaagaataggaagta

SEQ ID NO: 8247851 - DNA, 22 bp, Homo sapiens
tggacctgagcctggccctgcc

SEQ ID NO: 8247852 - DNA, 22 bp, Homo sapiens
tggacctggggtggcctcctct

SEQ ID NO: 8247853 - DNA, 22 bp, Homo sapiens
tggacctgctggatgggcaggt

SEQ ID NO: 8247854 - DNA, 22 bp, Homo sapiens
tggacctgagcctggccctgcc

SEQ ID NO: 8247855 - DNA, 22 bp, Homo sapiens
tggacctgctggatgggcaggt

SEQ ID NO: 8247856 - DNA, 22 bp, Homo sapiens
tggacctgctggatgggcaggt

SEQ ID NO: 8247857 - DNA, 22 bp, Homo sapiens
tggactcaccttgagttagcca

SEQ ID NO: 8247858 - DNA, 22 bp, Homo sapiens
tggacctggggtggcctcctct

SEQ ID NO: 8247859 - DNA, 19 bp, Homo sapiens
tggacctgtgcccatggct

SEQ ID NO: 8247860 - DNA, 22 bp, Homo sapiens
tggactgagcttgagagggttg

SEQ ID NO: 8247861 - DNA, 21 bp, Homo sapiens
tggacttatggagtgtttctt

SEQ ID NO: 8247862 - DNA, 22 bp, Homo sapiens
tggactgggctaatggcagaca

SEQ ID NO: 8247863 - DNA, 21 bp, Homo sapiens
tggactgcgctgctatgcagt

SEQ ID NO: 8247864 - DNA, 22 bp, Homo sapiens
tggacattccacccatatcaga

SEQ ID NO: 8247865 - DNA, 21 bp, Homo sapiens
tggacatttacccttcaggga

SEQ ID NO: 8247866 - DNA, 22 bp, Homo sapiens
tggacaggtgcacacagcagcc

SEQ ID NO: 8247867 - DNA, 22 bp, Homo sapiens
tggacaggtgagtgactcaggg

SEQ ID NO: 8247868 - DNA, 21 bp, Homo sapiens
tggaccaggaaggtggtggtg

SEQ ID NO: 8247869 - DNA, 21 bp, Homo sapiens
tggaccaggaaggtggtggtg

SEQ ID NO: 8247870 - DNA, 20 bp, Homo sapiens
tggacaggggcataggttgc

SEQ ID NO: 8247871 - DNA, 22 bp, Homo sapiens
tggacagggcagagaccgagtc

SEQ ID NO: 8247872 - DNA, 22 bp, Homo sapiens
tggacaggctcctaggggttcc

SEQ ID NO: 8247873 - DNA, 22 bp, Homo sapiens
tggacaggctcctaggggttcc

SEQ ID NO: 8247874 - DNA, 22 bp, Homo sapiens
tggacaggggctgctgttgtca

SEQ ID NO: 8247875 - DNA, 23 bp, Homo sapiens
tggacagggtaactggtggtttt

SEQ ID NO: 8247876 - DNA, 23 bp, Homo sapiens
tggacagggtaactggtggtttt

SEQ ID NO: 8247877 - DNA, 23 bp, Homo sapiens
tggacagggtaactggtggtttt

SEQ ID NO: 8247878 - DNA, 18 bp, Homo sapiens
tggacagggtggagaaaa

SEQ ID NO: 8247879 - DNA, 18 bp, Homo sapiens
tggacagggtggagaaaa

SEQ ID NO: 8247880 - DNA, 18 bp, Homo sapiens
tggacagggtggagaaaa

SEQ ID NO: 8247881 - DNA, 22 bp, Homo sapiens
tggaagggggaagacagctctg

SEQ ID NO: 8247882 - DNA, 22 bp, Homo sapiens
tggaaggggccaggcgcggagt

SEQ ID NO: 8247883 - DNA, 22 bp, Homo sapiens
tggaaggggagctggaaagggg

SEQ ID NO: 8247884 - DNA, 22 bp, Homo sapiens
tggaaggggccaggcgcggagt

SEQ ID NO: 8247885 - DNA, 22 bp, Homo sapiens
tggaaggggttacgcagcagga

SEQ ID NO: 8247886 - DNA, 22 bp, Homo sapiens
tggaagggggaagacagctctg

SEQ ID NO: 8247887 - DNA, 22 bp, Homo sapiens
tggaaggggttacgcagcagga

SEQ ID NO: 8247888 - DNA, 22 bp, Homo sapiens
tggaaggggttacgcagcagga

SEQ ID NO: 8247889 - DNA, 22 bp, Homo sapiens
tggaaggtgtggcaggtctagt

SEQ ID NO: 8247890 - DNA, 22 bp, Homo sapiens
tggaaggtgtggcaggtctagt

SEQ ID NO: 8247891 - DNA, 20 bp, Homo sapiens
tggaaggtcccagaggaatt

SEQ ID NO: 8247892 - DNA, 22 bp, Homo sapiens
tggaaggcaacggagtgagctg

SEQ ID NO: 8247893 - DNA, 22 bp, Homo sapiens
tggaaggggagctggaaagggg

SEQ ID NO: 8247894 - DNA, 22 bp, Homo sapiens
tggaaggggagctggaaagggg

SEQ ID NO: 8247895 - DNA, 22 bp, Homo sapiens
tggaaggggagctggaaagggg

SEQ ID NO: 8247896 - DNA, 22 bp, Homo sapiens
tggaaggggagctggaaagggg

SEQ ID NO: 8247897 - DNA, 22 bp, Homo sapiens
tggaaggggagctggaaagggg

SEQ ID NO: 8247898 - DNA, 22 bp, Homo sapiens
tggaaggagactgggaagtgtg

SEQ ID NO: 8247899 - DNA, 22 bp, Homo sapiens
tggaaggagctaaggacctggg

SEQ ID NO: 8247900 - DNA, 22 bp, Homo sapiens
tggaaggagctaaggacctggg

SEQ ID NO: 8247901 - DNA, 22 bp, Homo sapiens
tggaatctgtgctgttttagtg

SEQ ID NO: 8247902 - DNA, 22 bp, Homo sapiens
tggaatctgtatgtatgtataa

SEQ ID NO: 8247903 - DNA, 23 bp, Homo sapiens
tggaatcttcgatattgattcag

SEQ ID NO: 8247904 - DNA, 23 bp, Homo sapiens
tggaataataaggtacattaaca

SEQ ID NO: 8247905 - DNA, 20 bp, Homo sapiens
tggaataagttaagttgttt

SEQ ID NO: 8247906 - DNA, 23 bp, Homo sapiens
tggaataataaggtacattaaca

SEQ ID NO: 8247907 - DNA, 22 bp, Homo sapiens
tggaataatgaccacagaaaca

SEQ ID NO: 8247908 - DNA, 22 bp, Homo sapiens
tggaatagaggtgctgatatta

SEQ ID NO: 8247909 - DNA, 22 bp, Homo sapiens
tggaatcacctgttggtttgca

SEQ ID NO: 8247910 - DNA, 22 bp, Homo sapiens
tggaagtgctcttctgaccaac

SEQ ID NO: 8247911 - DNA, 22 bp, Homo sapiens
tggaagtgctaaactggagtgt

SEQ ID NO: 8247912 - DNA, 22 bp, Homo sapiens
tggaagtggcagaaaatgaaca

SEQ ID NO: 8247913 - DNA, 22 bp, Homo sapiens
tggaagtggcagaaaatgaaca

SEQ ID NO: 8247914 - DNA, 22 bp, Homo sapiens
tggaagtccctgtgtgtggcct

SEQ ID NO: 8247915 - DNA, 21 bp, Homo sapiens
tggaagtcttgagtagggggc

SEQ ID NO: 8247916 - DNA, 22 bp, Homo sapiens
tggaagtccctgtgtgtggcct

SEQ ID NO: 8247917 - DNA, 21 bp, Homo sapiens
tggaagtcttgagtagggggc

SEQ ID NO: 8247918 - DNA, 22 bp, Homo sapiens
tggaagtgatgctgaggtgacg

SEQ ID NO: 8247919 - DNA, 22 bp, Homo sapiens
tggaagtgccttgctggctgtg

SEQ ID NO: 8247920 - DNA, 22 bp, Homo sapiens
tggaataactcaccaaggtcat

SEQ ID NO: 8247921 - DNA, 22 bp, Homo sapiens
tggaataactcaccaaggtcat

SEQ ID NO: 8247922 - DNA, 22 bp, Homo sapiens
tggaataaaatgtcagttctta

SEQ ID NO: 8247923 - DNA, 22 bp, Homo sapiens
tggaagttgaatctcagtcatg

SEQ ID NO: 8247924 - DNA, 22 bp, Homo sapiens
tggaagtgtcctcttctgagtc

SEQ ID NO: 8247925 - DNA, 22 bp, Homo sapiens
tggaagtgtctacatgtggagt

SEQ ID NO: 8247926 - DNA, 22 bp, Homo sapiens
tggaaggaagccaaggaaggtt

SEQ ID NO: 8247927 - DNA, 22 bp, Homo sapiens
tggaaggaagccaaggaaggtt

SEQ ID NO: 8247928 - DNA, 22 bp, Homo sapiens
tggaagcttttgagattgttgc

SEQ ID NO: 8247929 - DNA, 22 bp, Homo sapiens
tggaagcttctgaccatttttg

SEQ ID NO: 8247930 - DNA, 22 bp, Homo sapiens
tggaaggaaaggtagcagagaa

SEQ ID NO: 8247931 - DNA, 22 bp, Homo sapiens
tggaagcttcctgttcttgagg

SEQ ID NO: 8247932 - DNA, 17 bp, Homo sapiens
tggaagcttcatgttgg

SEQ ID NO: 8247933 - DNA, 17 bp, Homo sapiens
tggaagcttcatgttgg

SEQ ID NO: 8247934 - DNA, 22 bp, Homo sapiens
tggaagctcaaggcagggtgag

SEQ ID NO: 8247935 - DNA, 17 bp, Homo sapiens
tggaagcttcatgttgg

SEQ ID NO: 8247936 - DNA, 18 bp, Homo sapiens
tggaagctggcagatttt

SEQ ID NO: 8247937 - DNA, 22 bp, Homo sapiens
tggaagctagagcttagtctcg

SEQ ID NO: 8247938 - DNA, 22 bp, Homo sapiens
tggaagcctcagtttgccttct

SEQ ID NO: 8247939 - DNA, 22 bp, Homo sapiens
tggaagcggtgctggcccatgg

SEQ ID NO: 8247940 - DNA, 22 bp, Homo sapiens
tggaagcgagacagagatctcc

SEQ ID NO: 8247941 - DNA, 22 bp, Homo sapiens
tggaagcggacgttgtggggtg

SEQ ID NO: 8247942 - DNA, 22 bp, Homo sapiens
tggaagcagtcacttcctagtt

SEQ ID NO: 8247943 - DNA, 22 bp, Homo sapiens
tggaagcccagaaggaagcaga

SEQ ID NO: 8247944 - DNA, 22 bp, Homo sapiens
tggaagccaggcccgctcctaa

SEQ ID NO: 8247945 - DNA, 22 bp, Homo sapiens
tggaagccagctgggcacctgc

SEQ ID NO: 8247946 - DNA, 22 bp, Homo sapiens
tggaagccaaggtcagaaggag

SEQ ID NO: 8247947 - DNA, 22 bp, Homo sapiens
tggaagcatagcagcgtgtgtg

SEQ ID NO: 8247948 - DNA, 22 bp, Homo sapiens
tggaagcatagcagcgtgtgtg

SEQ ID NO: 8247949 - DNA, 22 bp, Homo sapiens
tggaagaggtggaagtggcttc

SEQ ID NO: 8247950 - DNA, 22 bp, Homo sapiens
tggaagataagagattgggaag

SEQ ID NO: 8247951 - DNA, 22 bp, Homo sapiens
tggaagagggagctgggtggcc

SEQ ID NO: 8247952 - DNA, 22 bp, Homo sapiens
tggaagagggagctgggtggcc

SEQ ID NO: 8247953 - DNA, 22 bp, Homo sapiens
tggaagagggagctgggtggcc

SEQ ID NO: 8247954 - DNA, 22 bp, Homo sapiens
tggaagaggtggaagtggcttc

SEQ ID NO: 8247955 - DNA, 22 bp, Homo sapiens
tggaagaggtggaagtggcttc

SEQ ID NO: 8247956 - DNA, 19 bp, Homo sapiens
tggaagaggaagggaaata

SEQ ID NO: 8247957 - DNA, 20 bp, Homo sapiens
tggaagaggagatgcctctg

SEQ ID NO: 8247958 - DNA, 20 bp, Homo sapiens
tggaagaggagatgcctctg

SEQ ID NO: 8247959 - DNA, 22 bp, Homo sapiens
tggaagaggccagaaagtggga

SEQ ID NO: 8247960 - DNA, 22 bp, Homo sapiens
tggaagaggccagaaagtggga

SEQ ID NO: 8247961 - DNA, 22 bp, Homo sapiens
tggaagaggcccatgactgcct

SEQ ID NO: 8247962 - DNA, 22 bp, Homo sapiens
tggaagaggcccatgactgcct

SEQ ID NO: 8247963 - DNA, 22 bp, Homo sapiens
tggaagagaaaggagtggatct

SEQ ID NO: 8247964 - DNA, 22 bp, Homo sapiens
tggaagagaaaggagtggatct

SEQ ID NO: 8247965 - DNA, 22 bp, Homo sapiens
tggaagagacacttacattcag

SEQ ID NO: 8247966 - DNA, 22 bp, Homo sapiens
tggaagagcaggcagacaatgc

SEQ ID NO: 8247967 - DNA, 19 bp, Homo sapiens
tggaagaggaagggaaata

SEQ ID NO: 8247968 - DNA, 22 bp, Homo sapiens
tggaagagcaggcagacaatgc

SEQ ID NO: 8247969 - DNA, 22 bp, Homo sapiens
tggaagaccagacttcccgaac

SEQ ID NO: 8247970 - DNA, 22 bp, Homo sapiens
tggaagactatcccgtgatttt

SEQ ID NO: 8247971 - DNA, 22 bp, Homo sapiens
tggaagacggaaatctgtagat

SEQ ID NO: 8247972 - DNA, 22 bp, Homo sapiens
tggaagagaaaatccaccctta

SEQ ID NO: 8247973 - DNA, 22 bp, Homo sapiens
tggaagactcaaggtggtgaat

SEQ ID NO: 8247974 - DNA, 23 bp, Homo sapiens
tggaagactcctctcttggctgc

SEQ ID NO: 8247975 - DNA, 22 bp, Homo sapiens
tggaagacattattttgtttgt

SEQ ID NO: 8247976 - DNA, 22 bp, Homo sapiens
tggaagacattattttgtttgt

SEQ ID NO: 8247977 - DNA, 22 bp, Homo sapiens
tggaagacattgctttcctttg

SEQ ID NO: 8247978 - DNA, 22 bp, Homo sapiens
tggaagacattgctttcctttg

SEQ ID NO: 8247979 - DNA, 22 bp, Homo sapiens
tggaagacattgctttcctttg

SEQ ID NO: 8247980 - DNA, 22 bp, Homo sapiens
tggaagaccagacttcccgaac

SEQ ID NO: 8247981 - DNA, 22 bp, Homo sapiens
tggaagaccacaagcccttaac

SEQ ID NO: 8247982 - DNA, 22 bp, Homo sapiens
tggaagacattttggaccttgg

SEQ ID NO: 8247983 - DNA, 22 bp, Homo sapiens
tggagagctggttcaaagcaga

SEQ ID NO: 8247984 - DNA, 22 bp, Homo sapiens
tggagagcgtgcttagcactct

SEQ ID NO: 8247985 - DNA, 22 bp, Homo sapiens
tggagagcgtgcttagcactct

SEQ ID NO: 8247986 - DNA, 22 bp, Homo sapiens
tggagagctatttggacctcca

SEQ ID NO: 8247987 - DNA, 22 bp, Homo sapiens
tggagagcgtgcttagcactct

SEQ ID NO: 8247988 - DNA, 22 bp, Homo sapiens
tggagagcctggagtccctgat

SEQ ID NO: 8247989 - DNA, 22 bp, Homo sapiens
tggagagcgcgacgggaggaag

SEQ ID NO: 8247990 - DNA, 22 bp, Homo sapiens
tggagaggaaagtgcagttttg

SEQ ID NO: 8247991 - DNA, 22 bp, Homo sapiens
tggagaggaaagtgcagttttg

SEQ ID NO: 8247992 - DNA, 22 bp, Homo sapiens
tggagaggaaagtgcagttttg

SEQ ID NO: 8247993 - DNA, 19 bp, Homo sapiens
tggagaggaaatgctgctc

SEQ ID NO: 8247994 - DNA, 22 bp, Homo sapiens
tggagaggaaagtgcagttttg

SEQ ID NO: 8247995 - DNA, 22 bp, Homo sapiens
tggagaggaaagtgcagttttg

SEQ ID NO: 8247996 - DNA, 19 bp, Homo sapiens
tggagaggaaatgctgctc

SEQ ID NO: 8247997 - DNA, 19 bp, Homo sapiens
tggagaggaaatgctgctc

SEQ ID NO: 8247998 - DNA, 22 bp, Homo sapiens
tggagagcaatgaggggcaggc

SEQ ID NO: 8247999 - DNA, 22 bp, Homo sapiens
tggagagcaatgaggggcaggc

SEQ ID NO: 8248000 - DNA, 18 bp, Homo sapiens
tggagagcagcagtgggg

SEQ ID NO: 8248001 - DNA, 22 bp, Homo sapiens
tggagagcaagtcgcagacatg

SEQ ID NO: 8248002 - DNA, 22 bp, Homo sapiens
tggagagcaagtcgcagacatg

SEQ ID NO: 8248003 - DNA, 22 bp, Homo sapiens
tggagagcaagtcgcagacatg

SEQ ID NO: 8248004 - DNA, 22 bp, Homo sapiens
tggagagcaagtcgcagacatg

SEQ ID NO: 8248005 - DNA, 22 bp, Homo sapiens
tggagagatgtctgttcaaggt

SEQ ID NO: 8248006 - DNA, 22 bp, Homo sapiens
tggagagatgtctgttcaaggt

SEQ ID NO: 8248007 - DNA, 22 bp, Homo sapiens
tggagagcaggggatgcgggcg

SEQ ID NO: 8248008 - DNA, 20 bp, Homo sapiens
tggagagcctctggactgtg

SEQ ID NO: 8248009 - DNA, 20 bp, Homo sapiens
tggagagcctctggactgtg

SEQ ID NO: 8248010 - DNA, 20 bp, Homo sapiens
tggagagcctctggactgtg

SEQ ID NO: 8248011 - DNA, 22 bp, Homo sapiens
tggagagcagggctggagttca

SEQ ID NO: 8248012 - DNA, 22 bp, Homo sapiens
tggagagcagggctggagttca

SEQ ID NO: 8248013 - DNA, 22 bp, Homo sapiens
tggagagcaggggatgcgggcg

SEQ ID NO: 8248014 - DNA, 22 bp, Homo sapiens
tggagagcaggggatgcgggcg

SEQ ID NO: 8248015 - DNA, 18 bp, Homo sapiens
tggagagcagcagtgggg

SEQ ID NO: 8248016 - DNA, 18 bp, Homo sapiens
tggagagcagcagtgggg

SEQ ID NO: 8248017 - DNA, 22 bp, Homo sapiens
tggagagcagggctggagttca

SEQ ID NO: 8248018 - DNA, 18 bp, Homo sapiens
tggagagcagcagtgggg

SEQ ID NO: 8248019 - DNA, 22 bp, Homo sapiens
tggagaagtcaaagtgaacagg

SEQ ID NO: 8248020 - DNA, 22 bp, Homo sapiens
tggagaagtcaaagtgaacagg

SEQ ID NO: 8248021 - DNA, 22 bp, Homo sapiens
tggagaagtcaaagtgaacagg

SEQ ID NO: 8248022 - DNA, 22 bp, Homo sapiens
tggagaagtcaaagtgaacagg

SEQ ID NO: 8248023 - DNA, 22 bp, Homo sapiens
tggagagaaaaaagacagttct

SEQ ID NO: 8248024 - DNA, 22 bp, Homo sapiens
tggagagaaagttgaatggagg

SEQ ID NO: 8248025 - DNA, 22 bp, Homo sapiens
tggagagaaagttgaatggagg

SEQ ID NO: 8248026 - DNA, 22 bp, Homo sapiens
tggagagagtcgggatagtaca

SEQ ID NO: 8248027 - DNA, 22 bp, Homo sapiens
tggagagagtcgggatagtaca

SEQ ID NO: 8248028 - DNA, 22 bp, Homo sapiens
tggagagaagaggcagtgtgct

SEQ ID NO: 8248029 - DNA, 22 bp, Homo sapiens
tggagagaacagtgtctgaaag

SEQ ID NO: 8248030 - DNA, 22 bp, Homo sapiens
tggagagaacagtgtctgaaag

SEQ ID NO: 8248031 - DNA, 22 bp, Homo sapiens
tggagagaacagtgtctgaaag

SEQ ID NO: 8248032 - DNA, 22 bp, Homo sapiens
tggagagaagaggcagtgtgct

SEQ ID NO: 8248033 - DNA, 22 bp, Homo sapiens
tggagagaagaggcagtgtgct

SEQ ID NO: 8248034 - DNA, 22 bp, Homo sapiens
tggagaaggacagcctgagaaa

SEQ ID NO: 8248035 - DNA, 22 bp, Homo sapiens
tggagaaggacagcctgagaaa

SEQ ID NO: 8248036 - DNA, 22 bp, Homo sapiens
tggagaaggacagcctgagaaa

SEQ ID NO: 8248037 - DNA, 22 bp, Homo sapiens
tggagaaggccggccaggagtg

SEQ ID NO: 8248038 - DNA, 22 bp, Homo sapiens
tggagaaggccggccaggagtg

SEQ ID NO: 8248039 - DNA, 22 bp, Homo sapiens
tggagaaggccggccaggagtg

SEQ ID NO: 8248040 - DNA, 22 bp, Homo sapiens
tggagaaggggcagggtctcca

SEQ ID NO: 8248041 - DNA, 22 bp, Homo sapiens
tggagaagattggtcaccattc

SEQ ID NO: 8248042 - DNA, 22 bp, Homo sapiens
tggagaagctgtaggtggactc

SEQ ID NO: 8248043 - DNA, 22 bp, Homo sapiens
tggagaagctgtaggtggactc

SEQ ID NO: 8248044 - DNA, 22 bp, Homo sapiens
tggagaaagctgcatatggaaa

SEQ ID NO: 8248045 - DNA, 22 bp, Homo sapiens
tggagcagcatcactttgagct

SEQ ID NO: 8248046 - DNA, 22 bp, Homo sapiens
tggagcagcatcactttgagct

SEQ ID NO: 8248047 - DNA, 22 bp, Homo sapiens
tggagcagcacaagaaagggga

SEQ ID NO: 8248048 - DNA, 22 bp, Homo sapiens
tggagcagcattcatccagcag

SEQ ID NO: 8248049 - DNA, 22 bp, Homo sapiens
tggagcagcatcactttgagct

SEQ ID NO: 8248050 - DNA, 22 bp, Homo sapiens
tggagcagccatgatgacagag

SEQ ID NO: 8248051 - DNA, 22 bp, Homo sapiens
tggagcagcattcatccagcag

SEQ ID NO: 8248052 - DNA, 22 bp, Homo sapiens
tggagcagcattcatccagcag

SEQ ID NO: 8248053 - DNA, 22 bp, Homo sapiens
tggagcagctaagcctctgaga

SEQ ID NO: 8248054 - DNA, 22 bp, Homo sapiens
tggagcagccttttctaagcaa

SEQ ID NO: 8248055 - DNA, 22 bp, Homo sapiens
tggagcagccttttctaagcaa

SEQ ID NO: 8248056 - DNA, 22 bp, Homo sapiens
tggagcagcattcatccagcag

SEQ ID NO: 8248057 - DNA, 22 bp, Homo sapiens
tggagcagccatgatgacagag

SEQ ID NO: 8248058 - DNA, 22 bp, Homo sapiens
tggagcagccatgatgacagag

SEQ ID NO: 8248059 - DNA, 22 bp, Homo sapiens
tggagcagccatgatgacagag

SEQ ID NO: 8248060 - DNA, 22 bp, Homo sapiens
tggagcagccatgatgacagag

SEQ ID NO: 8248061 - DNA, 22 bp, Homo sapiens
tggagcagcacaagaaagggga

SEQ ID NO: 8248062 - DNA, 22 bp, Homo sapiens
tggagcagagttcagcggggag

SEQ ID NO: 8248063 - DNA, 22 bp, Homo sapiens
tggagcagagttcagcggggag

SEQ ID NO: 8248064 - DNA, 22 bp, Homo sapiens
tggagcagcacaagaaagggga

SEQ ID NO: 8248065 - DNA, 22 bp, Homo sapiens
tggagcagcacaagaaagggga

SEQ ID NO: 8248066 - DNA, 22 bp, Homo sapiens
tggagcagagttcagcggggag

SEQ ID NO: 8248067 - DNA, 22 bp, Homo sapiens
tggagcagagttcagcggggag

SEQ ID NO: 8248068 - DNA, 22 bp, Homo sapiens
tggagcagaggctgaggttggg

SEQ ID NO: 8248069 - DNA, 22 bp, Homo sapiens
tggagcagagttcagcggggag

SEQ ID NO: 8248070 - DNA, 22 bp, Homo sapiens
tggagcagaggctgaggttggg

SEQ ID NO: 8248071 - DNA, 22 bp, Homo sapiens
tggagcagaggctgaggttggg

SEQ ID NO: 8248072 - DNA, 22 bp, Homo sapiens
tggagcagaggaagaaggcttt

SEQ ID NO: 8248073 - DNA, 22 bp, Homo sapiens
tggagcagaggctgaggttggg

SEQ ID NO: 8248074 - DNA, 22 bp, Homo sapiens
tggagcagagatggtggccttc

SEQ ID NO: 8248075 - DNA, 22 bp, Homo sapiens
tggagcagagatggtggccttc

SEQ ID NO: 8248076 - DNA, 22 bp, Homo sapiens
tggagcagaggaagaaggcttt

SEQ ID NO: 8248077 - DNA, 22 bp, Homo sapiens
tggagcagagatggtggccttc

SEQ ID NO: 8248078 - DNA, 22 bp, Homo sapiens
tggagaggttgaataacttgtc

SEQ ID NO: 8248079 - DNA, 22 bp, Homo sapiens
tggagaggttgaataacttgtc

SEQ ID NO: 8248080 - DNA, 22 bp, Homo sapiens
tggagaggtttaaacaaaagtt

SEQ ID NO: 8248081 - DNA, 22 bp, Homo sapiens
tggagaggtttaaacaaaagtt

SEQ ID NO: 8248082 - DNA, 22 bp, Homo sapiens
tggagagtaatttctgaagacc

SEQ ID NO: 8248083 - DNA, 22 bp, Homo sapiens
tggagagtctcaaggcaggaaa

SEQ ID NO: 8248084 - DNA, 22 bp, Homo sapiens
tggagagtctcaaggcaggaaa

SEQ ID NO: 8248085 - DNA, 22 bp, Homo sapiens
tggagagtaaatggcagaatca

SEQ ID NO: 8248086 - DNA, 22 bp, Homo sapiens
tggagagtaaatggcagaatca

SEQ ID NO: 8248087 - DNA, 19 bp, Homo sapiens
tggagaggaaatgctgctc

SEQ ID NO: 8248088 - DNA, 19 bp, Homo sapiens
tggagaggaaatgctgctc

SEQ ID NO: 8248089 - DNA, 19 bp, Homo sapiens
tggagaggaaatgctgctc

SEQ ID NO: 8248090 - DNA, 22 bp, Homo sapiens
tggagaggagcaccatggccat

SEQ ID NO: 8248091 - DNA, 22 bp, Homo sapiens
tggagaggagcaccatggccat

SEQ ID NO: 8248092 - DNA, 22 bp, Homo sapiens
tggagagtctctgagccagggc

SEQ ID NO: 8248093 - DNA, 22 bp, Homo sapiens
tggagagtctctgagccagggc

SEQ ID NO: 8248094 - DNA, 22 bp, Homo sapiens
tggagagttctgtagatatcta

SEQ ID NO: 8248095 - DNA, 22 bp, Homo sapiens
tggagagtgtagacttcagagt

SEQ ID NO: 8248096 - DNA, 22 bp, Homo sapiens
tggagagtggatatgggagcaa

SEQ ID NO: 8248097 - DNA, 22 bp, Homo sapiens
tggagcagagatgggagcccaa

SEQ ID NO: 8248098 - DNA, 22 bp, Homo sapiens
tggagcagagatgggagcccaa

SEQ ID NO: 8248099 - DNA, 22 bp, Homo sapiens
tggagcagagatgggagcccaa

SEQ ID NO: 8248100 - DNA, 22 bp, Homo sapiens
tggagcagagatggtggccttc

SEQ ID NO: 8248101 - DNA, 22 bp, Homo sapiens
tggagcagaaatttgaagccat

SEQ ID NO: 8248102 - DNA, 22 bp, Homo sapiens
tggagcagaaatttgaagccat

SEQ ID NO: 8248103 - DNA, 22 bp, Homo sapiens
tggagcagaaatggcctcttgt

SEQ ID NO: 8248104 - DNA, 22 bp, Homo sapiens
tggagcagaaatggcctcttgt

SEQ ID NO: 8248105 - DNA, 22 bp, Homo sapiens
tggagcagagatgggagcccaa

SEQ ID NO: 8248106 - DNA, 22 bp, Homo sapiens
tggagcagaaatttgaagccat

SEQ ID NO: 8248107 - DNA, 18 bp, Homo sapiens
tggagccattgccaccat

SEQ ID NO: 8248108 - DNA, 22 bp, Homo sapiens
tggagcccacggatgtcgcttt

SEQ ID NO: 8248109 - DNA, 22 bp, Homo sapiens
tggagcccacggatgtcgcttt

SEQ ID NO: 8248110 - DNA, 22 bp, Homo sapiens
tggagccaggagcctgggagtc

SEQ ID NO: 8248111 - DNA, 22 bp, Homo sapiens
tggagccagggtagaagcagag

SEQ ID NO: 8248112 - DNA, 22 bp, Homo sapiens
tggagccatgcctggcctttcc

SEQ ID NO: 8248113 - DNA, 22 bp, Homo sapiens
tggagcctccagtctttctaga

SEQ ID NO: 8248114 - DNA, 22 bp, Homo sapiens
tggagcctcctcacactgtggc

SEQ ID NO: 8248115 - DNA, 22 bp, Homo sapiens
tggagcccagacactggcattg

SEQ ID NO: 8248116 - DNA, 22 bp, Homo sapiens
tggagcgagctcaaaggcagga

SEQ ID NO: 8248117 - DNA, 22 bp, Homo sapiens
tggagccttttacccacaggag

SEQ ID NO: 8248118 - DNA, 22 bp, Homo sapiens
tggagcctgtgtttctgcccag

SEQ ID NO: 8248119 - DNA, 22 bp, Homo sapiens
tggagctgaactttgaggccag

SEQ ID NO: 8248120 - DNA, 22 bp, Homo sapiens
tggagctgaactttgaggccag

SEQ ID NO: 8248121 - DNA, 23 bp, Homo sapiens
tggagctgacagtcagagggagg

SEQ ID NO: 8248122 - DNA, 22 bp, Homo sapiens
tggagctgaggggaatgctgag

SEQ ID NO: 8248123 - DNA, 23 bp, Homo sapiens
tggagctgacagtcagagggagg

SEQ ID NO: 8248124 - DNA, 23 bp, Homo sapiens
tggagctgacagtcagagggagg

SEQ ID NO: 8248125 - DNA, 21 bp, Homo sapiens
tggagctgaatttttggcatc

SEQ ID NO: 8248126 - DNA, 21 bp, Homo sapiens
tggagctgaatttttggcatc

SEQ ID NO: 8248127 - DNA, 22 bp, Homo sapiens
tggagctggaatttctgggcct

SEQ ID NO: 8248128 - DNA, 22 bp, Homo sapiens
tggagctggaagacagtgatat

SEQ ID NO: 8248129 - DNA, 22 bp, Homo sapiens
tggagctggaatttgagctgga

SEQ ID NO: 8248130 - DNA, 22 bp, Homo sapiens
tggagctggaatttgagctgga

SEQ ID NO: 8248131 - DNA, 22 bp, Homo sapiens
tggagctggaatttgagctgga

SEQ ID NO: 8248132 - DNA, 22 bp, Homo sapiens
tggagctggaatttctgggcct

SEQ ID NO: 8248133 - DNA, 22 bp, Homo sapiens
tggagctggaatttctgggcct

SEQ ID NO: 8248134 - DNA, 22 bp, Homo sapiens
tggagctggaatttgagctgga

SEQ ID NO: 8248135 - DNA, 22 bp, Homo sapiens
tggagctggaatttgagctgga

SEQ ID NO: 8248136 - DNA, 22 bp, Homo sapiens
tggagctggcagcggaaaaggg

SEQ ID NO: 8248137 - DNA, 22 bp, Homo sapiens
tggagctgggagtcctgggctg

SEQ ID NO: 8248138 - DNA, 22 bp, Homo sapiens
tggagctggcttgtggaagttg

SEQ ID NO: 8248139 - DNA, 22 bp, Homo sapiens
tggagctggcttgtggaagttg

SEQ ID NO: 8248140 - DNA, 22 bp, Homo sapiens
tggagctggcttgtggaagttg

SEQ ID NO: 8248141 - DNA, 22 bp, Homo sapiens
tggagctggcttgtggaagttg

SEQ ID NO: 8248142 - DNA, 22 bp, Homo sapiens
tggagctggcttgtggaagttg

SEQ ID NO: 8248143 - DNA, 22 bp, Homo sapiens
tggagctggcttgtggaagttg

SEQ ID NO: 8248144 - DNA, 22 bp, Homo sapiens
tggagctgatacagctggcttt

SEQ ID NO: 8248145 - DNA, 22 bp, Homo sapiens
tggagctgatacagctggcttt

SEQ ID NO: 8248146 - DNA, 22 bp, Homo sapiens
tggagctgatacagctggcttt

SEQ ID NO: 8248147 - DNA, 22 bp, Homo sapiens
tggagctgatacagctggcttt

SEQ ID NO: 8248148 - DNA, 21 bp, Homo sapiens
tggagctgccacttgagctgc

SEQ ID NO: 8248149 - DNA, 18 bp, Homo sapiens
tggagctgagtgctgtgc

SEQ ID NO: 8248150 - DNA, 18 bp, Homo sapiens
tggagctgagtgctgtgc

SEQ ID NO: 8248151 - DNA, 18 bp, Homo sapiens
tggagctgagtgctgtgc

SEQ ID NO: 8248152 - DNA, 22 bp, Homo sapiens
tggagctgatacagctggcttt

SEQ ID NO: 8248153 - DNA, 22 bp, Homo sapiens
tggagctgatacagctggcttt

SEQ ID NO: 8248154 - DNA, 18 bp, Homo sapiens
tggagctgagtgctgtgc

SEQ ID NO: 8248155 - DNA, 22 bp, Homo sapiens
tggagctggaagaatgtagacg

SEQ ID NO: 8248156 - DNA, 17 bp, Homo sapiens
tggagctgcgtgtgttc

SEQ ID NO: 8248157 - DNA, 17 bp, Homo sapiens
tggagctgcgtgtgttc

SEQ ID NO: 8248158 - DNA, 22 bp, Homo sapiens
tggagctggaagacagtgatat

SEQ ID NO: 8248159 - DNA, 22 bp, Homo sapiens
tggagctggaagacagtgatat

SEQ ID NO: 8248160 - DNA, 22 bp, Homo sapiens
tggagctggaagaatgtagacg

SEQ ID NO: 8248161 - DNA, 21 bp, Homo sapiens
tggagctgccacttgagctgc

SEQ ID NO: 8248162 - DNA, 21 bp, Homo sapiens
tggagctgccacttgagctgc

SEQ ID NO: 8248163 - DNA, 21 bp, Homo sapiens
tggagctgccacttgtcctcc

SEQ ID NO: 8248164 - DNA, 22 bp, Homo sapiens
tggagctgcctggcacctacag

SEQ ID NO: 8248165 - DNA, 21 bp, Homo sapiens
tggagctgccacttgtcctcc

SEQ ID NO: 8248166 - DNA, 22 bp, Homo sapiens
tggagcagctctagcgggcgcc

SEQ ID NO: 8248167 - DNA, 22 bp, Homo sapiens
tggagcagctctagcgggcgcc

SEQ ID NO: 8248168 - DNA, 22 bp, Homo sapiens
tggagcagctctagcgggcgcc

SEQ ID NO: 8248169 - DNA, 22 bp, Homo sapiens
tggagcagctgaacagagttga

SEQ ID NO: 8248170 - DNA, 22 bp, Homo sapiens
tggagcagctgaacagagttga

SEQ ID NO: 8248171 - DNA, 22 bp, Homo sapiens
tggagcagctaagcctctgaga

SEQ ID NO: 8248172 - DNA, 22 bp, Homo sapiens
tggagcagctaagcctctgaga

SEQ ID NO: 8248173 - DNA, 22 bp, Homo sapiens
tggagcagctaagcctctgaga

SEQ ID NO: 8248174 - DNA, 22 bp, Homo sapiens
tggagcagctaagcctctgaga

SEQ ID NO: 8248175 - DNA, 22 bp, Homo sapiens
tggagcagctaagcctctgaga

SEQ ID NO: 8248176 - DNA, 22 bp, Homo sapiens
tggagcagctctagcgggcgcc

SEQ ID NO: 8248177 - DNA, 22 bp, Homo sapiens
tggagcagctctagcgggcgcc

SEQ ID NO: 8248178 - DNA, 22 bp, Homo sapiens
tggagcaggaagtctatggctg

SEQ ID NO: 8248179 - DNA, 18 bp, Homo sapiens
tggagcaggaagcctggc

SEQ ID NO: 8248180 - DNA, 22 bp, Homo sapiens
tggagcaggaagtctatggctg

SEQ ID NO: 8248181 - DNA, 18 bp, Homo sapiens
tggagcaggaagcctggc

SEQ ID NO: 8248182 - DNA, 18 bp, Homo sapiens
tggagcaggaagcctggc

SEQ ID NO: 8248183 - DNA, 18 bp, Homo sapiens
tggagcaggaagcctggc

SEQ ID NO: 8248184 - DNA, 22 bp, Homo sapiens
tggagcaggaaacatctagagg

SEQ ID NO: 8248185 - DNA, 22 bp, Homo sapiens
tggagcaggaaacatctagagg

SEQ ID NO: 8248186 - DNA, 22 bp, Homo sapiens
tggagcaggaaacatctagagg

SEQ ID NO: 8248187 - DNA, 22 bp, Homo sapiens
tggagcaggaagtctatggctg

SEQ ID NO: 8248188 - DNA, 22 bp, Homo sapiens
tggagcaggaagtctatggctg

SEQ ID NO: 8248189 - DNA, 22 bp, Homo sapiens
tggagcaggaagtctatggctg

SEQ ID NO: 8248190 - DNA, 22 bp, Homo sapiens
tggagcaggacggggagtggta

SEQ ID NO: 8248191 - DNA, 22 bp, Homo sapiens
tggagcaggaagtctatggctg

SEQ ID NO: 8248192 - DNA, 22 bp, Homo sapiens
tggagcaggaagtctatggctg

SEQ ID NO: 8248193 - DNA, 22 bp, Homo sapiens
tggagcaggacggggagtggta

SEQ ID NO: 8248194 - DNA, 22 bp, Homo sapiens
tggagcaggacggggagtggta

SEQ ID NO: 8248195 - DNA, 22 bp, Homo sapiens
tggagcaggacggggagtggta

SEQ ID NO: 8248196 - DNA, 22 bp, Homo sapiens
tggagcaggacggggagtggta

SEQ ID NO: 8248197 - DNA, 22 bp, Homo sapiens
tggagcaggacggggagtggta

SEQ ID NO: 8248198 - DNA, 18 bp, Homo sapiens
tggagcaggtaggcatga

SEQ ID NO: 8248199 - DNA, 18 bp, Homo sapiens
tggagcaggtaggcatga

SEQ ID NO: 8248200 - DNA, 22 bp, Homo sapiens
tggagcaggtgccaggtgtgtg

SEQ ID NO: 8248201 - DNA, 22 bp, Homo sapiens
tggagcaggtgccaggtgtgtg

SEQ ID NO: 8248202 - DNA, 22 bp, Homo sapiens
tggagcaggtgccaggtgtgtg

SEQ ID NO: 8248203 - DNA, 22 bp, Homo sapiens
tggagcaggtgccaggtgtgtg

SEQ ID NO: 8248204 - DNA, 22 bp, Homo sapiens
tggagcaggtgccaggtgtgtg

SEQ ID NO: 8248205 - DNA, 22 bp, Homo sapiens
tggagcaggtcggcaccatttg

SEQ ID NO: 8248206 - DNA, 22 bp, Homo sapiens
tggagcaggtcggcaccatttg

SEQ ID NO: 8248207 - DNA, 22 bp, Homo sapiens
tggagcaggtgctcagggtaat

SEQ ID NO: 8248208 - DNA, 22 bp, Homo sapiens
tggagcaggtgccaggtgtgtg

SEQ ID NO: 8248209 - DNA, 22 bp, Homo sapiens
tggagcaggtgccaggtgtgtg

SEQ ID NO: 8248210 - DNA, 22 bp, Homo sapiens
tggagccaggctggccctgcca

SEQ ID NO: 8248211 - DNA, 22 bp, Homo sapiens
tggagccagcgagccgaggcgg

SEQ ID NO: 8248212 - DNA, 22 bp, Homo sapiens
tggagccagcggcctgctgagg

SEQ ID NO: 8248213 - DNA, 22 bp, Homo sapiens
tggagccagcggcctgctgagg

SEQ ID NO: 8248214 - DNA, 20 bp, Homo sapiens
tggagccagaggttatagca

SEQ ID NO: 8248215 - DNA, 22 bp, Homo sapiens
tggagccagcaggactcagagg

SEQ ID NO: 8248216 - DNA, 22 bp, Homo sapiens
tggagccagcaggactcagagg

SEQ ID NO: 8248217 - DNA, 22 bp, Homo sapiens
tggagccagcccaggcccctct

SEQ ID NO: 8248218 - DNA, 22 bp, Homo sapiens
tggagccactcactatctgagt

SEQ ID NO: 8248219 - DNA, 22 bp, Homo sapiens
tggagccagagcgcagcctggg

SEQ ID NO: 8248220 - DNA, 22 bp, Homo sapiens
tggagcaggtgctcagggtaat

SEQ ID NO: 8248221 - DNA, 22 bp, Homo sapiens
tggagcaggtgctcagggtaat

SEQ ID NO: 8248222 - DNA, 22 bp, Homo sapiens
tggagcaggtgctcagggtaat

SEQ ID NO: 8248223 - DNA, 22 bp, Homo sapiens
tggagcagtggtcctggagatg

SEQ ID NO: 8248224 - DNA, 22 bp, Homo sapiens
tggagcaggtgggatgtcgtga

SEQ ID NO: 8248225 - DNA, 22 bp, Homo sapiens
tggagcaggtgggatgtcgtga

SEQ ID NO: 8248226 - DNA, 22 bp, Homo sapiens
tggagcaggtgggatgtcgtga

SEQ ID NO: 8248227 - DNA, 22 bp, Homo sapiens
tggagcagtggtcctggagatg

SEQ ID NO: 8248228 - DNA, 22 bp, Homo sapiens
tggagcagtggtcctggagatg

SEQ ID NO: 8248229 - DNA, 22 bp, Homo sapiens
tggagccaatgaacatttgctg

SEQ ID NO: 8248230 - DNA, 22 bp, Homo sapiens
tggagccaaggccagttctcag

SEQ ID NO: 8248231 - DNA, 22 bp, Homo sapiens
tggagccaagagtcaaggggag

SEQ ID NO: 8248232 - DNA, 23 bp, Homo sapiens
tggagccaaacatcacatgcctg

SEQ ID NO: 8248233 - DNA, 22 bp, Homo sapiens
tggagccaaaaagggaaggaga

SEQ ID NO: 8248234 - DNA, 23 bp, Homo sapiens
tggatcaataagcctgactgtgt

SEQ ID NO: 8248235 - DNA, 22 bp, Homo sapiens
tggatatccttgttaactttct

SEQ ID NO: 8248236 - DNA, 22 bp, Homo sapiens
tggataaatgtgcagatgacat

SEQ ID NO: 8248237 - DNA, 22 bp, Homo sapiens
tggatggattgacgaaggcagc

SEQ ID NO: 8248238 - DNA, 22 bp, Homo sapiens
tggatggccccactggatccat

SEQ ID NO: 8248239 - DNA, 22 bp, Homo sapiens
tggatggattgacgaaggcagc

SEQ ID NO: 8248240 - DNA, 19 bp, Homo sapiens
tggatggagcctgtggttg

SEQ ID NO: 8248241 - DNA, 22 bp, Homo sapiens
tggatgctgtaggacacgctct

SEQ ID NO: 8248242 - DNA, 22 bp, Homo sapiens
tggagtgggcaatgtaggcaag

SEQ ID NO: 8248243 - DNA, 22 bp, Homo sapiens
tggagtgggcaatgtaggcaag

SEQ ID NO: 8248244 - DNA, 22 bp, Homo sapiens
tggagtgggcaatgtaggcaag

SEQ ID NO: 8248245 - DNA, 22 bp, Homo sapiens
tggagtgggcaatgtaggcaag

SEQ ID NO: 8248246 - DNA, 22 bp, Homo sapiens
tggagttgcagctaccagacat

SEQ ID NO: 8248247 - DNA, 22 bp, Homo sapiens
tggagttgcagctaccagacat

SEQ ID NO: 8248248 - DNA, 20 bp, Homo sapiens
tggagttgtggcagtttgga

SEQ ID NO: 8248249 - DNA, 22 bp, Homo sapiens
tggagttggccgcccggaccga

SEQ ID NO: 8248250 - DNA, 20 bp, Homo sapiens
tggagttgggctggtttacc

SEQ ID NO: 8248251 - DNA, 22 bp, Homo sapiens
tggagttggccgcccggaccga

SEQ ID NO: 8248252 - DNA, 22 bp, Homo sapiens
tggagttctcaggtgagggctt

SEQ ID NO: 8248253 - DNA, 23 bp, Homo sapiens
tggagttgatgtccttctgtgct

SEQ ID NO: 8248254 - DNA, 21 bp, Homo sapiens
tggataaaggcacttttcatc

SEQ ID NO: 8248255 - DNA, 22 bp, Homo sapiens
tggataaactcactgtaagttg

SEQ ID NO: 8248256 - DNA, 22 bp, Homo sapiens
tggataaaatctgtaaggctca

SEQ ID NO: 8248257 - DNA, 23 bp, Homo sapiens
tggataaaatacttacattcaac

SEQ ID NO: 8248258 - DNA, 20 bp, Homo sapiens
tggagttgttctgctaggtc

SEQ ID NO: 8248259 - DNA, 22 bp, Homo sapiens
tggagttgtgtcatctttgtaa

SEQ ID NO: 8248260 - DNA, 20 bp, Homo sapiens
tggagttgttctgctaggtc

SEQ ID NO: 8248261 - DNA, 20 bp, Homo sapiens
tggagttgttctgctaggtc

SEQ ID NO: 8248262 - DNA, 20 bp, Homo sapiens
tggagttgttctgctaggtc

SEQ ID NO: 8248263 - DNA, 22 bp, Homo sapiens
tggaggtgtccaactcgtgggt

SEQ ID NO: 8248264 - DNA, 22 bp, Homo sapiens
tggaggtgtccaactcgtgggt

SEQ ID NO: 8248265 - DNA, 22 bp, Homo sapiens
tggaggtgtataaggtagcttc

SEQ ID NO: 8248266 - DNA, 22 bp, Homo sapiens
tggaggtgtataaggtagcttc

SEQ ID NO: 8248267 - DNA, 22 bp, Homo sapiens
tggaggtgtataaggtagcttc

SEQ ID NO: 8248268 - DNA, 22 bp, Homo sapiens
tggaggtgtataaggtagcttc

SEQ ID NO: 8248269 - DNA, 22 bp, Homo sapiens
tggaggtgtataaggtagcttc

SEQ ID NO: 8248270 - DNA, 22 bp, Homo sapiens
tggaggtgtataaggtagcttc

SEQ ID NO: 8248271 - DNA, 16 bp, Homo sapiens
tggaggtgtttctagt

SEQ ID NO: 8248272 - DNA, 22 bp, Homo sapiens
tggaggttgggatgcttgtgat

SEQ ID NO: 8248273 - DNA, 22 bp, Homo sapiens
tggaggtgtggagtcaaaggga

SEQ ID NO: 8248274 - DNA, 22 bp, Homo sapiens
tggaggtgtggagtcaaaggga

SEQ ID NO: 8248275 - DNA, 22 bp, Homo sapiens
tggaggtgtccaactcgtgggt

SEQ ID NO: 8248276 - DNA, 22 bp, Homo sapiens
tggaggtgtccaactcgtgggt

SEQ ID NO: 8248277 - DNA, 22 bp, Homo sapiens
tggagtcaggcaatgcttgctt

SEQ ID NO: 8248278 - DNA, 22 bp, Homo sapiens
tggagtcagctagacctgtgtt

SEQ ID NO: 8248279 - DNA, 21 bp, Homo sapiens
tggagtgcaacactaggtata

SEQ ID NO: 8248280 - DNA, 22 bp, Homo sapiens
tggagtgaagtaaagaggacaa

SEQ ID NO: 8248281 - DNA, 22 bp, Homo sapiens
tggagtgaagtaaagaggacaa

SEQ ID NO: 8248282 - DNA, 21 bp, Homo sapiens
tggagtgcaacactaggtata

SEQ ID NO: 8248283 - DNA, 22 bp, Homo sapiens
tggagtggacttcatgaggcca

SEQ ID NO: 8248284 - DNA, 22 bp, Homo sapiens
tggagtggacttcatgaggcca

SEQ ID NO: 8248285 - DNA, 20 bp, Homo sapiens
tggagtgctgtgttgagaag

SEQ ID NO: 8248286 - DNA, 22 bp, Homo sapiens
tggagtggacttcatgaggcca

SEQ ID NO: 8248287 - DNA, 21 bp, Homo sapiens
tggagtgcactcagagttggt

SEQ ID NO: 8248288 - DNA, 22 bp, Homo sapiens
tggagtgaagtaaagaggacaa

SEQ ID NO: 8248289 - DNA, 22 bp, Homo sapiens
tggagtctgtgatgctctgggt

SEQ ID NO: 8248290 - DNA, 20 bp, Homo sapiens
tggagtctgacagatgggta

SEQ ID NO: 8248291 - DNA, 22 bp, Homo sapiens
tggagtctgtgatgctctgggt

SEQ ID NO: 8248292 - DNA, 20 bp, Homo sapiens
tggagtctgacagatgggta

SEQ ID NO: 8248293 - DNA, 22 bp, Homo sapiens
tggagtcatgatggctgctgat

SEQ ID NO: 8248294 - DNA, 22 bp, Homo sapiens
tggagtccgctccaagttctct

SEQ ID NO: 8248295 - DNA, 22 bp, Homo sapiens
tggaggctggtttctgctgagg

SEQ ID NO: 8248296 - DNA, 22 bp, Homo sapiens
tggaggctggagtgcagtggcg

SEQ ID NO: 8248297 - DNA, 22 bp, Homo sapiens
tggaggctggtttctgctgagg

SEQ ID NO: 8248298 - DNA, 22 bp, Homo sapiens
tggaggctgtgtgcatgagacc

SEQ ID NO: 8248299 - DNA, 22 bp, Homo sapiens
tggagggaacccaggctgctct

SEQ ID NO: 8248300 - DNA, 22 bp, Homo sapiens
tggagggaacccaggctgctct

SEQ ID NO: 8248301 - DNA, 20 bp, Homo sapiens
tggagggattgttggcaaat

SEQ ID NO: 8248302 - DNA, 20 bp, Homo sapiens
tggagggattgttggcaaat

SEQ ID NO: 8248303 - DNA, 20 bp, Homo sapiens
tggagggattgttggcaaat

SEQ ID NO: 8248304 - DNA, 22 bp, Homo sapiens
tggagggcatagctgttctttc

SEQ ID NO: 8248305 - DNA, 22 bp, Homo sapiens
tggagggcatctgtggtcaggc

SEQ ID NO: 8248306 - DNA, 22 bp, Homo sapiens
tggagggcatagctgttctttc

SEQ ID NO: 8248307 - DNA, 22 bp, Homo sapiens
tggagggcatctgtggtcaggc

SEQ ID NO: 8248308 - DNA, 22 bp, Homo sapiens
tggagggcatctgtggtcaggc

SEQ ID NO: 8248309 - DNA, 22 bp, Homo sapiens
tggagggcgcttagatggaggg

SEQ ID NO: 8248310 - DNA, 22 bp, Homo sapiens
tggagggcatgctgtccatggg

SEQ ID NO: 8248311 - DNA, 22 bp, Homo sapiens
tggaggtggagttggaaactga

SEQ ID NO: 8248312 - DNA, 22 bp, Homo sapiens
tggaggtggagttggaaactga

SEQ ID NO: 8248313 - DNA, 18 bp, Homo sapiens
tggagggcttgctgcagc

SEQ ID NO: 8248314 - DNA, 22 bp, Homo sapiens
tggaggtggagttggaaactga

SEQ ID NO: 8248315 - DNA, 22 bp, Homo sapiens
tggaggtggcacaagggaggtc

SEQ ID NO: 8248316 - DNA, 22 bp, Homo sapiens
tggagggctctttcacctggta

SEQ ID NO: 8248317 - DNA, 22 bp, Homo sapiens
tggagggctaagctgagggata

SEQ ID NO: 8248318 - DNA, 22 bp, Homo sapiens
tggagggctaagctgagggata

SEQ ID NO: 8248319 - DNA, 22 bp, Homo sapiens
tggagggctctttcacctggta

SEQ ID NO: 8248320 - DNA, 22 bp, Homo sapiens
tggagggctaagctgagggata

SEQ ID NO: 8248321 - DNA, 22 bp, Homo sapiens
tggagggctaagctgagggata

SEQ ID NO: 8248322 - DNA, 22 bp, Homo sapiens
tggagggcgcttagatggaggg

SEQ ID NO: 8248323 - DNA, 22 bp, Homo sapiens
tggagggcgcttagatggaggg

SEQ ID NO: 8248324 - DNA, 22 bp, Homo sapiens
tggagggcgcttagatggaggg

SEQ ID NO: 8248325 - DNA, 22 bp, Homo sapiens
tggagggctaagctgagggata

SEQ ID NO: 8248326 - DNA, 22 bp, Homo sapiens
tggaggtgggagggactgtcct

SEQ ID NO: 8248327 - DNA, 22 bp, Homo sapiens
tggaggtggcatctgacagctg

SEQ ID NO: 8248328 - DNA, 22 bp, Homo sapiens
tggaggtggcatctgacagctg

SEQ ID NO: 8248329 - DNA, 22 bp, Homo sapiens
tggaggtgggagggactgtcct

SEQ ID NO: 8248330 - DNA, 22 bp, Homo sapiens
tggaggtgggagggactgtcct

SEQ ID NO: 8248331 - DNA, 22 bp, Homo sapiens
tggaggtgggagggactgtcct

SEQ ID NO: 8248332 - DNA, 22 bp, Homo sapiens
tggaggtggcacaagggaggtc

SEQ ID NO: 8248333 - DNA, 22 bp, Homo sapiens
tggaggtggcatctgacagctg

SEQ ID NO: 8248334 - DNA, 22 bp, Homo sapiens
tggaggtggcatctgacagctg

SEQ ID NO: 8248335 - DNA, 22 bp, Homo sapiens
tggaggtggcacaagggaggtc

SEQ ID NO: 8248336 - DNA, 20 bp, Homo sapiens
tggaggtggtctgctgtcct

SEQ ID NO: 8248337 - DNA, 22 bp, Homo sapiens
tggaggtgtataaggtagcttc

SEQ ID NO: 8248338 - DNA, 22 bp, Homo sapiens
tggaggtggtgcccagcaattt

SEQ ID NO: 8248339 - DNA, 22 bp, Homo sapiens
tggaggtggtgcccagcaattt

SEQ ID NO: 8248340 - DNA, 20 bp, Homo sapiens
tggaggtggtctgctgtcct

SEQ ID NO: 8248341 - DNA, 22 bp, Homo sapiens
tggaggtggggctcaggaatct

SEQ ID NO: 8248342 - DNA, 22 bp, Homo sapiens
tggaggtggggctcaggaatct

SEQ ID NO: 8248343 - DNA, 22 bp, Homo sapiens
tggaggtggggctcaggaatct

SEQ ID NO: 8248344 - DNA, 22 bp, Homo sapiens
tggaggtggggctcaggaatct

SEQ ID NO: 8248345 - DNA, 22 bp, Homo sapiens
tggaggtggggctcaggaatct

SEQ ID NO: 8248346 - DNA, 20 bp, Homo sapiens
tggaggtggtctgctgtcct

SEQ ID NO: 8248347 - DNA, 22 bp, Homo sapiens
tggaggccagtgaaagtagatt

SEQ ID NO: 8248348 - DNA, 22 bp, Homo sapiens
tggaggcagtcacctgaagtca

SEQ ID NO: 8248349 - DNA, 19 bp, Homo sapiens
tggaggccaggacacaggt

SEQ ID NO: 8248350 - DNA, 19 bp, Homo sapiens
tggaggccaggacacaggt

SEQ ID NO: 8248351 - DNA, 22 bp, Homo sapiens
tggaggcaggttagccagacga

SEQ ID NO: 8248352 - DNA, 22 bp, Homo sapiens
tggaggcaggttagccagacga

SEQ ID NO: 8248353 - DNA, 22 bp, Homo sapiens
tggaggcaggttagccagacga

SEQ ID NO: 8248354 - DNA, 22 bp, Homo sapiens
tggaggcagtaactgagcaaca

SEQ ID NO: 8248355 - DNA, 22 bp, Homo sapiens
tggaggcagtaactgagcaaca

SEQ ID NO: 8248356 - DNA, 22 bp, Homo sapiens
tggaggcagtaactgagcaaca

SEQ ID NO: 8248357 - DNA, 22 bp, Homo sapiens
tggaggcagtaactgagcaaca

SEQ ID NO: 8248358 - DNA, 22 bp, Homo sapiens
tggaggcagtaactgagcaaca

SEQ ID NO: 8248359 - DNA, 22 bp, Homo sapiens
tggaggcagtcacctgaagtca

SEQ ID NO: 8248360 - DNA, 22 bp, Homo sapiens
tggaggcagtcacctgaagtca

SEQ ID NO: 8248361 - DNA, 22 bp, Homo sapiens
tggaggcctaggttgatgtgtg

SEQ ID NO: 8248362 - DNA, 20 bp, Homo sapiens
tggaggcctgcaggtttggg

SEQ ID NO: 8248363 - DNA, 22 bp, Homo sapiens
tggaggctggagtgcagtggcg

SEQ ID NO: 8248364 - DNA, 22 bp, Homo sapiens
tggaggctggagtgcagtggcg

SEQ ID NO: 8248365 - DNA, 22 bp, Homo sapiens
tggaggctggagtgcagtggcg

SEQ ID NO: 8248366 - DNA, 22 bp, Homo sapiens
tggaggctggagtgcagtggcg

SEQ ID NO: 8248367 - DNA, 22 bp, Homo sapiens
tggaggccgcgtagtctgagca

SEQ ID NO: 8248368 - DNA, 22 bp, Homo sapiens
tggaggccgcgtagtctgagca

SEQ ID NO: 8248369 - DNA, 22 bp, Homo sapiens
tggaggccgcaatgcagtttcc

SEQ ID NO: 8248370 - DNA, 22 bp, Homo sapiens
tggaggcccccaggcaacagca

SEQ ID NO: 8248371 - DNA, 22 bp, Homo sapiens
tggaggcccccaggcaacagca

SEQ ID NO: 8248372 - DNA, 22 bp, Homo sapiens
tggaggcaggtggaggagtgaa

SEQ ID NO: 8248373 - DNA, 22 bp, Homo sapiens
tggaggcaggtggaggagtgaa

SEQ ID NO: 8248374 - DNA, 22 bp, Homo sapiens
tggaggcaggtggaggagtgaa

SEQ ID NO: 8248375 - DNA, 22 bp, Homo sapiens
tggaggcaggtggaggagtgaa

SEQ ID NO: 8248376 - DNA, 22 bp, Homo sapiens
tggaggcaggggatacaggtca

SEQ ID NO: 8248377 - DNA, 22 bp, Homo sapiens
tggaggcaggggatacaggtca

SEQ ID NO: 8248378 - DNA, 22 bp, Homo sapiens
tggaggcaggggatacaggtca

SEQ ID NO: 8248379 - DNA, 23 bp, Homo sapiens
tggaggcaggatgctaaggagtc

SEQ ID NO: 8248380 - DNA, 23 bp, Homo sapiens
tggaggcaggatgctaaggagtc

SEQ ID NO: 8248381 - DNA, 23 bp, Homo sapiens
tggaggcaggatgctaaggagtc

SEQ ID NO: 8248382 - DNA, 18 bp, Homo sapiens
tggaggcagagttctggc

SEQ ID NO: 8248383 - DNA, 18 bp, Homo sapiens
tggaggcagagttctggc

SEQ ID NO: 8248384 - DNA, 18 bp, Homo sapiens
tggaggcagagttctggc

SEQ ID NO: 8248385 - DNA, 22 bp, Homo sapiens
tggaggcagatacactgtaaaa

SEQ ID NO: 8248386 - DNA, 22 bp, Homo sapiens
tggaggcagatacactgtaaaa

SEQ ID NO: 8248387 - DNA, 22 bp, Homo sapiens
tggaggcagatacactgtaaaa

SEQ ID NO: 8248388 - DNA, 22 bp, Homo sapiens
tggaggcaggagacagggcaaa

SEQ ID NO: 8248389 - DNA, 22 bp, Homo sapiens
tggaggcaggagacagggcaaa

SEQ ID NO: 8248390 - DNA, 22 bp, Homo sapiens
tggaggcagccgtgaaccacct

SEQ ID NO: 8248391 - DNA, 22 bp, Homo sapiens
tggaggcaggagacagggcaaa

SEQ ID NO: 8248392 - DNA, 22 bp, Homo sapiens
tggaggcaggagacagggcaaa

SEQ ID NO: 8248393 - DNA, 22 bp, Homo sapiens
tggaggcaggagacagggcaaa

SEQ ID NO: 8248394 - DNA, 22 bp, Homo sapiens
tggaggcaggagacagggcaaa

SEQ ID NO: 8248395 - DNA, 22 bp, Homo sapiens
tggaggcaactgaagatgtagt

SEQ ID NO: 8248396 - DNA, 19 bp, Homo sapiens
tggaggcaagacatggagg

SEQ ID NO: 8248397 - DNA, 19 bp, Homo sapiens
tggaggcaagacatggagg

SEQ ID NO: 8248398 - DNA, 22 bp, Homo sapiens
tggaggcaccactggctgcccg

SEQ ID NO: 8248399 - DNA, 22 bp, Homo sapiens
tggaggcaccactggctgcccg

SEQ ID NO: 8248400 - DNA, 22 bp, Homo sapiens
tggaggcaccactggctgcccg

SEQ ID NO: 8248401 - DNA, 20 bp, Homo sapiens
tggaggcacctgtggagatc

SEQ ID NO: 8248402 - DNA, 22 bp, Homo sapiens
tggaggcaccactggctgcccg

SEQ ID NO: 8248403 - DNA, 20 bp, Homo sapiens
tggaggcacctgtggagatc

SEQ ID NO: 8248404 - DNA, 22 bp, Homo sapiens
tggaggcaccactggctgcccg

SEQ ID NO: 8248405 - DNA, 20 bp, Homo sapiens
tggaggcagagccagaggga

SEQ ID NO: 8248406 - DNA, 20 bp, Homo sapiens
tggaggcagagccagaggga

SEQ ID NO: 8248407 - DNA, 20 bp, Homo sapiens
tggaggcagagccagaggga

SEQ ID NO: 8248408 - DNA, 20 bp, Homo sapiens
tggaggcagagccagaggga

SEQ ID NO: 8248409 - DNA, 22 bp, Homo sapiens
tggaggcactaaatggccacaa

SEQ ID NO: 8248410 - DNA, 20 bp, Homo sapiens
tggaggcagagccagaggga

SEQ ID NO: 8248411 - DNA, 22 bp, Homo sapiens
tggaggcactaaatggccacaa

SEQ ID NO: 8248412 - DNA, 22 bp, Homo sapiens
tggaggcactaaatggccacaa

SEQ ID NO: 8248413 - DNA, 22 bp, Homo sapiens
tggaggcactaaatggccacaa

SEQ ID NO: 8248414 - DNA, 20 bp, Homo sapiens
tggaggcacctgtggagatc

SEQ ID NO: 8248415 - DNA, 22 bp, Homo sapiens
tggaggagggctggtgtctgta

SEQ ID NO: 8248416 - DNA, 22 bp, Homo sapiens
tggaggagggctggtgtctgta

SEQ ID NO: 8248417 - DNA, 22 bp, Homo sapiens
tggaggaggaacttcttatctc

SEQ ID NO: 8248418 - DNA, 19 bp, Homo sapiens
tggaggagaggaaaagtca

SEQ ID NO: 8248419 - DNA, 22 bp, Homo sapiens
tggaggagaatttatggtcgaa

SEQ ID NO: 8248420 - DNA, 22 bp, Homo sapiens
tggaggagaatttatggtcgaa

SEQ ID NO: 8248421 - DNA, 22 bp, Homo sapiens
tggaggaaaattactggggtct

SEQ ID NO: 8248422 - DNA, 22 bp, Homo sapiens
tggaggagaatttatggtcgaa

SEQ ID NO: 8248423 - DNA, 22 bp, Homo sapiens
tggaggagaatttatggtcgaa

SEQ ID NO: 8248424 - DNA, 22 bp, Homo sapiens
tggaggagaccattccactcag

SEQ ID NO: 8248425 - DNA, 22 bp, Homo sapiens
tggaggagtagattttcagagg

SEQ ID NO: 8248426 - DNA, 22 bp, Homo sapiens
tggaggagggctggtgtctgta

SEQ ID NO: 8248427 - DNA, 22 bp, Homo sapiens
tggaggagtgtgattgtctgcc

SEQ ID NO: 8248428 - DNA, 22 bp, Homo sapiens
tggaggagtgtgattgtctgcc

SEQ ID NO: 8248429 - DNA, 22 bp, Homo sapiens
tggaggattccacttacatgag

SEQ ID NO: 8248430 - DNA, 22 bp, Homo sapiens
tggaggcaactgaagatgtagt

SEQ ID NO: 8248431 - DNA, 22 bp, Homo sapiens
tggaggcaactgaagatgtagt

SEQ ID NO: 8248432 - DNA, 22 bp, Homo sapiens
tggaggcaactgaagatgtagt

SEQ ID NO: 8248433 - DNA, 22 bp, Homo sapiens
tggaggcaactgaagatgtagt

SEQ ID NO: 8248434 - DNA, 22 bp, Homo sapiens
tggaggaaaaaaccaggcagag

SEQ ID NO: 8248435 - DNA, 22 bp, Homo sapiens
tggaggaaaaaaccaggcagag

SEQ ID NO: 8248436 - DNA, 22 bp, Homo sapiens
tggaggaaaaaaccaggcagag

SEQ ID NO: 8248437 - DNA, 22 bp, Homo sapiens
tggaggaaaaaaccaggcagag

SEQ ID NO: 8248438 - DNA, 22 bp, Homo sapiens
tggagctgtcactcagaaccaa

SEQ ID NO: 8248439 - DNA, 20 bp, Homo sapiens
tggagctgtggtaaggagca

SEQ ID NO: 8248440 - DNA, 22 bp, Homo sapiens
tggagctgtcactcagaaccaa

SEQ ID NO: 8248441 - DNA, 22 bp, Homo sapiens
tggagctggtaaacagtgacat

SEQ ID NO: 8248442 - DNA, 22 bp, Homo sapiens
tggagctggtaaacagtgacat

SEQ ID NO: 8248443 - DNA, 22 bp, Homo sapiens
tggagctggttctggggaagct

SEQ ID NO: 8248444 - DNA, 22 bp, Homo sapiens
tggagctggttctggggaagct

SEQ ID NO: 8248445 - DNA, 20 bp, Homo sapiens
tggagctgtaatcttgtctg

SEQ ID NO: 8248446 - DNA, 20 bp, Homo sapiens
tggagctgtaatcttgtctg

SEQ ID NO: 8248447 - DNA, 20 bp, Homo sapiens
tggagctgtaatcttgtctg

SEQ ID NO: 8248448 - DNA, 22 bp, Homo sapiens
tggagctgtagccaccaccctg

SEQ ID NO: 8248449 - DNA, 22 bp, Homo sapiens
tggagctgtagccaccaccctg

SEQ ID NO: 8248450 - DNA, 22 bp, Homo sapiens
tggagctggtaaacagtgacat

SEQ ID NO: 8248451 - DNA, 23 bp, Homo sapiens
tggagctgggctcagaccctggg

SEQ ID NO: 8248452 - DNA, 22 bp, Homo sapiens
tggagctggtaaacagtgacat

SEQ ID NO: 8248453 - DNA, 22 bp, Homo sapiens
tggagctggggtttgaatctgg

SEQ ID NO: 8248454 - DNA, 22 bp, Homo sapiens
tggagctggggtttgaatctgg

SEQ ID NO: 8248455 - DNA, 22 bp, Homo sapiens
tggagctggggtttgaatctgg

SEQ ID NO: 8248456 - DNA, 23 bp, Homo sapiens
tggagctgggctcagaccctggg

SEQ ID NO: 8248457 - DNA, 23 bp, Homo sapiens
tggagctgggctcagaccctggg

SEQ ID NO: 8248458 - DNA, 22 bp, Homo sapiens
tggagctggggtttgaatctgg

SEQ ID NO: 8248459 - DNA, 23 bp, Homo sapiens
tggagctgggctcagaccctggg

SEQ ID NO: 8248460 - DNA, 22 bp, Homo sapiens
tggagctgggagtcctgggctg

SEQ ID NO: 8248461 - DNA, 22 bp, Homo sapiens
tggagctgggagtcctgggctg

SEQ ID NO: 8248462 - DNA, 22 bp, Homo sapiens
tggagctgggagtcctgggctg

SEQ ID NO: 8248463 - DNA, 22 bp, Homo sapiens
tggagctgggagtcctgggctg

SEQ ID NO: 8248464 - DNA, 22 bp, Homo sapiens
tggagctgggatttgaactgca

SEQ ID NO: 8248465 - DNA, 22 bp, Homo sapiens
tggagctgggatttgaactgca

SEQ ID NO: 8248466 - DNA, 23 bp, Homo sapiens
tggagctgggatttgatttgatt

SEQ ID NO: 8248467 - DNA, 23 bp, Homo sapiens
tggagctgggatttgatttgatt

SEQ ID NO: 8248468 - DNA, 23 bp, Homo sapiens
tggagctgggatttgatttgatt

SEQ ID NO: 8248469 - DNA, 22 bp, Homo sapiens
tggagctgggatttgaactgca

SEQ ID NO: 8248470 - DNA, 23 bp, Homo sapiens
tggagctgggcagctgggaaagt

SEQ ID NO: 8248471 - DNA, 23 bp, Homo sapiens
tggagctgggcagctgggaaagt

SEQ ID NO: 8248472 - DNA, 23 bp, Homo sapiens
tggagctgggctcagaccctggg

SEQ ID NO: 8248473 - DNA, 23 bp, Homo sapiens
tggagctgggcagctgggaaagt

SEQ ID NO: 8248474 - DNA, 23 bp, Homo sapiens
tggagctgggcagctgggaaagt

SEQ ID NO: 8248475 - DNA, 23 bp, Homo sapiens
tgctgtgcctttgtctgcctcca

SEQ ID NO: 8248476 - DNA, 22 bp, Homo sapiens
tgctgtgcatcatagtgtttgg

SEQ ID NO: 8248477 - DNA, 18 bp, Homo sapiens
tgctgtgcacagccctat

SEQ ID NO: 8248478 - DNA, 22 bp, Homo sapiens
tgctgtgcaaaggtgatgtgag

SEQ ID NO: 8248479 - DNA, 22 bp, Homo sapiens
tgctgtgaggttgagaaggaag

SEQ ID NO: 8248480 - DNA, 22 bp, Homo sapiens
tgctgtgaggttgagaaggaag

SEQ ID NO: 8248481 - DNA, 22 bp, Homo sapiens
tgctgtgaggttgagaaggaag

SEQ ID NO: 8248482 - DNA, 22 bp, Homo sapiens
tgctgtctttcattgtctgcct

SEQ ID NO: 8248483 - DNA, 22 bp, Homo sapiens
tgctgtcttctctgaggtccct

SEQ ID NO: 8248484 - DNA, 22 bp, Homo sapiens
tgctgtcttccaggatggtgaa

SEQ ID NO: 8248485 - DNA, 22 bp, Homo sapiens
tgctgtcttccaggatggtgaa

SEQ ID NO: 8248486 - DNA, 22 bp, Homo sapiens
tgctgtgacagagtctcatgga

SEQ ID NO: 8248487 - DNA, 22 bp, Homo sapiens
tgctgtctttttcccttcctaa

SEQ ID NO: 8248488 - DNA, 17 bp, Homo sapiens
tgctgtctgcttcccta

SEQ ID NO: 8248489 - DNA, 17 bp, Homo sapiens
tgctgtctgcttcccta

SEQ ID NO: 8248490 - DNA, 22 bp, Homo sapiens
tgctgtctgcaacagtactaca

SEQ ID NO: 8248491 - DNA, 20 bp, Homo sapiens
tgctgtcgtgttttctgctt

SEQ ID NO: 8248492 - DNA, 22 bp, Homo sapiens
tgctgtctgattcagggtgatt

SEQ ID NO: 8248493 - DNA, 21 bp, Homo sapiens
tgctgtcctagaaccagggcc

SEQ ID NO: 8248494 - DNA, 22 bp, Homo sapiens
tgctgtccctaagtctcttcaa

SEQ ID NO: 8248495 - DNA, 19 bp, Homo sapiens
tgctgtcctcagagtaagt

SEQ ID NO: 8248496 - DNA, 22 bp, Homo sapiens
tgcttaaaccctgatcatgtgt

SEQ ID NO: 8248497 - DNA, 22 bp, Homo sapiens
tgcttaaaggatagtttaaact

SEQ ID NO: 8248498 - DNA, 22 bp, Homo sapiens
tgcttaaaggatagtttaaact

SEQ ID NO: 8248499 - DNA, 22 bp, Homo sapiens
tgcttaaagtagtggattgtta

SEQ ID NO: 8248500 - DNA, 22 bp, Homo sapiens
tgcttaaaattttccaaggatt

SEQ ID NO: 8248501 - DNA, 22 bp, Homo sapiens
tgcttaaacacatacatacata

SEQ ID NO: 8248502 - DNA, 22 bp, Homo sapiens
tgcttaaacacatacatacata

SEQ ID NO: 8248503 - DNA, 22 bp, Homo sapiens
tgcttaaacatactatttatat

SEQ ID NO: 8248504 - DNA, 22 bp, Homo sapiens
tgcttaaacatccagacagtat

SEQ ID NO: 8248505 - DNA, 22 bp, Homo sapiens
tgcttaaacatccagacagtat

SEQ ID NO: 8248506 - DNA, 22 bp, Homo sapiens
tgcttacattgcatctgtgcct

SEQ ID NO: 8248507 - DNA, 22 bp, Homo sapiens
tgcttacgagctattttcactt

SEQ ID NO: 8248508 - DNA, 22 bp, Homo sapiens
tgcttacattgcatctgtgcct

SEQ ID NO: 8248509 - DNA, 18 bp, Homo sapiens
tgcttacaggagttcctg

SEQ ID NO: 8248510 - DNA, 22 bp, Homo sapiens
tgcttacaactttattgaggaa

SEQ ID NO: 8248511 - DNA, 18 bp, Homo sapiens
tgcttacaggagttcctg

SEQ ID NO: 8248512 - DNA, 22 bp, Homo sapiens
tgcttagaatctggacttgttg

SEQ ID NO: 8248513 - DNA, 22 bp, Homo sapiens
tgcttaaagtgttaaccctgtt

SEQ ID NO: 8248514 - DNA, 22 bp, Homo sapiens
tgcttctccattgatgctaagt

SEQ ID NO: 8248515 - DNA, 22 bp, Homo sapiens
tgcttctcaaagaagcataatg

SEQ ID NO: 8248516 - DNA, 22 bp, Homo sapiens
tgcttctcaaagaagcataatg

SEQ ID NO: 8248517 - DNA, 22 bp, Homo sapiens
tgcttctcaaaaggaggtaggt

SEQ ID NO: 8248518 - DNA, 22 bp, Homo sapiens
tgcttccctcacttcacctggc

SEQ ID NO: 8248519 - DNA, 22 bp, Homo sapiens
tgcttccctgaaggcacaggag

SEQ ID NO: 8248520 - DNA, 22 bp, Homo sapiens
tgcttccctgaaggcacaggag

SEQ ID NO: 8248521 - DNA, 22 bp, Homo sapiens
tgcttcgaattgggcttctgga

SEQ ID NO: 8248522 - DNA, 22 bp, Homo sapiens
tgcttctgaaatgcaggtcttc

SEQ ID NO: 8248523 - DNA, 22 bp, Homo sapiens
tgcttctctttatttgtaggtt

SEQ ID NO: 8248524 - DNA, 22 bp, Homo sapiens
tgcttctgaaatgcaggtcttc

SEQ ID NO: 8248525 - DNA, 23 bp, Homo sapiens
tgcttctctgcttgacagttctg

SEQ ID NO: 8248526 - DNA, 22 bp, Homo sapiens
tgcttctctttatttgtaggtt

SEQ ID NO: 8248527 - DNA, 22 bp, Homo sapiens
tgcttctctgttctaacccttg

SEQ ID NO: 8248528 - DNA, 21 bp, Homo sapiens
tgcttctctagatcaactact

SEQ ID NO: 8248529 - DNA, 22 bp, Homo sapiens
tgcttctcccaaccagggcctg

SEQ ID NO: 8248530 - DNA, 22 bp, Homo sapiens
tgcttctgagttgcaggacttg

SEQ ID NO: 8248531 - DNA, 22 bp, Homo sapiens
tgcttctgcaggagctcctgat

SEQ ID NO: 8248532 - DNA, 22 bp, Homo sapiens
tgcttctgactgggtcagttga

SEQ ID NO: 8248533 - DNA, 22 bp, Homo sapiens
tgcttctgacatgttcttggtt

SEQ ID NO: 8248534 - DNA, 22 bp, Homo sapiens
tgcttctgaactcagcatgtgg

SEQ ID NO: 8248535 - DNA, 22 bp, Homo sapiens
tgcttattaaacatgcatattc

SEQ ID NO: 8248536 - DNA, 22 bp, Homo sapiens
tgcttatttgaatttattctca

SEQ ID NO: 8248537 - DNA, 22 bp, Homo sapiens
tgcttcaagttgaaatattctt

SEQ ID NO: 8248538 - DNA, 22 bp, Homo sapiens
tgcttcaaggacactgactttt

SEQ ID NO: 8248539 - DNA, 22 bp, Homo sapiens
tgcttcagagaagaatggaaag

SEQ ID NO: 8248540 - DNA, 22 bp, Homo sapiens
tgcttcagagaagaatggaaag

SEQ ID NO: 8248541 - DNA, 22 bp, Homo sapiens
tgcttcagcactttgagagcct

SEQ ID NO: 8248542 - DNA, 22 bp, Homo sapiens
tgcttcagaggaaaggcaaaag

SEQ ID NO: 8248543 - DNA, 22 bp, Homo sapiens
tgcttcagaggaaaggcaaaag

SEQ ID NO: 8248544 - DNA, 22 bp, Homo sapiens
tgcttccaggaatccatctggc

SEQ ID NO: 8248545 - DNA, 22 bp, Homo sapiens
tgcttccaggaatccatctggc

SEQ ID NO: 8248546 - DNA, 22 bp, Homo sapiens
tgcttccagctctctgtaaggt

SEQ ID NO: 8248547 - DNA, 22 bp, Homo sapiens
tgcttccactaatgagctgtgt

SEQ ID NO: 8248548 - DNA, 22 bp, Homo sapiens
tgcttccagcatccctggcctg

SEQ ID NO: 8248549 - DNA, 22 bp, Homo sapiens
tgcttccactaatgagctgtgt

SEQ ID NO: 8248550 - DNA, 22 bp, Homo sapiens
tgcttcattttgacttagccag

SEQ ID NO: 8248551 - DNA, 22 bp, Homo sapiens
tgcttcagtgctctgagcctgt

SEQ ID NO: 8248552 - DNA, 22 bp, Homo sapiens
tgcttcagtcctatgggcaggt

SEQ ID NO: 8248553 - DNA, 22 bp, Homo sapiens
tgcttcaggaagaaacgccagg

SEQ ID NO: 8248554 - DNA, 22 bp, Homo sapiens
tgcttcaggagatgtcaccatg

SEQ ID NO: 8248555 - DNA, 17 bp, Homo sapiens
tgcttcatcccgatcct

SEQ ID NO: 8248556 - DNA, 17 bp, Homo sapiens
tgcttcatcccgatcct

SEQ ID NO: 8248557 - DNA, 22 bp, Homo sapiens
tgcttcatgaggtagtggcagt

SEQ ID NO: 8248558 - DNA, 22 bp, Homo sapiens
tgcttcatgaggctgagagaag

SEQ ID NO: 8248559 - DNA, 22 bp, Homo sapiens
tgctggggatccgtaccaaccc

SEQ ID NO: 8248560 - DNA, 22 bp, Homo sapiens
tgctggggagtgattgaccatc

SEQ ID NO: 8248561 - DNA, 22 bp, Homo sapiens
tgctggggagtgattgaccatc

SEQ ID NO: 8248562 - DNA, 22 bp, Homo sapiens
tgctggggagtgattgaccatc

SEQ ID NO: 8248563 - DNA, 20 bp, Homo sapiens
tgctggggacatacagggtg

SEQ ID NO: 8248564 - DNA, 20 bp, Homo sapiens
tgctggggacatacagggtg

SEQ ID NO: 8248565 - DNA, 20 bp, Homo sapiens
tgctggggacatacagggtg

SEQ ID NO: 8248566 - DNA, 20 bp, Homo sapiens
tgctggggacatacagggtg

SEQ ID NO: 8248567 - DNA, 20 bp, Homo sapiens
tgctggggacatacagggtg

SEQ ID NO: 8248568 - DNA, 20 bp, Homo sapiens
tgctggggacatacagggtg

SEQ ID NO: 8248569 - DNA, 22 bp, Homo sapiens
tgctggggatccgtaccaaccc

SEQ ID NO: 8248570 - DNA, 22 bp, Homo sapiens
tgctggggatccgtaccaaccc

SEQ ID NO: 8248571 - DNA, 22 bp, Homo sapiens
tgctggggatccgtaccaaccc

SEQ ID NO: 8248572 - DNA, 22 bp, Homo sapiens
tgctggggcagaagagccaaga

SEQ ID NO: 8248573 - DNA, 22 bp, Homo sapiens
tgctggggcagaagagccaaga

SEQ ID NO: 8248574 - DNA, 22 bp, Homo sapiens
tgctggggcagaagagccaaga

SEQ ID NO: 8248575 - DNA, 16 bp, Homo sapiens
tgctggggcgccgtcc

SEQ ID NO: 8248576 - DNA, 16 bp, Homo sapiens
tgctggggcgccgtcc

SEQ ID NO: 8248577 - DNA, 16 bp, Homo sapiens
tgctggggcgccgtcc

SEQ ID NO: 8248578 - DNA, 23 bp, Homo sapiens
tgctggggtagtttgtggcacag

SEQ ID NO: 8248579 - DNA, 23 bp, Homo sapiens
tgctggggtagtttgtggcacag

SEQ ID NO: 8248580 - DNA, 23 bp, Homo sapiens
tgctggggtagtttgtggcacag

SEQ ID NO: 8248581 - DNA, 22 bp, Homo sapiens
tgctggggtcatggggcgcccg

SEQ ID NO: 8248582 - DNA, 22 bp, Homo sapiens
tgctggggtcatggggcgcccg

SEQ ID NO: 8248583 - DNA, 22 bp, Homo sapiens
tgctggggtcatggggcgcccg

SEQ ID NO: 8248584 - DNA, 22 bp, Homo sapiens
tgctggggtcatggggcgcccg

SEQ ID NO: 8248585 - DNA, 22 bp, Homo sapiens
tgctggggtcatggggcgcccg

SEQ ID NO: 8248586 - DNA, 22 bp, Homo sapiens
tgctggggtcatggggcgcccg

SEQ ID NO: 8248587 - DNA, 18 bp, Homo sapiens
tgctgggtaactgtatgg

SEQ ID NO: 8248588 - DNA, 22 bp, Homo sapiens
tgctgggtagaagtattagtct

SEQ ID NO: 8248589 - DNA, 22 bp, Homo sapiens
tgctgggtagaagtattagtct

SEQ ID NO: 8248590 - DNA, 22 bp, Homo sapiens
tgctgggtagaagtattagtct

SEQ ID NO: 8248591 - DNA, 22 bp, Homo sapiens
tgctggggtctctccggtgccc

SEQ ID NO: 8248592 - DNA, 22 bp, Homo sapiens
tgctggggtctctccggtgccc

SEQ ID NO: 8248593 - DNA, 22 bp, Homo sapiens
tgctggggtctctccggtgccc

SEQ ID NO: 8248594 - DNA, 22 bp, Homo sapiens
tgctggggtctctccggtgccc

SEQ ID NO: 8248595 - DNA, 22 bp, Homo sapiens
tgctgtagccctgcacagtgca

SEQ ID NO: 8248596 - DNA, 22 bp, Homo sapiens
tgctggttctttccttcccttc

SEQ ID NO: 8248597 - DNA, 22 bp, Homo sapiens
tgctggttgtattttctctgtg

SEQ ID NO: 8248598 - DNA, 22 bp, Homo sapiens
tgctggtggagaaagtggaggt

SEQ ID NO: 8248599 - DNA, 23 bp, Homo sapiens
tgctggttcaaaaaggaaggagg

SEQ ID NO: 8248600 - DNA, 22 bp, Homo sapiens
tgctggttcttaggagagagat

SEQ ID NO: 8248601 - DNA, 22 bp, Homo sapiens
tgctggttcttaagatgcctcc

SEQ ID NO: 8248602 - DNA, 20 bp, Homo sapiens
tgctggttacaccaccaagg

SEQ ID NO: 8248603 - DNA, 22 bp, Homo sapiens
tgctgtcaaggttacatgcttt

SEQ ID NO: 8248604 - DNA, 22 bp, Homo sapiens
tgctgtatatattttgaagtga

SEQ ID NO: 8248605 - DNA, 22 bp, Homo sapiens
tgctgtatatattttgaagtga

SEQ ID NO: 8248606 - DNA, 22 bp, Homo sapiens
tgctgtattacttttacaaact

SEQ ID NO: 8248607 - DNA, 22 bp, Homo sapiens
tgctgtcagacagcagtggtaa

SEQ ID NO: 8248608 - DNA, 22 bp, Homo sapiens
tgctgtcagttggcaggatgag

SEQ ID NO: 8248609 - DNA, 22 bp, Homo sapiens
tgctgtcccccgtgtctgggct

SEQ ID NO: 8248610 - DNA, 23 bp, Homo sapiens
tgctgtccaacagactggccatg

SEQ ID NO: 8248611 - DNA, 22 bp, Homo sapiens
tgctgggtggacttggctctca

SEQ ID NO: 8248612 - DNA, 22 bp, Homo sapiens
tgctggtaccgcgcctccgcca

SEQ ID NO: 8248613 - DNA, 22 bp, Homo sapiens
tgctggtaccgcgcctccgcca

SEQ ID NO: 8248614 - DNA, 22 bp, Homo sapiens
tgctgggttacctaagcctaaa

SEQ ID NO: 8248615 - DNA, 22 bp, Homo sapiens
tgctggtgaggtccttgctgga

SEQ ID NO: 8248616 - DNA, 21 bp, Homo sapiens
tgctggtgagctcatgtggct

SEQ ID NO: 8248617 - DNA, 22 bp, Homo sapiens
tgctggtgaggtccttgctgga

SEQ ID NO: 8248618 - DNA, 22 bp, Homo sapiens
tgctgggctgttcctgtccatg

SEQ ID NO: 8248619 - DNA, 22 bp, Homo sapiens
tgctgggctgttcctgtccatg

SEQ ID NO: 8248620 - DNA, 22 bp, Homo sapiens
tgctgggcttgaaagctgctaa

SEQ ID NO: 8248621 - DNA, 22 bp, Homo sapiens
tgctgggcttgaaagctgctaa

SEQ ID NO: 8248622 - DNA, 22 bp, Homo sapiens
tgctgggcttgaaagctgctaa

SEQ ID NO: 8248623 - DNA, 22 bp, Homo sapiens
tgctgggctggagctgccaggg

SEQ ID NO: 8248624 - DNA, 21 bp, Homo sapiens
tgctgggctgcaggggatgca

SEQ ID NO: 8248625 - DNA, 22 bp, Homo sapiens
tgctgggctagaagctgaggcc

SEQ ID NO: 8248626 - DNA, 22 bp, Homo sapiens
tgctgggctagaagctgaggcc

SEQ ID NO: 8248627 - DNA, 22 bp, Homo sapiens
tgctgggctagaagctgaggcc

SEQ ID NO: 8248628 - DNA, 22 bp, Homo sapiens
tgctgggcctttacctccaggg

SEQ ID NO: 8248629 - DNA, 22 bp, Homo sapiens
tgctgggcctgcccctgtcagc

SEQ ID NO: 8248630 - DNA, 22 bp, Homo sapiens
tgctgggctagggtggagctct

SEQ ID NO: 8248631 - DNA, 22 bp, Homo sapiens
tgctgggctagggtggagctct

SEQ ID NO: 8248632 - DNA, 22 bp, Homo sapiens
tgctgggctcaacctccagagc

SEQ ID NO: 8248633 - DNA, 23 bp, Homo sapiens
tgctgggcagagctggtgctgag

SEQ ID NO: 8248634 - DNA, 23 bp, Homo sapiens
tgctgggcagagctggtgctgag

SEQ ID NO: 8248635 - DNA, 22 bp, Homo sapiens
tgctggcttcctgtgcacagca

SEQ ID NO: 8248636 - DNA, 20 bp, Homo sapiens
tgctgggcatgcagtggaaa

SEQ ID NO: 8248637 - DNA, 20 bp, Homo sapiens
tgctgggcatgcagtggaaa

SEQ ID NO: 8248638 - DNA, 20 bp, Homo sapiens
tgctgggcatgcagtggaaa

SEQ ID NO: 8248639 - DNA, 22 bp, Homo sapiens
tgctgggcatcgtaggaggtac

SEQ ID NO: 8248640 - DNA, 22 bp, Homo sapiens
tgctgggcatcgtaggaggtac

SEQ ID NO: 8248641 - DNA, 22 bp, Homo sapiens
tgctgggcatcgtaggaggtac

SEQ ID NO: 8248642 - DNA, 20 bp, Homo sapiens
tgctgggcatgcagtggaaa

SEQ ID NO: 8248643 - DNA, 18 bp, Homo sapiens
tgctgggcattaggctta

SEQ ID NO: 8248644 - DNA, 22 bp, Homo sapiens
tgctgggcatttatgcagatgg

SEQ ID NO: 8248645 - DNA, 22 bp, Homo sapiens
tgctgggcatttttatggctcc

SEQ ID NO: 8248646 - DNA, 22 bp, Homo sapiens
tgctgggccaaagcagggtttt

SEQ ID NO: 8248647 - DNA, 22 bp, Homo sapiens
tgctgggcccagggagcctctg

SEQ ID NO: 8248648 - DNA, 20 bp, Homo sapiens
tgctgggccatcttgcatgc

SEQ ID NO: 8248649 - DNA, 22 bp, Homo sapiens
tgctgggcccagggagcctctg

SEQ ID NO: 8248650 - DNA, 20 bp, Homo sapiens
tgctgggccatcttgcatgc

SEQ ID NO: 8248651 - DNA, 20 bp, Homo sapiens
tgctgggccatcttgcatgc

SEQ ID NO: 8248652 - DNA, 22 bp, Homo sapiens
tgctgggcccccagtgaccttc

SEQ ID NO: 8248653 - DNA, 22 bp, Homo sapiens
tgctgcttttagttggatagaa

SEQ ID NO: 8248654 - DNA, 20 bp, Homo sapiens
tgctgctttgccactagttg

SEQ ID NO: 8248655 - DNA, 22 bp, Homo sapiens
tgctgctttgatgtgtaaatca

SEQ ID NO: 8248656 - DNA, 22 bp, Homo sapiens
tgctgctttgatgtgtaaatca

SEQ ID NO: 8248657 - DNA, 22 bp, Homo sapiens
tgctgctgtttcctacatctca

SEQ ID NO: 8248658 - DNA, 22 bp, Homo sapiens
tgctgcttcctggtagatagga

SEQ ID NO: 8248659 - DNA, 22 bp, Homo sapiens
tgctgctgttgacggctgtcca

SEQ ID NO: 8248660 - DNA, 22 bp, Homo sapiens
tgctgctgttgacggctgtcca

SEQ ID NO: 8248661 - DNA, 22 bp, Homo sapiens
tgctgctgttgacggctgtcca

SEQ ID NO: 8248662 - DNA, 20 bp, Homo sapiens
tgctgctgtgagcgtccctg

SEQ ID NO: 8248663 - DNA, 20 bp, Homo sapiens
tgctgctgtgagcgtccctg

SEQ ID NO: 8248664 - DNA, 20 bp, Homo sapiens
tgctgctgtgagcgtccctg

SEQ ID NO: 8248665 - DNA, 20 bp, Homo sapiens
tgctgctgtgagcgtccctg

SEQ ID NO: 8248666 - DNA, 22 bp, Homo sapiens
tgctgctgatggatgcctggac

SEQ ID NO: 8248667 - DNA, 22 bp, Homo sapiens
tgctgctgatggatgcctggac

SEQ ID NO: 8248668 - DNA, 22 bp, Homo sapiens
tgctgctgatggcacctaggca

SEQ ID NO: 8248669 - DNA, 20 bp, Homo sapiens
tgctgctgcctccgcctctg

SEQ ID NO: 8248670 - DNA, 20 bp, Homo sapiens
tgctgctgcctccgcctctg

SEQ ID NO: 8248671 - DNA, 22 bp, Homo sapiens
tgctgctgatggcacctaggca

SEQ ID NO: 8248672 - DNA, 22 bp, Homo sapiens
tgctgctgggtttgacagtcac

SEQ ID NO: 8248673 - DNA, 22 bp, Homo sapiens
tgctgctggatcttactcatct

SEQ ID NO: 8248674 - DNA, 22 bp, Homo sapiens
tgctgctgcttctgtacagcct

SEQ ID NO: 8248675 - DNA, 22 bp, Homo sapiens
tgctgctgcttctgtacagcct

SEQ ID NO: 8248676 - DNA, 20 bp, Homo sapiens
tgctgctgcttcacccccat

SEQ ID NO: 8248677 - DNA, 20 bp, Homo sapiens
tgctgctgcttcacccccat

SEQ ID NO: 8248678 - DNA, 22 bp, Homo sapiens
tgctgctgtatccttagtgtca

SEQ ID NO: 8248679 - DNA, 22 bp, Homo sapiens
tgctgctgtatcatgccttcat

SEQ ID NO: 8248680 - DNA, 22 bp, Homo sapiens
tgctgctgtatcatgccttcat

SEQ ID NO: 8248681 - DNA, 22 bp, Homo sapiens
tgctgctgtagctaggctttct

SEQ ID NO: 8248682 - DNA, 22 bp, Homo sapiens
tgctgctgggtttgacagtcac

SEQ ID NO: 8248683 - DNA, 22 bp, Homo sapiens
tgctgctgggtttgacagtcac

SEQ ID NO: 8248684 - DNA, 19 bp, Homo sapiens
tgctgctgtccttgcaggg

SEQ ID NO: 8248685 - DNA, 19 bp, Homo sapiens
tgctgctgtccttgcaggg

SEQ ID NO: 8248686 - DNA, 22 bp, Homo sapiens
tgctgctgtatccttagtgtca

SEQ ID NO: 8248687 - DNA, 22 bp, Homo sapiens
tgctgctgtatccttagtgtca

SEQ ID NO: 8248688 - DNA, 22 bp, Homo sapiens
tgctggaagctcctgcatgtct

SEQ ID NO: 8248689 - DNA, 22 bp, Homo sapiens
tgctggaagggtcggcgtgggc

SEQ ID NO: 8248690 - DNA, 22 bp, Homo sapiens
tgctggagaaagtttttctgaa

SEQ ID NO: 8248691 - DNA, 23 bp, Homo sapiens
tgctggagaagcaaagttctgag

SEQ ID NO: 8248692 - DNA, 23 bp, Homo sapiens
tgctggagaagcaaagttctgag

SEQ ID NO: 8248693 - DNA, 22 bp, Homo sapiens
tgctggagaagctcctgggact

SEQ ID NO: 8248694 - DNA, 22 bp, Homo sapiens
tgctggagaagctcctgggact

SEQ ID NO: 8248695 - DNA, 22 bp, Homo sapiens
tgctggagaaagtttttctgaa

SEQ ID NO: 8248696 - DNA, 22 bp, Homo sapiens
tgctggagaactgctctgtgtt

SEQ ID NO: 8248697 - DNA, 22 bp, Homo sapiens
tgctggagaactgctctgtgtt

SEQ ID NO: 8248698 - DNA, 22 bp, Homo sapiens
tgctggagaactgctctgtgtt

SEQ ID NO: 8248699 - DNA, 23 bp, Homo sapiens
tgctggagaagcaaagttctgag

SEQ ID NO: 8248700 - DNA, 23 bp, Homo sapiens
tgctggagacaagtgtgagaagg

SEQ ID NO: 8248701 - DNA, 22 bp, Homo sapiens
tgctggagcggaggtgagccag

SEQ ID NO: 8248702 - DNA, 22 bp, Homo sapiens
tgctggagcggaggtgagccag

SEQ ID NO: 8248703 - DNA, 22 bp, Homo sapiens
tgctggagctccgggctgtagg

SEQ ID NO: 8248704 - DNA, 22 bp, Homo sapiens
tgctggagctccgggctgtagg

SEQ ID NO: 8248705 - DNA, 21 bp, Homo sapiens
tgctggaggacagggtttcat

SEQ ID NO: 8248706 - DNA, 21 bp, Homo sapiens
tgctggaggacagggtttcat

SEQ ID NO: 8248707 - DNA, 22 bp, Homo sapiens
tgctggaggagaaggttgctca

SEQ ID NO: 8248708 - DNA, 22 bp, Homo sapiens
tgctggaggagaaggttgctca

SEQ ID NO: 8248709 - DNA, 22 bp, Homo sapiens
tgctggaggagaaggttgctca

SEQ ID NO: 8248710 - DNA, 22 bp, Homo sapiens
tgctggaggagaaggttgctca

SEQ ID NO: 8248711 - DNA, 20 bp, Homo sapiens
tgctgcagtttcatgggact

SEQ ID NO: 8248712 - DNA, 22 bp, Homo sapiens
tgctgccaaatgcgagctctgt

SEQ ID NO: 8248713 - DNA, 22 bp, Homo sapiens
tgctgcatttatcttctcaaac

SEQ ID NO: 8248714 - DNA, 17 bp, Homo sapiens
tgctgccaagtcccaac

SEQ ID NO: 8248715 - DNA, 22 bp, Homo sapiens
tgctgccaagcccgtgctcctg

SEQ ID NO: 8248716 - DNA, 22 bp, Homo sapiens
tgctgccaagcccgtgctcctg

SEQ ID NO: 8248717 - DNA, 22 bp, Homo sapiens
tgctgccaaatgcgagctctgt

SEQ ID NO: 8248718 - DNA, 23 bp, Homo sapiens
tgctgccaagcacgagttgagtt

SEQ ID NO: 8248719 - DNA, 22 bp, Homo sapiens
tgctgccaagcccgtgctcctg

SEQ ID NO: 8248720 - DNA, 22 bp, Homo sapiens
tgctgccaatttctggtcttga

SEQ ID NO: 8248721 - DNA, 17 bp, Homo sapiens
tgctgccaagtcccaac

SEQ ID NO: 8248722 - DNA, 17 bp, Homo sapiens
tgctgccaagtcccaac

SEQ ID NO: 8248723 - DNA, 22 bp, Homo sapiens
tgctgccacaaattcagctgcc

SEQ ID NO: 8248724 - DNA, 22 bp, Homo sapiens
tgctgccacaaattcagctgcc

SEQ ID NO: 8248725 - DNA, 22 bp, Homo sapiens
tgctgccacaaattcagctgcc

SEQ ID NO: 8248726 - DNA, 22 bp, Homo sapiens
tgctgccacatttaaagagggg

SEQ ID NO: 8248727 - DNA, 22 bp, Homo sapiens
tgctgccacccctcaccagagc

SEQ ID NO: 8248728 - DNA, 22 bp, Homo sapiens
tgctgccacatttaaagagggg

SEQ ID NO: 8248729 - DNA, 22 bp, Homo sapiens
tgctgccacctggtggctgaag

SEQ ID NO: 8248730 - DNA, 22 bp, Homo sapiens
tgctgccacctggtggctgaag

SEQ ID NO: 8248731 - DNA, 22 bp, Homo sapiens
tgctgccacccctcaccagagc

SEQ ID NO: 8248732 - DNA, 22 bp, Homo sapiens
tgctgccacccctcaccagagc

SEQ ID NO: 8248733 - DNA, 22 bp, Homo sapiens
tgctgccagagagacagggact

SEQ ID NO: 8248734 - DNA, 22 bp, Homo sapiens
tgctgccactggtagtctcatt

SEQ ID NO: 8248735 - DNA, 22 bp, Homo sapiens
tgctgccactggtagtctcatt

SEQ ID NO: 8248736 - DNA, 22 bp, Homo sapiens
tgctgccacctgtggtagtctg

SEQ ID NO: 8248737 - DNA, 22 bp, Homo sapiens
tgctgccacctggtggctgaag

SEQ ID NO: 8248738 - DNA, 22 bp, Homo sapiens
tgctgccacctggtggctgaag

SEQ ID NO: 8248739 - DNA, 22 bp, Homo sapiens
tgctgccagccaggccatggag

SEQ ID NO: 8248740 - DNA, 22 bp, Homo sapiens
tgctgccagccaggccatggag

SEQ ID NO: 8248741 - DNA, 22 bp, Homo sapiens
tgctgccagagagacagggact

SEQ ID NO: 8248742 - DNA, 22 bp, Homo sapiens
tgctgccagccaggccatggag

SEQ ID NO: 8248743 - DNA, 22 bp, Homo sapiens
tgctgccagccaggccatggag

SEQ ID NO: 8248744 - DNA, 22 bp, Homo sapiens
tgctgccagggctctgcccaca

SEQ ID NO: 8248745 - DNA, 22 bp, Homo sapiens
tgctgccagggctctgcccaca

SEQ ID NO: 8248746 - DNA, 22 bp, Homo sapiens
tgctgccagggctctgcccaca

SEQ ID NO: 8248747 - DNA, 22 bp, Homo sapiens
tgctgccaggtcttgctgtcca

SEQ ID NO: 8248748 - DNA, 22 bp, Homo sapiens
tgctgccagggctctgcccaca

SEQ ID NO: 8248749 - DNA, 22 bp, Homo sapiens
tgctgccaggtcttgctgtcca

SEQ ID NO: 8248750 - DNA, 22 bp, Homo sapiens
tgctgccaggtcttgctgtcca

SEQ ID NO: 8248751 - DNA, 21 bp, Homo sapiens
tgctgccatagacctgaggga

SEQ ID NO: 8248752 - DNA, 21 bp, Homo sapiens
tgctgccatagacctgaggga

SEQ ID NO: 8248753 - DNA, 21 bp, Homo sapiens
tgctgccatagacctgaggga

SEQ ID NO: 8248754 - DNA, 22 bp, Homo sapiens
tgctgccatctcaactgccctt

SEQ ID NO: 8248755 - DNA, 21 bp, Homo sapiens
tgctgccatcatgcagagatg

SEQ ID NO: 8248756 - DNA, 21 bp, Homo sapiens
tgctgccatcatgcagagatg

SEQ ID NO: 8248757 - DNA, 21 bp, Homo sapiens
tgctgccatcatgcagagatg

SEQ ID NO: 8248758 - DNA, 22 bp, Homo sapiens
tgctgcctccttcctgccagga

SEQ ID NO: 8248759 - DNA, 22 bp, Homo sapiens
tgctgctccccagcacacagca

SEQ ID NO: 8248760 - DNA, 22 bp, Homo sapiens
tgctgcctctgctgatatggcc

SEQ ID NO: 8248761 - DNA, 22 bp, Homo sapiens
tgctgctcctgcctggctccca

SEQ ID NO: 8248762 - DNA, 22 bp, Homo sapiens
tgctgctctgtaaagtgatgag

SEQ ID NO: 8248763 - DNA, 22 bp, Homo sapiens
tgctgctgaaaaggtgtgctta

SEQ ID NO: 8248764 - DNA, 22 bp, Homo sapiens
tgctgctctcagccaccaggaa

SEQ ID NO: 8248765 - DNA, 22 bp, Homo sapiens
tgctgctcgccacggcccaggg

SEQ ID NO: 8248766 - DNA, 21 bp, Homo sapiens
tgctgctgatcggggttggct

SEQ ID NO: 8248767 - DNA, 22 bp, Homo sapiens
tgctgctgatgcatagtctgct

SEQ ID NO: 8248768 - DNA, 21 bp, Homo sapiens
tgctgctgatcggggttggct

SEQ ID NO: 8248769 - DNA, 21 bp, Homo sapiens
tgctgctgatcggggttggct

SEQ ID NO: 8248770 - DNA, 22 bp, Homo sapiens
tgctgctgatcatttatagtct

SEQ ID NO: 8248771 - DNA, 22 bp, Homo sapiens
tgctgctgacatttggggcttg

SEQ ID NO: 8248772 - DNA, 22 bp, Homo sapiens
tgctgctgatcatttatagtct

SEQ ID NO: 8248773 - DNA, 22 bp, Homo sapiens
tgctgctgaggctaaagtatag

SEQ ID NO: 8248774 - DNA, 22 bp, Homo sapiens
tgctgctgaaaaggtgtgctta

SEQ ID NO: 8248775 - DNA, 22 bp, Homo sapiens
tgctgctgacatttggggcttg

SEQ ID NO: 8248776 - DNA, 22 bp, Homo sapiens
tgctgctgacatttggggcttg

SEQ ID NO: 8248777 - DNA, 22 bp, Homo sapiens
tgctgcctcaactgtcaggaac

SEQ ID NO: 8248778 - DNA, 22 bp, Homo sapiens
tgctgcctccttcctgccagga

SEQ ID NO: 8248779 - DNA, 23 bp, Homo sapiens
tgctgccctgccttcagctctcc

SEQ ID NO: 8248780 - DNA, 23 bp, Homo sapiens
tgctgccctgccttcagctctcc

SEQ ID NO: 8248781 - DNA, 23 bp, Homo sapiens
tgctgcccgcttggcacgctccc

SEQ ID NO: 8248782 - DNA, 23 bp, Homo sapiens
tgctgcccgcttggcacgctccc

SEQ ID NO: 8248783 - DNA, 23 bp, Homo sapiens
tgctgcccactcttccagccctc

SEQ ID NO: 8248784 - DNA, 18 bp, Homo sapiens
tgctgcccaactctcccc

SEQ ID NO: 8248785 - DNA, 22 bp, Homo sapiens
tgctgccatggtcgctggtgtc

SEQ ID NO: 8248786 - DNA, 22 bp, Homo sapiens
tgctgccatggtcgctggtgtc

SEQ ID NO: 8248787 - DNA, 22 bp, Homo sapiens
tgctgccatgcagagcaacaga

SEQ ID NO: 8248788 - DNA, 23 bp, Homo sapiens
tgctggagtttactcaggccagc

SEQ ID NO: 8248789 - DNA, 23 bp, Homo sapiens
tgctggagtttactcaggccagc

SEQ ID NO: 8248790 - DNA, 22 bp, Homo sapiens
tgctggcacatagagactggct

SEQ ID NO: 8248791 - DNA, 22 bp, Homo sapiens
tgctggcaatgctcttgacgtc

SEQ ID NO: 8248792 - DNA, 21 bp, Homo sapiens
tgctggcaagactcaggaata

SEQ ID NO: 8248793 - DNA, 22 bp, Homo sapiens
tgctggcaaggtaggtttcatt

SEQ ID NO: 8248794 - DNA, 22 bp, Homo sapiens
tgctggcaagtcttggaattgt

SEQ ID NO: 8248795 - DNA, 21 bp, Homo sapiens
tgctggcaagactcaggaata

SEQ ID NO: 8248796 - DNA, 21 bp, Homo sapiens
tgctggcaagactcaggaata

SEQ ID NO: 8248797 - DNA, 18 bp, Homo sapiens
tgctggcaactactattg

SEQ ID NO: 8248798 - DNA, 17 bp, Homo sapiens
tgctggcaacatacaaa

SEQ ID NO: 8248799 - DNA, 22 bp, Homo sapiens
tgctggagtggcactgtgtggc

SEQ ID NO: 8248800 - DNA, 22 bp, Homo sapiens
tgctggagtggcactgtgtggc

SEQ ID NO: 8248801 - DNA, 22 bp, Homo sapiens
tgctggagtgcagtggcttaac

SEQ ID NO: 8248802 - DNA, 22 bp, Homo sapiens
tgctggagtgagtggtttctta

SEQ ID NO: 8248803 - DNA, 22 bp, Homo sapiens
tgctggagtgcagtggcttaac

SEQ ID NO: 8248804 - DNA, 22 bp, Homo sapiens
tgctggagtgagattatgagtt

SEQ ID NO: 8248805 - DNA, 22 bp, Homo sapiens
tgctggagtgagattatgagtt

SEQ ID NO: 8248806 - DNA, 22 bp, Homo sapiens
tgctggagtgagtggtttctta

SEQ ID NO: 8248807 - DNA, 22 bp, Homo sapiens
tgctggagtgagtggtttctta

SEQ ID NO: 8248808 - DNA, 22 bp, Homo sapiens
tgctggagtggcactgtgtggc

SEQ ID NO: 8248809 - DNA, 22 bp, Homo sapiens
tgctggagtggcactgtgtggc

SEQ ID NO: 8248810 - DNA, 22 bp, Homo sapiens
tgctggagttcgacattgcaaa

SEQ ID NO: 8248811 - DNA, 22 bp, Homo sapiens
tgctggagttcgacattgcaaa

SEQ ID NO: 8248812 - DNA, 22 bp, Homo sapiens
tgctggagttcgacattgcaaa

SEQ ID NO: 8248813 - DNA, 22 bp, Homo sapiens
tgctggagttcgacattgcaaa

SEQ ID NO: 8248814 - DNA, 22 bp, Homo sapiens
tgctggcatgcatgctgtagga

SEQ ID NO: 8248815 - DNA, 22 bp, Homo sapiens
tgctggcatggtcttggtgaca

SEQ ID NO: 8248816 - DNA, 22 bp, Homo sapiens
tgctggcatggtcttggtgaca

SEQ ID NO: 8248817 - DNA, 22 bp, Homo sapiens
tgctggcatgcatgctgtagga

SEQ ID NO: 8248818 - DNA, 22 bp, Homo sapiens
tgctggcatgcatgctgtagga

SEQ ID NO: 8248819 - DNA, 22 bp, Homo sapiens
tgctggcatgcatgctgtagga

SEQ ID NO: 8248820 - DNA, 22 bp, Homo sapiens
tgctggcatcttaatgttctgt

SEQ ID NO: 8248821 - DNA, 20 bp, Homo sapiens
tgctggcatgcaagagggaa

SEQ ID NO: 8248822 - DNA, 22 bp, Homo sapiens
tgctggcagtggcagtgatggt

SEQ ID NO: 8248823 - DNA, 22 bp, Homo sapiens
tgctggcatactctctttgttg

SEQ ID NO: 8248824 - DNA, 22 bp, Homo sapiens
tgctggcatatgaaaatcctta

SEQ ID NO: 8248825 - DNA, 22 bp, Homo sapiens
tgctggcataccacctagttca

SEQ ID NO: 8248826 - DNA, 22 bp, Homo sapiens
tgctggcaggcacctcctgggg

SEQ ID NO: 8248827 - DNA, 22 bp, Homo sapiens
tgctggcaggcacctcctgggg

SEQ ID NO: 8248828 - DNA, 22 bp, Homo sapiens
tgctggcacgtgactgggaagt

SEQ ID NO: 8248829 - DNA, 22 bp, Homo sapiens
tgctggcagccatgccttggaa

SEQ ID NO: 8248830 - DNA, 22 bp, Homo sapiens
tgctggcagcttctttaaatgt

SEQ ID NO: 8248831 - DNA, 22 bp, Homo sapiens
tgctggcagccccagctttaac

SEQ ID NO: 8248832 - DNA, 22 bp, Homo sapiens
tgctggcaccagaatgactgca

SEQ ID NO: 8248833 - DNA, 22 bp, Homo sapiens
tgctggcaccagaatgactgca

SEQ ID NO: 8248834 - DNA, 22 bp, Homo sapiens
tgctggcaccagaatgactgca

SEQ ID NO: 8248835 - DNA, 22 bp, Homo sapiens
tgctggcacatagagactggct

SEQ ID NO: 8248836 - DNA, 22 bp, Homo sapiens
tgctggcacatagagactggct

SEQ ID NO: 8248837 - DNA, 22 bp, Homo sapiens
tgctggcacatagagactggct

SEQ ID NO: 8248838 - DNA, 22 bp, Homo sapiens
tgctggcaccattttcggacat

SEQ ID NO: 8248839 - DNA, 22 bp, Homo sapiens
tgctggcacgaaagggtgtcca

SEQ ID NO: 8248840 - DNA, 22 bp, Homo sapiens
tgctggcacgaaagggtgtcca

SEQ ID NO: 8248841 - DNA, 22 bp, Homo sapiens
tgctggcagaaggctcgtggaa

SEQ ID NO: 8248842 - DNA, 22 bp, Homo sapiens
tgctggcagaaggctcgtggaa

SEQ ID NO: 8248843 - DNA, 20 bp, Homo sapiens
tgctggcacgggtggactcc

SEQ ID NO: 8248844 - DNA, 20 bp, Homo sapiens
tgctggcacgggtggactcc

SEQ ID NO: 8248845 - DNA, 22 bp, Homo sapiens
tgctggcacgtggaccaggaga

SEQ ID NO: 8248846 - DNA, 22 bp, Homo sapiens
tgctggcacgtgactgggaagt

SEQ ID NO: 8248847 - DNA, 22 bp, Homo sapiens
tgctggaggccgagaagcagca

SEQ ID NO: 8248848 - DNA, 22 bp, Homo sapiens
tgctggaggccgagaagcagca

SEQ ID NO: 8248849 - DNA, 22 bp, Homo sapiens
tgctggaggccagaagtctgag

SEQ ID NO: 8248850 - DNA, 22 bp, Homo sapiens
tgctggaggccgagaagcagca

SEQ ID NO: 8248851 - DNA, 22 bp, Homo sapiens
tgctggaggccgagaagcagca

SEQ ID NO: 8248852 - DNA, 22 bp, Homo sapiens
tgctggaggcctgactgtgttt

SEQ ID NO: 8248853 - DNA, 22 bp, Homo sapiens
tgctggaggcctgactgtgttt

SEQ ID NO: 8248854 - DNA, 20 bp, Homo sapiens
tgctggaggcgccggcgctc

SEQ ID NO: 8248855 - DNA, 17 bp, Homo sapiens
tgctggaggcggggtat

SEQ ID NO: 8248856 - DNA, 22 bp, Homo sapiens
tgctggaggcagtggaggtgcc

SEQ ID NO: 8248857 - DNA, 22 bp, Homo sapiens
tgctggaggccagaagtctgag

SEQ ID NO: 8248858 - DNA, 22 bp, Homo sapiens
tgctggaggcagtggaggtgcc

SEQ ID NO: 8248859 - DNA, 22 bp, Homo sapiens
tgctggaggattaaacaagtca

SEQ ID NO: 8248860 - DNA, 22 bp, Homo sapiens
tgctggaggcagtggaggtgcc

SEQ ID NO: 8248861 - DNA, 22 bp, Homo sapiens
tgctggaggagtttactgtggc

SEQ ID NO: 8248862 - DNA, 22 bp, Homo sapiens
tgctggaggagaaggttgctca

SEQ ID NO: 8248863 - DNA, 22 bp, Homo sapiens
tgctggaggattaaacaagtca

SEQ ID NO: 8248864 - DNA, 22 bp, Homo sapiens
tgctggaggagtttactgtggc

SEQ ID NO: 8248865 - DNA, 22 bp, Homo sapiens
tgctggagtgagattatgagtt

SEQ ID NO: 8248866 - DNA, 19 bp, Homo sapiens
tgctggagtgacattctga

SEQ ID NO: 8248867 - DNA, 19 bp, Homo sapiens
tgctggagtgacattctga

SEQ ID NO: 8248868 - DNA, 22 bp, Homo sapiens
tgctggagtaacaagacactca

SEQ ID NO: 8248869 - DNA, 22 bp, Homo sapiens
tgctggagtaacaagacactca

SEQ ID NO: 8248870 - DNA, 22 bp, Homo sapiens
tgctggagtctcttgaccctgg

SEQ ID NO: 8248871 - DNA, 22 bp, Homo sapiens
tgctggagtctcttgaccctgg

SEQ ID NO: 8248872 - DNA, 22 bp, Homo sapiens
tgctggagtaacaagacactca

SEQ ID NO: 8248873 - DNA, 19 bp, Homo sapiens
tgctggaggttgacagggt

SEQ ID NO: 8248874 - DNA, 19 bp, Homo sapiens
tgctggaggttgacagggt

SEQ ID NO: 8248875 - DNA, 22 bp, Homo sapiens
tgctggagtaacaagacactca

SEQ ID NO: 8248876 - DNA, 19 bp, Homo sapiens
tgctggaggttgacagggt

SEQ ID NO: 8248877 - DNA, 19 bp, Homo sapiens
tgctggaggttgacagggt

SEQ ID NO: 8248878 - DNA, 19 bp, Homo sapiens
tgctggagggtagtgagtc

SEQ ID NO: 8248879 - DNA, 22 bp, Homo sapiens
tgctggaggggcctgaccagga

SEQ ID NO: 8248880 - DNA, 22 bp, Homo sapiens
tgctggaggggcctgaccagga

SEQ ID NO: 8248881 - DNA, 22 bp, Homo sapiens
tgctggaggggcctgaccagga

SEQ ID NO: 8248882 - DNA, 22 bp, Homo sapiens
tgctggagggggtaccactcaa

SEQ ID NO: 8248883 - DNA, 22 bp, Homo sapiens
tgctggaggggcctgaccagga

SEQ ID NO: 8248884 - DNA, 17 bp, Homo sapiens
tgctggaggcggggtat

SEQ ID NO: 8248885 - DNA, 17 bp, Homo sapiens
tgctggaggcggggtat

SEQ ID NO: 8248886 - DNA, 22 bp, Homo sapiens
tgctggaggggatgccttcact

SEQ ID NO: 8248887 - DNA, 22 bp, Homo sapiens
tgctggaggggatgccttcact

SEQ ID NO: 8248888 - DNA, 22 bp, Homo sapiens
tgctggctgtgtaccatctcaa

SEQ ID NO: 8248889 - DNA, 22 bp, Homo sapiens
tgctggctgtccctacctggct

SEQ ID NO: 8248890 - DNA, 22 bp, Homo sapiens
tgctggctgtgtaccatctcaa

SEQ ID NO: 8248891 - DNA, 22 bp, Homo sapiens
tgctggctgtccctacctggct

SEQ ID NO: 8248892 - DNA, 22 bp, Homo sapiens
tgctggctgtccctacctggct

SEQ ID NO: 8248893 - DNA, 23 bp, Homo sapiens
tgctggctgtgttattgccaaca

SEQ ID NO: 8248894 - DNA, 23 bp, Homo sapiens
tgctggctgtgttattgccaaca

SEQ ID NO: 8248895 - DNA, 22 bp, Homo sapiens
tgctggcttcctgtgcacagca

SEQ ID NO: 8248896 - DNA, 23 bp, Homo sapiens
tgctggcttccagctgctccctc

SEQ ID NO: 8248897 - DNA, 22 bp, Homo sapiens
tgctggcttatttagtaaatgt

SEQ ID NO: 8248898 - DNA, 22 bp, Homo sapiens
tgctggcttatttagtaaatgt

SEQ ID NO: 8248899 - DNA, 22 bp, Homo sapiens
tgctggcttagatatcactgcc

SEQ ID NO: 8248900 - DNA, 22 bp, Homo sapiens
tgctggctgttctagggaggcc

SEQ ID NO: 8248901 - DNA, 22 bp, Homo sapiens
tgctggctgttctagggaggcc

SEQ ID NO: 8248902 - DNA, 22 bp, Homo sapiens
tgctggctgggctgctggagac

SEQ ID NO: 8248903 - DNA, 22 bp, Homo sapiens
tgctggctggcctggcctggac

SEQ ID NO: 8248904 - DNA, 22 bp, Homo sapiens
tgctggctggcctggcctggac

SEQ ID NO: 8248905 - DNA, 22 bp, Homo sapiens
tgctggctggatcagagattgg

SEQ ID NO: 8248906 - DNA, 22 bp, Homo sapiens
tgctggctgggctgctggagac

SEQ ID NO: 8248907 - DNA, 22 bp, Homo sapiens
tgctggctgcagtgctgtcaaa

SEQ ID NO: 8248908 - DNA, 22 bp, Homo sapiens
tgctggctgccaggttccctgt

SEQ ID NO: 8248909 - DNA, 22 bp, Homo sapiens
tgctggctggagtgcctctgga

SEQ ID NO: 8248910 - DNA, 22 bp, Homo sapiens
tgctggctggagtgcctctgga

SEQ ID NO: 8248911 - DNA, 22 bp, Homo sapiens
tgctggctgccaggttccctgt

SEQ ID NO: 8248912 - DNA, 22 bp, Homo sapiens
tgctggctggatcagagattgg

SEQ ID NO: 8248913 - DNA, 22 bp, Homo sapiens
tgctggctggatcagagattgg

SEQ ID NO: 8248914 - DNA, 22 bp, Homo sapiens
tgctggctctaggctgagacag

SEQ ID NO: 8248915 - DNA, 22 bp, Homo sapiens
tgctggctctgggccaagcagg

SEQ ID NO: 8248916 - DNA, 22 bp, Homo sapiens
tgctggctctaggctgagacag

SEQ ID NO: 8248917 - DNA, 22 bp, Homo sapiens
tgctggctcctcgaggcttcgt

SEQ ID NO: 8248918 - DNA, 22 bp, Homo sapiens
tgctggctcctcgaggcttcgt

SEQ ID NO: 8248919 - DNA, 22 bp, Homo sapiens
tgctggctcctcgaggcttcgt

SEQ ID NO: 8248920 - DNA, 22 bp, Homo sapiens
tgctggctcctcgaggcttcgt

SEQ ID NO: 8248921 - DNA, 22 bp, Homo sapiens
tgctggctcccaggagccgctg

SEQ ID NO: 8248922 - DNA, 21 bp, Homo sapiens
tgctggctgaaaggcacagag

SEQ ID NO: 8248923 - DNA, 21 bp, Homo sapiens
tgctggctgaaaggcacagag

SEQ ID NO: 8248924 - DNA, 22 bp, Homo sapiens
tgctggctgaggcctgagcggg

SEQ ID NO: 8248925 - DNA, 23 bp, Homo sapiens
tgctggctgaaacagccaaagga

SEQ ID NO: 8248926 - DNA, 22 bp, Homo sapiens
tgctggctcagtttgcagactc

SEQ ID NO: 8248927 - DNA, 22 bp, Homo sapiens
tgctggctatttaaagaagaaa

SEQ ID NO: 8248928 - DNA, 22 bp, Homo sapiens
tgctggctatttaaagaagaaa

SEQ ID NO: 8248929 - DNA, 22 bp, Homo sapiens
tgctggctcagtttgcagactc

SEQ ID NO: 8248930 - DNA, 22 bp, Homo sapiens
tgctggctcagtttgcagactc

SEQ ID NO: 8248931 - DNA, 22 bp, Homo sapiens
tgctggctccaacctggcatct

SEQ ID NO: 8248932 - DNA, 22 bp, Homo sapiens
tgctggctccaacctggcatct

SEQ ID NO: 8248933 - DNA, 22 bp, Homo sapiens
tgctggctccaacctggcatct

SEQ ID NO: 8248934 - DNA, 22 bp, Homo sapiens
tgctggccaacaaggctccaag

SEQ ID NO: 8248935 - DNA, 22 bp, Homo sapiens
tgctggctactgatggcaggcc

SEQ ID NO: 8248936 - DNA, 22 bp, Homo sapiens
tgctggctactgatggcaggcc

SEQ ID NO: 8248937 - DNA, 22 bp, Homo sapiens
tgctggccaagcagaggtcaat

SEQ ID NO: 8248938 - DNA, 22 bp, Homo sapiens
tgctggcatttcaggactcacc

SEQ ID NO: 8248939 - DNA, 22 bp, Homo sapiens
tgctggcattgcataggcagtt

SEQ ID NO: 8248940 - DNA, 22 bp, Homo sapiens
tgctggcattgcataggcagtt

SEQ ID NO: 8248941 - DNA, 22 bp, Homo sapiens
tgctggcattgcataggcagtt

SEQ ID NO: 8248942 - DNA, 21 bp, Homo sapiens
tgctggcattaccacaaaccc

SEQ ID NO: 8248943 - DNA, 22 bp, Homo sapiens
tgctggcatttcaggactcacc

SEQ ID NO: 8248944 - DNA, 22 bp, Homo sapiens
tgcctgtgatcagctgagttca

SEQ ID NO: 8248945 - DNA, 22 bp, Homo sapiens
tgcctgtgaaaaccctggggtt

SEQ ID NO: 8248946 - DNA, 22 bp, Homo sapiens
tgcctgtctttcctccctcgta

SEQ ID NO: 8248947 - DNA, 22 bp, Homo sapiens
tgcctgtcttggagtcctggcc

SEQ ID NO: 8248948 - DNA, 22 bp, Homo sapiens
tgcctgtctttcctccctcgta

SEQ ID NO: 8248949 - DNA, 22 bp, Homo sapiens
tgcctgtctttcctccctcgta

SEQ ID NO: 8248950 - DNA, 22 bp, Homo sapiens
tgcctgtcttcaggagtgtcac

SEQ ID NO: 8248951 - DNA, 22 bp, Homo sapiens
tgcctgtcttggagtcctggcc

SEQ ID NO: 8248952 - DNA, 22 bp, Homo sapiens
tgcctgtcttggagtcctggcc

SEQ ID NO: 8248953 - DNA, 22 bp, Homo sapiens
tgcctgtcttaatatctggaaa

SEQ ID NO: 8248954 - DNA, 22 bp, Homo sapiens
tgcctgtcttcaggagtgtcac

SEQ ID NO: 8248955 - DNA, 22 bp, Homo sapiens
tgcctgtcttcaggagtgtcac

SEQ ID NO: 8248956 - DNA, 22 bp, Homo sapiens
tgcctgtctctgactgccatta

SEQ ID NO: 8248957 - DNA, 22 bp, Homo sapiens
tgcctgtctctgactgccatta

SEQ ID NO: 8248958 - DNA, 22 bp, Homo sapiens
tgcctgtctcctctgcagggtg

SEQ ID NO: 8248959 - DNA, 19 bp, Homo sapiens
tgcctgtcagtagatctca

SEQ ID NO: 8248960 - DNA, 22 bp, Homo sapiens
tgcctgtcctgaggatgagggt

SEQ ID NO: 8248961 - DNA, 22 bp, Homo sapiens
tgcctgggttcccaccccaaag

SEQ ID NO: 8248962 - DNA, 22 bp, Homo sapiens
tgcctgggttcccaccccaaag

SEQ ID NO: 8248963 - DNA, 22 bp, Homo sapiens
tgcctgggtgtaaagggccaac

SEQ ID NO: 8248964 - DNA, 22 bp, Homo sapiens
tgcctgggtgtaaagggccaac

SEQ ID NO: 8248965 - DNA, 22 bp, Homo sapiens
tgcctgggtgtaaagggccaac

SEQ ID NO: 8248966 - DNA, 22 bp, Homo sapiens
tgcctgtaataatgctaagcac

SEQ ID NO: 8248967 - DNA, 22 bp, Homo sapiens
tgcctggtatttgaataaagag

SEQ ID NO: 8248968 - DNA, 22 bp, Homo sapiens
tgcctgtcagggggagtgggaa

SEQ ID NO: 8248969 - DNA, 22 bp, Homo sapiens
tgcctgggttgactcttagctg

SEQ ID NO: 8248970 - DNA, 22 bp, Homo sapiens
tgcctgggttgactcttagctg

SEQ ID NO: 8248971 - DNA, 22 bp, Homo sapiens
tgcctgggtgctggctggtcac

SEQ ID NO: 8248972 - DNA, 22 bp, Homo sapiens
tgcctgggtgccctctgctcct

SEQ ID NO: 8248973 - DNA, 22 bp, Homo sapiens
tgcctgggtgccctctgctcct

SEQ ID NO: 8248974 - DNA, 22 bp, Homo sapiens
tgcctgggtgccctctgctcct

SEQ ID NO: 8248975 - DNA, 22 bp, Homo sapiens
tgcctgggtgccctctgctcct

SEQ ID NO: 8248976 - DNA, 22 bp, Homo sapiens
tgcctgggtgtaaagggccaac

SEQ ID NO: 8248977 - DNA, 22 bp, Homo sapiens
tgcctgggtgtaaagggccaac

SEQ ID NO: 8248978 - DNA, 22 bp, Homo sapiens
tgcctgggtgtaaagggccaac

SEQ ID NO: 8248979 - DNA, 22 bp, Homo sapiens
tgcctgggaaccaatcctggct

SEQ ID NO: 8248980 - DNA, 22 bp, Homo sapiens
tgcctgggaaccaatcctggct

SEQ ID NO: 8248981 - DNA, 22 bp, Homo sapiens
tgcctgggaaccaatcctggct

SEQ ID NO: 8248982 - DNA, 22 bp, Homo sapiens
tgcctgggaaccaatcctggct

SEQ ID NO: 8248983 - DNA, 22 bp, Homo sapiens
tgcctggctgggctgctcatgg

SEQ ID NO: 8248984 - DNA, 22 bp, Homo sapiens
tgcctgggctcggtagccatcg

SEQ ID NO: 8248985 - DNA, 22 bp, Homo sapiens
tgcctgggctcggtagccatcg

SEQ ID NO: 8248986 - DNA, 22 bp, Homo sapiens
tgcctggggattgctctgggcc

SEQ ID NO: 8248987 - DNA, 22 bp, Homo sapiens
tgcctggggattgctctgggcc

SEQ ID NO: 8248988 - DNA, 22 bp, Homo sapiens
tgcctggggattgctctgggcc

SEQ ID NO: 8248989 - DNA, 22 bp, Homo sapiens
tgcctgggggactaaggccaaa

SEQ ID NO: 8248990 - DNA, 22 bp, Homo sapiens
tgcctgggggactaaggccaaa

SEQ ID NO: 8248991 - DNA, 22 bp, Homo sapiens
tgcctggggttggcaaactgct

SEQ ID NO: 8248992 - DNA, 22 bp, Homo sapiens
tgcctgggtccaggccaagcct

SEQ ID NO: 8248993 - DNA, 22 bp, Homo sapiens
tgcctgggtccaggccaagcct

SEQ ID NO: 8248994 - DNA, 22 bp, Homo sapiens
tgcctggctgggctgctcatgg

SEQ ID NO: 8248995 - DNA, 22 bp, Homo sapiens
tgcctggctgaggtgacaggtt

SEQ ID NO: 8248996 - DNA, 22 bp, Homo sapiens
tgcctggctctatcagtggtgg

SEQ ID NO: 8248997 - DNA, 22 bp, Homo sapiens
tgcctggctctatcagtggtgg

SEQ ID NO: 8248998 - DNA, 22 bp, Homo sapiens
tgcctggccagaccctatagag

SEQ ID NO: 8248999 - DNA, 22 bp, Homo sapiens
tgcctggccctgacagccctgg

SEQ ID NO: 8249000 - DNA, 22 bp, Homo sapiens
tgcctggccctgacagccctgg

SEQ ID NO: 8249001 - DNA, 20 bp, Homo sapiens
tgcctggcctttctctgccc

SEQ ID NO: 8249002 - DNA, 22 bp, Homo sapiens
tgcctggccctgacagccctgg

SEQ ID NO: 8249003 - DNA, 19 bp, Homo sapiens
tgcctgtggcgagcatctt

SEQ ID NO: 8249004 - DNA, 19 bp, Homo sapiens
tgcctgtggcgagcatctt

SEQ ID NO: 8249005 - DNA, 19 bp, Homo sapiens
tgcctgtggcgagcatctt

SEQ ID NO: 8249006 - DNA, 22 bp, Homo sapiens
tgcctgtgtatgtgcatgcaca

SEQ ID NO: 8249007 - DNA, 22 bp, Homo sapiens
tgcctgtgggtgccaccaccct

SEQ ID NO: 8249008 - DNA, 22 bp, Homo sapiens
tgcctgtggttccagttttttc

SEQ ID NO: 8249009 - DNA, 22 bp, Homo sapiens
tgcctgtgggtgccaccaccct

SEQ ID NO: 8249010 - DNA, 22 bp, Homo sapiens
tgcctgtgtatttccggcctgc

SEQ ID NO: 8249011 - DNA, 22 bp, Homo sapiens
tgcctgtgtcacagtgatgttt

SEQ ID NO: 8249012 - DNA, 22 bp, Homo sapiens
tgcctgtgtcacagtgatgttt

SEQ ID NO: 8249013 - DNA, 22 bp, Homo sapiens
tgcctgtgtccccttcttggca

SEQ ID NO: 8249014 - DNA, 22 bp, Homo sapiens
tgcctgtgtgaccacgggcaag

SEQ ID NO: 8249015 - DNA, 22 bp, Homo sapiens
tgcctgtgtccccttcttggca

SEQ ID NO: 8249016 - DNA, 22 bp, Homo sapiens
tgccttgacagttgtaagacct

SEQ ID NO: 8249017 - DNA, 20 bp, Homo sapiens
tgccttggagcagccaaggt

SEQ ID NO: 8249018 - DNA, 22 bp, Homo sapiens
tgccttgcttcaatcaaaccgt

SEQ ID NO: 8249019 - DNA, 22 bp, Homo sapiens
tgccttgcgggcgtttctgttg

SEQ ID NO: 8249020 - DNA, 22 bp, Homo sapiens
tgccttggattgcagggaacct

SEQ ID NO: 8249021 - DNA, 22 bp, Homo sapiens
tgccttggattgcagggaacct

SEQ ID NO: 8249022 - DNA, 22 bp, Homo sapiens
tgccttggaggaatgatgagag

SEQ ID NO: 8249023 - DNA, 20 bp, Homo sapiens
tgccttgggacagtgcctgt

SEQ ID NO: 8249024 - DNA, 22 bp, Homo sapiens
tgccttgggagccagcatgcca

SEQ ID NO: 8249025 - DNA, 22 bp, Homo sapiens
tgccttggtggcagtctgcggt

SEQ ID NO: 8249026 - DNA, 22 bp, Homo sapiens
tgccttggttctctacttggag

SEQ ID NO: 8249027 - DNA, 22 bp, Homo sapiens
tgccttggtgcttcttcatgtg

SEQ ID NO: 8249028 - DNA, 22 bp, Homo sapiens
tgccttggtgcttcttcatgtg

SEQ ID NO: 8249029 - DNA, 22 bp, Homo sapiens
tgccttgggatatatggacact

SEQ ID NO: 8249030 - DNA, 22 bp, Homo sapiens
tgcctttaacaagatctccaga

SEQ ID NO: 8249031 - DNA, 22 bp, Homo sapiens
tgccttggtttccccatctgta

SEQ ID NO: 8249032 - DNA, 22 bp, Homo sapiens
tgccttggtttccccatctgta

SEQ ID NO: 8249033 - DNA, 22 bp, Homo sapiens
tgccttgtccttcgtcagggct

SEQ ID NO: 8249034 - DNA, 22 bp, Homo sapiens
tgcgagcccagccagctctctg

SEQ ID NO: 8249035 - DNA, 22 bp, Homo sapiens
tgcgatgcaacagcttggcgga

SEQ ID NO: 8249036 - DNA, 22 bp, Homo sapiens
tgcgatgcaacagcttggcgga

SEQ ID NO: 8249037 - DNA, 22 bp, Homo sapiens
tgcgatgcaacagcttggcgga

SEQ ID NO: 8249038 - DNA, 22 bp, Homo sapiens
tgcgaccctagccccctcactt

SEQ ID NO: 8249039 - DNA, 22 bp, Homo sapiens
tgcgagagtggaaaggaagcct

SEQ ID NO: 8249040 - DNA, 22 bp, Homo sapiens
tgccttttagtgctcaataaag

SEQ ID NO: 8249041 - DNA, 20 bp, Homo sapiens
tgccttttatacctttaaac

SEQ ID NO: 8249042 - DNA, 22 bp, Homo sapiens
tgccttttccagttcctagaag

SEQ ID NO: 8249043 - DNA, 22 bp, Homo sapiens
tgcggggagagaggtccaggat

SEQ ID NO: 8249044 - DNA, 22 bp, Homo sapiens
tgcgggttggtggcatatgcag

SEQ ID NO: 8249045 - DNA, 22 bp, Homo sapiens
tgcgtctggagtggagtttgaa

SEQ ID NO: 8249046 - DNA, 20 bp, Homo sapiens
tgcgtacctggaagaagata

SEQ ID NO: 8249047 - DNA, 20 bp, Homo sapiens
tgcgtgtgtatttattttct

SEQ ID NO: 8249048 - DNA, 21 bp, Homo sapiens
tgcgtgtgcatggccttcggg

SEQ ID NO: 8249049 - DNA, 22 bp, Homo sapiens
tgctaaataacttacatagtgg

SEQ ID NO: 8249050 - DNA, 22 bp, Homo sapiens
tgctaaacaatgtacagtgtat

SEQ ID NO: 8249051 - DNA, 22 bp, Homo sapiens
tgctaaattcattattgattta

SEQ ID NO: 8249052 - DNA, 22 bp, Homo sapiens
tgctaaataagtggaatagaca

SEQ ID NO: 8249053 - DNA, 22 bp, Homo sapiens
tgcggggccctcccgtgcactg

SEQ ID NO: 8249054 - DNA, 22 bp, Homo sapiens
tgcggcaggagaaggtgttatg

SEQ ID NO: 8249055 - DNA, 22 bp, Homo sapiens
tgcggatggattaggagagccc

SEQ ID NO: 8249056 - DNA, 22 bp, Homo sapiens
tgcggcagccaccgcgtggccc

SEQ ID NO: 8249057 - DNA, 22 bp, Homo sapiens
tgcgctggtggcggataagggt

SEQ ID NO: 8249058 - DNA, 22 bp, Homo sapiens
tgcgctgtggcagggcaggatg

SEQ ID NO: 8249059 - DNA, 22 bp, Homo sapiens
tgcgcctgtaagtccagagtcc

SEQ ID NO: 8249060 - DNA, 22 bp, Homo sapiens
tgcgcaggagctctgccaggag

SEQ ID NO: 8249061 - DNA, 22 bp, Homo sapiens
tgcgccatgtgctctcggccct

SEQ ID NO: 8249062 - DNA, 22 bp, Homo sapiens
tgctatttggcacttttgacct

SEQ ID NO: 8249063 - DNA, 22 bp, Homo sapiens
tgctatttggcacttttgacct

SEQ ID NO: 8249064 - DNA, 22 bp, Homo sapiens
tgctatttgggggctacatgat

SEQ ID NO: 8249065 - DNA, 19 bp, Homo sapiens
tgctatttgaagaagtgta

SEQ ID NO: 8249066 - DNA, 22 bp, Homo sapiens
tgctattttagacatactttgt

SEQ ID NO: 8249067 - DNA, 22 bp, Homo sapiens
tgctatttgtgtaatggtaaat

SEQ ID NO: 8249068 - DNA, 22 bp, Homo sapiens
tgctattttagacatactttgt

SEQ ID NO: 8249069 - DNA, 22 bp, Homo sapiens
tgctatttgtgagtgtcttcgt

SEQ ID NO: 8249070 - DNA, 22 bp, Homo sapiens
tgctattttggtctacagcact

SEQ ID NO: 8249071 - DNA, 22 bp, Homo sapiens
tgctatttttatcttgatcaaa

SEQ ID NO: 8249072 - DNA, 22 bp, Homo sapiens
tgctatttttatcttgatcaaa

SEQ ID NO: 8249073 - DNA, 22 bp, Homo sapiens
tgctataagctccacgctgtag

SEQ ID NO: 8249074 - DNA, 22 bp, Homo sapiens
tgctagtgtgtgagatgttcaa

SEQ ID NO: 8249075 - DNA, 22 bp, Homo sapiens
tgctatataatggaatttctaa

SEQ ID NO: 8249076 - DNA, 22 bp, Homo sapiens
tgctatctctatatccatttat

SEQ ID NO: 8249077 - DNA, 22 bp, Homo sapiens
tgctatggaaaacagaatggca

SEQ ID NO: 8249078 - DNA, 22 bp, Homo sapiens
tgctatataatggaatttctaa

SEQ ID NO: 8249079 - DNA, 22 bp, Homo sapiens
tgctatataatggaatttctaa

SEQ ID NO: 8249080 - DNA, 22 bp, Homo sapiens
tgctatttaacttttatgtgta

SEQ ID NO: 8249081 - DNA, 21 bp, Homo sapiens
tgctatttaatttttctgttc

SEQ ID NO: 8249082 - DNA, 21 bp, Homo sapiens
tgctatttaatttttctgttc

SEQ ID NO: 8249083 - DNA, 22 bp, Homo sapiens
tgctatttaacttttatgtgta

SEQ ID NO: 8249084 - DNA, 22 bp, Homo sapiens
tgctatgtccagcacagagtgg

SEQ ID NO: 8249085 - DNA, 22 bp, Homo sapiens
tgctcagcagtcaaggtcatag

SEQ ID NO: 8249086 - DNA, 22 bp, Homo sapiens
tgctcagcagtcaaggtcatag

SEQ ID NO: 8249087 - DNA, 22 bp, Homo sapiens
tgctcagcacagaccaggccag

SEQ ID NO: 8249088 - DNA, 22 bp, Homo sapiens
tgctcagcacagaccaggccag

SEQ ID NO: 8249089 - DNA, 22 bp, Homo sapiens
tgctcagcaaaaagcttgtgag

SEQ ID NO: 8249090 - DNA, 22 bp, Homo sapiens
tgctcagcaaaaagcttgtgag

SEQ ID NO: 8249091 - DNA, 21 bp, Homo sapiens
tgctcagattctccatctgga

SEQ ID NO: 8249092 - DNA, 21 bp, Homo sapiens
tgctcagattctccatctgga

SEQ ID NO: 8249093 - DNA, 22 bp, Homo sapiens
tgctcagccgtgagcagagccg

SEQ ID NO: 8249094 - DNA, 22 bp, Homo sapiens
tgctcagccgtgagcagagccg

SEQ ID NO: 8249095 - DNA, 22 bp, Homo sapiens
tgctcagccgtgagcagagccg

SEQ ID NO: 8249096 - DNA, 22 bp, Homo sapiens
tgctcagcgccaaagctgatgg

SEQ ID NO: 8249097 - DNA, 22 bp, Homo sapiens
tgctcagctggtgccagggtcc

SEQ ID NO: 8249098 - DNA, 22 bp, Homo sapiens
tgctcagctggtgccagggtcc

SEQ ID NO: 8249099 - DNA, 22 bp, Homo sapiens
tgctcagctgctctgtattctt

SEQ ID NO: 8249100 - DNA, 22 bp, Homo sapiens
tgctcagacttaagaagatcag

SEQ ID NO: 8249101 - DNA, 22 bp, Homo sapiens
tgctcagacaagctgaacagta

SEQ ID NO: 8249102 - DNA, 22 bp, Homo sapiens
tgctcagaattgcgctggtgga

SEQ ID NO: 8249103 - DNA, 22 bp, Homo sapiens
tgctcagacaagctgaacagta

SEQ ID NO: 8249104 - DNA, 22 bp, Homo sapiens
tgctcagacaagctgaacagta

SEQ ID NO: 8249105 - DNA, 22 bp, Homo sapiens
tgctcagagctccagctctcct

SEQ ID NO: 8249106 - DNA, 22 bp, Homo sapiens
tgctcagagctctggtgcaggt

SEQ ID NO: 8249107 - DNA, 18 bp, Homo sapiens
tgctcagagaaatcaagg

SEQ ID NO: 8249108 - DNA, 18 bp, Homo sapiens
tgctcagagaaatcaagg

SEQ ID NO: 8249109 - DNA, 22 bp, Homo sapiens
tgctcacagcccagaacataat

SEQ ID NO: 8249110 - DNA, 21 bp, Homo sapiens
tgctcacagatgtgctcagtg

SEQ ID NO: 8249111 - DNA, 22 bp, Homo sapiens
tgctcaagtgtttgttgaatgg

SEQ ID NO: 8249112 - DNA, 17 bp, Homo sapiens
tgctcaaatacttttga

SEQ ID NO: 8249113 - DNA, 22 bp, Homo sapiens
tgctcaaatgtggacaactgat

SEQ ID NO: 8249114 - DNA, 22 bp, Homo sapiens
tgctcacaggtgaccctgggca

SEQ ID NO: 8249115 - DNA, 22 bp, Homo sapiens
tgctcactctattcacagtgcc

SEQ ID NO: 8249116 - DNA, 22 bp, Homo sapiens
tgctcagaaacgaggtgcagcc

SEQ ID NO: 8249117 - DNA, 22 bp, Homo sapiens
tgctcactgaactcttgctgtc

SEQ ID NO: 8249118 - DNA, 22 bp, Homo sapiens
tgctcagaacatgattcaggcg

SEQ ID NO: 8249119 - DNA, 22 bp, Homo sapiens
tgctcagaactgtgaatacatg

SEQ ID NO: 8249120 - DNA, 22 bp, Homo sapiens
tgctcagaactgtgaatacatg

SEQ ID NO: 8249121 - DNA, 22 bp, Homo sapiens
tgctccagcaccaagagctcca

SEQ ID NO: 8249122 - DNA, 22 bp, Homo sapiens
tgctccagcaccaagagctcca

SEQ ID NO: 8249123 - DNA, 22 bp, Homo sapiens
tgctccagcaacaggcttagct

SEQ ID NO: 8249124 - DNA, 22 bp, Homo sapiens
tgctccagcaacaggcttagct

SEQ ID NO: 8249125 - DNA, 22 bp, Homo sapiens
tgctccagcaacaggcttagct

SEQ ID NO: 8249126 - DNA, 22 bp, Homo sapiens
tgctccagcaacaggcttagct

SEQ ID NO: 8249127 - DNA, 22 bp, Homo sapiens
tgctccagaacctgaccatgct

SEQ ID NO: 8249128 - DNA, 22 bp, Homo sapiens
tgctccagaacctgaccatgct

SEQ ID NO: 8249129 - DNA, 22 bp, Homo sapiens
tgctccacttgggcacccccca

SEQ ID NO: 8249130 - DNA, 22 bp, Homo sapiens
tgctccagaaaaacttgagact

SEQ ID NO: 8249131 - DNA, 22 bp, Homo sapiens
tgctcattggcgatctgaggga

SEQ ID NO: 8249132 - DNA, 22 bp, Homo sapiens
tgctcattggcgatctgaggga

SEQ ID NO: 8249133 - DNA, 22 bp, Homo sapiens
tgctcattggcgatctgaggga

SEQ ID NO: 8249134 - DNA, 22 bp, Homo sapiens
tgctcattggcgatctgaggga

SEQ ID NO: 8249135 - DNA, 22 bp, Homo sapiens
tgctcattggcgatctgaggga

SEQ ID NO: 8249136 - DNA, 22 bp, Homo sapiens
tgctcattggcgatctgaggga

SEQ ID NO: 8249137 - DNA, 22 bp, Homo sapiens
tgctccactaagccatcccatt

SEQ ID NO: 8249138 - DNA, 22 bp, Homo sapiens
tgctccactcccaattgcatgt

SEQ ID NO: 8249139 - DNA, 22 bp, Homo sapiens
tgctccaccctcacactcttcc

SEQ ID NO: 8249140 - DNA, 18 bp, Homo sapiens
tgctcagctggtgctgaa

SEQ ID NO: 8249141 - DNA, 22 bp, Homo sapiens
tgctcagcttcagaggatcccc

SEQ ID NO: 8249142 - DNA, 22 bp, Homo sapiens
tgctcagtagcagtgtgctgct

SEQ ID NO: 8249143 - DNA, 21 bp, Homo sapiens
tgctcagtctgtctccagctt

SEQ ID NO: 8249144 - DNA, 21 bp, Homo sapiens
tgctcagtctgtctccagctt

SEQ ID NO: 8249145 - DNA, 22 bp, Homo sapiens
tgctcagtcctaccttggctcc

SEQ ID NO: 8249146 - DNA, 22 bp, Homo sapiens
tgctcagtcctcctgcagtgcc

SEQ ID NO: 8249147 - DNA, 22 bp, Homo sapiens
tgctcagtcctcctgcagtgcc

SEQ ID NO: 8249148 - DNA, 19 bp, Homo sapiens
tgctcagtggctaaaagca

SEQ ID NO: 8249149 - DNA, 22 bp, Homo sapiens
tgctgcaggccttggctgggaa

SEQ ID NO: 8249150 - DNA, 22 bp, Homo sapiens
tgctgcaggcagcccctctact

SEQ ID NO: 8249151 - DNA, 22 bp, Homo sapiens
tgctgcaaattctttaattctt

SEQ ID NO: 8249152 - DNA, 22 bp, Homo sapiens
tgctgcaaatgagaagagactg

SEQ ID NO: 8249153 - DNA, 22 bp, Homo sapiens
tgctgcaacattttataactca

SEQ ID NO: 8249154 - DNA, 22 bp, Homo sapiens
tgctgcagggccttccctgcat

SEQ ID NO: 8249155 - DNA, 22 bp, Homo sapiens
tgctgcagggatttcagagaca

SEQ ID NO: 8249156 - DNA, 22 bp, Homo sapiens
tgctgcaggtgtgttcagtgag

SEQ ID NO: 8249157 - DNA, 22 bp, Homo sapiens
tgctgcaggtgtgttcagtgag

SEQ ID NO: 8249158 - DNA, 22 bp, Homo sapiens
tgctgcagtatatatttcttgg

SEQ ID NO: 8249159 - DNA, 22 bp, Homo sapiens
tgctgcagttcaccctgccgtc

SEQ ID NO: 8249160 - DNA, 22 bp, Homo sapiens
tgctgcagtgtttgctgaagtt

SEQ ID NO: 8249161 - DNA, 22 bp, Homo sapiens
tgctgaggtttctgactatgga

SEQ ID NO: 8249162 - DNA, 22 bp, Homo sapiens
tgctgaggtttcgtctgcttgc

SEQ ID NO: 8249163 - DNA, 22 bp, Homo sapiens
tgctgaggtttctgactatgga

SEQ ID NO: 8249164 - DNA, 22 bp, Homo sapiens
tgctgaggtttctgactatgga

SEQ ID NO: 8249165 - DNA, 22 bp, Homo sapiens
tgctgaggttgtggagtgcatt

SEQ ID NO: 8249166 - DNA, 22 bp, Homo sapiens
tgctgaggttgtggagtgcatt

SEQ ID NO: 8249167 - DNA, 22 bp, Homo sapiens
tgctgaggttgtggagtgcatt

SEQ ID NO: 8249168 - DNA, 22 bp, Homo sapiens
tgctgaggttgtggagtgcatt

SEQ ID NO: 8249169 - DNA, 22 bp, Homo sapiens
tgctgaggttgtggagtgcatt

SEQ ID NO: 8249170 - DNA, 22 bp, Homo sapiens
tgctgagtatttgtttgaataa

SEQ ID NO: 8249171 - DNA, 22 bp, Homo sapiens
tgctgatgagtccttctatcgc

SEQ ID NO: 8249172 - DNA, 22 bp, Homo sapiens
tgctgatgctgttctgttagga

SEQ ID NO: 8249173 - DNA, 22 bp, Homo sapiens
tgctgatgctgttctgttagga

SEQ ID NO: 8249174 - DNA, 22 bp, Homo sapiens
tgctgatgctttcccgttcaca

SEQ ID NO: 8249175 - DNA, 18 bp, Homo sapiens
tgctgatggtccattagt

SEQ ID NO: 8249176 - DNA, 22 bp, Homo sapiens
tgctgcaaaagaggtactgaat

SEQ ID NO: 8249177 - DNA, 22 bp, Homo sapiens
tgctgattttgcctactgatcc

SEQ ID NO: 8249178 - DNA, 22 bp, Homo sapiens
tgctgcaaagctggccagtagc

SEQ ID NO: 8249179 - DNA, 21 bp, Homo sapiens
tgctgatgtcagagaagcaag

SEQ ID NO: 8249180 - DNA, 20 bp, Homo sapiens
tgctgaggcctgaggcctgg

SEQ ID NO: 8249181 - DNA, 20 bp, Homo sapiens
tgctgaggcctgaggcctgg

SEQ ID NO: 8249182 - DNA, 22 bp, Homo sapiens
tgctgaggcccaggagcacttt

SEQ ID NO: 8249183 - DNA, 22 bp, Homo sapiens
tgctgaggctagacctggaagt

SEQ ID NO: 8249184 - DNA, 20 bp, Homo sapiens
tgctgaggcctgaggcctgg

SEQ ID NO: 8249185 - DNA, 20 bp, Homo sapiens
tgctgaggcctgaggcctgg

SEQ ID NO: 8249186 - DNA, 20 bp, Homo sapiens
tgctgaggcctgaggcctgg

SEQ ID NO: 8249187 - DNA, 22 bp, Homo sapiens
tgctgaggcagtcctaacagga

SEQ ID NO: 8249188 - DNA, 22 bp, Homo sapiens
tgctgaggcatttggacagagt

SEQ ID NO: 8249189 - DNA, 22 bp, Homo sapiens
tgctgaggcatttggacagagt

SEQ ID NO: 8249190 - DNA, 22 bp, Homo sapiens
tgctgaggcagatgtctgtgac

SEQ ID NO: 8249191 - DNA, 22 bp, Homo sapiens
tgctgaggcagatgtctgtgac

SEQ ID NO: 8249192 - DNA, 22 bp, Homo sapiens
tgctgaggcagatgtctgtgac

SEQ ID NO: 8249193 - DNA, 22 bp, Homo sapiens
tgctgaggcagatgtctgtgac

SEQ ID NO: 8249194 - DNA, 22 bp, Homo sapiens
tgctgaggcagatgtctgtgac

SEQ ID NO: 8249195 - DNA, 19 bp, Homo sapiens
tgctgaggatgcaagatcc

SEQ ID NO: 8249196 - DNA, 22 bp, Homo sapiens
tgctgaggctagacctggaagt

SEQ ID NO: 8249197 - DNA, 22 bp, Homo sapiens
tgctgagggaggggttttccag

SEQ ID NO: 8249198 - DNA, 22 bp, Homo sapiens
tgctgagggagcatcaaagaaa

SEQ ID NO: 8249199 - DNA, 22 bp, Homo sapiens
tgctgaggtaaccatatcctgc

SEQ ID NO: 8249200 - DNA, 22 bp, Homo sapiens
tgctgagggctgttaaggaagc

SEQ ID NO: 8249201 - DNA, 22 bp, Homo sapiens
tgctgagggcagatgaattaga

SEQ ID NO: 8249202 - DNA, 22 bp, Homo sapiens
tgctgaggtcacggcggccaga

SEQ ID NO: 8249203 - DNA, 22 bp, Homo sapiens
tgctgaggtcaccttgctgcta

SEQ ID NO: 8249204 - DNA, 22 bp, Homo sapiens
tgctgaggtcaccttgctgcta

SEQ ID NO: 8249205 - DNA, 22 bp, Homo sapiens
tgctgaggtcacggcggccaga

SEQ ID NO: 8249206 - DNA, 22 bp, Homo sapiens
tgctgaggtcatttccaagtga

SEQ ID NO: 8249207 - DNA, 22 bp, Homo sapiens
tgctgaggtcatttccaagtga

SEQ ID NO: 8249208 - DNA, 20 bp, Homo sapiens
tgctgaggttgacatgccca

SEQ ID NO: 8249209 - DNA, 22 bp, Homo sapiens
tgctctgtgtgtggttatttcc

SEQ ID NO: 8249210 - DNA, 22 bp, Homo sapiens
tgctctgttgtgcatgtgggat

SEQ ID NO: 8249211 - DNA, 22 bp, Homo sapiens
tgctctgttcagtgtatcttgt

SEQ ID NO: 8249212 - DNA, 22 bp, Homo sapiens
tgctcttcacagtttcagcatc

SEQ ID NO: 8249213 - DNA, 23 bp, Homo sapiens
tgctcttctcagacctgtcagcc

SEQ ID NO: 8249214 - DNA, 22 bp, Homo sapiens
tgctcttcggggccactgcttg

SEQ ID NO: 8249215 - DNA, 22 bp, Homo sapiens
tgctctgtaacaaattgacatg

SEQ ID NO: 8249216 - DNA, 22 bp, Homo sapiens
tgctctgtattctatggcagtt

SEQ ID NO: 8249217 - DNA, 22 bp, Homo sapiens
tgctctgtgataaaggcgtatg

SEQ ID NO: 8249218 - DNA, 17 bp, Homo sapiens
tgctctgtggtctttta

SEQ ID NO: 8249219 - DNA, 17 bp, Homo sapiens
tgctctgtggtctttta

SEQ ID NO: 8249220 - DNA, 22 bp, Homo sapiens
tgctctgtccagtgcaccatca

SEQ ID NO: 8249221 - DNA, 22 bp, Homo sapiens
tgctctgtccagtgcaccatca

SEQ ID NO: 8249222 - DNA, 20 bp, Homo sapiens
tgctctgggggtggagagac

SEQ ID NO: 8249223 - DNA, 20 bp, Homo sapiens
tgctctgggggtggagagac

SEQ ID NO: 8249224 - DNA, 20 bp, Homo sapiens
tgctctgggggtggagagac

SEQ ID NO: 8249225 - DNA, 22 bp, Homo sapiens
tgctctgggttcttgctgttac

SEQ ID NO: 8249226 - DNA, 18 bp, Homo sapiens
tgctctggtctcacttgg

SEQ ID NO: 8249227 - DNA, 22 bp, Homo sapiens
tgctctggtaactcacttccat

SEQ ID NO: 8249228 - DNA, 19 bp, Homo sapiens
tgctgaggatgcaagatcc

SEQ ID NO: 8249229 - DNA, 19 bp, Homo sapiens
tgctgaggatgcaagatcc

SEQ ID NO: 8249230 - DNA, 22 bp, Homo sapiens
tgctgaggaggtggctgtgctt

SEQ ID NO: 8249231 - DNA, 22 bp, Homo sapiens
tgctgaggaggtggctgtgctt

SEQ ID NO: 8249232 - DNA, 22 bp, Homo sapiens
tgctgaggaggtggctgtgctt

SEQ ID NO: 8249233 - DNA, 22 bp, Homo sapiens
tgctgaggaggtggctgtgctt

SEQ ID NO: 8249234 - DNA, 22 bp, Homo sapiens
tgctgaggactaaaggagatga

SEQ ID NO: 8249235 - DNA, 22 bp, Homo sapiens
tgctgaggagggcacccggggg

SEQ ID NO: 8249236 - DNA, 22 bp, Homo sapiens
tgctgaggactaaaggagatga

SEQ ID NO: 8249237 - DNA, 22 bp, Homo sapiens
tgctgaggactaaaggagatga

SEQ ID NO: 8249238 - DNA, 22 bp, Homo sapiens
tgctgaggactaaaggagatga

SEQ ID NO: 8249239 - DNA, 22 bp, Homo sapiens
tgctgaggactaaaggagatga

SEQ ID NO: 8249240 - DNA, 22 bp, Homo sapiens
tgctgaggactaaaggagatga

SEQ ID NO: 8249241 - DNA, 22 bp, Homo sapiens
tgctgaggacacctagccttct

SEQ ID NO: 8249242 - DNA, 22 bp, Homo sapiens
tgctgaggaataattgttcctg

SEQ ID NO: 8249243 - DNA, 22 bp, Homo sapiens
tgctgaggaatttggtttatgt

SEQ ID NO: 8249244 - DNA, 22 bp, Homo sapiens
tgctgaggaaaaatgtgactct

SEQ ID NO: 8249245 - DNA, 22 bp, Homo sapiens
tgctgaggaaagaggataaaag

SEQ ID NO: 8249246 - DNA, 22 bp, Homo sapiens
tgctgaggaaagaggataaaag

SEQ ID NO: 8249247 - DNA, 22 bp, Homo sapiens
tgctgaaggcaggggaggtggc

SEQ ID NO: 8249248 - DNA, 20 bp, Homo sapiens
tgctgaagaatcacagatgg

SEQ ID NO: 8249249 - DNA, 22 bp, Homo sapiens
tgctgaaggcaggggaggtggc

SEQ ID NO: 8249250 - DNA, 22 bp, Homo sapiens
tgctgaaaatgcgtatcttcca

SEQ ID NO: 8249251 - DNA, 22 bp, Homo sapiens
tgctgaaagaccgtatttatct

SEQ ID NO: 8249252 - DNA, 22 bp, Homo sapiens
tgctgagcgcatccggcggccg

SEQ ID NO: 8249253 - DNA, 22 bp, Homo sapiens
tgctgagcgcatccggcggccg

SEQ ID NO: 8249254 - DNA, 22 bp, Homo sapiens
tgctgagcgcatccggcggccg

SEQ ID NO: 8249255 - DNA, 22 bp, Homo sapiens
tgctgagcgcatccggcggccg

SEQ ID NO: 8249256 - DNA, 22 bp, Homo sapiens
tgctgaggaaaaatgtgactct

SEQ ID NO: 8249257 - DNA, 22 bp, Homo sapiens
tgctgaagggaaggtcttgaat

SEQ ID NO: 8249258 - DNA, 22 bp, Homo sapiens
tgctctccggcttccgtggcct

SEQ ID NO: 8249259 - DNA, 22 bp, Homo sapiens
tgctctcagagtcaggaggtaa

SEQ ID NO: 8249260 - DNA, 22 bp, Homo sapiens
tgctctcctgctcctcagccca

SEQ ID NO: 8249261 - DNA, 22 bp, Homo sapiens
tgctctcctgctcctcagccca

SEQ ID NO: 8249262 - DNA, 22 bp, Homo sapiens
tgctctcctgctcctcagccca

SEQ ID NO: 8249263 - DNA, 22 bp, Homo sapiens
tgctctcctgctcctcagccca

SEQ ID NO: 8249264 - DNA, 22 bp, Homo sapiens
tgctctcctgctcctcagccca

SEQ ID NO: 8249265 - DNA, 22 bp, Homo sapiens
tgctctctcaggcctggcccac

SEQ ID NO: 8249266 - DNA, 22 bp, Homo sapiens
tgctctggctggagcaatgact

SEQ ID NO: 8249267 - DNA, 19 bp, Homo sapiens
tgctctctggtgcttcatg

SEQ ID NO: 8249268 - DNA, 19 bp, Homo sapiens
tgctctctggtgcttcatg

SEQ ID NO: 8249269 - DNA, 23 bp, Homo sapiens
tgctctgggaggccctggagagc

SEQ ID NO: 8249270 - DNA, 23 bp, Homo sapiens
tgctctgggaggccctggagagc

SEQ ID NO: 8249271 - DNA, 22 bp, Homo sapiens
tgctctgggattcagcagcctg

SEQ ID NO: 8249272 - DNA, 22 bp, Homo sapiens
tgctctggctgggatgagtgca

SEQ ID NO: 8249273 - DNA, 22 bp, Homo sapiens
tgctctggctggagcaatgact

SEQ ID NO: 8249274 - DNA, 22 bp, Homo sapiens
tgctctggctggagcaatgact

SEQ ID NO: 8249275 - DNA, 19 bp, Homo sapiens
tgctctctggtgcttcatg

SEQ ID NO: 8249276 - DNA, 22 bp, Homo sapiens
tgctctggctgggatgagtgca

SEQ ID NO: 8249277 - DNA, 22 bp, Homo sapiens
tgctctggggagctcctctgcg

SEQ ID NO: 8249278 - DNA, 22 bp, Homo sapiens
tgctctggggagctcctctgcg

SEQ ID NO: 8249279 - DNA, 22 bp, Homo sapiens
tgctctggggagctcctctgcg

SEQ ID NO: 8249280 - DNA, 22 bp, Homo sapiens
tgctctgggggaagccagctgt

SEQ ID NO: 8249281 - DNA, 22 bp, Homo sapiens
tgctctggggctccccaccaga

SEQ ID NO: 8249282 - DNA, 22 bp, Homo sapiens
tgctctgggggaagccagctgt

SEQ ID NO: 8249283 - DNA, 22 bp, Homo sapiens
tgctctgggctcaatggcagct

SEQ ID NO: 8249284 - DNA, 22 bp, Homo sapiens
tgctctgggctatctgagaaag

SEQ ID NO: 8249285 - DNA, 22 bp, Homo sapiens
tgctctgggcaacagcctccct

SEQ ID NO: 8249286 - DNA, 22 bp, Homo sapiens
tgctctgggctatctgagaaag

SEQ ID NO: 8249287 - DNA, 22 bp, Homo sapiens
tgctcctggctccttccctaac

SEQ ID NO: 8249288 - DNA, 22 bp, Homo sapiens
tgctcctggcttcaggttgggc

SEQ ID NO: 8249289 - DNA, 22 bp, Homo sapiens
tgctcctggatgaggtactcca

SEQ ID NO: 8249290 - DNA, 22 bp, Homo sapiens
tgctcctggactggtgtgagat

SEQ ID NO: 8249291 - DNA, 22 bp, Homo sapiens
tgctcctggactggtgtgagat

SEQ ID NO: 8249292 - DNA, 22 bp, Homo sapiens
tgctcctggatgaggtactcca

SEQ ID NO: 8249293 - DNA, 22 bp, Homo sapiens
tgctcctggatgaggtactcca

SEQ ID NO: 8249294 - DNA, 22 bp, Homo sapiens
tgctcctggcatctctgcgtcc

SEQ ID NO: 8249295 - DNA, 22 bp, Homo sapiens
tgctcctggcatctctgcgtcc

SEQ ID NO: 8249296 - DNA, 22 bp, Homo sapiens
tgctcctgtttcatcagctata

SEQ ID NO: 8249297 - DNA, 22 bp, Homo sapiens
tgctcctgtttcatcagctata

SEQ ID NO: 8249298 - DNA, 22 bp, Homo sapiens
tgctcctgtttcatcagctata

SEQ ID NO: 8249299 - DNA, 17 bp, Homo sapiens
tgctcctgtggcagcct

SEQ ID NO: 8249300 - DNA, 17 bp, Homo sapiens
tgctcctgtggcagcct

SEQ ID NO: 8249301 - DNA, 22 bp, Homo sapiens
tgctcgccccacatgccctcat

SEQ ID NO: 8249302 - DNA, 22 bp, Homo sapiens
tgctcgccccacatgccctcat

SEQ ID NO: 8249303 - DNA, 22 bp, Homo sapiens
tgctctagcctgtaaaacatga

SEQ ID NO: 8249304 - DNA, 22 bp, Homo sapiens
tgctctagagctattggcttcc

SEQ ID NO: 8249305 - DNA, 22 bp, Homo sapiens
tgctctagccattgacctagct

SEQ ID NO: 8249306 - DNA, 22 bp, Homo sapiens
tgctctagtgggtagagcattg

SEQ ID NO: 8249307 - DNA, 22 bp, Homo sapiens
tgctctagctcataggactcat

SEQ ID NO: 8249308 - DNA, 22 bp, Homo sapiens
tgctcgaggtccccaccggctc

SEQ ID NO: 8249309 - DNA, 22 bp, Homo sapiens
tgctcgccccacatgccctcat

SEQ ID NO: 8249310 - DNA, 22 bp, Homo sapiens
tgctcgccccacatgccctcat

SEQ ID NO: 8249311 - DNA, 22 bp, Homo sapiens
tgctcgccccacatgccctcat

SEQ ID NO: 8249312 - DNA, 22 bp, Homo sapiens
tgctccttcccttcccagtgag

SEQ ID NO: 8249313 - DNA, 22 bp, Homo sapiens
tgctcctttcatccaattctca

SEQ ID NO: 8249314 - DNA, 21 bp, Homo sapiens
tgctcctttaccccacaagac

SEQ ID NO: 8249315 - DNA, 22 bp, Homo sapiens
tgctccagcccctggtgcacag

SEQ ID NO: 8249316 - DNA, 22 bp, Homo sapiens
tgctccagcctatgctctccgg

SEQ ID NO: 8249317 - DNA, 22 bp, Homo sapiens
tgctccagcctatgctctccgg

SEQ ID NO: 8249318 - DNA, 22 bp, Homo sapiens
tgctccagcaccaagagctcca

SEQ ID NO: 8249319 - DNA, 22 bp, Homo sapiens
tgctccagcatgaccctcaatg

SEQ ID NO: 8249320 - DNA, 22 bp, Homo sapiens
tgctccagcatgaccctcaatg

SEQ ID NO: 8249321 - DNA, 22 bp, Homo sapiens
tgctccagcctatgctctccgg

SEQ ID NO: 8249322 - DNA, 22 bp, Homo sapiens
tgctccagcctatgctctccgg

SEQ ID NO: 8249323 - DNA, 22 bp, Homo sapiens
tgctccagcctatgctctccgg

SEQ ID NO: 8249324 - DNA, 23 bp, Homo sapiens
tgctccagcctctttgatagtgt

SEQ ID NO: 8249325 - DNA, 22 bp, Homo sapiens
tgctccagcgctgccaccagtt

SEQ ID NO: 8249326 - DNA, 22 bp, Homo sapiens
tgctccagcgctgccaccagtt

SEQ ID NO: 8249327 - DNA, 22 bp, Homo sapiens
tgctccagcgctgccaccagtt

SEQ ID NO: 8249328 - DNA, 20 bp, Homo sapiens
tgctccaggaacactggccg

SEQ ID NO: 8249329 - DNA, 22 bp, Homo sapiens
tgctccagctggagatgggggc

SEQ ID NO: 8249330 - DNA, 22 bp, Homo sapiens
tgctccaggagcaacctttgag

SEQ ID NO: 8249331 - DNA, 20 bp, Homo sapiens
tgctccaggaacactggccg

SEQ ID NO: 8249332 - DNA, 20 bp, Homo sapiens
tgctccaggaacactggccg

SEQ ID NO: 8249333 - DNA, 22 bp, Homo sapiens
tgctccaggctgctgaagatct

SEQ ID NO: 8249334 - DNA, 19 bp, Homo sapiens
tgctccaggccttgccgca

SEQ ID NO: 8249335 - DNA, 19 bp, Homo sapiens
tgctccaggccttgccgca

SEQ ID NO: 8249336 - DNA, 19 bp, Homo sapiens
tgctccaggccttgccgca

SEQ ID NO: 8249337 - DNA, 22 bp, Homo sapiens
tgctccaggccgcctggggctg

SEQ ID NO: 8249338 - DNA, 22 bp, Homo sapiens
tgctccaggccgcctggggctg

SEQ ID NO: 8249339 - DNA, 22 bp, Homo sapiens
tgctccagggcctccagtgggg

SEQ ID NO: 8249340 - DNA, 21 bp, Homo sapiens
tgctccagggcagcttccagc

SEQ ID NO: 8249341 - DNA, 21 bp, Homo sapiens
tgctccagggcagcttccagc

SEQ ID NO: 8249342 - DNA, 21 bp, Homo sapiens
tgctccagggcagcttccagc

SEQ ID NO: 8249343 - DNA, 21 bp, Homo sapiens
tgctccaggagggggcagtcc

SEQ ID NO: 8249344 - DNA, 22 bp, Homo sapiens
tgctccaggcaagctgagagtt

SEQ ID NO: 8249345 - DNA, 22 bp, Homo sapiens
tgctccaggagcactttccatt

SEQ ID NO: 8249346 - DNA, 22 bp, Homo sapiens
tgctccaggagcactttccatt

SEQ ID NO: 8249347 - DNA, 18 bp, Homo sapiens
tgctccaggcccatgggc

SEQ ID NO: 8249348 - DNA, 18 bp, Homo sapiens
tgctccaggcccatgggc

SEQ ID NO: 8249349 - DNA, 22 bp, Homo sapiens
tgctccaggcaagctgagagtt

SEQ ID NO: 8249350 - DNA, 22 bp, Homo sapiens
tgctccaggcaagctgagagtt

SEQ ID NO: 8249351 - DNA, 20 bp, Homo sapiens
tgctcctaccacttctgccc

SEQ ID NO: 8249352 - DNA, 22 bp, Homo sapiens
tgctccgttcttctgcttcttg

SEQ ID NO: 8249353 - DNA, 22 bp, Homo sapiens
tgctcccttgccagaggggaag

SEQ ID NO: 8249354 - DNA, 23 bp, Homo sapiens
tgctcccaggtgacgctgctgtt

SEQ ID NO: 8249355 - DNA, 22 bp, Homo sapiens
tgctccctgctcagagaggcca

SEQ ID NO: 8249356 - DNA, 22 bp, Homo sapiens
tgctccagggcctccagtgggg

SEQ ID NO: 8249357 - DNA, 22 bp, Homo sapiens
tgctccagggcctccagtgggg

SEQ ID NO: 8249358 - DNA, 22 bp, Homo sapiens
tgctcccaggactcttgagcca

SEQ ID NO: 8249359 - DNA, 22 bp, Homo sapiens
tgctcccaggcattctctgttg

SEQ ID NO: 8249360 - DNA, 22 bp, Homo sapiens
tgctcccaggcattctctgttg

SEQ ID NO: 8249361 - DNA, 22 bp, Homo sapiens
tgctcccaggctctgtggtctg

SEQ ID NO: 8249362 - DNA, 22 bp, Homo sapiens
tgctcccaggctctgtggtctg

SEQ ID NO: 8249363 - DNA, 22 bp, Homo sapiens
tgctcccagggactctggctgg

SEQ ID NO: 8249364 - DNA, 22 bp, Homo sapiens
tgctcccagggactctggctgg

SEQ ID NO: 8249365 - DNA, 22 bp, Homo sapiens
tgctcctgaattacactactac

SEQ ID NO: 8249366 - DNA, 22 bp, Homo sapiens
tgctcctgaacacagccctatg

SEQ ID NO: 8249367 - DNA, 22 bp, Homo sapiens
tgctcctgaggttggagatcca

SEQ ID NO: 8249368 - DNA, 22 bp, Homo sapiens
tgctcctgagtgtgcaggagat

SEQ ID NO: 8249369 - DNA, 22 bp, Homo sapiens
tgctcctgagtgtgcaggagat

SEQ ID NO: 8249370 - DNA, 22 bp, Homo sapiens
tgctcctgatatctaatgtgta

SEQ ID NO: 8249371 - DNA, 22 bp, Homo sapiens
tgctcctgctgcatgcatctcc

SEQ ID NO: 8249372 - DNA, 22 bp, Homo sapiens
tgctcctgctgcatgcatctcc

SEQ ID NO: 8249373 - DNA, 22 bp, Homo sapiens
tgctcctgctgcatgcatctcc

SEQ ID NO: 8249374 - DNA, 22 bp, Homo sapiens
tgctcctgctgcatgcatctcc

SEQ ID NO: 8249375 - DNA, 22 bp, Homo sapiens
tgctcctgctggccctcgtgcc

SEQ ID NO: 8249376 - DNA, 22 bp, Homo sapiens
tgctcctgctggccctcgtgcc

SEQ ID NO: 8249377 - DNA, 22 bp, Homo sapiens
tggcacatatttttagtgctca

SEQ ID NO: 8249378 - DNA, 22 bp, Homo sapiens
tggcacatagtaggtgctcaat

SEQ ID NO: 8249379 - DNA, 22 bp, Homo sapiens
tggcacatagtaggtgctcaat

SEQ ID NO: 8249380 - DNA, 22 bp, Homo sapiens
tggcacagttaaagttgtagaa

SEQ ID NO: 8249381 - DNA, 22 bp, Homo sapiens
tggcaccaggcggggtggctgt

SEQ ID NO: 8249382 - DNA, 20 bp, Homo sapiens
tggcaccaggtggtggcccc

SEQ ID NO: 8249383 - DNA, 20 bp, Homo sapiens
tggcaccaggtggtggcccc

SEQ ID NO: 8249384 - DNA, 22 bp, Homo sapiens
tggcaccatcaaggctgagaac

SEQ ID NO: 8249385 - DNA, 22 bp, Homo sapiens
tggcaccagcacctagatgggg

SEQ ID NO: 8249386 - DNA, 22 bp, Homo sapiens
tggcaccagcacctagatgggg

SEQ ID NO: 8249387 - DNA, 22 bp, Homo sapiens
tggcactgaagctggaaagcct

SEQ ID NO: 8249388 - DNA, 22 bp, Homo sapiens
tggcactgacagggtgctcaag

SEQ ID NO: 8249389 - DNA, 22 bp, Homo sapiens
tggcactgacagggtgctcaag

SEQ ID NO: 8249390 - DNA, 22 bp, Homo sapiens
tggcactgacagggtgctcaag

SEQ ID NO: 8249391 - DNA, 22 bp, Homo sapiens
tggcacctgaacttagaggtgt

SEQ ID NO: 8249392 - DNA, 22 bp, Homo sapiens
tggcaccctgaagttggtcact

SEQ ID NO: 8249393 - DNA, 22 bp, Homo sapiens
tggcacctggtgcagggtggcc

SEQ ID NO: 8249394 - DNA, 22 bp, Homo sapiens
tggcacctgaacttagaggtgt

SEQ ID NO: 8249395 - DNA, 22 bp, Homo sapiens
tggcacgacaattggcaccaat

SEQ ID NO: 8249396 - DNA, 22 bp, Homo sapiens
tggcacgacaattggcaccaat

SEQ ID NO: 8249397 - DNA, 22 bp, Homo sapiens
tggcacgacaattggcaccaat

SEQ ID NO: 8249398 - DNA, 22 bp, Homo sapiens
tggcacgacaattggcaccaat

SEQ ID NO: 8249399 - DNA, 22 bp, Homo sapiens
tggcacgacaattggcaccaat

SEQ ID NO: 8249400 - DNA, 22 bp, Homo sapiens
tggcacgacaattggcaccaat

SEQ ID NO: 8249401 - DNA, 22 bp, Homo sapiens
tggcacgttggattgggagttc

SEQ ID NO: 8249402 - DNA, 22 bp, Homo sapiens
tggcacgacaattggcaccaat

SEQ ID NO: 8249403 - DNA, 22 bp, Homo sapiens
tggcactgaccccaggcctgtg

SEQ ID NO: 8249404 - DNA, 22 bp, Homo sapiens
tggcactgaccccaggcctgtg

SEQ ID NO: 8249405 - DNA, 22 bp, Homo sapiens
tggcactgaccccaggcctgtg

SEQ ID NO: 8249406 - DNA, 22 bp, Homo sapiens
tggcactgaccccaggcctgtg

SEQ ID NO: 8249407 - DNA, 22 bp, Homo sapiens
tggcactgaccccaggcctgtg

SEQ ID NO: 8249408 - DNA, 22 bp, Homo sapiens
tggcactgaccccaggcctgtg

SEQ ID NO: 8249409 - DNA, 22 bp, Homo sapiens
tggcactgagcagccgcggcag

SEQ ID NO: 8249410 - DNA, 22 bp, Homo sapiens
tggcactgccaacctgctaggt

SEQ ID NO: 8249411 - DNA, 22 bp, Homo sapiens
tggcactgccaacctgctaggt

SEQ ID NO: 8249412 - DNA, 22 bp, Homo sapiens
tggcactgccaacctgctaggt

SEQ ID NO: 8249413 - DNA, 22 bp, Homo sapiens
tggcactgccaacctgctaggt

SEQ ID NO: 8249414 - DNA, 22 bp, Homo sapiens
tggcactggaatcgtagccttg

SEQ ID NO: 8249415 - DNA, 22 bp, Homo sapiens
tggcactggaatcgtagccttg

SEQ ID NO: 8249416 - DNA, 21 bp, Homo sapiens
tggcactgcttagcaggttcc

SEQ ID NO: 8249417 - DNA, 22 bp, Homo sapiens
tggcactggaatcgtagccttg

SEQ ID NO: 8249418 - DNA, 22 bp, Homo sapiens
tggcactggaatcgtagccttg

SEQ ID NO: 8249419 - DNA, 22 bp, Homo sapiens
tggcactggaatcgtagccttg

SEQ ID NO: 8249420 - DNA, 22 bp, Homo sapiens
tggcactgcctggcagggcccc

SEQ ID NO: 8249421 - DNA, 22 bp, Homo sapiens
tggcactgcctggcagggcccc

SEQ ID NO: 8249422 - DNA, 22 bp, Homo sapiens
tggcactgccaacctgctaggt

SEQ ID NO: 8249423 - DNA, 21 bp, Homo sapiens
tggcactgcttagcaggttcc

SEQ ID NO: 8249424 - DNA, 22 bp, Homo sapiens
tggcactggcgcaggatggcgg

SEQ ID NO: 8249425 - DNA, 22 bp, Homo sapiens
tggcactgggacagatgctctc

SEQ ID NO: 8249426 - DNA, 22 bp, Homo sapiens
tggcactgggacagatgctctc

SEQ ID NO: 8249427 - DNA, 22 bp, Homo sapiens
tggcactgtcaccaatgctgtc

SEQ ID NO: 8249428 - DNA, 22 bp, Homo sapiens
tggcactgtcaccaatgctgtc

SEQ ID NO: 8249429 - DNA, 22 bp, Homo sapiens
tggcactgtagccactactgcc

SEQ ID NO: 8249430 - DNA, 22 bp, Homo sapiens
tggcactgtagccactactgcc

SEQ ID NO: 8249431 - DNA, 22 bp, Homo sapiens
tggcactgggatgctactgtta

SEQ ID NO: 8249432 - DNA, 22 bp, Homo sapiens
tggcacttccatttctttagtg

SEQ ID NO: 8249433 - DNA, 22 bp, Homo sapiens
tggcacttccgtctgccttgtg

SEQ ID NO: 8249434 - DNA, 22 bp, Homo sapiens
tggcacttccactgtggctgct

SEQ ID NO: 8249435 - DNA, 22 bp, Homo sapiens
tggcacttagcagggaaggtgt

SEQ ID NO: 8249436 - DNA, 22 bp, Homo sapiens
tggcacttattcatatcatgga

SEQ ID NO: 8249437 - DNA, 22 bp, Homo sapiens
tggcacttagatcaggttgggt

SEQ ID NO: 8249438 - DNA, 22 bp, Homo sapiens
tggcacttaggtacaagggaat

SEQ ID NO: 8249439 - DNA, 22 bp, Homo sapiens
tggcacttaggtacaagggaat

SEQ ID NO: 8249440 - DNA, 22 bp, Homo sapiens
tggcacttattcatatcatgga

SEQ ID NO: 8249441 - DNA, 22 bp, Homo sapiens
tggcacttccactgtggctgct

SEQ ID NO: 8249442 - DNA, 22 bp, Homo sapiens
tggcacttccactgtggctgct

SEQ ID NO: 8249443 - DNA, 22 bp, Homo sapiens
tggcacttattcatatcatgga

SEQ ID NO: 8249444 - DNA, 22 bp, Homo sapiens
tggcacttaaaaattattcttc

SEQ ID NO: 8249445 - DNA, 22 bp, Homo sapiens
tggcactgtggatttcacaagt

SEQ ID NO: 8249446 - DNA, 22 bp, Homo sapiens
tggcacttagcagggaaggtgt

SEQ ID NO: 8249447 - DNA, 22 bp, Homo sapiens
tggcacttaatgcatgtgctat

SEQ ID NO: 8249448 - DNA, 22 bp, Homo sapiens
tggcacttagatcaggttgggt

SEQ ID NO: 8249449 - DNA, 22 bp, Homo sapiens
tggcacttaatgcatgtgctat

SEQ ID NO: 8249450 - DNA, 22 bp, Homo sapiens
tggcagagagagtgcagtcgac

SEQ ID NO: 8249451 - DNA, 22 bp, Homo sapiens
tggcagagagagtgcagtcgac

SEQ ID NO: 8249452 - DNA, 22 bp, Homo sapiens
tggcagagagagtgcagtcgac

SEQ ID NO: 8249453 - DNA, 22 bp, Homo sapiens
tggcagagagagtgcagtcgac

SEQ ID NO: 8249454 - DNA, 22 bp, Homo sapiens
tggcagagagactctccttgat

SEQ ID NO: 8249455 - DNA, 22 bp, Homo sapiens
tggcagagagagtgcagtcgac

SEQ ID NO: 8249456 - DNA, 22 bp, Homo sapiens
tggcagagagactctccttgat

SEQ ID NO: 8249457 - DNA, 22 bp, Homo sapiens
tggcagagactcctcctgggag

SEQ ID NO: 8249458 - DNA, 22 bp, Homo sapiens
tggcagagactcctcctgggag

SEQ ID NO: 8249459 - DNA, 22 bp, Homo sapiens
tggcagagactcctcctgggag

SEQ ID NO: 8249460 - DNA, 23 bp, Homo sapiens
tggcagagacccagaatctacat

SEQ ID NO: 8249461 - DNA, 22 bp, Homo sapiens
tggcagagagactctccttgat

SEQ ID NO: 8249462 - DNA, 22 bp, Homo sapiens
tggcagagagactctccttgat

SEQ ID NO: 8249463 - DNA, 22 bp, Homo sapiens
tggcagagactcctcctgggag

SEQ ID NO: 8249464 - DNA, 22 bp, Homo sapiens
tggcagagactcctcctgggag

SEQ ID NO: 8249465 - DNA, 22 bp, Homo sapiens
tggcagagacaaggccgggcct

SEQ ID NO: 8249466 - DNA, 22 bp, Homo sapiens
tggcagagacaaggccgggcct

SEQ ID NO: 8249467 - DNA, 22 bp, Homo sapiens
tggcagagacaaggccgggcct

SEQ ID NO: 8249468 - DNA, 22 bp, Homo sapiens
tggcagagacaaggccgggcct

SEQ ID NO: 8249469 - DNA, 22 bp, Homo sapiens
tggcagagaataaatcttgact

SEQ ID NO: 8249470 - DNA, 22 bp, Homo sapiens
tggcagagaacctgggctttgt

SEQ ID NO: 8249471 - DNA, 22 bp, Homo sapiens
tggcagagaacctgggctttgt

SEQ ID NO: 8249472 - DNA, 22 bp, Homo sapiens
tggcagagaataaatcttgact

SEQ ID NO: 8249473 - DNA, 22 bp, Homo sapiens
tggcagagaacctgggctttgt

SEQ ID NO: 8249474 - DNA, 22 bp, Homo sapiens
tggcagagaacacggctgatct

SEQ ID NO: 8249475 - DNA, 22 bp, Homo sapiens
tggcacttccgtctgccttgtg

SEQ ID NO: 8249476 - DNA, 22 bp, Homo sapiens
tggcagagaacacggctgatct

SEQ ID NO: 8249477 - DNA, 22 bp, Homo sapiens
tggcagagaacacggctgatct

SEQ ID NO: 8249478 - DNA, 22 bp, Homo sapiens
tggcagagaacacggctgatct

SEQ ID NO: 8249479 - DNA, 22 bp, Homo sapiens
tggcagagatgaagagttgttt

SEQ ID NO: 8249480 - DNA, 22 bp, Homo sapiens
tggcagagatgaagagttgttt

SEQ ID NO: 8249481 - DNA, 22 bp, Homo sapiens
tggcagagatgaagagttgttt

SEQ ID NO: 8249482 - DNA, 22 bp, Homo sapiens
tggcagagcaaaaagatagaat

SEQ ID NO: 8249483 - DNA, 22 bp, Homo sapiens
tggcagagcaaaaagatagaat

SEQ ID NO: 8249484 - DNA, 22 bp, Homo sapiens
tggcagagcccagaactgagca

SEQ ID NO: 8249485 - DNA, 22 bp, Homo sapiens
tggcagagcaaaaagatagaat

SEQ ID NO: 8249486 - DNA, 22 bp, Homo sapiens
tggcagagcccagaactgagca

SEQ ID NO: 8249487 - DNA, 22 bp, Homo sapiens
tggcagagcccagaactgagca

SEQ ID NO: 8249488 - DNA, 22 bp, Homo sapiens
tggcagagcccagaactgagca

SEQ ID NO: 8249489 - DNA, 22 bp, Homo sapiens
tggcagagcccagactccagtc

SEQ ID NO: 8249490 - DNA, 22 bp, Homo sapiens
tggcagagcccagactccagtc

SEQ ID NO: 8249491 - DNA, 22 bp, Homo sapiens
tggcagagcccagactccagtc

SEQ ID NO: 8249492 - DNA, 22 bp, Homo sapiens
tggcagagccttgccaaactcc

SEQ ID NO: 8249493 - DNA, 22 bp, Homo sapiens
tggcagagccttgccaaactcc

SEQ ID NO: 8249494 - DNA, 22 bp, Homo sapiens
tggcagagccttgccaaactcc

SEQ ID NO: 8249495 - DNA, 22 bp, Homo sapiens
tggcagagctggctgcggatga

SEQ ID NO: 8249496 - DNA, 22 bp, Homo sapiens
tggcagagctggctgcggatga

SEQ ID NO: 8249497 - DNA, 22 bp, Homo sapiens
tggcagagctggctgcggatga

SEQ ID NO: 8249498 - DNA, 22 bp, Homo sapiens
tggcagagctggctgcggatga

SEQ ID NO: 8249499 - DNA, 22 bp, Homo sapiens
tggcagagctggctgcggatga

SEQ ID NO: 8249500 - DNA, 22 bp, Homo sapiens
tggcagagctggctgcggatga

SEQ ID NO: 8249501 - DNA, 16 bp, Homo sapiens
tggcagaggttcagcc

SEQ ID NO: 8249502 - DNA, 22 bp, Homo sapiens
tggcagaggaaaaagtcactgg

SEQ ID NO: 8249503 - DNA, 22 bp, Homo sapiens
tggcagaggtatattgggagga

SEQ ID NO: 8249504 - DNA, 22 bp, Homo sapiens
tggcagaggaaaaagtcactgg

SEQ ID NO: 8249505 - DNA, 22 bp, Homo sapiens
tggcagaggaaaaagtcactgg

SEQ ID NO: 8249506 - DNA, 22 bp, Homo sapiens
tggattcacaccattctcctgc

SEQ ID NO: 8249507 - DNA, 22 bp, Homo sapiens
tggatttagttcttcacaggcc

SEQ ID NO: 8249508 - DNA, 19 bp, Homo sapiens
tggatttatattctttatc

SEQ ID NO: 8249509 - DNA, 22 bp, Homo sapiens
tggatttatggagaccgaaagt

SEQ ID NO: 8249510 - DNA, 22 bp, Homo sapiens
tggatttaacagaataccaggt

SEQ ID NO: 8249511 - DNA, 22 bp, Homo sapiens
tggatttccagacagcttaatt

SEQ ID NO: 8249512 - DNA, 22 bp, Homo sapiens
tggatttatggagaccgaaagt

SEQ ID NO: 8249513 - DNA, 22 bp, Homo sapiens
tggatttcatagactgccatct

SEQ ID NO: 8249514 - DNA, 22 bp, Homo sapiens
tggatttcagctccatacttac

SEQ ID NO: 8249515 - DNA, 22 bp, Homo sapiens
tggatgtgagaaggatcaggct

SEQ ID NO: 8249516 - DNA, 22 bp, Homo sapiens
tggatgtctcagcttgagctgc

SEQ ID NO: 8249517 - DNA, 22 bp, Homo sapiens
tggatgtcatagttggatatac

SEQ ID NO: 8249518 - DNA, 22 bp, Homo sapiens
tggatgtcaaaggagtttccag

SEQ ID NO: 8249519 - DNA, 20 bp, Homo sapiens
tggatgtcaaattaggctgg

SEQ ID NO: 8249520 - DNA, 22 bp, Homo sapiens
tggatgggttgaaatgtgagcc

SEQ ID NO: 8249521 - DNA, 22 bp, Homo sapiens
tggatgggttgaaatgtgagcc

SEQ ID NO: 8249522 - DNA, 22 bp, Homo sapiens
tggatgggttgaaatgtgagcc

SEQ ID NO: 8249523 - DNA, 22 bp, Homo sapiens
tggatggttgaaaacgggcagt

SEQ ID NO: 8249524 - DNA, 22 bp, Homo sapiens
tggatggttctgggcggcagca

SEQ ID NO: 8249525 - DNA, 22 bp, Homo sapiens
tggatgtgtcgccctggctctc

SEQ ID NO: 8249526 - DNA, 17 bp, Homo sapiens
tggatgtgggatctgga

SEQ ID NO: 8249527 - DNA, 17 bp, Homo sapiens
tggatgtgggatctgga

SEQ ID NO: 8249528 - DNA, 22 bp, Homo sapiens
tggattaaagattaaaatgaca

SEQ ID NO: 8249529 - DNA, 22 bp, Homo sapiens
tggatgtgtcgccctggctctc

SEQ ID NO: 8249530 - DNA, 22 bp, Homo sapiens
tggattcacaccattctcctgc

SEQ ID NO: 8249531 - DNA, 22 bp, Homo sapiens
tggcaaaggaaatgatttaaga

SEQ ID NO: 8249532 - DNA, 22 bp, Homo sapiens
tggcaacaagaaaggcagaggg

SEQ ID NO: 8249533 - DNA, 22 bp, Homo sapiens
tggcaacacctggaagacatgg

SEQ ID NO: 8249534 - DNA, 22 bp, Homo sapiens
tggcaacatggacaggtctgcc

SEQ ID NO: 8249535 - DNA, 22 bp, Homo sapiens
tggcaacatgtcgaagtgctgt

SEQ ID NO: 8249536 - DNA, 22 bp, Homo sapiens
tggcaactcctgactctactca

SEQ ID NO: 8249537 - DNA, 23 bp, Homo sapiens
tggcaactagtggtgaagagcct

SEQ ID NO: 8249538 - DNA, 22 bp, Homo sapiens
tggcaaccgcatggcctgcttc

SEQ ID NO: 8249539 - DNA, 22 bp, Homo sapiens
tggcaagttggtgggtttagtg

SEQ ID NO: 8249540 - DNA, 22 bp, Homo sapiens
tggcaattcctgagctctgaga

SEQ ID NO: 8249541 - DNA, 22 bp, Homo sapiens
tggcaattgtccactgtctgcc

SEQ ID NO: 8249542 - DNA, 22 bp, Homo sapiens
tggcaattatatttttggctga

SEQ ID NO: 8249543 - DNA, 22 bp, Homo sapiens
tggcaattgtccactgtctgcc

SEQ ID NO: 8249544 - DNA, 22 bp, Homo sapiens
tggcaatttcacatggcttaac

SEQ ID NO: 8249545 - DNA, 22 bp, Homo sapiens
tggcaattttctagcagatggc

SEQ ID NO: 8249546 - DNA, 22 bp, Homo sapiens
tggcacaaaagtaattgcagtt

SEQ ID NO: 8249547 - DNA, 22 bp, Homo sapiens
tggcacaaatctagtccctggt

SEQ ID NO: 8249548 - DNA, 22 bp, Homo sapiens
tggcacagaaaaatgctccatt

SEQ ID NO: 8249549 - DNA, 22 bp, Homo sapiens
tggcacaagggctattccttag

SEQ ID NO: 8249550 - DNA, 22 bp, Homo sapiens
tggcacaagggctattccttag

SEQ ID NO: 8249551 - DNA, 22 bp, Homo sapiens
tggcacagaaaaatgctccatt

SEQ ID NO: 8249552 - DNA, 22 bp, Homo sapiens
tggcacagacatttaatagcct

SEQ ID NO: 8249553 - DNA, 22 bp, Homo sapiens
tggcacagaccttatcttctct

SEQ ID NO: 8249554 - DNA, 22 bp, Homo sapiens
tggcacagacagcacagcaatg

SEQ ID NO: 8249555 - DNA, 22 bp, Homo sapiens
tggcacagacagatcaggagtc

SEQ ID NO: 8249556 - DNA, 22 bp, Homo sapiens
tggcacagacagatcaggagtc

SEQ ID NO: 8249557 - DNA, 22 bp, Homo sapiens
tggcacagaaaaatgctccatt

SEQ ID NO: 8249558 - DNA, 22 bp, Homo sapiens
tggcacagacagatcaggagtc

SEQ ID NO: 8249559 - DNA, 22 bp, Homo sapiens
tggcacagacagatcaggagtc

SEQ ID NO: 8249560 - DNA, 22 bp, Homo sapiens
tggcacagacagatcaggagtc

SEQ ID NO: 8249561 - DNA, 22 bp, Homo sapiens
tggcacagacagatcaggagtc

SEQ ID NO: 8249562 - DNA, 22 bp, Homo sapiens
tggcacagacagatcaggagtc

SEQ ID NO: 8249563 - DNA, 20 bp, Homo sapiens
tggcacagaacccttgccta

SEQ ID NO: 8249564 - DNA, 17 bp, Homo sapiens
tggcacagaggtgctat

SEQ ID NO: 8249565 - DNA, 17 bp, Homo sapiens
tggcacagaggtgctat

SEQ ID NO: 8249566 - DNA, 17 bp, Homo sapiens
tggcacagaggtgctat

SEQ ID NO: 8249567 - DNA, 19 bp, Homo sapiens
tggcacagatttcctccct

SEQ ID NO: 8249568 - DNA, 21 bp, Homo sapiens
tggcacagcaagtgggctcat

SEQ ID NO: 8249569 - DNA, 17 bp, Homo sapiens
tggcacagaggtgctat

SEQ ID NO: 8249570 - DNA, 17 bp, Homo sapiens
tggcacagaggtgctat

SEQ ID NO: 8249571 - DNA, 17 bp, Homo sapiens
tggcacagaggtgctat

SEQ ID NO: 8249572 - DNA, 22 bp, Homo sapiens
tggcacagagggacccagcagc

SEQ ID NO: 8249573 - DNA, 23 bp, Homo sapiens
tggcacagaggaccatgctttgc

SEQ ID NO: 8249574 - DNA, 16 bp, Homo sapiens
tggcacagagcagata

SEQ ID NO: 8249575 - DNA, 22 bp, Homo sapiens
tggcacagactgggccaaggaa

SEQ ID NO: 8249576 - DNA, 22 bp, Homo sapiens
tggcacagactgggccaaggaa

SEQ ID NO: 8249577 - DNA, 22 bp, Homo sapiens
tggcacagactgggccaaggaa

SEQ ID NO: 8249578 - DNA, 22 bp, Homo sapiens
tggcacagactgggccaaggaa

SEQ ID NO: 8249579 - DNA, 22 bp, Homo sapiens
tggcacagcccattcagagaag

SEQ ID NO: 8249580 - DNA, 22 bp, Homo sapiens
tggcacagcctccatgtcgtcc

SEQ ID NO: 8249581 - DNA, 22 bp, Homo sapiens
tggcacagcctttaaagtacca

SEQ ID NO: 8249582 - DNA, 22 bp, Homo sapiens
tggcacagtgctggatggtgct

SEQ ID NO: 8249583 - DNA, 22 bp, Homo sapiens
tggcacagtgctggatggtgct

SEQ ID NO: 8249584 - DNA, 22 bp, Homo sapiens
tggcacagcttgtcataaactc

SEQ ID NO: 8249585 - DNA, 22 bp, Homo sapiens
tggcacagttaaagttgtagaa

SEQ ID NO: 8249586 - DNA, 23 bp, Homo sapiens
tggcacagcaggtgtgctttgtt

SEQ ID NO: 8249587 - DNA, 21 bp, Homo sapiens
tggcacagcaagtgggctcat

SEQ ID NO: 8249588 - DNA, 21 bp, Homo sapiens
tggcacagcaagtgggctcat

SEQ ID NO: 8249589 - DNA, 21 bp, Homo sapiens
tggcacagcaagtgggctcat

SEQ ID NO: 8249590 - DNA, 21 bp, Homo sapiens
tggcacagcaagtgggctcat

SEQ ID NO: 8249591 - DNA, 22 bp, Homo sapiens
tggcacagccactgaatcggga

SEQ ID NO: 8249592 - DNA, 22 bp, Homo sapiens
tggcacagccatcttctcctgc

SEQ ID NO: 8249593 - DNA, 22 bp, Homo sapiens
tggcacagcccagagctcttga

SEQ ID NO: 8249594 - DNA, 22 bp, Homo sapiens
tggcagagtctgggcttgggca

SEQ ID NO: 8249595 - DNA, 22 bp, Homo sapiens
tggcagagtgcagaagaggcat

SEQ ID NO: 8249596 - DNA, 22 bp, Homo sapiens
tggcagagtgcagaagaggcat

SEQ ID NO: 8249597 - DNA, 22 bp, Homo sapiens
tggcagagtgcagaagaggcat

SEQ ID NO: 8249598 - DNA, 22 bp, Homo sapiens
tggcagagtgcagaagaggcat

SEQ ID NO: 8249599 - DNA, 22 bp, Homo sapiens
tggcagagtgcagaagaggcat

SEQ ID NO: 8249600 - DNA, 21 bp, Homo sapiens
tggcagagtgcagtctataca

SEQ ID NO: 8249601 - DNA, 21 bp, Homo sapiens
tggcagagtgcagtctataca

SEQ ID NO: 8249602 - DNA, 21 bp, Homo sapiens
tggcagagtgcagtctataca

SEQ ID NO: 8249603 - DNA, 22 bp, Homo sapiens
tggcagagtgcggcatcccctg

SEQ ID NO: 8249604 - DNA, 22 bp, Homo sapiens
tggcagagtggaccatactcaa

SEQ ID NO: 8249605 - DNA, 22 bp, Homo sapiens
tggcagagtggaccatactcaa

SEQ ID NO: 8249606 - DNA, 22 bp, Homo sapiens
tggcagagtcatcacatctgga

SEQ ID NO: 8249607 - DNA, 22 bp, Homo sapiens
tggcagagtcatcacatctgga

SEQ ID NO: 8249608 - DNA, 22 bp, Homo sapiens
tggcagagtcatcacatctgga

SEQ ID NO: 8249609 - DNA, 22 bp, Homo sapiens
tggcagagtcatcacatctgga

SEQ ID NO: 8249610 - DNA, 22 bp, Homo sapiens
tggcagagtaggatggccctgt

SEQ ID NO: 8249611 - DNA, 22 bp, Homo sapiens
tggcagagtaggatggccctgt

SEQ ID NO: 8249612 - DNA, 22 bp, Homo sapiens
tggcagagtaggatggccctgt

SEQ ID NO: 8249613 - DNA, 22 bp, Homo sapiens
tggcagagtaggatggccctgt

SEQ ID NO: 8249614 - DNA, 22 bp, Homo sapiens
tggcagagtctctcctttccag

SEQ ID NO: 8249615 - DNA, 22 bp, Homo sapiens
tggcagagtctctcctttccag

SEQ ID NO: 8249616 - DNA, 22 bp, Homo sapiens
tggcagagtctctcctttccag

SEQ ID NO: 8249617 - DNA, 22 bp, Homo sapiens
tggcagagtctgggcttgggca

SEQ ID NO: 8249618 - DNA, 22 bp, Homo sapiens
tggcagagtctgggcttgggca

SEQ ID NO: 8249619 - DNA, 22 bp, Homo sapiens
tggcagagtctgggcttgggca

SEQ ID NO: 8249620 - DNA, 22 bp, Homo sapiens
tggcagagtctgggcttgggca

SEQ ID NO: 8249621 - DNA, 22 bp, Homo sapiens
tggcagagtctgggcttgggca

SEQ ID NO: 8249622 - DNA, 22 bp, Homo sapiens
tggcagagtctctcctttccag

SEQ ID NO: 8249623 - DNA, 22 bp, Homo sapiens
tggcagagtctctcctttccag

SEQ ID NO: 8249624 - DNA, 20 bp, Homo sapiens
tggcagagttgtcccaccca

SEQ ID NO: 8249625 - DNA, 22 bp, Homo sapiens
tggcagcagacaaaaggccatt

SEQ ID NO: 8249626 - DNA, 22 bp, Homo sapiens
tggcagcagacaaaaggccatt

SEQ ID NO: 8249627 - DNA, 20 bp, Homo sapiens
tggcagagttgtcccaccca

SEQ ID NO: 8249628 - DNA, 20 bp, Homo sapiens
tggcagagttgtcccaccca

SEQ ID NO: 8249629 - DNA, 20 bp, Homo sapiens
tggcagagttgtcccaccca

SEQ ID NO: 8249630 - DNA, 22 bp, Homo sapiens
tggcagagttggaggtggaaga

SEQ ID NO: 8249631 - DNA, 21 bp, Homo sapiens
tggcagagttgagtagttatg

SEQ ID NO: 8249632 - DNA, 22 bp, Homo sapiens
tggcagagttggaggtggaaga

SEQ ID NO: 8249633 - DNA, 22 bp, Homo sapiens
tggcagagttggaggtggaaga

SEQ ID NO: 8249634 - DNA, 22 bp, Homo sapiens
tggcagagttggaggtggaaga

SEQ ID NO: 8249635 - DNA, 22 bp, Homo sapiens
tggcagagttcgctgtgccttt

SEQ ID NO: 8249636 - DNA, 22 bp, Homo sapiens
tggcagagttcgctgtgccttt

SEQ ID NO: 8249637 - DNA, 22 bp, Homo sapiens
tggcagagttcgctgtgccttt

SEQ ID NO: 8249638 - DNA, 22 bp, Homo sapiens
tggcagagttcgctgtgccttt

SEQ ID NO: 8249639 - DNA, 22 bp, Homo sapiens
tggcagagttcgctgtgccttt

SEQ ID NO: 8249640 - DNA, 22 bp, Homo sapiens
tggcagagttcgctgtgccttt

SEQ ID NO: 8249641 - DNA, 22 bp, Homo sapiens
tggcagagttcgctcctattca

SEQ ID NO: 8249642 - DNA, 22 bp, Homo sapiens
tggcagagttcgctcctattca

SEQ ID NO: 8249643 - DNA, 22 bp, Homo sapiens
tggcagagttatgggtatttat

SEQ ID NO: 8249644 - DNA, 18 bp, Homo sapiens
tggcagagtgtctgttct

SEQ ID NO: 8249645 - DNA, 18 bp, Homo sapiens
tggcagagtgtctgttct

SEQ ID NO: 8249646 - DNA, 18 bp, Homo sapiens
tggcagagtgtctgttct

SEQ ID NO: 8249647 - DNA, 18 bp, Homo sapiens
tggcagagtgtctgttct

SEQ ID NO: 8249648 - DNA, 22 bp, Homo sapiens
tggcagagtggaccatactcaa

SEQ ID NO: 8249649 - DNA, 22 bp, Homo sapiens
tggcagccttctctgagaaggt

SEQ ID NO: 8249650 - DNA, 22 bp, Homo sapiens
tggcagctatctttaatgagat

SEQ ID NO: 8249651 - DNA, 22 bp, Homo sapiens
tggcagctccgggtaggggctg

SEQ ID NO: 8249652 - DNA, 22 bp, Homo sapiens
tggcagctccgggtaggggctg

SEQ ID NO: 8249653 - DNA, 22 bp, Homo sapiens
tggcagctcctggggccagcac

SEQ ID NO: 8249654 - DNA, 22 bp, Homo sapiens
tggcagctcctggggccagcac

SEQ ID NO: 8249655 - DNA, 22 bp, Homo sapiens
tggcagctcctggggccagcac

SEQ ID NO: 8249656 - DNA, 22 bp, Homo sapiens
tggcagctattacaaggaagtc

SEQ ID NO: 8249657 - DNA, 22 bp, Homo sapiens
tggcagctcccagagcttccaa

SEQ ID NO: 8249658 - DNA, 22 bp, Homo sapiens
tggcagcctggaatctctcagc

SEQ ID NO: 8249659 - DNA, 22 bp, Homo sapiens
tggcagcctggaatctctcagc

SEQ ID NO: 8249660 - DNA, 22 bp, Homo sapiens
tggcagccttctctgagaaggt

SEQ ID NO: 8249661 - DNA, 22 bp, Homo sapiens
tggcagcctgcgtgaaggagct

SEQ ID NO: 8249662 - DNA, 22 bp, Homo sapiens
tggcagcctgcgtgaaggagct

SEQ ID NO: 8249663 - DNA, 22 bp, Homo sapiens
tggcagcctcccagctgcattc

SEQ ID NO: 8249664 - DNA, 22 bp, Homo sapiens
tggcagccatctgagggtgggg

SEQ ID NO: 8249665 - DNA, 22 bp, Homo sapiens
tggcagccatctgagggtgggg

SEQ ID NO: 8249666 - DNA, 22 bp, Homo sapiens
tggcagccatctgagggtgggg

SEQ ID NO: 8249667 - DNA, 22 bp, Homo sapiens
tggcagccatctgagggtgggg

SEQ ID NO: 8249668 - DNA, 22 bp, Homo sapiens
tggcagcctcccagctgcattc

SEQ ID NO: 8249669 - DNA, 19 bp, Homo sapiens
tggcagcctccacttttgc

SEQ ID NO: 8249670 - DNA, 22 bp, Homo sapiens
tggcagcctcagacaaggacct

SEQ ID NO: 8249671 - DNA, 22 bp, Homo sapiens
tggcagcctcagacaaggacct

SEQ ID NO: 8249672 - DNA, 22 bp, Homo sapiens
tggcagccatcagagcaggggt

SEQ ID NO: 8249673 - DNA, 22 bp, Homo sapiens
tggcagccatcagagcaggggt

SEQ ID NO: 8249674 - DNA, 22 bp, Homo sapiens
tggcagccacatctcgtggatt

SEQ ID NO: 8249675 - DNA, 22 bp, Homo sapiens
tggcagccacatctcgtggatt

SEQ ID NO: 8249676 - DNA, 22 bp, Homo sapiens
tggcagccacatctcgtggatt

SEQ ID NO: 8249677 - DNA, 22 bp, Homo sapiens
tggcagcagtagccaccccagc

SEQ ID NO: 8249678 - DNA, 22 bp, Homo sapiens
tggcagcagtagccaccccagc

SEQ ID NO: 8249679 - DNA, 22 bp, Homo sapiens
tggcagcagtggaggtagaaag

SEQ ID NO: 8249680 - DNA, 22 bp, Homo sapiens
tggcagcatgtcccggcctcag

SEQ ID NO: 8249681 - DNA, 22 bp, Homo sapiens
tggcagcatgtcccggcctcag

SEQ ID NO: 8249682 - DNA, 22 bp, Homo sapiens
tggcagcatgtcccggcctcag

SEQ ID NO: 8249683 - DNA, 22 bp, Homo sapiens
tggcagcatgttatgtaaggaa

SEQ ID NO: 8249684 - DNA, 22 bp, Homo sapiens
tggcagcagtagccaccccagc

SEQ ID NO: 8249685 - DNA, 22 bp, Homo sapiens
tggcagcagggaggccagtgtt

SEQ ID NO: 8249686 - DNA, 22 bp, Homo sapiens
tggcagcagggcccctggagga

SEQ ID NO: 8249687 - DNA, 22 bp, Homo sapiens
tggcagcagggaggccagtgtt

SEQ ID NO: 8249688 - DNA, 22 bp, Homo sapiens
tggcagcagggaggccagtgtt

SEQ ID NO: 8249689 - DNA, 22 bp, Homo sapiens
tggcagcagggaggccagtgtt

SEQ ID NO: 8249690 - DNA, 18 bp, Homo sapiens
tggcagcaggaagccatt

SEQ ID NO: 8249691 - DNA, 22 bp, Homo sapiens
tggcagcagctaacttaggcag

SEQ ID NO: 8249692 - DNA, 22 bp, Homo sapiens
tggcagcagctaacttaggcag

SEQ ID NO: 8249693 - DNA, 18 bp, Homo sapiens
tggcagcaggaagccatt

SEQ ID NO: 8249694 - DNA, 22 bp, Homo sapiens
tggcagcagccatggaaggccc

SEQ ID NO: 8249695 - DNA, 22 bp, Homo sapiens
tggcagcagccatggaaggccc

SEQ ID NO: 8249696 - DNA, 22 bp, Homo sapiens
tggcagcagccatggaaggccc

SEQ ID NO: 8249697 - DNA, 22 bp, Homo sapiens
tggcagcagcaaatggcatatc

SEQ ID NO: 8249698 - DNA, 22 bp, Homo sapiens
tggcagcagcaaatggcatatc

SEQ ID NO: 8249699 - DNA, 22 bp, Homo sapiens
tggcagcagacatctgaggtct

SEQ ID NO: 8249700 - DNA, 22 bp, Homo sapiens
tggcagctgcaggcctcctgag

SEQ ID NO: 8249701 - DNA, 22 bp, Homo sapiens
tggcaggaaagtaacagagcac

SEQ ID NO: 8249702 - DNA, 22 bp, Homo sapiens
tggcagctggagggcaatggcc

SEQ ID NO: 8249703 - DNA, 22 bp, Homo sapiens
tggcaggaaaaagggccagagg

SEQ ID NO: 8249704 - DNA, 22 bp, Homo sapiens
tggcagctgaggggaggctttg

SEQ ID NO: 8249705 - DNA, 22 bp, Homo sapiens
tggcagctgagtgcaccccctc

SEQ ID NO: 8249706 - DNA, 22 bp, Homo sapiens
tggcagctgattagatggtgcc

SEQ ID NO: 8249707 - DNA, 18 bp, Homo sapiens
tggcaggaaatgcacttt

SEQ ID NO: 8249708 - DNA, 22 bp, Homo sapiens
tggcaggaaataccctgcctag

SEQ ID NO: 8249709 - DNA, 22 bp, Homo sapiens
tggcaggaaagtaacagagcac

SEQ ID NO: 8249710 - DNA, 22 bp, Homo sapiens
tggcaggaaagtaacagagcac

SEQ ID NO: 8249711 - DNA, 22 bp, Homo sapiens
tggcaggaaagtaacagagcac

SEQ ID NO: 8249712 - DNA, 22 bp, Homo sapiens
tggcaggaaataccctgcctag

SEQ ID NO: 8249713 - DNA, 22 bp, Homo sapiens
tggcaggaaccaggaggctctc

SEQ ID NO: 8249714 - DNA, 22 bp, Homo sapiens
tggcaggaaccaggaggctctc

SEQ ID NO: 8249715 - DNA, 22 bp, Homo sapiens
tggcaggaaccaggaggctctc

SEQ ID NO: 8249716 - DNA, 22 bp, Homo sapiens
tggcaggaaccaggaggctctc

SEQ ID NO: 8249717 - DNA, 18 bp, Homo sapiens
tggcaggaaatgcacttt

SEQ ID NO: 8249718 - DNA, 18 bp, Homo sapiens
tggcaggaaatgcacttt

SEQ ID NO: 8249719 - DNA, 22 bp, Homo sapiens
tggcaggaaataccctgcctag

SEQ ID NO: 8249720 - DNA, 22 bp, Homo sapiens
tggcaggaagacgtggggcacc

SEQ ID NO: 8249721 - DNA, 22 bp, Homo sapiens
tggcaggaaccttaaccacaaa

SEQ ID NO: 8249722 - DNA, 22 bp, Homo sapiens
tggcaggaaccttaaccacaaa

SEQ ID NO: 8249723 - DNA, 22 bp, Homo sapiens
tggcaggaggatgaggcggcta

SEQ ID NO: 8249724 - DNA, 22 bp, Homo sapiens
tggcaggaggatgaggcggcta

SEQ ID NO: 8249725 - DNA, 22 bp, Homo sapiens
tggcaggaggatgaggcggcta

SEQ ID NO: 8249726 - DNA, 22 bp, Homo sapiens
tggcaggaggatgaggcggcta

SEQ ID NO: 8249727 - DNA, 22 bp, Homo sapiens
tggcaggaggatgaggcggcta

SEQ ID NO: 8249728 - DNA, 20 bp, Homo sapiens
tggcaggagccactggaagc

SEQ ID NO: 8249729 - DNA, 20 bp, Homo sapiens
tggcaggaggcagcagtgga

SEQ ID NO: 8249730 - DNA, 20 bp, Homo sapiens
tggcaggaggcagcagtgga

SEQ ID NO: 8249731 - DNA, 20 bp, Homo sapiens
tggcaggaggcagcagtgga

SEQ ID NO: 8249732 - DNA, 20 bp, Homo sapiens
tggcaggaggcagcagtgga

SEQ ID NO: 8249733 - DNA, 20 bp, Homo sapiens
tggcaggaggcagcagtgga

SEQ ID NO: 8249734 - DNA, 22 bp, Homo sapiens
tggcaggatctttgagagtgaa

SEQ ID NO: 8249735 - DNA, 22 bp, Homo sapiens
tggcaggaggttttctccagga

SEQ ID NO: 8249736 - DNA, 22 bp, Homo sapiens
tggcaggaggttttctccagga

SEQ ID NO: 8249737 - DNA, 22 bp, Homo sapiens
tggcaggaggttttctccagga

SEQ ID NO: 8249738 - DNA, 22 bp, Homo sapiens
tggcaggagacacatggcatag

SEQ ID NO: 8249739 - DNA, 22 bp, Homo sapiens
tggcaggagacacatggcatag

SEQ ID NO: 8249740 - DNA, 22 bp, Homo sapiens
tggcaggagacacatggcatag

SEQ ID NO: 8249741 - DNA, 22 bp, Homo sapiens
tggcaggagacacatggcatag

SEQ ID NO: 8249742 - DNA, 22 bp, Homo sapiens
tggcaggagagcgtcagatcag

SEQ ID NO: 8249743 - DNA, 22 bp, Homo sapiens
tggcaggagagcgtcagatcag

SEQ ID NO: 8249744 - DNA, 20 bp, Homo sapiens
tggcaggactggctccaccc

SEQ ID NO: 8249745 - DNA, 20 bp, Homo sapiens
tggcaggactggctccaccc

SEQ ID NO: 8249746 - DNA, 20 bp, Homo sapiens
tggcaggactggctccaccc

SEQ ID NO: 8249747 - DNA, 20 bp, Homo sapiens
tggcaggactggctccaccc

SEQ ID NO: 8249748 - DNA, 20 bp, Homo sapiens
tggcaggactggctccaccc

SEQ ID NO: 8249749 - DNA, 20 bp, Homo sapiens
tggcaggactggctccaccc

SEQ ID NO: 8249750 - DNA, 22 bp, Homo sapiens
tggcaggaaggagactcagccc

SEQ ID NO: 8249751 - DNA, 20 bp, Homo sapiens
tggcaggaatagggccagag

SEQ ID NO: 8249752 - DNA, 20 bp, Homo sapiens
tggcaggaatagggccagag

SEQ ID NO: 8249753 - DNA, 22 bp, Homo sapiens
tggcaggaagcatctataggtc

SEQ ID NO: 8249754 - DNA, 22 bp, Homo sapiens
tggcaggaaggagactcagccc

SEQ ID NO: 8249755 - DNA, 22 bp, Homo sapiens
tggcaggaagacgtggggcacc

SEQ ID NO: 8249756 - DNA, 22 bp, Homo sapiens
tggcaggaagacgtggggcacc

SEQ ID NO: 8249757 - DNA, 22 bp, Homo sapiens
tggcaggaagacgtggggcacc

SEQ ID NO: 8249758 - DNA, 22 bp, Homo sapiens
tggcaggcaggcagccttctga

SEQ ID NO: 8249759 - DNA, 22 bp, Homo sapiens
tggcaggcagctggcatcctaa

SEQ ID NO: 8249760 - DNA, 22 bp, Homo sapiens
tggcaggcagtgtgggagctgg

SEQ ID NO: 8249761 - DNA, 22 bp, Homo sapiens
tggcaggcagtgtgggagctgg

SEQ ID NO: 8249762 - DNA, 22 bp, Homo sapiens
tggcaggcagtgtgggagctgg

SEQ ID NO: 8249763 - DNA, 21 bp, Homo sapiens
tggcaggcagctggaagcttg

SEQ ID NO: 8249764 - DNA, 21 bp, Homo sapiens
tggcaggcagctggaagcttg

SEQ ID NO: 8249765 - DNA, 22 bp, Homo sapiens
tggcaggcagctggcatcctaa

SEQ ID NO: 8249766 - DNA, 22 bp, Homo sapiens
tggcaggcagctggcatcctaa

SEQ ID NO: 8249767 - DNA, 21 bp, Homo sapiens
tggcaggcagctggaagcttg

SEQ ID NO: 8249768 - DNA, 22 bp, Homo sapiens
tggcaggcagagagcggccttt

SEQ ID NO: 8249769 - DNA, 22 bp, Homo sapiens
tggcaggcagagagcggccttt

SEQ ID NO: 8249770 - DNA, 22 bp, Homo sapiens
tggcaggcaagttcagctccac

SEQ ID NO: 8249771 - DNA, 22 bp, Homo sapiens
tggcaggcaagttcagctccac

SEQ ID NO: 8249772 - DNA, 22 bp, Homo sapiens
tggcaggatttgcccggaagga

SEQ ID NO: 8249773 - DNA, 22 bp, Homo sapiens
tggcaggatctttgagagtgaa

SEQ ID NO: 8249774 - DNA, 22 bp, Homo sapiens
tggcaggatttgcccggaagga

SEQ ID NO: 8249775 - DNA, 22 bp, Homo sapiens
tggcagggagccaccggtcatg

SEQ ID NO: 8249776 - DNA, 22 bp, Homo sapiens
tggcaggcattgatgcgagttc

SEQ ID NO: 8249777 - DNA, 22 bp, Homo sapiens
tggcaggcattgatgcgagttc

SEQ ID NO: 8249778 - DNA, 22 bp, Homo sapiens
tggcaggcagtgtgggagctgg

SEQ ID NO: 8249779 - DNA, 22 bp, Homo sapiens
tggcagggagccaccggtcatg

SEQ ID NO: 8249780 - DNA, 18 bp, Homo sapiens
tggcagggaggaaatata

SEQ ID NO: 8249781 - DNA, 18 bp, Homo sapiens
tggcagggaggaaatata

SEQ ID NO: 8249782 - DNA, 18 bp, Homo sapiens
tggcagggaggaaatata

SEQ ID NO: 8249783 - DNA, 22 bp, Homo sapiens
tggcagggagttcgttcacaac

SEQ ID NO: 8249784 - DNA, 22 bp, Homo sapiens
tggcagggagttcgttcacaac

SEQ ID NO: 8249785 - DNA, 22 bp, Homo sapiens
tggcagggagttcgttcacaac

SEQ ID NO: 8249786 - DNA, 19 bp, Homo sapiens
tggcagggagtgatattag

SEQ ID NO: 8249787 - DNA, 19 bp, Homo sapiens
tggcagggagtgatattag

SEQ ID NO: 8249788 - DNA, 19 bp, Homo sapiens
tggcagggagtgatattag

SEQ ID NO: 8249789 - DNA, 18 bp, Homo sapiens
tggcaggggcagtacgcc

SEQ ID NO: 8249790 - DNA, 18 bp, Homo sapiens
tggcaggggcagtacgcc

SEQ ID NO: 8249791 - DNA, 18 bp, Homo sapiens
tggcaggggcagtacgcc

SEQ ID NO: 8249792 - DNA, 18 bp, Homo sapiens
tggcaggggcagtacgcc

SEQ ID NO: 8249793 - DNA, 22 bp, Homo sapiens
tggcaggggaggtgcttgctta

SEQ ID NO: 8249794 - DNA, 22 bp, Homo sapiens
tggcaggggaggtgcttgctta

SEQ ID NO: 8249795 - DNA, 21 bp, Homo sapiens
tggcaggggtagtagtacagc

SEQ ID NO: 8249796 - DNA, 21 bp, Homo sapiens
tggcaggggtagtagtacagc

SEQ ID NO: 8249797 - DNA, 18 bp, Homo sapiens
tggcaggggcagtacgcc

SEQ ID NO: 8249798 - DNA, 21 bp, Homo sapiens
tggcaggggtagtagtacagc

SEQ ID NO: 8249799 - DNA, 21 bp, Homo sapiens
tggcaggggtagtagtacagc

SEQ ID NO: 8249800 - DNA, 22 bp, Homo sapiens
tggcagggtacaccttaacacc

SEQ ID NO: 8249801 - DNA, 22 bp, Homo sapiens
tggcagggtacaccttaacacc

SEQ ID NO: 8249802 - DNA, 22 bp, Homo sapiens
tggcagggcctgctcatcatcc

SEQ ID NO: 8249803 - DNA, 22 bp, Homo sapiens
tggcagggcctgctcatcatcc

SEQ ID NO: 8249804 - DNA, 22 bp, Homo sapiens
tggcaggggaggtgcttgctta

SEQ ID NO: 8249805 - DNA, 22 bp, Homo sapiens
tggcagggcctgctcatcatcc

SEQ ID NO: 8249806 - DNA, 22 bp, Homo sapiens
tggcagggcctgaatcttatac

SEQ ID NO: 8249807 - DNA, 22 bp, Homo sapiens
tggcagggcctgaatcttatac

SEQ ID NO: 8249808 - DNA, 22 bp, Homo sapiens
tggcagggcctgaatcttatac

SEQ ID NO: 8249809 - DNA, 22 bp, Homo sapiens
tggcagggagttgcaggatttc

SEQ ID NO: 8249810 - DNA, 22 bp, Homo sapiens
tggcagggagttgcaggatttc

SEQ ID NO: 8249811 - DNA, 22 bp, Homo sapiens
tggcagggagttgcaggatttc

SEQ ID NO: 8249812 - DNA, 22 bp, Homo sapiens
tggcagggagttgcaggatttc

SEQ ID NO: 8249813 - DNA, 22 bp, Homo sapiens
tggcagggcctaccccaatatc

SEQ ID NO: 8249814 - DNA, 22 bp, Homo sapiens
tggcagggcctaccccaatatc

SEQ ID NO: 8249815 - DNA, 22 bp, Homo sapiens
tggcagggagttgcaggatttc

SEQ ID NO: 8249816 - DNA, 22 bp, Homo sapiens
tggccaccaccaatacttgcct

SEQ ID NO: 8249817 - DNA, 22 bp, Homo sapiens
tggccacccctttctctgcact

SEQ ID NO: 8249818 - DNA, 22 bp, Homo sapiens
tggccacatatgtgggacagct

SEQ ID NO: 8249819 - DNA, 22 bp, Homo sapiens
tggccacatatgtgggacagct

SEQ ID NO: 8249820 - DNA, 22 bp, Homo sapiens
tggccacatgcgtctgtgaggc

SEQ ID NO: 8249821 - DNA, 22 bp, Homo sapiens
tggccacatgcgtctgtgaggc

SEQ ID NO: 8249822 - DNA, 22 bp, Homo sapiens
tggccacatctgaaatgagtgt

SEQ ID NO: 8249823 - DNA, 22 bp, Homo sapiens
tggccacagtgtccagcagcag

SEQ ID NO: 8249824 - DNA, 23 bp, Homo sapiens
tggccacagtccatgcatgccca

SEQ ID NO: 8249825 - DNA, 23 bp, Homo sapiens
tggccacagtccatgcatgccca

SEQ ID NO: 8249826 - DNA, 20 bp, Homo sapiens
tggccactggccactggagc

SEQ ID NO: 8249827 - DNA, 22 bp, Homo sapiens
tggccactcctccctgcaggct

SEQ ID NO: 8249828 - DNA, 22 bp, Homo sapiens
tggccactcctccctgcaggct

SEQ ID NO: 8249829 - DNA, 22 bp, Homo sapiens
tggccactcctccctgcaggct

SEQ ID NO: 8249830 - DNA, 22 bp, Homo sapiens
tggccactcagggatgcaggaa

SEQ ID NO: 8249831 - DNA, 19 bp, Homo sapiens
tggccacctctgctgttct

SEQ ID NO: 8249832 - DNA, 17 bp, Homo sapiens
tggccagagcaggcccc

SEQ ID NO: 8249833 - DNA, 22 bp, Homo sapiens
tggccagacagagaggctttgt

SEQ ID NO: 8249834 - DNA, 22 bp, Homo sapiens
tggccagaactcagacatgtgg

SEQ ID NO: 8249835 - DNA, 22 bp, Homo sapiens
tggccagaacctgcagtaggcc

SEQ ID NO: 8249836 - DNA, 22 bp, Homo sapiens
tggccacttggcatgtgtgcca

SEQ ID NO: 8249837 - DNA, 22 bp, Homo sapiens
tggccagaacctgcagtaggcc

SEQ ID NO: 8249838 - DNA, 22 bp, Homo sapiens
tggccacactgcccccactggg

SEQ ID NO: 8249839 - DNA, 23 bp, Homo sapiens
tggcatttctatactggcaagtg

SEQ ID NO: 8249840 - DNA, 22 bp, Homo sapiens
tggccacagcctctgccagttc

SEQ ID NO: 8249841 - DNA, 23 bp, Homo sapiens
tggccacagtccatgcatgccca

SEQ ID NO: 8249842 - DNA, 23 bp, Homo sapiens
tggccacagtccatgcatgccca

SEQ ID NO: 8249843 - DNA, 22 bp, Homo sapiens
tggccacagcctctgccagttc

SEQ ID NO: 8249844 - DNA, 22 bp, Homo sapiens
tggcatttcagtattttcataa

SEQ ID NO: 8249845 - DNA, 22 bp, Homo sapiens
tggcatttagaaaacaacatgt

SEQ ID NO: 8249846 - DNA, 22 bp, Homo sapiens
tggcatttatatcccagtttat

SEQ ID NO: 8249847 - DNA, 22 bp, Homo sapiens
tggcatttagttgcgtattgca

SEQ ID NO: 8249848 - DNA, 22 bp, Homo sapiens
tggcattggttgccaggctgtg

SEQ ID NO: 8249849 - DNA, 19 bp, Homo sapiens
tggcattggtccagataaa

SEQ ID NO: 8249850 - DNA, 19 bp, Homo sapiens
tggcattggtccagataaa

SEQ ID NO: 8249851 - DNA, 22 bp, Homo sapiens
tggcatgttttgctcttgaaaa

SEQ ID NO: 8249852 - DNA, 22 bp, Homo sapiens
tggcattagtgctcctactcag

SEQ ID NO: 8249853 - DNA, 22 bp, Homo sapiens
tggcattatgtagcagggagca

SEQ ID NO: 8249854 - DNA, 22 bp, Homo sapiens
tggcatgttgataatggagaag

SEQ ID NO: 8249855 - DNA, 22 bp, Homo sapiens
tggcatgttctcttagcagctc

SEQ ID NO: 8249856 - DNA, 22 bp, Homo sapiens
tggcatgttgagaggcaagatt

SEQ ID NO: 8249857 - DNA, 22 bp, Homo sapiens
tggcatgttaaataagatcata

SEQ ID NO: 8249858 - DNA, 19 bp, Homo sapiens
tggcatgtttggctaagga

SEQ ID NO: 8249859 - DNA, 22 bp, Homo sapiens
tggcatgtttcatggctgcaaa

SEQ ID NO: 8249860 - DNA, 22 bp, Homo sapiens
tggcatgtaacatctccagatt

SEQ ID NO: 8249861 - DNA, 22 bp, Homo sapiens
tggcatgtacccaggaatggac

SEQ ID NO: 8249862 - DNA, 22 bp, Homo sapiens
tggcatgtatacttgagtagga

SEQ ID NO: 8249863 - DNA, 22 bp, Homo sapiens
tggcatgtattagttggcagtt

SEQ ID NO: 8249864 - DNA, 22 bp, Homo sapiens
tggcatgtctgagggaggtttg

SEQ ID NO: 8249865 - DNA, 22 bp, Homo sapiens
tggcatgtggcagctggttcag

SEQ ID NO: 8249866 - DNA, 22 bp, Homo sapiens
tggcatgtccacttcaacagtt

SEQ ID NO: 8249867 - DNA, 22 bp, Homo sapiens
tggcatgtattagttggcagtt

SEQ ID NO: 8249868 - DNA, 22 bp, Homo sapiens
tggcatgttctcttagcagctc

SEQ ID NO: 8249869 - DNA, 22 bp, Homo sapiens
tggcatgtgtgtgtaggataca

SEQ ID NO: 8249870 - DNA, 22 bp, Homo sapiens
tggcatgtccacttcaacagtt

SEQ ID NO: 8249871 - DNA, 22 bp, Homo sapiens
tggccagccttgtcatcgcttt

SEQ ID NO: 8249872 - DNA, 22 bp, Homo sapiens
tggccagcctggtgcttgctcc

SEQ ID NO: 8249873 - DNA, 22 bp, Homo sapiens
tggccagcctggtgcttgctcc

SEQ ID NO: 8249874 - DNA, 22 bp, Homo sapiens
tggccaggcattcagataagac

SEQ ID NO: 8249875 - DNA, 22 bp, Homo sapiens
tggccaggcattcagataagac

SEQ ID NO: 8249876 - DNA, 22 bp, Homo sapiens
tggccaggccggggacagaact

SEQ ID NO: 8249877 - DNA, 17 bp, Homo sapiens
tggccaggccccgccag

SEQ ID NO: 8249878 - DNA, 17 bp, Homo sapiens
tggccaggccccgccag

SEQ ID NO: 8249879 - DNA, 17 bp, Homo sapiens
tggccaggccccgccag

SEQ ID NO: 8249880 - DNA, 22 bp, Homo sapiens
tggccaggccggggacagaact

SEQ ID NO: 8249881 - DNA, 22 bp, Homo sapiens
tggccaggccggggacagaact

SEQ ID NO: 8249882 - DNA, 22 bp, Homo sapiens
tggccaggccggggacagaact

SEQ ID NO: 8249883 - DNA, 22 bp, Homo sapiens
tggccaggccggggacagaact

SEQ ID NO: 8249884 - DNA, 22 bp, Homo sapiens
tggccaggccggggacagaact

SEQ ID NO: 8249885 - DNA, 22 bp, Homo sapiens
tggccagccagaaagaagcctt

SEQ ID NO: 8249886 - DNA, 22 bp, Homo sapiens
tggccagccagaaagaagcctt

SEQ ID NO: 8249887 - DNA, 22 bp, Homo sapiens
tggccagcagagttcactctct

SEQ ID NO: 8249888 - DNA, 22 bp, Homo sapiens
tggccagagttgagggggtttc

SEQ ID NO: 8249889 - DNA, 22 bp, Homo sapiens
tggccagcacttagcccttacc

SEQ ID NO: 8249890 - DNA, 22 bp, Homo sapiens
tggccagcccttcagccatgcc

SEQ ID NO: 8249891 - DNA, 22 bp, Homo sapiens
tggccagcccttcagccatgcc

SEQ ID NO: 8249892 - DNA, 22 bp, Homo sapiens
tggccagcccttcagccatgcc

SEQ ID NO: 8249893 - DNA, 22 bp, Homo sapiens
tggccagcccttcagccatgcc

SEQ ID NO: 8249894 - DNA, 22 bp, Homo sapiens
tggccagcccttcagccatgcc

SEQ ID NO: 8249895 - DNA, 22 bp, Homo sapiens
tggccagccctcttcccacact

SEQ ID NO: 8249896 - DNA, 22 bp, Homo sapiens
tggccagcccttcagccatgcc

SEQ ID NO: 8249897 - DNA, 22 bp, Homo sapiens
tggccagccctcttcccacact

SEQ ID NO: 8249898 - DNA, 22 bp, Homo sapiens
tggccagccagaaagaagcctt

SEQ ID NO: 8249899 - DNA, 23 bp, Homo sapiens
tggccaggtagaggaggtagtga

SEQ ID NO: 8249900 - DNA, 23 bp, Homo sapiens
tggccaggtagaggaggtagtga

SEQ ID NO: 8249901 - DNA, 19 bp, Homo sapiens
tggccaggtactgtctgct

SEQ ID NO: 8249902 - DNA, 19 bp, Homo sapiens
tggccaggtactgtctgct

SEQ ID NO: 8249903 - DNA, 23 bp, Homo sapiens
tggccaggtagaggaggtagtga

SEQ ID NO: 8249904 - DNA, 23 bp, Homo sapiens
tggccaggtagaggaggtagtga

SEQ ID NO: 8249905 - DNA, 23 bp, Homo sapiens
tggccaggtagaggaggtagtga

SEQ ID NO: 8249906 - DNA, 23 bp, Homo sapiens
tggccaggtagaggaggtagtga

SEQ ID NO: 8249907 - DNA, 23 bp, Homo sapiens
tggccaggtagaggaggtagtga

SEQ ID NO: 8249908 - DNA, 22 bp, Homo sapiens
tggccaggtgtgggttctcaga

SEQ ID NO: 8249909 - DNA, 22 bp, Homo sapiens
tggccaggtgtgggttctcaga

SEQ ID NO: 8249910 - DNA, 22 bp, Homo sapiens
tggccaggttgggctttgcagc

SEQ ID NO: 8249911 - DNA, 22 bp, Homo sapiens
tggccaggttgggctttgcagc

SEQ ID NO: 8249912 - DNA, 22 bp, Homo sapiens
tggccagtagagctcagatagt

SEQ ID NO: 8249913 - DNA, 22 bp, Homo sapiens
tggccagtaatagcttctggtg

SEQ ID NO: 8249914 - DNA, 22 bp, Homo sapiens
tggccagtagataggcaggcaa

SEQ ID NO: 8249915 - DNA, 22 bp, Homo sapiens
tggccagtagataggcaggcaa

SEQ ID NO: 8249916 - DNA, 22 bp, Homo sapiens
tggccaggcctcttggtgccca

SEQ ID NO: 8249917 - DNA, 22 bp, Homo sapiens
tggccaggcctcttggtgccca

SEQ ID NO: 8249918 - DNA, 22 bp, Homo sapiens
tggccaggcctcttggtgccca

SEQ ID NO: 8249919 - DNA, 22 bp, Homo sapiens
tggccaggctggtctggaacgc

SEQ ID NO: 8249920 - DNA, 22 bp, Homo sapiens
tggccaggctggtctggaacgc

SEQ ID NO: 8249921 - DNA, 22 bp, Homo sapiens
tggccaggctggtctggaacgc

SEQ ID NO: 8249922 - DNA, 22 bp, Homo sapiens
tggccaggctggtctggaacgc

SEQ ID NO: 8249923 - DNA, 22 bp, Homo sapiens
tggccaggggagttcccctcca

SEQ ID NO: 8249924 - DNA, 22 bp, Homo sapiens
tggccaggctggtctggaacgc

SEQ ID NO: 8249925 - DNA, 23 bp, Homo sapiens
tggccagggtactacacccaccc

SEQ ID NO: 8249926 - DNA, 19 bp, Homo sapiens
tggccaggtactgtctgct

SEQ ID NO: 8249927 - DNA, 19 bp, Homo sapiens
tggccaggtactgtctgct

SEQ ID NO: 8249928 - DNA, 19 bp, Homo sapiens
tggccaggtactgtctgct

SEQ ID NO: 8249929 - DNA, 23 bp, Homo sapiens
tggccagggtactacacccaccc

SEQ ID NO: 8249930 - DNA, 23 bp, Homo sapiens
tggccagggtactacacccaccc

SEQ ID NO: 8249931 - DNA, 23 bp, Homo sapiens
tggccagggtactacacccaccc

SEQ ID NO: 8249932 - DNA, 22 bp, Homo sapiens
tggccaggggagttcccctcca

SEQ ID NO: 8249933 - DNA, 22 bp, Homo sapiens
tggccaggggagttcccctcca

SEQ ID NO: 8249934 - DNA, 22 bp, Homo sapiens
tggccaggggagttcccctcca

SEQ ID NO: 8249935 - DNA, 22 bp, Homo sapiens
tggccaggggagttcccctcca

SEQ ID NO: 8249936 - DNA, 22 bp, Homo sapiens
tggccaggggagttcccctcca

SEQ ID NO: 8249937 - DNA, 22 bp, Homo sapiens
tggcatcattttcagctggcca

SEQ ID NO: 8249938 - DNA, 22 bp, Homo sapiens
tggcatccagataccctgaggg

SEQ ID NO: 8249939 - DNA, 21 bp, Homo sapiens
tggcatcctcttctcctttcc

SEQ ID NO: 8249940 - DNA, 22 bp, Homo sapiens
tggcatccaggtcctcacatgg

SEQ ID NO: 8249941 - DNA, 22 bp, Homo sapiens
tggcatccagccatgtgatttt

SEQ ID NO: 8249942 - DNA, 18 bp, Homo sapiens
tggcatcccttctcttac

SEQ ID NO: 8249943 - DNA, 22 bp, Homo sapiens
tggcatcccttcccacccttta

SEQ ID NO: 8249944 - DNA, 22 bp, Homo sapiens
tggcagtgtttctaaggggctc

SEQ ID NO: 8249945 - DNA, 22 bp, Homo sapiens
tggcagttcaggttggactctt

SEQ ID NO: 8249946 - DNA, 22 bp, Homo sapiens
tggcagtgtttctaaggggctc

SEQ ID NO: 8249947 - DNA, 19 bp, Homo sapiens
tggcagtgtggggtatgaa

SEQ ID NO: 8249948 - DNA, 22 bp, Homo sapiens
tggcagtggctcagagtgcaga

SEQ ID NO: 8249949 - DNA, 22 bp, Homo sapiens
tggcagtggctcagagtgcaga

SEQ ID NO: 8249950 - DNA, 22 bp, Homo sapiens
tggcagtggctcagagtgcaga

SEQ ID NO: 8249951 - DNA, 22 bp, Homo sapiens
tggcagtggctcagagtgcaga

SEQ ID NO: 8249952 - DNA, 22 bp, Homo sapiens
tggcagtggataggggagcggt

SEQ ID NO: 8249953 - DNA, 22 bp, Homo sapiens
tggcagtggataggggagcggt

SEQ ID NO: 8249954 - DNA, 22 bp, Homo sapiens
tggcagtggataggggagcggt

SEQ ID NO: 8249955 - DNA, 22 bp, Homo sapiens
tggcagtggataggggagcggt

SEQ ID NO: 8249956 - DNA, 22 bp, Homo sapiens
tggcagtgccccttgaccagtg

SEQ ID NO: 8249957 - DNA, 22 bp, Homo sapiens
tggcagtggcgggactcagggc

SEQ ID NO: 8249958 - DNA, 22 bp, Homo sapiens
tggcagtggcgggactcagggc

SEQ ID NO: 8249959 - DNA, 21 bp, Homo sapiens
tggcatggaggtagcagtgtg

SEQ ID NO: 8249960 - DNA, 21 bp, Homo sapiens
tggcatggaggtagcagtgtg

SEQ ID NO: 8249961 - DNA, 22 bp, Homo sapiens
tggcatggactagtgctgaggt

SEQ ID NO: 8249962 - DNA, 22 bp, Homo sapiens
tggcatggactagtgctgaggt

SEQ ID NO: 8249963 - DNA, 22 bp, Homo sapiens
tggcatggactagtgctgaggt

SEQ ID NO: 8249964 - DNA, 22 bp, Homo sapiens
tggcatggcatttagagaatta

SEQ ID NO: 8249965 - DNA, 22 bp, Homo sapiens
tggcatggccagtgctgggagt

SEQ ID NO: 8249966 - DNA, 22 bp, Homo sapiens
tggcatggcaaccctgcaggga

SEQ ID NO: 8249967 - DNA, 22 bp, Homo sapiens
tggcatggcaaccctgcaggga

SEQ ID NO: 8249968 - DNA, 22 bp, Homo sapiens
tggcatggcaaccctgcaggga

SEQ ID NO: 8249969 - DNA, 22 bp, Homo sapiens
tggcatggcaaccctgcaggga

SEQ ID NO: 8249970 - DNA, 21 bp, Homo sapiens
tggcatggaggtagcagtgtg

SEQ ID NO: 8249971 - DNA, 22 bp, Homo sapiens
tggcatgggccagggagagctg

SEQ ID NO: 8249972 - DNA, 22 bp, Homo sapiens
tggcatgggccagggagagctg

SEQ ID NO: 8249973 - DNA, 22 bp, Homo sapiens
tggcatgggccagggagagctg

SEQ ID NO: 8249974 - DNA, 22 bp, Homo sapiens
tggcatgggtggagagagcaca

SEQ ID NO: 8249975 - DNA, 22 bp, Homo sapiens
tggcatgggtggagagagcaca

SEQ ID NO: 8249976 - DNA, 22 bp, Homo sapiens
tggcatgggtggagagagcaca

SEQ ID NO: 8249977 - DNA, 22 bp, Homo sapiens
tggcatgggccagggagagctg

SEQ ID NO: 8249978 - DNA, 22 bp, Homo sapiens
tggcatggcgtggcatcgtgtg

SEQ ID NO: 8249979 - DNA, 22 bp, Homo sapiens
tggcatgggcaaaccagggaaa

SEQ ID NO: 8249980 - DNA, 22 bp, Homo sapiens
tggcatggccagtgctgggagt

SEQ ID NO: 8249981 - DNA, 17 bp, Homo sapiens
tggcatcttttgctcat

SEQ ID NO: 8249982 - DNA, 22 bp, Homo sapiens
tggcatctttgtcccagaagct

SEQ ID NO: 8249983 - DNA, 17 bp, Homo sapiens
tggcatgagggtgtggg

SEQ ID NO: 8249984 - DNA, 22 bp, Homo sapiens
tggcatgaatttagctttccat

SEQ ID NO: 8249985 - DNA, 22 bp, Homo sapiens
tggcatgaagtcagcagctggg

SEQ ID NO: 8249986 - DNA, 23 bp, Homo sapiens
tggcatcttggcatcttgctgct

SEQ ID NO: 8249987 - DNA, 23 bp, Homo sapiens
tggcatcttggcatcttgctgct

SEQ ID NO: 8249988 - DNA, 22 bp, Homo sapiens
tggcatctgtgttgcggttgtc

SEQ ID NO: 8249989 - DNA, 22 bp, Homo sapiens
tggcatgataggaggtgcagaa

SEQ ID NO: 8249990 - DNA, 22 bp, Homo sapiens
tggcatgcaagaggaggctccc

SEQ ID NO: 8249991 - DNA, 17 bp, Homo sapiens
tggcatgagggtgtggg

SEQ ID NO: 8249992 - DNA, 22 bp, Homo sapiens
tggcatgagtataggcttctca

SEQ ID NO: 8249993 - DNA, 22 bp, Homo sapiens
tggcatgagtataggcttctca

SEQ ID NO: 8249994 - DNA, 22 bp, Homo sapiens
tggcatgccttgtcagacagtg

SEQ ID NO: 8249995 - DNA, 22 bp, Homo sapiens
tggcatgcattgtgggtaatta

SEQ ID NO: 8249996 - DNA, 22 bp, Homo sapiens
tggcatgcacagccctgttcgg

SEQ ID NO: 8249997 - DNA, 21 bp, Homo sapiens
tggcatgcagtgttcctgtgc

SEQ ID NO: 8249998 - DNA, 22 bp, Homo sapiens
tggcagtgatgcggcaggacat

SEQ ID NO: 8249999 - DNA, 22 bp, Homo sapiens
tggcagtgatgcggcaggacat

SEQ ID NO: 8250000 - DNA, 22 bp, Homo sapiens
tggcagtgatgcggcaggacat

SEQ ID NO: 8250001 - DNA, 22 bp, Homo sapiens
tggcagtgatgcggcaggacat

SEQ ID NO: 8250002 - DNA, 22 bp, Homo sapiens
tggcagtgatgcggcaggacat

SEQ ID NO: 8250003 - DNA, 22 bp, Homo sapiens
tggcagtgatgcggcaggacat

SEQ ID NO: 8250004 - DNA, 22 bp, Homo sapiens
tggcagtgatgcggcaggacat

SEQ ID NO: 8250005 - DNA, 22 bp, Homo sapiens
tggcagtgccccttgaccagtg

SEQ ID NO: 8250006 - DNA, 22 bp, Homo sapiens
tggcagtgccccttgaccagtg

SEQ ID NO: 8250007 - DNA, 23 bp, Homo sapiens
tggcagtgcccagggagatgatc

SEQ ID NO: 8250008 - DNA, 23 bp, Homo sapiens
tggcagtgcccagggagatgatc

SEQ ID NO: 8250009 - DNA, 22 bp, Homo sapiens
tggcagtgaaccaaggctccaa

SEQ ID NO: 8250010 - DNA, 23 bp, Homo sapiens
tggcagtgatcaaaagcttacat

SEQ ID NO: 8250011 - DNA, 18 bp, Homo sapiens
tggcagtgaggtaggcat

SEQ ID NO: 8250012 - DNA, 18 bp, Homo sapiens
tggcagtgaggtaggcat

SEQ ID NO: 8250013 - DNA, 18 bp, Homo sapiens
tggcagtgaggtaggcat

SEQ ID NO: 8250014 - DNA, 18 bp, Homo sapiens
tggcagtgaggtaggcat

SEQ ID NO: 8250015 - DNA, 18 bp, Homo sapiens
tggcagtgaggtaggcat

SEQ ID NO: 8250016 - DNA, 22 bp, Homo sapiens
tggcaggttggcctttggttca

SEQ ID NO: 8250017 - DNA, 21 bp, Homo sapiens
tggcaggttcaaaggcctatc

SEQ ID NO: 8250018 - DNA, 21 bp, Homo sapiens
tggcaggttcaaaggcctatc

SEQ ID NO: 8250019 - DNA, 21 bp, Homo sapiens
tggcaggttcaaaggcctatc

SEQ ID NO: 8250020 - DNA, 22 bp, Homo sapiens
tggcaggtttcctcctcatagt

SEQ ID NO: 8250021 - DNA, 22 bp, Homo sapiens
tggcaggttggcctttggttca

SEQ ID NO: 8250022 - DNA, 22 bp, Homo sapiens
tggcaggtttcgttaaaaatgg

SEQ ID NO: 8250023 - DNA, 22 bp, Homo sapiens
tggcaggtttcctcctcatagt

SEQ ID NO: 8250024 - DNA, 22 bp, Homo sapiens
tggcaggtttcctcctcatagt

SEQ ID NO: 8250025 - DNA, 16 bp, Homo sapiens
tggcaggtttttatct

SEQ ID NO: 8250026 - DNA, 22 bp, Homo sapiens
tggcaggtttcgttaaaaatgg

SEQ ID NO: 8250027 - DNA, 16 bp, Homo sapiens
tggcaggtttttatct

SEQ ID NO: 8250028 - DNA, 22 bp, Homo sapiens
tggcagtcattatcgctgagtc

SEQ ID NO: 8250029 - DNA, 22 bp, Homo sapiens
tggcagtccagaccctggactc

SEQ ID NO: 8250030 - DNA, 22 bp, Homo sapiens
tggcagtcccctgtgcctggaa

SEQ ID NO: 8250031 - DNA, 22 bp, Homo sapiens
tggcagtcccctgtgcctggaa

SEQ ID NO: 8250032 - DNA, 22 bp, Homo sapiens
tggcagtcctcttcctcgggcg

SEQ ID NO: 8250033 - DNA, 22 bp, Homo sapiens
tggcagtctgggttggcagtta

SEQ ID NO: 8250034 - DNA, 22 bp, Homo sapiens
tggcagggtgccagttgcgagt

SEQ ID NO: 8250035 - DNA, 22 bp, Homo sapiens
tggcagggtgccagttgcgagt

SEQ ID NO: 8250036 - DNA, 22 bp, Homo sapiens
tggcagggtgccagttgcgagt

SEQ ID NO: 8250037 - DNA, 22 bp, Homo sapiens
tggcagggtggcaacttttggt

SEQ ID NO: 8250038 - DNA, 22 bp, Homo sapiens
tggcaggtcatgagtggccacc

SEQ ID NO: 8250039 - DNA, 22 bp, Homo sapiens
tggcaggtcatgagtggccacc

SEQ ID NO: 8250040 - DNA, 22 bp, Homo sapiens
tggcaggtcatgagtggccacc

SEQ ID NO: 8250041 - DNA, 22 bp, Homo sapiens
tggcagggtcttgctgtgttgc

SEQ ID NO: 8250042 - DNA, 22 bp, Homo sapiens
tggcagggtcttgctgtgttgc

SEQ ID NO: 8250043 - DNA, 22 bp, Homo sapiens
tggcagggtcttgctgtgttgc

SEQ ID NO: 8250044 - DNA, 22 bp, Homo sapiens
tggcagggtcttgctgtgttgc

SEQ ID NO: 8250045 - DNA, 22 bp, Homo sapiens
tggcagggtgccagttgcgagt

SEQ ID NO: 8250046 - DNA, 18 bp, Homo sapiens
tggcaggtccagctgtgg

SEQ ID NO: 8250047 - DNA, 18 bp, Homo sapiens
tggcaggtccagctgtgg

SEQ ID NO: 8250048 - DNA, 22 bp, Homo sapiens
tggcaggtgaagttgttaggga

SEQ ID NO: 8250049 - DNA, 22 bp, Homo sapiens
tggcaggtgaagttgttaggga

SEQ ID NO: 8250050 - DNA, 22 bp, Homo sapiens
tggcaggtgaagttgttaggga

SEQ ID NO: 8250051 - DNA, 22 bp, Homo sapiens
tggcaggtccactcacagatct

SEQ ID NO: 8250052 - DNA, 22 bp, Homo sapiens
tggcaggtccactcacagatct

SEQ ID NO: 8250053 - DNA, 22 bp, Homo sapiens
tggcaggtccactcacagatct

SEQ ID NO: 8250054 - DNA, 18 bp, Homo sapiens
tggcaggtccagctgtgg

SEQ ID NO: 8250055 - DNA, 22 bp, Homo sapiens
tggcaggtgcctgtaatctcag

SEQ ID NO: 8250056 - DNA, 22 bp, Homo sapiens
tggcaggtgcctgtaatctcag

SEQ ID NO: 8250057 - DNA, 22 bp, Homo sapiens
tggcaggtgccatgggctcaga

SEQ ID NO: 8250058 - DNA, 22 bp, Homo sapiens
tggcaggtgccatgggctcaga

SEQ ID NO: 8250059 - DNA, 22 bp, Homo sapiens
tggcaggtgcacttttggtttc

SEQ ID NO: 8250060 - DNA, 22 bp, Homo sapiens
tggcaggtgccatgggctcaga

SEQ ID NO: 8250061 - DNA, 22 bp, Homo sapiens
tggcaggtgcacttttggtttc

SEQ ID NO: 8250062 - DNA, 22 bp, Homo sapiens
tggcaggtgaagttgttaggga

SEQ ID NO: 8250063 - DNA, 22 bp, Homo sapiens
tggcaggtggcacagcctggga

SEQ ID NO: 8250064 - DNA, 22 bp, Homo sapiens
tggcaggtggagacagcagagc

SEQ ID NO: 8250065 - DNA, 20 bp, Homo sapiens
tggcaggtggcctcagttcc

SEQ ID NO: 8250066 - DNA, 20 bp, Homo sapiens
tggcaggtggcctcagttcc

SEQ ID NO: 8250067 - DNA, 22 bp, Homo sapiens
tggcaggtggcacagcctggga

SEQ ID NO: 8250068 - DNA, 22 bp, Homo sapiens
tggcaggtggagacagcagagc

SEQ ID NO: 8250069 - DNA, 22 bp, Homo sapiens
tggcaggtggcacagcctggga

SEQ ID NO: 8250070 - DNA, 22 bp, Homo sapiens
tggcaggtggcacagcctggga

SEQ ID NO: 8250071 - DNA, 22 bp, Homo sapiens
tggcaggtggctctggcattct

SEQ ID NO: 8250072 - DNA, 22 bp, Homo sapiens
tggcaggtggctctggcattct

SEQ ID NO: 8250073 - DNA, 23 bp, Homo sapiens
tggcaggtggttagatgttttgt

SEQ ID NO: 8250074 - DNA, 23 bp, Homo sapiens
tggcaggtggttagatgttttgt

SEQ ID NO: 8250075 - DNA, 22 bp, Homo sapiens
tggcaggttaacttacaactgt

SEQ ID NO: 8250076 - DNA, 22 bp, Homo sapiens
tggcaggttaacttacaactgt

SEQ ID NO: 8250077 - DNA, 22 bp, Homo sapiens
tggcaggttatgcgggccacat

SEQ ID NO: 8250078 - DNA, 22 bp, Homo sapiens
tggcaggttatgcgggccacat

SEQ ID NO: 8250079 - DNA, 22 bp, Homo sapiens
tggcaggttatgcgggccacat

SEQ ID NO: 8250080 - DNA, 22 bp, Homo sapiens
tggcccagtcagcaggagaggg

SEQ ID NO: 8250081 - DNA, 22 bp, Homo sapiens
tggcccagtcagcaggagaggg

SEQ ID NO: 8250082 - DNA, 22 bp, Homo sapiens
tggcccagtcagcaggagaggg

SEQ ID NO: 8250083 - DNA, 22 bp, Homo sapiens
tggcccagtcagcaggagaggg

SEQ ID NO: 8250084 - DNA, 22 bp, Homo sapiens
tggcccaggtgcacccagaggc

SEQ ID NO: 8250085 - DNA, 22 bp, Homo sapiens
tggcccaggtgcacccagaggc

SEQ ID NO: 8250086 - DNA, 22 bp, Homo sapiens
tggcccaggtgcaagagacaga

SEQ ID NO: 8250087 - DNA, 22 bp, Homo sapiens
tggcccaggtgcacccagaggc

SEQ ID NO: 8250088 - DNA, 22 bp, Homo sapiens
tggcccaggtgcaagagacaga

SEQ ID NO: 8250089 - DNA, 22 bp, Homo sapiens
tggccctgacacgtggtactgg

SEQ ID NO: 8250090 - DNA, 23 bp, Homo sapiens
tggccctgaatctgtcctggagg

SEQ ID NO: 8250091 - DNA, 23 bp, Homo sapiens
tggccctgaatctgtcctggagg

SEQ ID NO: 8250092 - DNA, 23 bp, Homo sapiens
tggccctgaatctgtcctggagg

SEQ ID NO: 8250093 - DNA, 22 bp, Homo sapiens
tggccctgaatcaaggccagca

SEQ ID NO: 8250094 - DNA, 22 bp, Homo sapiens
tggccctgaatcaaggccagca

SEQ ID NO: 8250095 - DNA, 22 bp, Homo sapiens
tggccctgaaggccttgagcat

SEQ ID NO: 8250096 - DNA, 22 bp, Homo sapiens
tggccctcgtccgacaggtggg

SEQ ID NO: 8250097 - DNA, 22 bp, Homo sapiens
tggccctcgtccgacaggtggg

SEQ ID NO: 8250098 - DNA, 22 bp, Homo sapiens
tggccctcagtcttgctcctgc

SEQ ID NO: 8250099 - DNA, 22 bp, Homo sapiens
tggccctcagcactgagacctt

SEQ ID NO: 8250100 - DNA, 22 bp, Homo sapiens
tggccctcagtcttgctcctgc

SEQ ID NO: 8250101 - DNA, 22 bp, Homo sapiens
tggccctgacacgtggtactgg

SEQ ID NO: 8250102 - DNA, 22 bp, Homo sapiens
tggccctgacaggtcctgggca

SEQ ID NO: 8250103 - DNA, 22 bp, Homo sapiens
tggccctgactgatgtggaggg

SEQ ID NO: 8250104 - DNA, 22 bp, Homo sapiens
tggccctgaggacccagtgtgg

SEQ ID NO: 8250105 - DNA, 22 bp, Homo sapiens
tggccctgaggacccagtgtgg

SEQ ID NO: 8250106 - DNA, 22 bp, Homo sapiens
tggccctgaggacccagtgtgg

SEQ ID NO: 8250107 - DNA, 22 bp, Homo sapiens
tggccctgacttggaggcctga

SEQ ID NO: 8250108 - DNA, 22 bp, Homo sapiens
tggccctgacttggaggcctga

SEQ ID NO: 8250109 - DNA, 22 bp, Homo sapiens
tggccctgacttggaggcctga

SEQ ID NO: 8250110 - DNA, 22 bp, Homo sapiens
tggccctgacttggaggcctga

SEQ ID NO: 8250111 - DNA, 22 bp, Homo sapiens
tggccctgccactcactgctga

SEQ ID NO: 8250112 - DNA, 22 bp, Homo sapiens
tggccctgcagaactagcctgg

SEQ ID NO: 8250113 - DNA, 22 bp, Homo sapiens
tggccctgcagaactagcctgg

SEQ ID NO: 8250114 - DNA, 22 bp, Homo sapiens
tggccctgcagaactagcctgg

SEQ ID NO: 8250115 - DNA, 22 bp, Homo sapiens
tggccctgcacccagagcagtt

SEQ ID NO: 8250116 - DNA, 22 bp, Homo sapiens
tggccctgcacccagagcagtt

SEQ ID NO: 8250117 - DNA, 22 bp, Homo sapiens
tggccctgaggggctgtgcccc

SEQ ID NO: 8250118 - DNA, 22 bp, Homo sapiens
tggccctgaggggctgtgcccc

SEQ ID NO: 8250119 - DNA, 22 bp, Homo sapiens
tggccctgagggctcggagcca

SEQ ID NO: 8250120 - DNA, 22 bp, Homo sapiens
tggcccagggcacagcagggag

SEQ ID NO: 8250121 - DNA, 22 bp, Homo sapiens
tggcccagggcacagcagggag

SEQ ID NO: 8250122 - DNA, 22 bp, Homo sapiens
tggcccagggcacagcagggag

SEQ ID NO: 8250123 - DNA, 22 bp, Homo sapiens
tggcccaggggctcttggtgtt

SEQ ID NO: 8250124 - DNA, 22 bp, Homo sapiens
tggcccaggggctcttggtgtt

SEQ ID NO: 8250125 - DNA, 22 bp, Homo sapiens
tggcccaggggctcttggtgtt

SEQ ID NO: 8250126 - DNA, 22 bp, Homo sapiens
tggcccaggtctctctgagccc

SEQ ID NO: 8250127 - DNA, 22 bp, Homo sapiens
tggcccaggtctctctgagccc

SEQ ID NO: 8250128 - DNA, 22 bp, Homo sapiens
tggcccaggtctctctgagccc

SEQ ID NO: 8250129 - DNA, 22 bp, Homo sapiens
tggcccagggtctacagcctca

SEQ ID NO: 8250130 - DNA, 22 bp, Homo sapiens
tggcccagggtctacagcctca

SEQ ID NO: 8250131 - DNA, 22 bp, Homo sapiens
tggcccagggtctacagcctca

SEQ ID NO: 8250132 - DNA, 22 bp, Homo sapiens
tggcccaggtctctctgagccc

SEQ ID NO: 8250133 - DNA, 22 bp, Homo sapiens
tggcccagggagttcatggtgt

SEQ ID NO: 8250134 - DNA, 22 bp, Homo sapiens
tggcccaggcgaggtgggcaga

SEQ ID NO: 8250135 - DNA, 22 bp, Homo sapiens
tggcccagggagttcatggtgt

SEQ ID NO: 8250136 - DNA, 22 bp, Homo sapiens
tggcccaggcgaggtgggcaga

SEQ ID NO: 8250137 - DNA, 22 bp, Homo sapiens
tggcccaggcgaggtgggcaga

SEQ ID NO: 8250138 - DNA, 22 bp, Homo sapiens
tggcccaggaggccagagggca

SEQ ID NO: 8250139 - DNA, 22 bp, Homo sapiens
tggcccaggaggccagagggca

SEQ ID NO: 8250140 - DNA, 22 bp, Homo sapiens
tggcccagctgcagatggtgga

SEQ ID NO: 8250141 - DNA, 22 bp, Homo sapiens
tggcccagctgcagatggtgga

SEQ ID NO: 8250142 - DNA, 22 bp, Homo sapiens
tggcccaggccaaagccctgga

SEQ ID NO: 8250143 - DNA, 22 bp, Homo sapiens
tggcccaggccaaagccctgga

SEQ ID NO: 8250144 - DNA, 22 bp, Homo sapiens
tggcccaggaggccagagggca

SEQ ID NO: 8250145 - DNA, 22 bp, Homo sapiens
tggcccagctcagggtgggcgg

SEQ ID NO: 8250146 - DNA, 22 bp, Homo sapiens
tggcccagctcagggtgggcgg

SEQ ID NO: 8250147 - DNA, 22 bp, Homo sapiens
tggcccagccctgctctagggc

SEQ ID NO: 8250148 - DNA, 22 bp, Homo sapiens
tggcccagccctgctctagggc

SEQ ID NO: 8250149 - DNA, 22 bp, Homo sapiens
tggcccagccctgctctagggc

SEQ ID NO: 8250150 - DNA, 22 bp, Homo sapiens
tggcccagccctgctctagggc

SEQ ID NO: 8250151 - DNA, 22 bp, Homo sapiens
tggcccagagcactgctgggca

SEQ ID NO: 8250152 - DNA, 22 bp, Homo sapiens
tggcccagactctgctcttatc

SEQ ID NO: 8250153 - DNA, 22 bp, Homo sapiens
tggcccagactctgctcttatc

SEQ ID NO: 8250154 - DNA, 22 bp, Homo sapiens
tggccagtctgtggaagccagg

SEQ ID NO: 8250155 - DNA, 22 bp, Homo sapiens
tggccagtcttagctgtgcctg

SEQ ID NO: 8250156 - DNA, 22 bp, Homo sapiens
tggccagtgattaatgacgctt

SEQ ID NO: 8250157 - DNA, 22 bp, Homo sapiens
tggccagtggggttgagcagga

SEQ ID NO: 8250158 - DNA, 22 bp, Homo sapiens
tggccagtgcctgccagtgcag

SEQ ID NO: 8250159 - DNA, 22 bp, Homo sapiens
tggccagtggactaagttctga

SEQ ID NO: 8250160 - DNA, 22 bp, Homo sapiens
tggccagtgtcggaggccagga

SEQ ID NO: 8250161 - DNA, 22 bp, Homo sapiens
tggccagtggggttgagcagga

SEQ ID NO: 8250162 - DNA, 22 bp, Homo sapiens
tggccagtggggttgagcagga

SEQ ID NO: 8250163 - DNA, 22 bp, Homo sapiens
tggccagtgttggctagggaca

SEQ ID NO: 8250164 - DNA, 22 bp, Homo sapiens
tggccagtgttggctagggaca

SEQ ID NO: 8250165 - DNA, 22 bp, Homo sapiens
tggccagtgtcggaggccagga

SEQ ID NO: 8250166 - DNA, 22 bp, Homo sapiens
tggccagtgtgtgctgccggct

SEQ ID NO: 8250167 - DNA, 22 bp, Homo sapiens
tggccagttgaagacaatgctc

SEQ ID NO: 8250168 - DNA, 22 bp, Homo sapiens
tggccagtttgctcaggcagtc

SEQ ID NO: 8250169 - DNA, 22 bp, Homo sapiens
tggccagtttgctcaggcagtc

SEQ ID NO: 8250170 - DNA, 22 bp, Homo sapiens
tggccagtttgctcaggcagtc

SEQ ID NO: 8250171 - DNA, 22 bp, Homo sapiens
tggccatgaaggaggcagcaga

SEQ ID NO: 8250172 - DNA, 22 bp, Homo sapiens
tggccatgggatagtgcagggg

SEQ ID NO: 8250173 - DNA, 22 bp, Homo sapiens
tggccatgacatggaggctttg

SEQ ID NO: 8250174 - DNA, 22 bp, Homo sapiens
tggccatgggatagtgcagggg

SEQ ID NO: 8250175 - DNA, 22 bp, Homo sapiens
tggccatgggatagtgcagggg

SEQ ID NO: 8250176 - DNA, 22 bp, Homo sapiens
tggccctgggcagaggcaacat

SEQ ID NO: 8250177 - DNA, 22 bp, Homo sapiens
tggccctgggcatctttcgtga

SEQ ID NO: 8250178 - DNA, 22 bp, Homo sapiens
tggccctgggcagaggcaacat

SEQ ID NO: 8250179 - DNA, 22 bp, Homo sapiens
tggccctgccactcactgctga

SEQ ID NO: 8250180 - DNA, 22 bp, Homo sapiens
tggccctgccctcttcatcttt

SEQ ID NO: 8250181 - DNA, 22 bp, Homo sapiens
tggccctgccactcactgctga

SEQ ID NO: 8250182 - DNA, 22 bp, Homo sapiens
tggccctgccgcactatcctca

SEQ ID NO: 8250183 - DNA, 22 bp, Homo sapiens
tggccctgccgccacgacgtct

SEQ ID NO: 8250184 - DNA, 22 bp, Homo sapiens
tggccctgccctcttcatcttt

SEQ ID NO: 8250185 - DNA, 22 bp, Homo sapiens
tggccctgccgcactatcctca

SEQ ID NO: 8250186 - DNA, 22 bp, Homo sapiens
tggccctgtccctggagcctgg

SEQ ID NO: 8250187 - DNA, 22 bp, Homo sapiens
tggccctgtccctggagcctgg

SEQ ID NO: 8250188 - DNA, 22 bp, Homo sapiens
tggccctggtggcacagcctgc

SEQ ID NO: 8250189 - DNA, 22 bp, Homo sapiens
tggccctggtggcacagcctgc

SEQ ID NO: 8250190 - DNA, 22 bp, Homo sapiens
tggccctgtgactgagttctag

SEQ ID NO: 8250191 - DNA, 23 bp, Homo sapiens
tggccctgtgcatgctgcttccc

SEQ ID NO: 8250192 - DNA, 23 bp, Homo sapiens
tggccctgtgcatgctgcttccc

SEQ ID NO: 8250193 - DNA, 22 bp, Homo sapiens
tggccctgtcctcatttcatct

SEQ ID NO: 8250194 - DNA, 22 bp, Homo sapiens
tggccctgtcctcatttcatct

SEQ ID NO: 8250195 - DNA, 22 bp, Homo sapiens
tggccctgtctgcacacaggat

SEQ ID NO: 8250196 - DNA, 16 bp, Homo sapiens
tggccgcagaggcctc

SEQ ID NO: 8250197 - DNA, 22 bp, Homo sapiens
tggccggtgccgcgaagccggg

SEQ ID NO: 8250198 - DNA, 22 bp, Homo sapiens
tggcccttgtcctgggagagtt

SEQ ID NO: 8250199 - DNA, 22 bp, Homo sapiens
tggccctttgggtgcaggggca

SEQ ID NO: 8250200 - DNA, 22 bp, Homo sapiens
tggcccttttgtgaagtggcca

SEQ ID NO: 8250201 - DNA, 22 bp, Homo sapiens
tggccctttggtttatgactga

SEQ ID NO: 8250202 - DNA, 20 bp, Homo sapiens
tggccctgttttctccaggc

SEQ ID NO: 8250203 - DNA, 22 bp, Homo sapiens
tggcccttctgagcacagggcc

SEQ ID NO: 8250204 - DNA, 22 bp, Homo sapiens
tggcccttcaaattccctagtc

SEQ ID NO: 8250205 - DNA, 22 bp, Homo sapiens
tggcccttcaaattccctagtc

SEQ ID NO: 8250206 - DNA, 20 bp, Homo sapiens
tggccctgttttctccaggc

SEQ ID NO: 8250207 - DNA, 22 bp, Homo sapiens
tggccctgtggaggtcagtgag

SEQ ID NO: 8250208 - DNA, 22 bp, Homo sapiens
tggccctgtggaggtcagtgag

SEQ ID NO: 8250209 - DNA, 22 bp, Homo sapiens
tggccctgtgtcctgctgccag

SEQ ID NO: 8250210 - DNA, 22 bp, Homo sapiens
tggccctgtgtcctgctgccag

SEQ ID NO: 8250211 - DNA, 22 bp, Homo sapiens
tggccctgtgtgcaggctgcac

SEQ ID NO: 8250212 - DNA, 22 bp, Homo sapiens
tggccctgtgtgcaggctgcac

SEQ ID NO: 8250213 - DNA, 22 bp, Homo sapiens
tggccctgtgtgcaggctgcac

SEQ ID NO: 8250214 - DNA, 22 bp, Homo sapiens
tggccctgtgtgcaggctgcac

SEQ ID NO: 8250215 - DNA, 22 bp, Homo sapiens
tggcctctggctgaggactaac

SEQ ID NO: 8250216 - DNA, 20 bp, Homo sapiens
tggcctctgtagaggccaag

SEQ ID NO: 8250217 - DNA, 22 bp, Homo sapiens
tggcctctgaggcacctttgcc

SEQ ID NO: 8250218 - DNA, 22 bp, Homo sapiens
tggcctcttacgacatagcctt

SEQ ID NO: 8250219 - DNA, 22 bp, Homo sapiens
tggcctcttacgacatagcctt

SEQ ID NO: 8250220 - DNA, 22 bp, Homo sapiens
tggcctctttcttccctttgac

SEQ ID NO: 8250221 - DNA, 22 bp, Homo sapiens
tggcctcttaggacatcctcta

SEQ ID NO: 8250222 - DNA, 22 bp, Homo sapiens
tggcctgcccagagcagctctg

SEQ ID NO: 8250223 - DNA, 22 bp, Homo sapiens
tggcctgcctcccggcttcttt

SEQ ID NO: 8250224 - DNA, 22 bp, Homo sapiens
tggcctgccactgccacgccac

SEQ ID NO: 8250225 - DNA, 22 bp, Homo sapiens
tggcctgcccagagcagctctg

SEQ ID NO: 8250226 - DNA, 22 bp, Homo sapiens
tggcctgcccagagcagctctg

SEQ ID NO: 8250227 - DNA, 23 bp, Homo sapiens
tggcctgcagagtttctgctggg

SEQ ID NO: 8250228 - DNA, 22 bp, Homo sapiens
tggcctgactgtccagccaggg

SEQ ID NO: 8250229 - DNA, 22 bp, Homo sapiens
tggcctgaggctcggcatgggt

SEQ ID NO: 8250230 - DNA, 22 bp, Homo sapiens
tggcctgagttgtctgcaggcc

SEQ ID NO: 8250231 - DNA, 22 bp, Homo sapiens
tggcctgaggctcggcatgggt

SEQ ID NO: 8250232 - DNA, 22 bp, Homo sapiens
tggcctgcaaagtcttcttgct

SEQ ID NO: 8250233 - DNA, 22 bp, Homo sapiens
tggcctggaacctggcagggac

SEQ ID NO: 8250234 - DNA, 22 bp, Homo sapiens
tggcctggaacctggcagggac

SEQ ID NO: 8250235 - DNA, 22 bp, Homo sapiens
tggcctggaaaaatgcagatgg

SEQ ID NO: 8250236 - DNA, 22 bp, Homo sapiens
tggcctggaaaaatgcagatgg

SEQ ID NO: 8250237 - DNA, 22 bp, Homo sapiens
tggcctggaaaaatgcagatgg

SEQ ID NO: 8250238 - DNA, 22 bp, Homo sapiens
tggcctggaacctggcagggac

SEQ ID NO: 8250239 - DNA, 22 bp, Homo sapiens
tggcctggaacctggcagggac

SEQ ID NO: 8250240 - DNA, 22 bp, Homo sapiens
tggcctggaacctggcagggac

SEQ ID NO: 8250241 - DNA, 22 bp, Homo sapiens
tggcctggaagagaggtcgagg

SEQ ID NO: 8250242 - DNA, 22 bp, Homo sapiens
tggcctggaagagaggtcgagg

SEQ ID NO: 8250243 - DNA, 22 bp, Homo sapiens
tggcctggaaaaatgcagatgg

SEQ ID NO: 8250244 - DNA, 22 bp, Homo sapiens
tggcctggaaaaatgcagatgg

SEQ ID NO: 8250245 - DNA, 22 bp, Homo sapiens
tggcctgccttcgctgagctga

SEQ ID NO: 8250246 - DNA, 22 bp, Homo sapiens
tggcctgccttcgctgagctga

SEQ ID NO: 8250247 - DNA, 22 bp, Homo sapiens
tggcctggccacatccagcagg

SEQ ID NO: 8250248 - DNA, 22 bp, Homo sapiens
tggcctggccacatccagcagg

SEQ ID NO: 8250249 - DNA, 23 bp, Homo sapiens
tggcctggagagaaaagatgagt

SEQ ID NO: 8250250 - DNA, 22 bp, Homo sapiens
tggcctggcagagcaaggcctg

SEQ ID NO: 8250251 - DNA, 22 bp, Homo sapiens
tggcctggcagagcaaggcctg

SEQ ID NO: 8250252 - DNA, 22 bp, Homo sapiens
tggcctggcagagcaaggcctg

SEQ ID NO: 8250253 - DNA, 22 bp, Homo sapiens
tggcctggccacatccagcagg

SEQ ID NO: 8250254 - DNA, 18 bp, Homo sapiens
tggcctggagacaactct

SEQ ID NO: 8250255 - DNA, 18 bp, Homo sapiens
tggcctggagacaactct

SEQ ID NO: 8250256 - DNA, 22 bp, Homo sapiens
tggcctggaagagaggtcgagg

SEQ ID NO: 8250257 - DNA, 22 bp, Homo sapiens
tggcctggaagagaggtcgagg

SEQ ID NO: 8250258 - DNA, 22 bp, Homo sapiens
tggcctggaagagaggtcgagg

SEQ ID NO: 8250259 - DNA, 22 bp, Homo sapiens
tggcctggaagagaggtcgagg

SEQ ID NO: 8250260 - DNA, 23 bp, Homo sapiens
tggcctggagagaaaagatgagt

SEQ ID NO: 8250261 - DNA, 18 bp, Homo sapiens
tggcctggagacaactct

SEQ ID NO: 8250262 - DNA, 23 bp, Homo sapiens
tggcctggagagaaaagatgagt

SEQ ID NO: 8250263 - DNA, 23 bp, Homo sapiens
tggcctggagagaaaagatgagt

SEQ ID NO: 8250264 - DNA, 22 bp, Homo sapiens
tggctggagtataggagtagga

SEQ ID NO: 8250265 - DNA, 22 bp, Homo sapiens
tggctggagtctggtgctagcc

SEQ ID NO: 8250266 - DNA, 22 bp, Homo sapiens
tggctggagtctggtgctagcc

SEQ ID NO: 8250267 - DNA, 22 bp, Homo sapiens
tggctggagtctggtgctagcc

SEQ ID NO: 8250268 - DNA, 22 bp, Homo sapiens
tggctggagtgggagaagttta

SEQ ID NO: 8250269 - DNA, 22 bp, Homo sapiens
tggctggatatcagaggaagtg

SEQ ID NO: 8250270 - DNA, 21 bp, Homo sapiens
tggctggatagatgggaactg

SEQ ID NO: 8250271 - DNA, 22 bp, Homo sapiens
tggctggataatattctgttgt

SEQ ID NO: 8250272 - DNA, 22 bp, Homo sapiens
tggctggatgtgagatcaagag

SEQ ID NO: 8250273 - DNA, 22 bp, Homo sapiens
tggctggattattggctagtac

SEQ ID NO: 8250274 - DNA, 22 bp, Homo sapiens
tggctggattattggctagtac

SEQ ID NO: 8250275 - DNA, 22 bp, Homo sapiens
tggctggatgtgagatcaagag

SEQ ID NO: 8250276 - DNA, 22 bp, Homo sapiens
tggctggatatcaggcaagggg

SEQ ID NO: 8250277 - DNA, 22 bp, Homo sapiens
tggctggatatcaggcaagggg

SEQ ID NO: 8250278 - DNA, 22 bp, Homo sapiens
tggctggcaaggctggagtcag

SEQ ID NO: 8250279 - DNA, 22 bp, Homo sapiens
tggctggcaaggctggagtcag

SEQ ID NO: 8250280 - DNA, 22 bp, Homo sapiens
tggctggcaaggctggagtcag

SEQ ID NO: 8250281 - DNA, 22 bp, Homo sapiens
tggctggcaaggctggagtcag

SEQ ID NO: 8250282 - DNA, 22 bp, Homo sapiens
tggctggagcccctcaagagca

SEQ ID NO: 8250283 - DNA, 22 bp, Homo sapiens
tggctggagcattccttgtctt

SEQ ID NO: 8250284 - DNA, 22 bp, Homo sapiens
tggctggaggaaggaactgagg

SEQ ID NO: 8250285 - DNA, 22 bp, Homo sapiens
tggctggagcgccctcctctgc

SEQ ID NO: 8250286 - DNA, 22 bp, Homo sapiens
tggctggagcgccctcctctgc

SEQ ID NO: 8250287 - DNA, 22 bp, Homo sapiens
tggctggagggttagtgagata

SEQ ID NO: 8250288 - DNA, 22 bp, Homo sapiens
tggctggaggcatgcaagctcc

SEQ ID NO: 8250289 - DNA, 22 bp, Homo sapiens
tggctggaggcatgcaagctcc

SEQ ID NO: 8250290 - DNA, 22 bp, Homo sapiens
tggctggaggcatgcaagctcc

SEQ ID NO: 8250291 - DNA, 22 bp, Homo sapiens
tggctggagggacccactcaga

SEQ ID NO: 8250292 - DNA, 22 bp, Homo sapiens
tggctggacctgggctggaatt

SEQ ID NO: 8250293 - DNA, 22 bp, Homo sapiens
tggctggacctgggctggaatt

SEQ ID NO: 8250294 - DNA, 22 bp, Homo sapiens
tggctggagaacttggggatct

SEQ ID NO: 8250295 - DNA, 22 bp, Homo sapiens
tggctggagaacttggggatct

SEQ ID NO: 8250296 - DNA, 22 bp, Homo sapiens
tggctggagagggtcccatgag

SEQ ID NO: 8250297 - DNA, 19 bp, Homo sapiens
tggctggagatctgctact

SEQ ID NO: 8250298 - DNA, 22 bp, Homo sapiens
tggctggaatggagctgagcct

SEQ ID NO: 8250299 - DNA, 22 bp, Homo sapiens
tggctggacagtgggcagtgga

SEQ ID NO: 8250300 - DNA, 22 bp, Homo sapiens
tggctggacagtgggcagtgga

SEQ ID NO: 8250301 - DNA, 22 bp, Homo sapiens
tggctgggagctggaactgggc

SEQ ID NO: 8250302 - DNA, 22 bp, Homo sapiens
tggctgggagctggaactgggc

SEQ ID NO: 8250303 - DNA, 22 bp, Homo sapiens
tggctgggcccccacctgcctc

SEQ ID NO: 8250304 - DNA, 22 bp, Homo sapiens
tggctgggcccccacctgcctc

SEQ ID NO: 8250305 - DNA, 22 bp, Homo sapiens
tggctgggagctggaactgggc

SEQ ID NO: 8250306 - DNA, 22 bp, Homo sapiens
tggctgggagctggaactgggc

SEQ ID NO: 8250307 - DNA, 22 bp, Homo sapiens
tggctgggagctggaactgggc

SEQ ID NO: 8250308 - DNA, 22 bp, Homo sapiens
tggctgggagctggaactgggc

SEQ ID NO: 8250309 - DNA, 22 bp, Homo sapiens
tggctgggagctggaactgggc

SEQ ID NO: 8250310 - DNA, 22 bp, Homo sapiens
tggctggcgttggggccagtga

SEQ ID NO: 8250311 - DNA, 22 bp, Homo sapiens
tggctggctagaatggaaatgt

SEQ ID NO: 8250312 - DNA, 23 bp, Homo sapiens
tggctggcgcctgcctcaccctg

SEQ ID NO: 8250313 - DNA, 22 bp, Homo sapiens
tggctggcgccgggctagccac

SEQ ID NO: 8250314 - DNA, 22 bp, Homo sapiens
tggctggcgccgggctagccac

SEQ ID NO: 8250315 - DNA, 22 bp, Homo sapiens
tggctggcgttggggccagtga

SEQ ID NO: 8250316 - DNA, 23 bp, Homo sapiens
tggctggcgcctgcctcaccctg

SEQ ID NO: 8250317 - DNA, 22 bp, Homo sapiens
tggctggcagtaggctagtggc

SEQ ID NO: 8250318 - DNA, 23 bp, Homo sapiens
tggctggcagaaactgaagcatg

SEQ ID NO: 8250319 - DNA, 23 bp, Homo sapiens
tggctggcagaaactgaagcatg

SEQ ID NO: 8250320 - DNA, 22 bp, Homo sapiens
tggctggcagtaggctagtggc

SEQ ID NO: 8250321 - DNA, 22 bp, Homo sapiens
tggctggcagtaggctagtggc

SEQ ID NO: 8250322 - DNA, 22 bp, Homo sapiens
tggctggcagtaggctagtggc

SEQ ID NO: 8250323 - DNA, 22 bp, Homo sapiens
tggctggcgccgggctagccac

SEQ ID NO: 8250324 - DNA, 22 bp, Homo sapiens
tggctggcgccgggctagccac

SEQ ID NO: 8250325 - DNA, 22 bp, Homo sapiens
tggctggcgccgggctagccac

SEQ ID NO: 8250326 - DNA, 22 bp, Homo sapiens
tggctggccctgggagtgcaga

SEQ ID NO: 8250327 - DNA, 22 bp, Homo sapiens
tggctggcagttatctttggat

SEQ ID NO: 8250328 - DNA, 22 bp, Homo sapiens
tggctggcagttatctttggat

SEQ ID NO: 8250329 - DNA, 18 bp, Homo sapiens
tggctggcagtgggcagc

SEQ ID NO: 8250330 - DNA, 22 bp, Homo sapiens
tggctggcatagccattgctcc

SEQ ID NO: 8250331 - DNA, 22 bp, Homo sapiens
tggctggcatagccattgctcc

SEQ ID NO: 8250332 - DNA, 22 bp, Homo sapiens
tggctggcatagccattgctcc

SEQ ID NO: 8250333 - DNA, 22 bp, Homo sapiens
tggctggcatagccattgctcc

SEQ ID NO: 8250334 - DNA, 22 bp, Homo sapiens
tggctgtgttaccacttcatgt

SEQ ID NO: 8250335 - DNA, 22 bp, Homo sapiens
tggctgtgtgccaggctgtctg

SEQ ID NO: 8250336 - DNA, 22 bp, Homo sapiens
tggctgtgttaccacttcatgt

SEQ ID NO: 8250337 - DNA, 22 bp, Homo sapiens
tggcttaatatttcatatttaa

SEQ ID NO: 8250338 - DNA, 22 bp, Homo sapiens
tggctgtgtccctgtccagagt

SEQ ID NO: 8250339 - DNA, 22 bp, Homo sapiens
tggctgtgtccctgtccagagt

SEQ ID NO: 8250340 - DNA, 22 bp, Homo sapiens
tggcttcaaaggtagcatacaa

SEQ ID NO: 8250341 - DNA, 22 bp, Homo sapiens
tggcttcacacaggcacttccg

SEQ ID NO: 8250342 - DNA, 22 bp, Homo sapiens
tggctgtgggatgagagcctca

SEQ ID NO: 8250343 - DNA, 19 bp, Homo sapiens
tggctgtggggaaatgctt

SEQ ID NO: 8250344 - DNA, 22 bp, Homo sapiens
tggctgtggtttatcccagttc

SEQ ID NO: 8250345 - DNA, 22 bp, Homo sapiens
tggctgtcttcctggttcatgt

SEQ ID NO: 8250346 - DNA, 22 bp, Homo sapiens
tggctgtgaatggcaaataatc

SEQ ID NO: 8250347 - DNA, 22 bp, Homo sapiens
tggctgtgcggcctcgggcaga

SEQ ID NO: 8250348 - DNA, 19 bp, Homo sapiens
tggctgggtgccaatggcc

SEQ ID NO: 8250349 - DNA, 22 bp, Homo sapiens
tggctgggggtgctatagctgc

SEQ ID NO: 8250350 - DNA, 19 bp, Homo sapiens
tggctgggtgccaatggcc

SEQ ID NO: 8250351 - DNA, 22 bp, Homo sapiens
tggctgggggtgctatagctgc

SEQ ID NO: 8250352 - DNA, 22 bp, Homo sapiens
tggctggtcacatggtaggtct

SEQ ID NO: 8250353 - DNA, 22 bp, Homo sapiens
tggctggtcacatggtaggtct

SEQ ID NO: 8250354 - DNA, 22 bp, Homo sapiens
tggctgtcagctgcctggtgcg

SEQ ID NO: 8250355 - DNA, 22 bp, Homo sapiens
tggctgtagaatcagagacttg

SEQ ID NO: 8250356 - DNA, 22 bp, Homo sapiens
tggctggtcacatggtaggtct

SEQ ID NO: 8250357 - DNA, 22 bp, Homo sapiens
tggctggttttggtgagctccg

SEQ ID NO: 8250358 - DNA, 22 bp, Homo sapiens
tggctggggcctgaatcctgca

SEQ ID NO: 8250359 - DNA, 22 bp, Homo sapiens
tggctggggcctgaatcctgca

SEQ ID NO: 8250360 - DNA, 22 bp, Homo sapiens
tggctggggccacagttttcct

SEQ ID NO: 8250361 - DNA, 22 bp, Homo sapiens
tggctgggccgggccttgtgcc

SEQ ID NO: 8250362 - DNA, 22 bp, Homo sapiens
tggctgggccgggccttgtgcc

SEQ ID NO: 8250363 - DNA, 22 bp, Homo sapiens
tggctgggccgggccttgtgcc

SEQ ID NO: 8250364 - DNA, 19 bp, Homo sapiens
tggctgggcgtgcctccgt

SEQ ID NO: 8250365 - DNA, 22 bp, Homo sapiens
tgggaagactcctcaggaggcg

SEQ ID NO: 8250366 - DNA, 22 bp, Homo sapiens
tgggaagactcctcaggaggcg

SEQ ID NO: 8250367 - DNA, 22 bp, Homo sapiens
tgggaagaggagcactggaatg

SEQ ID NO: 8250368 - DNA, 22 bp, Homo sapiens
tgggaagaggcgggaggctgtt

SEQ ID NO: 8250369 - DNA, 22 bp, Homo sapiens
tgggaagaggagcactggaatg

SEQ ID NO: 8250370 - DNA, 22 bp, Homo sapiens
tgggaaagtgtagcctgcaggc

SEQ ID NO: 8250371 - DNA, 22 bp, Homo sapiens
tgggaaagtctttatttctctt

SEQ ID NO: 8250372 - DNA, 22 bp, Homo sapiens
tgggaaagtgttgaggtgtctt

SEQ ID NO: 8250373 - DNA, 22 bp, Homo sapiens
tgggaaagtgttgaggtgtctt

SEQ ID NO: 8250374 - DNA, 18 bp, Homo sapiens
tgggaaagtttatagaat

SEQ ID NO: 8250375 - DNA, 22 bp, Homo sapiens
tgggaaattgtatttctatttc

SEQ ID NO: 8250376 - DNA, 22 bp, Homo sapiens
tgggaacagtagctgctgagct

SEQ ID NO: 8250377 - DNA, 22 bp, Homo sapiens
tgggaaatatggcattgggcct

SEQ ID NO: 8250378 - DNA, 22 bp, Homo sapiens
tgggaaatataatttagctgtg

SEQ ID NO: 8250379 - DNA, 22 bp, Homo sapiens
tgggaaatattctaaaagtctt

SEQ ID NO: 8250380 - DNA, 22 bp, Homo sapiens
tgggaaatattctaaaagtctt

SEQ ID NO: 8250381 - DNA, 22 bp, Homo sapiens
tgggaaatattggttattggat

SEQ ID NO: 8250382 - DNA, 22 bp, Homo sapiens
tgggaaatcagtatagtatcag

SEQ ID NO: 8250383 - DNA, 22 bp, Homo sapiens
tgggaaatctttccgtatttat

SEQ ID NO: 8250384 - DNA, 22 bp, Homo sapiens
tgggaaatgctgcattgggcaa

SEQ ID NO: 8250385 - DNA, 23 bp, Homo sapiens
tgggaaatgtagccttggcatga

SEQ ID NO: 8250386 - DNA, 22 bp, Homo sapiens
tgggaaattgtatttctatttc

SEQ ID NO: 8250387 - DNA, 22 bp, Homo sapiens
tgggaaatgtgtttctggacca

SEQ ID NO: 8250388 - DNA, 21 bp, Homo sapiens
tggcttttatggagctctggg

SEQ ID NO: 8250389 - DNA, 22 bp, Homo sapiens
tggctttgaaatccagtcatta

SEQ ID NO: 8250390 - DNA, 22 bp, Homo sapiens
tgggaaagactcaggacaggag

SEQ ID NO: 8250391 - DNA, 22 bp, Homo sapiens
tggctttttctcagctctggct

SEQ ID NO: 8250392 - DNA, 22 bp, Homo sapiens
tgggaaagactcaggacaggag

SEQ ID NO: 8250393 - DNA, 19 bp, Homo sapiens
tgggaaagtaacatacaaa

SEQ ID NO: 8250394 - DNA, 22 bp, Homo sapiens
tgggaaagctgcagaaattctc

SEQ ID NO: 8250395 - DNA, 22 bp, Homo sapiens
tgggaaagactcaggacaggag

SEQ ID NO: 8250396 - DNA, 22 bp, Homo sapiens
tgggaaagccagcagtgtcacc

SEQ ID NO: 8250397 - DNA, 22 bp, Homo sapiens
tgggaaagccagcagtgtcacc

SEQ ID NO: 8250398 - DNA, 20 bp, Homo sapiens
tgggaaagtctaagtgcctc

SEQ ID NO: 8250399 - DNA, 22 bp, Homo sapiens
tgggaaagtaattgtcatcctt

SEQ ID NO: 8250400 - DNA, 19 bp, Homo sapiens
tgggaaagtaacatacaaa

SEQ ID NO: 8250401 - DNA, 22 bp, Homo sapiens
tggcttcttagaccagtggcct

SEQ ID NO: 8250402 - DNA, 19 bp, Homo sapiens
tggcttcttcggtgttccc

SEQ ID NO: 8250403 - DNA, 22 bp, Homo sapiens
tggcttcttgatcttggacttg

SEQ ID NO: 8250404 - DNA, 22 bp, Homo sapiens
tggcttcttgatcttggacttg

SEQ ID NO: 8250405 - DNA, 22 bp, Homo sapiens
tggcttcttgacttcttggctg

SEQ ID NO: 8250406 - DNA, 23 bp, Homo sapiens
tggctttattcacatatctgacc

SEQ ID NO: 8250407 - DNA, 22 bp, Homo sapiens
tggctttcgctatagagcacgg

SEQ ID NO: 8250408 - DNA, 22 bp, Homo sapiens
tggctttctcccccagcttctc

SEQ ID NO: 8250409 - DNA, 22 bp, Homo sapiens
tggcttcactgctcaagtgatt

SEQ ID NO: 8250410 - DNA, 22 bp, Homo sapiens
tggcttcagagtctgagttctt

SEQ ID NO: 8250411 - DNA, 17 bp, Homo sapiens
tggcttcagatgtacat

SEQ ID NO: 8250412 - DNA, 18 bp, Homo sapiens
tggcttcctgcgggctgc

SEQ ID NO: 8250413 - DNA, 19 bp, Homo sapiens
tggcttcctgactctcatc

SEQ ID NO: 8250414 - DNA, 22 bp, Homo sapiens
tggcttcctccagagcaggagg

SEQ ID NO: 8250415 - DNA, 22 bp, Homo sapiens
tggcttcctaggagcccgtgct

SEQ ID NO: 8250416 - DNA, 22 bp, Homo sapiens
tggcttccgccgcgggcctcgg

SEQ ID NO: 8250417 - DNA, 17 bp, Homo sapiens
tggcttccctgggccac

SEQ ID NO: 8250418 - DNA, 17 bp, Homo sapiens
tggcttccctgggccac

SEQ ID NO: 8250419 - DNA, 22 bp, Homo sapiens
tggcttctaaagtttcttttag

SEQ ID NO: 8250420 - DNA, 22 bp, Homo sapiens
tggcttctagcagtgttgattt

SEQ ID NO: 8250421 - DNA, 22 bp, Homo sapiens
tggcttctagtttgaggaaaaa

SEQ ID NO: 8250422 - DNA, 22 bp, Homo sapiens
tggcttctcagaatactctgga

SEQ ID NO: 8250423 - DNA, 22 bp, Homo sapiens
tggcttctattgctgtggcatt

SEQ ID NO: 8250424 - DNA, 18 bp, Homo sapiens
tggcttctattttactca

SEQ ID NO: 8250425 - DNA, 22 bp, Homo sapiens
tggcttctccagaaatcttggt

SEQ ID NO: 8250426 - DNA, 22 bp, Homo sapiens
tggcttctcagtttcataatga

SEQ ID NO: 8250427 - DNA, 22 bp, Homo sapiens
tggcttctcagtttcataatga

SEQ ID NO: 8250428 - DNA, 22 bp, Homo sapiens
tggcttctcagaatactctgga

SEQ ID NO: 8250429 - DNA, 22 bp, Homo sapiens
tggcttctccctacaacatgcc

SEQ ID NO: 8250430 - DNA, 22 bp, Homo sapiens
tggcttctcccgacaccctggc

SEQ ID NO: 8250431 - DNA, 20 bp, Homo sapiens
tggcttctcttcactcctgt

SEQ ID NO: 8250432 - DNA, 22 bp, Homo sapiens
tggcttctctgttttagtattt

SEQ ID NO: 8250433 - DNA, 22 bp, Homo sapiens
tggcttctctgttttagtattt

SEQ ID NO: 8250434 - DNA, 22 bp, Homo sapiens
tggcttctgagcattgaaacgt

SEQ ID NO: 8250435 - DNA, 22 bp, Homo sapiens
tggcttctgcatatttttagag

SEQ ID NO: 8250436 - DNA, 19 bp, Homo sapiens
tggcttctgttttcatgtt

SEQ ID NO: 8250437 - DNA, 22 bp, Homo sapiens
tggcttctgggacttgtgagca

SEQ ID NO: 8250438 - DNA, 22 bp, Homo sapiens
tggcttctgctcccagaatgat

SEQ ID NO: 8250439 - DNA, 23 bp, Homo sapiens
tggcttctgccccattctctcca

SEQ ID NO: 8250440 - DNA, 22 bp, Homo sapiens
tggcttctgctcccagaatgat

SEQ ID NO: 8250441 - DNA, 22 bp, Homo sapiens
tggcttctgctcccagaatgat

SEQ ID NO: 8250442 - DNA, 22 bp, Homo sapiens
tgggaagggtctgaatctgaga

SEQ ID NO: 8250443 - DNA, 22 bp, Homo sapiens
tgggaaggtacacgggaaagag

SEQ ID NO: 8250444 - DNA, 22 bp, Homo sapiens
tgggaagggtctgaatctgaga

SEQ ID NO: 8250445 - DNA, 22 bp, Homo sapiens
tgggaagggtcagtttcttcat

SEQ ID NO: 8250446 - DNA, 22 bp, Homo sapiens
tgggaagggtcagtttcttcat

SEQ ID NO: 8250447 - DNA, 22 bp, Homo sapiens
tgggaagggtcaacagctggaa

SEQ ID NO: 8250448 - DNA, 22 bp, Homo sapiens
tgggaagggtcaacagctggaa

SEQ ID NO: 8250449 - DNA, 22 bp, Homo sapiens
tgggaagggtcaacagctggaa

SEQ ID NO: 8250450 - DNA, 22 bp, Homo sapiens
tgggaaggtgattttccaaaag

SEQ ID NO: 8250451 - DNA, 22 bp, Homo sapiens
tgggaaggtgattttccaaaag

SEQ ID NO: 8250452 - DNA, 22 bp, Homo sapiens
tgggaaggtgtagaaagaacaa

SEQ ID NO: 8250453 - DNA, 22 bp, Homo sapiens
tgggaaggtgtagaaagaacaa

SEQ ID NO: 8250454 - DNA, 22 bp, Homo sapiens
tgggaaggtacacgggaaagag

SEQ ID NO: 8250455 - DNA, 22 bp, Homo sapiens
tgggaaggtacacgggaaagag

SEQ ID NO: 8250456 - DNA, 22 bp, Homo sapiens
tgggaaggtacacgggaaagag

SEQ ID NO: 8250457 - DNA, 22 bp, Homo sapiens
tgggaagggcctgcccttcctc

SEQ ID NO: 8250458 - DNA, 22 bp, Homo sapiens
tgggaaggggagctggaaagga

SEQ ID NO: 8250459 - DNA, 22 bp, Homo sapiens
tgggaagggcctgcccttcctc

SEQ ID NO: 8250460 - DNA, 22 bp, Homo sapiens
tgggaagggcctgcccttcctc

SEQ ID NO: 8250461 - DNA, 22 bp, Homo sapiens
tgggaaggggagctggaaagga

SEQ ID NO: 8250462 - DNA, 22 bp, Homo sapiens
tgggaaggggagctggaaagga

SEQ ID NO: 8250463 - DNA, 22 bp, Homo sapiens
tgggaaggggagctggaaagga

SEQ ID NO: 8250464 - DNA, 22 bp, Homo sapiens
tgggaagggtcaacagctggaa

SEQ ID NO: 8250465 - DNA, 22 bp, Homo sapiens
tgggaagggtcaacagctggaa

SEQ ID NO: 8250466 - DNA, 22 bp, Homo sapiens
tgggaagggtcaacagctggaa

SEQ ID NO: 8250467 - DNA, 22 bp, Homo sapiens
tgggaagggtcaacagctggaa

SEQ ID NO: 8250468 - DNA, 22 bp, Homo sapiens
tgggaagggtcaacagctggaa

SEQ ID NO: 8250469 - DNA, 22 bp, Homo sapiens
tgggaagggtcaacagctggaa

SEQ ID NO: 8250470 - DNA, 22 bp, Homo sapiens
tgggaagggtcaacagctggaa

SEQ ID NO: 8250471 - DNA, 22 bp, Homo sapiens
tgggaagagttagagacagctg

SEQ ID NO: 8250472 - DNA, 22 bp, Homo sapiens
tgggaagatatgagtgaccaac

SEQ ID NO: 8250473 - DNA, 22 bp, Homo sapiens
tgggaagatatgagtgaccaac

SEQ ID NO: 8250474 - DNA, 23 bp, Homo sapiens
tgggaagatatgtatgttcaagg

SEQ ID NO: 8250475 - DNA, 22 bp, Homo sapiens
tgggaagagttagagacagctg

SEQ ID NO: 8250476 - DNA, 22 bp, Homo sapiens
tgggaagaggggtataaagaag

SEQ ID NO: 8250477 - DNA, 22 bp, Homo sapiens
tgggaagaggcgggaggctgtt

SEQ ID NO: 8250478 - DNA, 22 bp, Homo sapiens
tgggaagcacgctcagcagaaa

SEQ ID NO: 8250479 - DNA, 22 bp, Homo sapiens
tgggaagcattaatgatagggg

SEQ ID NO: 8250480 - DNA, 22 bp, Homo sapiens
tgggaagcattaatgatagggg

SEQ ID NO: 8250481 - DNA, 22 bp, Homo sapiens
tgggaagatggagtgacaggca

SEQ ID NO: 8250482 - DNA, 22 bp, Homo sapiens
tgggaaggcgtggaagtagaag

SEQ ID NO: 8250483 - DNA, 22 bp, Homo sapiens
tgggaaggcgtggaagtagaag

SEQ ID NO: 8250484 - DNA, 22 bp, Homo sapiens
tgggaagggagagtgtcctgga

SEQ ID NO: 8250485 - DNA, 22 bp, Homo sapiens
tgggaagggagagtgtcctgga

SEQ ID NO: 8250486 - DNA, 22 bp, Homo sapiens
tgggaagggagagtgtcctgga

SEQ ID NO: 8250487 - DNA, 22 bp, Homo sapiens
tgggaagctactcatgcaggca

SEQ ID NO: 8250488 - DNA, 22 bp, Homo sapiens
tgggaagcctagcagacagctg

SEQ ID NO: 8250489 - DNA, 22 bp, Homo sapiens
tgggaaggcgtggaagtagaag

SEQ ID NO: 8250490 - DNA, 22 bp, Homo sapiens
tgggaagggccgatggagcctc

SEQ ID NO: 8250491 - DNA, 22 bp, Homo sapiens
tgggaagggccgatggagcctc

SEQ ID NO: 8250492 - DNA, 22 bp, Homo sapiens
tgggaagggccgatggagcctc

SEQ ID NO: 8250493 - DNA, 22 bp, Homo sapiens
tgggaagggagtttcttggagt

SEQ ID NO: 8250494 - DNA, 22 bp, Homo sapiens
tgggaagggagtttcttggagt

SEQ ID NO: 8250495 - DNA, 22 bp, Homo sapiens
tgggaagggccgatggagcctc

SEQ ID NO: 8250496 - DNA, 22 bp, Homo sapiens
tgggaatgctgagcccatgtat

SEQ ID NO: 8250497 - DNA, 22 bp, Homo sapiens
tgggaatgctgagcccatgtat

SEQ ID NO: 8250498 - DNA, 22 bp, Homo sapiens
tgggaatgctgatttcaggaac

SEQ ID NO: 8250499 - DNA, 22 bp, Homo sapiens
tgggaatgggcctagaaggctg

SEQ ID NO: 8250500 - DNA, 22 bp, Homo sapiens
tgggaatggatgctaagtgcta

SEQ ID NO: 8250501 - DNA, 22 bp, Homo sapiens
tgggacacaaaccagaccagga

SEQ ID NO: 8250502 - DNA, 22 bp, Homo sapiens
tgggaatgtggcaaggcataga

SEQ ID NO: 8250503 - DNA, 22 bp, Homo sapiens
tgggaatgtgagcattcattca

SEQ ID NO: 8250504 - DNA, 22 bp, Homo sapiens
tgggaatgggcctagaaggctg

SEQ ID NO: 8250505 - DNA, 22 bp, Homo sapiens
tgggaatgtagaatgtaaacca

SEQ ID NO: 8250506 - DNA, 22 bp, Homo sapiens
tgggaatgtagaatgtaaacca

SEQ ID NO: 8250507 - DNA, 23 bp, Homo sapiens
tgggaatgacatctagagcagag

SEQ ID NO: 8250508 - DNA, 23 bp, Homo sapiens
tgggaatgacatctagagcagag

SEQ ID NO: 8250509 - DNA, 23 bp, Homo sapiens
tgggaatgacatctagagcagag

SEQ ID NO: 8250510 - DNA, 18 bp, Homo sapiens
tgggaatgctcaaggccc

SEQ ID NO: 8250511 - DNA, 22 bp, Homo sapiens
tgggaatgcaaggaaagctgtt

SEQ ID NO: 8250512 - DNA, 22 bp, Homo sapiens
tgggaagttaggatgccaggga

SEQ ID NO: 8250513 - DNA, 22 bp, Homo sapiens
tgggaaggttagcagtttgtca

SEQ ID NO: 8250514 - DNA, 22 bp, Homo sapiens
tgggaaggttagcagtttgtca

SEQ ID NO: 8250515 - DNA, 22 bp, Homo sapiens
tgggaagtaggacagtgcagtt

SEQ ID NO: 8250516 - DNA, 22 bp, Homo sapiens
tgggacaccctcacgcctgcac

SEQ ID NO: 8250517 - DNA, 22 bp, Homo sapiens
tgggacagggaatctgatcccc

SEQ ID NO: 8250518 - DNA, 22 bp, Homo sapiens
tgggacagggaatctgatcccc

SEQ ID NO: 8250519 - DNA, 22 bp, Homo sapiens
tgggacacctcagatagtgtct

SEQ ID NO: 8250520 - DNA, 22 bp, Homo sapiens
tgggacacagaaaaggcaggtt

SEQ ID NO: 8250521 - DNA, 22 bp, Homo sapiens
tgggacacaaaccagaccagga

SEQ ID NO: 8250522 - DNA, 22 bp, Homo sapiens
tgggacaggttggagagaagca

SEQ ID NO: 8250523 - DNA, 22 bp, Homo sapiens
tgggacaggttggagagaagca

SEQ ID NO: 8250524 - DNA, 22 bp, Homo sapiens
tgggacagtgaccccagaggtc

SEQ ID NO: 8250525 - DNA, 22 bp, Homo sapiens
tgggacagtgaccccagaggtc

SEQ ID NO: 8250526 - DNA, 22 bp, Homo sapiens
tgggacagtgtgccttgctcct

SEQ ID NO: 8250527 - DNA, 21 bp, Homo sapiens
tgggacagtgatggctcctcc

SEQ ID NO: 8250528 - DNA, 21 bp, Homo sapiens
tgggacagtgatggctcctcc

SEQ ID NO: 8250529 - DNA, 21 bp, Homo sapiens
tgggacagtgatggctcctcc

SEQ ID NO: 8250530 - DNA, 21 bp, Homo sapiens
tgggacagtgatggctcctcc

SEQ ID NO: 8250531 - DNA, 22 bp, Homo sapiens
tgggacagtgaccccagaggtc

SEQ ID NO: 8250532 - DNA, 22 bp, Homo sapiens
tgggacagttgtcctccactct

SEQ ID NO: 8250533 - DNA, 22 bp, Homo sapiens
tgggacagttgtcctccactct

SEQ ID NO: 8250534 - DNA, 22 bp, Homo sapiens
tgggacagtgtgccttgctcct

SEQ ID NO: 8250535 - DNA, 22 bp, Homo sapiens
tgggacagtgtgccttgctcct

SEQ ID NO: 8250536 - DNA, 22 bp, Homo sapiens
tgggacagtgtgccttgctcct

SEQ ID NO: 8250537 - DNA, 22 bp, Homo sapiens
tgggacagtgtgccttgctcct

SEQ ID NO: 8250538 - DNA, 22 bp, Homo sapiens
tgggacagtgtgccttgctcct

SEQ ID NO: 8250539 - DNA, 22 bp, Homo sapiens
tgggacctctcttgagagagca

SEQ ID NO: 8250540 - DNA, 21 bp, Homo sapiens
tgggacctatttcaactggat

SEQ ID NO: 8250541 - DNA, 22 bp, Homo sapiens
tgggacctgttacattgagtta

SEQ ID NO: 8250542 - DNA, 23 bp, Homo sapiens
tgggacctgtttgcccacagatg

SEQ ID NO: 8250543 - DNA, 16 bp, Homo sapiens
tgggacctgtggccaa

SEQ ID NO: 8250544 - DNA, 22 bp, Homo sapiens
tgggacctgctcttggaatgag

SEQ ID NO: 8250545 - DNA, 22 bp, Homo sapiens
tgggacctgctcctggaatgag

SEQ ID NO: 8250546 - DNA, 22 bp, Homo sapiens
tgggacctgccctggccccatc

SEQ ID NO: 8250547 - DNA, 20 bp, Homo sapiens
tgggactgacccatctgagc

SEQ ID NO: 8250548 - DNA, 22 bp, Homo sapiens
tgggactgtgacctccagggta

SEQ ID NO: 8250549 - DNA, 22 bp, Homo sapiens
tgggactgctcttgctggggtc

SEQ ID NO: 8250550 - DNA, 22 bp, Homo sapiens
tgggactgctcttgctggggtc

SEQ ID NO: 8250551 - DNA, 22 bp, Homo sapiens
tgggactgtgacctccagggta

SEQ ID NO: 8250552 - DNA, 22 bp, Homo sapiens
tgggactgagaatatgatgggg

SEQ ID NO: 8250553 - DNA, 22 bp, Homo sapiens
tgggaggcagaagttgactgga

SEQ ID NO: 8250554 - DNA, 22 bp, Homo sapiens
tgggaggcagaagttgactgga

SEQ ID NO: 8250555 - DNA, 22 bp, Homo sapiens
tgggaggcagaagttgactgga

SEQ ID NO: 8250556 - DNA, 22 bp, Homo sapiens
tgggaggatctcttgaggccag

SEQ ID NO: 8250557 - DNA, 22 bp, Homo sapiens
tgggaggatctcttgaggccag

SEQ ID NO: 8250558 - DNA, 22 bp, Homo sapiens
tgggaggatctcttgaggccag

SEQ ID NO: 8250559 - DNA, 22 bp, Homo sapiens
tgggaggatctcttgaggccag

SEQ ID NO: 8250560 - DNA, 22 bp, Homo sapiens
tgggaggatcgcttgagcccag

SEQ ID NO: 8250561 - DNA, 22 bp, Homo sapiens
tgggaggatcgcttgagcccag

SEQ ID NO: 8250562 - DNA, 22 bp, Homo sapiens
tgggaggatctcttgaggccag

SEQ ID NO: 8250563 - DNA, 22 bp, Homo sapiens
tgggaggatctcttgaggccag

SEQ ID NO: 8250564 - DNA, 22 bp, Homo sapiens
tgggaggatcgcttgagcccag

SEQ ID NO: 8250565 - DNA, 22 bp, Homo sapiens
tgggaggatcgcttgagcccag

SEQ ID NO: 8250566 - DNA, 22 bp, Homo sapiens
tgggaggagccctctgggaagg

SEQ ID NO: 8250567 - DNA, 22 bp, Homo sapiens
tgggaggagccctctgggaagg

SEQ ID NO: 8250568 - DNA, 22 bp, Homo sapiens
tgggaggagccctctgggaagg

SEQ ID NO: 8250569 - DNA, 22 bp, Homo sapiens
tgggaggagccctctgggaagg

SEQ ID NO: 8250570 - DNA, 22 bp, Homo sapiens
tgggaggaatgtcactgagcca

SEQ ID NO: 8250571 - DNA, 22 bp, Homo sapiens
tgggaggaagtgctaatgggag

SEQ ID NO: 8250572 - DNA, 22 bp, Homo sapiens
tgggaggaagtgctaatgggag

SEQ ID NO: 8250573 - DNA, 22 bp, Homo sapiens
tgggaggaatgtcactgagcca

SEQ ID NO: 8250574 - DNA, 22 bp, Homo sapiens
tgggaggaatgtcactgagcca

SEQ ID NO: 8250575 - DNA, 22 bp, Homo sapiens
tgggaggaatgtcactgagcca

SEQ ID NO: 8250576 - DNA, 22 bp, Homo sapiens
tgggaggacttgtgggcttcat

SEQ ID NO: 8250577 - DNA, 22 bp, Homo sapiens
tgggaggacttgtgggcttcat

SEQ ID NO: 8250578 - DNA, 22 bp, Homo sapiens
tgggaggacttgtgggcttcat

SEQ ID NO: 8250579 - DNA, 22 bp, Homo sapiens
tgggaggacttgtgggcttcat

SEQ ID NO: 8250580 - DNA, 22 bp, Homo sapiens
tgggaggacttgtgggcttcat

SEQ ID NO: 8250581 - DNA, 22 bp, Homo sapiens
tgggagctggggttggacgtct

SEQ ID NO: 8250582 - DNA, 20 bp, Homo sapiens
tgggagctggtgaggtctca

SEQ ID NO: 8250583 - DNA, 22 bp, Homo sapiens
tgggaggaagtgctaatgggag

SEQ ID NO: 8250584 - DNA, 22 bp, Homo sapiens
tgggaggaagtgctaatgggag

SEQ ID NO: 8250585 - DNA, 22 bp, Homo sapiens
tgggagctggggttggacgtct

SEQ ID NO: 8250586 - DNA, 22 bp, Homo sapiens
tgggagcagcagggagatgcgg

SEQ ID NO: 8250587 - DNA, 22 bp, Homo sapiens
tgggagcagcagggagatgcgg

SEQ ID NO: 8250588 - DNA, 22 bp, Homo sapiens
tgggagcagcagggagatgcgg

SEQ ID NO: 8250589 - DNA, 22 bp, Homo sapiens
tgggagcagcattgccatgtgc

SEQ ID NO: 8250590 - DNA, 22 bp, Homo sapiens
tgggagcagccaacatggcctt

SEQ ID NO: 8250591 - DNA, 22 bp, Homo sapiens
tgggagctcctggagggcagga

SEQ ID NO: 8250592 - DNA, 22 bp, Homo sapiens
tgggagcagctttgcgagggag

SEQ ID NO: 8250593 - DNA, 22 bp, Homo sapiens
tgggagcagcctcagcttcggg

SEQ ID NO: 8250594 - DNA, 22 bp, Homo sapiens
tgggagcaccctgaggagcttc

SEQ ID NO: 8250595 - DNA, 22 bp, Homo sapiens
tgggagcaccctgaggagcttc

SEQ ID NO: 8250596 - DNA, 22 bp, Homo sapiens
tgggagcaagctggtgctggag

SEQ ID NO: 8250597 - DNA, 22 bp, Homo sapiens
tgggagcaagctggtgctggag

SEQ ID NO: 8250598 - DNA, 22 bp, Homo sapiens
tgggagcaagctggtgctggag

SEQ ID NO: 8250599 - DNA, 22 bp, Homo sapiens
tgggagcaccttgagggcagaa

SEQ ID NO: 8250600 - DNA, 22 bp, Homo sapiens
tgggagcaccttgagggcagaa

SEQ ID NO: 8250601 - DNA, 22 bp, Homo sapiens
tgggagcaccttgagggcagaa

SEQ ID NO: 8250602 - DNA, 22 bp, Homo sapiens
tgggagcactctttgggaagca

SEQ ID NO: 8250603 - DNA, 22 bp, Homo sapiens
tgggagagtaaccaattccttc

SEQ ID NO: 8250604 - DNA, 22 bp, Homo sapiens
tgggagagtaaccaattccttc

SEQ ID NO: 8250605 - DNA, 22 bp, Homo sapiens
tgggagagtaaccaattccttc

SEQ ID NO: 8250606 - DNA, 22 bp, Homo sapiens
tgggagagtctaaaaccgaggt

SEQ ID NO: 8250607 - DNA, 21 bp, Homo sapiens
tgggagagggctcagctaccc

SEQ ID NO: 8250608 - DNA, 21 bp, Homo sapiens
tgggagagggctcagctaccc

SEQ ID NO: 8250609 - DNA, 21 bp, Homo sapiens
tgggagagggctcagctaccc

SEQ ID NO: 8250610 - DNA, 19 bp, Homo sapiens
tgggagaggcaacagagta

SEQ ID NO: 8250611 - DNA, 19 bp, Homo sapiens
tgggagaggcaacagagta

SEQ ID NO: 8250612 - DNA, 19 bp, Homo sapiens
tgggagaggcaacagagta

SEQ ID NO: 8250613 - DNA, 19 bp, Homo sapiens
tgggagaggcaacagagta

SEQ ID NO: 8250614 - DNA, 22 bp, Homo sapiens
tgggagaggctgccatcttgca

SEQ ID NO: 8250615 - DNA, 22 bp, Homo sapiens
tgggagaggctgccatcttgca

SEQ ID NO: 8250616 - DNA, 22 bp, Homo sapiens
tgggagaggctgccatcttgca

SEQ ID NO: 8250617 - DNA, 22 bp, Homo sapiens
tgggagatatccggcctccgtg

SEQ ID NO: 8250618 - DNA, 22 bp, Homo sapiens
tgggagagtttgtttagagtga

SEQ ID NO: 8250619 - DNA, 22 bp, Homo sapiens
tgggagagtttgtttagagtga

SEQ ID NO: 8250620 - DNA, 22 bp, Homo sapiens
tgggagagtctaaaaccgaggt

SEQ ID NO: 8250621 - DNA, 22 bp, Homo sapiens
tgggagagtctaaaaccgaggt

SEQ ID NO: 8250622 - DNA, 22 bp, Homo sapiens
tgggagagtgctcaatgtgcaa

SEQ ID NO: 8250623 - DNA, 22 bp, Homo sapiens
tgggagagtgctcaatgtgcaa

SEQ ID NO: 8250624 - DNA, 22 bp, Homo sapiens
tgggagagtgctcaatgtgcaa

SEQ ID NO: 8250625 - DNA, 22 bp, Homo sapiens
tgggagcaagctacttagggaa

SEQ ID NO: 8250626 - DNA, 22 bp, Homo sapiens
tgggagcaaatgactgggagat

SEQ ID NO: 8250627 - DNA, 22 bp, Homo sapiens
tgggagcaaatgactgggagat

SEQ ID NO: 8250628 - DNA, 22 bp, Homo sapiens
tgggagatggttctgagacttt

SEQ ID NO: 8250629 - DNA, 20 bp, Homo sapiens
tgggagatgatctccttgct

SEQ ID NO: 8250630 - DNA, 22 bp, Homo sapiens
tgggagatcttgaggcttattt

SEQ ID NO: 8250631 - DNA, 22 bp, Homo sapiens
tgggagatattgctgtggctgt

SEQ ID NO: 8250632 - DNA, 22 bp, Homo sapiens
tgggagatattgctgtggctgt

SEQ ID NO: 8250633 - DNA, 20 bp, Homo sapiens
tgggagatgatctccttgct

SEQ ID NO: 8250634 - DNA, 22 bp, Homo sapiens
tgggagatggttctgagacttt

SEQ ID NO: 8250635 - DNA, 22 bp, Homo sapiens
tgggagaagcatggggtgcaga

SEQ ID NO: 8250636 - DNA, 22 bp, Homo sapiens
tgggagaagcagtgggacagta

SEQ ID NO: 8250637 - DNA, 22 bp, Homo sapiens
tgggagagaataatcaataggt

SEQ ID NO: 8250638 - DNA, 22 bp, Homo sapiens
tgggagagcttcatgccttcag

SEQ ID NO: 8250639 - DNA, 22 bp, Homo sapiens
tgggagagcttcatgccttcag

SEQ ID NO: 8250640 - DNA, 21 bp, Homo sapiens
tgggagaccgccttcctggga

SEQ ID NO: 8250641 - DNA, 23 bp, Homo sapiens
tgggagacttttcattttgttct

SEQ ID NO: 8250642 - DNA, 22 bp, Homo sapiens
tgggagacactggtgggagctt

SEQ ID NO: 8250643 - DNA, 22 bp, Homo sapiens
tgggagacactggtgggagctt

SEQ ID NO: 8250644 - DNA, 22 bp, Homo sapiens
tgggagacactggtgggagctt

SEQ ID NO: 8250645 - DNA, 22 bp, Homo sapiens
tgggacttgcctcgagggctgc

SEQ ID NO: 8250646 - DNA, 22 bp, Homo sapiens
tgggacttcaatgcaatgaggt

SEQ ID NO: 8250647 - DNA, 22 bp, Homo sapiens
tgggacttaatatgcccttgat

SEQ ID NO: 8250648 - DNA, 22 bp, Homo sapiens
tgggacttgcctcgagggctgc

SEQ ID NO: 8250649 - DNA, 22 bp, Homo sapiens
tgggacttcaatgcaatgaggt

SEQ ID NO: 8250650 - DNA, 22 bp, Homo sapiens
tgggagaacccagggtcaggct

SEQ ID NO: 8250651 - DNA, 22 bp, Homo sapiens
tgggagaacccagggtcaggct

SEQ ID NO: 8250652 - DNA, 22 bp, Homo sapiens
tgggagaacccagggtcaggct

SEQ ID NO: 8250653 - DNA, 20 bp, Homo sapiens
tgggagaagaacactggaac

SEQ ID NO: 8250654 - DNA, 22 bp, Homo sapiens
tgggagaagcagcagccaagtg

SEQ ID NO: 8250655 - DNA, 22 bp, Homo sapiens
tgggagaagcagcagccaagtg

SEQ ID NO: 8250656 - DNA, 22 bp, Homo sapiens
tggcgaggccaggccagggcct

SEQ ID NO: 8250657 - DNA, 22 bp, Homo sapiens
tggcgagcatccagcgcatcca

SEQ ID NO: 8250658 - DNA, 22 bp, Homo sapiens
tggcgagccccgactgagtgtt

SEQ ID NO: 8250659 - DNA, 22 bp, Homo sapiens
tggccttgttctctctcccatc

SEQ ID NO: 8250660 - DNA, 22 bp, Homo sapiens
tggcgaggtttcagagagcggc

SEQ ID NO: 8250661 - DNA, 22 bp, Homo sapiens
tggcgaggtttcagagagcggc

SEQ ID NO: 8250662 - DNA, 18 bp, Homo sapiens
tggcgatggtcatttttc

SEQ ID NO: 8250663 - DNA, 22 bp, Homo sapiens
tggccttggccgtgctggggtc

SEQ ID NO: 8250664 - DNA, 22 bp, Homo sapiens
tggccttgtgtttaagcaagaa

SEQ ID NO: 8250665 - DNA, 22 bp, Homo sapiens
tggccttgtgttttagagaaag

SEQ ID NO: 8250666 - DNA, 22 bp, Homo sapiens
tggccttggtcctctttgcaat

SEQ ID NO: 8250667 - DNA, 22 bp, Homo sapiens
tggccttgtctctcagaaccgc

SEQ ID NO: 8250668 - DNA, 22 bp, Homo sapiens
tggccttgaaccaggtctccac

SEQ ID NO: 8250669 - DNA, 22 bp, Homo sapiens
tggccttcctggtgactcatga

SEQ ID NO: 8250670 - DNA, 22 bp, Homo sapiens
tggcctgtgtggcttcctggga

SEQ ID NO: 8250671 - DNA, 22 bp, Homo sapiens
tggcctgttgctcctaggggtc

SEQ ID NO: 8250672 - DNA, 22 bp, Homo sapiens
tggcctgttgctcctaggggtc

SEQ ID NO: 8250673 - DNA, 22 bp, Homo sapiens
tggcctgtcttgttgtgctaga

SEQ ID NO: 8250674 - DNA, 22 bp, Homo sapiens
tggcctgtcttgttgtgctaga

SEQ ID NO: 8250675 - DNA, 22 bp, Homo sapiens
tggcctgtggcttaaggtctgt

SEQ ID NO: 8250676 - DNA, 22 bp, Homo sapiens
tggccttggcagtgagaagagt

SEQ ID NO: 8250677 - DNA, 22 bp, Homo sapiens
tggccttggagaggcacggccc

SEQ ID NO: 8250678 - DNA, 22 bp, Homo sapiens
tggccttggagaggcacggccc

SEQ ID NO: 8250679 - DNA, 22 bp, Homo sapiens
tggccttggacagagcgctcct

SEQ ID NO: 8250680 - DNA, 22 bp, Homo sapiens
tggccttgcccagcgcctaggt

SEQ ID NO: 8250681 - DNA, 22 bp, Homo sapiens
tggccttgagatgcagcagcca

SEQ ID NO: 8250682 - DNA, 22 bp, Homo sapiens
tggccttgattatgccagtaga

SEQ ID NO: 8250683 - DNA, 22 bp, Homo sapiens
tggccttgataactggggagag

SEQ ID NO: 8250684 - DNA, 22 bp, Homo sapiens
tggcctgggtgctgctgacatc

SEQ ID NO: 8250685 - DNA, 22 bp, Homo sapiens
tggcctgggtgctgctgacatc

SEQ ID NO: 8250686 - DNA, 22 bp, Homo sapiens
tggcctgggtgctgctgacatc

SEQ ID NO: 8250687 - DNA, 22 bp, Homo sapiens
tggcctggtaccacatagattt

SEQ ID NO: 8250688 - DNA, 22 bp, Homo sapiens
tggcctggtccttgtcaaggca

SEQ ID NO: 8250689 - DNA, 22 bp, Homo sapiens
tggcctggtaccacatagattt

SEQ ID NO: 8250690 - DNA, 22 bp, Homo sapiens
tggcctgggtgctgctgacatc

SEQ ID NO: 8250691 - DNA, 22 bp, Homo sapiens
tggcctgggtcacaccagggtc

SEQ ID NO: 8250692 - DNA, 22 bp, Homo sapiens
tggcctgggtcacaccagggtc

SEQ ID NO: 8250693 - DNA, 22 bp, Homo sapiens
tggcctggctcacagtgagatt

SEQ ID NO: 8250694 - DNA, 22 bp, Homo sapiens
tggcctggctcacagtgagatt

SEQ ID NO: 8250695 - DNA, 22 bp, Homo sapiens
tggcctggctcacagtgagatt

SEQ ID NO: 8250696 - DNA, 22 bp, Homo sapiens
tggcctggccctgaggccctgt

SEQ ID NO: 8250697 - DNA, 22 bp, Homo sapiens
tggcctggccctgaggccctgt

SEQ ID NO: 8250698 - DNA, 22 bp, Homo sapiens
tggcctggccctgaggccctgt

SEQ ID NO: 8250699 - DNA, 22 bp, Homo sapiens
tggcctggccctgaggccctgt

SEQ ID NO: 8250700 - DNA, 22 bp, Homo sapiens
tggcctggttgttgctgccgtt

SEQ ID NO: 8250701 - DNA, 22 bp, Homo sapiens
tggcctggttgttgctgccgtt

SEQ ID NO: 8250702 - DNA, 22 bp, Homo sapiens
tggcctggtgtctgcgaggcct

SEQ ID NO: 8250703 - DNA, 22 bp, Homo sapiens
tggcctggtgtctgcgaggcct

SEQ ID NO: 8250704 - DNA, 22 bp, Homo sapiens
tggcctggtgtctgcgaggcct

SEQ ID NO: 8250705 - DNA, 22 bp, Homo sapiens
tggcctggttatattgctatca

SEQ ID NO: 8250706 - DNA, 22 bp, Homo sapiens
tggcctggttatattgctatca

SEQ ID NO: 8250707 - DNA, 22 bp, Homo sapiens
tggcctggtgtctgcgaggcct

SEQ ID NO: 8250708 - DNA, 22 bp, Homo sapiens
tggcctggtgtctgcgaggcct

SEQ ID NO: 8250709 - DNA, 22 bp, Homo sapiens
tggcctggtgctcaggcagtag

SEQ ID NO: 8250710 - DNA, 22 bp, Homo sapiens
tggcctggtgctcaggcagtag

SEQ ID NO: 8250711 - DNA, 22 bp, Homo sapiens
tggcctggtgtctgcgaggcct

SEQ ID NO: 8250712 - DNA, 22 bp, Homo sapiens
tggcctggtgctcaggcagtag

SEQ ID NO: 8250713 - DNA, 22 bp, Homo sapiens
tggcctggtgctcaggcagtag

SEQ ID NO: 8250714 - DNA, 22 bp, Homo sapiens
tggcctggtgctcaggcagtag

SEQ ID NO: 8250715 - DNA, 22 bp, Homo sapiens
tggcctggtccttgtcaaggca

SEQ ID NO: 8250716 - DNA, 22 bp, Homo sapiens
tggcctggtccttgtcaaggca

SEQ ID NO: 8250717 - DNA, 22 bp, Homo sapiens
tggcggcgtgtggactgaggac

SEQ ID NO: 8250718 - DNA, 22 bp, Homo sapiens
tggcggctttaattatcacttg

SEQ ID NO: 8250719 - DNA, 22 bp, Homo sapiens
tggcgcgctcgctctcgctgag

SEQ ID NO: 8250720 - DNA, 22 bp, Homo sapiens
tggcggagttccagctgggatc

SEQ ID NO: 8250721 - DNA, 22 bp, Homo sapiens
tggcgcgacgtgccccctgctt

SEQ ID NO: 8250722 - DNA, 22 bp, Homo sapiens
tggcgcgacgtgccccctgctt

SEQ ID NO: 8250723 - DNA, 20 bp, Homo sapiens
tggcggggatgagggagtta

SEQ ID NO: 8250724 - DNA, 20 bp, Homo sapiens
tggcggggatgagggagtta

SEQ ID NO: 8250725 - DNA, 23 bp, Homo sapiens
tggctaaacagtggagaaagctt

SEQ ID NO: 8250726 - DNA, 22 bp, Homo sapiens
tggctcagaagaaaaggtaaac

SEQ ID NO: 8250727 - DNA, 22 bp, Homo sapiens
tggctcagaactacttctagtt

SEQ ID NO: 8250728 - DNA, 22 bp, Homo sapiens
tggctcagaactacttctagtt

SEQ ID NO: 8250729 - DNA, 22 bp, Homo sapiens
tggctcagaactacttctagtt

SEQ ID NO: 8250730 - DNA, 22 bp, Homo sapiens
tggctcagaactacttctagtt

SEQ ID NO: 8250731 - DNA, 22 bp, Homo sapiens
tggctcactgtagccttgacct

SEQ ID NO: 8250732 - DNA, 22 bp, Homo sapiens
tggctcactgtagccttgacct

SEQ ID NO: 8250733 - DNA, 22 bp, Homo sapiens
tggctcacttccgtggagaggt

SEQ ID NO: 8250734 - DNA, 22 bp, Homo sapiens
tggctcacaatctcccatgaag

SEQ ID NO: 8250735 - DNA, 22 bp, Homo sapiens
tggctcaagtaacaaaaatata

SEQ ID NO: 8250736 - DNA, 22 bp, Homo sapiens
tggctcaccttcagaatatacc

SEQ ID NO: 8250737 - DNA, 22 bp, Homo sapiens
tggctcacaatctcccatgaag

SEQ ID NO: 8250738 - DNA, 22 bp, Homo sapiens
tggctcaccttcagaatatacc

SEQ ID NO: 8250739 - DNA, 22 bp, Homo sapiens
tggctcacaggactctctgggc

SEQ ID NO: 8250740 - DNA, 22 bp, Homo sapiens
tggctcagatgctcttccagtg

SEQ ID NO: 8250741 - DNA, 18 bp, Homo sapiens
tggctcagatggctttaa

SEQ ID NO: 8250742 - DNA, 22 bp, Homo sapiens
tggctcagatgctcttccagtg

SEQ ID NO: 8250743 - DNA, 22 bp, Homo sapiens
tggctcagatgctcttccagtg

SEQ ID NO: 8250744 - DNA, 22 bp, Homo sapiens
tggctcagatgctcttccagtg

SEQ ID NO: 8250745 - DNA, 18 bp, Homo sapiens
tggctcagatggctttaa

SEQ ID NO: 8250746 - DNA, 22 bp, Homo sapiens
tggctcagatttttgtaggctt

SEQ ID NO: 8250747 - DNA, 22 bp, Homo sapiens
tggctcagatttttgtaggctt

SEQ ID NO: 8250748 - DNA, 18 bp, Homo sapiens
tggctcagatggctttaa

SEQ ID NO: 8250749 - DNA, 22 bp, Homo sapiens
tggctcagatgctcttccagtg

SEQ ID NO: 8250750 - DNA, 22 bp, Homo sapiens
tggctcagataattcaaggggc

SEQ ID NO: 8250751 - DNA, 22 bp, Homo sapiens
tggctcagagttcatcttttag

SEQ ID NO: 8250752 - DNA, 22 bp, Homo sapiens
tggctcagaggggaagtggttt

SEQ ID NO: 8250753 - DNA, 22 bp, Homo sapiens
tggctcagagttcatcttttag

SEQ ID NO: 8250754 - DNA, 22 bp, Homo sapiens
tggctcagagttcatcttttag

SEQ ID NO: 8250755 - DNA, 22 bp, Homo sapiens
tggctcagataattcaaggggc

SEQ ID NO: 8250756 - DNA, 22 bp, Homo sapiens
tggctcagagccttgagagctg

SEQ ID NO: 8250757 - DNA, 22 bp, Homo sapiens
tggctcagagcagggactctgg

SEQ ID NO: 8250758 - DNA, 22 bp, Homo sapiens
tggctcagagcagggactctgg

SEQ ID NO: 8250759 - DNA, 22 bp, Homo sapiens
tggctcagagccttgagagctg

SEQ ID NO: 8250760 - DNA, 22 bp, Homo sapiens
tggctcagagccttgagagctg

SEQ ID NO: 8250761 - DNA, 22 bp, Homo sapiens
tggctcagaggggaagtggttt

SEQ ID NO: 8250762 - DNA, 22 bp, Homo sapiens
tggctcagagccttgagagctg

SEQ ID NO: 8250763 - DNA, 22 bp, Homo sapiens
tggctcagaaggctgccttcac

SEQ ID NO: 8250764 - DNA, 22 bp, Homo sapiens
tggctcagaagaaaaggtaaac

SEQ ID NO: 8250765 - DNA, 22 bp, Homo sapiens
tggctcagaaggctgccttcac

SEQ ID NO: 8250766 - DNA, 22 bp, Homo sapiens
tggctcagaaggctgccttcac

SEQ ID NO: 8250767 - DNA, 22 bp, Homo sapiens
tggctcagagagggagtgtgga

SEQ ID NO: 8250768 - DNA, 22 bp, Homo sapiens
tggctcagagagggagtgtgga

SEQ ID NO: 8250769 - DNA, 22 bp, Homo sapiens
tggctcagagagggagtgtgga

SEQ ID NO: 8250770 - DNA, 22 bp, Homo sapiens
tggctcagttccatcatctgga

SEQ ID NO: 8250771 - DNA, 22 bp, Homo sapiens
tggctcagttaggtcagaaaca

SEQ ID NO: 8250772 - DNA, 22 bp, Homo sapiens
tggctcagtggcagccgcagct

SEQ ID NO: 8250773 - DNA, 21 bp, Homo sapiens
tggctcagttgctgggcacag

SEQ ID NO: 8250774 - DNA, 22 bp, Homo sapiens
tggctcagttccatcatctgga

SEQ ID NO: 8250775 - DNA, 22 bp, Homo sapiens
tggctcagttccatcatctgga

SEQ ID NO: 8250776 - DNA, 22 bp, Homo sapiens
tggctccaccgccgcggagctc

SEQ ID NO: 8250777 - DNA, 22 bp, Homo sapiens
tggctccaaaaacaaatgacat

SEQ ID NO: 8250778 - DNA, 21 bp, Homo sapiens
tggctcagttgctgggcacag

SEQ ID NO: 8250779 - DNA, 22 bp, Homo sapiens
tggctccactactgggtgtgtt

SEQ ID NO: 8250780 - DNA, 22 bp, Homo sapiens
tggctccaccgccgcggagctc

SEQ ID NO: 8250781 - DNA, 22 bp, Homo sapiens
tggctccagaagggagggcgcc

SEQ ID NO: 8250782 - DNA, 22 bp, Homo sapiens
tggctccagatttcctgctgca

SEQ ID NO: 8250783 - DNA, 22 bp, Homo sapiens
tggctccagatttcctgctgca

SEQ ID NO: 8250784 - DNA, 23 bp, Homo sapiens
tggctccaggagaagccagaagc

SEQ ID NO: 8250785 - DNA, 23 bp, Homo sapiens
tggctccaggagaagccagaagc

SEQ ID NO: 8250786 - DNA, 22 bp, Homo sapiens
tggctccagctcaagtatggca

SEQ ID NO: 8250787 - DNA, 22 bp, Homo sapiens
tggctccagccctgagcaagct

SEQ ID NO: 8250788 - DNA, 22 bp, Homo sapiens
tggctccagatttcctgctgca

SEQ ID NO: 8250789 - DNA, 22 bp, Homo sapiens
tggctccagccctgagcaagct

SEQ ID NO: 8250790 - DNA, 18 bp, Homo sapiens
tggctcctgcctcctgca

SEQ ID NO: 8250791 - DNA, 22 bp, Homo sapiens
tggctcctgcagaccatctgga

SEQ ID NO: 8250792 - DNA, 18 bp, Homo sapiens
tggctcctgcctcctgca

SEQ ID NO: 8250793 - DNA, 18 bp, Homo sapiens
tggctcctgcctcctgca

SEQ ID NO: 8250794 - DNA, 18 bp, Homo sapiens
tggctcctgcctcctgca

SEQ ID NO: 8250795 - DNA, 18 bp, Homo sapiens
tggctcctgcctcctgca

SEQ ID NO: 8250796 - DNA, 19 bp, Homo sapiens
tggctcctgcctgccttct

SEQ ID NO: 8250797 - DNA, 20 bp, Homo sapiens
tggctcctgcggtggaacca

SEQ ID NO: 8250798 - DNA, 19 bp, Homo sapiens
tggctcctgcctgccttct

SEQ ID NO: 8250799 - DNA, 22 bp, Homo sapiens
tggctcctcatcacagttggtg

SEQ ID NO: 8250800 - DNA, 22 bp, Homo sapiens
tggctcctcacgtcctcagagc

SEQ ID NO: 8250801 - DNA, 22 bp, Homo sapiens
tggctcctgcagaccatctgga

SEQ ID NO: 8250802 - DNA, 22 bp, Homo sapiens
tggctcctgcagaccatctgga

SEQ ID NO: 8250803 - DNA, 22 bp, Homo sapiens
tggctcctaatgctgcccagac

SEQ ID NO: 8250804 - DNA, 22 bp, Homo sapiens
tggctcctaggatggtgcctgg

SEQ ID NO: 8250805 - DNA, 22 bp, Homo sapiens
tggctcctatcaaggagtgggt

SEQ ID NO: 8250806 - DNA, 22 bp, Homo sapiens
tggctcctatcaaggagtgggt

SEQ ID NO: 8250807 - DNA, 22 bp, Homo sapiens
tggctcccaaggagctcctgcc

SEQ ID NO: 8250808 - DNA, 22 bp, Homo sapiens
tggctccatgatagttcttaca

SEQ ID NO: 8250809 - DNA, 22 bp, Homo sapiens
tggctccatcatccatgcaaga

SEQ ID NO: 8250810 - DNA, 22 bp, Homo sapiens
tggctccaggggacacgcagta

SEQ ID NO: 8250811 - DNA, 23 bp, Homo sapiens
tggctccaggagaagccagaagc

SEQ ID NO: 8250812 - DNA, 22 bp, Homo sapiens
tggctcaggagggatctttgct

SEQ ID NO: 8250813 - DNA, 22 bp, Homo sapiens
tggctcaggagggatctttgct

SEQ ID NO: 8250814 - DNA, 22 bp, Homo sapiens
tggctcagctttccccatctgg

SEQ ID NO: 8250815 - DNA, 22 bp, Homo sapiens
tggctcaggataattttcccaa

SEQ ID NO: 8250816 - DNA, 22 bp, Homo sapiens
tggctcaggagggatctttgct

SEQ ID NO: 8250817 - DNA, 22 bp, Homo sapiens
tggctcaggatctaagcagaat

SEQ ID NO: 8250818 - DNA, 22 bp, Homo sapiens
tggctcaggcctacgacgcctt

SEQ ID NO: 8250819 - DNA, 22 bp, Homo sapiens
tggctcaggcctacgacgcctt

SEQ ID NO: 8250820 - DNA, 22 bp, Homo sapiens
tggctcaggcttgaaaatagat

SEQ ID NO: 8250821 - DNA, 22 bp, Homo sapiens
tggctcaggccacttcttttat

SEQ ID NO: 8250822 - DNA, 22 bp, Homo sapiens
tggctcaggccacttcttttat

SEQ ID NO: 8250823 - DNA, 22 bp, Homo sapiens
tggctcagctttccccatctgg

SEQ ID NO: 8250824 - DNA, 22 bp, Homo sapiens
tggctcagcttacttttgaggg

SEQ ID NO: 8250825 - DNA, 22 bp, Homo sapiens
tggctcagcttacttttgaggg

SEQ ID NO: 8250826 - DNA, 22 bp, Homo sapiens
tggctcagctgtcacagcctgg

SEQ ID NO: 8250827 - DNA, 22 bp, Homo sapiens
tggctcagccagccctaggaac

SEQ ID NO: 8250828 - DNA, 22 bp, Homo sapiens
tggctcagccagccctaggaac

SEQ ID NO: 8250829 - DNA, 22 bp, Homo sapiens
tggctcagccagccctaggaac

SEQ ID NO: 8250830 - DNA, 22 bp, Homo sapiens
tggctcagccagccctaggaac

SEQ ID NO: 8250831 - DNA, 22 bp, Homo sapiens
tggctcagcaagacattgacct

SEQ ID NO: 8250832 - DNA, 22 bp, Homo sapiens
tggctcagatttttgtaggctt

SEQ ID NO: 8250833 - DNA, 22 bp, Homo sapiens
tggctcagcaggttagaaacta

SEQ ID NO: 8250834 - DNA, 22 bp, Homo sapiens
tggctcagccagccctaggaac

SEQ ID NO: 8250835 - DNA, 22 bp, Homo sapiens
tggctcagcattcactggtctt

SEQ ID NO: 8250836 - DNA, 22 bp, Homo sapiens
tggctcagcattcactggtctt

SEQ ID NO: 8250837 - DNA, 22 bp, Homo sapiens
tggctcaggggtctggctctgt

SEQ ID NO: 8250838 - DNA, 22 bp, Homo sapiens
tggctcaggggtctggctctgt

SEQ ID NO: 8250839 - DNA, 22 bp, Homo sapiens
tggctcaggggtctggctctgt

SEQ ID NO: 8250840 - DNA, 22 bp, Homo sapiens
tggctcaggggtctggctctgt

SEQ ID NO: 8250841 - DNA, 22 bp, Homo sapiens
tggctcaggcttgaaaatagat

SEQ ID NO: 8250842 - DNA, 22 bp, Homo sapiens
tggctcaggggtctggctctgt

SEQ ID NO: 8250843 - DNA, 22 bp, Homo sapiens
tggctcagggtccccaaatggt

SEQ ID NO: 8250844 - DNA, 22 bp, Homo sapiens
tggctcagggtccccaaatggt

SEQ ID NO: 8250845 - DNA, 23 bp, Homo sapiens
tggctcagggtctcttatgaagt

SEQ ID NO: 8250846 - DNA, 22 bp, Homo sapiens
tggctcagtagcagtgtggtca

SEQ ID NO: 8250847 - DNA, 22 bp, Homo sapiens
tggctcagtaatcgagtctcct

SEQ ID NO: 8250848 - DNA, 22 bp, Homo sapiens
tggctcagtagcagtgtggtca

SEQ ID NO: 8250849 - DNA, 22 bp, Homo sapiens
tggctcagtaatcgagtctcct

SEQ ID NO: 8250850 - DNA, 22 bp, Homo sapiens
tggctcagtaatcgagtctcct

SEQ ID NO: 8250851 - DNA, 22 bp, Homo sapiens
tggctcaggtgtgagctgaaga

SEQ ID NO: 8250852 - DNA, 22 bp, Homo sapiens
tggctcaggtgtgagctgaaga

SEQ ID NO: 8250853 - DNA, 22 bp, Homo sapiens
tggctcagtggcagccgcagct

SEQ ID NO: 8250854 - DNA, 22 bp, Homo sapiens
tggctcagtggcagccgcagct

SEQ ID NO: 8250855 - DNA, 22 bp, Homo sapiens
tggctcagtggcagccgcagct

SEQ ID NO: 8250856 - DNA, 22 bp, Homo sapiens
tggctcagtgacattcctccca

SEQ ID NO: 8250857 - DNA, 22 bp, Homo sapiens
tggctcagtgacattcctccca

SEQ ID NO: 8250858 - DNA, 22 bp, Homo sapiens
tggctcagtgcattcacagtaa

SEQ ID NO: 8250859 - DNA, 22 bp, Homo sapiens
tggctcagtgacattcctccca

SEQ ID NO: 8250860 - DNA, 22 bp, Homo sapiens
tggctcagtgcattcacagtaa

SEQ ID NO: 8250861 - DNA, 22 bp, Homo sapiens
tggctcagtctgggttgactga

SEQ ID NO: 8250862 - DNA, 22 bp, Homo sapiens
tggctcagtctgggttgactga

SEQ ID NO: 8250863 - DNA, 22 bp, Homo sapiens
tggctcagtgaagagataactt

SEQ ID NO: 8250864 - DNA, 22 bp, Homo sapiens
tggctcagtctgggttgactga

SEQ ID NO: 8250865 - DNA, 22 bp, Homo sapiens
tggctcagtctgggttgactga

SEQ ID NO: 8250866 - DNA, 22 bp, Homo sapiens
tggctcagtcatggatgagtaa

SEQ ID NO: 8250867 - DNA, 22 bp, Homo sapiens
tggctcagtcatggatgagtaa

SEQ ID NO: 8250868 - DNA, 22 bp, Homo sapiens
tggctggaatatgtggagacca

SEQ ID NO: 8250869 - DNA, 22 bp, Homo sapiens
tggctggaatggagctgagcct

SEQ ID NO: 8250870 - DNA, 22 bp, Homo sapiens
tggctggaagtcagaaatggga

SEQ ID NO: 8250871 - DNA, 22 bp, Homo sapiens
tggctgctgtgggtagagggat

SEQ ID NO: 8250872 - DNA, 22 bp, Homo sapiens
tggctgcttaaaattgctgcaa

SEQ ID NO: 8250873 - DNA, 18 bp, Homo sapiens
tggctgcttccaggtaca

SEQ ID NO: 8250874 - DNA, 18 bp, Homo sapiens
tggctgcttccaggtaca

SEQ ID NO: 8250875 - DNA, 22 bp, Homo sapiens
tggctggaaacaggagattcag

SEQ ID NO: 8250876 - DNA, 22 bp, Homo sapiens
tggctgctgcagacagacagga

SEQ ID NO: 8250877 - DNA, 22 bp, Homo sapiens
tggctgctgcagacagacagga

SEQ ID NO: 8250878 - DNA, 22 bp, Homo sapiens
tggctgctgctcactcagcctc

SEQ ID NO: 8250879 - DNA, 22 bp, Homo sapiens
tggctgctgctcactcagcctc

SEQ ID NO: 8250880 - DNA, 22 bp, Homo sapiens
tggctgctgcttggtcttcttc

SEQ ID NO: 8250881 - DNA, 22 bp, Homo sapiens
tggctgctgctcactcagcctc

SEQ ID NO: 8250882 - DNA, 18 bp, Homo sapiens
tggctgctggagtagggt

SEQ ID NO: 8250883 - DNA, 18 bp, Homo sapiens
tggctgctggagtagggt

SEQ ID NO: 8250884 - DNA, 22 bp, Homo sapiens
tggctgctgtgggtagagggat

SEQ ID NO: 8250885 - DNA, 21 bp, Homo sapiens
tggctgctggccctctctcca

SEQ ID NO: 8250886 - DNA, 22 bp, Homo sapiens
tggctgcagttcacaggagcaa

SEQ ID NO: 8250887 - DNA, 22 bp, Homo sapiens
tggctgcagttcacaggagcaa

SEQ ID NO: 8250888 - DNA, 22 bp, Homo sapiens
tggctgcagatctgtgggacac

SEQ ID NO: 8250889 - DNA, 22 bp, Homo sapiens
tggctgcagttcacaggagcaa

SEQ ID NO: 8250890 - DNA, 22 bp, Homo sapiens
tggctgcagttgggccctcaga

SEQ ID NO: 8250891 - DNA, 22 bp, Homo sapiens
tggctgccaagcaggtcagaga

SEQ ID NO: 8250892 - DNA, 22 bp, Homo sapiens
tggctgccaagcaggtcagaga

SEQ ID NO: 8250893 - DNA, 22 bp, Homo sapiens
tggctgccaatggcttggaaag

SEQ ID NO: 8250894 - DNA, 22 bp, Homo sapiens
tggctgccatgacgcctgggga

SEQ ID NO: 8250895 - DNA, 22 bp, Homo sapiens
tggctgccatgacgcctgggga

SEQ ID NO: 8250896 - DNA, 22 bp, Homo sapiens
tggctgccatgacgcctgggga

SEQ ID NO: 8250897 - DNA, 22 bp, Homo sapiens
tggctgctctcttccccagggt

SEQ ID NO: 8250898 - DNA, 22 bp, Homo sapiens
tggctgctctcttccccagggt

SEQ ID NO: 8250899 - DNA, 22 bp, Homo sapiens
tggctgctgagaaggcagctgt

SEQ ID NO: 8250900 - DNA, 20 bp, Homo sapiens
tggctgcccgaggcacacac

SEQ ID NO: 8250901 - DNA, 22 bp, Homo sapiens
tggctgcagatctgtgggacac

SEQ ID NO: 8250902 - DNA, 22 bp, Homo sapiens
tggctgcagatcaagggcaggc

SEQ ID NO: 8250903 - DNA, 22 bp, Homo sapiens
tggctgcagatcaagggcaggc

SEQ ID NO: 8250904 - DNA, 22 bp, Homo sapiens
tggctgcagatcaagggcaggc

SEQ ID NO: 8250905 - DNA, 22 bp, Homo sapiens
tggctgcagacacctatggcag

SEQ ID NO: 8250906 - DNA, 21 bp, Homo sapiens
tggctgcactgtggctttcat

SEQ ID NO: 8250907 - DNA, 20 bp, Homo sapiens
tggctgcacaccaggacagg

SEQ ID NO: 8250908 - DNA, 20 bp, Homo sapiens
tggctgcacaccaggacagg

SEQ ID NO: 8250909 - DNA, 20 bp, Homo sapiens
tggctgcacaccaggacagg

SEQ ID NO: 8250910 - DNA, 22 bp, Homo sapiens
tggctgagtttcatgcatcatg

SEQ ID NO: 8250911 - DNA, 22 bp, Homo sapiens
tggctgagttctccaggagtag

SEQ ID NO: 8250912 - DNA, 22 bp, Homo sapiens
tggctgagtttcatgcatcatg

SEQ ID NO: 8250913 - DNA, 22 bp, Homo sapiens
tggctgagtttcatgcatcatg

SEQ ID NO: 8250914 - DNA, 22 bp, Homo sapiens
tggctgagttctccaggagtag

SEQ ID NO: 8250915 - DNA, 22 bp, Homo sapiens
tggctgagttctccaggagtag

SEQ ID NO: 8250916 - DNA, 22 bp, Homo sapiens
tggctgagttctccaggagtag

SEQ ID NO: 8250917 - DNA, 22 bp, Homo sapiens
tggctgagttctccaggagtag

SEQ ID NO: 8250918 - DNA, 22 bp, Homo sapiens
tggctgagtttcatgcatcatg

SEQ ID NO: 8250919 - DNA, 21 bp, Homo sapiens
tggctgcaagcagctgcctcc

SEQ ID NO: 8250920 - DNA, 22 bp, Homo sapiens
tggctgagttcctggcacacgg

SEQ ID NO: 8250921 - DNA, 22 bp, Homo sapiens
tggctgagttacgaacagagca

SEQ ID NO: 8250922 - DNA, 22 bp, Homo sapiens
tggctgagttacgaacagagca

SEQ ID NO: 8250923 - DNA, 22 bp, Homo sapiens
tggctgagttacgaacagagca

SEQ ID NO: 8250924 - DNA, 22 bp, Homo sapiens
tggctgagtgttccaaggagca

SEQ ID NO: 8250925 - DNA, 22 bp, Homo sapiens
tggctgagttacgaacagagca

SEQ ID NO: 8250926 - DNA, 22 bp, Homo sapiens
tggctgagttacgaacagagca

SEQ ID NO: 8250927 - DNA, 22 bp, Homo sapiens
tggctgagtgttccaaggagca

SEQ ID NO: 8250928 - DNA, 22 bp, Homo sapiens
tggctgagttctccaggagtag

SEQ ID NO: 8250929 - DNA, 22 bp, Homo sapiens
tggctgagttctccaggagtag

SEQ ID NO: 8250930 - DNA, 22 bp, Homo sapiens
tggctgagttctccaggagtag

SEQ ID NO: 8250931 - DNA, 22 bp, Homo sapiens
tggctgagttcctggcacacgg

SEQ ID NO: 8250932 - DNA, 22 bp, Homo sapiens
tggctgagttcctggcacacgg

SEQ ID NO: 8250933 - DNA, 22 bp, Homo sapiens
tggctgagttcctggcacacgg

SEQ ID NO: 8250934 - DNA, 22 bp, Homo sapiens
tggctgagtgttccaaggagca

SEQ ID NO: 8250935 - DNA, 21 bp, Homo sapiens
tggctgagtggatgcatgaat

SEQ ID NO: 8250936 - DNA, 21 bp, Homo sapiens
tggctgagtggatgcatgaat

SEQ ID NO: 8250937 - DNA, 21 bp, Homo sapiens
tggctgagtggatgcatgaat

SEQ ID NO: 8250938 - DNA, 21 bp, Homo sapiens
tggctgagtggatgcatgaat

SEQ ID NO: 8250939 - DNA, 22 bp, Homo sapiens
tggctgagtgttccaaggagca

SEQ ID NO: 8250940 - DNA, 22 bp, Homo sapiens
tggctgagtgttccaaggagca

SEQ ID NO: 8250941 - DNA, 22 bp, Homo sapiens
tggctgagtgttccaaggagca

SEQ ID NO: 8250942 - DNA, 22 bp, Homo sapiens
tggctgagtgatatttgcaaag

SEQ ID NO: 8250943 - DNA, 22 bp, Homo sapiens
tggctgagtgaacatgtccatt

SEQ ID NO: 8250944 - DNA, 22 bp, Homo sapiens
tggctgagtgaacatgtccatt

SEQ ID NO: 8250945 - DNA, 22 bp, Homo sapiens
tggctgagtaagttgtgatatg

SEQ ID NO: 8250946 - DNA, 21 bp, Homo sapiens
tggctgagtggatgcatgaat

SEQ ID NO: 8250947 - DNA, 22 bp, Homo sapiens
tggctgagtgatatttgcaaag

SEQ ID NO: 8250948 - DNA, 22 bp, Homo sapiens
tggctgagtgatatttgcaaag

SEQ ID NO: 8250949 - DNA, 22 bp, Homo sapiens
tggctgagtgatatttgcaaag

SEQ ID NO: 8250950 - DNA, 22 bp, Homo sapiens
tggctgagccacttgttcagat

SEQ ID NO: 8250951 - DNA, 23 bp, Homo sapiens
tggctgagatcctactgtttgct

SEQ ID NO: 8250952 - DNA, 23 bp, Homo sapiens
tggctgagatcctactgtttgct

SEQ ID NO: 8250953 - DNA, 22 bp, Homo sapiens
tggctgagagtcatcctgtgtg

SEQ ID NO: 8250954 - DNA, 23 bp, Homo sapiens
tggctgagatcctactgtttgct

SEQ ID NO: 8250955 - DNA, 23 bp, Homo sapiens
tggctgagatcctactgtttgct

SEQ ID NO: 8250956 - DNA, 22 bp, Homo sapiens
tggctgagagtcatcctgtgtg

SEQ ID NO: 8250957 - DNA, 22 bp, Homo sapiens
tggctgagagcaattgactctg

SEQ ID NO: 8250958 - DNA, 22 bp, Homo sapiens
tggctgagagtcatcctgtgtg

SEQ ID NO: 8250959 - DNA, 22 bp, Homo sapiens
tggctgagagcaattgactctg

SEQ ID NO: 8250960 - DNA, 22 bp, Homo sapiens
tggctgagagcaattgactctg

SEQ ID NO: 8250961 - DNA, 22 bp, Homo sapiens
tggctgagaagttctggtggga

SEQ ID NO: 8250962 - DNA, 22 bp, Homo sapiens
tggctgagcctttggggctttc

SEQ ID NO: 8250963 - DNA, 23 bp, Homo sapiens
tggctgagcccactatcttggcc

SEQ ID NO: 8250964 - DNA, 22 bp, Homo sapiens
tggctgagcctttggggctttc

SEQ ID NO: 8250965 - DNA, 22 bp, Homo sapiens
tggctgagcctttggggctttc

SEQ ID NO: 8250966 - DNA, 23 bp, Homo sapiens
tggctgagcccactatcttggcc

SEQ ID NO: 8250967 - DNA, 23 bp, Homo sapiens
tggctgagcccactatcttggcc

SEQ ID NO: 8250968 - DNA, 23 bp, Homo sapiens
tggctgagcccactatcttggcc

SEQ ID NO: 8250969 - DNA, 21 bp, Homo sapiens
tggctgagccaggtgtgtgga

SEQ ID NO: 8250970 - DNA, 21 bp, Homo sapiens
tggctgagccaggtgtgtgga

SEQ ID NO: 8250971 - DNA, 22 bp, Homo sapiens
tggctgagccacttgttcagat

SEQ ID NO: 8250972 - DNA, 22 bp, Homo sapiens
tggctgagccacttgttcagat

SEQ ID NO: 8250973 - DNA, 21 bp, Homo sapiens
tggctgagccaggtgtgtgga

SEQ ID NO: 8250974 - DNA, 21 bp, Homo sapiens
tggctgagccaggtgtgtgga

SEQ ID NO: 8250975 - DNA, 21 bp, Homo sapiens
tggctgagccaggtgtgtgga

SEQ ID NO: 8250976 - DNA, 22 bp, Homo sapiens
tggctgagaagttctggtggga

SEQ ID NO: 8250977 - DNA, 22 bp, Homo sapiens
tggctgagaagttctggtggga

SEQ ID NO: 8250978 - DNA, 22 bp, Homo sapiens
tggctgagaagttctggtggga

SEQ ID NO: 8250979 - DNA, 22 bp, Homo sapiens
tggctgagaagttctggtggga

SEQ ID NO: 8250980 - DNA, 22 bp, Homo sapiens
tggctgagaaaatggttttagg

SEQ ID NO: 8250981 - DNA, 22 bp, Homo sapiens
tggctgagaaaatggttttagg

SEQ ID NO: 8250982 - DNA, 22 bp, Homo sapiens
tggctgagaaaatggttttagg

SEQ ID NO: 8250983 - DNA, 22 bp, Homo sapiens
tggctgagaaaatggttttagg

SEQ ID NO: 8250984 - DNA, 22 bp, Homo sapiens
tggctgagaaaaaagagctata

SEQ ID NO: 8250985 - DNA, 22 bp, Homo sapiens
tggctgagaaaaaagagctata

SEQ ID NO: 8250986 - DNA, 22 bp, Homo sapiens
tggctgagaaaaaagagctata

SEQ ID NO: 8250987 - DNA, 22 bp, Homo sapiens
tggctgagaaaaaagagctata

SEQ ID NO: 8250988 - DNA, 22 bp, Homo sapiens
tggctgagaaaaaagagctata

SEQ ID NO: 8250989 - DNA, 22 bp, Homo sapiens
tggctgagaaaaaagagctata

SEQ ID NO: 8250990 - DNA, 22 bp, Homo sapiens
tggctgagaaaaaagagctata

SEQ ID NO: 8250991 - DNA, 22 bp, Homo sapiens
tggctgagaaaaaagagctata

SEQ ID NO: 8250992 - DNA, 22 bp, Homo sapiens
tggctgacaatgtagcagtaac

SEQ ID NO: 8250993 - DNA, 22 bp, Homo sapiens
tggctgacaaataggtgcagtt

SEQ ID NO: 8250994 - DNA, 22 bp, Homo sapiens
tggctctttctgtctgggatcc

SEQ ID NO: 8250995 - DNA, 19 bp, Homo sapiens
tggctctttttatgacatt

SEQ ID NO: 8250996 - DNA, 22 bp, Homo sapiens
tggctgaagtgggcaggaggga

SEQ ID NO: 8250997 - DNA, 22 bp, Homo sapiens
tggctgaggagggtcttctggt

SEQ ID NO: 8250998 - DNA, 22 bp, Homo sapiens
tggctgaggagggtcttctggt

SEQ ID NO: 8250999 - DNA, 22 bp, Homo sapiens
tggctgaggcacagctgccgcc

SEQ ID NO: 8251000 - DNA, 22 bp, Homo sapiens
tggctgaggcacagctgccgcc

SEQ ID NO: 8251001 - DNA, 22 bp, Homo sapiens
tggctgaggagggtcttctggt

SEQ ID NO: 8251002 - DNA, 22 bp, Homo sapiens
tggctgaggagggtcttctggt

SEQ ID NO: 8251003 - DNA, 22 bp, Homo sapiens
tggctgaggagagggcggaagt

SEQ ID NO: 8251004 - DNA, 19 bp, Homo sapiens
tggctgagctggactgagg

SEQ ID NO: 8251005 - DNA, 19 bp, Homo sapiens
tggctgagctggactgagg

SEQ ID NO: 8251006 - DNA, 19 bp, Homo sapiens
tggctgagctggactgagg

SEQ ID NO: 8251007 - DNA, 19 bp, Homo sapiens
tggctgagctggactgagg

SEQ ID NO: 8251008 - DNA, 22 bp, Homo sapiens
tggctgaggagagggcggaagt

SEQ ID NO: 8251009 - DNA, 22 bp, Homo sapiens
tggctgaggagagggcggaagt

SEQ ID NO: 8251010 - DNA, 22 bp, Homo sapiens
tggctgaggagagggcggaagt

SEQ ID NO: 8251011 - DNA, 19 bp, Homo sapiens
tggctgagctggactgagg

SEQ ID NO: 8251012 - DNA, 22 bp, Homo sapiens
tggctgagctgcagcgtggctt

SEQ ID NO: 8251013 - DNA, 19 bp, Homo sapiens
tggctgagctggactgagg

SEQ ID NO: 8251014 - DNA, 22 bp, Homo sapiens
tggctgagctgcagcgtggctt

SEQ ID NO: 8251015 - DNA, 22 bp, Homo sapiens
tggctgagctgcagcgtggctt

SEQ ID NO: 8251016 - DNA, 22 bp, Homo sapiens
tggctgagctgcagcgtggctt

SEQ ID NO: 8251017 - DNA, 22 bp, Homo sapiens
tggctgagctgcagcgtggctt

SEQ ID NO: 8251018 - DNA, 22 bp, Homo sapiens
tggctgagctccctgtgtgttg

SEQ ID NO: 8251019 - DNA, 22 bp, Homo sapiens
tggctgagcctttggggctttc

SEQ ID NO: 8251020 - DNA, 22 bp, Homo sapiens
tggctgagcctttggggctttc

SEQ ID NO: 8251021 - DNA, 22 bp, Homo sapiens
tggctgagctgcagcgtggctt

SEQ ID NO: 8251022 - DNA, 22 bp, Homo sapiens
tggctgagctccctgtgtgttg

SEQ ID NO: 8251023 - DNA, 22 bp, Homo sapiens
tggctgagctccctgtgtgttg

SEQ ID NO: 8251024 - DNA, 22 bp, Homo sapiens
tggctgagctccctgtgtgttg

SEQ ID NO: 8251025 - DNA, 22 bp, Homo sapiens
tggctgaggttatgctggttgt

SEQ ID NO: 8251026 - DNA, 22 bp, Homo sapiens
tggctgaggttatgctggttgt

SEQ ID NO: 8251027 - DNA, 22 bp, Homo sapiens
tggctgaggtctggggcttctg

SEQ ID NO: 8251028 - DNA, 22 bp, Homo sapiens
tggctgaggtctggggcttctg

SEQ ID NO: 8251029 - DNA, 22 bp, Homo sapiens
tggctgagggcactatgaagcc

SEQ ID NO: 8251030 - DNA, 22 bp, Homo sapiens
tggctgaggcttttcttaaaga

SEQ ID NO: 8251031 - DNA, 22 bp, Homo sapiens
tggctgagggcactatgaagcc

SEQ ID NO: 8251032 - DNA, 22 bp, Homo sapiens
tggctgagggcactatgaagcc

SEQ ID NO: 8251033 - DNA, 22 bp, Homo sapiens
tggctgagtaagttgtgatatg

SEQ ID NO: 8251034 - DNA, 22 bp, Homo sapiens
tggctgaggttatgctggttgt

SEQ ID NO: 8251035 - DNA, 22 bp, Homo sapiens
tggctgaggttatgctggttgt

SEQ ID NO: 8251036 - DNA, 22 bp, Homo sapiens
tggctgaggttatgctggttgt

SEQ ID NO: 8251037 - DNA, 22 bp, Homo sapiens
tggctgagtgaacatgtccatt

SEQ ID NO: 8251038 - DNA, 22 bp, Homo sapiens
tggctgagtaagttgtgatatg

SEQ ID NO: 8251039 - DNA, 22 bp, Homo sapiens
tggctgagtaagttgtgatatg

SEQ ID NO: 8251040 - DNA, 22 bp, Homo sapiens
tggctgagtaagttgtgatatg

SEQ ID NO: 8251041 - DNA, 22 bp, Homo sapiens
tggctgaggcttttcttaaaga

SEQ ID NO: 8251042 - DNA, 22 bp, Homo sapiens
tggctgaggctggagtgcagtg

SEQ ID NO: 8251043 - DNA, 22 bp, Homo sapiens
tggctgaggctggagtgcagtg

SEQ ID NO: 8251044 - DNA, 22 bp, Homo sapiens
tggctgagggcactatgaagcc

SEQ ID NO: 8251045 - DNA, 22 bp, Homo sapiens
tggctgaggcttttcttaaaga

SEQ ID NO: 8251046 - DNA, 22 bp, Homo sapiens
tggctgaggcttttcttaaaga

SEQ ID NO: 8251047 - DNA, 22 bp, Homo sapiens
tggctgaggctggagtgcagtg

SEQ ID NO: 8251048 - DNA, 22 bp, Homo sapiens
tggctgaggcacagctgccgcc

SEQ ID NO: 8251049 - DNA, 22 bp, Homo sapiens
tggctgaggcacagctgccgcc

SEQ ID NO: 8251050 - DNA, 22 bp, Homo sapiens
tggctgaggctggagtgcagtg

SEQ ID NO: 8251051 - DNA, 22 bp, Homo sapiens
tggctgaggctggagtgcagtg

SEQ ID NO: 8251052 - DNA, 22 bp, Homo sapiens
tggctgaggctggagtgcagtg

SEQ ID NO: 8251053 - DNA, 22 bp, Homo sapiens
tggctgaggctggagtgcagtg

SEQ ID NO: 8251054 - DNA, 19 bp, Homo sapiens
tggctctgtttctctggag

SEQ ID NO: 8251055 - DNA, 19 bp, Homo sapiens
tggctctgtttctctggag

SEQ ID NO: 8251056 - DNA, 22 bp, Homo sapiens
tggctctgttgtgctgagccag

SEQ ID NO: 8251057 - DNA, 22 bp, Homo sapiens
tggctctgttgtgctgagccag

SEQ ID NO: 8251058 - DNA, 22 bp, Homo sapiens
tggctctgttgtgctgagccag

SEQ ID NO: 8251059 - DNA, 22 bp, Homo sapiens
tggctctgtttgttaactagac

SEQ ID NO: 8251060 - DNA, 22 bp, Homo sapiens
tggctctgtttgttaactagac

SEQ ID NO: 8251061 - DNA, 22 bp, Homo sapiens
tggctctgttttatgagtacca

SEQ ID NO: 8251062 - DNA, 22 bp, Homo sapiens
tggctctgtttgttaactagac

SEQ ID NO: 8251063 - DNA, 22 bp, Homo sapiens
tggctcttaaggtccctgtgct

SEQ ID NO: 8251064 - DNA, 22 bp, Homo sapiens
tggctctgttttatgagtacca

SEQ ID NO: 8251065 - DNA, 19 bp, Homo sapiens
tggctcttgtgggactgca

SEQ ID NO: 8251066 - DNA, 22 bp, Homo sapiens
tggctctttctgtctgggatcc

SEQ ID NO: 8251067 - DNA, 22 bp, Homo sapiens
tggctcttttcacgtcccctct

SEQ ID NO: 8251068 - DNA, 22 bp, Homo sapiens
tggctcttctcaagcattggct

SEQ ID NO: 8251069 - DNA, 22 bp, Homo sapiens
tggctcttaaggtccctgtgct

SEQ ID NO: 8251070 - DNA, 19 bp, Homo sapiens
tggctcttgtgggactgca

SEQ ID NO: 8251071 - DNA, 22 bp, Homo sapiens
tggctctgttcgccatcaggag

SEQ ID NO: 8251072 - DNA, 22 bp, Homo sapiens
tggctctgttcgccatcaggag

SEQ ID NO: 8251073 - DNA, 22 bp, Homo sapiens
tggctctgttgaggtatggatt

SEQ ID NO: 8251074 - DNA, 22 bp, Homo sapiens
tggctctgttgaggtatggatt

SEQ ID NO: 8251075 - DNA, 22 bp, Homo sapiens
tggctctgttcgccatcaggag

SEQ ID NO: 8251076 - DNA, 22 bp, Homo sapiens
tggctctgttgaggtatggatt

SEQ ID NO: 8251077 - DNA, 22 bp, Homo sapiens
tggctctgttgtaaagaaattt

SEQ ID NO: 8251078 - DNA, 22 bp, Homo sapiens
tggctctgttgctcgcagtttt

SEQ ID NO: 8251079 - DNA, 22 bp, Homo sapiens
tggctctgttgctcgcagtttt

SEQ ID NO: 8251080 - DNA, 22 bp, Homo sapiens
tggctctgttgtaaagaaattt

SEQ ID NO: 8251081 - DNA, 23 bp, Homo sapiens
tggctctgtgtcacatacaggat

SEQ ID NO: 8251082 - DNA, 23 bp, Homo sapiens
tggctctgtgtcacatacaggat

SEQ ID NO: 8251083 - DNA, 22 bp, Homo sapiens
tggctctgtgtctcccagcagc

SEQ ID NO: 8251084 - DNA, 22 bp, Homo sapiens
tggctctgtgtctcccagcagc

SEQ ID NO: 8251085 - DNA, 21 bp, Homo sapiens
tggctctgttcaatatatgga

SEQ ID NO: 8251086 - DNA, 22 bp, Homo sapiens
tggctctgtgtctcccagcagc

SEQ ID NO: 8251087 - DNA, 22 bp, Homo sapiens
tggctctgttcgccatcaggag

SEQ ID NO: 8251088 - DNA, 22 bp, Homo sapiens
tggctctgttcgccatcaggag

SEQ ID NO: 8251089 - DNA, 22 bp, Homo sapiens
tggctctggattaatctaggaa

SEQ ID NO: 8251090 - DNA, 22 bp, Homo sapiens
tggctctggagctggcggctga

SEQ ID NO: 8251091 - DNA, 22 bp, Homo sapiens
tggctctggagctggcggctga

SEQ ID NO: 8251092 - DNA, 22 bp, Homo sapiens
tggctctggattaatctaggaa

SEQ ID NO: 8251093 - DNA, 22 bp, Homo sapiens
tggctctggattaatctaggaa

SEQ ID NO: 8251094 - DNA, 22 bp, Homo sapiens
tggctctggattaatctaggaa

SEQ ID NO: 8251095 - DNA, 22 bp, Homo sapiens
tggctctggcgtgaagcccaga

SEQ ID NO: 8251096 - DNA, 22 bp, Homo sapiens
tggctctggccaccgggagggc

SEQ ID NO: 8251097 - DNA, 22 bp, Homo sapiens
tggctctggccaccgggagggc

SEQ ID NO: 8251098 - DNA, 22 bp, Homo sapiens
tggctctggccaccgggagggc

SEQ ID NO: 8251099 - DNA, 22 bp, Homo sapiens
tggctctggccaccgggagggc

SEQ ID NO: 8251100 - DNA, 22 bp, Homo sapiens
tggctctggccaccgggagggc

SEQ ID NO: 8251101 - DNA, 22 bp, Homo sapiens
tggctctgggaatgggaagatg

SEQ ID NO: 8251102 - DNA, 22 bp, Homo sapiens
tggctctgggcaccgtgtccac

SEQ ID NO: 8251103 - DNA, 22 bp, Homo sapiens
tggctctggcgtgaagcccaga

SEQ ID NO: 8251104 - DNA, 22 bp, Homo sapiens
tggctctgggaatctgttgctt

SEQ ID NO: 8251105 - DNA, 22 bp, Homo sapiens
tggctctgggaatctgttgctt

SEQ ID NO: 8251106 - DNA, 22 bp, Homo sapiens
tggctctgggaatctgttgctt

SEQ ID NO: 8251107 - DNA, 22 bp, Homo sapiens
tggctctgggaatctgttgctt

SEQ ID NO: 8251108 - DNA, 22 bp, Homo sapiens
tggctctgggaatgggaagatg

SEQ ID NO: 8251109 - DNA, 22 bp, Homo sapiens
tggctctgggaatgggaagatg

SEQ ID NO: 8251110 - DNA, 22 bp, Homo sapiens
tggctctgggaatgggaagatg

SEQ ID NO: 8251111 - DNA, 23 bp, Homo sapiens
tggctctgtggatccctcaggag

SEQ ID NO: 8251112 - DNA, 23 bp, Homo sapiens
tggctctgtggatccctcaggag

SEQ ID NO: 8251113 - DNA, 23 bp, Homo sapiens
tggctctgtggatccctcaggag

SEQ ID NO: 8251114 - DNA, 23 bp, Homo sapiens
tggctctgtggatccctcaggag

SEQ ID NO: 8251115 - DNA, 23 bp, Homo sapiens
tggctctgtgtcacatacaggat

SEQ ID NO: 8251116 - DNA, 22 bp, Homo sapiens
tggctctgtggtcttagcatgc

SEQ ID NO: 8251117 - DNA, 22 bp, Homo sapiens
tggctctgtggatgttctgacc

SEQ ID NO: 8251118 - DNA, 22 bp, Homo sapiens
tggctctgtggatgttctgacc

SEQ ID NO: 8251119 - DNA, 22 bp, Homo sapiens
tggctctgtggatgttctgacc

SEQ ID NO: 8251120 - DNA, 22 bp, Homo sapiens
tggctctgtgaacagacgactg

SEQ ID NO: 8251121 - DNA, 22 bp, Homo sapiens
tggctctgtgaacagacgactg

SEQ ID NO: 8251122 - DNA, 22 bp, Homo sapiens
tggctctgtgcttctagtatct

SEQ ID NO: 8251123 - DNA, 22 bp, Homo sapiens
tggctctgtgcttctagtatct

SEQ ID NO: 8251124 - DNA, 22 bp, Homo sapiens
tggctctggggacagtaagtcc

SEQ ID NO: 8251125 - DNA, 22 bp, Homo sapiens
tggctctgtcgccgtttggaat

SEQ ID NO: 8251126 - DNA, 22 bp, Homo sapiens
tggctctgtcgccgtttggaat

SEQ ID NO: 8251127 - DNA, 18 bp, Homo sapiens
tggctctgcagccagatg

SEQ ID NO: 8251128 - DNA, 22 bp, Homo sapiens
tggctctgcagcagtgtgcgtg

SEQ ID NO: 8251129 - DNA, 18 bp, Homo sapiens
tggctctgcagccagatg

SEQ ID NO: 8251130 - DNA, 22 bp, Homo sapiens
tggctctgcacctcagtgtacc

SEQ ID NO: 8251131 - DNA, 22 bp, Homo sapiens
tggctctgcacctcagtgtacc

SEQ ID NO: 8251132 - DNA, 22 bp, Homo sapiens
tggctctgcagcagtgtgcgtg

SEQ ID NO: 8251133 - DNA, 22 bp, Homo sapiens
tggctctgcacctcagtgtacc

SEQ ID NO: 8251134 - DNA, 22 bp, Homo sapiens
tggctctgatgggaggtattgg

SEQ ID NO: 8251135 - DNA, 22 bp, Homo sapiens
tggctctgatcagatgtccagt

SEQ ID NO: 8251136 - DNA, 22 bp, Homo sapiens
tggctctgatcagatgtccagt

SEQ ID NO: 8251137 - DNA, 22 bp, Homo sapiens
tggctctgatcagatgtccagt

SEQ ID NO: 8251138 - DNA, 18 bp, Homo sapiens
tggctctgccactcaccg

SEQ ID NO: 8251139 - DNA, 18 bp, Homo sapiens
tggctctgccactcaccg

SEQ ID NO: 8251140 - DNA, 18 bp, Homo sapiens
tggctctgccactcaccg

SEQ ID NO: 8251141 - DNA, 18 bp, Homo sapiens
tggctctgccactcaccg

SEQ ID NO: 8251142 - DNA, 22 bp, Homo sapiens
tggctctgccccatacccctgc

SEQ ID NO: 8251143 - DNA, 18 bp, Homo sapiens
tggctctgccactcaccg

SEQ ID NO: 8251144 - DNA, 18 bp, Homo sapiens
tggctctgcagccagatg

SEQ ID NO: 8251145 - DNA, 18 bp, Homo sapiens
tggctctgcagccagatg

SEQ ID NO: 8251146 - DNA, 22 bp, Homo sapiens
tggctctgccactaacttggta

SEQ ID NO: 8251147 - DNA, 22 bp, Homo sapiens
tggctctgccactaacttggta

SEQ ID NO: 8251148 - DNA, 22 bp, Homo sapiens
tggctctgccacctttccctaa

SEQ ID NO: 8251149 - DNA, 22 bp, Homo sapiens
tggctctgccacctttccctaa

SEQ ID NO: 8251150 - DNA, 22 bp, Homo sapiens
tggctctggagctggcggctga

SEQ ID NO: 8251151 - DNA, 22 bp, Homo sapiens
tggctctggagctcctgggccc

SEQ ID NO: 8251152 - DNA, 18 bp, Homo sapiens
tggctctggacttgctcc

SEQ ID NO: 8251153 - DNA, 18 bp, Homo sapiens
tggctctggacttgctcc

SEQ ID NO: 8251154 - DNA, 22 bp, Homo sapiens
tggctctgctgaacctagtgca

SEQ ID NO: 8251155 - DNA, 21 bp, Homo sapiens
tggctctgctcagagcagtcc

SEQ ID NO: 8251156 - DNA, 21 bp, Homo sapiens
tggctctgctcagagcagtcc

SEQ ID NO: 8251157 - DNA, 21 bp, Homo sapiens
tggctctgctcagagcagtcc

SEQ ID NO: 8251158 - DNA, 21 bp, Homo sapiens
tggctctgctcagagcagtcc

SEQ ID NO: 8251159 - DNA, 21 bp, Homo sapiens
tggctctgctcagagcagtcc

SEQ ID NO: 8251160 - DNA, 22 bp, Homo sapiens
tggctctgcgtctgttcgtggg

SEQ ID NO: 8251161 - DNA, 22 bp, Homo sapiens
tggctctgcgtctgttcgtggg

SEQ ID NO: 8251162 - DNA, 22 bp, Homo sapiens
tggctctgcgtctgttcgtggg

SEQ ID NO: 8251163 - DNA, 22 bp, Homo sapiens
tggctctgccccatacccctgc

SEQ ID NO: 8251164 - DNA, 17 bp, Homo sapiens
tggctctgaggctgaat

SEQ ID NO: 8251165 - DNA, 23 bp, Homo sapiens
tggctctgagcttcctggtggcc

SEQ ID NO: 8251166 - DNA, 22 bp, Homo sapiens
tggctctgagctgcaaagctgc

SEQ ID NO: 8251167 - DNA, 23 bp, Homo sapiens
tggctctgagcttcctggtggcc

SEQ ID NO: 8251168 - DNA, 23 bp, Homo sapiens
tggctctgagcttcctggtggcc

SEQ ID NO: 8251169 - DNA, 17 bp, Homo sapiens
tggctctgaggctgaat

SEQ ID NO: 8251170 - DNA, 17 bp, Homo sapiens
tggctctgaggctgaat

SEQ ID NO: 8251171 - DNA, 22 bp, Homo sapiens
tggctctgagtctgcccttggc

SEQ ID NO: 8251172 - DNA, 17 bp, Homo sapiens
tggctctgaggctgaat

SEQ ID NO: 8251173 - DNA, 23 bp, Homo sapiens
tggctctgagaggttcagatgct

SEQ ID NO: 8251174 - DNA, 23 bp, Homo sapiens
tggctctgagaggttcagatgct

SEQ ID NO: 8251175 - DNA, 22 bp, Homo sapiens
tggctctgagacacaggctctc

SEQ ID NO: 8251176 - DNA, 21 bp, Homo sapiens
tggctctgagcctcatggctg

SEQ ID NO: 8251177 - DNA, 23 bp, Homo sapiens
tggctctgagaggttcagatgct

SEQ ID NO: 8251178 - DNA, 23 bp, Homo sapiens
tggctctgagaggttcagatgct

SEQ ID NO: 8251179 - DNA, 22 bp, Homo sapiens
tggctctgagctgcaaagctgc

SEQ ID NO: 8251180 - DNA, 21 bp, Homo sapiens
tggctctgagcctcatggctg

SEQ ID NO: 8251181 - DNA, 21 bp, Homo sapiens
tggctctgagcctcatggctg

SEQ ID NO: 8251182 - DNA, 22 bp, Homo sapiens
tggctccttccgcagcatgcct

SEQ ID NO: 8251183 - DNA, 22 bp, Homo sapiens
tggctccttccgcagcatgcct

SEQ ID NO: 8251184 - DNA, 22 bp, Homo sapiens
tggctccttcattctcctgcca

SEQ ID NO: 8251185 - DNA, 22 bp, Homo sapiens
tggctccttcattctcctgcca

SEQ ID NO: 8251186 - DNA, 22 bp, Homo sapiens
tggctccttcattctcctgcca

SEQ ID NO: 8251187 - DNA, 20 bp, Homo sapiens
tggctcctggctcctccctc

SEQ ID NO: 8251188 - DNA, 20 bp, Homo sapiens
tggctcctggctcctccctc

SEQ ID NO: 8251189 - DNA, 20 bp, Homo sapiens
tggctcctggctcctccctc

SEQ ID NO: 8251190 - DNA, 20 bp, Homo sapiens
tggctcctggctcctccctc

SEQ ID NO: 8251191 - DNA, 22 bp, Homo sapiens
tggctctgagacacaggctctc

SEQ ID NO: 8251192 - DNA, 22 bp, Homo sapiens
tggctctgagacacaggctctc

SEQ ID NO: 8251193 - DNA, 20 bp, Homo sapiens
tggctctcaccctgtgcgat

SEQ ID NO: 8251194 - DNA, 20 bp, Homo sapiens
tggctctcaccctgtgcgat

SEQ ID NO: 8251195 - DNA, 22 bp, Homo sapiens
tggctcctttccgggtctccag

SEQ ID NO: 8251196 - DNA, 22 bp, Homo sapiens
tgaagaaacagaccaagaggat

SEQ ID NO: 8251197 - DNA, 22 bp, Homo sapiens
tgaagaaacagaccaagaggat

SEQ ID NO: 8251198 - DNA, 22 bp, Homo sapiens
tgaagaaacgcagagaggtagg

SEQ ID NO: 8251199 - DNA, 22 bp, Homo sapiens
tgaacttttatttgatgacagg

SEQ ID NO: 8251200 - DNA, 22 bp, Homo sapiens
tgaagaaaggtgtgggatactc

SEQ ID NO: 8251201 - DNA, 22 bp, Homo sapiens
tgaagaaacgcagagaggtagg

SEQ ID NO: 8251202 - DNA, 22 bp, Homo sapiens
tgaagaaacgcagagaggtagg

SEQ ID NO: 8251203 - DNA, 22 bp, Homo sapiens
tgaagaagccaattggtaggct

SEQ ID NO: 8251204 - DNA, 22 bp, Homo sapiens
tgaagaataaatggttgagact

SEQ ID NO: 8251205 - DNA, 22 bp, Homo sapiens
tgaagaataagatagatggagc

SEQ ID NO: 8251206 - DNA, 22 bp, Homo sapiens
tgaagaatgttgcagtgagcat

SEQ ID NO: 8251207 - DNA, 22 bp, Homo sapiens
tgaagaatgttgcagtgagcat

SEQ ID NO: 8251208 - DNA, 22 bp, Homo sapiens
tgaagaatgtgaattggtagct

SEQ ID NO: 8251209 - DNA, 22 bp, Homo sapiens
tgaagaatcccagggaatttgg

SEQ ID NO: 8251210 - DNA, 22 bp, Homo sapiens
tgaagaatcagattggcctgcg

SEQ ID NO: 8251211 - DNA, 22 bp, Homo sapiens
tgaagacaagaaaacactgggg

SEQ ID NO: 8251212 - DNA, 22 bp, Homo sapiens
tgaagacagaccaaggagaatg

SEQ ID NO: 8251213 - DNA, 22 bp, Homo sapiens
tgaagacagaccaaggagaatg

SEQ ID NO: 8251214 - DNA, 22 bp, Homo sapiens
tgaagacacatacaagggaatg

SEQ ID NO: 8251215 - DNA, 22 bp, Homo sapiens
tgaagacacatacaagggaatg

SEQ ID NO: 8251216 - DNA, 22 bp, Homo sapiens
tgaagactcagaagctaagata

SEQ ID NO: 8251217 - DNA, 22 bp, Homo sapiens
tgaagactcagaagctaagata

SEQ ID NO: 8251218 - DNA, 22 bp, Homo sapiens
tgaagactcagaagctaagata

SEQ ID NO: 8251219 - DNA, 18 bp, Homo sapiens
tgaagacatgaggttagt

SEQ ID NO: 8251220 - DNA, 22 bp, Homo sapiens
tgaagacagttttactcatgag

SEQ ID NO: 8251221 - DNA, 22 bp, Homo sapiens
tgaagcaaatttttctcagagt

SEQ ID NO: 8251222 - DNA, 22 bp, Homo sapiens
tgaagcaaatttttctcagagt

SEQ ID NO: 8251223 - DNA, 19 bp, Homo sapiens
tgaagcaataccatttttg

SEQ ID NO: 8251224 - DNA, 22 bp, Homo sapiens
tgaagcaatgatcttttggtgg

SEQ ID NO: 8251225 - DNA, 22 bp, Homo sapiens
tgaagcaatagagacaagacca

SEQ ID NO: 8251226 - DNA, 22 bp, Homo sapiens
tgaagcaatgatagcagaatga

SEQ ID NO: 8251227 - DNA, 19 bp, Homo sapiens
tgaagcaataccatttttg

SEQ ID NO: 8251228 - DNA, 22 bp, Homo sapiens
tgaagcagaggggtcttgagct

SEQ ID NO: 8251229 - DNA, 22 bp, Homo sapiens
tgaagcagagaatttgacagtc

SEQ ID NO: 8251230 - DNA, 22 bp, Homo sapiens
tgaagcagagaatttgacagtc

SEQ ID NO: 8251231 - DNA, 22 bp, Homo sapiens
tgaagcagcaccattttagagc

SEQ ID NO: 8251232 - DNA, 19 bp, Homo sapiens
tgaagcagcaaactctcag

SEQ ID NO: 8251233 - DNA, 20 bp, Homo sapiens
tgaagcagccttgattctgt

SEQ ID NO: 8251234 - DNA, 20 bp, Homo sapiens
tgaagcagccttgattctgt

SEQ ID NO: 8251235 - DNA, 19 bp, Homo sapiens
tgaagcaggcagagaagat

SEQ ID NO: 8251236 - DNA, 22 bp, Homo sapiens
tgaagcagttctcagaagtggg

SEQ ID NO: 8251237 - DNA, 18 bp, Homo sapiens
tgaaattgcatccatgag

SEQ ID NO: 8251238 - DNA, 23 bp, Homo sapiens
tgaaattgtagagattttgtgtg

SEQ ID NO: 8251239 - DNA, 22 bp, Homo sapiens
tgaaattccaggagagttaaaa

SEQ ID NO: 8251240 - DNA, 22 bp, Homo sapiens
tgaaattcaaaacacatttgtc

SEQ ID NO: 8251241 - DNA, 22 bp, Homo sapiens
tgaaattcattgttttatgtgt

SEQ ID NO: 8251242 - DNA, 22 bp, Homo sapiens
tgaacaaactgcattcttcact

SEQ ID NO: 8251243 - DNA, 22 bp, Homo sapiens
tgaacaaactgcattcttcact

SEQ ID NO: 8251244 - DNA, 23 bp, Homo sapiens
tgaacaaaggcaggagaaggcgg

SEQ ID NO: 8251245 - DNA, 22 bp, Homo sapiens
tgaacaaactgcattcttcact

SEQ ID NO: 8251246 - DNA, 22 bp, Homo sapiens
tgaacaaactgcattcttcact

SEQ ID NO: 8251247 - DNA, 22 bp, Homo sapiens
tgaacaaactgcattcttcact

SEQ ID NO: 8251248 - DNA, 22 bp, Homo sapiens
tgaaattagtgaagttacagtt

SEQ ID NO: 8251249 - DNA, 22 bp, Homo sapiens
tgaaattcaaaacacatttgtc

SEQ ID NO: 8251250 - DNA, 22 bp, Homo sapiens
tgaaattatgcattgttgtacc

SEQ ID NO: 8251251 - DNA, 22 bp, Homo sapiens
tgaaattatgcattgttgtacc

SEQ ID NO: 8251252 - DNA, 22 bp, Homo sapiens
tgaaattatgcattgttgtacc

SEQ ID NO: 8251253 - DNA, 22 bp, Homo sapiens
tgaacaaatgaatcagtgtagc

SEQ ID NO: 8251254 - DNA, 21 bp, Homo sapiens
tgaacaaagttcttatcgtga

SEQ ID NO: 8251255 - DNA, 22 bp, Homo sapiens
tgaacaaatggaaataaccagt

SEQ ID NO: 8251256 - DNA, 22 bp, Homo sapiens
tgaacacacacctatgtacaaa

SEQ ID NO: 8251257 - DNA, 22 bp, Homo sapiens
tgaacagtggttcatgtcacgg

SEQ ID NO: 8251258 - DNA, 22 bp, Homo sapiens
tgaacagtgggcatgtgaagac

SEQ ID NO: 8251259 - DNA, 22 bp, Homo sapiens
tgaacagtgatctacatgtggc

SEQ ID NO: 8251260 - DNA, 22 bp, Homo sapiens
tgaacagtgtatctagatcatg

SEQ ID NO: 8251261 - DNA, 22 bp, Homo sapiens
tgaacagttactttgtagaaga

SEQ ID NO: 8251262 - DNA, 22 bp, Homo sapiens
tgaacagtgtgagggtgtgacc

SEQ ID NO: 8251263 - DNA, 22 bp, Homo sapiens
tgaacagtttcaagaaaacttt

SEQ ID NO: 8251264 - DNA, 22 bp, Homo sapiens
tgaacagtttcaagaaaacttt

SEQ ID NO: 8251265 - DNA, 22 bp, Homo sapiens
tgaacatacaattattaagaac

SEQ ID NO: 8251266 - DNA, 22 bp, Homo sapiens
tgaactgagcagtttcctggga

SEQ ID NO: 8251267 - DNA, 22 bp, Homo sapiens
tgaactcctgacctcatgatcc

SEQ ID NO: 8251268 - DNA, 22 bp, Homo sapiens
tgaactctaatggtgcttttct

SEQ ID NO: 8251269 - DNA, 22 bp, Homo sapiens
tgaacgcaggtccacatggctc

SEQ ID NO: 8251270 - DNA, 22 bp, Homo sapiens
tgaacgttcatagttatttgtt

SEQ ID NO: 8251271 - DNA, 22 bp, Homo sapiens
tgaactatacgataacatgatt

SEQ ID NO: 8251272 - DNA, 22 bp, Homo sapiens
tgaactttgtagtaatggagat

SEQ ID NO: 8251273 - DNA, 22 bp, Homo sapiens
tgaactgcaggaatctcagtgg

SEQ ID NO: 8251274 - DNA, 22 bp, Homo sapiens
tgaacccttaggattttatttg

SEQ ID NO: 8251275 - DNA, 22 bp, Homo sapiens
tgaaccagagtctccagtggtt

SEQ ID NO: 8251276 - DNA, 22 bp, Homo sapiens
tgaaccaggaggcagccagcac

SEQ ID NO: 8251277 - DNA, 22 bp, Homo sapiens
tgaaccacaggagggttcatgt

SEQ ID NO: 8251278 - DNA, 22 bp, Homo sapiens
tgaaccacagaagtcaggagct

SEQ ID NO: 8251279 - DNA, 22 bp, Homo sapiens
tgaacattgtcacattcctagc

SEQ ID NO: 8251280 - DNA, 22 bp, Homo sapiens
tgaacatgctgttgatggcctg

SEQ ID NO: 8251281 - DNA, 22 bp, Homo sapiens
tgaacatgctgttgatggcctg

SEQ ID NO: 8251282 - DNA, 22 bp, Homo sapiens
tgaacatattcacctctaaata

SEQ ID NO: 8251283 - DNA, 22 bp, Homo sapiens
tgaacatgctgttgatggcctg

SEQ ID NO: 8251284 - DNA, 22 bp, Homo sapiens
tgaacatacaattattaagaac

SEQ ID NO: 8251285 - DNA, 22 bp, Homo sapiens
tgaacattggcacaaggcagca

SEQ ID NO: 8251286 - DNA, 22 bp, Homo sapiens
tgaacattcctgaatgaagcat

SEQ ID NO: 8251287 - DNA, 22 bp, Homo sapiens
tgaacatgctgttgatggcctg

SEQ ID NO: 8251288 - DNA, 22 bp, Homo sapiens
tgaacatgctgttgatggcctg

SEQ ID NO: 8251289 - DNA, 22 bp, Homo sapiens
tgaacatgctgttgatggcctg

SEQ ID NO: 8251290 - DNA, 22 bp, Homo sapiens
tgaacattagttgagtaaagtc

SEQ ID NO: 8251291 - DNA, 22 bp, Homo sapiens
tgaaatgtgtccatgttatttc

SEQ ID NO: 8251292 - DNA, 22 bp, Homo sapiens
tgaaatgtgtaatgtggatgcc

SEQ ID NO: 8251293 - DNA, 22 bp, Homo sapiens
tgaaatgtctttgcaattgaaa

SEQ ID NO: 8251294 - DNA, 22 bp, Homo sapiens
tgaaatgtcagtgttttataag

SEQ ID NO: 8251295 - DNA, 22 bp, Homo sapiens
tgaaatgtacataaaaacgcac

SEQ ID NO: 8251296 - DNA, 22 bp, Homo sapiens
tgaaatgtagattaggcattct

SEQ ID NO: 8251297 - DNA, 22 bp, Homo sapiens
tgaaatgttctggagtttctgt

SEQ ID NO: 8251298 - DNA, 22 bp, Homo sapiens
tgaaatgttctggagtttctgt

SEQ ID NO: 8251299 - DNA, 22 bp, Homo sapiens
tgaaatgttgccatgaggtctc

SEQ ID NO: 8251300 - DNA, 22 bp, Homo sapiens
tgaaatgtgttctagtgttttg

SEQ ID NO: 8251301 - DNA, 22 bp, Homo sapiens
tgaaatgtgttctagtgttttg

SEQ ID NO: 8251302 - DNA, 22 bp, Homo sapiens
tgaaatgtgttctagtgttttg

SEQ ID NO: 8251303 - DNA, 22 bp, Homo sapiens
tgaaatgtttgggtccagaagt

SEQ ID NO: 8251304 - DNA, 22 bp, Homo sapiens
tgaaatgtttgggtccagaagt

SEQ ID NO: 8251305 - DNA, 22 bp, Homo sapiens
tgaaatgtttatctctcctgct

SEQ ID NO: 8251306 - DNA, 22 bp, Homo sapiens
tgaaatgttggtaattttatat

SEQ ID NO: 8251307 - DNA, 22 bp, Homo sapiens
tgaaatgttggtaattttatat

SEQ ID NO: 8251308 - DNA, 22 bp, Homo sapiens
tgaaatcattggggttgaataa

SEQ ID NO: 8251309 - DNA, 22 bp, Homo sapiens
tgaaatcattggggttgaataa

SEQ ID NO: 8251310 - DNA, 22 bp, Homo sapiens
tgaaatctgcatgcaaagtcct

SEQ ID NO: 8251311 - DNA, 22 bp, Homo sapiens
tgaaatcttagccattctgcct

SEQ ID NO: 8251312 - DNA, 22 bp, Homo sapiens
tgaaatcatgagatagtgtcac

SEQ ID NO: 8251313 - DNA, 22 bp, Homo sapiens
tgaaatcatgagatagtgtcac

SEQ ID NO: 8251314 - DNA, 22 bp, Homo sapiens
tgaaatcatgagatagtgtcac

SEQ ID NO: 8251315 - DNA, 22 bp, Homo sapiens
tgaaatcatgaacaaggtaggt

SEQ ID NO: 8251316 - DNA, 22 bp, Homo sapiens
tgaaatcatgtagttattgcaa

SEQ ID NO: 8251317 - DNA, 22 bp, Homo sapiens
tgaaatcatgagatagtgtcac

SEQ ID NO: 8251318 - DNA, 22 bp, Homo sapiens
tgaaatcatgtagttattgcaa

SEQ ID NO: 8251319 - DNA, 22 bp, Homo sapiens
tgaaatcattgccaagtattga

SEQ ID NO: 8251320 - DNA, 22 bp, Homo sapiens
tgaaatcattgccaagtattga

SEQ ID NO: 8251321 - DNA, 22 bp, Homo sapiens
tgaaatcattgccaagtattga

SEQ ID NO: 8251322 - DNA, 22 bp, Homo sapiens
tgaaatggtattctttttcaat

SEQ ID NO: 8251323 - DNA, 22 bp, Homo sapiens
tgaaatggcaaggcagagcttt

SEQ ID NO: 8251324 - DNA, 22 bp, Homo sapiens
tgaaatggcaaggcagagcttt

SEQ ID NO: 8251325 - DNA, 19 bp, Homo sapiens
tgaaatggcagttgctaaa

SEQ ID NO: 8251326 - DNA, 22 bp, Homo sapiens
tgaaatggatgagagcagaggt

SEQ ID NO: 8251327 - DNA, 22 bp, Homo sapiens
tgaaatggcaaggcagagcttt

SEQ ID NO: 8251328 - DNA, 22 bp, Homo sapiens
tgaaatggattgaagtggctta

SEQ ID NO: 8251329 - DNA, 22 bp, Homo sapiens
tgaaatggatgagagcagaggt

SEQ ID NO: 8251330 - DNA, 22 bp, Homo sapiens
tgaaatgcttgggaccagaagt

SEQ ID NO: 8251331 - DNA, 22 bp, Homo sapiens
tgaaatgcttttacaggatatt

SEQ ID NO: 8251332 - DNA, 22 bp, Homo sapiens
tgaaatgcttaggaccagaagg

SEQ ID NO: 8251333 - DNA, 22 bp, Homo sapiens
tgaaatgctgtagagactgtat

SEQ ID NO: 8251334 - DNA, 22 bp, Homo sapiens
tgaaatgctgtagagactgtat

SEQ ID NO: 8251335 - DNA, 22 bp, Homo sapiens
tgaaatctttagtttctgtccc

SEQ ID NO: 8251336 - DNA, 22 bp, Homo sapiens
tgaaatgcacatattccataaa

SEQ ID NO: 8251337 - DNA, 22 bp, Homo sapiens
tgaaatcagtatgtctttctca

SEQ ID NO: 8251338 - DNA, 17 bp, Homo sapiens
tgaaatcagcacccagg

SEQ ID NO: 8251339 - DNA, 22 bp, Homo sapiens
tgaaatcaattgcaatgtttat

SEQ ID NO: 8251340 - DNA, 22 bp, Homo sapiens
tgaaatcagtatgtctttctca

SEQ ID NO: 8251341 - DNA, 22 bp, Homo sapiens
tgaaatcataacagtttggctt

SEQ ID NO: 8251342 - DNA, 22 bp, Homo sapiens
tgaaatcagtggtataatcggg

SEQ ID NO: 8251343 - DNA, 22 bp, Homo sapiens
tgaaatcagtatgtctttctca

SEQ ID NO: 8251344 - DNA, 22 bp, Homo sapiens
tgaaatcatcaaaagagccatt

SEQ ID NO: 8251345 - DNA, 22 bp, Homo sapiens
tgaaatcatctgccaataagtt

SEQ ID NO: 8251346 - DNA, 22 bp, Homo sapiens
tgaaatatgctcccattcactt

SEQ ID NO: 8251347 - DNA, 22 bp, Homo sapiens
tgaaatatgctcccattcactt

SEQ ID NO: 8251348 - DNA, 22 bp, Homo sapiens
tgaaatcaattgcaatgtttat

SEQ ID NO: 8251349 - DNA, 22 bp, Homo sapiens
tgaaatcaatgtcttctgtctc

SEQ ID NO: 8251350 - DNA, 22 bp, Homo sapiens
tgaaatcaataattggtgattg

SEQ ID NO: 8251351 - DNA, 22 bp, Homo sapiens
tgaaatcaactaggagacacca

SEQ ID NO: 8251352 - DNA, 22 bp, Homo sapiens
tgaaatcaactaggagacacca

SEQ ID NO: 8251353 - DNA, 22 bp, Homo sapiens
tgaaataatatctggatcaatc

SEQ ID NO: 8251354 - DNA, 22 bp, Homo sapiens
tgaaataatatctggatcaatc

SEQ ID NO: 8251355 - DNA, 22 bp, Homo sapiens
tgaaatacacaaatttagtaag

SEQ ID NO: 8251356 - DNA, 22 bp, Homo sapiens
tgaaatactgagtgaaagaatt

SEQ ID NO: 8251357 - DNA, 22 bp, Homo sapiens
tgaaatagtcaagtatttgaac

SEQ ID NO: 8251358 - DNA, 22 bp, Homo sapiens
tgaaatagtcaagtatttgaac

SEQ ID NO: 8251359 - DNA, 22 bp, Homo sapiens
tgaaataggaaacagatgtttc

SEQ ID NO: 8251360 - DNA, 22 bp, Homo sapiens
tgaaatagacttgcactatatg

SEQ ID NO: 8251361 - DNA, 22 bp, Homo sapiens
tgaaatatcattttcatctccc

SEQ ID NO: 8251362 - DNA, 23 bp, Homo sapiens
tgaaagcaatgggtctatagtat

SEQ ID NO: 8251363 - DNA, 22 bp, Homo sapiens
tgaaagcacaagttctaacagg

SEQ ID NO: 8251364 - DNA, 22 bp, Homo sapiens
tgaaaggtagctggcctcatag

SEQ ID NO: 8251365 - DNA, 22 bp, Homo sapiens
tgaaagataagttattatgtac

SEQ ID NO: 8251366 - DNA, 22 bp, Homo sapiens
tgaaagatgaaagcaggctggt

SEQ ID NO: 8251367 - DNA, 22 bp, Homo sapiens
tgaaagataagttattatgtac

SEQ ID NO: 8251368 - DNA, 22 bp, Homo sapiens
tgaaagatgctcaatgaatggt

SEQ ID NO: 8251369 - DNA, 22 bp, Homo sapiens
tgaaagttgcacataagagaat

SEQ ID NO: 8251370 - DNA, 21 bp, Homo sapiens
tgaaagttggagtcaaatgta

SEQ ID NO: 8251371 - DNA, 23 bp, Homo sapiens
tgaaagttctgaagagatcatgc

SEQ ID NO: 8251372 - DNA, 22 bp, Homo sapiens
tgaaagttattactgatgatgt

SEQ ID NO: 8251373 - DNA, 22 bp, Homo sapiens
tgaaagttattactgatgatgt

SEQ ID NO: 8251374 - DNA, 22 bp, Homo sapiens
tgaaagttacaggaaaacagat

SEQ ID NO: 8251375 - DNA, 22 bp, Homo sapiens
tgaaagttaggatgtagtaatt

SEQ ID NO: 8251376 - DNA, 22 bp, Homo sapiens
tgaaaggttatttaggtctgct

SEQ ID NO: 8251377 - DNA, 22 bp, Homo sapiens
tgaaaggttaaaagtagtattg

SEQ ID NO: 8251378 - DNA, 22 bp, Homo sapiens
tgaaaggtgtccaatatttctc

SEQ ID NO: 8251379 - DNA, 20 bp, Homo sapiens
tgaaaggtgggaattgtggg

SEQ ID NO: 8251380 - DNA, 22 bp, Homo sapiens
tgaaaggtgacatttcttggat

SEQ ID NO: 8251381 - DNA, 22 bp, Homo sapiens
tgaaagtatttgatttctatta

SEQ ID NO: 8251382 - DNA, 22 bp, Homo sapiens
tgaaagaaacaggtatattggg

SEQ ID NO: 8251383 - DNA, 22 bp, Homo sapiens
tgaaagaaacaggtatattggg

SEQ ID NO: 8251384 - DNA, 22 bp, Homo sapiens
tgaaacttgctaattgcacgta

SEQ ID NO: 8251385 - DNA, 22 bp, Homo sapiens
tgaaacttttgaggttcttcca

SEQ ID NO: 8251386 - DNA, 22 bp, Homo sapiens
tgaaacttattcagtttctacc

SEQ ID NO: 8251387 - DNA, 22 bp, Homo sapiens
tgaaactaggccaatcaaatta

SEQ ID NO: 8251388 - DNA, 22 bp, Homo sapiens
tgaaacttataagaatatgaat

SEQ ID NO: 8251389 - DNA, 22 bp, Homo sapiens
tgaaacggaatgttctttatcg

SEQ ID NO: 8251390 - DNA, 22 bp, Homo sapiens
tgaaaccactgatggtaccaag

SEQ ID NO: 8251391 - DNA, 22 bp, Homo sapiens
tgaaaccattctcaggtacact

SEQ ID NO: 8251392 - DNA, 22 bp, Homo sapiens
tgaaagaagtgtcacattgcca

SEQ ID NO: 8251393 - DNA, 17 bp, Homo sapiens
tgaaagaatcagggaga

SEQ ID NO: 8251394 - DNA, 21 bp, Homo sapiens
tgaaagaggatgtggtcattc

SEQ ID NO: 8251395 - DNA, 21 bp, Homo sapiens
tgaaagaggatgtggtcattc

SEQ ID NO: 8251396 - DNA, 22 bp, Homo sapiens
tgaaagaactagcatcttcaag

SEQ ID NO: 8251397 - DNA, 22 bp, Homo sapiens
tgaaagaactagcatcttcaag

SEQ ID NO: 8251398 - DNA, 22 bp, Homo sapiens
tgaaacattaggaaatcattat

SEQ ID NO: 8251399 - DNA, 22 bp, Homo sapiens
tgaaacattaggaaatcattat

SEQ ID NO: 8251400 - DNA, 22 bp, Homo sapiens
tgaaacataaagttatcttcag

SEQ ID NO: 8251401 - DNA, 22 bp, Homo sapiens
tgaaacataaagttatcttcag

SEQ ID NO: 8251402 - DNA, 22 bp, Homo sapiens
tgaaacataaagttatcttcag

SEQ ID NO: 8251403 - DNA, 22 bp, Homo sapiens
tgaaacattaggaaatcattat

SEQ ID NO: 8251404 - DNA, 22 bp, Homo sapiens
tgaaacattaggaaatcattat

SEQ ID NO: 8251405 - DNA, 22 bp, Homo sapiens
tgaaacattatagaatatttat

SEQ ID NO: 8251406 - DNA, 22 bp, Homo sapiens
tgaaacattatagaatatttat

SEQ ID NO: 8251407 - DNA, 22 bp, Homo sapiens
tgaaacattatagaatatttat

SEQ ID NO: 8251408 - DNA, 22 bp, Homo sapiens
tgaaacattatagaatatttat

SEQ ID NO: 8251409 - DNA, 23 bp, Homo sapiens
tgaaacatttagggtagaatttc

SEQ ID NO: 8251410 - DNA, 22 bp, Homo sapiens
tgaaacatttgatgatctttgg

SEQ ID NO: 8251411 - DNA, 22 bp, Homo sapiens
tgaaacatttgatgatctttgg

SEQ ID NO: 8251412 - DNA, 21 bp, Homo sapiens
tgaaacatttgatcaaagcac

SEQ ID NO: 8251413 - DNA, 21 bp, Homo sapiens
tgaaacatttgatcaaagcac

SEQ ID NO: 8251414 - DNA, 22 bp, Homo sapiens
tgaaacagtattctcaaccttt

SEQ ID NO: 8251415 - DNA, 22 bp, Homo sapiens
tgaaacagtctccagacttgga

SEQ ID NO: 8251416 - DNA, 22 bp, Homo sapiens
tgaaacaggcaaaactgcagat

SEQ ID NO: 8251417 - DNA, 19 bp, Homo sapiens
tgaaacaaacttaaaagga

SEQ ID NO: 8251418 - DNA, 22 bp, Homo sapiens
tgaaacaaaccagtaattttgt

SEQ ID NO: 8251419 - DNA, 22 bp, Homo sapiens
tgaaaatgccctctatgtctca

SEQ ID NO: 8251420 - DNA, 22 bp, Homo sapiens
tgaaaatgccctctatgtctca

SEQ ID NO: 8251421 - DNA, 22 bp, Homo sapiens
tgaaaattaagcagatgaatga

SEQ ID NO: 8251422 - DNA, 22 bp, Homo sapiens
tgaaaattcatctcatagcaga

SEQ ID NO: 8251423 - DNA, 22 bp, Homo sapiens
tgaaaattgttgtacttgataa

SEQ ID NO: 8251424 - DNA, 22 bp, Homo sapiens
tgaaaattgttgtacttgataa

SEQ ID NO: 8251425 - DNA, 22 bp, Homo sapiens
tgaaaattgttgtacttgataa

SEQ ID NO: 8251426 - DNA, 22 bp, Homo sapiens
tgaaacaaaagtatgtagcttg

SEQ ID NO: 8251427 - DNA, 22 bp, Homo sapiens
tgaaaatatagttttccagact

SEQ ID NO: 8251428 - DNA, 22 bp, Homo sapiens
tgaaaatatagttttccagact

SEQ ID NO: 8251429 - DNA, 22 bp, Homo sapiens
tgaaaatatagttttccagact

SEQ ID NO: 8251430 - DNA, 22 bp, Homo sapiens
tgaaaatatagttttccagact

SEQ ID NO: 8251431 - DNA, 22 bp, Homo sapiens
tgaaaatatagttttccagact

SEQ ID NO: 8251432 - DNA, 22 bp, Homo sapiens
tgaaaagactgcaagagagcat

SEQ ID NO: 8251433 - DNA, 22 bp, Homo sapiens
tgaaaagtcttatattgtctga

SEQ ID NO: 8251434 - DNA, 22 bp, Homo sapiens
tgaaaagggtagatccctaagt

SEQ ID NO: 8251435 - DNA, 22 bp, Homo sapiens
tgaaaaactttaatccataaag

SEQ ID NO: 8251436 - DNA, 22 bp, Homo sapiens
tgaaaacactttagtttaggtc

SEQ ID NO: 8251437 - DNA, 22 bp, Homo sapiens
tgaaaactccaagtttcatcag

SEQ ID NO: 8251438 - DNA, 22 bp, Homo sapiens
tgaaaaaacaagttggcccatt

SEQ ID NO: 8251439 - DNA, 22 bp, Homo sapiens
tgaaaaaacaagttggcccatt

SEQ ID NO: 8251440 - DNA, 22 bp, Homo sapiens
tgaaaaactgaatagttgagta

SEQ ID NO: 8251441 - DNA, 22 bp, Homo sapiens
tgaaaaacactaattggaaagc

SEQ ID NO: 8251442 - DNA, 23 bp, Homo sapiens
tctttttaagagatctagtgacg

SEQ ID NO: 8251443 - DNA, 22 bp, Homo sapiens
tcttttgttgatggaattaatg

SEQ ID NO: 8251444 - DNA, 22 bp, Homo sapiens
tctttttatattgacaaaaggt

SEQ ID NO: 8251445 - DNA, 23 bp, Homo sapiens
tctttttaagagatctagtgacg

SEQ ID NO: 8251446 - DNA, 22 bp, Homo sapiens
tctttttttcctgtgcagagct

SEQ ID NO: 8251447 - DNA, 22 bp, Homo sapiens
tctttttttcctgtgcagagct

SEQ ID NO: 8251448 - DNA, 22 bp, Homo sapiens
tctttttctgcacacgtgtccc

SEQ ID NO: 8251449 - DNA, 22 bp, Homo sapiens
tctttttcttattcccacactg

SEQ ID NO: 8251450 - DNA, 22 bp, Homo sapiens
tctttgtttgcctttatcaaga

SEQ ID NO: 8251451 - DNA, 22 bp, Homo sapiens
tctttgtttgtactgttagaat

SEQ ID NO: 8251452 - DNA, 22 bp, Homo sapiens
tctttgtttgcctttatcaaga

SEQ ID NO: 8251453 - DNA, 21 bp, Homo sapiens
tcttttaacaccaggaattcc

SEQ ID NO: 8251454 - DNA, 21 bp, Homo sapiens
tcttttaacaccaggaattcc

SEQ ID NO: 8251455 - DNA, 22 bp, Homo sapiens
tctttgtttgtactgttagaat

SEQ ID NO: 8251456 - DNA, 22 bp, Homo sapiens
tctttgtttgtactgttagaat

SEQ ID NO: 8251457 - DNA, 22 bp, Homo sapiens
tctttgttattgctttatctat

SEQ ID NO: 8251458 - DNA, 20 bp, Homo sapiens
tctttgttaattttatctcc

SEQ ID NO: 8251459 - DNA, 22 bp, Homo sapiens
tcttttagagcatttctgattc

SEQ ID NO: 8251460 - DNA, 22 bp, Homo sapiens
tcttttagtaataaatatttgt

SEQ ID NO: 8251461 - DNA, 22 bp, Homo sapiens
tcttttatcctacatttagctc

SEQ ID NO: 8251462 - DNA, 22 bp, Homo sapiens
tcttttatcctacatttagctc

SEQ ID NO: 8251463 - DNA, 22 bp, Homo sapiens
tcttttatagtgaattttcttg

SEQ ID NO: 8251464 - DNA, 22 bp, Homo sapiens
tcttttatagtgaattttcttg

SEQ ID NO: 8251465 - DNA, 22 bp, Homo sapiens
tcttttatagtgaattttcttg

SEQ ID NO: 8251466 - DNA, 21 bp, Homo sapiens
tcttttaacaccaggaattcc

SEQ ID NO: 8251467 - DNA, 21 bp, Homo sapiens
tcttttaacaccaggaattcc

SEQ ID NO: 8251468 - DNA, 22 bp, Homo sapiens
tcttttaacctaactagcttgg

SEQ ID NO: 8251469 - DNA, 22 bp, Homo sapiens
tcttttaacctaactagcttgg

SEQ ID NO: 8251470 - DNA, 22 bp, Homo sapiens
tcttttagaaaagttgaatgta

SEQ ID NO: 8251471 - DNA, 22 bp, Homo sapiens
tcttttaagcctctggcatagg

SEQ ID NO: 8251472 - DNA, 22 bp, Homo sapiens
tcttttagaaaagttgaatgta

SEQ ID NO: 8251473 - DNA, 22 bp, Homo sapiens
tcttttaagcctctggcatagg

SEQ ID NO: 8251474 - DNA, 22 bp, Homo sapiens
tcttttattaggctgaaatggg

SEQ ID NO: 8251475 - DNA, 22 bp, Homo sapiens
tcttttatctgttgtgtaacaa

SEQ ID NO: 8251476 - DNA, 22 bp, Homo sapiens
tcttttatcctacatttagctc

SEQ ID NO: 8251477 - DNA, 22 bp, Homo sapiens
tcttttattaggctgaaatggg

SEQ ID NO: 8251478 - DNA, 22 bp, Homo sapiens
tcttttattaggctgaaatggg

SEQ ID NO: 8251479 - DNA, 22 bp, Homo sapiens
tcttttattaggctgaaatggg

SEQ ID NO: 8251480 - DNA, 20 bp, Homo sapiens
tcttttattggcagatcctg

SEQ ID NO: 8251481 - DNA, 20 bp, Homo sapiens
tcttttattggcagatcctg

SEQ ID NO: 8251482 - DNA, 22 bp, Homo sapiens
tcttttcatcatttaataggta

SEQ ID NO: 8251483 - DNA, 22 bp, Homo sapiens
tcttttcatcatttaataggta

SEQ ID NO: 8251484 - DNA, 23 bp, Homo sapiens
tcttttcaatggttctttatgtg

SEQ ID NO: 8251485 - DNA, 22 bp, Homo sapiens
tcttttcacaaaggagctggag

SEQ ID NO: 8251486 - DNA, 22 bp, Homo sapiens
tcttttcacagacaaatggaga

SEQ ID NO: 8251487 - DNA, 22 bp, Homo sapiens
tcttttcacagacaaatggaga

SEQ ID NO: 8251488 - DNA, 22 bp, Homo sapiens
tcttttctccagacctgggatc

SEQ ID NO: 8251489 - DNA, 21 bp, Homo sapiens
tcttttctctgcaggattcct

SEQ ID NO: 8251490 - DNA, 21 bp, Homo sapiens
tcttttctctgcaggattcct

SEQ ID NO: 8251491 - DNA, 21 bp, Homo sapiens
tcttttctcagctttgtggtt

SEQ ID NO: 8251492 - DNA, 22 bp, Homo sapiens
tcttttctagcaaatccaggag

SEQ ID NO: 8251493 - DNA, 22 bp, Homo sapiens
tcttttctagcaaatccaggag

SEQ ID NO: 8251494 - DNA, 22 bp, Homo sapiens
tcttttctagcaaatccaggag

SEQ ID NO: 8251495 - DNA, 21 bp, Homo sapiens
tcttttcctttctgtgtgcaa

SEQ ID NO: 8251496 - DNA, 18 bp, Homo sapiens
tcttttccttccacttcc

SEQ ID NO: 8251497 - DNA, 18 bp, Homo sapiens
tcttttccttccacttcc

SEQ ID NO: 8251498 - DNA, 22 bp, Homo sapiens
tcttttccttccctacagatct

SEQ ID NO: 8251499 - DNA, 22 bp, Homo sapiens
tcttttccttccctacagatct

SEQ ID NO: 8251500 - DNA, 22 bp, Homo sapiens
tcttttccttccctacagatct

SEQ ID NO: 8251501 - DNA, 22 bp, Homo sapiens
tctttggaaggagcagtttttg

SEQ ID NO: 8251502 - DNA, 22 bp, Homo sapiens
tctttggaagctttcagagaag

SEQ ID NO: 8251503 - DNA, 22 bp, Homo sapiens
tctttggaagtcaggggcatgg

SEQ ID NO: 8251504 - DNA, 22 bp, Homo sapiens
tctttggaatgctagcattcta

SEQ ID NO: 8251505 - DNA, 22 bp, Homo sapiens
tctttggaaaaaatggacaatc

SEQ ID NO: 8251506 - DNA, 22 bp, Homo sapiens
tctttggaaatgctttgagaat

SEQ ID NO: 8251507 - DNA, 22 bp, Homo sapiens
tctttgctgagtacatctccaa

SEQ ID NO: 8251508 - DNA, 22 bp, Homo sapiens
tctttgctgagtacatctccaa

SEQ ID NO: 8251509 - DNA, 22 bp, Homo sapiens
tctttgctattgtgagtagtgc

SEQ ID NO: 8251510 - DNA, 22 bp, Homo sapiens
tctttgcatcccttccatagtt

SEQ ID NO: 8251511 - DNA, 22 bp, Homo sapiens
tctttgattttgttactaagac

SEQ ID NO: 8251512 - DNA, 22 bp, Homo sapiens
tctttgcaaaatacaacaatgg

SEQ ID NO: 8251513 - DNA, 22 bp, Homo sapiens
tctttgcaaatgttattatctt

SEQ ID NO: 8251514 - DNA, 22 bp, Homo sapiens
tctttgcaggccaaattgttaa

SEQ ID NO: 8251515 - DNA, 22 bp, Homo sapiens
tctttgcagttctgattaaata

SEQ ID NO: 8251516 - DNA, 22 bp, Homo sapiens
tctttgcagtggtgaataaaga

SEQ ID NO: 8251517 - DNA, 22 bp, Homo sapiens
tctttgcagaatttaactttgc

SEQ ID NO: 8251518 - DNA, 22 bp, Homo sapiens
tctttgcactgtgcaagcagaa

SEQ ID NO: 8251519 - DNA, 22 bp, Homo sapiens
tctttggacatgttgaggttgc

SEQ ID NO: 8251520 - DNA, 18 bp, Homo sapiens
tctttggacaactactgg

SEQ ID NO: 8251521 - DNA, 23 bp, Homo sapiens
tctttggagtgctaggggttggg

SEQ ID NO: 8251522 - DNA, 22 bp, Homo sapiens
tctttggactttccaatttgtt

SEQ ID NO: 8251523 - DNA, 22 bp, Homo sapiens
tctttggaattctctgcagccc

SEQ ID NO: 8251524 - DNA, 22 bp, Homo sapiens
tctttggaatgctagcattcta

SEQ ID NO: 8251525 - DNA, 22 bp, Homo sapiens
tctttggaatttgctggaaata

SEQ ID NO: 8251526 - DNA, 18 bp, Homo sapiens
tctttggacaactactgg

SEQ ID NO: 8251527 - DNA, 22 bp, Homo sapiens
tctttggatatgtatggataga

SEQ ID NO: 8251528 - DNA, 22 bp, Homo sapiens
tctttggagtgttatcagtaat

SEQ ID NO: 8251529 - DNA, 22 bp, Homo sapiens
tctttggatatcgctagaccgt

SEQ ID NO: 8251530 - DNA, 22 bp, Homo sapiens
tctttggatgcgttacttttac

SEQ ID NO: 8251531 - DNA, 22 bp, Homo sapiens
tctttggatggaaaatgtattc

SEQ ID NO: 8251532 - DNA, 22 bp, Homo sapiens
tctttggatcccaactggctgg

SEQ ID NO: 8251533 - DNA, 22 bp, Homo sapiens
tctttggatcccaactggctgg

SEQ ID NO: 8251534 - DNA, 22 bp, Homo sapiens
tctttggatctcaaggtggcag

SEQ ID NO: 8251535 - DNA, 22 bp, Homo sapiens
tctttgtgccatgcagtgaggc

SEQ ID NO: 8251536 - DNA, 22 bp, Homo sapiens
tctttgtactttctggctgtcc

SEQ ID NO: 8251537 - DNA, 22 bp, Homo sapiens
tctttgtatgtatgtttcaaag

SEQ ID NO: 8251538 - DNA, 19 bp, Homo sapiens
tctttgtacaagtctctgc

SEQ ID NO: 8251539 - DNA, 22 bp, Homo sapiens
tctttggcacttctgttttaag

SEQ ID NO: 8251540 - DNA, 22 bp, Homo sapiens
tctttggattaaaatatttgta

SEQ ID NO: 8251541 - DNA, 22 bp, Homo sapiens
tctttggatggaaattggagtc

SEQ ID NO: 8251542 - DNA, 22 bp, Homo sapiens
tctttgtaactgtctattgaga

SEQ ID NO: 8251543 - DNA, 22 bp, Homo sapiens
tctttgtaaatgcctagcataa

SEQ ID NO: 8251544 - DNA, 22 bp, Homo sapiens
tgacacattaaatgctcacaaa

SEQ ID NO: 8251545 - DNA, 22 bp, Homo sapiens
tgacacagttgtcgactctaca

SEQ ID NO: 8251546 - DNA, 22 bp, Homo sapiens
tgacacataccgaaaatatttg

SEQ ID NO: 8251547 - DNA, 22 bp, Homo sapiens
tgacacatgcaccagtctttaa

SEQ ID NO: 8251548 - DNA, 22 bp, Homo sapiens
tgacacagtagaaagatgatga

SEQ ID NO: 8251549 - DNA, 22 bp, Homo sapiens
tgacacagggaaagcggatcca

SEQ ID NO: 8251550 - DNA, 22 bp, Homo sapiens
tgacacaggcagctcccagcac

SEQ ID NO: 8251551 - DNA, 23 bp, Homo sapiens
tgacacaggtcaaaaataagatg

SEQ ID NO: 8251552 - DNA, 22 bp, Homo sapiens
tgacacaggtcaaatctacttt

SEQ ID NO: 8251553 - DNA, 22 bp, Homo sapiens
tgacacaggggaaggagtctgg

SEQ ID NO: 8251554 - DNA, 22 bp, Homo sapiens
tgacacactaggaaaagcattt

SEQ ID NO: 8251555 - DNA, 22 bp, Homo sapiens
tgacacagaaattaagctgtca

SEQ ID NO: 8251556 - DNA, 22 bp, Homo sapiens
tgacacactaggaaaagcattt

SEQ ID NO: 8251557 - DNA, 22 bp, Homo sapiens
tgacacagaaattaagctgtca

SEQ ID NO: 8251558 - DNA, 22 bp, Homo sapiens
tgacacagattagagacatacc

SEQ ID NO: 8251559 - DNA, 22 bp, Homo sapiens
tgacacagattagagacatacc

SEQ ID NO: 8251560 - DNA, 22 bp, Homo sapiens
tgacactgccgaaactgtagag

SEQ ID NO: 8251561 - DNA, 22 bp, Homo sapiens
tgacactgcatatattgaagtt

SEQ ID NO: 8251562 - DNA, 22 bp, Homo sapiens
tgacactgcatatattgaagtt

SEQ ID NO: 8251563 - DNA, 22 bp, Homo sapiens
tgacactgcaaatataaatatt

SEQ ID NO: 8251564 - DNA, 22 bp, Homo sapiens
tgacactgacctaaagacctgg

SEQ ID NO: 8251565 - DNA, 22 bp, Homo sapiens
tgacacttccagttaaaaatat

SEQ ID NO: 8251566 - DNA, 22 bp, Homo sapiens
tgacacttccggtaaaaaatgc

SEQ ID NO: 8251567 - DNA, 22 bp, Homo sapiens
tgacacttggaagcttggcaac

SEQ ID NO: 8251568 - DNA, 20 bp, Homo sapiens
tgacacttgatattgtcagt

SEQ ID NO: 8251569 - DNA, 22 bp, Homo sapiens
tgacacttctgaaacggaagtt

SEQ ID NO: 8251570 - DNA, 22 bp, Homo sapiens
tgacagaaaaatgtagctccat

SEQ ID NO: 8251571 - DNA, 22 bp, Homo sapiens
tgacacttgggctttgagaggt

SEQ ID NO: 8251572 - DNA, 22 bp, Homo sapiens
tgacactttgtgactctgagaa

SEQ ID NO: 8251573 - DNA, 22 bp, Homo sapiens
tgacagaaagaatatgtcaatc

SEQ ID NO: 8251574 - DNA, 22 bp, Homo sapiens
tgacagaaagaatatgtcaatc

SEQ ID NO: 8251575 - DNA, 22 bp, Homo sapiens
tgacagaaagagtattaaagat

SEQ ID NO: 8251576 - DNA, 22 bp, Homo sapiens
tgacagaaagagtattaaagat

SEQ ID NO: 8251577 - DNA, 22 bp, Homo sapiens
tgacagaaatagttcttaattt

SEQ ID NO: 8251578 - DNA, 22 bp, Homo sapiens
tgacagattttttctgagctaa

SEQ ID NO: 8251579 - DNA, 22 bp, Homo sapiens
tgacagcagcatagtgagcaat

SEQ ID NO: 8251580 - DNA, 21 bp, Homo sapiens
tgacagcacatgcaatcggag

SEQ ID NO: 8251581 - DNA, 23 bp, Homo sapiens
tgacagaccttcccagacagtca

SEQ ID NO: 8251582 - DNA, 22 bp, Homo sapiens
tgacagaccactgcaactctgt

SEQ ID NO: 8251583 - DNA, 22 bp, Homo sapiens
tgacagatgaagctggggacca

SEQ ID NO: 8251584 - DNA, 18 bp, Homo sapiens
tgacagaacctggagcct

SEQ ID NO: 8251585 - DNA, 22 bp, Homo sapiens
tgacagaacaggttgggagcaa

SEQ ID NO: 8251586 - DNA, 22 bp, Homo sapiens
tgacagaatgtgactctcagat

SEQ ID NO: 8251587 - DNA, 22 bp, Homo sapiens
tgacagacagcttctcatttta

SEQ ID NO: 8251588 - DNA, 22 bp, Homo sapiens
tgacagacacaccttaggaaag

SEQ ID NO: 8251589 - DNA, 22 bp, Homo sapiens
tgacagacatggaagccagagt

SEQ ID NO: 8251590 - DNA, 17 bp, Homo sapiens
tgacagacatcatgagc

SEQ ID NO: 8251591 - DNA, 22 bp, Homo sapiens
tgacagacagcttctcatttta

SEQ ID NO: 8251592 - DNA, 22 bp, Homo sapiens
tgacagcatgaccacagggtct

SEQ ID NO: 8251593 - DNA, 22 bp, Homo sapiens
tgacagcataacactggtcttg

SEQ ID NO: 8251594 - DNA, 22 bp, Homo sapiens
tgacagcataacactggtcttg

SEQ ID NO: 8251595 - DNA, 22 bp, Homo sapiens
tgacagcagcatagtgagcaat

SEQ ID NO: 8251596 - DNA, 22 bp, Homo sapiens
tgacaggaggcttgaggccagg

SEQ ID NO: 8251597 - DNA, 22 bp, Homo sapiens
tgacagcccacctcacaggatt

SEQ ID NO: 8251598 - DNA, 22 bp, Homo sapiens
tgacaggagggttgtggcaggg

SEQ ID NO: 8251599 - DNA, 22 bp, Homo sapiens
tgacaggcactgctgtagtgct

SEQ ID NO: 8251600 - DNA, 22 bp, Homo sapiens
tgacaggcactgctgtagtgct

SEQ ID NO: 8251601 - DNA, 21 bp, Homo sapiens
tgacaggcaccctggctgtga

SEQ ID NO: 8251602 - DNA, 23 bp, Homo sapiens
tgacaggccagaagagcagctgg

SEQ ID NO: 8251603 - DNA, 23 bp, Homo sapiens
tgacaggccagaagagcagctgg

SEQ ID NO: 8251604 - DNA, 22 bp, Homo sapiens
tgacaggcgtttttctctagta

SEQ ID NO: 8251605 - DNA, 22 bp, Homo sapiens
tgacaggtgattgtgaactaag

SEQ ID NO: 8251606 - DNA, 22 bp, Homo sapiens
tgacaggtgctgggggcagtgt

SEQ ID NO: 8251607 - DNA, 21 bp, Homo sapiens
tgacaggtatttatctggaaa

SEQ ID NO: 8251608 - DNA, 22 bp, Homo sapiens
tgacaggttcgttagtcatgtt

SEQ ID NO: 8251609 - DNA, 22 bp, Homo sapiens
tgacaggttcgttagtcatgtt

SEQ ID NO: 8251610 - DNA, 21 bp, Homo sapiens
tgacaggtttaggattaaaat

SEQ ID NO: 8251611 - DNA, 22 bp, Homo sapiens
tgacaggttgtgtaggtggcca

SEQ ID NO: 8251612 - DNA, 19 bp, Homo sapiens
tgacaggttttatgtgttt

SEQ ID NO: 8251613 - DNA, 22 bp, Homo sapiens
tgacatgtaagatggaaaagcg

SEQ ID NO: 8251614 - DNA, 22 bp, Homo sapiens
tgacatgtatatcttacgctat

SEQ ID NO: 8251615 - DNA, 22 bp, Homo sapiens
tgacatgtatgtatttgtttat

SEQ ID NO: 8251616 - DNA, 21 bp, Homo sapiens
tgacaggtatttatctggaaa

SEQ ID NO: 8251617 - DNA, 22 bp, Homo sapiens
tgacagggtcagagctgagctg

SEQ ID NO: 8251618 - DNA, 22 bp, Homo sapiens
tgacaggtgaaatgtccttatt

SEQ ID NO: 8251619 - DNA, 22 bp, Homo sapiens
tgacaggtcatataagcttgca

SEQ ID NO: 8251620 - DNA, 22 bp, Homo sapiens
tgacaggtgattgtgaactaag

SEQ ID NO: 8251621 - DNA, 22 bp, Homo sapiens
tgacaggggctggtggataaat

SEQ ID NO: 8251622 - DNA, 22 bp, Homo sapiens
tgactggattgtcattacgacg

SEQ ID NO: 8251623 - DNA, 19 bp, Homo sapiens
tgactgcctcaggggtgga

SEQ ID NO: 8251624 - DNA, 22 bp, Homo sapiens
tgactgccccttccattcctgc

SEQ ID NO: 8251625 - DNA, 22 bp, Homo sapiens
tgactgcccccaccgcacaggc

SEQ ID NO: 8251626 - DNA, 21 bp, Homo sapiens
tgactgaggcttcttcacaca

SEQ ID NO: 8251627 - DNA, 22 bp, Homo sapiens
tgactgaaggactagattgatt

SEQ ID NO: 8251628 - DNA, 22 bp, Homo sapiens
tgactgagagagaactcagctt

SEQ ID NO: 8251629 - DNA, 22 bp, Homo sapiens
tgacttactctagagaatgctg

SEQ ID NO: 8251630 - DNA, 22 bp, Homo sapiens
tgacttcaaaggctctactcct

SEQ ID NO: 8251631 - DNA, 22 bp, Homo sapiens
tgacttcaaaggctctactcct

SEQ ID NO: 8251632 - DNA, 17 bp, Homo sapiens
tgacttaacagcaaggc

SEQ ID NO: 8251633 - DNA, 22 bp, Homo sapiens
tgacttctagcatttagcaacc

SEQ ID NO: 8251634 - DNA, 22 bp, Homo sapiens
tgacttctagcatttagcaacc

SEQ ID NO: 8251635 - DNA, 22 bp, Homo sapiens
tgacttcctgcactcaggtgat

SEQ ID NO: 8251636 - DNA, 22 bp, Homo sapiens
tgacttcctgcactcaggtgat

SEQ ID NO: 8251637 - DNA, 22 bp, Homo sapiens
tgacttcctgcactcaggtgat

SEQ ID NO: 8251638 - DNA, 22 bp, Homo sapiens
tgacttcctgcactcaggtgat

SEQ ID NO: 8251639 - DNA, 22 bp, Homo sapiens
tgacttgtctctttgggagaca

SEQ ID NO: 8251640 - DNA, 22 bp, Homo sapiens
tgactttaaaataacaagttta

SEQ ID NO: 8251641 - DNA, 22 bp, Homo sapiens
tgactttaaaataacaagttta

SEQ ID NO: 8251642 - DNA, 20 bp, Homo sapiens
tgacttctgggatttgtggt

SEQ ID NO: 8251643 - DNA, 22 bp, Homo sapiens
tgacttctctggcctggtgcag

SEQ ID NO: 8251644 - DNA, 22 bp, Homo sapiens
tgacttctgattgcttctattt

SEQ ID NO: 8251645 - DNA, 20 bp, Homo sapiens
tgacttcttcatgctgtact

SEQ ID NO: 8251646 - DNA, 20 bp, Homo sapiens
tgacttcttcatgctgtact

SEQ ID NO: 8251647 - DNA, 22 bp, Homo sapiens
tgacctgtcacattttgatgaa

SEQ ID NO: 8251648 - DNA, 22 bp, Homo sapiens
tgacctttctctgggtgcttgg

SEQ ID NO: 8251649 - DNA, 22 bp, Homo sapiens
tgacctttgtgctagaaacata

SEQ ID NO: 8251650 - DNA, 22 bp, Homo sapiens
tgacctattagatttccttgcc

SEQ ID NO: 8251651 - DNA, 22 bp, Homo sapiens
tgactaaaataggacattaact

SEQ ID NO: 8251652 - DNA, 22 bp, Homo sapiens
tgactaattatgttactaatca

SEQ ID NO: 8251653 - DNA, 22 bp, Homo sapiens
tgacgttttaggtgttaaatcg

SEQ ID NO: 8251654 - DNA, 22 bp, Homo sapiens
tgacgtcaactgcaaaggcctt

SEQ ID NO: 8251655 - DNA, 22 bp, Homo sapiens
tgactacctgtttagggaattg

SEQ ID NO: 8251656 - DNA, 22 bp, Homo sapiens
tgactacctgttacaggtgagg

SEQ ID NO: 8251657 - DNA, 22 bp, Homo sapiens
tgactacaacctccacctcccg

SEQ ID NO: 8251658 - DNA, 22 bp, Homo sapiens
tgactacaacctccacctcccg

SEQ ID NO: 8251659 - DNA, 20 bp, Homo sapiens
tgactctgcaaccgtctctc

SEQ ID NO: 8251660 - DNA, 22 bp, Homo sapiens
tgactctggagatccgaaataa

SEQ ID NO: 8251661 - DNA, 22 bp, Homo sapiens
tgactctgcccagccgcttgtc

SEQ ID NO: 8251662 - DNA, 22 bp, Homo sapiens
tgactctgaatttatgaaatgg

SEQ ID NO: 8251663 - DNA, 20 bp, Homo sapiens
tgactctgcaaccgtctctc

SEQ ID NO: 8251664 - DNA, 19 bp, Homo sapiens
tgactctgtggaacagaag

SEQ ID NO: 8251665 - DNA, 22 bp, Homo sapiens
tgactctgtacctgtctgcctt

SEQ ID NO: 8251666 - DNA, 20 bp, Homo sapiens
tgactctggtcccagtatga

SEQ ID NO: 8251667 - DNA, 22 bp, Homo sapiens
tgactcttaaatatactgttga

SEQ ID NO: 8251668 - DNA, 22 bp, Homo sapiens
tgactcttaaatatactgttga

SEQ ID NO: 8251669 - DNA, 22 bp, Homo sapiens
tgactattttttatagattcca

SEQ ID NO: 8251670 - DNA, 22 bp, Homo sapiens
tgactattttttatagattcca

SEQ ID NO: 8251671 - DNA, 22 bp, Homo sapiens
tgactattttttatagattcca

SEQ ID NO: 8251672 - DNA, 18 bp, Homo sapiens
tgactcaccctgtcagtg

SEQ ID NO: 8251673 - DNA, 22 bp, Homo sapiens
tgactattacggccacgaattt

SEQ ID NO: 8251674 - DNA, 22 bp, Homo sapiens
tgactattcacaattacaatag

SEQ ID NO: 8251675 - DNA, 22 bp, Homo sapiens
tgactattcacaattacaatag

SEQ ID NO: 8251676 - DNA, 22 bp, Homo sapiens
tgactcagtacatctggagttg

SEQ ID NO: 8251677 - DNA, 22 bp, Homo sapiens
tgactccacaatttgacttata

SEQ ID NO: 8251678 - DNA, 22 bp, Homo sapiens
tgactctcccaagtttgaggga

SEQ ID NO: 8251679 - DNA, 22 bp, Homo sapiens
tgactcgcaacccctatgagat

SEQ ID NO: 8251680 - DNA, 22 bp, Homo sapiens
tgacatttaatccctaaatatt

SEQ ID NO: 8251681 - DNA, 22 bp, Homo sapiens
tgacatttaatccctaaatatt

SEQ ID NO: 8251682 - DNA, 22 bp, Homo sapiens
tgacatttaatccctaaatatt

SEQ ID NO: 8251683 - DNA, 22 bp, Homo sapiens
tgacatttaatccctaaatatt

SEQ ID NO: 8251684 - DNA, 22 bp, Homo sapiens
tgacatttaatccctaaatatt

SEQ ID NO: 8251685 - DNA, 22 bp, Homo sapiens
tgacatttaattaacgaatgct

SEQ ID NO: 8251686 - DNA, 22 bp, Homo sapiens
tgacatttaattaacgaatgct

SEQ ID NO: 8251687 - DNA, 22 bp, Homo sapiens
tgacattctgttaagtctcata

SEQ ID NO: 8251688 - DNA, 22 bp, Homo sapiens
tgacatttaagcctctgatttc

SEQ ID NO: 8251689 - DNA, 22 bp, Homo sapiens
tgacatttaagcctctgatttc

SEQ ID NO: 8251690 - DNA, 22 bp, Homo sapiens
tgacatttaagcctctgatttc

SEQ ID NO: 8251691 - DNA, 22 bp, Homo sapiens
tgacatgtcctgagaagatggc

SEQ ID NO: 8251692 - DNA, 22 bp, Homo sapiens
tgacatgtccaggtggtcctgt

SEQ ID NO: 8251693 - DNA, 22 bp, Homo sapiens
tgacatgtatgttgttggcatg

SEQ ID NO: 8251694 - DNA, 22 bp, Homo sapiens
tgacatgtggctttgacccagg

SEQ ID NO: 8251695 - DNA, 22 bp, Homo sapiens
tgacatgtgctcatcttggcta

SEQ ID NO: 8251696 - DNA, 22 bp, Homo sapiens
tgacatgttagggaaatgtgat

SEQ ID NO: 8251697 - DNA, 22 bp, Homo sapiens
tgacatgtgtctccttccgtct

SEQ ID NO: 8251698 - DNA, 22 bp, Homo sapiens
tgacatgtgtaatcagctccgt

SEQ ID NO: 8251699 - DNA, 21 bp, Homo sapiens
tgacatttccaatataaagcc

SEQ ID NO: 8251700 - DNA, 21 bp, Homo sapiens
tgacatttccaatataaagcc

SEQ ID NO: 8251701 - DNA, 21 bp, Homo sapiens
tgacatttccaatataaagcc

SEQ ID NO: 8251702 - DNA, 22 bp, Homo sapiens
tgacatttcagatatggtattt

SEQ ID NO: 8251703 - DNA, 22 bp, Homo sapiens
tgacatttcagatatggtattt

SEQ ID NO: 8251704 - DNA, 22 bp, Homo sapiens
tgacatttatcttctacaatga

SEQ ID NO: 8251705 - DNA, 22 bp, Homo sapiens
tgacatttatcttctacaatga

SEQ ID NO: 8251706 - DNA, 22 bp, Homo sapiens
tgacatttatcttctacaatga

SEQ ID NO: 8251707 - DNA, 22 bp, Homo sapiens
tgacatttatcttctacaatga

SEQ ID NO: 8251708 - DNA, 22 bp, Homo sapiens
tgacatttatcttctacaatga

SEQ ID NO: 8251709 - DNA, 22 bp, Homo sapiens
tgacatttactattcctggtta

SEQ ID NO: 8251710 - DNA, 21 bp, Homo sapiens
tgacatttagtagcattgtca

SEQ ID NO: 8251711 - DNA, 21 bp, Homo sapiens
tgacatttagtagcattgtca

SEQ ID NO: 8251712 - DNA, 22 bp, Homo sapiens
tgacatttatcaaagaaatggt

SEQ ID NO: 8251713 - DNA, 22 bp, Homo sapiens
tgacatttatcaaagaaatggt

SEQ ID NO: 8251714 - DNA, 22 bp, Homo sapiens
tgacatttatcttctacaatga

SEQ ID NO: 8251715 - DNA, 22 bp, Homo sapiens
tgacccttgtttatcatttctg

SEQ ID NO: 8251716 - DNA, 18 bp, Homo sapiens
tgaccctttctccctgtg

SEQ ID NO: 8251717 - DNA, 22 bp, Homo sapiens
tgacctattagatttccttgcc

SEQ ID NO: 8251718 - DNA, 22 bp, Homo sapiens
tgacatttttaaaaccactagt

SEQ ID NO: 8251719 - DNA, 22 bp, Homo sapiens
tgacatttttaaaaccactagt

SEQ ID NO: 8251720 - DNA, 22 bp, Homo sapiens
tgacatttttataagagtcaaa

SEQ ID NO: 8251721 - DNA, 22 bp, Homo sapiens
tgacattttatcaatatcacag

SEQ ID NO: 8251722 - DNA, 22 bp, Homo sapiens
tgacattttatcaatatcacag

SEQ ID NO: 8251723 - DNA, 22 bp, Homo sapiens
tgacattttatcaatatcacag

SEQ ID NO: 8251724 - DNA, 21 bp, Homo sapiens
tgacatttggattcatagtaa

SEQ ID NO: 8251725 - DNA, 21 bp, Homo sapiens
tgacatttggattcatagtaa

SEQ ID NO: 8251726 - DNA, 22 bp, Homo sapiens
tgacatttcctagtgctttgtg

SEQ ID NO: 8251727 - DNA, 18 bp, Homo sapiens
tgacatttccagagtgta

SEQ ID NO: 8251728 - DNA, 22 bp, Homo sapiens
tgacatttcctagtgctttgtg

SEQ ID NO: 8251729 - DNA, 22 bp, Homo sapiens
tgacatttcggtgtatgtgatg

SEQ ID NO: 8251730 - DNA, 22 bp, Homo sapiens
tgacatttcggtgtatgtgatg

SEQ ID NO: 8251731 - DNA, 22 bp, Homo sapiens
tgacatttcggtgtatgtgatg

SEQ ID NO: 8251732 - DNA, 22 bp, Homo sapiens
tgacatttcggtgtatgtgatg

SEQ ID NO: 8251733 - DNA, 22 bp, Homo sapiens
tgacatttcttgttgatataaa

SEQ ID NO: 8251734 - DNA, 22 bp, Homo sapiens
tgacatttcttgttgatataaa

SEQ ID NO: 8251735 - DNA, 22 bp, Homo sapiens
tgacatttcttgttgatataaa

SEQ ID NO: 8251736 - DNA, 22 bp, Homo sapiens
tgacatttgagcatacatgtaa

SEQ ID NO: 8251737 - DNA, 22 bp, Homo sapiens
tgacatttgagcatacatgtaa

SEQ ID NO: 8251738 - DNA, 22 bp, Homo sapiens
tgacatttgagcatacatgtaa

SEQ ID NO: 8251739 - DNA, 22 bp, Homo sapiens
tgacatttgagcatacatgtaa

SEQ ID NO: 8251740 - DNA, 22 bp, Homo sapiens
tgacatttgagcatacatgtaa

SEQ ID NO: 8251741 - DNA, 22 bp, Homo sapiens
tgacatttgagagagatataca

SEQ ID NO: 8251742 - DNA, 22 bp, Homo sapiens
tgacatttgagagagatataca

SEQ ID NO: 8251743 - DNA, 22 bp, Homo sapiens
tgacatttgagagagatataca

SEQ ID NO: 8251744 - DNA, 22 bp, Homo sapiens
tgacatttcttgttgatataaa

SEQ ID NO: 8251745 - DNA, 22 bp, Homo sapiens
tgaatgaatcctaacaaagaca

SEQ ID NO: 8251746 - DNA, 22 bp, Homo sapiens
tgaatgagaacactgaaagagg

SEQ ID NO: 8251747 - DNA, 19 bp, Homo sapiens
tgaatgacgggcatgagca

SEQ ID NO: 8251748 - DNA, 22 bp, Homo sapiens
tgaatgagaacactgaaagagg

SEQ ID NO: 8251749 - DNA, 22 bp, Homo sapiens
tgaatgacctttgaggatggaa

SEQ ID NO: 8251750 - DNA, 22 bp, Homo sapiens
tgaatctatgttgccccataat

SEQ ID NO: 8251751 - DNA, 22 bp, Homo sapiens
tgaatgagtcaatcatttagct

SEQ ID NO: 8251752 - DNA, 22 bp, Homo sapiens
tgaatgaggatccttgacctta

SEQ ID NO: 8251753 - DNA, 22 bp, Homo sapiens
tgaatgaggatccttgacctta

SEQ ID NO: 8251754 - DNA, 21 bp, Homo sapiens
tgaatgaggaggatggcattt

SEQ ID NO: 8251755 - DNA, 21 bp, Homo sapiens
tgaatgagcatctggactttt

SEQ ID NO: 8251756 - DNA, 21 bp, Homo sapiens
tgaatgagcatctggactttt

SEQ ID NO: 8251757 - DNA, 22 bp, Homo sapiens
tgaatgagaacactgaaagagg

SEQ ID NO: 8251758 - DNA, 22 bp, Homo sapiens
tgaatgctttggagccttctaa

SEQ ID NO: 8251759 - DNA, 22 bp, Homo sapiens
tgaatgctttggagccttctaa

SEQ ID NO: 8251760 - DNA, 22 bp, Homo sapiens
tgaatggatataacaacagtgt

SEQ ID NO: 8251761 - DNA, 22 bp, Homo sapiens
tgaatgcttggagtcataaaat

SEQ ID NO: 8251762 - DNA, 21 bp, Homo sapiens
tgaatgcttcgtcatcctggc

SEQ ID NO: 8251763 - DNA, 22 bp, Homo sapiens
tgaatgcttggagtcataaaat

SEQ ID NO: 8251764 - DNA, 21 bp, Homo sapiens
tgaatgcttcgtcatcctggc

SEQ ID NO: 8251765 - DNA, 22 bp, Homo sapiens
tgaatgagtgagttcagacctc

SEQ ID NO: 8251766 - DNA, 22 bp, Homo sapiens
tgaatgtaggcacatgcaaatg

SEQ ID NO: 8251767 - DNA, 22 bp, Homo sapiens
tgaatggtgattggtgcttctc

SEQ ID NO: 8251768 - DNA, 22 bp, Homo sapiens
tgaatgtgatgctaaacatatg

SEQ ID NO: 8251769 - DNA, 22 bp, Homo sapiens
tgaatgtgatgctaaacatatg

SEQ ID NO: 8251770 - DNA, 22 bp, Homo sapiens
tgaatgtgatgctaaacatatg

SEQ ID NO: 8251771 - DNA, 22 bp, Homo sapiens
tgaatgtgatgctaaacatatg

SEQ ID NO: 8251772 - DNA, 18 bp, Homo sapiens
tgaattagtttgtggttt

SEQ ID NO: 8251773 - DNA, 22 bp, Homo sapiens
tgaattatcttgtaattttgaa

SEQ ID NO: 8251774 - DNA, 19 bp, Homo sapiens
tgaattagaattatcctct

SEQ ID NO: 8251775 - DNA, 23 bp, Homo sapiens
tgaatgtttattctcggtgcaga

SEQ ID NO: 8251776 - DNA, 22 bp, Homo sapiens
tgaatgtttgatgagaaataga

SEQ ID NO: 8251777 - DNA, 18 bp, Homo sapiens
tgaatgttttctggaccc

SEQ ID NO: 8251778 - DNA, 22 bp, Homo sapiens
tgaatcatggataaatagctta

SEQ ID NO: 8251779 - DNA, 22 bp, Homo sapiens
tgaatcatgccactgagctccc

SEQ ID NO: 8251780 - DNA, 22 bp, Homo sapiens
tgaatcagtataaattctcaaa

SEQ ID NO: 8251781 - DNA, 22 bp, Homo sapiens
tgaatcatgccactgagctccc

SEQ ID NO: 8251782 - DNA, 22 bp, Homo sapiens
tgaatatgctttgcaatcctaa

SEQ ID NO: 8251783 - DNA, 22 bp, Homo sapiens
tgaatatgattgcaaatttggc

SEQ ID NO: 8251784 - DNA, 22 bp, Homo sapiens
tgaatagttctactacttgaca

SEQ ID NO: 8251785 - DNA, 22 bp, Homo sapiens
tgaatatgttcctcacaagttc

SEQ ID NO: 8251786 - DNA, 22 bp, Homo sapiens
tgaatatggcaactcttgtaac

SEQ ID NO: 8251787 - DNA, 22 bp, Homo sapiens
tgaatatggcaactcttgtaac

SEQ ID NO: 8251788 - DNA, 22 bp, Homo sapiens
tgaatatggcacctctgtgtaa

SEQ ID NO: 8251789 - DNA, 22 bp, Homo sapiens
tgaatactatttcataatgtgg

SEQ ID NO: 8251790 - DNA, 20 bp, Homo sapiens
tgaatagagagcacatatgc

SEQ ID NO: 8251791 - DNA, 22 bp, Homo sapiens
tgaatagacatctggccataga

SEQ ID NO: 8251792 - DNA, 22 bp, Homo sapiens
tgaatagactggggctgtgaag

SEQ ID NO: 8251793 - DNA, 22 bp, Homo sapiens
tgaatagatggtgacagtatga

SEQ ID NO: 8251794 - DNA, 22 bp, Homo sapiens
tgaatagatggtgacagtatga

SEQ ID NO: 8251795 - DNA, 22 bp, Homo sapiens
tgaatagataaaaattcctgct

SEQ ID NO: 8251796 - DNA, 22 bp, Homo sapiens
tgaatagagcttggcactagaa

SEQ ID NO: 8251797 - DNA, 22 bp, Homo sapiens
tgaatagtccttggaataactg

SEQ ID NO: 8251798 - DNA, 22 bp, Homo sapiens
tgaatagtccttggaataactg

SEQ ID NO: 8251799 - DNA, 22 bp, Homo sapiens
tgaatagctgtgacagacatca

SEQ ID NO: 8251800 - DNA, 22 bp, Homo sapiens
tgaatagatttttaacatataa

SEQ ID NO: 8251801 - DNA, 22 bp, Homo sapiens
tgaatacactaaaaatcacttt

SEQ ID NO: 8251802 - DNA, 22 bp, Homo sapiens
tgaatacactaaaaatcacttt

SEQ ID NO: 8251803 - DNA, 22 bp, Homo sapiens
tgaataattcctttttgtcaag

SEQ ID NO: 8251804 - DNA, 22 bp, Homo sapiens
tgaatacaggaaaatatactga

SEQ ID NO: 8251805 - DNA, 22 bp, Homo sapiens
tgaatacaggaaaatatactga

SEQ ID NO: 8251806 - DNA, 19 bp, Homo sapiens
tgaatacagagatacagaa

SEQ ID NO: 8251807 - DNA, 19 bp, Homo sapiens
tgaatacagagatacagaa

SEQ ID NO: 8251808 - DNA, 19 bp, Homo sapiens
tgaatacagagatacagaa

SEQ ID NO: 8251809 - DNA, 22 bp, Homo sapiens
tgacaaatacaataagatctgt

SEQ ID NO: 8251810 - DNA, 22 bp, Homo sapiens
tgacaaatacaataagatctgt

SEQ ID NO: 8251811 - DNA, 22 bp, Homo sapiens
tgacacaaaggaaagcataatc

SEQ ID NO: 8251812 - DNA, 22 bp, Homo sapiens
tgacacaaaggaaagcataatc

SEQ ID NO: 8251813 - DNA, 20 bp, Homo sapiens
tgacacaaattgctttctca

SEQ ID NO: 8251814 - DNA, 22 bp, Homo sapiens
tgacacaaacaagatatttgcc

SEQ ID NO: 8251815 - DNA, 22 bp, Homo sapiens
tgacaatttatagaatgtgact

SEQ ID NO: 8251816 - DNA, 23 bp, Homo sapiens
tgaattttggcatattctgaaat

SEQ ID NO: 8251817 - DNA, 22 bp, Homo sapiens
tgacaaaactgcaattactttt

SEQ ID NO: 8251818 - DNA, 22 bp, Homo sapiens
tgacaaaactgcaattactttt

SEQ ID NO: 8251819 - DNA, 22 bp, Homo sapiens
tgacaaaactgcaattactttt

SEQ ID NO: 8251820 - DNA, 22 bp, Homo sapiens
tgacaaaccctgcaaatagctc

SEQ ID NO: 8251821 - DNA, 22 bp, Homo sapiens
tgacaaagaggaacagcagggg

SEQ ID NO: 8251822 - DNA, 22 bp, Homo sapiens
tgacaaagcatgatggtgacag

SEQ ID NO: 8251823 - DNA, 23 bp, Homo sapiens
tgacaaagcgagactccagctca

SEQ ID NO: 8251824 - DNA, 22 bp, Homo sapiens
tgaatttatcaaagattcttaa

SEQ ID NO: 8251825 - DNA, 21 bp, Homo sapiens
tgaatttccctctatcattct

SEQ ID NO: 8251826 - DNA, 22 bp, Homo sapiens
tgaatttaagcactgatgttaa

SEQ ID NO: 8251827 - DNA, 22 bp, Homo sapiens
tgaatttatattgctgagagtt

SEQ ID NO: 8251828 - DNA, 22 bp, Homo sapiens
tgaatttatattgctgagagtt

SEQ ID NO: 8251829 - DNA, 22 bp, Homo sapiens
tgaatttatcaaagattcttaa

SEQ ID NO: 8251830 - DNA, 23 bp, Homo sapiens
tgaattttggcatattctgaaat

SEQ ID NO: 8251831 - DNA, 22 bp, Homo sapiens
tgaattgtacagtatgtgaatt

SEQ ID NO: 8251832 - DNA, 22 bp, Homo sapiens
tgaattcttatctgggctgtgc

SEQ ID NO: 8251833 - DNA, 22 bp, Homo sapiens
tgaattgactggctcagaattg

SEQ ID NO: 8251834 - DNA, 22 bp, Homo sapiens
tgaattgctgccatcatatttc

SEQ ID NO: 8251835 - DNA, 22 bp, Homo sapiens
tgaattgctgccatcatatttc

SEQ ID NO: 8251836 - DNA, 22 bp, Homo sapiens
tgaattgaattgaattgaattg

SEQ ID NO: 8251837 - DNA, 22 bp, Homo sapiens
tgaattcatccatttatgcaag

SEQ ID NO: 8251838 - DNA, 20 bp, Homo sapiens
tgaattctagatgactggag

SEQ ID NO: 8251839 - DNA, 21 bp, Homo sapiens
tgaattcccatgtgagcagca

SEQ ID NO: 8251840 - DNA, 22 bp, Homo sapiens
tgaattctggctcttctgttta

SEQ ID NO: 8251841 - DNA, 22 bp, Homo sapiens
tgaattctggccctctcactta

SEQ ID NO: 8251842 - DNA, 22 bp, Homo sapiens
tgaattcttaatgaaatctact

SEQ ID NO: 8251843 - DNA, 22 bp, Homo sapiens
tgaattcttaatgaaatctact

SEQ ID NO: 8251844 - DNA, 22 bp, Homo sapiens
tgaattctggctcttctgttta

SEQ ID NO: 8251845 - DNA, 22 bp, Homo sapiens
tgaattctgggtcagcagcttg

SEQ ID NO: 8251846 - DNA, 22 bp, Homo sapiens
tgaaggagctgatgtaaggggt

SEQ ID NO: 8251847 - DNA, 22 bp, Homo sapiens
tgaaggagctgatgtaaggggt

SEQ ID NO: 8251848 - DNA, 22 bp, Homo sapiens
tgaaggaggaatgtggcctcca

SEQ ID NO: 8251849 - DNA, 22 bp, Homo sapiens
tgaaggagggaagaaggctctg

SEQ ID NO: 8251850 - DNA, 22 bp, Homo sapiens
tgaaggaggaatgtggcctcca

SEQ ID NO: 8251851 - DNA, 22 bp, Homo sapiens
tgaaggaggaatgtggcctcca

SEQ ID NO: 8251852 - DNA, 19 bp, Homo sapiens
tgaaggagggggatggcca

SEQ ID NO: 8251853 - DNA, 19 bp, Homo sapiens
tgaaggagggggatggcca

SEQ ID NO: 8251854 - DNA, 19 bp, Homo sapiens
tgaaggagggggatggcca

SEQ ID NO: 8251855 - DNA, 19 bp, Homo sapiens
tgaaggagggggatggcca

SEQ ID NO: 8251856 - DNA, 22 bp, Homo sapiens
tgaaggagggaagaaggctctg

SEQ ID NO: 8251857 - DNA, 22 bp, Homo sapiens
tgaaggcacttgcctaggggca

SEQ ID NO: 8251858 - DNA, 22 bp, Homo sapiens
tgaaggcacttgcctaggggca

SEQ ID NO: 8251859 - DNA, 22 bp, Homo sapiens
tgaaggcacgtgggtggatact

SEQ ID NO: 8251860 - DNA, 22 bp, Homo sapiens
tgaaggcaaaacatgttacacc

SEQ ID NO: 8251861 - DNA, 22 bp, Homo sapiens
tgaaggcaactgagaaaaagca

SEQ ID NO: 8251862 - DNA, 22 bp, Homo sapiens
tgaaggagctgatgtaaggggt

SEQ ID NO: 8251863 - DNA, 22 bp, Homo sapiens
tgaaggagctcaggagatagtc

SEQ ID NO: 8251864 - DNA, 22 bp, Homo sapiens
tgaaggagctcaggagatagtc

SEQ ID NO: 8251865 - DNA, 22 bp, Homo sapiens
tgaaggagctcaggagatagtc

SEQ ID NO: 8251866 - DNA, 22 bp, Homo sapiens
tgaaggagctcaggagatagtc

SEQ ID NO: 8251867 - DNA, 22 bp, Homo sapiens
tgaaggagctcaggagatagtc

SEQ ID NO: 8251868 - DNA, 22 bp, Homo sapiens
tgaaggagatttttagggaggc

SEQ ID NO: 8251869 - DNA, 22 bp, Homo sapiens
tgaaggagatttttagggaggc

SEQ ID NO: 8251870 - DNA, 22 bp, Homo sapiens
tgaaggagatttttagggaggc

SEQ ID NO: 8251871 - DNA, 22 bp, Homo sapiens
tgaagcttgtatttaaataagt

SEQ ID NO: 8251872 - DNA, 22 bp, Homo sapiens
tgaaggagatttttagggaggc

SEQ ID NO: 8251873 - DNA, 22 bp, Homo sapiens
tgaagctggcttgacatggcct

SEQ ID NO: 8251874 - DNA, 22 bp, Homo sapiens
tgaagctggaagttaggtagac

SEQ ID NO: 8251875 - DNA, 22 bp, Homo sapiens
tgaagctggttgtatgactgga

SEQ ID NO: 8251876 - DNA, 22 bp, Homo sapiens
tgaagctggttgtatgactgga

SEQ ID NO: 8251877 - DNA, 22 bp, Homo sapiens
tgaagctggcttgacatggcct

SEQ ID NO: 8251878 - DNA, 22 bp, Homo sapiens
tgaagctggcttgacatggcct

SEQ ID NO: 8251879 - DNA, 22 bp, Homo sapiens
tgaagctggaagttaggtagac

SEQ ID NO: 8251880 - DNA, 22 bp, Homo sapiens
tgaagctggaagttaggtagac

SEQ ID NO: 8251881 - DNA, 22 bp, Homo sapiens
tgaagctggaagcatgcagact

SEQ ID NO: 8251882 - DNA, 22 bp, Homo sapiens
tgaagctggaagcatgcagact

SEQ ID NO: 8251883 - DNA, 22 bp, Homo sapiens
tgaagctgtccttgataggggc

SEQ ID NO: 8251884 - DNA, 22 bp, Homo sapiens
tgaagctgtccttgataggggc

SEQ ID NO: 8251885 - DNA, 22 bp, Homo sapiens
tgaagctggttgtatgactgga

SEQ ID NO: 8251886 - DNA, 22 bp, Homo sapiens
tgaagctggttgtatgactgga

SEQ ID NO: 8251887 - DNA, 22 bp, Homo sapiens
tgaagctgtaggcatgggcagc

SEQ ID NO: 8251888 - DNA, 22 bp, Homo sapiens
tgaagctgtaggcatgggcagc

SEQ ID NO: 8251889 - DNA, 22 bp, Homo sapiens
tgaagctgtgggcagtggagcc

SEQ ID NO: 8251890 - DNA, 22 bp, Homo sapiens
tgaagctgtgggcagtggagcc

SEQ ID NO: 8251891 - DNA, 22 bp, Homo sapiens
tgaagccaatctgccaggcaga

SEQ ID NO: 8251892 - DNA, 22 bp, Homo sapiens
tgaagcagttctcagaagtggg

SEQ ID NO: 8251893 - DNA, 22 bp, Homo sapiens
tgaagccacagagcatctgcct

SEQ ID NO: 8251894 - DNA, 22 bp, Homo sapiens
tgaagccacagagcatctgcct

SEQ ID NO: 8251895 - DNA, 22 bp, Homo sapiens
tgaagccacagagcatctgcct

SEQ ID NO: 8251896 - DNA, 22 bp, Homo sapiens
tgaagccacactagcttgtcct

SEQ ID NO: 8251897 - DNA, 22 bp, Homo sapiens
tgaagccagtcaatgttaagtt

SEQ ID NO: 8251898 - DNA, 21 bp, Homo sapiens
tgaagccaggatcacgattct

SEQ ID NO: 8251899 - DNA, 22 bp, Homo sapiens
tgaagccataggacagaggata

SEQ ID NO: 8251900 - DNA, 22 bp, Homo sapiens
tgaagccagtcaatgttaagtt

SEQ ID NO: 8251901 - DNA, 22 bp, Homo sapiens
tgaagccactttccagaatcac

SEQ ID NO: 8251902 - DNA, 22 bp, Homo sapiens
tgaagccaccgaaccagaagag

SEQ ID NO: 8251903 - DNA, 22 bp, Homo sapiens
tgaagccagctttggaagacac

SEQ ID NO: 8251904 - DNA, 22 bp, Homo sapiens
tgaagccattactgtgttaggg

SEQ ID NO: 8251905 - DNA, 22 bp, Homo sapiens
tgaagccattactgtgttaggg

SEQ ID NO: 8251906 - DNA, 22 bp, Homo sapiens
tgaagccatccctcagatggcc

SEQ ID NO: 8251907 - DNA, 22 bp, Homo sapiens
tgaagccatccctcagatggcc

SEQ ID NO: 8251908 - DNA, 22 bp, Homo sapiens
tgaagccatccctcagatggcc

SEQ ID NO: 8251909 - DNA, 22 bp, Homo sapiens
tgaagccatcaggaagccagca

SEQ ID NO: 8251910 - DNA, 22 bp, Homo sapiens
tgaagccatcaggaagccagca

SEQ ID NO: 8251911 - DNA, 22 bp, Homo sapiens
tgaagctatataagttacagca

SEQ ID NO: 8251912 - DNA, 17 bp, Homo sapiens
tgaagcgtgcctttgaa

SEQ ID NO: 8251913 - DNA, 21 bp, Homo sapiens
tgaagcctgaggcatagcccc

SEQ ID NO: 8251914 - DNA, 19 bp, Homo sapiens
tgaagcgtcgctcctcttc

SEQ ID NO: 8251915 - DNA, 22 bp, Homo sapiens
tgaagcgtgacccctcacctct

SEQ ID NO: 8251916 - DNA, 22 bp, Homo sapiens
tgaagcctgaaagctggacagg

SEQ ID NO: 8251917 - DNA, 22 bp, Homo sapiens
tgaagccctgtgtcagcttcca

SEQ ID NO: 8251918 - DNA, 22 bp, Homo sapiens
tgaaggtgggaattcaccaggt

SEQ ID NO: 8251919 - DNA, 22 bp, Homo sapiens
tgaaggtggcataggagagatg

SEQ ID NO: 8251920 - DNA, 22 bp, Homo sapiens
tgaaggtgagcatttgctgatt

SEQ ID NO: 8251921 - DNA, 22 bp, Homo sapiens
tgaaggtggcataggagagatg

SEQ ID NO: 8251922 - DNA, 22 bp, Homo sapiens
tgaaggtggcataggagagatg

SEQ ID NO: 8251923 - DNA, 22 bp, Homo sapiens
tgaaggtggaagggtggttctg

SEQ ID NO: 8251924 - DNA, 22 bp, Homo sapiens
tgaaggtgagcatttgctgatt

SEQ ID NO: 8251925 - DNA, 22 bp, Homo sapiens
tgaaggtgacctgacagtggct

SEQ ID NO: 8251926 - DNA, 22 bp, Homo sapiens
tgaaggtgaatgtctatgggga

SEQ ID NO: 8251927 - DNA, 23 bp, Homo sapiens
tgaaggtattacctgagatgctc

SEQ ID NO: 8251928 - DNA, 22 bp, Homo sapiens
tgaagtttaaggttagataagt

SEQ ID NO: 8251929 - DNA, 22 bp, Homo sapiens
tgaagtttaattttggacatga

SEQ ID NO: 8251930 - DNA, 22 bp, Homo sapiens
tgaagtttataacatagcctcc

SEQ ID NO: 8251931 - DNA, 22 bp, Homo sapiens
tgaagtttaattttggacatga

SEQ ID NO: 8251932 - DNA, 22 bp, Homo sapiens
tgaagtttgaactgtgttgctg

SEQ ID NO: 8251933 - DNA, 22 bp, Homo sapiens
tgaagtttcttgaatcttggag

SEQ ID NO: 8251934 - DNA, 22 bp, Homo sapiens
tgaagtttggtggaaatttcct

SEQ ID NO: 8251935 - DNA, 22 bp, Homo sapiens
tgaagtttcctctgaggccagt

SEQ ID NO: 8251936 - DNA, 22 bp, Homo sapiens
tgaagtttcacgcgtcattcaa

SEQ ID NO: 8251937 - DNA, 22 bp, Homo sapiens
tgaataatcttgggtattaata

SEQ ID NO: 8251938 - DNA, 22 bp, Homo sapiens
tgaataatccacagtcattcat

SEQ ID NO: 8251939 - DNA, 22 bp, Homo sapiens
tgaataagtgatgtcatatata

SEQ ID NO: 8251940 - DNA, 22 bp, Homo sapiens
tgaataaattgagagcgaatgt

SEQ ID NO: 8251941 - DNA, 22 bp, Homo sapiens
tgaataagaattattataatga

SEQ ID NO: 8251942 - DNA, 22 bp, Homo sapiens
tgaataaatcaaagactgccct

SEQ ID NO: 8251943 - DNA, 22 bp, Homo sapiens
tgaagtttttccagacaagtcc

SEQ ID NO: 8251944 - DNA, 22 bp, Homo sapiens
tgaataaactatgaggaggaat

SEQ ID NO: 8251945 - DNA, 22 bp, Homo sapiens
tgaataaactatgaggaggaat

SEQ ID NO: 8251946 - DNA, 22 bp, Homo sapiens
tgaagttttctggttgattaag

SEQ ID NO: 8251947 - DNA, 22 bp, Homo sapiens
tgaagttttactaggtgaattt

SEQ ID NO: 8251948 - DNA, 22 bp, Homo sapiens
tgaagttttacatcctctccaa

SEQ ID NO: 8251949 - DNA, 22 bp, Homo sapiens
tgaaggcattgatgaaggaatc

SEQ ID NO: 8251950 - DNA, 22 bp, Homo sapiens
tgaaggcataaatcttgggaac

SEQ ID NO: 8251951 - DNA, 22 bp, Homo sapiens
tgaaggcagcatgcacactagt

SEQ ID NO: 8251952 - DNA, 20 bp, Homo sapiens
tgaaggcaggtaagaaagat

SEQ ID NO: 8251953 - DNA, 22 bp, Homo sapiens
tgaagggcaaccccaggcccag

SEQ ID NO: 8251954 - DNA, 22 bp, Homo sapiens
tgaaggctgggctcagccagct

SEQ ID NO: 8251955 - DNA, 22 bp, Homo sapiens
tgaaggcttgactgaggcagga

SEQ ID NO: 8251956 - DNA, 22 bp, Homo sapiens
tgaagggcaaccccaggcccag

SEQ ID NO: 8251957 - DNA, 22 bp, Homo sapiens
tgaagggtggcatggcaggcag

SEQ ID NO: 8251958 - DNA, 22 bp, Homo sapiens
tgagaggaacaggcagtaggtt

SEQ ID NO: 8251959 - DNA, 22 bp, Homo sapiens
tgagaggaacaggcagtaggtt

SEQ ID NO: 8251960 - DNA, 22 bp, Homo sapiens
tgagaggatattttgggaggat

SEQ ID NO: 8251961 - DNA, 22 bp, Homo sapiens
tgagaggatattttgggaggat

SEQ ID NO: 8251962 - DNA, 22 bp, Homo sapiens
tgagaggagtgattgtaaaatt

SEQ ID NO: 8251963 - DNA, 22 bp, Homo sapiens
tgagaggatattttgggaggat

SEQ ID NO: 8251964 - DNA, 22 bp, Homo sapiens
tgagaggatattttgggaggat

SEQ ID NO: 8251965 - DNA, 22 bp, Homo sapiens
tgagaggaacaggcagtaggtt

SEQ ID NO: 8251966 - DNA, 22 bp, Homo sapiens
tgagaggaacaggcagtaggtt

SEQ ID NO: 8251967 - DNA, 20 bp, Homo sapiens
tgagaggacatttttcatgt

SEQ ID NO: 8251968 - DNA, 22 bp, Homo sapiens
tgagaggagtgattgtaaaatt

SEQ ID NO: 8251969 - DNA, 22 bp, Homo sapiens
tgagagggcccagagcacacca

SEQ ID NO: 8251970 - DNA, 22 bp, Homo sapiens
tgagagggcccagagcacacca

SEQ ID NO: 8251971 - DNA, 19 bp, Homo sapiens
tgagaggcttaaggcagct

SEQ ID NO: 8251972 - DNA, 22 bp, Homo sapiens
tgagagggcccagagcacacca

SEQ ID NO: 8251973 - DNA, 22 bp, Homo sapiens
tgagaggtaggaaatgaacaag

SEQ ID NO: 8251974 - DNA, 22 bp, Homo sapiens
tgagagggttcccaggggtttc

SEQ ID NO: 8251975 - DNA, 18 bp, Homo sapiens
tgagaggcaggtagagga

SEQ ID NO: 8251976 - DNA, 22 bp, Homo sapiens
tgagaggcgctcactctcaggt

SEQ ID NO: 8251977 - DNA, 22 bp, Homo sapiens
tgagaggctagatcagctctgt

SEQ ID NO: 8251978 - DNA, 22 bp, Homo sapiens
tgagaggctagatcagctctgt

SEQ ID NO: 8251979 - DNA, 18 bp, Homo sapiens
tgagaggctattttttgc

SEQ ID NO: 8251980 - DNA, 18 bp, Homo sapiens
tgagaggctattttttgc

SEQ ID NO: 8251981 - DNA, 22 bp, Homo sapiens
tgagagaggatgccctcatatt

SEQ ID NO: 8251982 - DNA, 22 bp, Homo sapiens
tgagagaggggactgcctgctt

SEQ ID NO: 8251983 - DNA, 22 bp, Homo sapiens
tgagagagggatgcaccctcct

SEQ ID NO: 8251984 - DNA, 22 bp, Homo sapiens
tgagagagtaattgagtggtaa

SEQ ID NO: 8251985 - DNA, 22 bp, Homo sapiens
tgagagagtaattgagtggtaa

SEQ ID NO: 8251986 - DNA, 22 bp, Homo sapiens
tgagagagtaattgagtggtaa

SEQ ID NO: 8251987 - DNA, 22 bp, Homo sapiens
tgagagagtaattgagtggtaa

SEQ ID NO: 8251988 - DNA, 22 bp, Homo sapiens
tgagagacacactgtgcatgta

SEQ ID NO: 8251989 - DNA, 22 bp, Homo sapiens
tgagacttgtgagtccttctag

SEQ ID NO: 8251990 - DNA, 22 bp, Homo sapiens
tgagacttgtgagtccttctag

SEQ ID NO: 8251991 - DNA, 22 bp, Homo sapiens
tgagagagcgcctgggatcatt

SEQ ID NO: 8251992 - DNA, 21 bp, Homo sapiens
tgagagactggtggatacagg

SEQ ID NO: 8251993 - DNA, 22 bp, Homo sapiens
tgagagagcctgaatctcttac

SEQ ID NO: 8251994 - DNA, 21 bp, Homo sapiens
tgagagagtagcaggacatat

SEQ ID NO: 8251995 - DNA, 21 bp, Homo sapiens
tgagagagtagcaggacatat

SEQ ID NO: 8251996 - DNA, 21 bp, Homo sapiens
tgagagagtagcaggacatat

SEQ ID NO: 8251997 - DNA, 21 bp, Homo sapiens
tgagagagtagcaggacatat

SEQ ID NO: 8251998 - DNA, 21 bp, Homo sapiens
tgagagagtagcaggacatat

SEQ ID NO: 8251999 - DNA, 21 bp, Homo sapiens
tgagagagtagcaggacatat

SEQ ID NO: 8252000 - DNA, 22 bp, Homo sapiens
tgagagcacacagaaatatttt

SEQ ID NO: 8252001 - DNA, 22 bp, Homo sapiens
tgagagcaacacgcagtagtat

SEQ ID NO: 8252002 - DNA, 22 bp, Homo sapiens
tgagagcaacacgcagtagtat

SEQ ID NO: 8252003 - DNA, 22 bp, Homo sapiens
tgagagcaacacgcagtagtat

SEQ ID NO: 8252004 - DNA, 22 bp, Homo sapiens
tgagagatgaagttagttgttc

SEQ ID NO: 8252005 - DNA, 22 bp, Homo sapiens
tgagagattgctgtatgttttg

SEQ ID NO: 8252006 - DNA, 22 bp, Homo sapiens
tgagagatgaagttagttgttc

SEQ ID NO: 8252007 - DNA, 22 bp, Homo sapiens
tgagagatgaagttagttgttc

SEQ ID NO: 8252008 - DNA, 23 bp, Homo sapiens
tgagagcctggcagcctgggttc

SEQ ID NO: 8252009 - DNA, 23 bp, Homo sapiens
tgagagcctggcagcctgggttc

SEQ ID NO: 8252010 - DNA, 18 bp, Homo sapiens
tgagagcctgcttgtccc

SEQ ID NO: 8252011 - DNA, 18 bp, Homo sapiens
tgagagcctgcttgtccc

SEQ ID NO: 8252012 - DNA, 21 bp, Homo sapiens
tgagagcctccaaccggctac

SEQ ID NO: 8252013 - DNA, 22 bp, Homo sapiens
tgagagccaggatctgctctat

SEQ ID NO: 8252014 - DNA, 22 bp, Homo sapiens
tgagagccaggatctgctctat

SEQ ID NO: 8252015 - DNA, 22 bp, Homo sapiens
tgagagcagaggtgggcagcct

SEQ ID NO: 8252016 - DNA, 17 bp, Homo sapiens
tgagagcagggctgggc

SEQ ID NO: 8252017 - DNA, 17 bp, Homo sapiens
tgagagcagggctgggc

SEQ ID NO: 8252018 - DNA, 17 bp, Homo sapiens
tgagagcagggctgggc

SEQ ID NO: 8252019 - DNA, 17 bp, Homo sapiens
tgagagcagggctgggc

SEQ ID NO: 8252020 - DNA, 20 bp, Homo sapiens
tgagatttgtattataagtc

SEQ ID NO: 8252021 - DNA, 22 bp, Homo sapiens
tgagattttaatattgagaaaa

SEQ ID NO: 8252022 - DNA, 22 bp, Homo sapiens
tgagattttcctaaatataatg

SEQ ID NO: 8252023 - DNA, 22 bp, Homo sapiens
tgagattttcagcatcacttca

SEQ ID NO: 8252024 - DNA, 21 bp, Homo sapiens
tgagcaaaatttagagtgatg

SEQ ID NO: 8252025 - DNA, 22 bp, Homo sapiens
tgagatttcgccgacagtattt

SEQ ID NO: 8252026 - DNA, 22 bp, Homo sapiens
tgagattcagttgattagtgat

SEQ ID NO: 8252027 - DNA, 22 bp, Homo sapiens
tgagatgtaaggtatgcttact

SEQ ID NO: 8252028 - DNA, 22 bp, Homo sapiens
tgagatgtcatagttcagttca

SEQ ID NO: 8252029 - DNA, 22 bp, Homo sapiens
tgagatttgagggttaatctga

SEQ ID NO: 8252030 - DNA, 22 bp, Homo sapiens
tgagatttgggttgtttaacat

SEQ ID NO: 8252031 - DNA, 22 bp, Homo sapiens
tgagatttgggttgtttaacat

SEQ ID NO: 8252032 - DNA, 22 bp, Homo sapiens
tgagatttggaaaatttgatat

SEQ ID NO: 8252033 - DNA, 22 bp, Homo sapiens
tgagatttggaaaatttgatat

SEQ ID NO: 8252034 - DNA, 22 bp, Homo sapiens
tgagatgtaaggtatgcttact

SEQ ID NO: 8252035 - DNA, 22 bp, Homo sapiens
tgagatgtaaggtatgcttact

SEQ ID NO: 8252036 - DNA, 22 bp, Homo sapiens
tgagatggttgaccagagagca

SEQ ID NO: 8252037 - DNA, 22 bp, Homo sapiens
tgagatgggtgtccagggagga

SEQ ID NO: 8252038 - DNA, 22 bp, Homo sapiens
tgagatggattgggttggttcc

SEQ ID NO: 8252039 - DNA, 22 bp, Homo sapiens
tgagatggagttttggggatat

SEQ ID NO: 8252040 - DNA, 22 bp, Homo sapiens
tgagatggggagggctgcagaa

SEQ ID NO: 8252041 - DNA, 22 bp, Homo sapiens
tgagatgggatgtgcacttggc

SEQ ID NO: 8252042 - DNA, 22 bp, Homo sapiens
tgagatggggagggctgcagaa

SEQ ID NO: 8252043 - DNA, 22 bp, Homo sapiens
tgagatggggagggctgcagaa

SEQ ID NO: 8252044 - DNA, 22 bp, Homo sapiens
tgagatggggtcatgctttgtc

SEQ ID NO: 8252045 - DNA, 22 bp, Homo sapiens
tgagatgggtggggagctcagg

SEQ ID NO: 8252046 - DNA, 22 bp, Homo sapiens
tgagatgggtcatcaggtttgg

SEQ ID NO: 8252047 - DNA, 22 bp, Homo sapiens
tgagaggtcaaagggcatggag

SEQ ID NO: 8252048 - DNA, 22 bp, Homo sapiens
tgagatcatgtgtggaccccag

SEQ ID NO: 8252049 - DNA, 22 bp, Homo sapiens
tgagatcaaaattggtattaga

SEQ ID NO: 8252050 - DNA, 22 bp, Homo sapiens
tgagatcacttacgtggctgca

SEQ ID NO: 8252051 - DNA, 22 bp, Homo sapiens
tgagatcattgacttgttcctg

SEQ ID NO: 8252052 - DNA, 22 bp, Homo sapiens
tgagatatctgttaattttctt

SEQ ID NO: 8252053 - DNA, 22 bp, Homo sapiens
tgagatatctgttaattttctt

SEQ ID NO: 8252054 - DNA, 23 bp, Homo sapiens
tgagataggtattattatcatgc

SEQ ID NO: 8252055 - DNA, 22 bp, Homo sapiens
tgagatcttcgctcttcacaga

SEQ ID NO: 8252056 - DNA, 22 bp, Homo sapiens
tgagatcttcgctcttcacaga

SEQ ID NO: 8252057 - DNA, 22 bp, Homo sapiens
tgagatctgctaattgactgac

SEQ ID NO: 8252058 - DNA, 22 bp, Homo sapiens
tgagatctgtgcatgttagtta

SEQ ID NO: 8252059 - DNA, 22 bp, Homo sapiens
tgagatctgtgcatgttagtta

SEQ ID NO: 8252060 - DNA, 23 bp, Homo sapiens
tgagatctttgtagtatcaatga

SEQ ID NO: 8252061 - DNA, 23 bp, Homo sapiens
tgagatctttgtagtatcaatga

SEQ ID NO: 8252062 - DNA, 22 bp, Homo sapiens
tgagatcatttatttacctttc

SEQ ID NO: 8252063 - DNA, 23 bp, Homo sapiens
tgagatctacagatctcagatct

SEQ ID NO: 8252064 - DNA, 22 bp, Homo sapiens
tgagatctctgcctatatggat

SEQ ID NO: 8252065 - DNA, 23 bp, Homo sapiens
tgagatctacagatctcagatct

SEQ ID NO: 8252066 - DNA, 22 bp, Homo sapiens
tgagatccccaggaaggacaac

SEQ ID NO: 8252067 - DNA, 22 bp, Homo sapiens
tgagatgatgggataagagggc

SEQ ID NO: 8252068 - DNA, 22 bp, Homo sapiens
tgagatgaataactcctgctaa

SEQ ID NO: 8252069 - DNA, 22 bp, Homo sapiens
tgagatgaataactcctgctaa

SEQ ID NO: 8252070 - DNA, 22 bp, Homo sapiens
tgagatgatgggataagagggc

SEQ ID NO: 8252071 - DNA, 22 bp, Homo sapiens
tgagatgctaaagggctgctca

SEQ ID NO: 8252072 - DNA, 22 bp, Homo sapiens
tgagatggaaggtgaggcagta

SEQ ID NO: 8252073 - DNA, 22 bp, Homo sapiens
tgagatggaaggtgaggcagta

SEQ ID NO: 8252074 - DNA, 22 bp, Homo sapiens
tgagatggaaggtgaggcagta

SEQ ID NO: 8252075 - DNA, 22 bp, Homo sapiens
tgagatggagtcttgctctgtt

SEQ ID NO: 8252076 - DNA, 22 bp, Homo sapiens
tgagatggagttctgctcttgt

SEQ ID NO: 8252077 - DNA, 22 bp, Homo sapiens
tgagatggagttctgctcttgt

SEQ ID NO: 8252078 - DNA, 22 bp, Homo sapiens
tgagatggagtctcactctgtt

SEQ ID NO: 8252079 - DNA, 22 bp, Homo sapiens
tgagatggagtctcgctctgtt

SEQ ID NO: 8252080 - DNA, 22 bp, Homo sapiens
tgagatggagtctcgctctgtt

SEQ ID NO: 8252081 - DNA, 22 bp, Homo sapiens
tgagatggagtcttgctctgtt

SEQ ID NO: 8252082 - DNA, 22 bp, Homo sapiens
tgagatggagtcttgctctgtt

SEQ ID NO: 8252083 - DNA, 17 bp, Homo sapiens
tgagacagggcaggccc

SEQ ID NO: 8252084 - DNA, 17 bp, Homo sapiens
tgagacagggcaggccc

SEQ ID NO: 8252085 - DNA, 17 bp, Homo sapiens
tgagacagggcaggccc

SEQ ID NO: 8252086 - DNA, 17 bp, Homo sapiens
tgagacagggcaggccc

SEQ ID NO: 8252087 - DNA, 22 bp, Homo sapiens
tgagacagggtcttgctctgtt

SEQ ID NO: 8252088 - DNA, 22 bp, Homo sapiens
tgagacagtatcgccccaaggc

SEQ ID NO: 8252089 - DNA, 22 bp, Homo sapiens
tgagacagtcaccaggcaggcc

SEQ ID NO: 8252090 - DNA, 22 bp, Homo sapiens
tgagacagtcaccaggcaggcc

SEQ ID NO: 8252091 - DNA, 22 bp, Homo sapiens
tgagacaggcttccttcttggg

SEQ ID NO: 8252092 - DNA, 19 bp, Homo sapiens
tgagacagggattcaggtg

SEQ ID NO: 8252093 - DNA, 19 bp, Homo sapiens
tgagacagggattcaggtg

SEQ ID NO: 8252094 - DNA, 22 bp, Homo sapiens
tgagacaggagaggcccctcct

SEQ ID NO: 8252095 - DNA, 22 bp, Homo sapiens
tgagacagcagtcagggaaata

SEQ ID NO: 8252096 - DNA, 22 bp, Homo sapiens
tgagacagcagtcagggaaata

SEQ ID NO: 8252097 - DNA, 22 bp, Homo sapiens
tgagacagcccttctgcacagg

SEQ ID NO: 8252098 - DNA, 22 bp, Homo sapiens
tgagacagcccttctgcacagg

SEQ ID NO: 8252099 - DNA, 22 bp, Homo sapiens
tgagacagcctctgcactcatg

SEQ ID NO: 8252100 - DNA, 22 bp, Homo sapiens
tgagacagcagattagcaatga

SEQ ID NO: 8252101 - DNA, 19 bp, Homo sapiens
tgagacagaagatgagcct

SEQ ID NO: 8252102 - DNA, 19 bp, Homo sapiens
tgagacagaagatgagcct

SEQ ID NO: 8252103 - DNA, 19 bp, Homo sapiens
tgagacagaagatgagcct

SEQ ID NO: 8252104 - DNA, 22 bp, Homo sapiens
tgagacaaggaaaggaagctga

SEQ ID NO: 8252105 - DNA, 22 bp, Homo sapiens
tgagacaaagcagctgacagaa

SEQ ID NO: 8252106 - DNA, 22 bp, Homo sapiens
tgagacaacagcttgtgctgct

SEQ ID NO: 8252107 - DNA, 22 bp, Homo sapiens
tgagacaaagcagctgacagaa

SEQ ID NO: 8252108 - DNA, 22 bp, Homo sapiens
tgagacaataaggctgagaagc

SEQ ID NO: 8252109 - DNA, 22 bp, Homo sapiens
tgagacaataaggctgagaagc

SEQ ID NO: 8252110 - DNA, 22 bp, Homo sapiens
tgagacaataaggctgagaagc

SEQ ID NO: 8252111 - DNA, 22 bp, Homo sapiens
tgagacaatatcctttgtaacc

SEQ ID NO: 8252112 - DNA, 22 bp, Homo sapiens
tgagacaatatcctttgtaacc

SEQ ID NO: 8252113 - DNA, 22 bp, Homo sapiens
tgagacaatattaacctatctt

SEQ ID NO: 8252114 - DNA, 22 bp, Homo sapiens
tgagaagctgctgacttagcct

SEQ ID NO: 8252115 - DNA, 20 bp, Homo sapiens
tgagaagctcctgtctcctc

SEQ ID NO: 8252116 - DNA, 22 bp, Homo sapiens
tgagaagctgcttgtgctgtat

SEQ ID NO: 8252117 - DNA, 22 bp, Homo sapiens
tgagaatttgcatttctaacaa

SEQ ID NO: 8252118 - DNA, 22 bp, Homo sapiens
tgagaattttcagtttcacttt

SEQ ID NO: 8252119 - DNA, 22 bp, Homo sapiens
tgagaattttcagtttcacttt

SEQ ID NO: 8252120 - DNA, 22 bp, Homo sapiens
tgagaatttgtgaacttttctc

SEQ ID NO: 8252121 - DNA, 22 bp, Homo sapiens
tgagacaaaattgacagacaaa

SEQ ID NO: 8252122 - DNA, 22 bp, Homo sapiens
tgagacaaaattgacagacaaa

SEQ ID NO: 8252123 - DNA, 22 bp, Homo sapiens
tgagacaaaattgacagacaaa

SEQ ID NO: 8252124 - DNA, 22 bp, Homo sapiens
tgagacaaaattgacagacaaa

SEQ ID NO: 8252125 - DNA, 22 bp, Homo sapiens
tgagaaaggtatttcatgcact

SEQ ID NO: 8252126 - DNA, 22 bp, Homo sapiens
tgagaaagacagacattcctaa

SEQ ID NO: 8252127 - DNA, 22 bp, Homo sapiens
tgagaaacacaggcatgaatag

SEQ ID NO: 8252128 - DNA, 22 bp, Homo sapiens
tgagaaaatccagaggctagtt

SEQ ID NO: 8252129 - DNA, 22 bp, Homo sapiens
tgagaaaattactataattgtc

SEQ ID NO: 8252130 - DNA, 22 bp, Homo sapiens
tgagaaaggtatttcatgcact

SEQ ID NO: 8252131 - DNA, 22 bp, Homo sapiens
tgagaaaggtatttcatgcact

SEQ ID NO: 8252132 - DNA, 20 bp, Homo sapiens
tgagaaagtagagactcagg

SEQ ID NO: 8252133 - DNA, 20 bp, Homo sapiens
tgagaaagtagagactcagg

SEQ ID NO: 8252134 - DNA, 22 bp, Homo sapiens
tgagaaatccagatgtgcagtt

SEQ ID NO: 8252135 - DNA, 22 bp, Homo sapiens
tgagaaattcgacatatattta

SEQ ID NO: 8252136 - DNA, 22 bp, Homo sapiens
tgagaacatttgcagggagagt

SEQ ID NO: 8252137 - DNA, 22 bp, Homo sapiens
tgagaacacattcgtgccctac

SEQ ID NO: 8252138 - DNA, 22 bp, Homo sapiens
tgagaacaaagttgaaagtttg

SEQ ID NO: 8252139 - DNA, 22 bp, Homo sapiens
tgagaacggatactaagggctg

SEQ ID NO: 8252140 - DNA, 22 bp, Homo sapiens
tgagaactggtttctattcatg

SEQ ID NO: 8252141 - DNA, 22 bp, Homo sapiens
tgagaacttgtgctattgcaca

SEQ ID NO: 8252142 - DNA, 22 bp, Homo sapiens
tgagaactgaggatttgaattc

SEQ ID NO: 8252143 - DNA, 23 bp, Homo sapiens
tgagaagccattagagcaggtgg

SEQ ID NO: 8252144 - DNA, 23 bp, Homo sapiens
tgagaagccaggggagcgtgagg

SEQ ID NO: 8252145 - DNA, 22 bp, Homo sapiens
tgagaagcattaggaagaacat

SEQ ID NO: 8252146 - DNA, 22 bp, Homo sapiens
tgagaagcccaagccgggtggt

SEQ ID NO: 8252147 - DNA, 22 bp, Homo sapiens
tgagaagagcaaggaactggtt

SEQ ID NO: 8252148 - DNA, 22 bp, Homo sapiens
tgagaagattgggcagagtgga

SEQ ID NO: 8252149 - DNA, 22 bp, Homo sapiens
tgagaagattgggcagagtgga

SEQ ID NO: 8252150 - DNA, 22 bp, Homo sapiens
tgagaagcagtttcagtaagaa

SEQ ID NO: 8252151 - DNA, 22 bp, Homo sapiens
tgagaagcagcttacaggtgtc

SEQ ID NO: 8252152 - DNA, 22 bp, Homo sapiens
tgagaagcagcttacaggtgtc

SEQ ID NO: 8252153 - DNA, 22 bp, Homo sapiens
tgagccaggttttccatcattc

SEQ ID NO: 8252154 - DNA, 20 bp, Homo sapiens
tgagccagtcaagctacatt

SEQ ID NO: 8252155 - DNA, 20 bp, Homo sapiens
tgagccagtcaagctacatt

SEQ ID NO: 8252156 - DNA, 22 bp, Homo sapiens
tgagccaggttaagacaggagc

SEQ ID NO: 8252157 - DNA, 22 bp, Homo sapiens
tgagccaggttaagacaggagc

SEQ ID NO: 8252158 - DNA, 22 bp, Homo sapiens
tgagccaggtctcactcacctt

SEQ ID NO: 8252159 - DNA, 22 bp, Homo sapiens
tgagccaggtctcactcacctt

SEQ ID NO: 8252160 - DNA, 22 bp, Homo sapiens
tgagcccagtctgtctgacatg

SEQ ID NO: 8252161 - DNA, 22 bp, Homo sapiens
tgagcccagtctgtctgacatg

SEQ ID NO: 8252162 - DNA, 22 bp, Homo sapiens
tgagccagtctgtctgggtgaa

SEQ ID NO: 8252163 - DNA, 22 bp, Homo sapiens
tgagccagtctgtctgggtgaa

SEQ ID NO: 8252164 - DNA, 22 bp, Homo sapiens
tgagccagtctgtctgggtgaa

SEQ ID NO: 8252165 - DNA, 22 bp, Homo sapiens
tgagccagtctctcagaaccct

SEQ ID NO: 8252166 - DNA, 22 bp, Homo sapiens
tgagccagtctctcagaaccct

SEQ ID NO: 8252167 - DNA, 21 bp, Homo sapiens
tgagcccttgcctcagagccc

SEQ ID NO: 8252168 - DNA, 22 bp, Homo sapiens
tgagccgtggtctctgagggtg

SEQ ID NO: 8252169 - DNA, 22 bp, Homo sapiens
tgagccctggagccctctgtta

SEQ ID NO: 8252170 - DNA, 22 bp, Homo sapiens
tgagccctgaggatctgttcgg

SEQ ID NO: 8252171 - DNA, 22 bp, Homo sapiens
tgagccctgacctagcctggcc

SEQ ID NO: 8252172 - DNA, 22 bp, Homo sapiens
tgagccctcttcccattttatt

SEQ ID NO: 8252173 - DNA, 22 bp, Homo sapiens
tgagcccatgtagcacttccat

SEQ ID NO: 8252174 - DNA, 22 bp, Homo sapiens
tgagcccatgtagcacttccat

SEQ ID NO: 8252175 - DNA, 23 bp, Homo sapiens
tgagcccagttttccctcttgcc

SEQ ID NO: 8252176 - DNA, 23 bp, Homo sapiens
tgagcccagttttccctcttgcc

SEQ ID NO: 8252177 - DNA, 22 bp, Homo sapiens
tgagcccatgctctttctacga

SEQ ID NO: 8252178 - DNA, 22 bp, Homo sapiens
tgagccctaagggtcaagcagg

SEQ ID NO: 8252179 - DNA, 22 bp, Homo sapiens
tgagccctaagggtcaagcagg

SEQ ID NO: 8252180 - DNA, 22 bp, Homo sapiens
tgagccctcggctggggcagag

SEQ ID NO: 8252181 - DNA, 22 bp, Homo sapiens
tgagccctccaaacccaggatt

SEQ ID NO: 8252182 - DNA, 22 bp, Homo sapiens
tgagccctaatttacaacatct

SEQ ID NO: 8252183 - DNA, 22 bp, Homo sapiens
tgagccctacctgctcatctcc

SEQ ID NO: 8252184 - DNA, 22 bp, Homo sapiens
tgagcctgctgtcgctggaccc

SEQ ID NO: 8252185 - DNA, 22 bp, Homo sapiens
tgagcctggagcccagatgttt

SEQ ID NO: 8252186 - DNA, 22 bp, Homo sapiens
tgagcctgctgtcgctggaccc

SEQ ID NO: 8252187 - DNA, 22 bp, Homo sapiens
tgagcctggagtcgtggagggg

SEQ ID NO: 8252188 - DNA, 20 bp, Homo sapiens
tgagcctgctgtaggaggcc

SEQ ID NO: 8252189 - DNA, 22 bp, Homo sapiens
tgagcctggagtcgtggagggg

SEQ ID NO: 8252190 - DNA, 22 bp, Homo sapiens
tgagcctggcggaagcagcgtg

SEQ ID NO: 8252191 - DNA, 22 bp, Homo sapiens
tgagcctggcggaagcagcgtg

SEQ ID NO: 8252192 - DNA, 22 bp, Homo sapiens
tgagcctggcctgcagagacca

SEQ ID NO: 8252193 - DNA, 22 bp, Homo sapiens
tgagcctggcctgcagagacca

SEQ ID NO: 8252194 - DNA, 22 bp, Homo sapiens
tgagcctggagtcgtggagggg

SEQ ID NO: 8252195 - DNA, 22 bp, Homo sapiens
tgagcctggcctgcagagacca

SEQ ID NO: 8252196 - DNA, 22 bp, Homo sapiens
tgagcctgcaataagcacagcc

SEQ ID NO: 8252197 - DNA, 22 bp, Homo sapiens
tgagcctgcaataagcacagcc

SEQ ID NO: 8252198 - DNA, 22 bp, Homo sapiens
tgagcctgcaataagcacagcc

SEQ ID NO: 8252199 - DNA, 22 bp, Homo sapiens
tgagcctgcaataagcacagcc

SEQ ID NO: 8252200 - DNA, 22 bp, Homo sapiens
tgagcctgagttcaaggctgca

SEQ ID NO: 8252201 - DNA, 22 bp, Homo sapiens
tgagcctgagttcaaggctgca

SEQ ID NO: 8252202 - DNA, 22 bp, Homo sapiens
tgagcctgagttcaaggctgca

SEQ ID NO: 8252203 - DNA, 23 bp, Homo sapiens
tgagcctgctgatagacacaatt

SEQ ID NO: 8252204 - DNA, 20 bp, Homo sapiens
tgagcctgctgtaggaggcc

SEQ ID NO: 8252205 - DNA, 22 bp, Homo sapiens
tgagcctgcctgcaggtgtgct

SEQ ID NO: 8252206 - DNA, 22 bp, Homo sapiens
tgagcctgggctttctctggag

SEQ ID NO: 8252207 - DNA, 22 bp, Homo sapiens
tgagcctggggcctgggcagcg

SEQ ID NO: 8252208 - DNA, 22 bp, Homo sapiens
tgagcctgggctttctctggag

SEQ ID NO: 8252209 - DNA, 22 bp, Homo sapiens
tgagcctgggagatggaggctg

SEQ ID NO: 8252210 - DNA, 22 bp, Homo sapiens
tgagcctgggagatggaggctg

SEQ ID NO: 8252211 - DNA, 22 bp, Homo sapiens
tgagcctgggagatggaggctg

SEQ ID NO: 8252212 - DNA, 22 bp, Homo sapiens
tgagcctgggagatggaggctg

SEQ ID NO: 8252213 - DNA, 22 bp, Homo sapiens
tgagcctggttgcagtgtctgg

SEQ ID NO: 8252214 - DNA, 22 bp, Homo sapiens
tgagcctggggcctgggcagcg

SEQ ID NO: 8252215 - DNA, 22 bp, Homo sapiens
tgagcctggttgcagtgtctgg

SEQ ID NO: 8252216 - DNA, 22 bp, Homo sapiens
tgagcctggttgcagtgtctgg

SEQ ID NO: 8252217 - DNA, 22 bp, Homo sapiens
tgagcctggggcctgggcagcg

SEQ ID NO: 8252218 - DNA, 22 bp, Homo sapiens
tgagcctgggtggtcgaggctg

SEQ ID NO: 8252219 - DNA, 22 bp, Homo sapiens
tgagcctgggtggtcgaggctg

SEQ ID NO: 8252220 - DNA, 22 bp, Homo sapiens
tgagcctgtggggtgacaacca

SEQ ID NO: 8252221 - DNA, 22 bp, Homo sapiens
tgagcctgtcattattcagaga

SEQ ID NO: 8252222 - DNA, 22 bp, Homo sapiens
tgagcctgtcctgtgcatgtga

SEQ ID NO: 8252223 - DNA, 22 bp, Homo sapiens
tgagcctgtggggtgacaacca

SEQ ID NO: 8252224 - DNA, 22 bp, Homo sapiens
tgagctagggctggtgaggagc

SEQ ID NO: 8252225 - DNA, 22 bp, Homo sapiens
tgaggaaaacgtattgaaagga

SEQ ID NO: 8252226 - DNA, 22 bp, Homo sapiens
tgaggaaaatgtcttatagatt

SEQ ID NO: 8252227 - DNA, 22 bp, Homo sapiens
tgaggaaactgaggcacagatg

SEQ ID NO: 8252228 - DNA, 22 bp, Homo sapiens
tgaggaaactgaggcacagatg

SEQ ID NO: 8252229 - DNA, 22 bp, Homo sapiens
tgaggaaacttacaaggcagaa

SEQ ID NO: 8252230 - DNA, 22 bp, Homo sapiens
tgagcttcctccctgcatccat

SEQ ID NO: 8252231 - DNA, 22 bp, Homo sapiens
tgagcttccctcctgcactaca

SEQ ID NO: 8252232 - DNA, 22 bp, Homo sapiens
tgagcttcctccctgcatccat

SEQ ID NO: 8252233 - DNA, 22 bp, Homo sapiens
tgagcttgcagtgccagccttg

SEQ ID NO: 8252234 - DNA, 20 bp, Homo sapiens
tgagcttcagatatcgtgca

SEQ ID NO: 8252235 - DNA, 22 bp, Homo sapiens
tgagcttcaaaatatgtgaatc

SEQ ID NO: 8252236 - DNA, 22 bp, Homo sapiens
tgagcttcaaagttggatctga

SEQ ID NO: 8252237 - DNA, 22 bp, Homo sapiens
tgagcttcaaagttggatctga

SEQ ID NO: 8252238 - DNA, 22 bp, Homo sapiens
tgagctgtgtgacattgagcca

SEQ ID NO: 8252239 - DNA, 22 bp, Homo sapiens
tgagcttacgtgggaacagact

SEQ ID NO: 8252240 - DNA, 22 bp, Homo sapiens
tgagctgtgattaactctgaga

SEQ ID NO: 8252241 - DNA, 22 bp, Homo sapiens
tgagctgtcaaggtacagtgaa

SEQ ID NO: 8252242 - DNA, 22 bp, Homo sapiens
tgagctgtctatggtcctgtct

SEQ ID NO: 8252243 - DNA, 22 bp, Homo sapiens
tgagctgtagcagatgctgttg

SEQ ID NO: 8252244 - DNA, 22 bp, Homo sapiens
tgagctggaatcttcttgactg

SEQ ID NO: 8252245 - DNA, 22 bp, Homo sapiens
tgagctggaggacaggagggta

SEQ ID NO: 8252246 - DNA, 22 bp, Homo sapiens
tgagctggagtcgtgagcaaag

SEQ ID NO: 8252247 - DNA, 22 bp, Homo sapiens
tgagctggatccaactccgttt

SEQ ID NO: 8252248 - DNA, 22 bp, Homo sapiens
tgagctggagtctgtggctcct

SEQ ID NO: 8252249 - DNA, 22 bp, Homo sapiens
tgagctggagtcgtgagcaaag

SEQ ID NO: 8252250 - DNA, 22 bp, Homo sapiens
tgagctggagtctgtggctcct

SEQ ID NO: 8252251 - DNA, 22 bp, Homo sapiens
tgagctggtcttgagtgtagct

SEQ ID NO: 8252252 - DNA, 22 bp, Homo sapiens
tgagctgtaaggctgtcactga

SEQ ID NO: 8252253 - DNA, 22 bp, Homo sapiens
tgagctggttcttgaggcatga

SEQ ID NO: 8252254 - DNA, 18 bp, Homo sapiens
tgagctgctctgtgaaga

SEQ ID NO: 8252255 - DNA, 19 bp, Homo sapiens
tgagctgctgctgcccatc

SEQ ID NO: 8252256 - DNA, 22 bp, Homo sapiens
tgagctgatggcatccctgttt

SEQ ID NO: 8252257 - DNA, 22 bp, Homo sapiens
tgagctgataggctgtgagcct

SEQ ID NO: 8252258 - DNA, 22 bp, Homo sapiens
tgagctgcagtgagctgagatg

SEQ ID NO: 8252259 - DNA, 22 bp, Homo sapiens
tgagctgcagtgagctgagatg

SEQ ID NO: 8252260 - DNA, 22 bp, Homo sapiens
tgagctgcattacagcctctgt

SEQ ID NO: 8252261 - DNA, 22 bp, Homo sapiens
tgagctctaagatcccctcaag

SEQ ID NO: 8252262 - DNA, 23 bp, Homo sapiens
tgagctctatggaggactgaacc

SEQ ID NO: 8252263 - DNA, 22 bp, Homo sapiens
tgagctctgttagggctggaac

SEQ ID NO: 8252264 - DNA, 22 bp, Homo sapiens
tgagctctgacttttgggaatt

SEQ ID NO: 8252265 - DNA, 19 bp, Homo sapiens
tgagctctccacaatttcc

SEQ ID NO: 8252266 - DNA, 19 bp, Homo sapiens
tgagctctccacaatttcc

SEQ ID NO: 8252267 - DNA, 22 bp, Homo sapiens
tgagctctcattaatattattc

SEQ ID NO: 8252268 - DNA, 22 bp, Homo sapiens
tgagctgagaacacttgggcta

SEQ ID NO: 8252269 - DNA, 22 bp, Homo sapiens
tgagctgagtttaaaagctgct

SEQ ID NO: 8252270 - DNA, 22 bp, Homo sapiens
tgagctgagtggcaggtctcag

SEQ ID NO: 8252271 - DNA, 23 bp, Homo sapiens
tgagctgagtgagttggcctggg

SEQ ID NO: 8252272 - DNA, 22 bp, Homo sapiens
tgagctgacacccaatcatact

SEQ ID NO: 8252273 - DNA, 22 bp, Homo sapiens
tgagctcttctaactaattgtg

SEQ ID NO: 8252274 - DNA, 22 bp, Homo sapiens
tgagctctgttagggctggaac

SEQ ID NO: 8252275 - DNA, 22 bp, Homo sapiens
tgagcagggagctgggctgagc

SEQ ID NO: 8252276 - DNA, 22 bp, Homo sapiens
tgagcagggactttggagtctg

SEQ ID NO: 8252277 - DNA, 22 bp, Homo sapiens
tgagcagggactttggagtctg

SEQ ID NO: 8252278 - DNA, 22 bp, Homo sapiens
tgagcagggactttggagtctg

SEQ ID NO: 8252279 - DNA, 22 bp, Homo sapiens
tgagcagggactttggagtctg

SEQ ID NO: 8252280 - DNA, 22 bp, Homo sapiens
tgagcatggtgggtgcagagca

SEQ ID NO: 8252281 - DNA, 19 bp, Homo sapiens
tgagcatgcgagctgagaa

SEQ ID NO: 8252282 - DNA, 22 bp, Homo sapiens
tgagcatggtgggtgcagagca

SEQ ID NO: 8252283 - DNA, 19 bp, Homo sapiens
tgagcatgcgagctgagaa

SEQ ID NO: 8252284 - DNA, 22 bp, Homo sapiens
tgagcatagccttcagtagcag

SEQ ID NO: 8252285 - DNA, 22 bp, Homo sapiens
tgagcatagcccttctagtgtt

SEQ ID NO: 8252286 - DNA, 22 bp, Homo sapiens
tgagcagggagctgggctgagc

SEQ ID NO: 8252287 - DNA, 22 bp, Homo sapiens
tgagcagggagctgggctgagc

SEQ ID NO: 8252288 - DNA, 22 bp, Homo sapiens
tgagccagataagggctcacgc

SEQ ID NO: 8252289 - DNA, 22 bp, Homo sapiens
tgagccagataagggctcacgc

SEQ ID NO: 8252290 - DNA, 22 bp, Homo sapiens
tgagccagataagggctcacgc

SEQ ID NO: 8252291 - DNA, 22 bp, Homo sapiens
tgagccagagtggagtgtgcct

SEQ ID NO: 8252292 - DNA, 22 bp, Homo sapiens
tgagccagagtggagtgtgcct

SEQ ID NO: 8252293 - DNA, 22 bp, Homo sapiens
tgagccagaggaggctgtgtgg

SEQ ID NO: 8252294 - DNA, 22 bp, Homo sapiens
tgagccagaggaggctgtgtgg

SEQ ID NO: 8252295 - DNA, 22 bp, Homo sapiens
tgagccagaggaggctgtgtgg

SEQ ID NO: 8252296 - DNA, 22 bp, Homo sapiens
tgagcattggatcaaatgactt

SEQ ID NO: 8252297 - DNA, 22 bp, Homo sapiens
tgagccaaggcctcaagaattt

SEQ ID NO: 8252298 - DNA, 22 bp, Homo sapiens
tgagccagagaggttgaggcta

SEQ ID NO: 8252299 - DNA, 22 bp, Homo sapiens
tgagccagagaggttgaggcta

SEQ ID NO: 8252300 - DNA, 22 bp, Homo sapiens
tgagccacagtgagagctcctg

SEQ ID NO: 8252301 - DNA, 22 bp, Homo sapiens
tgagccacagtgagagctcctg

SEQ ID NO: 8252302 - DNA, 22 bp, Homo sapiens
tgagccagcaggcctccagtgg

SEQ ID NO: 8252303 - DNA, 22 bp, Homo sapiens
tgagccagcaggcctccagtgg

SEQ ID NO: 8252304 - DNA, 22 bp, Homo sapiens
tgagccagcaggcctccagtgg

SEQ ID NO: 8252305 - DNA, 22 bp, Homo sapiens
tgagccagcaggcctccagtgg

SEQ ID NO: 8252306 - DNA, 22 bp, Homo sapiens
tgagccagcctcagaagtcacg

SEQ ID NO: 8252307 - DNA, 22 bp, Homo sapiens
tgagccagccttgcagctgtgc

SEQ ID NO: 8252308 - DNA, 22 bp, Homo sapiens
tgagccagccttgcagctgtgc

SEQ ID NO: 8252309 - DNA, 22 bp, Homo sapiens
tgagccaggcactgctcctgga

SEQ ID NO: 8252310 - DNA, 22 bp, Homo sapiens
tgagccaggcactgctcctgga

SEQ ID NO: 8252311 - DNA, 22 bp, Homo sapiens
tgagccaggcactgctcctgga

SEQ ID NO: 8252312 - DNA, 22 bp, Homo sapiens
tgagccaggagtttgaggctgt

SEQ ID NO: 8252313 - DNA, 22 bp, Homo sapiens
tgagccaggagtttgaggctgt

SEQ ID NO: 8252314 - DNA, 22 bp, Homo sapiens
tgagccaggagtttgaggctgt

SEQ ID NO: 8252315 - DNA, 22 bp, Homo sapiens
tgagccagctccttgcctgtca

SEQ ID NO: 8252316 - DNA, 22 bp, Homo sapiens
tgagccagctccttgcctgtca

SEQ ID NO: 8252317 - DNA, 22 bp, Homo sapiens
tgagccaggctccatgccacct

SEQ ID NO: 8252318 - DNA, 21 bp, Homo sapiens
tgagccaggctgacggctgtg

SEQ ID NO: 8252319 - DNA, 21 bp, Homo sapiens
tgagccaggctgacggctgtg

SEQ ID NO: 8252320 - DNA, 19 bp, Homo sapiens
tgagccagggaggccatgc

SEQ ID NO: 8252321 - DNA, 22 bp, Homo sapiens
tgagccagggtttccggctgct

SEQ ID NO: 8252322 - DNA, 22 bp, Homo sapiens
tgagccaggctcaagtgatcct

SEQ ID NO: 8252323 - DNA, 22 bp, Homo sapiens
tgagccaggctcaagtgatcct

SEQ ID NO: 8252324 - DNA, 22 bp, Homo sapiens
tgagccaggctcaagtgatcct

SEQ ID NO: 8252325 - DNA, 22 bp, Homo sapiens
tgagccaggcccagtggggtca

SEQ ID NO: 8252326 - DNA, 20 bp, Homo sapiens
tgagccaggctaggaagggc

SEQ ID NO: 8252327 - DNA, 20 bp, Homo sapiens
tgagccaggctaggaagggc

SEQ ID NO: 8252328 - DNA, 22 bp, Homo sapiens
tgagcaggagataaacaggtag

SEQ ID NO: 8252329 - DNA, 22 bp, Homo sapiens
tgagcaggactcactgcagcct

SEQ ID NO: 8252330 - DNA, 22 bp, Homo sapiens
tgagcagcccttcctccggcca

SEQ ID NO: 8252331 - DNA, 22 bp, Homo sapiens
tgagcagcaggatcttctggta

SEQ ID NO: 8252332 - DNA, 22 bp, Homo sapiens
tgagcagatgtgccaaactgta

SEQ ID NO: 8252333 - DNA, 22 bp, Homo sapiens
tgagcagcaactgtccatggca

SEQ ID NO: 8252334 - DNA, 22 bp, Homo sapiens
tgagcaggcgcagcaggaggtc

SEQ ID NO: 8252335 - DNA, 21 bp, Homo sapiens
tgagcaggagtcatgggaatg

SEQ ID NO: 8252336 - DNA, 22 bp, Homo sapiens
tgagcaggcgcagcaggaggtc

SEQ ID NO: 8252337 - DNA, 22 bp, Homo sapiens
tgagcaggcgcagcaggaggtc

SEQ ID NO: 8252338 - DNA, 22 bp, Homo sapiens
tgagcaggcgcagcaggaggtc

SEQ ID NO: 8252339 - DNA, 22 bp, Homo sapiens
tgagcagggactttgagtgtag

SEQ ID NO: 8252340 - DNA, 22 bp, Homo sapiens
tgagcagggactttgagtgtag

SEQ ID NO: 8252341 - DNA, 22 bp, Homo sapiens
tgagcagagcaataggactctc

SEQ ID NO: 8252342 - DNA, 22 bp, Homo sapiens
tgagcagagatgactgggcatt

SEQ ID NO: 8252343 - DNA, 22 bp, Homo sapiens
tgagcacatgccagcccttctc

SEQ ID NO: 8252344 - DNA, 22 bp, Homo sapiens
tgagcacatttcacatgacagg

SEQ ID NO: 8252345 - DNA, 22 bp, Homo sapiens
tgagcagagatgactgggcatt

SEQ ID NO: 8252346 - DNA, 22 bp, Homo sapiens
tgagcaccaggcaccacagctc

SEQ ID NO: 8252347 - DNA, 23 bp, Homo sapiens
tgagcaagtgaccaactgtctgt

SEQ ID NO: 8252348 - DNA, 22 bp, Homo sapiens
tgagcacaagtttgcatgtgtg

SEQ ID NO: 8252349 - DNA, 22 bp, Homo sapiens
tgagcaagagaaactgactgta

SEQ ID NO: 8252350 - DNA, 22 bp, Homo sapiens
tgagcaagacccggcctctgcc

SEQ ID NO: 8252351 - DNA, 22 bp, Homo sapiens
tgagcaaagggatgaatcactg

SEQ ID NO: 8252352 - DNA, 22 bp, Homo sapiens
tgagcacagctcgcaccagctt

SEQ ID NO: 8252353 - DNA, 22 bp, Homo sapiens
tgagcagagcaggctgcgccct

SEQ ID NO: 8252354 - DNA, 22 bp, Homo sapiens
tgagcagagcagtaacaggagc

SEQ ID NO: 8252355 - DNA, 22 bp, Homo sapiens
tgagcagaggaggctgccaact

SEQ ID NO: 8252356 - DNA, 22 bp, Homo sapiens
tgagcagaggagtgacgtaggt

SEQ ID NO: 8252357 - DNA, 22 bp, Homo sapiens
tgagcagagtcgctccagagtg

SEQ ID NO: 8252358 - DNA, 22 bp, Homo sapiens
tgagcagatggaggcttctgca

SEQ ID NO: 8252359 - DNA, 22 bp, Homo sapiens
tgagcagatggaggcttctgca

SEQ ID NO: 8252360 - DNA, 22 bp, Homo sapiens
tgaggcatggtcctgagggagc

SEQ ID NO: 8252361 - DNA, 22 bp, Homo sapiens
tgaggcagttgagcttcctgag

SEQ ID NO: 8252362 - DNA, 22 bp, Homo sapiens
tgaggcagttgagcttcctgag

SEQ ID NO: 8252363 - DNA, 22 bp, Homo sapiens
tgaggcattaaagggaggtcaa

SEQ ID NO: 8252364 - DNA, 22 bp, Homo sapiens
tgaggccaaaatgactcaaatg

SEQ ID NO: 8252365 - DNA, 22 bp, Homo sapiens
tgaggccaagcctcctctgcca

SEQ ID NO: 8252366 - DNA, 19 bp, Homo sapiens
tgaggccaaggtcacagat

SEQ ID NO: 8252367 - DNA, 19 bp, Homo sapiens
tgaggccaaggtcacagat

SEQ ID NO: 8252368 - DNA, 22 bp, Homo sapiens
tgaggccaagcctcctctgcca

SEQ ID NO: 8252369 - DNA, 22 bp, Homo sapiens
tgaggccaactagggagatgga

SEQ ID NO: 8252370 - DNA, 23 bp, Homo sapiens
tgaggcaggcggatcacgaggtc

SEQ ID NO: 8252371 - DNA, 22 bp, Homo sapiens
tgaggcagggagagtggatatg

SEQ ID NO: 8252372 - DNA, 22 bp, Homo sapiens
tgaggcagggagagtggatatg

SEQ ID NO: 8252373 - DNA, 22 bp, Homo sapiens
tgaggcagttcttacttgtatt

SEQ ID NO: 8252374 - DNA, 22 bp, Homo sapiens
tgaggcagttcttacttgtatt

SEQ ID NO: 8252375 - DNA, 21 bp, Homo sapiens
tgaggcaggggtgcttttgtc

SEQ ID NO: 8252376 - DNA, 22 bp, Homo sapiens
tgaggcagggagtttaattgtc

SEQ ID NO: 8252377 - DNA, 22 bp, Homo sapiens
tgaggcagtgtgagataataaa

SEQ ID NO: 8252378 - DNA, 22 bp, Homo sapiens
tgaggcaggagaatggcgggaa

SEQ ID NO: 8252379 - DNA, 22 bp, Homo sapiens
tgaggcaggagaatggcgggaa

SEQ ID NO: 8252380 - DNA, 22 bp, Homo sapiens
tgaggcaggaggttgagaactg

SEQ ID NO: 8252381 - DNA, 22 bp, Homo sapiens
tgaggcaggaggttgagaactg

SEQ ID NO: 8252382 - DNA, 22 bp, Homo sapiens
tgaggcaggaggattgcaggat

SEQ ID NO: 8252383 - DNA, 22 bp, Homo sapiens
tgaggcaggaggattgcaggat

SEQ ID NO: 8252384 - DNA, 22 bp, Homo sapiens
tgaggcaggaggattgcaggat

SEQ ID NO: 8252385 - DNA, 22 bp, Homo sapiens
tgaggcaggagttcaggctgcg

SEQ ID NO: 8252386 - DNA, 22 bp, Homo sapiens
tgaggcaggagttcaggctgcg

SEQ ID NO: 8252387 - DNA, 22 bp, Homo sapiens
tgaggcaggagttcaggctgcg

SEQ ID NO: 8252388 - DNA, 22 bp, Homo sapiens
tgaggcaggagttcaggctgcg

SEQ ID NO: 8252389 - DNA, 22 bp, Homo sapiens
tgaggcaggagttcaggctgcg

SEQ ID NO: 8252390 - DNA, 22 bp, Homo sapiens
tgaggcaggagttcaggctgcg

SEQ ID NO: 8252391 - DNA, 22 bp, Homo sapiens
tgaggcaggagttcaggctgcg

SEQ ID NO: 8252392 - DNA, 23 bp, Homo sapiens
tgaggcaggcggatcacgaggtc

SEQ ID NO: 8252393 - DNA, 23 bp, Homo sapiens
tgaggcaggcggatcacgaggtc

SEQ ID NO: 8252394 - DNA, 23 bp, Homo sapiens
tgaggcaggcggatcacgaggtc

SEQ ID NO: 8252395 - DNA, 23 bp, Homo sapiens
tgaggcaggcggatcacgaggtc

SEQ ID NO: 8252396 - DNA, 22 bp, Homo sapiens
tgaggcaggagttcaggctgcg

SEQ ID NO: 8252397 - DNA, 22 bp, Homo sapiens
tgaggcaggatgcttgcacagg

SEQ ID NO: 8252398 - DNA, 21 bp, Homo sapiens
tgaggccaatagcccctggac

SEQ ID NO: 8252399 - DNA, 19 bp, Homo sapiens
tgaggccaaggtcacagat

SEQ ID NO: 8252400 - DNA, 21 bp, Homo sapiens
tgaggccaatagcccctggac

SEQ ID NO: 8252401 - DNA, 22 bp, Homo sapiens
tgaggccaatgaccctgggcag

SEQ ID NO: 8252402 - DNA, 22 bp, Homo sapiens
tgaggccaatgaccctgggcag

SEQ ID NO: 8252403 - DNA, 22 bp, Homo sapiens
tgaggccaatgaccctgggcag

SEQ ID NO: 8252404 - DNA, 22 bp, Homo sapiens
tgaggccacaggaaagggcccg

SEQ ID NO: 8252405 - DNA, 22 bp, Homo sapiens
tgaggccacaggaaagggcccg

SEQ ID NO: 8252406 - DNA, 22 bp, Homo sapiens
tgaggccacagtatcagaacag

SEQ ID NO: 8252407 - DNA, 22 bp, Homo sapiens
tgaggccacagtatcagaacag

SEQ ID NO: 8252408 - DNA, 22 bp, Homo sapiens
tgaggccacttccccacagccc

SEQ ID NO: 8252409 - DNA, 22 bp, Homo sapiens
tgaggccagagagtttgcattt

SEQ ID NO: 8252410 - DNA, 22 bp, Homo sapiens
tgaggccacttccccacagccc

SEQ ID NO: 8252411 - DNA, 22 bp, Homo sapiens
tgaggccacttccccacagccc

SEQ ID NO: 8252412 - DNA, 22 bp, Homo sapiens
tgaggccacttccccacagccc

SEQ ID NO: 8252413 - DNA, 22 bp, Homo sapiens
tgaggccaggacccccagcagg

SEQ ID NO: 8252414 - DNA, 22 bp, Homo sapiens
tgaggccagcttcagcagtgga

SEQ ID NO: 8252415 - DNA, 22 bp, Homo sapiens
tgaggccagcttcagcagtgga

SEQ ID NO: 8252416 - DNA, 22 bp, Homo sapiens
tgaggccagcttcagcagtgga

SEQ ID NO: 8252417 - DNA, 16 bp, Homo sapiens
tgaggccagccatttc

SEQ ID NO: 8252418 - DNA, 22 bp, Homo sapiens
tgaggccagccacagccaccct

SEQ ID NO: 8252419 - DNA, 22 bp, Homo sapiens
tgaggccagccacagccaccct

SEQ ID NO: 8252420 - DNA, 22 bp, Homo sapiens
tgaggccagagtttttaattcc

SEQ ID NO: 8252421 - DNA, 22 bp, Homo sapiens
tgaggccagactgaaaccaaca

SEQ ID NO: 8252422 - DNA, 18 bp, Homo sapiens
tgaggccagagtgggcat

SEQ ID NO: 8252423 - DNA, 18 bp, Homo sapiens
tgaggccagagtgggcat

SEQ ID NO: 8252424 - DNA, 22 bp, Homo sapiens
tgaggccctctgggctggtcct

SEQ ID NO: 8252425 - DNA, 22 bp, Homo sapiens
tgaggccctctgggctggtcct

SEQ ID NO: 8252426 - DNA, 22 bp, Homo sapiens
tgaggccctctgggctggtcct

SEQ ID NO: 8252427 - DNA, 22 bp, Homo sapiens
tgaggccctagggcatgggaga

SEQ ID NO: 8252428 - DNA, 22 bp, Homo sapiens
tgaggccaggatcccaggctct

SEQ ID NO: 8252429 - DNA, 22 bp, Homo sapiens
tgaggccaggacccccagcagg

SEQ ID NO: 8252430 - DNA, 22 bp, Homo sapiens
tgaggccaggacccccagcagg

SEQ ID NO: 8252431 - DNA, 22 bp, Homo sapiens
tgaggcccgggtggaggaatgc

SEQ ID NO: 8252432 - DNA, 22 bp, Homo sapiens
tgaggccccgaagctgaggttt

SEQ ID NO: 8252433 - DNA, 18 bp, Homo sapiens
tgaggcccgcagaggtgg

SEQ ID NO: 8252434 - DNA, 17 bp, Homo sapiens
tgaggcctgcatcagtg

SEQ ID NO: 8252435 - DNA, 17 bp, Homo sapiens
tgaggcctgcatcagtg

SEQ ID NO: 8252436 - DNA, 17 bp, Homo sapiens
tgaggcctgcatcagtg

SEQ ID NO: 8252437 - DNA, 17 bp, Homo sapiens
tgaggcctgcatcagtg

SEQ ID NO: 8252438 - DNA, 22 bp, Homo sapiens
tgaggcctctgtgccatccagg

SEQ ID NO: 8252439 - DNA, 18 bp, Homo sapiens
tgaggcctctgctgggcc

SEQ ID NO: 8252440 - DNA, 22 bp, Homo sapiens
tgaggcctctgaggcctaggct

SEQ ID NO: 8252441 - DNA, 22 bp, Homo sapiens
tgaggcctctgaggcctaggct

SEQ ID NO: 8252442 - DNA, 22 bp, Homo sapiens
tgaggcctgaagcctggagcct

SEQ ID NO: 8252443 - DNA, 22 bp, Homo sapiens
tgaggcctctgtgccatccagg

SEQ ID NO: 8252444 - DNA, 22 bp, Homo sapiens
tgaggcctctgtgccatccagg

SEQ ID NO: 8252445 - DNA, 22 bp, Homo sapiens
tgaggaggtgggcacacagagt

SEQ ID NO: 8252446 - DNA, 22 bp, Homo sapiens
tgaggaggtcagagtctggctg

SEQ ID NO: 8252447 - DNA, 22 bp, Homo sapiens
tgaggaggtgggcacacagagt

SEQ ID NO: 8252448 - DNA, 22 bp, Homo sapiens
tgaggaggtgggcacacagagt

SEQ ID NO: 8252449 - DNA, 22 bp, Homo sapiens
tgaggaggtgggcacacagagt

SEQ ID NO: 8252450 - DNA, 22 bp, Homo sapiens
tgaggaggtcagagtctggctg

SEQ ID NO: 8252451 - DNA, 22 bp, Homo sapiens
tgaggaggtcagagtctggctg

SEQ ID NO: 8252452 - DNA, 22 bp, Homo sapiens
tgaggaggcccaggttggggct

SEQ ID NO: 8252453 - DNA, 22 bp, Homo sapiens
tgaggaggcccaggttggggct

SEQ ID NO: 8252454 - DNA, 22 bp, Homo sapiens
tgaggaggcccaggttggggct

SEQ ID NO: 8252455 - DNA, 23 bp, Homo sapiens
tgaggagcatagctgactgacag

SEQ ID NO: 8252456 - DNA, 22 bp, Homo sapiens
tgaggagccactctagcagtca

SEQ ID NO: 8252457 - DNA, 22 bp, Homo sapiens
tgaggagcttctggaaagtgca

SEQ ID NO: 8252458 - DNA, 22 bp, Homo sapiens
tgaggagcgggcagggatgcag

SEQ ID NO: 8252459 - DNA, 23 bp, Homo sapiens
tgaggagcatagctgactgacag

SEQ ID NO: 8252460 - DNA, 22 bp, Homo sapiens
tgaggagtatggtggggtcatt

SEQ ID NO: 8252461 - DNA, 22 bp, Homo sapiens
tgaggagtgtggatggagcttg

SEQ ID NO: 8252462 - DNA, 22 bp, Homo sapiens
tgaggatgagatgagataacac

SEQ ID NO: 8252463 - DNA, 22 bp, Homo sapiens
tgaggatatagtggtaaacagt

SEQ ID NO: 8252464 - DNA, 22 bp, Homo sapiens
tgaggatgagatgagataacac

SEQ ID NO: 8252465 - DNA, 22 bp, Homo sapiens
tgaggatgacgatggcaatggc

SEQ ID NO: 8252466 - DNA, 22 bp, Homo sapiens
tgaggatgacgatggcaatggc

SEQ ID NO: 8252467 - DNA, 22 bp, Homo sapiens
tgaggatggcagtgtgctcagc

SEQ ID NO: 8252468 - DNA, 22 bp, Homo sapiens
tgaggatggaatgctgtgcaag

SEQ ID NO: 8252469 - DNA, 22 bp, Homo sapiens
tgaggatggaatgctgtgcaag

SEQ ID NO: 8252470 - DNA, 22 bp, Homo sapiens
tgaggatggcagtgtgctcagc

SEQ ID NO: 8252471 - DNA, 22 bp, Homo sapiens
tgaggatggcagtgtgctcagc

SEQ ID NO: 8252472 - DNA, 22 bp, Homo sapiens
tgaggatggcagtgtgctcagc

SEQ ID NO: 8252473 - DNA, 22 bp, Homo sapiens
tgaggatggcagtgtgctcagc

SEQ ID NO: 8252474 - DNA, 22 bp, Homo sapiens
tgaggatggtgttggagagggc

SEQ ID NO: 8252475 - DNA, 22 bp, Homo sapiens
tgaggatggtgttggagagggc

SEQ ID NO: 8252476 - DNA, 22 bp, Homo sapiens
tgaggaacaactcctgtgacta

SEQ ID NO: 8252477 - DNA, 22 bp, Homo sapiens
tgaggaaattgaggctcacaga

SEQ ID NO: 8252478 - DNA, 22 bp, Homo sapiens
tgaggaaattgaggctcacaga

SEQ ID NO: 8252479 - DNA, 22 bp, Homo sapiens
tgaggaagaacaagaatttaga

SEQ ID NO: 8252480 - DNA, 22 bp, Homo sapiens
tgaggaactcaccaggcagaga

SEQ ID NO: 8252481 - DNA, 22 bp, Homo sapiens
tgaggaaatatggtgaactctt

SEQ ID NO: 8252482 - DNA, 22 bp, Homo sapiens
tgaggaaatatggtgaactctt

SEQ ID NO: 8252483 - DNA, 22 bp, Homo sapiens
tgaggaaagaaaggcatgcatg

SEQ ID NO: 8252484 - DNA, 22 bp, Homo sapiens
tgaggaaagaaaggcatgcatg

SEQ ID NO: 8252485 - DNA, 22 bp, Homo sapiens
tgaggaagccaaacagctacac

SEQ ID NO: 8252486 - DNA, 22 bp, Homo sapiens
tgaggaagcaaaggcttgtgtg

SEQ ID NO: 8252487 - DNA, 22 bp, Homo sapiens
tgaggaagaacaagaatttaga

SEQ ID NO: 8252488 - DNA, 22 bp, Homo sapiens
tgaggaagcaaaggcttgtgtg

SEQ ID NO: 8252489 - DNA, 22 bp, Homo sapiens
tgaggagaaatgctcagagcca

SEQ ID NO: 8252490 - DNA, 22 bp, Homo sapiens
tgaggagaaatgctcagagcca

SEQ ID NO: 8252491 - DNA, 22 bp, Homo sapiens
tgaggaagttgatctcatcagt

SEQ ID NO: 8252492 - DNA, 22 bp, Homo sapiens
tgaggaagttgatctcatcagt

SEQ ID NO: 8252493 - DNA, 22 bp, Homo sapiens
tgaggaagtggttgtatggttt

SEQ ID NO: 8252494 - DNA, 22 bp, Homo sapiens
tgaggaagggtgtgacggcacc

SEQ ID NO: 8252495 - DNA, 22 bp, Homo sapiens
tgaggaagggtgtgacggcacc

SEQ ID NO: 8252496 - DNA, 22 bp, Homo sapiens
tgaggaagggtgtgacggcacc

SEQ ID NO: 8252497 - DNA, 22 bp, Homo sapiens
tgaggaagggtgtgacggcacc

SEQ ID NO: 8252498 - DNA, 20 bp, Homo sapiens
tgaggcaggagaatggcatg

SEQ ID NO: 8252499 - DNA, 20 bp, Homo sapiens
tgaggcaggagaatggcatg

SEQ ID NO: 8252500 - DNA, 22 bp, Homo sapiens
tgaggcaggagaatcaccggaa

SEQ ID NO: 8252501 - DNA, 22 bp, Homo sapiens
tgaggcaggagaatcacatgaa

SEQ ID NO: 8252502 - DNA, 22 bp, Homo sapiens
tgaggcaggagaatcacatgaa

SEQ ID NO: 8252503 - DNA, 22 bp, Homo sapiens
tgaggcaggagaatcaccggaa

SEQ ID NO: 8252504 - DNA, 22 bp, Homo sapiens
tgaggcaggagaatcaccggaa

SEQ ID NO: 8252505 - DNA, 22 bp, Homo sapiens
tgaggcaggagaatcacatgaa

SEQ ID NO: 8252506 - DNA, 22 bp, Homo sapiens
tgaggcaggagaatcacatgaa

SEQ ID NO: 8252507 - DNA, 22 bp, Homo sapiens
tgaggcaggacttgcataaagt

SEQ ID NO: 8252508 - DNA, 22 bp, Homo sapiens
tgaggcaggactgagcgggatg

SEQ ID NO: 8252509 - DNA, 22 bp, Homo sapiens
tgaggcaggactgagcgggatg

SEQ ID NO: 8252510 - DNA, 22 bp, Homo sapiens
tgaggcaggacatggacaactg

SEQ ID NO: 8252511 - DNA, 22 bp, Homo sapiens
tgaggcaggacatggacaactg

SEQ ID NO: 8252512 - DNA, 22 bp, Homo sapiens
tgaggcagctttttctgtgtgt

SEQ ID NO: 8252513 - DNA, 22 bp, Homo sapiens
tgaggcagctttttctgtgtgt

SEQ ID NO: 8252514 - DNA, 22 bp, Homo sapiens
tgaggcagctttttctgtgtgt

SEQ ID NO: 8252515 - DNA, 22 bp, Homo sapiens
tgaggcagaaaatagcagttca

SEQ ID NO: 8252516 - DNA, 22 bp, Homo sapiens
tgaggcagctttttctgtgtgt

SEQ ID NO: 8252517 - DNA, 22 bp, Homo sapiens
tgaggcagaaaatagcagttca

SEQ ID NO: 8252518 - DNA, 22 bp, Homo sapiens
tgaggcactgggagagcacact

SEQ ID NO: 8252519 - DNA, 22 bp, Homo sapiens
tgaggcacatccaggccagctc

SEQ ID NO: 8252520 - DNA, 22 bp, Homo sapiens
tgaggcacatccaggccagctc

SEQ ID NO: 8252521 - DNA, 22 bp, Homo sapiens
tgaggcaatgtccttcatcctt

SEQ ID NO: 8252522 - DNA, 22 bp, Homo sapiens
tgaggcaatgtccttcatcctt

SEQ ID NO: 8252523 - DNA, 22 bp, Homo sapiens
tgaggcaattggaaattttaac

SEQ ID NO: 8252524 - DNA, 19 bp, Homo sapiens
tgaggcacatgataagaac

SEQ ID NO: 8252525 - DNA, 19 bp, Homo sapiens
tgaggcactagtctggtcc

SEQ ID NO: 8252526 - DNA, 19 bp, Homo sapiens
tgaggcacatgataagaac

SEQ ID NO: 8252527 - DNA, 22 bp, Homo sapiens
tgaggcaagggatggccccgtg

SEQ ID NO: 8252528 - DNA, 22 bp, Homo sapiens
tgaggcaaggctgaatgaaggc

SEQ ID NO: 8252529 - DNA, 22 bp, Homo sapiens
tgaggcaagctgggcccatgga

SEQ ID NO: 8252530 - DNA, 22 bp, Homo sapiens
tgaggcaagctgggcccatgga

SEQ ID NO: 8252531 - DNA, 19 bp, Homo sapiens
tgaggcaagctttttcttg

SEQ ID NO: 8252532 - DNA, 22 bp, Homo sapiens
tgaggcaagtactttccctttt

SEQ ID NO: 8252533 - DNA, 21 bp, Homo sapiens
tgaggcaagtccttttatagc

SEQ ID NO: 8252534 - DNA, 22 bp, Homo sapiens
tgaggcaagtctcaatctttga

SEQ ID NO: 8252535 - DNA, 22 bp, Homo sapiens
tgaggcaatccctagggtaagg

SEQ ID NO: 8252536 - DNA, 22 bp, Homo sapiens
tgaggatggttaaagaacattg

SEQ ID NO: 8252537 - DNA, 22 bp, Homo sapiens
tgaggatggtgttggagagggc

SEQ ID NO: 8252538 - DNA, 22 bp, Homo sapiens
tgaggatttctatggttctttc

SEQ ID NO: 8252539 - DNA, 22 bp, Homo sapiens
tgaggcaaaaacactgattagg

SEQ ID NO: 8252540 - DNA, 21 bp, Homo sapiens
tgaggatttcagtagatgcct

SEQ ID NO: 8252541 - DNA, 21 bp, Homo sapiens
tgaggatttcagtagatgcct

SEQ ID NO: 8252542 - DNA, 22 bp, Homo sapiens
tgaggatttaatgggactcatt

SEQ ID NO: 8252543 - DNA, 22 bp, Homo sapiens
tgaggatttaatgggactcatt

SEQ ID NO: 8252544 - DNA, 22 bp, Homo sapiens
tgaggatttaatactcataagc

SEQ ID NO: 8252545 - DNA, 22 bp, Homo sapiens
tgaggattggcaaaactcaggg

SEQ ID NO: 8252546 - DNA, 22 bp, Homo sapiens
tgaggattgagtcaagcagtat

SEQ ID NO: 8252547 - DNA, 22 bp, Homo sapiens
tgaggattcaagagggaacaag

SEQ ID NO: 8252548 - DNA, 22 bp, Homo sapiens
tgaggattaaatgagctaataa

SEQ ID NO: 8252549 - DNA, 19 bp, Homo sapiens
tgaggattgaggtccagta

SEQ ID NO: 8252550 - DNA, 22 bp, Homo sapiens
tgaggatttcctgcagctttct

SEQ ID NO: 8252551 - DNA, 22 bp, Homo sapiens
tgaggatttcctgcagctttct

SEQ ID NO: 8252552 - DNA, 22 bp, Homo sapiens
tgaggcaaaagttatgtggtag

SEQ ID NO: 8252553 - DNA, 22 bp, Homo sapiens
tgaggcaaagacaaagcagcat

SEQ ID NO: 8252554 - DNA, 22 bp, Homo sapiens
tgaggcaaagttcaagctgaaa

SEQ ID NO: 8252555 - DNA, 22 bp, Homo sapiens
tgaggcaaagttcaagctgaaa

SEQ ID NO: 8252556 - DNA, 22 bp, Homo sapiens
tgaggcaagagtttgattagag

SEQ ID NO: 8252557 - DNA, 19 bp, Homo sapiens
tgaggcaagatggctctgg

SEQ ID NO: 8252558 - DNA, 19 bp, Homo sapiens
tgaggcaagatggctctgg

SEQ ID NO: 8252559 - DNA, 17 bp, Homo sapiens
tgaggcaaccatcacta

SEQ ID NO: 8252560 - DNA, 22 bp, Homo sapiens
tgaggcaacagaaagggccaat

SEQ ID NO: 8252561 - DNA, 22 bp, Homo sapiens
tgaggcaacagaaagggccaat

SEQ ID NO: 8252562 - DNA, 22 bp, Homo sapiens
tgaggctgttctaccagggcca

SEQ ID NO: 8252563 - DNA, 21 bp, Homo sapiens
tgaggctgttgtaccagggag

SEQ ID NO: 8252564 - DNA, 21 bp, Homo sapiens
tgaggctgttgtaccagggag

SEQ ID NO: 8252565 - DNA, 22 bp, Homo sapiens
tgaggctgttctaccagggcca

SEQ ID NO: 8252566 - DNA, 22 bp, Homo sapiens
tgaggctggcaaggctggtatt

SEQ ID NO: 8252567 - DNA, 22 bp, Homo sapiens
tgaggctgttctaccagggcca

SEQ ID NO: 8252568 - DNA, 22 bp, Homo sapiens
tgaggctgttctaccagggcca

SEQ ID NO: 8252569 - DNA, 22 bp, Homo sapiens
tgaggcttggagaggtcaggga

SEQ ID NO: 8252570 - DNA, 21 bp, Homo sapiens
tgaggctgttgtaccagggag

SEQ ID NO: 8252571 - DNA, 21 bp, Homo sapiens
tgaggctgttgtaccagggag

SEQ ID NO: 8252572 - DNA, 21 bp, Homo sapiens
tgaggctgttgtaccagggag

SEQ ID NO: 8252573 - DNA, 21 bp, Homo sapiens
tgaggctgttgtaccagggag

SEQ ID NO: 8252574 - DNA, 22 bp, Homo sapiens
tgaggctggatgggatgcctcc

SEQ ID NO: 8252575 - DNA, 22 bp, Homo sapiens
tgaggctgccttgggaagaggg

SEQ ID NO: 8252576 - DNA, 22 bp, Homo sapiens
tgaggctgccttgggaagaggg

SEQ ID NO: 8252577 - DNA, 22 bp, Homo sapiens
tgaggctgccttgggaagaggg

SEQ ID NO: 8252578 - DNA, 22 bp, Homo sapiens
tgaggctggcaaggctggtatt

SEQ ID NO: 8252579 - DNA, 22 bp, Homo sapiens
tgaggctggcaaggctggtatt

SEQ ID NO: 8252580 - DNA, 22 bp, Homo sapiens
tgaggctggatgggatgcctcc

SEQ ID NO: 8252581 - DNA, 22 bp, Homo sapiens
tgaggctgccttgggaagaggg

SEQ ID NO: 8252582 - DNA, 22 bp, Homo sapiens
tgaggctgccttgggaagaggg

SEQ ID NO: 8252583 - DNA, 22 bp, Homo sapiens
tgaggctctgcttctgtggctc

SEQ ID NO: 8252584 - DNA, 21 bp, Homo sapiens
tgaggctctgttgtgcctgca

SEQ ID NO: 8252585 - DNA, 17 bp, Homo sapiens
tgaggctcggtgaggag

SEQ ID NO: 8252586 - DNA, 17 bp, Homo sapiens
tgaggctcggtgaggag

SEQ ID NO: 8252587 - DNA, 22 bp, Homo sapiens
tgaggctctccaagcagatgag

SEQ ID NO: 8252588 - DNA, 22 bp, Homo sapiens
tgaggctctatgtggtagatta

SEQ ID NO: 8252589 - DNA, 22 bp, Homo sapiens
tgaggctcagagaagtgctgtt

SEQ ID NO: 8252590 - DNA, 22 bp, Homo sapiens
tgaggctcagagaagtgctgtt

SEQ ID NO: 8252591 - DNA, 22 bp, Homo sapiens
tgaggctcagaaatgtaagttt

SEQ ID NO: 8252592 - DNA, 22 bp, Homo sapiens
tgaggctcagaaatgtaagttt

SEQ ID NO: 8252593 - DNA, 22 bp, Homo sapiens
tgaggctcacgaacagaagact

SEQ ID NO: 8252594 - DNA, 22 bp, Homo sapiens
tgaggctcagaagtgccaagtg

SEQ ID NO: 8252595 - DNA, 22 bp, Homo sapiens
tgaggctcagagaacagtgact

SEQ ID NO: 8252596 - DNA, 22 bp, Homo sapiens
tgaggctccttgtagagagtgg

SEQ ID NO: 8252597 - DNA, 22 bp, Homo sapiens
tgaggctcattctgcatgccaa

SEQ ID NO: 8252598 - DNA, 18 bp, Homo sapiens
tgaggctcagctcctggt

SEQ ID NO: 8252599 - DNA, 22 bp, Homo sapiens
tgaggctcagtgagccctgcag

SEQ ID NO: 8252600 - DNA, 20 bp, Homo sapiens
tgaggctcagagaggttgag

SEQ ID NO: 8252601 - DNA, 20 bp, Homo sapiens
tgaggctcagagaggttgag

SEQ ID NO: 8252602 - DNA, 22 bp, Homo sapiens
tgaggctcagagcacctgctcc

SEQ ID NO: 8252603 - DNA, 22 bp, Homo sapiens
tgaggcctggactctgcatgga

SEQ ID NO: 8252604 - DNA, 21 bp, Homo sapiens
tgaggcctgccagtctcagaa

SEQ ID NO: 8252605 - DNA, 22 bp, Homo sapiens
tgaggcctggagggaggagttt

SEQ ID NO: 8252606 - DNA, 22 bp, Homo sapiens
tgaggctcacaaatctgcattt

SEQ ID NO: 8252607 - DNA, 22 bp, Homo sapiens
tgaggctcaagaatctgcattt

SEQ ID NO: 8252608 - DNA, 22 bp, Homo sapiens
tgaggctcaagaatagacagta

SEQ ID NO: 8252609 - DNA, 22 bp, Homo sapiens
tgaggctcaagaaagatttgtt

SEQ ID NO: 8252610 - DNA, 22 bp, Homo sapiens
tgaggctcaagaaagatttgtt

SEQ ID NO: 8252611 - DNA, 22 bp, Homo sapiens
tgaggctaaaggtgaccagatt

SEQ ID NO: 8252612 - DNA, 22 bp, Homo sapiens
tgagggagttgggtgtatagga

SEQ ID NO: 8252613 - DNA, 22 bp, Homo sapiens
tgagggagtgtggatacagtag

SEQ ID NO: 8252614 - DNA, 22 bp, Homo sapiens
tgagggagtgtggatacagtag

SEQ ID NO: 8252615 - DNA, 22 bp, Homo sapiens
tgagggagtgtggatacagtag

SEQ ID NO: 8252616 - DNA, 22 bp, Homo sapiens
tgagggagtgtggatacagtag

SEQ ID NO: 8252617 - DNA, 22 bp, Homo sapiens
tgagggagtcatgattaaggaa

SEQ ID NO: 8252618 - DNA, 22 bp, Homo sapiens
tgaggggaactgatgcccattg

SEQ ID NO: 8252619 - DNA, 22 bp, Homo sapiens
tgaggggagaagcagcagcctg

SEQ ID NO: 8252620 - DNA, 22 bp, Homo sapiens
tgaggggagacagagtggactc

SEQ ID NO: 8252621 - DNA, 22 bp, Homo sapiens
tgaggggagacagagtggactc

SEQ ID NO: 8252622 - DNA, 22 bp, Homo sapiens
tgaggggagacagagtggactc

SEQ ID NO: 8252623 - DNA, 22 bp, Homo sapiens
tgaggggagcccgccctggacg

SEQ ID NO: 8252624 - DNA, 22 bp, Homo sapiens
tgaggggagcccgccctggacg

SEQ ID NO: 8252625 - DNA, 22 bp, Homo sapiens
tgaggggagctagcatgccttg

SEQ ID NO: 8252626 - DNA, 22 bp, Homo sapiens
tgaggggagcccgccctggacg

SEQ ID NO: 8252627 - DNA, 22 bp, Homo sapiens
tgaggggagcccgccctggacg

SEQ ID NO: 8252628 - DNA, 19 bp, Homo sapiens
tgaggggaggagaggcctg

SEQ ID NO: 8252629 - DNA, 22 bp, Homo sapiens
tgaggggaggttggggcacatc

SEQ ID NO: 8252630 - DNA, 22 bp, Homo sapiens
tgaggggaggttggggcacatc

SEQ ID NO: 8252631 - DNA, 22 bp, Homo sapiens
tgagggagctgacctttctgtg

SEQ ID NO: 8252632 - DNA, 22 bp, Homo sapiens
tgagggagctgacctttctgtg

SEQ ID NO: 8252633 - DNA, 22 bp, Homo sapiens
tgagggagcacacactgaagtg

SEQ ID NO: 8252634 - DNA, 22 bp, Homo sapiens
tgagggaggccctttgagcaga

SEQ ID NO: 8252635 - DNA, 20 bp, Homo sapiens
tgagggagtattgatttccc

SEQ ID NO: 8252636 - DNA, 22 bp, Homo sapiens
tgagggaggcctccatctgcca

SEQ ID NO: 8252637 - DNA, 22 bp, Homo sapiens
tgagggaggcctccatctgcca

SEQ ID NO: 8252638 - DNA, 22 bp, Homo sapiens
tgagggagagggcgaaaatgaa

SEQ ID NO: 8252639 - DNA, 22 bp, Homo sapiens
tgagggacttgctagttctctg

SEQ ID NO: 8252640 - DNA, 19 bp, Homo sapiens
tgagggacattgggagcag

SEQ ID NO: 8252641 - DNA, 22 bp, Homo sapiens
tgagggacttgctagttctctg

SEQ ID NO: 8252642 - DNA, 22 bp, Homo sapiens
tgagggagagggcgaaaatgaa

SEQ ID NO: 8252643 - DNA, 22 bp, Homo sapiens
tgagggaatattgatagatccg

SEQ ID NO: 8252644 - DNA, 22 bp, Homo sapiens
tgagggaatattgatagatccg

SEQ ID NO: 8252645 - DNA, 22 bp, Homo sapiens
tgagggaatcctcacatcaatc

SEQ ID NO: 8252646 - DNA, 23 bp, Homo sapiens
tgagggacatggtggcttctgag

SEQ ID NO: 8252647 - DNA, 23 bp, Homo sapiens
tgagggacatggtggcttctgag

SEQ ID NO: 8252648 - DNA, 19 bp, Homo sapiens
tgagggacattgggagcag

SEQ ID NO: 8252649 - DNA, 22 bp, Homo sapiens
tgaggcttggaggctccagtgg

SEQ ID NO: 8252650 - DNA, 22 bp, Homo sapiens
tgaggcttggaggctccagtgg

SEQ ID NO: 8252651 - DNA, 22 bp, Homo sapiens
tgaggtgggcttgtggatttgc

SEQ ID NO: 8252652 - DNA, 22 bp, Homo sapiens
tgaggtgggcttgtggatttgc

SEQ ID NO: 8252653 - DNA, 22 bp, Homo sapiens
tgaggtgggtgtcaggtcagag

SEQ ID NO: 8252654 - DNA, 22 bp, Homo sapiens
tgaggtggctagggaggcactc

SEQ ID NO: 8252655 - DNA, 22 bp, Homo sapiens
tgaggtggctagggaggcactc

SEQ ID NO: 8252656 - DNA, 22 bp, Homo sapiens
tgaggtggctggatctcagcct

SEQ ID NO: 8252657 - DNA, 22 bp, Homo sapiens
tgaggtgataataactccctgc

SEQ ID NO: 8252658 - DNA, 22 bp, Homo sapiens
tgaggtgatacagaccctactt

SEQ ID NO: 8252659 - DNA, 22 bp, Homo sapiens
tgaggtgccacccaagagcctt

SEQ ID NO: 8252660 - DNA, 22 bp, Homo sapiens
tgaggtggctagggaggcactc

SEQ ID NO: 8252661 - DNA, 22 bp, Homo sapiens
tgaggtggccgaggagcaggac

SEQ ID NO: 8252662 - DNA, 22 bp, Homo sapiens
tgaggtggccgaggagcaggac

SEQ ID NO: 8252663 - DNA, 22 bp, Homo sapiens
tgaggtggccgaggagcaggac

SEQ ID NO: 8252664 - DNA, 22 bp, Homo sapiens
tgaggtggccgaggagcaggac

SEQ ID NO: 8252665 - DNA, 22 bp, Homo sapiens
tgaggtggttcaagagccttgt

SEQ ID NO: 8252666 - DNA, 22 bp, Homo sapiens
tgaggtggtttgtatcactggg

SEQ ID NO: 8252667 - DNA, 22 bp, Homo sapiens
tgaggttatgcttgttgaggtt

SEQ ID NO: 8252668 - DNA, 22 bp, Homo sapiens
tgaggttagctgggatttcatg

SEQ ID NO: 8252669 - DNA, 22 bp, Homo sapiens
tgaggtggtgctaatctctgct

SEQ ID NO: 8252670 - DNA, 22 bp, Homo sapiens
tgaggtggttactgtggtgctc

SEQ ID NO: 8252671 - DNA, 22 bp, Homo sapiens
tgaggtggttactgtggtgctc

SEQ ID NO: 8252672 - DNA, 22 bp, Homo sapiens
tgaggtggtccaaagactgttt

SEQ ID NO: 8252673 - DNA, 22 bp, Homo sapiens
tgaggtggtccaaagactgttt

SEQ ID NO: 8252674 - DNA, 22 bp, Homo sapiens
tgaggtgggtgtcaggtcagag

SEQ ID NO: 8252675 - DNA, 22 bp, Homo sapiens
tgagtaggtggttaagcatgga

SEQ ID NO: 8252676 - DNA, 22 bp, Homo sapiens
tgagtataaaacatatacatca

SEQ ID NO: 8252677 - DNA, 22 bp, Homo sapiens
tgagtatacaatggcactgcca

SEQ ID NO: 8252678 - DNA, 22 bp, Homo sapiens
tgagtatacactcctaagggta

SEQ ID NO: 8252679 - DNA, 22 bp, Homo sapiens
tgagtatatgatttgtgtttgc

SEQ ID NO: 8252680 - DNA, 22 bp, Homo sapiens
tgagtatattaatttgccagca

SEQ ID NO: 8252681 - DNA, 22 bp, Homo sapiens
tgagtatagaaagtcacccttt

SEQ ID NO: 8252682 - DNA, 22 bp, Homo sapiens
tgagtatagcatgatgggccat

SEQ ID NO: 8252683 - DNA, 22 bp, Homo sapiens
tgagtatatacccagaagtgga

SEQ ID NO: 8252684 - DNA, 22 bp, Homo sapiens
tgagtagacgtgatctagtaac

SEQ ID NO: 8252685 - DNA, 22 bp, Homo sapiens
tgagtagagaattcagctaagg

SEQ ID NO: 8252686 - DNA, 22 bp, Homo sapiens
tgagtagagaattcagctaagg

SEQ ID NO: 8252687 - DNA, 17 bp, Homo sapiens
tgagtagggaagaggag

SEQ ID NO: 8252688 - DNA, 22 bp, Homo sapiens
tgagtactttatgttagttatt

SEQ ID NO: 8252689 - DNA, 22 bp, Homo sapiens
tgagtactcttctcactacacc

SEQ ID NO: 8252690 - DNA, 22 bp, Homo sapiens
tgagtagagaattcagctaagg

SEQ ID NO: 8252691 - DNA, 22 bp, Homo sapiens
tgaggttatttattatgcatga

SEQ ID NO: 8252692 - DNA, 22 bp, Homo sapiens
tgagtcacacatttcttcatac

SEQ ID NO: 8252693 - DNA, 22 bp, Homo sapiens
tgagtatattgagtttagggca

SEQ ID NO: 8252694 - DNA, 22 bp, Homo sapiens
tgagtatattttccctgggtgg

SEQ ID NO: 8252695 - DNA, 22 bp, Homo sapiens
tgagtatcaattacatagttgt

SEQ ID NO: 8252696 - DNA, 22 bp, Homo sapiens
tgagtcacatccatttttgtgt

SEQ ID NO: 8252697 - DNA, 23 bp, Homo sapiens
tgagtcttgagctttggattctg

SEQ ID NO: 8252698 - DNA, 22 bp, Homo sapiens
tgagggtggccttgtgtggact

SEQ ID NO: 8252699 - DNA, 22 bp, Homo sapiens
tgagggtggccttgtgtggact

SEQ ID NO: 8252700 - DNA, 22 bp, Homo sapiens
tgagggtgggccctgggcatct

SEQ ID NO: 8252701 - DNA, 22 bp, Homo sapiens
tgagggtgggccctgggcatct

SEQ ID NO: 8252702 - DNA, 22 bp, Homo sapiens
tgagggtgggcctgcaggaaga

SEQ ID NO: 8252703 - DNA, 22 bp, Homo sapiens
tgagggtttttgagcagtgatt

SEQ ID NO: 8252704 - DNA, 22 bp, Homo sapiens
tgagggtttccgggcagtggac

SEQ ID NO: 8252705 - DNA, 22 bp, Homo sapiens
tgaggtagaagcctgggttgag

SEQ ID NO: 8252706 - DNA, 22 bp, Homo sapiens
tgaggtacactaaatttgtctt

SEQ ID NO: 8252707 - DNA, 22 bp, Homo sapiens
tgaggtagagattgtgactgta

SEQ ID NO: 8252708 - DNA, 22 bp, Homo sapiens
tgaggtgaggttgaggaaagaa

SEQ ID NO: 8252709 - DNA, 22 bp, Homo sapiens
tgaggtgagcatctttatcttc

SEQ ID NO: 8252710 - DNA, 22 bp, Homo sapiens
tgaggtgagtcatgcattggag

SEQ ID NO: 8252711 - DNA, 22 bp, Homo sapiens
tgaggtgagtcatgcattggag

SEQ ID NO: 8252712 - DNA, 22 bp, Homo sapiens
tgaggtgagtcagtttctgatg

SEQ ID NO: 8252713 - DNA, 22 bp, Homo sapiens
tgaggtgacaattcattctcca

SEQ ID NO: 8252714 - DNA, 20 bp, Homo sapiens
tgaggtgaatgtcttttaga

SEQ ID NO: 8252715 - DNA, 22 bp, Homo sapiens
tgaggtgaatggtgtccctgga

SEQ ID NO: 8252716 - DNA, 22 bp, Homo sapiens
tgaggtgaccgcagatgggaag

SEQ ID NO: 8252717 - DNA, 22 bp, Homo sapiens
tgaggtgacacaatttactcca

SEQ ID NO: 8252718 - DNA, 22 bp, Homo sapiens
tgaggtgagatggctaccccaa

SEQ ID NO: 8252719 - DNA, 22 bp, Homo sapiens
tgaggtctgtcctgtctttgga

SEQ ID NO: 8252720 - DNA, 22 bp, Homo sapiens
tgaggtcttttatagtgtgtca

SEQ ID NO: 8252721 - DNA, 22 bp, Homo sapiens
tgaggtgaagagtggagctcag

SEQ ID NO: 8252722 - DNA, 22 bp, Homo sapiens
tgaggtcttttatagtgtgtca

SEQ ID NO: 8252723 - DNA, 22 bp, Homo sapiens
tgaggtgaagagtggagctcag

SEQ ID NO: 8252724 - DNA, 22 bp, Homo sapiens
tgaggtcttttatagtgtgtca

SEQ ID NO: 8252725 - DNA, 22 bp, Homo sapiens
tgaggtgaagagtggagctcag

SEQ ID NO: 8252726 - DNA, 22 bp, Homo sapiens
tgaggtgaaggagttttaaagt

SEQ ID NO: 8252727 - DNA, 22 bp, Homo sapiens
tgaggtgaatggtgtccctgga

SEQ ID NO: 8252728 - DNA, 22 bp, Homo sapiens
tgaggtgaatggtgtccctgga

SEQ ID NO: 8252729 - DNA, 22 bp, Homo sapiens
tgaggtctcagctgggaagact

SEQ ID NO: 8252730 - DNA, 22 bp, Homo sapiens
tgaggtctgcagggctgtgcat

SEQ ID NO: 8252731 - DNA, 22 bp, Homo sapiens
tgaggtaggataagacaatgag

SEQ ID NO: 8252732 - DNA, 22 bp, Homo sapiens
tgaggtctgcagggctgtgcat

SEQ ID NO: 8252733 - DNA, 22 bp, Homo sapiens
tgaggtctgctcaagtccctgg

SEQ ID NO: 8252734 - DNA, 19 bp, Homo sapiens
tgaggggctcacagtctca

SEQ ID NO: 8252735 - DNA, 22 bp, Homo sapiens
tgaggggcgctggcaggttcct

SEQ ID NO: 8252736 - DNA, 22 bp, Homo sapiens
tgaggggccgcccaagcacttc

SEQ ID NO: 8252737 - DNA, 22 bp, Homo sapiens
tgaggggccagaccccacctag

SEQ ID NO: 8252738 - DNA, 22 bp, Homo sapiens
tgaggggcggcctgcagaggcc

SEQ ID NO: 8252739 - DNA, 22 bp, Homo sapiens
tgaggggggtaatcactgggtt

SEQ ID NO: 8252740 - DNA, 22 bp, Homo sapiens
tgaggggtaagtaaaggaattg

SEQ ID NO: 8252741 - DNA, 22 bp, Homo sapiens
tgaggggttaccttggagttga

SEQ ID NO: 8252742 - DNA, 22 bp, Homo sapiens
tgaggggtctaggctgcgcacc

SEQ ID NO: 8252743 - DNA, 22 bp, Homo sapiens
tgagggggttaattaggagagt

SEQ ID NO: 8252744 - DNA, 22 bp, Homo sapiens
tgagggtaacctggagctgctg

SEQ ID NO: 8252745 - DNA, 22 bp, Homo sapiens
tgaggggttgtgagaaatgtag

SEQ ID NO: 8252746 - DNA, 22 bp, Homo sapiens
tgagggtagctggatcacggag

SEQ ID NO: 8252747 - DNA, 22 bp, Homo sapiens
tgagggtagaggcaggagtgca

SEQ ID NO: 8252748 - DNA, 19 bp, Homo sapiens
tgagggtgagctttggaga

SEQ ID NO: 8252749 - DNA, 22 bp, Homo sapiens
tgagggtggcacaggcacaaag

SEQ ID NO: 8252750 - DNA, 22 bp, Homo sapiens
tgagggtggcacaggcacaaag

SEQ ID NO: 8252751 - DNA, 22 bp, Homo sapiens
tgagggtgcatttagcatgtag

SEQ ID NO: 8252752 - DNA, 22 bp, Homo sapiens
tgagggtgcatttagcatgtag

SEQ ID NO: 8252753 - DNA, 22 bp, Homo sapiens
tgcatggcttgtgagggtttga

SEQ ID NO: 8252754 - DNA, 20 bp, Homo sapiens
tgcatggcgcacatctgtgg

SEQ ID NO: 8252755 - DNA, 19 bp, Homo sapiens
tgcatggcagatttaactt

SEQ ID NO: 8252756 - DNA, 22 bp, Homo sapiens
tgcatggttatatactactagt

SEQ ID NO: 8252757 - DNA, 22 bp, Homo sapiens
tgcatggtgaatacagttcatt

SEQ ID NO: 8252758 - DNA, 22 bp, Homo sapiens
tgcatggtttgtgaattatacc

SEQ ID NO: 8252759 - DNA, 22 bp, Homo sapiens
tgcatggtttgtgaattatacc

SEQ ID NO: 8252760 - DNA, 22 bp, Homo sapiens
tgcatggtaaccaggatgtcta

SEQ ID NO: 8252761 - DNA, 23 bp, Homo sapiens
tgcatggggctatactgctgttc

SEQ ID NO: 8252762 - DNA, 22 bp, Homo sapiens
tgcatgtatttaaagttgcaat

SEQ ID NO: 8252763 - DNA, 22 bp, Homo sapiens
tgcatgtaggatgcatctacat

SEQ ID NO: 8252764 - DNA, 17 bp, Homo sapiens
tgcatgtcctttgttcc

SEQ ID NO: 8252765 - DNA, 17 bp, Homo sapiens
tgcatgtcctttgttcc

SEQ ID NO: 8252766 - DNA, 23 bp, Homo sapiens
tgcatgtgaattcatacttgttt

SEQ ID NO: 8252767 - DNA, 23 bp, Homo sapiens
tgcatgtgaattcatacttgttt

SEQ ID NO: 8252768 - DNA, 23 bp, Homo sapiens
tgcatgtgaattcatacttgttt

SEQ ID NO: 8252769 - DNA, 22 bp, Homo sapiens
tgcatgtttctgtatgttaatg

SEQ ID NO: 8252770 - DNA, 22 bp, Homo sapiens
tgcatgttatagaattttaact

SEQ ID NO: 8252771 - DNA, 22 bp, Homo sapiens
tgcatgttattgtggcaagaat

SEQ ID NO: 8252772 - DNA, 22 bp, Homo sapiens
tgcatgttatagaattttaact

SEQ ID NO: 8252773 - DNA, 22 bp, Homo sapiens
tgcatgttaagaaaatattgag

SEQ ID NO: 8252774 - DNA, 22 bp, Homo sapiens
tgcatgtgtttgccacagtgag

SEQ ID NO: 8252775 - DNA, 22 bp, Homo sapiens
tgcatgtgtttgccacagtgag

SEQ ID NO: 8252776 - DNA, 22 bp, Homo sapiens
tgcattccatgtgtttcctgag

SEQ ID NO: 8252777 - DNA, 22 bp, Homo sapiens
tgcatgtgtcgggcctgtgcta

SEQ ID NO: 8252778 - DNA, 22 bp, Homo sapiens
tgcatgtggatcatatgtccta

SEQ ID NO: 8252779 - DNA, 19 bp, Homo sapiens
tgcatgtgttctcccattg

SEQ ID NO: 8252780 - DNA, 22 bp, Homo sapiens
tgcatgtgtgtgtatttataaa

SEQ ID NO: 8252781 - DNA, 22 bp, Homo sapiens
tgcatctttctgcatatgtaaa

SEQ ID NO: 8252782 - DNA, 22 bp, Homo sapiens
tgcatgatagagatggtattag

SEQ ID NO: 8252783 - DNA, 22 bp, Homo sapiens
tgcatgatgactaaggtggtga

SEQ ID NO: 8252784 - DNA, 22 bp, Homo sapiens
tgcatgatggtttagatggggt

SEQ ID NO: 8252785 - DNA, 22 bp, Homo sapiens
tgcatgatgttaaacatcaggt

SEQ ID NO: 8252786 - DNA, 22 bp, Homo sapiens
tgcatgcaacaattcttctata

SEQ ID NO: 8252787 - DNA, 22 bp, Homo sapiens
tgcatgcacttggctggcacgt

SEQ ID NO: 8252788 - DNA, 22 bp, Homo sapiens
tgcatgcagcatatgaggcctc

SEQ ID NO: 8252789 - DNA, 22 bp, Homo sapiens
tgcatgcactatctagatgatg

SEQ ID NO: 8252790 - DNA, 22 bp, Homo sapiens
tgcatgcacgtgctatgtatga

SEQ ID NO: 8252791 - DNA, 22 bp, Homo sapiens
tgcatgcacgtatctgcgtgtg

SEQ ID NO: 8252792 - DNA, 22 bp, Homo sapiens
tgcatgcacgtatctgcgtgtg

SEQ ID NO: 8252793 - DNA, 22 bp, Homo sapiens
tgcatgcttcctgtaagtacct

SEQ ID NO: 8252794 - DNA, 22 bp, Homo sapiens
tgcatgcttcctgtaagtacct

SEQ ID NO: 8252795 - DNA, 22 bp, Homo sapiens
tgcatgctttcagaaatagggc

SEQ ID NO: 8252796 - DNA, 22 bp, Homo sapiens
tgcatgcatgtgagcatgcata

SEQ ID NO: 8252797 - DNA, 22 bp, Homo sapiens
tgcatgcatgtttttacccaca

SEQ ID NO: 8252798 - DNA, 22 bp, Homo sapiens
tgcatgcatgctactgggaggt

SEQ ID NO: 8252799 - DNA, 22 bp, Homo sapiens
tgcatgcataaatgtacacaca

SEQ ID NO: 8252800 - DNA, 22 bp, Homo sapiens
tgcatgcataaatgtacacaca

SEQ ID NO: 8252801 - DNA, 22 bp, Homo sapiens
tgcatgcatgatgtttggtagc

SEQ ID NO: 8252802 - DNA, 22 bp, Homo sapiens
tgcatgctaagaaatagcagct

SEQ ID NO: 8252803 - DNA, 21 bp, Homo sapiens
tgcatgctatgtttttatttc

SEQ ID NO: 8252804 - DNA, 22 bp, Homo sapiens
tgcataaagtgccatagtatta

SEQ ID NO: 8252805 - DNA, 22 bp, Homo sapiens
tgcataaagtgccatagtatta

SEQ ID NO: 8252806 - DNA, 19 bp, Homo sapiens
tgcataaattatatacttt

SEQ ID NO: 8252807 - DNA, 21 bp, Homo sapiens
tgcataaagaaatacaaatac

SEQ ID NO: 8252808 - DNA, 22 bp, Homo sapiens
tgcataaaatatgagaaatgta

SEQ ID NO: 8252809 - DNA, 22 bp, Homo sapiens
tgcataaaatatgagaaatgta

SEQ ID NO: 8252810 - DNA, 22 bp, Homo sapiens
tgcataaaacatgatttctgct

SEQ ID NO: 8252811 - DNA, 22 bp, Homo sapiens
tgcataaacagatacttcatgt

SEQ ID NO: 8252812 - DNA, 22 bp, Homo sapiens
tgcagttcaaggttgtacagct

SEQ ID NO: 8252813 - DNA, 22 bp, Homo sapiens
tgcatcattaaggtacagttgg

SEQ ID NO: 8252814 - DNA, 22 bp, Homo sapiens
tgcatcattaaggtacagttgg

SEQ ID NO: 8252815 - DNA, 22 bp, Homo sapiens
tgcatcatttataatgtctttg

SEQ ID NO: 8252816 - DNA, 22 bp, Homo sapiens
tgcatcagtgactgaatatgag

SEQ ID NO: 8252817 - DNA, 22 bp, Homo sapiens
tgcatcagtgactgggagataa

SEQ ID NO: 8252818 - DNA, 22 bp, Homo sapiens
tgcatctgttcagagctgtcga

SEQ ID NO: 8252819 - DNA, 22 bp, Homo sapiens
tgcatctggcctttgctggcta

SEQ ID NO: 8252820 - DNA, 22 bp, Homo sapiens
tgcatatacccgcatttacata

SEQ ID NO: 8252821 - DNA, 20 bp, Homo sapiens
tgcatagttgctgcagttga

SEQ ID NO: 8252822 - DNA, 22 bp, Homo sapiens
tgcatagttctccttcctcctc

SEQ ID NO: 8252823 - DNA, 19 bp, Homo sapiens
tgcataaattatatacttt

SEQ ID NO: 8252824 - DNA, 22 bp, Homo sapiens
tgcatacataaagtgctatcat

SEQ ID NO: 8252825 - DNA, 22 bp, Homo sapiens
tgcatacataaagtgctatcat

SEQ ID NO: 8252826 - DNA, 22 bp, Homo sapiens
tgcatacacacatcaaatgttt

SEQ ID NO: 8252827 - DNA, 22 bp, Homo sapiens
tgcatacacatgtgcacatacg

SEQ ID NO: 8252828 - DNA, 22 bp, Homo sapiens
tgccagcccaccttggggcctc

SEQ ID NO: 8252829 - DNA, 22 bp, Homo sapiens
tgccagccaggttctgaggcta

SEQ ID NO: 8252830 - DNA, 22 bp, Homo sapiens
tgccagccaggttctgaggcta

SEQ ID NO: 8252831 - DNA, 22 bp, Homo sapiens
tgccagccagggaagctcaccc

SEQ ID NO: 8252832 - DNA, 21 bp, Homo sapiens
tgccagcattaaacagtcatt

SEQ ID NO: 8252833 - DNA, 21 bp, Homo sapiens
tgccagcatgtaggctagttg

SEQ ID NO: 8252834 - DNA, 19 bp, Homo sapiens
tgccagcattaggctgaag

SEQ ID NO: 8252835 - DNA, 22 bp, Homo sapiens
tgccagcagtagcagtaggcca

SEQ ID NO: 8252836 - DNA, 23 bp, Homo sapiens
tgccagcagggaatgggaaggac

SEQ ID NO: 8252837 - DNA, 23 bp, Homo sapiens
tgccagaggcagtcacagtggtg

SEQ ID NO: 8252838 - DNA, 22 bp, Homo sapiens
tgccagagttacatgagggtca

SEQ ID NO: 8252839 - DNA, 22 bp, Homo sapiens
tgccagattgtggcatggcact

SEQ ID NO: 8252840 - DNA, 22 bp, Homo sapiens
tgccagcacttctggctgtctg

SEQ ID NO: 8252841 - DNA, 22 bp, Homo sapiens
tgccagcacttctggctgtctg

SEQ ID NO: 8252842 - DNA, 22 bp, Homo sapiens
tgccagcacttctggctgtctg

SEQ ID NO: 8252843 - DNA, 22 bp, Homo sapiens
tgccagcacaagttaagagatc

SEQ ID NO: 8252844 - DNA, 23 bp, Homo sapiens
tgccagaggcagtcacagtggtg

SEQ ID NO: 8252845 - DNA, 23 bp, Homo sapiens
tgccagaggcagtcacagtggtg

SEQ ID NO: 8252846 - DNA, 23 bp, Homo sapiens
tgccagaggcagtcacagtggtg

SEQ ID NO: 8252847 - DNA, 22 bp, Homo sapiens
tgccagagatttcacactgcta

SEQ ID NO: 8252848 - DNA, 22 bp, Homo sapiens
tgccagagatttcacactgcta

SEQ ID NO: 8252849 - DNA, 22 bp, Homo sapiens
tgccagagagtggctgggtgtc

SEQ ID NO: 8252850 - DNA, 22 bp, Homo sapiens
tgccaaattgccctataaatga

SEQ ID NO: 8252851 - DNA, 22 bp, Homo sapiens
tgccaaattgaattacataatt

SEQ ID NO: 8252852 - DNA, 22 bp, Homo sapiens
tgccacaggcaatccctgcacg

SEQ ID NO: 8252853 - DNA, 17 bp, Homo sapiens
tgccaagaagagcagag

SEQ ID NO: 8252854 - DNA, 22 bp, Homo sapiens
tgccacagggtcctcaggccag

SEQ ID NO: 8252855 - DNA, 22 bp, Homo sapiens
tgccacagttgtttgtgctcta

SEQ ID NO: 8252856 - DNA, 22 bp, Homo sapiens
tgccaagagggcagagggcagt

SEQ ID NO: 8252857 - DNA, 22 bp, Homo sapiens
tgccacatggtgcatttcctag

SEQ ID NO: 8252858 - DNA, 22 bp, Homo sapiens
tgccacagttgtttgtgctcta

SEQ ID NO: 8252859 - DNA, 22 bp, Homo sapiens
tgccaccccggaccccgaagtg

SEQ ID NO: 8252860 - DNA, 22 bp, Homo sapiens
tgccaccatctggctgtgttga

SEQ ID NO: 8252861 - DNA, 22 bp, Homo sapiens
tgccagagaagacccagtcact

SEQ ID NO: 8252862 - DNA, 22 bp, Homo sapiens
tgccagaagtgctttataagtg

SEQ ID NO: 8252863 - DNA, 22 bp, Homo sapiens
tgccagaaccattcaatgtgaa

SEQ ID NO: 8252864 - DNA, 23 bp, Homo sapiens
tgccacccttctcttcccagctt

SEQ ID NO: 8252865 - DNA, 22 bp, Homo sapiens
tgccaccctggcggcagcctgc

SEQ ID NO: 8252866 - DNA, 22 bp, Homo sapiens
tgccaccctctctgctacccgc

SEQ ID NO: 8252867 - DNA, 22 bp, Homo sapiens
tgccacccctctgcaccctcag

SEQ ID NO: 8252868 - DNA, 22 bp, Homo sapiens
tgccacccctctgcaccctcag

SEQ ID NO: 8252869 - DNA, 22 bp, Homo sapiens
tgccacccctctgcaccctcag

SEQ ID NO: 8252870 - DNA, 19 bp, Homo sapiens
tgccaaatccatgcccagg

SEQ ID NO: 8252871 - DNA, 22 bp, Homo sapiens
tgccaaaatgggctttataccg

SEQ ID NO: 8252872 - DNA, 22 bp, Homo sapiens
tgcatttttgaggttaactcaa

SEQ ID NO: 8252873 - DNA, 22 bp, Homo sapiens
tgccaaaatggccaaaagctag

SEQ ID NO: 8252874 - DNA, 22 bp, Homo sapiens
tgcatttttaacaaggctaatt

SEQ ID NO: 8252875 - DNA, 22 bp, Homo sapiens
tgcatttgttcagtgaaatgtt

SEQ ID NO: 8252876 - DNA, 22 bp, Homo sapiens
tgcatttatttgaattgatcta

SEQ ID NO: 8252877 - DNA, 22 bp, Homo sapiens
tgcatttatttgaattgatcta

SEQ ID NO: 8252878 - DNA, 22 bp, Homo sapiens
tgcatttattaccaggctttca

SEQ ID NO: 8252879 - DNA, 22 bp, Homo sapiens
tgcatttattaccaggctttca

SEQ ID NO: 8252880 - DNA, 22 bp, Homo sapiens
tgcatttatgtctcccaccagc

SEQ ID NO: 8252881 - DNA, 22 bp, Homo sapiens
tgcatttatgtctcccaccagc

SEQ ID NO: 8252882 - DNA, 22 bp, Homo sapiens
tgcatttataaaatgttcgtgg

SEQ ID NO: 8252883 - DNA, 22 bp, Homo sapiens
tgcatttagttttaataaagga

SEQ ID NO: 8252884 - DNA, 22 bp, Homo sapiens
tgcatttagttttaataaagga

SEQ ID NO: 8252885 - DNA, 22 bp, Homo sapiens
tgcatttatggagcaaggcagt

SEQ ID NO: 8252886 - DNA, 22 bp, Homo sapiens
tgcatttatggagcaaggcagt

SEQ ID NO: 8252887 - DNA, 22 bp, Homo sapiens
tgcatttatggagcaaggcagt

SEQ ID NO: 8252888 - DNA, 22 bp, Homo sapiens
tgcatttatggagttacctcat

SEQ ID NO: 8252889 - DNA, 22 bp, Homo sapiens
tgcatttcagaagaaaattcgg

SEQ ID NO: 8252890 - DNA, 22 bp, Homo sapiens
tgcatttcagaagaaaattcgg

SEQ ID NO: 8252891 - DNA, 22 bp, Homo sapiens
tgcatttccagatttctggagt

SEQ ID NO: 8252892 - DNA, 22 bp, Homo sapiens
tgcatttccagatttctggagt

SEQ ID NO: 8252893 - DNA, 22 bp, Homo sapiens
tgcatttccagatttctggagt

SEQ ID NO: 8252894 - DNA, 22 bp, Homo sapiens
tgcatttcttttgagtatatgc

SEQ ID NO: 8252895 - DNA, 22 bp, Homo sapiens
tgcatttgctggggatgtgatt

SEQ ID NO: 8252896 - DNA, 22 bp, Homo sapiens
tgcatttgagttgggagcaggc

SEQ ID NO: 8252897 - DNA, 17 bp, Homo sapiens
tgcattgttggaaattt

SEQ ID NO: 8252898 - DNA, 22 bp, Homo sapiens
tgcattgtttgataggtgaatt

SEQ ID NO: 8252899 - DNA, 21 bp, Homo sapiens
tgcatttaacagaaacaggaa

SEQ ID NO: 8252900 - DNA, 21 bp, Homo sapiens
tgcatttaacagaaacaggaa

SEQ ID NO: 8252901 - DNA, 22 bp, Homo sapiens
tgcattgttgatgagttgaata

SEQ ID NO: 8252902 - DNA, 22 bp, Homo sapiens
tgcattgttgatgagttgaata

SEQ ID NO: 8252903 - DNA, 22 bp, Homo sapiens
tgcatttaatagatgctccctg

SEQ ID NO: 8252904 - DNA, 20 bp, Homo sapiens
tgcatttacagtgtggatac

SEQ ID NO: 8252905 - DNA, 22 bp, Homo sapiens
tgcatttaagaaaacatgagtc

SEQ ID NO: 8252906 - DNA, 22 bp, Homo sapiens
tgcatttaactagaatattaat

SEQ ID NO: 8252907 - DNA, 22 bp, Homo sapiens
tgcatttaactagaatattaat

SEQ ID NO: 8252908 - DNA, 22 bp, Homo sapiens
tgcatttaagaaaacatgagtc

SEQ ID NO: 8252909 - DNA, 22 bp, Homo sapiens
tgcatttaagaaaacatgagtc

SEQ ID NO: 8252910 - DNA, 22 bp, Homo sapiens
tgcatttacctggaggtcattt

SEQ ID NO: 8252911 - DNA, 22 bp, Homo sapiens
tgcatttacggtacaacagcag

SEQ ID NO: 8252912 - DNA, 22 bp, Homo sapiens
tgcatttacggtacaacagcag

SEQ ID NO: 8252913 - DNA, 20 bp, Homo sapiens
tgcatttacagtgtggatac

SEQ ID NO: 8252914 - DNA, 22 bp, Homo sapiens
tgcatttacctggaggtcattt

SEQ ID NO: 8252915 - DNA, 22 bp, Homo sapiens
tgcatttacctggaggtcattt

SEQ ID NO: 8252916 - DNA, 18 bp, Homo sapiens
tgcatttagtacatctag

SEQ ID NO: 8252917 - DNA, 18 bp, Homo sapiens
tgcatttagtacatctag

SEQ ID NO: 8252918 - DNA, 18 bp, Homo sapiens
tgcatttagtacatctag

SEQ ID NO: 8252919 - DNA, 22 bp, Homo sapiens
tgcatttagttatgagaaaaac

SEQ ID NO: 8252920 - DNA, 22 bp, Homo sapiens
tgcatttagttatgagaaaaac

SEQ ID NO: 8252921 - DNA, 22 bp, Homo sapiens
tgcatttagttatgagaaaaac

SEQ ID NO: 8252922 - DNA, 22 bp, Homo sapiens
tgcattggtcatttgaaaatat

SEQ ID NO: 8252923 - DNA, 22 bp, Homo sapiens
tgcattggtcttaatcttcagg

SEQ ID NO: 8252924 - DNA, 22 bp, Homo sapiens
tgcattggtcatttagaaaata

SEQ ID NO: 8252925 - DNA, 22 bp, Homo sapiens
tgcattggtaaaatacatacac

SEQ ID NO: 8252926 - DNA, 22 bp, Homo sapiens
tgcattgggttgacatactaaa

SEQ ID NO: 8252927 - DNA, 22 bp, Homo sapiens
tgcattgggagagattagggca

SEQ ID NO: 8252928 - DNA, 22 bp, Homo sapiens
tgcattgggagtcagtgctgaa

SEQ ID NO: 8252929 - DNA, 22 bp, Homo sapiens
tgcattggaaactcagcagcac

SEQ ID NO: 8252930 - DNA, 22 bp, Homo sapiens
tgcattggaaaactatggctca

SEQ ID NO: 8252931 - DNA, 22 bp, Homo sapiens
tgcattctgacttagttaatat

SEQ ID NO: 8252932 - DNA, 22 bp, Homo sapiens
tgcattcctttagcagatttga

SEQ ID NO: 8252933 - DNA, 22 bp, Homo sapiens
tgcattcctttgtctgttaaag

SEQ ID NO: 8252934 - DNA, 22 bp, Homo sapiens
tgcattcctttctaggatagct

SEQ ID NO: 8252935 - DNA, 22 bp, Homo sapiens
tgcagtggtggtaaagatgctc

SEQ ID NO: 8252936 - DNA, 22 bp, Homo sapiens
tgcagtggtggtaaagatgctc

SEQ ID NO: 8252937 - DNA, 22 bp, Homo sapiens
tgcagtggtgtccaggtgtact

SEQ ID NO: 8252938 - DNA, 22 bp, Homo sapiens
tgcagtggtgtccaggtgtact

SEQ ID NO: 8252939 - DNA, 22 bp, Homo sapiens
tgcagtgggccggaggccaggg

SEQ ID NO: 8252940 - DNA, 22 bp, Homo sapiens
tgcagtggcgccatctcagctc

SEQ ID NO: 8252941 - DNA, 22 bp, Homo sapiens
tgcagtggcgccatctcagctc

SEQ ID NO: 8252942 - DNA, 22 bp, Homo sapiens
tgcagtgggccggaggccaggg

SEQ ID NO: 8252943 - DNA, 22 bp, Homo sapiens
tgcagtgggccggaggccaggg

SEQ ID NO: 8252944 - DNA, 20 bp, Homo sapiens
tgcaggtgttggagaaggta

SEQ ID NO: 8252945 - DNA, 22 bp, Homo sapiens
tgcagtgtgacctgtagcgagc

SEQ ID NO: 8252946 - DNA, 22 bp, Homo sapiens
tgcagtggttgagagcccagac

SEQ ID NO: 8252947 - DNA, 22 bp, Homo sapiens
tgcagtggttgagagcccagac

SEQ ID NO: 8252948 - DNA, 22 bp, Homo sapiens
tgcagtgtttttcagggcatat

SEQ ID NO: 8252949 - DNA, 20 bp, Homo sapiens
tgcaggtgtgtccaagcact

SEQ ID NO: 8252950 - DNA, 22 bp, Homo sapiens
tgcaggtgtgtgcaagggaggg

SEQ ID NO: 8252951 - DNA, 20 bp, Homo sapiens
tgcaggtgttggagaaggta

SEQ ID NO: 8252952 - DNA, 22 bp, Homo sapiens
tgcaggtgtgtgcaagggaggg

SEQ ID NO: 8252953 - DNA, 22 bp, Homo sapiens
tgcaggtgtggttcctcagcca

SEQ ID NO: 8252954 - DNA, 22 bp, Homo sapiens
tgcaggtgtggttcctcagcca

SEQ ID NO: 8252955 - DNA, 22 bp, Homo sapiens
tgcaggtgtggttcctcagcca

SEQ ID NO: 8252956 - DNA, 20 bp, Homo sapiens
tgcaggtgtgtccaagcact

SEQ ID NO: 8252957 - DNA, 22 bp, Homo sapiens
tgcaggtgtggttcctcagcca

SEQ ID NO: 8252958 - DNA, 22 bp, Homo sapiens
tgcaggtgtgggcaggggagca

SEQ ID NO: 8252959 - DNA, 22 bp, Homo sapiens
tgcaggtgtgggcaggggagca

SEQ ID NO: 8252960 - DNA, 22 bp, Homo sapiens
tgcaggtgtgggcaggggagca

SEQ ID NO: 8252961 - DNA, 22 bp, Homo sapiens
tgcaggtgtgggcaggggagca

SEQ ID NO: 8252962 - DNA, 23 bp, Homo sapiens
tgcaggtgtgcagagggctcttg

SEQ ID NO: 8252963 - DNA, 23 bp, Homo sapiens
tgcaggtgtgcagagggctcttg

SEQ ID NO: 8252964 - DNA, 22 bp, Homo sapiens
tgcaggtgtctgggggcaacag

SEQ ID NO: 8252965 - DNA, 22 bp, Homo sapiens
tgcaggtgtctgggggcaacag

SEQ ID NO: 8252966 - DNA, 23 bp, Homo sapiens
tgcaggtgtgcagagggctcttg

SEQ ID NO: 8252967 - DNA, 22 bp, Homo sapiens
tgcaggtgtctctgtctagcgt

SEQ ID NO: 8252968 - DNA, 22 bp, Homo sapiens
tgcaggtgtctctgtctagcgt

SEQ ID NO: 8252969 - DNA, 22 bp, Homo sapiens
tgcaggtgtctgggggcaacag

SEQ ID NO: 8252970 - DNA, 22 bp, Homo sapiens
tgcaggtggtttggacactgct

SEQ ID NO: 8252971 - DNA, 22 bp, Homo sapiens
tgcaggtggtttggacactgct

SEQ ID NO: 8252972 - DNA, 22 bp, Homo sapiens
tgcaggtggtttggacactgct

SEQ ID NO: 8252973 - DNA, 22 bp, Homo sapiens
tgcaggtggtccttcctctgct

SEQ ID NO: 8252974 - DNA, 22 bp, Homo sapiens
tgcaggtggtccttcctctgct

SEQ ID NO: 8252975 - DNA, 22 bp, Homo sapiens
tgcaggtggtccttcctctgct

SEQ ID NO: 8252976 - DNA, 22 bp, Homo sapiens
tgcaggtggtccatttgggaac

SEQ ID NO: 8252977 - DNA, 22 bp, Homo sapiens
tgcaggtggtccttcctctgct

SEQ ID NO: 8252978 - DNA, 22 bp, Homo sapiens
tgcaggtggtccatttgggaac

SEQ ID NO: 8252979 - DNA, 22 bp, Homo sapiens
tgcaggtggtacttctttttct

SEQ ID NO: 8252980 - DNA, 22 bp, Homo sapiens
tgcaggtggtacttctttttct

SEQ ID NO: 8252981 - DNA, 20 bp, Homo sapiens
tgcaggtgggcccttctggg

SEQ ID NO: 8252982 - DNA, 20 bp, Homo sapiens
tgcaggtgggcccttctggg

SEQ ID NO: 8252983 - DNA, 20 bp, Homo sapiens
tgcaggtgggcccttctggg

SEQ ID NO: 8252984 - DNA, 20 bp, Homo sapiens
tgcaggtgggcccttctggg

SEQ ID NO: 8252985 - DNA, 22 bp, Homo sapiens
tgcaggtgtctccagggcaggt

SEQ ID NO: 8252986 - DNA, 22 bp, Homo sapiens
tgcaggtgtctccagggcaggt

SEQ ID NO: 8252987 - DNA, 22 bp, Homo sapiens
tgcaggtgtctccagggcaggt

SEQ ID NO: 8252988 - DNA, 22 bp, Homo sapiens
tgcaggtgtagagttgggctcc

SEQ ID NO: 8252989 - DNA, 22 bp, Homo sapiens
tgcaggtgtagagttgggctcc

SEQ ID NO: 8252990 - DNA, 22 bp, Homo sapiens
tgcaggtgtagagttgggctcc

SEQ ID NO: 8252991 - DNA, 22 bp, Homo sapiens
tgcaggtgtagagttgggctcc

SEQ ID NO: 8252992 - DNA, 22 bp, Homo sapiens
tgcaggtgtaaattttcaagag

SEQ ID NO: 8252993 - DNA, 22 bp, Homo sapiens
tgcaggtgtaaattttcaagag

SEQ ID NO: 8252994 - DNA, 22 bp, Homo sapiens
tgcaggtggtttggacactgct

SEQ ID NO: 8252995 - DNA, 22 bp, Homo sapiens
tgcaggggcttgtctgggcctg

SEQ ID NO: 8252996 - DNA, 22 bp, Homo sapiens
tgcaggggcttgtctgggcctg

SEQ ID NO: 8252997 - DNA, 22 bp, Homo sapiens
tgcaggggcttgtctgggcctg

SEQ ID NO: 8252998 - DNA, 22 bp, Homo sapiens
tgcaggggcttgtctgggcctg

SEQ ID NO: 8252999 - DNA, 22 bp, Homo sapiens
tgcaggggcttgtctgggcctg

SEQ ID NO: 8253000 - DNA, 22 bp, Homo sapiens
tgcagggtagacaggtgaggtc

SEQ ID NO: 8253001 - DNA, 22 bp, Homo sapiens
tgcagggtggagcggaagcgga

SEQ ID NO: 8253002 - DNA, 22 bp, Homo sapiens
tgcagggtggtttgaagggtct

SEQ ID NO: 8253003 - DNA, 22 bp, Homo sapiens
tgcagggtgcacagtggggtgc

SEQ ID NO: 8253004 - DNA, 22 bp, Homo sapiens
tgcagggtatccttgtctctgc

SEQ ID NO: 8253005 - DNA, 22 bp, Homo sapiens
tgcagggtcccgaagggaagac

SEQ ID NO: 8253006 - DNA, 22 bp, Homo sapiens
tgcagggtagatgcaggctgtg

SEQ ID NO: 8253007 - DNA, 22 bp, Homo sapiens
tgcagggtagatgcaggctgtg

SEQ ID NO: 8253008 - DNA, 22 bp, Homo sapiens
tgcagggcttcctcttggagtt

SEQ ID NO: 8253009 - DNA, 22 bp, Homo sapiens
tgcagggcttcctcttggagtt

SEQ ID NO: 8253010 - DNA, 22 bp, Homo sapiens
tgcagggcttcctcttggagtt

SEQ ID NO: 8253011 - DNA, 19 bp, Homo sapiens
tgcagggctgcgcctgggg

SEQ ID NO: 8253012 - DNA, 19 bp, Homo sapiens
tgcagggctgcgcctgggg

SEQ ID NO: 8253013 - DNA, 19 bp, Homo sapiens
tgcagggctgcgcctgggg

SEQ ID NO: 8253014 - DNA, 19 bp, Homo sapiens
tgcagggctgcgcctgggg

SEQ ID NO: 8253015 - DNA, 22 bp, Homo sapiens
tgcagggcttcctcttggagtt

SEQ ID NO: 8253016 - DNA, 22 bp, Homo sapiens
tgcagggcttcctcttggagtt

SEQ ID NO: 8253017 - DNA, 22 bp, Homo sapiens
tgcagggcttcctcttggagtt

SEQ ID NO: 8253018 - DNA, 19 bp, Homo sapiens
tgcagggctgcgcctgggg

SEQ ID NO: 8253019 - DNA, 19 bp, Homo sapiens
tgcagggctgcgcctgggg

SEQ ID NO: 8253020 - DNA, 19 bp, Homo sapiens
tgcagggctgcgcctgggg

SEQ ID NO: 8253021 - DNA, 20 bp, Homo sapiens
tgcagggctgcctcccagct

SEQ ID NO: 8253022 - DNA, 20 bp, Homo sapiens
tgcagggctgcctcccagct

SEQ ID NO: 8253023 - DNA, 20 bp, Homo sapiens
tgcagggctctgcttctctc

SEQ ID NO: 8253024 - DNA, 20 bp, Homo sapiens
tgcagggctctgcttctctc

SEQ ID NO: 8253025 - DNA, 22 bp, Homo sapiens
tgcagggctcctggctccaatc

SEQ ID NO: 8253026 - DNA, 20 bp, Homo sapiens
tgcagggctgcctcccagct

SEQ ID NO: 8253027 - DNA, 20 bp, Homo sapiens
tgcagggctgcctcccagct

SEQ ID NO: 8253028 - DNA, 20 bp, Homo sapiens
tgcagggctctgcttctctc

SEQ ID NO: 8253029 - DNA, 20 bp, Homo sapiens
tgcagggctctgcttctctc

SEQ ID NO: 8253030 - DNA, 20 bp, Homo sapiens
tgcagggctctgcttctctc

SEQ ID NO: 8253031 - DNA, 22 bp, Homo sapiens
tgcagggtgtccggaggatcac

SEQ ID NO: 8253032 - DNA, 22 bp, Homo sapiens
tgcagggtgtccggaggatcac

SEQ ID NO: 8253033 - DNA, 22 bp, Homo sapiens
tgcaggtaggcctgacttccag

SEQ ID NO: 8253034 - DNA, 22 bp, Homo sapiens
tgcaggtacttgacaacttggg

SEQ ID NO: 8253035 - DNA, 22 bp, Homo sapiens
tgcaggtacttgacaacttggg

SEQ ID NO: 8253036 - DNA, 23 bp, Homo sapiens
tgcaggtagggcccagcagtctt

SEQ ID NO: 8253037 - DNA, 22 bp, Homo sapiens
tgcaggtagcaggtacggttgt

SEQ ID NO: 8253038 - DNA, 22 bp, Homo sapiens
tgcaggtcaatcttcaggttcc

SEQ ID NO: 8253039 - DNA, 22 bp, Homo sapiens
tgcaggtctccattggcagact

SEQ ID NO: 8253040 - DNA, 22 bp, Homo sapiens
tgcaggtctatttaaatgattg

SEQ ID NO: 8253041 - DNA, 22 bp, Homo sapiens
tgcaggtcatgtggcgggactg

SEQ ID NO: 8253042 - DNA, 22 bp, Homo sapiens
tgcaggtctatttaaatgattg

SEQ ID NO: 8253043 - DNA, 22 bp, Homo sapiens
tgcaggtcaatcttcaggttcc

SEQ ID NO: 8253044 - DNA, 22 bp, Homo sapiens
tgcaggtcatccctgtgcttct

SEQ ID NO: 8253045 - DNA, 22 bp, Homo sapiens
tgcaggtcatccctgtgcttct

SEQ ID NO: 8253046 - DNA, 22 bp, Homo sapiens
tgcaggtcatgtggcgggactg

SEQ ID NO: 8253047 - DNA, 22 bp, Homo sapiens
tgcaggtgaaaattatgaggat

SEQ ID NO: 8253048 - DNA, 22 bp, Homo sapiens
tgcaggtgaaaattatgaggat

SEQ ID NO: 8253049 - DNA, 22 bp, Homo sapiens
tgcaggtctctgcaaggcctat

SEQ ID NO: 8253050 - DNA, 22 bp, Homo sapiens
tgcaggtctctgcaaggcctat

SEQ ID NO: 8253051 - DNA, 22 bp, Homo sapiens
tgcaggtctctgcaaggcctat

SEQ ID NO: 8253052 - DNA, 22 bp, Homo sapiens
tgcaggtctccattggcagact

SEQ ID NO: 8253053 - DNA, 22 bp, Homo sapiens
tgcaggtctccattggcagact

SEQ ID NO: 8253054 - DNA, 22 bp, Homo sapiens
tgcaggtgagtgcaggggctca

SEQ ID NO: 8253055 - DNA, 22 bp, Homo sapiens
tgcaggtgagtgcaggggctca

SEQ ID NO: 8253056 - DNA, 22 bp, Homo sapiens
tgcaggtgagtgcaggggctca

SEQ ID NO: 8253057 - DNA, 22 bp, Homo sapiens
tgcaggtgacaccactcttcct

SEQ ID NO: 8253058 - DNA, 22 bp, Homo sapiens
tgcaggtgacaccactcttcct

SEQ ID NO: 8253059 - DNA, 22 bp, Homo sapiens
tgcaggtgagtgcaggggctca

SEQ ID NO: 8253060 - DNA, 23 bp, Homo sapiens
tgcaggtgattaatccagtttca

SEQ ID NO: 8253061 - DNA, 23 bp, Homo sapiens
tgcaggtgattaatccagtttca

SEQ ID NO: 8253062 - DNA, 22 bp, Homo sapiens
tgcaggtgattctgatgcagtt

SEQ ID NO: 8253063 - DNA, 22 bp, Homo sapiens
tgcaggtgattctgatgcagtt

SEQ ID NO: 8253064 - DNA, 22 bp, Homo sapiens
tgcaggtgattctgatgcagtt

SEQ ID NO: 8253065 - DNA, 22 bp, Homo sapiens
tgcaggtgcagcgatactgtga

SEQ ID NO: 8253066 - DNA, 22 bp, Homo sapiens
tgcaggtgcagcgatactgtga

SEQ ID NO: 8253067 - DNA, 22 bp, Homo sapiens
tgcaggtggacacgggagacgg

SEQ ID NO: 8253068 - DNA, 22 bp, Homo sapiens
tgcaggtggatatctcatcaga

SEQ ID NO: 8253069 - DNA, 22 bp, Homo sapiens
tgcaggtggatatctcatcaga

SEQ ID NO: 8253070 - DNA, 22 bp, Homo sapiens
tgcaggtggatatctcatcaga

SEQ ID NO: 8253071 - DNA, 22 bp, Homo sapiens
tgcaggtggatatctcatcaga

SEQ ID NO: 8253072 - DNA, 22 bp, Homo sapiens
tgcaggtggccatcttcgttct

SEQ ID NO: 8253073 - DNA, 22 bp, Homo sapiens
tgcaggtggccatcttcgttct

SEQ ID NO: 8253074 - DNA, 22 bp, Homo sapiens
tgcaggtggctccagggactgc

SEQ ID NO: 8253075 - DNA, 22 bp, Homo sapiens
tgcaggtggctccagggactgc

SEQ ID NO: 8253076 - DNA, 22 bp, Homo sapiens
tgcaggtggctccagggactgc

SEQ ID NO: 8253077 - DNA, 22 bp, Homo sapiens
tgcaggtggctccagggactgc

SEQ ID NO: 8253078 - DNA, 22 bp, Homo sapiens
tgcaggtggctccagggactgc

SEQ ID NO: 8253079 - DNA, 22 bp, Homo sapiens
tgcaggtggcagcggggcacca

SEQ ID NO: 8253080 - DNA, 22 bp, Homo sapiens
tgcaggtggcagcggggcacca

SEQ ID NO: 8253081 - DNA, 22 bp, Homo sapiens
tgcaggtggcagcggggcacca

SEQ ID NO: 8253082 - DNA, 22 bp, Homo sapiens
tgcaggtggattcaatgtggga

SEQ ID NO: 8253083 - DNA, 22 bp, Homo sapiens
tgcaggtggatatctcatcaga

SEQ ID NO: 8253084 - DNA, 22 bp, Homo sapiens
tgcaggtggattcaatgtggga

SEQ ID NO: 8253085 - DNA, 22 bp, Homo sapiens
tgcaggtggattcaatgtggga

SEQ ID NO: 8253086 - DNA, 22 bp, Homo sapiens
tgcagggaaaacccaggatgct

SEQ ID NO: 8253087 - DNA, 22 bp, Homo sapiens
tgcagggaaaacccaggatgct

SEQ ID NO: 8253088 - DNA, 20 bp, Homo sapiens
tgcaggcttcgctctaggag

SEQ ID NO: 8253089 - DNA, 22 bp, Homo sapiens
tgcaggcttggatcacatctcc

SEQ ID NO: 8253090 - DNA, 22 bp, Homo sapiens
tgcaggcttggatcacatctcc

SEQ ID NO: 8253091 - DNA, 21 bp, Homo sapiens
tgcaggctgtgcgctcctgcc

SEQ ID NO: 8253092 - DNA, 21 bp, Homo sapiens
tgcaggctgtgcgctcctgcc

SEQ ID NO: 8253093 - DNA, 22 bp, Homo sapiens
tgcagggaacttggacagctag

SEQ ID NO: 8253094 - DNA, 22 bp, Homo sapiens
tgcagggaacttggacagctag

SEQ ID NO: 8253095 - DNA, 22 bp, Homo sapiens
tgcagggaaagtgttggcagca

SEQ ID NO: 8253096 - DNA, 22 bp, Homo sapiens
tgcagggaaagggcactgggct

SEQ ID NO: 8253097 - DNA, 22 bp, Homo sapiens
tgcagggaagtcccagctcctg

SEQ ID NO: 8253098 - DNA, 22 bp, Homo sapiens
tgcagggaagtcccagctcctg

SEQ ID NO: 8253099 - DNA, 22 bp, Homo sapiens
tgcagggaagtcccagctcctg

SEQ ID NO: 8253100 - DNA, 22 bp, Homo sapiens
tgcaggctgaggctggctcaac

SEQ ID NO: 8253101 - DNA, 22 bp, Homo sapiens
tgcaggctctgtgtgtgcctgg

SEQ ID NO: 8253102 - DNA, 22 bp, Homo sapiens
tgcaggctgcagtctcaggtgg

SEQ ID NO: 8253103 - DNA, 17 bp, Homo sapiens
tgcaggctcctgtccct

SEQ ID NO: 8253104 - DNA, 22 bp, Homo sapiens
tgcaggctccatgaggacaggc

SEQ ID NO: 8253105 - DNA, 22 bp, Homo sapiens
tgcaggctctctgctgccagat

SEQ ID NO: 8253106 - DNA, 22 bp, Homo sapiens
tgcaggctctctgctgccagat

SEQ ID NO: 8253107 - DNA, 22 bp, Homo sapiens
tgcaggctggggaggcagactt

SEQ ID NO: 8253108 - DNA, 22 bp, Homo sapiens
tgcaggctgccttcacagagcc

SEQ ID NO: 8253109 - DNA, 22 bp, Homo sapiens
tgcaggctgccttcacagagcc

SEQ ID NO: 8253110 - DNA, 22 bp, Homo sapiens
tgcaggctgccttcacagagcc

SEQ ID NO: 8253111 - DNA, 22 bp, Homo sapiens
tgcaggctgctggcagtagctt

SEQ ID NO: 8253112 - DNA, 22 bp, Homo sapiens
tgcagggattgttggcatccat

SEQ ID NO: 8253113 - DNA, 22 bp, Homo sapiens
tgcagggattatgtaggggttg

SEQ ID NO: 8253114 - DNA, 22 bp, Homo sapiens
tgcagggattgttggcatccat

SEQ ID NO: 8253115 - DNA, 22 bp, Homo sapiens
tgcagggcacacgcacgggtgt

SEQ ID NO: 8253116 - DNA, 22 bp, Homo sapiens
tgcagggcacacgcacgggtgt

SEQ ID NO: 8253117 - DNA, 23 bp, Homo sapiens
tgcagggcaagttagagacccca

SEQ ID NO: 8253118 - DNA, 23 bp, Homo sapiens
tgcagggcaagttagagacccca

SEQ ID NO: 8253119 - DNA, 23 bp, Homo sapiens
tgcagggcaagttagagacccca

SEQ ID NO: 8253120 - DNA, 22 bp, Homo sapiens
tgcagggattagaggccgggga

SEQ ID NO: 8253121 - DNA, 22 bp, Homo sapiens
tgcagggattagaggccgggga

SEQ ID NO: 8253122 - DNA, 22 bp, Homo sapiens
tgcagggatgctagaggtaaga

SEQ ID NO: 8253123 - DNA, 22 bp, Homo sapiens
tgcagggcagatatgactgtag

SEQ ID NO: 8253124 - DNA, 22 bp, Homo sapiens
tgcagggcacggtgcgcgtggg

SEQ ID NO: 8253125 - DNA, 22 bp, Homo sapiens
tgcagggcagatatgactgtag

SEQ ID NO: 8253126 - DNA, 22 bp, Homo sapiens
tgcagggcagatatgactgtag

SEQ ID NO: 8253127 - DNA, 22 bp, Homo sapiens
tgcagggcacggtgcgcgtggg

SEQ ID NO: 8253128 - DNA, 22 bp, Homo sapiens
tgcagggcacacgcacgggtgt

SEQ ID NO: 8253129 - DNA, 22 bp, Homo sapiens
tgcagggcacacgcacgggtgt

SEQ ID NO: 8253130 - DNA, 22 bp, Homo sapiens
tgcagggcacacgcacgggtgt

SEQ ID NO: 8253131 - DNA, 22 bp, Homo sapiens
tgcagggcacggtgcgcgtggg

SEQ ID NO: 8253132 - DNA, 22 bp, Homo sapiens
tgcagggcacggtgcgcgtggg

SEQ ID NO: 8253133 - DNA, 22 bp, Homo sapiens
tgcagggcacacgcacgggtgt

SEQ ID NO: 8253134 - DNA, 22 bp, Homo sapiens
tgcagggcacggtgcgcgtggg

SEQ ID NO: 8253135 - DNA, 22 bp, Homo sapiens
tgcagggcagtggaggttgagt

SEQ ID NO: 8253136 - DNA, 22 bp, Homo sapiens
tgcagggcagtggaggttgagt

SEQ ID NO: 8253137 - DNA, 22 bp, Homo sapiens
tgcagggcagtttgtttcggca

SEQ ID NO: 8253138 - DNA, 22 bp, Homo sapiens
tgcagggcagtggaggttgagt

SEQ ID NO: 8253139 - DNA, 22 bp, Homo sapiens
tgcagggcagtggaggttgagt

SEQ ID NO: 8253140 - DNA, 22 bp, Homo sapiens
tgcagggcagatatgactgtag

SEQ ID NO: 8253141 - DNA, 22 bp, Homo sapiens
tgcagggcagatatgactgtag

SEQ ID NO: 8253142 - DNA, 22 bp, Homo sapiens
tgcagggcagctagggagcttt

SEQ ID NO: 8253143 - DNA, 22 bp, Homo sapiens
tgcagggcagctagggagcttt

SEQ ID NO: 8253144 - DNA, 22 bp, Homo sapiens
tgcagggcagctagggagcttt

SEQ ID NO: 8253145 - DNA, 22 bp, Homo sapiens
tgcagggcagctagggagcttt

SEQ ID NO: 8253146 - DNA, 22 bp, Homo sapiens
tgcagggcagctagggagcttt

SEQ ID NO: 8253147 - DNA, 22 bp, Homo sapiens
tgcagggcatctttgaagtgtg

SEQ ID NO: 8253148 - DNA, 22 bp, Homo sapiens
tgcagggcatctttgaagtgtg

SEQ ID NO: 8253149 - DNA, 22 bp, Homo sapiens
tgcagggcatctttgaagtgtg

SEQ ID NO: 8253150 - DNA, 22 bp, Homo sapiens
tgcagggcatctttgaagtgtg

SEQ ID NO: 8253151 - DNA, 22 bp, Homo sapiens
tgcagggccagactgggttgga

SEQ ID NO: 8253152 - DNA, 22 bp, Homo sapiens
tgcagggccagactgggttgga

SEQ ID NO: 8253153 - DNA, 22 bp, Homo sapiens
tgcagggcatctttgaagtgtg

SEQ ID NO: 8253154 - DNA, 22 bp, Homo sapiens
tgcagggcatagggtccagttt

SEQ ID NO: 8253155 - DNA, 22 bp, Homo sapiens
tgcagggcatctttgaagtgtg

SEQ ID NO: 8253156 - DNA, 22 bp, Homo sapiens
tgcagggcatagggtccagttt

SEQ ID NO: 8253157 - DNA, 22 bp, Homo sapiens
tgcagggcatagggtccagttt

SEQ ID NO: 8253158 - DNA, 22 bp, Homo sapiens
tgcagggcatagggtccagttt

SEQ ID NO: 8253159 - DNA, 22 bp, Homo sapiens
tgcagggcagtttgtttcggca

SEQ ID NO: 8253160 - DNA, 22 bp, Homo sapiens
tgcagggccagactgggttgga

SEQ ID NO: 8253161 - DNA, 22 bp, Homo sapiens
tgcagggccagactgggttgga

SEQ ID NO: 8253162 - DNA, 22 bp, Homo sapiens
tgcagggccagactgggttgga

SEQ ID NO: 8253163 - DNA, 22 bp, Homo sapiens
tgcagggccatggtggcggctg

SEQ ID NO: 8253164 - DNA, 22 bp, Homo sapiens
tgcagggccatggtggcggctg

SEQ ID NO: 8253165 - DNA, 22 bp, Homo sapiens
tgcagggccatggtggcggctg

SEQ ID NO: 8253166 - DNA, 22 bp, Homo sapiens
tgcagggcccctctgcatgagt

SEQ ID NO: 8253167 - DNA, 22 bp, Homo sapiens
tgcagggcccctctgcatgagt

SEQ ID NO: 8253168 - DNA, 22 bp, Homo sapiens
tgcagggccatggtggcggctg

SEQ ID NO: 8253169 - DNA, 22 bp, Homo sapiens
tgcagggccatggtggcggctg

SEQ ID NO: 8253170 - DNA, 22 bp, Homo sapiens
tgcagggccatggtggcggctg

SEQ ID NO: 8253171 - DNA, 22 bp, Homo sapiens
tgcagggccatggtggcggctg

SEQ ID NO: 8253172 - DNA, 22 bp, Homo sapiens
tgcagggccctcattcctgtcc

SEQ ID NO: 8253173 - DNA, 22 bp, Homo sapiens
tgcagggccctcattcctgtcc

SEQ ID NO: 8253174 - DNA, 22 bp, Homo sapiens
tgcagggccctcattcctgtcc

SEQ ID NO: 8253175 - DNA, 22 bp, Homo sapiens
tgcagggccctcattcctgtcc

SEQ ID NO: 8253176 - DNA, 22 bp, Homo sapiens
tgcagggcccctctgcatgagt

SEQ ID NO: 8253177 - DNA, 22 bp, Homo sapiens
tgcagggcccctctgcatgagt

SEQ ID NO: 8253178 - DNA, 22 bp, Homo sapiens
tgcagggcccctctgcatgagt

SEQ ID NO: 8253179 - DNA, 22 bp, Homo sapiens
tgcagggcccttggggttgaac

SEQ ID NO: 8253180 - DNA, 22 bp, Homo sapiens
tgcagggcccttggggttgaac

SEQ ID NO: 8253181 - DNA, 22 bp, Homo sapiens
tgcagggcccttggggttgaac

SEQ ID NO: 8253182 - DNA, 22 bp, Homo sapiens
tgcagggcccttggggttgaac

SEQ ID NO: 8253183 - DNA, 22 bp, Homo sapiens
tgcagggcccttggggttgaac

SEQ ID NO: 8253184 - DNA, 22 bp, Homo sapiens
tgcagggccgctggaggtcatg

SEQ ID NO: 8253185 - DNA, 22 bp, Homo sapiens
tgcagggctcctggctccaatc

SEQ ID NO: 8253186 - DNA, 22 bp, Homo sapiens
tgcagggctcctggctccaatc

SEQ ID NO: 8253187 - DNA, 22 bp, Homo sapiens
tgcagggctcctggctccaatc

SEQ ID NO: 8253188 - DNA, 22 bp, Homo sapiens
tgcagggctataactccattct

SEQ ID NO: 8253189 - DNA, 22 bp, Homo sapiens
tgcagggctataactccattct

SEQ ID NO: 8253190 - DNA, 22 bp, Homo sapiens
tgcagggctacaggactacaac

SEQ ID NO: 8253191 - DNA, 22 bp, Homo sapiens
tgcagggccgctggaggtcatg

SEQ ID NO: 8253192 - DNA, 22 bp, Homo sapiens
tgcagggccgctggaggtcatg

SEQ ID NO: 8253193 - DNA, 22 bp, Homo sapiens
tgcagggccgctggaggtcatg

SEQ ID NO: 8253194 - DNA, 22 bp, Homo sapiens
tgcagggccgctggaggtcatg

SEQ ID NO: 8253195 - DNA, 22 bp, Homo sapiens
tgcagggctacaggactacaac

SEQ ID NO: 8253196 - DNA, 22 bp, Homo sapiens
tgcagggctacaggactacaac

SEQ ID NO: 8253197 - DNA, 18 bp, Homo sapiens
tgcccagaaaagcaggga

SEQ ID NO: 8253198 - DNA, 22 bp, Homo sapiens
tgcccagaatagatgggctgtg

SEQ ID NO: 8253199 - DNA, 22 bp, Homo sapiens
tgcccagagcctcttacctcca

SEQ ID NO: 8253200 - DNA, 22 bp, Homo sapiens
tgcccagaatagatgggctgtg

SEQ ID NO: 8253201 - DNA, 20 bp, Homo sapiens
tgcccagcaagagtgcagtt

SEQ ID NO: 8253202 - DNA, 20 bp, Homo sapiens
tgcccagcaagagtgcagtt

SEQ ID NO: 8253203 - DNA, 19 bp, Homo sapiens
tgcccagagtgtatgcgca

SEQ ID NO: 8253204 - DNA, 22 bp, Homo sapiens
tgcccagagcctgagaggatta

SEQ ID NO: 8253205 - DNA, 20 bp, Homo sapiens
tgcccagcaagagtgcagtt

SEQ ID NO: 8253206 - DNA, 22 bp, Homo sapiens
tgcccacatggtgccatggcca

SEQ ID NO: 8253207 - DNA, 22 bp, Homo sapiens
tgcccacatggtgccatggcca

SEQ ID NO: 8253208 - DNA, 22 bp, Homo sapiens
tgcccacatggtgccatggcca

SEQ ID NO: 8253209 - DNA, 22 bp, Homo sapiens
tgcccacatggtgccatggcca

SEQ ID NO: 8253210 - DNA, 22 bp, Homo sapiens
tgcccacattctgaagctccct

SEQ ID NO: 8253211 - DNA, 22 bp, Homo sapiens
tgcccacctttactgtgattta

SEQ ID NO: 8253212 - DNA, 22 bp, Homo sapiens
tgcccacctaacagtgtttgga

SEQ ID NO: 8253213 - DNA, 18 bp, Homo sapiens
tgcccaccagaagaggga

SEQ ID NO: 8253214 - DNA, 21 bp, Homo sapiens
tgcccaccaagctccacactg

SEQ ID NO: 8253215 - DNA, 22 bp, Homo sapiens
tgcccagcaataaaccagaaga

SEQ ID NO: 8253216 - DNA, 22 bp, Homo sapiens
tgcccagcaataaaccagaaga

SEQ ID NO: 8253217 - DNA, 22 bp, Homo sapiens
tgcccagcaataaaccagaaga

SEQ ID NO: 8253218 - DNA, 22 bp, Homo sapiens
tgcccagcactgtgccagtcac

SEQ ID NO: 8253219 - DNA, 22 bp, Homo sapiens
tgcccagcactgtgccagtcac

SEQ ID NO: 8253220 - DNA, 22 bp, Homo sapiens
tgcccagcagggagctacctgg

SEQ ID NO: 8253221 - DNA, 20 bp, Homo sapiens
tgcccacatcactcaggagt

SEQ ID NO: 8253222 - DNA, 20 bp, Homo sapiens
tgcccacatcactcaggagt

SEQ ID NO: 8253223 - DNA, 22 bp, Homo sapiens
tgcccacagctcagggctgctc

SEQ ID NO: 8253224 - DNA, 21 bp, Homo sapiens
tgcccacagcaaatgcagagg

SEQ ID NO: 8253225 - DNA, 22 bp, Homo sapiens
tgcccacacctgggggaggctg

SEQ ID NO: 8253226 - DNA, 22 bp, Homo sapiens
tgcccacagatatgtgcagtct

SEQ ID NO: 8253227 - DNA, 22 bp, Homo sapiens
tgcccacagcaaagaggtagga

SEQ ID NO: 8253228 - DNA, 21 bp, Homo sapiens
tgcccacagcaaatgcagagg

SEQ ID NO: 8253229 - DNA, 23 bp, Homo sapiens
tgcccacaaaagtaaagacattt

SEQ ID NO: 8253230 - DNA, 20 bp, Homo sapiens
tgcccacaattcacaatgcc

SEQ ID NO: 8253231 - DNA, 22 bp, Homo sapiens
tgccatttttgctgggaattta

SEQ ID NO: 8253232 - DNA, 20 bp, Homo sapiens
tgccatggtaacagagtgtg

SEQ ID NO: 8253233 - DNA, 22 bp, Homo sapiens
tgccatttgctggttttctgat

SEQ ID NO: 8253234 - DNA, 22 bp, Homo sapiens
tgccatttggacctaactgggc

SEQ ID NO: 8253235 - DNA, 22 bp, Homo sapiens
tgccatttgtaactatcattct

SEQ ID NO: 8253236 - DNA, 23 bp, Homo sapiens
tgccattttccatctcatgcaga

SEQ ID NO: 8253237 - DNA, 22 bp, Homo sapiens
tgccatttctcacatatgtatg

SEQ ID NO: 8253238 - DNA, 22 bp, Homo sapiens
tgccatttctcacatatgtatg

SEQ ID NO: 8253239 - DNA, 22 bp, Homo sapiens
tgccatttctttcaatattctt

SEQ ID NO: 8253240 - DNA, 19 bp, Homo sapiens
tgccatttgactgaatgta

SEQ ID NO: 8253241 - DNA, 22 bp, Homo sapiens
tgcccagggtggagtgcagtgg

SEQ ID NO: 8253242 - DNA, 22 bp, Homo sapiens
tgcccagggtggagtgcagtgg

SEQ ID NO: 8253243 - DNA, 22 bp, Homo sapiens
tgcccaggtttgagtgcccaag

SEQ ID NO: 8253244 - DNA, 22 bp, Homo sapiens
tgcccaggtttgagtgcccaag

SEQ ID NO: 8253245 - DNA, 22 bp, Homo sapiens
tgcccagggtttctaagagcag

SEQ ID NO: 8253246 - DNA, 22 bp, Homo sapiens
tgcccagggtttctaagagcag

SEQ ID NO: 8253247 - DNA, 22 bp, Homo sapiens
tgcccagggtttctaagagcag

SEQ ID NO: 8253248 - DNA, 22 bp, Homo sapiens
tgcccagtctccgggccagccc

SEQ ID NO: 8253249 - DNA, 22 bp, Homo sapiens
tgcccaggtttgagtgcccaag

SEQ ID NO: 8253250 - DNA, 22 bp, Homo sapiens
tgcccaggtttgagtgcccaag

SEQ ID NO: 8253251 - DNA, 22 bp, Homo sapiens
tgcccatgtttctctgtatccc

SEQ ID NO: 8253252 - DNA, 23 bp, Homo sapiens
tgcccagtgggtgcagggggtat

SEQ ID NO: 8253253 - DNA, 19 bp, Homo sapiens
tgcccccagcacctccctg

SEQ ID NO: 8253254 - DNA, 22 bp, Homo sapiens
tgccccaggtgctgaggttgga

SEQ ID NO: 8253255 - DNA, 22 bp, Homo sapiens
tgcccctcgacgcaatgaaggg

SEQ ID NO: 8253256 - DNA, 22 bp, Homo sapiens
tgccccagacctactgaatggg

SEQ ID NO: 8253257 - DNA, 22 bp, Homo sapiens
tgcccattattcagccattaaa

SEQ ID NO: 8253258 - DNA, 23 bp, Homo sapiens
tgcccattgcatcttggtactgg

SEQ ID NO: 8253259 - DNA, 20 bp, Homo sapiens
tgccccaggcctgcacctgc

SEQ ID NO: 8253260 - DNA, 20 bp, Homo sapiens
tgccccaggcctgcacctgc

SEQ ID NO: 8253261 - DNA, 22 bp, Homo sapiens
tgcccaggattgtgaggtcagg

SEQ ID NO: 8253262 - DNA, 22 bp, Homo sapiens
tgcccaggattgtgaggtcagg

SEQ ID NO: 8253263 - DNA, 19 bp, Homo sapiens
tgcccaggccaggttgggc

SEQ ID NO: 8253264 - DNA, 22 bp, Homo sapiens
tgcccaggctcctcgcagcctt

SEQ ID NO: 8253265 - DNA, 22 bp, Homo sapiens
tgcccaggctcctcgcagcctt

SEQ ID NO: 8253266 - DNA, 22 bp, Homo sapiens
tgcccaggctcctcgcagcctt

SEQ ID NO: 8253267 - DNA, 22 bp, Homo sapiens
tgcccaggctcctcgcagcctt

SEQ ID NO: 8253268 - DNA, 22 bp, Homo sapiens
tgcccaggctggaatgcagtgg

SEQ ID NO: 8253269 - DNA, 22 bp, Homo sapiens
tgcccaggctggaatgcagtgg

SEQ ID NO: 8253270 - DNA, 22 bp, Homo sapiens
tgcccagggataagcctagaga

SEQ ID NO: 8253271 - DNA, 22 bp, Homo sapiens
tgcccaggcttcaccctcagag

SEQ ID NO: 8253272 - DNA, 22 bp, Homo sapiens
tgcccagggataagcctagaga

SEQ ID NO: 8253273 - DNA, 22 bp, Homo sapiens
tgcccagggataagcctagaga

SEQ ID NO: 8253274 - DNA, 22 bp, Homo sapiens
tgcccagggtggagtgcagcgg

SEQ ID NO: 8253275 - DNA, 21 bp, Homo sapiens
tgcccaggggccaaccgctgc

SEQ ID NO: 8253276 - DNA, 22 bp, Homo sapiens
tgcccagggtggagtgcagcgg

SEQ ID NO: 8253277 - DNA, 22 bp, Homo sapiens
tgcccagggtggagtgcagcgg

SEQ ID NO: 8253278 - DNA, 22 bp, Homo sapiens
tgcccaggctggagtgcagagg

SEQ ID NO: 8253279 - DNA, 22 bp, Homo sapiens
tgcccaggctggagtgcagagg

SEQ ID NO: 8253280 - DNA, 22 bp, Homo sapiens
tgcccaggctggagtgcagagg

SEQ ID NO: 8253281 - DNA, 22 bp, Homo sapiens
tgcccaggcttcaccctcagag

SEQ ID NO: 8253282 - DNA, 22 bp, Homo sapiens
tgcccaggcttcaccctcagag

SEQ ID NO: 8253283 - DNA, 22 bp, Homo sapiens
tgcccaggcttcaccctcagag

SEQ ID NO: 8253284 - DNA, 22 bp, Homo sapiens
tgcccaggctggagtgcagtgg

SEQ ID NO: 8253285 - DNA, 22 bp, Homo sapiens
tgcccaggctggagtgcagtgg

SEQ ID NO: 8253286 - DNA, 22 bp, Homo sapiens
tgccaggccaattctatttgac

SEQ ID NO: 8253287 - DNA, 22 bp, Homo sapiens
tgccaggccaatgaaggcaggg

SEQ ID NO: 8253288 - DNA, 22 bp, Homo sapiens
tgccaggccaatgaaggcaggg

SEQ ID NO: 8253289 - DNA, 22 bp, Homo sapiens
tgccaggccaatgaaggcaggg

SEQ ID NO: 8253290 - DNA, 22 bp, Homo sapiens
tgccaggccaatgaaggcaggg

SEQ ID NO: 8253291 - DNA, 22 bp, Homo sapiens
tgccaggcatttgacagacact

SEQ ID NO: 8253292 - DNA, 22 bp, Homo sapiens
tgccaggcatttgacagacact

SEQ ID NO: 8253293 - DNA, 22 bp, Homo sapiens
tgccaggcatttgacagacact

SEQ ID NO: 8253294 - DNA, 22 bp, Homo sapiens
tgccaggcatttgacagacact

SEQ ID NO: 8253295 - DNA, 22 bp, Homo sapiens
tgccaggcccagctccagagct

SEQ ID NO: 8253296 - DNA, 22 bp, Homo sapiens
tgccaggcccagcagggcggcc

SEQ ID NO: 8253297 - DNA, 22 bp, Homo sapiens
tgccaggcccagcagggcggcc

SEQ ID NO: 8253298 - DNA, 22 bp, Homo sapiens
tgccaggcccagctccagagct

SEQ ID NO: 8253299 - DNA, 22 bp, Homo sapiens
tgccaggcccagctccagagct

SEQ ID NO: 8253300 - DNA, 22 bp, Homo sapiens
tgccaggcccagcagggcggcc

SEQ ID NO: 8253301 - DNA, 22 bp, Homo sapiens
tgccaggcccagcagggcggcc

SEQ ID NO: 8253302 - DNA, 22 bp, Homo sapiens
tgccaggccacgtagcttcaag

SEQ ID NO: 8253303 - DNA, 22 bp, Homo sapiens
tgccaggccacgtagcttcaag

SEQ ID NO: 8253304 - DNA, 22 bp, Homo sapiens
tgccaggccacgtagcttcaag

SEQ ID NO: 8253305 - DNA, 22 bp, Homo sapiens
tgccaggctcagcccctatctt

SEQ ID NO: 8253306 - DNA, 22 bp, Homo sapiens
tgccaggctcaggatgtccctg

SEQ ID NO: 8253307 - DNA, 22 bp, Homo sapiens
tgccaggctcaggatgtccctg

SEQ ID NO: 8253308 - DNA, 22 bp, Homo sapiens
tgccaggctcagcccctatctt

SEQ ID NO: 8253309 - DNA, 22 bp, Homo sapiens
tgccaggctcagcccctatctt

SEQ ID NO: 8253310 - DNA, 22 bp, Homo sapiens
tgccaggccctgtgctggatgc

SEQ ID NO: 8253311 - DNA, 22 bp, Homo sapiens
tgccaggccctgcggggtccca

SEQ ID NO: 8253312 - DNA, 22 bp, Homo sapiens
tgccaggccctcccacagatta

SEQ ID NO: 8253313 - DNA, 22 bp, Homo sapiens
tgccaggccctgtgctggatgc

SEQ ID NO: 8253314 - DNA, 22 bp, Homo sapiens
tgccaggccctgcggggtccca

SEQ ID NO: 8253315 - DNA, 22 bp, Homo sapiens
tgccaggccctgcggggtccca

SEQ ID NO: 8253316 - DNA, 22 bp, Homo sapiens
tgccaggccctcccacagatta

SEQ ID NO: 8253317 - DNA, 22 bp, Homo sapiens
tgccaggccctcccacagatta

SEQ ID NO: 8253318 - DNA, 22 bp, Homo sapiens
tgccaggccctcccacagatta

SEQ ID NO: 8253319 - DNA, 18 bp, Homo sapiens
tgccagccgactggcctg

SEQ ID NO: 8253320 - DNA, 22 bp, Homo sapiens
tgccagcctggcctgagtcttt

SEQ ID NO: 8253321 - DNA, 22 bp, Homo sapiens
tgccagcctggcctgagtcttt

SEQ ID NO: 8253322 - DNA, 17 bp, Homo sapiens
tgccagcctgtcccagg

SEQ ID NO: 8253323 - DNA, 19 bp, Homo sapiens
tgccagctcacaggagctc

SEQ ID NO: 8253324 - DNA, 22 bp, Homo sapiens
tgccagcgtgaagctgggcccc

SEQ ID NO: 8253325 - DNA, 22 bp, Homo sapiens
tgccaggcaactgcccagccat

SEQ ID NO: 8253326 - DNA, 22 bp, Homo sapiens
tgccaggcaactgcccagccat

SEQ ID NO: 8253327 - DNA, 22 bp, Homo sapiens
tgccaggcaactgcccagccat

SEQ ID NO: 8253328 - DNA, 20 bp, Homo sapiens
tgccaggcacggagtgcatg

SEQ ID NO: 8253329 - DNA, 20 bp, Homo sapiens
tgccaggcacggagtgcatg

SEQ ID NO: 8253330 - DNA, 19 bp, Homo sapiens
tgccagctcacaggagctc

SEQ ID NO: 8253331 - DNA, 22 bp, Homo sapiens
tgccagctcccttttctcctcc

SEQ ID NO: 8253332 - DNA, 22 bp, Homo sapiens
tgccaggatggccagggggcca

SEQ ID NO: 8253333 - DNA, 20 bp, Homo sapiens
tgccaggcacggagtgcatg

SEQ ID NO: 8253334 - DNA, 20 bp, Homo sapiens
tgccaggcacggagtgcatg

SEQ ID NO: 8253335 - DNA, 22 bp, Homo sapiens
tgccaggcacgtgagagtggcc

SEQ ID NO: 8253336 - DNA, 22 bp, Homo sapiens
tgccaggcacgtgagagtggcc

SEQ ID NO: 8253337 - DNA, 22 bp, Homo sapiens
tgccaggcacgtgagagtggcc

SEQ ID NO: 8253338 - DNA, 22 bp, Homo sapiens
tgccaggcaggaccctagaacc

SEQ ID NO: 8253339 - DNA, 22 bp, Homo sapiens
tgccaggcaggaccctagaacc

SEQ ID NO: 8253340 - DNA, 22 bp, Homo sapiens
tgccaggcaggaccctagaacc

SEQ ID NO: 8253341 - DNA, 22 bp, Homo sapiens
tgccaggcatgtagtagacttg

SEQ ID NO: 8253342 - DNA, 22 bp, Homo sapiens
tgccaggcatatggcctctttg

SEQ ID NO: 8253343 - DNA, 22 bp, Homo sapiens
tgccaggcatatggcctctttg

SEQ ID NO: 8253344 - DNA, 22 bp, Homo sapiens
tgccaggcatgtagtagacttg

SEQ ID NO: 8253345 - DNA, 22 bp, Homo sapiens
tgccaggcatgtagtagacttg

SEQ ID NO: 8253346 - DNA, 22 bp, Homo sapiens
tgccaggcatatggcctctttg

SEQ ID NO: 8253347 - DNA, 22 bp, Homo sapiens
tgccaggcatatggcctctttg

SEQ ID NO: 8253348 - DNA, 22 bp, Homo sapiens
tgccaggcagtgtcagattgag

SEQ ID NO: 8253349 - DNA, 22 bp, Homo sapiens
tgccaggcagtgtcagattgag

SEQ ID NO: 8253350 - DNA, 22 bp, Homo sapiens
tgccaggcagtgtcagattgag

SEQ ID NO: 8253351 - DNA, 22 bp, Homo sapiens
tgccaggctttggtcaaaggct

SEQ ID NO: 8253352 - DNA, 22 bp, Homo sapiens
tgccaggctttggtcaaaggct

SEQ ID NO: 8253353 - DNA, 22 bp, Homo sapiens
tgccaggctttggtcaaaggct

SEQ ID NO: 8253354 - DNA, 22 bp, Homo sapiens
tgccaggcttagagcaggggct

SEQ ID NO: 8253355 - DNA, 22 bp, Homo sapiens
tgccaggcttagagcaggggct

SEQ ID NO: 8253356 - DNA, 22 bp, Homo sapiens
tgccaggcttagagcaggggct

SEQ ID NO: 8253357 - DNA, 22 bp, Homo sapiens
tgccaggcttagagcaggggct

SEQ ID NO: 8253358 - DNA, 22 bp, Homo sapiens
tgccagggagccctgctgacca

SEQ ID NO: 8253359 - DNA, 20 bp, Homo sapiens
tgccagggccagcagaggct

SEQ ID NO: 8253360 - DNA, 20 bp, Homo sapiens
tgccagggccagcagaggct

SEQ ID NO: 8253361 - DNA, 20 bp, Homo sapiens
tgccagggccagcagaggct

SEQ ID NO: 8253362 - DNA, 20 bp, Homo sapiens
tgccagggccagcagaggct

SEQ ID NO: 8253363 - DNA, 21 bp, Homo sapiens
tgccagggatttacagagcct

SEQ ID NO: 8253364 - DNA, 21 bp, Homo sapiens
tgccagggatttacagagcct

SEQ ID NO: 8253365 - DNA, 22 bp, Homo sapiens
tgccagggagccctgctgacca

SEQ ID NO: 8253366 - DNA, 22 bp, Homo sapiens
tgccagggaccctgtcggccct

SEQ ID NO: 8253367 - DNA, 22 bp, Homo sapiens
tgccaggctgtcctgggcctgg

SEQ ID NO: 8253368 - DNA, 22 bp, Homo sapiens
tgccaggctgtcctgggcctgg

SEQ ID NO: 8253369 - DNA, 22 bp, Homo sapiens
tgccaggctgtcaattcaccca

SEQ ID NO: 8253370 - DNA, 22 bp, Homo sapiens
tgccaggctgtcctgggcctgg

SEQ ID NO: 8253371 - DNA, 22 bp, Homo sapiens
tgccaggctgccctccagtctg

SEQ ID NO: 8253372 - DNA, 22 bp, Homo sapiens
tgccaggctgtcaattcaccca

SEQ ID NO: 8253373 - DNA, 22 bp, Homo sapiens
tgccaggctgccctccagtctg

SEQ ID NO: 8253374 - DNA, 22 bp, Homo sapiens
tgccaggctgccctccagtctg

SEQ ID NO: 8253375 - DNA, 22 bp, Homo sapiens
tgccaggctgaacagggtctta

SEQ ID NO: 8253376 - DNA, 22 bp, Homo sapiens
tgccaggctgaacagggtctta

SEQ ID NO: 8253377 - DNA, 22 bp, Homo sapiens
tgccaggctgaacagggtctta

SEQ ID NO: 8253378 - DNA, 20 bp, Homo sapiens
tgccaggctgcacgcctgcc

SEQ ID NO: 8253379 - DNA, 20 bp, Homo sapiens
tgccaggctgcacgcctgcc

SEQ ID NO: 8253380 - DNA, 20 bp, Homo sapiens
tgccaggctgcacgcctgcc

SEQ ID NO: 8253381 - DNA, 22 bp, Homo sapiens
tgccaggctccggaacgacagt

SEQ ID NO: 8253382 - DNA, 22 bp, Homo sapiens
tgccaggctccggaacgacagt

SEQ ID NO: 8253383 - DNA, 22 bp, Homo sapiens
tgccaggctcaggatgtccctg

SEQ ID NO: 8253384 - DNA, 22 bp, Homo sapiens
tgccaggctccggaacgacagt

SEQ ID NO: 8253385 - DNA, 22 bp, Homo sapiens
tgccaggctccggaacgacagt

SEQ ID NO: 8253386 - DNA, 22 bp, Homo sapiens
tgccatcttccttcctctgcac

SEQ ID NO: 8253387 - DNA, 22 bp, Homo sapiens
tgccatctcttcctcgtgctgc

SEQ ID NO: 8253388 - DNA, 22 bp, Homo sapiens
tgccatcctgtgtcatgctcat

SEQ ID NO: 8253389 - DNA, 22 bp, Homo sapiens
tgccatcctgtgtcatgctcat

SEQ ID NO: 8253390 - DNA, 22 bp, Homo sapiens
tgccatccaacagttccatctt

SEQ ID NO: 8253391 - DNA, 22 bp, Homo sapiens
tgccatcactgaacttctgaaa

SEQ ID NO: 8253392 - DNA, 22 bp, Homo sapiens
tgccagggtgtcaggagagcta

SEQ ID NO: 8253393 - DNA, 22 bp, Homo sapiens
tgccagggtgtcaggagagcta

SEQ ID NO: 8253394 - DNA, 22 bp, Homo sapiens
tgccaggtacacaagtagccag

SEQ ID NO: 8253395 - DNA, 22 bp, Homo sapiens
tgccaggtacacaagtagccag

SEQ ID NO: 8253396 - DNA, 22 bp, Homo sapiens
tgccagggtcctgagggccttg

SEQ ID NO: 8253397 - DNA, 22 bp, Homo sapiens
tgccagggtgtcaggagagcta

SEQ ID NO: 8253398 - DNA, 22 bp, Homo sapiens
tgccaggggacctagggatgtc

SEQ ID NO: 8253399 - DNA, 22 bp, Homo sapiens
tgccagggtcagctgcagctct

SEQ ID NO: 8253400 - DNA, 22 bp, Homo sapiens
tgccaggggacctagggatgtc

SEQ ID NO: 8253401 - DNA, 23 bp, Homo sapiens
tgccagggccctgtgtgcaatgc

SEQ ID NO: 8253402 - DNA, 22 bp, Homo sapiens
tgccagggctgctactggctga

SEQ ID NO: 8253403 - DNA, 22 bp, Homo sapiens
tgccagggccatagggagtcta

SEQ ID NO: 8253404 - DNA, 22 bp, Homo sapiens
tgccagggccatagggagtcta

SEQ ID NO: 8253405 - DNA, 22 bp, Homo sapiens
tgccctgcccatctaccctgtc

SEQ ID NO: 8253406 - DNA, 22 bp, Homo sapiens
tgccctgccaagactgagtggt

SEQ ID NO: 8253407 - DNA, 22 bp, Homo sapiens
tgccctgccaagactgagtggt

SEQ ID NO: 8253408 - DNA, 22 bp, Homo sapiens
tgccctgcccatctaccctgtc

SEQ ID NO: 8253409 - DNA, 19 bp, Homo sapiens
tgccctgcccgcagccttg

SEQ ID NO: 8253410 - DNA, 19 bp, Homo sapiens
tgccctgcccgcagccttg

SEQ ID NO: 8253411 - DNA, 22 bp, Homo sapiens
tgccctgccaagactcagtggt

SEQ ID NO: 8253412 - DNA, 22 bp, Homo sapiens
tgccctgccaagactcagtggt

SEQ ID NO: 8253413 - DNA, 22 bp, Homo sapiens
tgccctgcatgcagggagctgt

SEQ ID NO: 8253414 - DNA, 22 bp, Homo sapiens
tgccctgcatgcagggagctgt

SEQ ID NO: 8253415 - DNA, 22 bp, Homo sapiens
tgccctgccaagaccaagtggt

SEQ ID NO: 8253416 - DNA, 22 bp, Homo sapiens
tgccctgctaaatataggtagc

SEQ ID NO: 8253417 - DNA, 22 bp, Homo sapiens
tgccctgctaaccttggttcca

SEQ ID NO: 8253418 - DNA, 22 bp, Homo sapiens
tgccctgctgtgcctggagcca

SEQ ID NO: 8253419 - DNA, 22 bp, Homo sapiens
tgccctgctgtgcctggagcca

SEQ ID NO: 8253420 - DNA, 22 bp, Homo sapiens
tgccctgctgtgcctggagcca

SEQ ID NO: 8253421 - DNA, 22 bp, Homo sapiens
tgccctgcctgagagacagtaa

SEQ ID NO: 8253422 - DNA, 22 bp, Homo sapiens
tgccctgcccttgctatttcta

SEQ ID NO: 8253423 - DNA, 22 bp, Homo sapiens
tgccctgcctgagagacagtaa

SEQ ID NO: 8253424 - DNA, 22 bp, Homo sapiens
tgccctgcggctatctagatga

SEQ ID NO: 8253425 - DNA, 22 bp, Homo sapiens
tgccctgcggctatctagatga

SEQ ID NO: 8253426 - DNA, 22 bp, Homo sapiens
tgccctgcagtgagtgcgtctg

SEQ ID NO: 8253427 - DNA, 22 bp, Homo sapiens
tgccctgcagtgagtgcgtctg

SEQ ID NO: 8253428 - DNA, 22 bp, Homo sapiens
tgccctgcagaccctgcagtgt

SEQ ID NO: 8253429 - DNA, 22 bp, Homo sapiens
tgccctgcagaccctgcagtgt

SEQ ID NO: 8253430 - DNA, 22 bp, Homo sapiens
tgccctcagaattgctccctgc

SEQ ID NO: 8253431 - DNA, 22 bp, Homo sapiens
tgcccctcttgctggccctgtc

SEQ ID NO: 8253432 - DNA, 22 bp, Homo sapiens
tgcccctctcctgtgatccaag

SEQ ID NO: 8253433 - DNA, 21 bp, Homo sapiens
tgcccctttatgggctcccta

SEQ ID NO: 8253434 - DNA, 22 bp, Homo sapiens
tgccctgctgtggctctgccca

SEQ ID NO: 8253435 - DNA, 22 bp, Homo sapiens
tgccctgcttctcttgggacag

SEQ ID NO: 8253436 - DNA, 22 bp, Homo sapiens
tgccctgctgtggctctgccca

SEQ ID NO: 8253437 - DNA, 22 bp, Homo sapiens
tgccctgctgtggctctgccca

SEQ ID NO: 8253438 - DNA, 22 bp, Homo sapiens
tgccctgctgtggctctgccca

SEQ ID NO: 8253439 - DNA, 22 bp, Homo sapiens
tgccctgctgtggctctgccca

SEQ ID NO: 8253440 - DNA, 22 bp, Homo sapiens
tgccctgcttggtttattttca

SEQ ID NO: 8253441 - DNA, 22 bp, Homo sapiens
tgccctggaaatgagaggtgtg

SEQ ID NO: 8253442 - DNA, 22 bp, Homo sapiens
tgccctggaaccatctacagtc

SEQ ID NO: 8253443 - DNA, 22 bp, Homo sapiens
tgccctggaaatgagaggtgtg

SEQ ID NO: 8253444 - DNA, 22 bp, Homo sapiens
tgccctggaaccatctacagtc

SEQ ID NO: 8253445 - DNA, 22 bp, Homo sapiens
tgccctggaaccatctacagtc

SEQ ID NO: 8253446 - DNA, 22 bp, Homo sapiens
tgccctggaggggcttacagtc

SEQ ID NO: 8253447 - DNA, 22 bp, Homo sapiens
tgccctggaggggcttacagtc

SEQ ID NO: 8253448 - DNA, 22 bp, Homo sapiens
tgccctggaggggcttacagtc

SEQ ID NO: 8253449 - DNA, 22 bp, Homo sapiens
tgccctggaggggcttacagtc

SEQ ID NO: 8253450 - DNA, 22 bp, Homo sapiens
tgccctggagtcagtggctatt

SEQ ID NO: 8253451 - DNA, 22 bp, Homo sapiens
tgccctggcacacacacagctg

SEQ ID NO: 8253452 - DNA, 22 bp, Homo sapiens
tgccctggcacacacacagctg

SEQ ID NO: 8253453 - DNA, 22 bp, Homo sapiens
tgccctggcattgggttggata

SEQ ID NO: 8253454 - DNA, 22 bp, Homo sapiens
tgccctggcattgggttggata

SEQ ID NO: 8253455 - DNA, 22 bp, Homo sapiens
tgccctggatgctgcaggtgtg

SEQ ID NO: 8253456 - DNA, 22 bp, Homo sapiens
tgccctggatgctgcaggtgtg

SEQ ID NO: 8253457 - DNA, 22 bp, Homo sapiens
tgccctggatgctgcaggtgtg

SEQ ID NO: 8253458 - DNA, 22 bp, Homo sapiens
tgccctggcacacacacagctg

SEQ ID NO: 8253459 - DNA, 22 bp, Homo sapiens
tgccctggcgctgtctctatgg

SEQ ID NO: 8253460 - DNA, 22 bp, Homo sapiens
tgccctggctcctcccacgctg

SEQ ID NO: 8253461 - DNA, 22 bp, Homo sapiens
tgccctggctcctcccacgctg

SEQ ID NO: 8253462 - DNA, 22 bp, Homo sapiens
tgccctggctcctcccacgctg

SEQ ID NO: 8253463 - DNA, 22 bp, Homo sapiens
tgccctggctcctcccacgctg

SEQ ID NO: 8253464 - DNA, 22 bp, Homo sapiens
tgccctggctcttcttgttcca

SEQ ID NO: 8253465 - DNA, 22 bp, Homo sapiens
tgccgcagtgcggggagggccc

SEQ ID NO: 8253466 - DNA, 22 bp, Homo sapiens
tgccgcctggtttctccgcccc

SEQ ID NO: 8253467 - DNA, 22 bp, Homo sapiens
tgccgcagtgcggggagggccc

SEQ ID NO: 8253468 - DNA, 22 bp, Homo sapiens
tgccgcagtgcggggagggccc

SEQ ID NO: 8253469 - DNA, 22 bp, Homo sapiens
tgccgcagtgcggggagggccc

SEQ ID NO: 8253470 - DNA, 22 bp, Homo sapiens
tgccgcgcccgccaggtgtgtc

SEQ ID NO: 8253471 - DNA, 22 bp, Homo sapiens
tgccgcgcgcccaggttaggtg

SEQ ID NO: 8253472 - DNA, 22 bp, Homo sapiens
tgccgctccaggtctcgcggtg

SEQ ID NO: 8253473 - DNA, 20 bp, Homo sapiens
tgccgggcagcctgaggagt

SEQ ID NO: 8253474 - DNA, 22 bp, Homo sapiens
tgcctaactccaccaggcaggt

SEQ ID NO: 8253475 - DNA, 22 bp, Homo sapiens
tgcctaaacagtccccaaatta

SEQ ID NO: 8253476 - DNA, 22 bp, Homo sapiens
tgcctactagtactattttgtg

SEQ ID NO: 8253477 - DNA, 22 bp, Homo sapiens
tgcctaccagtgttctcccttc

SEQ ID NO: 8253478 - DNA, 22 bp, Homo sapiens
tgccgtggggctgaggctggag

SEQ ID NO: 8253479 - DNA, 22 bp, Homo sapiens
tgccgtggggctgaggctggag

SEQ ID NO: 8253480 - DNA, 22 bp, Homo sapiens
tgcctcaagccctccactgcac

SEQ ID NO: 8253481 - DNA, 22 bp, Homo sapiens
tgcctcagagacctgacagtac

SEQ ID NO: 8253482 - DNA, 22 bp, Homo sapiens
tgcctcagagtgggcttgctat

SEQ ID NO: 8253483 - DNA, 22 bp, Homo sapiens
tgcctcaagccctccactgcac

SEQ ID NO: 8253484 - DNA, 22 bp, Homo sapiens
tgcctcagagacctgacagtac

SEQ ID NO: 8253485 - DNA, 22 bp, Homo sapiens
tgcctcagagacctgacagtac

SEQ ID NO: 8253486 - DNA, 22 bp, Homo sapiens
tgcctaggctggagtgcaatgg

SEQ ID NO: 8253487 - DNA, 22 bp, Homo sapiens
tgcctaggaaacctcatgcttc

SEQ ID NO: 8253488 - DNA, 22 bp, Homo sapiens
tgcctagaactttattctttat

SEQ ID NO: 8253489 - DNA, 22 bp, Homo sapiens
tgcctaggctggagtgtagtgg

SEQ ID NO: 8253490 - DNA, 22 bp, Homo sapiens
tgcctaggctggagtgtagtgg

SEQ ID NO: 8253491 - DNA, 22 bp, Homo sapiens
tgcctagggcctaaccagagcc

SEQ ID NO: 8253492 - DNA, 22 bp, Homo sapiens
tgccgcaagtactgctgcctgt

SEQ ID NO: 8253493 - DNA, 22 bp, Homo sapiens
tgcccttgggtaacttgctgat

SEQ ID NO: 8253494 - DNA, 22 bp, Homo sapiens
tgcccttgggatttaggtaagg

SEQ ID NO: 8253495 - DNA, 22 bp, Homo sapiens
tgccctgttcctgcctccagct

SEQ ID NO: 8253496 - DNA, 22 bp, Homo sapiens
tgccctgtgtgtgcaagcactg

SEQ ID NO: 8253497 - DNA, 22 bp, Homo sapiens
tgccctgttatcttggaagagt

SEQ ID NO: 8253498 - DNA, 22 bp, Homo sapiens
tgccctgtgccagacttcctgg

SEQ ID NO: 8253499 - DNA, 22 bp, Homo sapiens
tgccctgtcgctcactcccacc

SEQ ID NO: 8253500 - DNA, 22 bp, Homo sapiens
tgccctgtctaagctgtcagta

SEQ ID NO: 8253501 - DNA, 22 bp, Homo sapiens
tgccctgtctaagctgtcagta

SEQ ID NO: 8253502 - DNA, 22 bp, Homo sapiens
tgccctgggacatgcagcggag

SEQ ID NO: 8253503 - DNA, 22 bp, Homo sapiens
tgccctgggacatgcagcggag

SEQ ID NO: 8253504 - DNA, 22 bp, Homo sapiens
tgccctgggaacacagatgcca

SEQ ID NO: 8253505 - DNA, 22 bp, Homo sapiens
tgccctgggaacacagatgcca

SEQ ID NO: 8253506 - DNA, 22 bp, Homo sapiens
tgccctgggaacacagatgcca

SEQ ID NO: 8253507 - DNA, 22 bp, Homo sapiens
tgccctgggaacacagatgcca

SEQ ID NO: 8253508 - DNA, 22 bp, Homo sapiens
tgccctgggaacacagatgcca

SEQ ID NO: 8253509 - DNA, 22 bp, Homo sapiens
tgccctgggaacacagatgcca

SEQ ID NO: 8253510 - DNA, 22 bp, Homo sapiens
tgccctggcttcagctttggct

SEQ ID NO: 8253511 - DNA, 22 bp, Homo sapiens
tgccctggctggagtgcagtgg

SEQ ID NO: 8253512 - DNA, 19 bp, Homo sapiens
tgcctggagcataacaggc

SEQ ID NO: 8253513 - DNA, 22 bp, Homo sapiens
tgcctggagaaggcaccatctg

SEQ ID NO: 8253514 - DNA, 19 bp, Homo sapiens
tgcctggagcataacaggc

SEQ ID NO: 8253515 - DNA, 22 bp, Homo sapiens
tgcctggagtccccaagtccat

SEQ ID NO: 8253516 - DNA, 22 bp, Homo sapiens
tgcctggagtgtgttcaggatt

SEQ ID NO: 8253517 - DNA, 22 bp, Homo sapiens
tgcctggagtccccaagtccat

SEQ ID NO: 8253518 - DNA, 22 bp, Homo sapiens
tgcctggatactcattaatttc

SEQ ID NO: 8253519 - DNA, 22 bp, Homo sapiens
tgcctggatctgaggacccatt

SEQ ID NO: 8253520 - DNA, 22 bp, Homo sapiens
tgcctggatctgaggacccatt

SEQ ID NO: 8253521 - DNA, 22 bp, Homo sapiens
tgcctggatggctctgagcagg

SEQ ID NO: 8253522 - DNA, 22 bp, Homo sapiens
tgcctggatggctctgagcagg

SEQ ID NO: 8253523 - DNA, 22 bp, Homo sapiens
tgcctggatgtgctggcctcac

SEQ ID NO: 8253524 - DNA, 22 bp, Homo sapiens
tgcctggattcaaagctcatgt

SEQ ID NO: 8253525 - DNA, 22 bp, Homo sapiens
tgcctggatgtgctggcctcac

SEQ ID NO: 8253526 - DNA, 22 bp, Homo sapiens
tgcctggatgtgctggcctcac

SEQ ID NO: 8253527 - DNA, 22 bp, Homo sapiens
tgcctggcaagaggggctggct

SEQ ID NO: 8253528 - DNA, 22 bp, Homo sapiens
tgcctggcaagaggggctggct

SEQ ID NO: 8253529 - DNA, 22 bp, Homo sapiens
tgcctggcaagaggggctggct

SEQ ID NO: 8253530 - DNA, 22 bp, Homo sapiens
tgcctggattcggttgttgtca

SEQ ID NO: 8253531 - DNA, 22 bp, Homo sapiens
tgcctggattcaaagctcatgt

SEQ ID NO: 8253532 - DNA, 22 bp, Homo sapiens
tgcctggattcaaagctcatgt

SEQ ID NO: 8253533 - DNA, 22 bp, Homo sapiens
tgcctggattcggttgttgtca

SEQ ID NO: 8253534 - DNA, 22 bp, Homo sapiens
tgcctggcaactgtggtgggct

SEQ ID NO: 8253535 - DNA, 22 bp, Homo sapiens
tgcctggcaccccagtctgcac

SEQ ID NO: 8253536 - DNA, 22 bp, Homo sapiens
tgcctggcaccccagtctgcac

SEQ ID NO: 8253537 - DNA, 22 bp, Homo sapiens
tgcctggcatctagccctggga

SEQ ID NO: 8253538 - DNA, 22 bp, Homo sapiens
tgcctggcagcttgaaagaaat

SEQ ID NO: 8253539 - DNA, 22 bp, Homo sapiens
tgcctggcatctagccctggga

SEQ ID NO: 8253540 - DNA, 22 bp, Homo sapiens
tgcctggcatgttatagacaca

SEQ ID NO: 8253541 - DNA, 22 bp, Homo sapiens
tgcctggcatctagccctggga

SEQ ID NO: 8253542 - DNA, 19 bp, Homo sapiens
tgcctggcaccagctccac

SEQ ID NO: 8253543 - DNA, 19 bp, Homo sapiens
tgcctggcaccagctccac

SEQ ID NO: 8253544 - DNA, 22 bp, Homo sapiens
tgcctggcaccccagtctgcac

SEQ ID NO: 8253545 - DNA, 22 bp, Homo sapiens
tgcctggcacagagcaggtggc

SEQ ID NO: 8253546 - DNA, 22 bp, Homo sapiens
tgcctggcaatgccagaagcca

SEQ ID NO: 8253547 - DNA, 22 bp, Homo sapiens
tgcctgccacgcttgctaccac

SEQ ID NO: 8253548 - DNA, 22 bp, Homo sapiens
tgcctgcccacgactacagcag

SEQ ID NO: 8253549 - DNA, 22 bp, Homo sapiens
tgcctgataccctctgtctctc

SEQ ID NO: 8253550 - DNA, 22 bp, Homo sapiens
tgcctgatgcaggagtatcaga

SEQ ID NO: 8253551 - DNA, 22 bp, Homo sapiens
tgcctgatgcaggagtatcaga

SEQ ID NO: 8253552 - DNA, 22 bp, Homo sapiens
tgcctgagtttaaccctcagag

SEQ ID NO: 8253553 - DNA, 22 bp, Homo sapiens
tgcctgatgcaggagtatcaga

SEQ ID NO: 8253554 - DNA, 22 bp, Homo sapiens
tgcctgatgcaggagtatcaga

SEQ ID NO: 8253555 - DNA, 22 bp, Homo sapiens
tgcctgagtttaaccctcagag

SEQ ID NO: 8253556 - DNA, 20 bp, Homo sapiens
tgcctgcccaggtcctgcac

SEQ ID NO: 8253557 - DNA, 22 bp, Homo sapiens
tgcctgctgcctttcatcccaa

SEQ ID NO: 8253558 - DNA, 22 bp, Homo sapiens
tgcctgcttgtttacctactcc

SEQ ID NO: 8253559 - DNA, 19 bp, Homo sapiens
tgcctgctgtattccagag

SEQ ID NO: 8253560 - DNA, 22 bp, Homo sapiens
tgcctggaaggcccatgggaag

SEQ ID NO: 8253561 - DNA, 19 bp, Homo sapiens
tgcctggacaaatgtgggg

SEQ ID NO: 8253562 - DNA, 19 bp, Homo sapiens
tgcctggacaaatgtgggg

SEQ ID NO: 8253563 - DNA, 22 bp, Homo sapiens
tgcctggaccccacctccggaa

SEQ ID NO: 8253564 - DNA, 22 bp, Homo sapiens
tgcctggaccccacctccggaa

SEQ ID NO: 8253565 - DNA, 23 bp, Homo sapiens
tgcctggagaagcatgaaatgta

SEQ ID NO: 8253566 - DNA, 23 bp, Homo sapiens
tgcctggagaagcatgaaatgta

SEQ ID NO: 8253567 - DNA, 22 bp, Homo sapiens
tgcctggagaaggcaccatctg

SEQ ID NO: 8253568 - DNA, 22 bp, Homo sapiens
tgcctggaaggcccatgggaag

SEQ ID NO: 8253569 - DNA, 18 bp, Homo sapiens
tgcctggaaggaacagga

SEQ ID NO: 8253570 - DNA, 18 bp, Homo sapiens
tgcctggaaggaacagga

SEQ ID NO: 8253571 - DNA, 22 bp, Homo sapiens
tgcctgctttctcctcaactca

SEQ ID NO: 8253572 - DNA, 22 bp, Homo sapiens
tgcctgctttctcctcaactca

SEQ ID NO: 8253573 - DNA, 22 bp, Homo sapiens
tgcctgctttctgggctgccat

SEQ ID NO: 8253574 - DNA, 22 bp, Homo sapiens
tgcctcagctgaggccgctcca

SEQ ID NO: 8253575 - DNA, 22 bp, Homo sapiens
tgcctcagctgaggccgctcca

SEQ ID NO: 8253576 - DNA, 22 bp, Homo sapiens
tgcctcagctgaggccgctcca

SEQ ID NO: 8253577 - DNA, 22 bp, Homo sapiens
tgcctcaggcacctggcaggtt

SEQ ID NO: 8253578 - DNA, 22 bp, Homo sapiens
tgcctcaggcacctggcaggtt

SEQ ID NO: 8253579 - DNA, 22 bp, Homo sapiens
tgcctcaggcacctggcaggtt

SEQ ID NO: 8253580 - DNA, 22 bp, Homo sapiens
tgcctcaggcacctggcaggtt

SEQ ID NO: 8253581 - DNA, 22 bp, Homo sapiens
tgcctcagagtgggcttgctat

SEQ ID NO: 8253582 - DNA, 22 bp, Homo sapiens
tgcctcagagttgtccctacca

SEQ ID NO: 8253583 - DNA, 22 bp, Homo sapiens
tgcctcagctgaggccgctcca

SEQ ID NO: 8253584 - DNA, 22 bp, Homo sapiens
tgcctcagctgaggccgctcca

SEQ ID NO: 8253585 - DNA, 22 bp, Homo sapiens
tgcctcagtctaaagtctctca

SEQ ID NO: 8253586 - DNA, 22 bp, Homo sapiens
tgcctcagtctaaagtctctca

SEQ ID NO: 8253587 - DNA, 22 bp, Homo sapiens
tgcctcagtctaaagtctctca

SEQ ID NO: 8253588 - DNA, 22 bp, Homo sapiens
tgcctcagtcagcttccctggg

SEQ ID NO: 8253589 - DNA, 19 bp, Homo sapiens
tgcctcagggctttgagga

SEQ ID NO: 8253590 - DNA, 22 bp, Homo sapiens
tgcctcagtcagcttccctggg

SEQ ID NO: 8253591 - DNA, 22 bp, Homo sapiens
tgcctcagtcagcttccctggg

SEQ ID NO: 8253592 - DNA, 19 bp, Homo sapiens
tgcctcagggctttgagga

SEQ ID NO: 8253593 - DNA, 19 bp, Homo sapiens
tgcctcagggctttgagga

SEQ ID NO: 8253594 - DNA, 19 bp, Homo sapiens
tgcctcagggctttgagga

SEQ ID NO: 8253595 - DNA, 22 bp, Homo sapiens
tgcctctgaggaagattgtgtt

SEQ ID NO: 8253596 - DNA, 22 bp, Homo sapiens
tgcctctctaacccatgcccaa

SEQ ID NO: 8253597 - DNA, 22 bp, Homo sapiens
tgcctctctaacccatgcccaa

SEQ ID NO: 8253598 - DNA, 22 bp, Homo sapiens
tgcctctctaacccatgcccaa

SEQ ID NO: 8253599 - DNA, 22 bp, Homo sapiens
tgcctctgctgctgtggcatca

SEQ ID NO: 8253600 - DNA, 23 bp, Homo sapiens
tgcctctgcctccctagtctgca

SEQ ID NO: 8253601 - DNA, 22 bp, Homo sapiens
tgcctctctaacccatgcccaa

SEQ ID NO: 8253602 - DNA, 22 bp, Homo sapiens
tgcctctctaacccatgcccaa

SEQ ID NO: 8253603 - DNA, 22 bp, Homo sapiens
tgcctccctggcaagtctctcc

SEQ ID NO: 8253604 - DNA, 22 bp, Homo sapiens
tgcctccctggcaagtctctcc

SEQ ID NO: 8253605 - DNA, 22 bp, Homo sapiens
tgcctccctggcaagtctctcc

SEQ ID NO: 8253606 - DNA, 22 bp, Homo sapiens
tgcctccctctctgccactgga

SEQ ID NO: 8253607 - DNA, 22 bp, Homo sapiens
tgcctccctctctgccactgga

SEQ ID NO: 8253608 - DNA, 22 bp, Homo sapiens
tgcctccctctctgccactgga

SEQ ID NO: 8253609 - DNA, 22 bp, Homo sapiens
tgcctccctctctgccactgga

SEQ ID NO: 8253610 - DNA, 22 bp, Homo sapiens
tgcctctgttgagccttggctg

SEQ ID NO: 8253611 - DNA, 22 bp, Homo sapiens
tgcctgaagaaaacttgcagca

SEQ ID NO: 8253612 - DNA, 22 bp, Homo sapiens
tgcctgaaataccatcatgagt

SEQ ID NO: 8253613 - DNA, 22 bp, Homo sapiens
tgcctgaggagtcagggcaggt

SEQ ID NO: 8253614 - DNA, 22 bp, Homo sapiens
tgcctgaggagtcagggcaggt

SEQ ID NO: 8253615 - DNA, 22 bp, Homo sapiens
tgcctgagggagtaagagtcct

SEQ ID NO: 8253616 - DNA, 22 bp, Homo sapiens
tgcctgaggagtcagggcaggt

SEQ ID NO: 8253617 - DNA, 22 bp, Homo sapiens
tgcctgagtgatgtggcagcca

SEQ ID NO: 8253618 - DNA, 22 bp, Homo sapiens
tgcctgagtttaaccctcagag

SEQ ID NO: 8253619 - DNA, 22 bp, Homo sapiens
tgcctgagtgatgtggcagcca

SEQ ID NO: 8253620 - DNA, 22 bp, Homo sapiens
tgcctgagtgatgtggcagcca

SEQ ID NO: 8253621 - DNA, 22 bp, Homo sapiens
tgcctctgtgggccttcctggc

SEQ ID NO: 8253622 - DNA, 22 bp, Homo sapiens
tgcctctgtgggcagagctgcc

SEQ ID NO: 8253623 - DNA, 22 bp, Homo sapiens
tgcctctgtgggcagagctgcc

SEQ ID NO: 8253624 - DNA, 22 bp, Homo sapiens
tgcctctgtgggcagagctgcc

SEQ ID NO: 8253625 - DNA, 22 bp, Homo sapiens
tgcctctgtgggcagagctgcc

SEQ ID NO: 8253626 - DNA, 22 bp, Homo sapiens
tgcctctgtgggccttcctggc

SEQ ID NO: 8253627 - DNA, 22 bp, Homo sapiens
tgcctctgtgggccttcctggc

SEQ ID NO: 8253628 - DNA, 22 bp, Homo sapiens
tgcctctgtgggccttcctggc

SEQ ID NO: 8253629 - DNA, 22 bp, Homo sapiens
tgcctctggttatctggtacct

SEQ ID NO: 8253630 - DNA, 22 bp, Homo sapiens
tgcctctgggtgaccaaggagc

SEQ ID NO: 8253631 - DNA, 22 bp, Homo sapiens
tgcctctggcctttggtgccca

SEQ ID NO: 8253632 - DNA, 22 bp, Homo sapiens
tgcctctggttatctggtacct

SEQ ID NO: 8253633 - DNA, 22 bp, Homo sapiens
tgatagaaaggaaattaattgg

SEQ ID NO: 8253634 - DNA, 22 bp, Homo sapiens
tgatagaaaggaaattaattgg

SEQ ID NO: 8253635 - DNA, 22 bp, Homo sapiens
tgatactttggagacttgagta

SEQ ID NO: 8253636 - DNA, 22 bp, Homo sapiens
tgatacttttcttttagactaa

SEQ ID NO: 8253637 - DNA, 22 bp, Homo sapiens
tgagttctcacccattcttctt

SEQ ID NO: 8253638 - DNA, 22 bp, Homo sapiens
tgagttctaggcttaaaactaa

SEQ ID NO: 8253639 - DNA, 23 bp, Homo sapiens
tgagttctaggcttaaaactagc

SEQ ID NO: 8253640 - DNA, 22 bp, Homo sapiens
tgatatgtccctcgacatcagg

SEQ ID NO: 8253641 - DNA, 22 bp, Homo sapiens
tgatatgtaactactccttata

SEQ ID NO: 8253642 - DNA, 22 bp, Homo sapiens
tgatatgggaaaagggctcgga

SEQ ID NO: 8253643 - DNA, 20 bp, Homo sapiens
tgatatggtttggctgtgtt

SEQ ID NO: 8253644 - DNA, 20 bp, Homo sapiens
tgatatattactcaggggaa

SEQ ID NO: 8253645 - DNA, 22 bp, Homo sapiens
tgatatcctttaacctggaccg

SEQ ID NO: 8253646 - DNA, 22 bp, Homo sapiens
tgatatgcatgtaagggagaca

SEQ ID NO: 8253647 - DNA, 22 bp, Homo sapiens
tgatatttgctgactgcattgt

SEQ ID NO: 8253648 - DNA, 20 bp, Homo sapiens
tgatatttctggaagtggag

SEQ ID NO: 8253649 - DNA, 22 bp, Homo sapiens
tgatatttaagcaaaaatatgg

SEQ ID NO: 8253650 - DNA, 22 bp, Homo sapiens
tgatatgtgaagctattagttc

SEQ ID NO: 8253651 - DNA, 22 bp, Homo sapiens
tgatatgtttggatttaggttt

SEQ ID NO: 8253652 - DNA, 22 bp, Homo sapiens
tgatatgtgaagctattagttc

SEQ ID NO: 8253653 - DNA, 22 bp, Homo sapiens
tgatatttaagcaaaaatatgg

SEQ ID NO: 8253654 - DNA, 22 bp, Homo sapiens
tgatatttaagcaaaaatatgg

SEQ ID NO: 8253655 - DNA, 22 bp, Homo sapiens
tgatcacaagtctgaagaatga

SEQ ID NO: 8253656 - DNA, 22 bp, Homo sapiens
tgatcaaaacattactccacca

SEQ ID NO: 8253657 - DNA, 22 bp, Homo sapiens
tgatcaaaacattactccacca

SEQ ID NO: 8253658 - DNA, 22 bp, Homo sapiens
tgatcaaaacattactccacca

SEQ ID NO: 8253659 - DNA, 22 bp, Homo sapiens
tgatattttatgagctttcata

SEQ ID NO: 8253660 - DNA, 22 bp, Homo sapiens
tgatattttatgagctttcata

SEQ ID NO: 8253661 - DNA, 22 bp, Homo sapiens
tgatattttatgagctttcata

SEQ ID NO: 8253662 - DNA, 22 bp, Homo sapiens
tgatatttttcactggcctctg

SEQ ID NO: 8253663 - DNA, 22 bp, Homo sapiens
tgatcagcatcttcccagctcg

SEQ ID NO: 8253664 - DNA, 21 bp, Homo sapiens
tgatcacatgaaaaccatgca

SEQ ID NO: 8253665 - DNA, 21 bp, Homo sapiens
tgatcatttgtgtaaaggaga

SEQ ID NO: 8253666 - DNA, 21 bp, Homo sapiens
tgatcatttgtgtaaaggaga

SEQ ID NO: 8253667 - DNA, 22 bp, Homo sapiens
tgatcagtaaccaatcacatca

SEQ ID NO: 8253668 - DNA, 22 bp, Homo sapiens
tgatcatccagtttcttgtcca

SEQ ID NO: 8253669 - DNA, 22 bp, Homo sapiens
tgatctcctgaccttgtaatcc

SEQ ID NO: 8253670 - DNA, 22 bp, Homo sapiens
tgatctcctgaccttgtaatcc

SEQ ID NO: 8253671 - DNA, 22 bp, Homo sapiens
tgatctaggttggcttcaactg

SEQ ID NO: 8253672 - DNA, 22 bp, Homo sapiens
tgatcccaatctttcctgctcc

SEQ ID NO: 8253673 - DNA, 22 bp, Homo sapiens
tgatccccttcccagtaagcct

SEQ ID NO: 8253674 - DNA, 22 bp, Homo sapiens
tgatctggaattccctgtggta

SEQ ID NO: 8253675 - DNA, 22 bp, Homo sapiens
tgatctggtcctactgtgggca

SEQ ID NO: 8253676 - DNA, 22 bp, Homo sapiens
tgatcttcaccttgttctttgg

SEQ ID NO: 8253677 - DNA, 22 bp, Homo sapiens
tgatctggtcctactgtgggca

SEQ ID NO: 8253678 - DNA, 23 bp, Homo sapiens
tgagtgtgttccctgtgagattt

SEQ ID NO: 8253679 - DNA, 22 bp, Homo sapiens
tgagttataatgaatatttgaa

SEQ ID NO: 8253680 - DNA, 22 bp, Homo sapiens
tgagttaaatgagaacatgaaa

SEQ ID NO: 8253681 - DNA, 22 bp, Homo sapiens
tgagttatctaaaatagtcaaa

SEQ ID NO: 8253682 - DNA, 22 bp, Homo sapiens
tgagttatctaaaatagtcaaa

SEQ ID NO: 8253683 - DNA, 22 bp, Homo sapiens
tgagttcaaattttggctctgc

SEQ ID NO: 8253684 - DNA, 22 bp, Homo sapiens
tgagttcaaagacaggtatagg

SEQ ID NO: 8253685 - DNA, 22 bp, Homo sapiens
tgagttatggagaataaagtca

SEQ ID NO: 8253686 - DNA, 22 bp, Homo sapiens
tgagttattgagaaataactgc

SEQ ID NO: 8253687 - DNA, 22 bp, Homo sapiens
tgagttccacacctaggaagtc

SEQ ID NO: 8253688 - DNA, 20 bp, Homo sapiens
tgagttcatttgcatgtggt

SEQ ID NO: 8253689 - DNA, 22 bp, Homo sapiens
tgagttcagatcctggctctgc

SEQ ID NO: 8253690 - DNA, 22 bp, Homo sapiens
tgagttcacatgaggtctggtc

SEQ ID NO: 8253691 - DNA, 22 bp, Homo sapiens
tgagtgggttatcaggaaaggt

SEQ ID NO: 8253692 - DNA, 19 bp, Homo sapiens
tgagtgggcccctgcagac

SEQ ID NO: 8253693 - DNA, 19 bp, Homo sapiens
tgagtgggcccctgcagac

SEQ ID NO: 8253694 - DNA, 22 bp, Homo sapiens
tgagtgggattaaatgaggtga

SEQ ID NO: 8253695 - DNA, 22 bp, Homo sapiens
tgagtgggattaaatgaggtga

SEQ ID NO: 8253696 - DNA, 19 bp, Homo sapiens
tgagtgggcccctgcagac

SEQ ID NO: 8253697 - DNA, 22 bp, Homo sapiens
tgagtgggttatcaggaaaggt

SEQ ID NO: 8253698 - DNA, 22 bp, Homo sapiens
tgagtgtctggtcatggcaggc

SEQ ID NO: 8253699 - DNA, 19 bp, Homo sapiens
tgagtgtcacgtcagtgcc

SEQ ID NO: 8253700 - DNA, 22 bp, Homo sapiens
tgagtgtctggtcatggcaggc

SEQ ID NO: 8253701 - DNA, 22 bp, Homo sapiens
tgagtgtccttaaggttgttct

SEQ ID NO: 8253702 - DNA, 23 bp, Homo sapiens
tgagtgtggggacagtggtttgc

SEQ ID NO: 8253703 - DNA, 22 bp, Homo sapiens
tgagtgtggggaatgtcatgag

SEQ ID NO: 8253704 - DNA, 22 bp, Homo sapiens
tgagtgtgctaggtgtctcggt

SEQ ID NO: 8253705 - DNA, 22 bp, Homo sapiens
tgagtgggacctgcgtgtgtca

SEQ ID NO: 8253706 - DNA, 22 bp, Homo sapiens
tgagtgggacctgcgtgtgtca

SEQ ID NO: 8253707 - DNA, 22 bp, Homo sapiens
tgagtggagtagtgaatgcatt

SEQ ID NO: 8253708 - DNA, 19 bp, Homo sapiens
tgagtggagtgcaatgaag

SEQ ID NO: 8253709 - DNA, 22 bp, Homo sapiens
tgagtgggatgagttagaggtg

SEQ ID NO: 8253710 - DNA, 16 bp, Homo sapiens
tgagtgggagaagggg

SEQ ID NO: 8253711 - DNA, 22 bp, Homo sapiens
tgagtgggattaaatgaggtga

SEQ ID NO: 8253712 - DNA, 16 bp, Homo sapiens
tgagtgggagaagggg

SEQ ID NO: 8253713 - DNA, 16 bp, Homo sapiens
tgagtgggagaagggg

SEQ ID NO: 8253714 - DNA, 19 bp, Homo sapiens
tgagtgggagcccaggtat

SEQ ID NO: 8253715 - DNA, 19 bp, Homo sapiens
tgagtgggagcccaggtat

SEQ ID NO: 8253716 - DNA, 22 bp, Homo sapiens
tgagtggacacctgcttcttta

SEQ ID NO: 8253717 - DNA, 22 bp, Homo sapiens
tgagtggacacctgcttcttta

SEQ ID NO: 8253718 - DNA, 22 bp, Homo sapiens
tgagtgctgcattagcagatat

SEQ ID NO: 8253719 - DNA, 22 bp, Homo sapiens
tgagtgctgtctgtctagcctc

SEQ ID NO: 8253720 - DNA, 22 bp, Homo sapiens
tgagtggagaacagaggctctc

SEQ ID NO: 8253721 - DNA, 22 bp, Homo sapiens
tgagtgagacaccaaaggctgt

SEQ ID NO: 8253722 - DNA, 22 bp, Homo sapiens
tgagtgagacatcctgtcttaa

SEQ ID NO: 8253723 - DNA, 22 bp, Homo sapiens
tgagtgaggctgggcagtccct

SEQ ID NO: 8253724 - DNA, 22 bp, Homo sapiens
tgagtgaggaagcggtggagga

SEQ ID NO: 8253725 - DNA, 21 bp, Homo sapiens
tgagtcttttgcacaaggaat

SEQ ID NO: 8253726 - DNA, 22 bp, Homo sapiens
tgagtcttttatcctgggaatg

SEQ ID NO: 8253727 - DNA, 22 bp, Homo sapiens
tgagtcttttatcctgggaatg

SEQ ID NO: 8253728 - DNA, 22 bp, Homo sapiens
tgagtgaccagaagtccccctc

SEQ ID NO: 8253729 - DNA, 22 bp, Homo sapiens
tgagtgcctgaacatagagtag

SEQ ID NO: 8253730 - DNA, 22 bp, Homo sapiens
tgagtgctaagaataatctgca

SEQ ID NO: 8253731 - DNA, 20 bp, Homo sapiens
tgagtgctccattctgccca

SEQ ID NO: 8253732 - DNA, 22 bp, Homo sapiens
tgagtgctctgtatgtgccaga

SEQ ID NO: 8253733 - DNA, 22 bp, Homo sapiens
tgagtgagttttcacggtcagc

SEQ ID NO: 8253734 - DNA, 20 bp, Homo sapiens
tgagtgagtttgtggcagga

SEQ ID NO: 8253735 - DNA, 20 bp, Homo sapiens
tgagtgagtttgtggcagga

SEQ ID NO: 8253736 - DNA, 22 bp, Homo sapiens
tgagtgaggtgcttagggcaca

SEQ ID NO: 8253737 - DNA, 22 bp, Homo sapiens
tgagtgaggctgggcagtccct

SEQ ID NO: 8253738 - DNA, 22 bp, Homo sapiens
tgattgtatgattgaaatattt

SEQ ID NO: 8253739 - DNA, 22 bp, Homo sapiens
tgatttaaaagaaacattgtct

SEQ ID NO: 8253740 - DNA, 22 bp, Homo sapiens
tgattggtcaggctgtggtgac

SEQ ID NO: 8253741 - DNA, 22 bp, Homo sapiens
tgattggtcaggctgtggtgac

SEQ ID NO: 8253742 - DNA, 22 bp, Homo sapiens
tgattctgtaaacatgtcttta

SEQ ID NO: 8253743 - DNA, 23 bp, Homo sapiens
tgattgaaatgaggagtatttgt

SEQ ID NO: 8253744 - DNA, 22 bp, Homo sapiens
tgattctctgatggagaaagac

SEQ ID NO: 8253745 - DNA, 22 bp, Homo sapiens
tgattctcttgtaagctatgtt

SEQ ID NO: 8253746 - DNA, 22 bp, Homo sapiens
tgattctatctaggtagaactg

SEQ ID NO: 8253747 - DNA, 22 bp, Homo sapiens
tgattctatctaggtagaactg

SEQ ID NO: 8253748 - DNA, 22 bp, Homo sapiens
tgattctatattggaaaagggg

SEQ ID NO: 8253749 - DNA, 23 bp, Homo sapiens
tgattctgctttgagaatcatgg

SEQ ID NO: 8253750 - DNA, 22 bp, Homo sapiens
tgattctgccccttggctctgg

SEQ ID NO: 8253751 - DNA, 22 bp, Homo sapiens
tgattctgatcatcatcatggt

SEQ ID NO: 8253752 - DNA, 22 bp, Homo sapiens
tgattcctaggcactcttctcc

SEQ ID NO: 8253753 - DNA, 22 bp, Homo sapiens
tgattcatcagaataggagttt

SEQ ID NO: 8253754 - DNA, 22 bp, Homo sapiens
tgattccactctgaggatcgta

SEQ ID NO: 8253755 - DNA, 22 bp, Homo sapiens
tgattcacgtaataagaaaaag

SEQ ID NO: 8253756 - DNA, 22 bp, Homo sapiens
tgattcatcagaataggagttt

SEQ ID NO: 8253757 - DNA, 22 bp, Homo sapiens
tgattcagttggttttgttcag

SEQ ID NO: 8253758 - DNA, 22 bp, Homo sapiens
tgattcagtctcttcaggagaa

SEQ ID NO: 8253759 - DNA, 22 bp, Homo sapiens
tgattcagtctcttcaggagaa

SEQ ID NO: 8253760 - DNA, 22 bp, Homo sapiens
tgattcagacctgtcagacttc

SEQ ID NO: 8253761 - DNA, 23 bp, Homo sapiens
tgattcagcaagtccacttctgg

SEQ ID NO: 8253762 - DNA, 22 bp, Homo sapiens
tgattacaaaagattgtttgaa

SEQ ID NO: 8253763 - DNA, 23 bp, Homo sapiens
tgattacaagggccaaagaaagg

SEQ ID NO: 8253764 - DNA, 23 bp, Homo sapiens
tgattacaagggccaaagaaagg

SEQ ID NO: 8253765 - DNA, 22 bp, Homo sapiens
tgattacaattgtcttagattt

SEQ ID NO: 8253766 - DNA, 23 bp, Homo sapiens
tgattacaagggccaaagaaagg

SEQ ID NO: 8253767 - DNA, 22 bp, Homo sapiens
tgattaagcaaagagcagtaaa

SEQ ID NO: 8253768 - DNA, 22 bp, Homo sapiens
tgattaagttcaaaatatagaa

SEQ ID NO: 8253769 - DNA, 22 bp, Homo sapiens
tgatgtctgccagggtcctggg

SEQ ID NO: 8253770 - DNA, 22 bp, Homo sapiens
tgatgtctgccagggtcctggg

SEQ ID NO: 8253771 - DNA, 22 bp, Homo sapiens
tgatggttttattaataggacc

SEQ ID NO: 8253772 - DNA, 22 bp, Homo sapiens
tgatggttgattataaatcagt

SEQ ID NO: 8253773 - DNA, 22 bp, Homo sapiens
tgatggtcaacaattttgagtg

SEQ ID NO: 8253774 - DNA, 22 bp, Homo sapiens
tgatggtgggtctgatctcata

SEQ ID NO: 8253775 - DNA, 22 bp, Homo sapiens
tgatgtcctcatgtcaagctcc

SEQ ID NO: 8253776 - DNA, 22 bp, Homo sapiens
tgatgtacacaatgaaattatg

SEQ ID NO: 8253777 - DNA, 22 bp, Homo sapiens
tgatgtaagagatacacttgat

SEQ ID NO: 8253778 - DNA, 22 bp, Homo sapiens
tgattaaaatttaacttagtta

SEQ ID NO: 8253779 - DNA, 22 bp, Homo sapiens
tgatgtttaatactatgctttt

SEQ ID NO: 8253780 - DNA, 22 bp, Homo sapiens
tgatgttattagatacaaacca

SEQ ID NO: 8253781 - DNA, 22 bp, Homo sapiens
tgatggaaatattgacaccaca

SEQ ID NO: 8253782 - DNA, 22 bp, Homo sapiens
tgatggaaatgttctgtatctg

SEQ ID NO: 8253783 - DNA, 23 bp, Homo sapiens
tgatggaaatgatctgggtctgt

SEQ ID NO: 8253784 - DNA, 22 bp, Homo sapiens
tgatggaaatgttctgtatctg

SEQ ID NO: 8253785 - DNA, 22 bp, Homo sapiens
tgatggaaatttgggaagcttt

SEQ ID NO: 8253786 - DNA, 22 bp, Homo sapiens
tgatggaacagcctttgccaaa

SEQ ID NO: 8253787 - DNA, 22 bp, Homo sapiens
tgatggaaaataaatcttattc

SEQ ID NO: 8253788 - DNA, 22 bp, Homo sapiens
tgatggaaacttgggtaagtca

SEQ ID NO: 8253789 - DNA, 21 bp, Homo sapiens
tgatggaaaggattttgggtc

SEQ ID NO: 8253790 - DNA, 22 bp, Homo sapiens
tgatggaaatatgtaatctggt

SEQ ID NO: 8253791 - DNA, 22 bp, Homo sapiens
tgatggaaataaaagcatagct

SEQ ID NO: 8253792 - DNA, 22 bp, Homo sapiens
tgatggaaataaaagcatagct

SEQ ID NO: 8253793 - DNA, 19 bp, Homo sapiens
tgatggaatttgacattcc

SEQ ID NO: 8253794 - DNA, 22 bp, Homo sapiens
tgatggaaggtttctcggtgat

SEQ ID NO: 8253795 - DNA, 22 bp, Homo sapiens
tgatggaagagctaacaatatc

SEQ ID NO: 8253796 - DNA, 22 bp, Homo sapiens
tgatggaatggaggacatgtgg

SEQ ID NO: 8253797 - DNA, 22 bp, Homo sapiens
tgatggaagtgactgtcagttc

SEQ ID NO: 8253798 - DNA, 22 bp, Homo sapiens
tgatggaagtgactgtcagttc

SEQ ID NO: 8253799 - DNA, 22 bp, Homo sapiens
tgatggaatataccttcgggag

SEQ ID NO: 8253800 - DNA, 22 bp, Homo sapiens
tgatggctatccctggaagggc

SEQ ID NO: 8253801 - DNA, 22 bp, Homo sapiens
tgatggctcccatgggcatatg

SEQ ID NO: 8253802 - DNA, 22 bp, Homo sapiens
tgatggctcatgtttggggatg

SEQ ID NO: 8253803 - DNA, 22 bp, Homo sapiens
tgatggctccttcattatgggt

SEQ ID NO: 8253804 - DNA, 22 bp, Homo sapiens
tgatggctccttcattatgggt

SEQ ID NO: 8253805 - DNA, 19 bp, Homo sapiens
tgatggctggaactatact

SEQ ID NO: 8253806 - DNA, 22 bp, Homo sapiens
tgatggctgtagggtccggggc

SEQ ID NO: 8253807 - DNA, 22 bp, Homo sapiens
tgatggctggaagttcaaaaat

SEQ ID NO: 8253808 - DNA, 22 bp, Homo sapiens
tgatggctgtgctgatgttagg

SEQ ID NO: 8253809 - DNA, 22 bp, Homo sapiens
tgatggcttcggacctgggcag

SEQ ID NO: 8253810 - DNA, 22 bp, Homo sapiens
tgatggcttatggagagagcaa

SEQ ID NO: 8253811 - DNA, 22 bp, Homo sapiens
tgatggcttagtggcagggcga

SEQ ID NO: 8253812 - DNA, 22 bp, Homo sapiens
tgatggatgtggctctggagct

SEQ ID NO: 8253813 - DNA, 18 bp, Homo sapiens
tgatggaggagggctggt

SEQ ID NO: 8253814 - DNA, 22 bp, Homo sapiens
tgatggtattaggaggtgaggc

SEQ ID NO: 8253815 - DNA, 22 bp, Homo sapiens
tgatggtatgggattaccatgt

SEQ ID NO: 8253816 - DNA, 22 bp, Homo sapiens
tgatggtcaggatgcatggaga

SEQ ID NO: 8253817 - DNA, 20 bp, Homo sapiens
tgatggtattaggaggtgtg

SEQ ID NO: 8253818 - DNA, 22 bp, Homo sapiens
tgatggtagtttatcaaaaaga

SEQ ID NO: 8253819 - DNA, 22 bp, Homo sapiens
tgatggtagggatactacagga

SEQ ID NO: 8253820 - DNA, 22 bp, Homo sapiens
tgatggtaaatccatatacctt

SEQ ID NO: 8253821 - DNA, 22 bp, Homo sapiens
tgatggtaaacaaagacattta

SEQ ID NO: 8253822 - DNA, 22 bp, Homo sapiens
tgatggcttttaggcttttaag

SEQ ID NO: 8253823 - DNA, 22 bp, Homo sapiens
tgatgggaaaatgaggcctggg

SEQ ID NO: 8253824 - DNA, 22 bp, Homo sapiens
tgatgggaaaatgaggcctggg

SEQ ID NO: 8253825 - DNA, 22 bp, Homo sapiens
tgatgggactgccagctgctga

SEQ ID NO: 8253826 - DNA, 22 bp, Homo sapiens
tgatgggactgccagctgctga

SEQ ID NO: 8253827 - DNA, 22 bp, Homo sapiens
tgatgggaggtgctgcaggacc

SEQ ID NO: 8253828 - DNA, 22 bp, Homo sapiens
tgatgctgctgggagtggtgct

SEQ ID NO: 8253829 - DNA, 22 bp, Homo sapiens
tgatgcctatgaattgtaatgt

SEQ ID NO: 8253830 - DNA, 22 bp, Homo sapiens
tgatgaatgtcatacataatga

SEQ ID NO: 8253831 - DNA, 22 bp, Homo sapiens
tgatgaatgtcatacataatga

SEQ ID NO: 8253832 - DNA, 22 bp, Homo sapiens
tgatgaatcctctatgcctttt

SEQ ID NO: 8253833 - DNA, 22 bp, Homo sapiens
tgatgaataaccttgagcatat

SEQ ID NO: 8253834 - DNA, 22 bp, Homo sapiens
tgatgaataaacttgagagtca

SEQ ID NO: 8253835 - DNA, 22 bp, Homo sapiens
tgatgaaagttcagtagtgaat

SEQ ID NO: 8253836 - DNA, 22 bp, Homo sapiens
tgatgaaagttcagtagtgaat

SEQ ID NO: 8253837 - DNA, 22 bp, Homo sapiens
tgatgaaaatgttcagcaatta

SEQ ID NO: 8253838 - DNA, 22 bp, Homo sapiens
tgatgaaactgaggttccaaga

SEQ ID NO: 8253839 - DNA, 22 bp, Homo sapiens
tgatgaaagtgtttactcacct

SEQ ID NO: 8253840 - DNA, 22 bp, Homo sapiens
tgatgaaagtgtttactcacct

SEQ ID NO: 8253841 - DNA, 22 bp, Homo sapiens
tgatctttttggtcatttgggt

SEQ ID NO: 8253842 - DNA, 22 bp, Homo sapiens
tgatgaaaaccagaactctcat

SEQ ID NO: 8253843 - DNA, 22 bp, Homo sapiens
tgatgaaaatatgattctgagg

SEQ ID NO: 8253844 - DNA, 18 bp, Homo sapiens
tgatctttgagtataatg

SEQ ID NO: 8253845 - DNA, 22 bp, Homo sapiens
tgcacaaagcattctagacgca

SEQ ID NO: 8253846 - DNA, 22 bp, Homo sapiens
tgcacaaacttgtgtcccaggg

SEQ ID NO: 8253847 - DNA, 22 bp, Homo sapiens
tgcaatttttatcaattcagca

SEQ ID NO: 8253848 - DNA, 22 bp, Homo sapiens
tgcaatttttccatgacctaga

SEQ ID NO: 8253849 - DNA, 22 bp, Homo sapiens
tgcacaaaggctccctgctgag

SEQ ID NO: 8253850 - DNA, 22 bp, Homo sapiens
tgcacaaatttgtgtatgctca

SEQ ID NO: 8253851 - DNA, 22 bp, Homo sapiens
tgcacaaatttgtgtatgctca

SEQ ID NO: 8253852 - DNA, 17 bp, Homo sapiens
tgcacaagagacaatag

SEQ ID NO: 8253853 - DNA, 22 bp, Homo sapiens
tgcacacaagttggagaatgaa

SEQ ID NO: 8253854 - DNA, 22 bp, Homo sapiens
tgcacacacacgtagagaaaag

SEQ ID NO: 8253855 - DNA, 22 bp, Homo sapiens
tgcacacaaatgtgaacgtgcc

SEQ ID NO: 8253856 - DNA, 22 bp, Homo sapiens
tgcacacaagttggagaatgaa

SEQ ID NO: 8253857 - DNA, 22 bp, Homo sapiens
tgcacacaaatgtgaacgtgcc

SEQ ID NO: 8253858 - DNA, 22 bp, Homo sapiens
tgcaatctcggcactttgggag

SEQ ID NO: 8253859 - DNA, 22 bp, Homo sapiens
tgcaatctcggcactttgggag

SEQ ID NO: 8253860 - DNA, 22 bp, Homo sapiens
tgcaatctcggcactttgggag

SEQ ID NO: 8253861 - DNA, 22 bp, Homo sapiens
tgcaattaatttacatgcttaa

SEQ ID NO: 8253862 - DNA, 22 bp, Homo sapiens
tgcaattaatttacatgcttaa

SEQ ID NO: 8253863 - DNA, 22 bp, Homo sapiens
tgcaattaatttacatgcttaa

SEQ ID NO: 8253864 - DNA, 22 bp, Homo sapiens
tgcaattactgggaggttttat

SEQ ID NO: 8253865 - DNA, 22 bp, Homo sapiens
tgcaattatgggcaatttttaa

SEQ ID NO: 8253866 - DNA, 22 bp, Homo sapiens
tgcaatttgacgtcagcacagt

SEQ ID NO: 8253867 - DNA, 22 bp, Homo sapiens
tgcaatttggggaagaaagaga

SEQ ID NO: 8253868 - DNA, 22 bp, Homo sapiens
tgcaatttcaggcatatattgt

SEQ ID NO: 8253869 - DNA, 22 bp, Homo sapiens
tgcacacacggagataggcttt

SEQ ID NO: 8253870 - DNA, 22 bp, Homo sapiens
tgcacacacgcggcacatctgt

SEQ ID NO: 8253871 - DNA, 22 bp, Homo sapiens
tgcacacacgcggcacatctgt

SEQ ID NO: 8253872 - DNA, 22 bp, Homo sapiens
tgcacacacgcggcacatctgt

SEQ ID NO: 8253873 - DNA, 22 bp, Homo sapiens
tgcacacacgcggcacatctgt

SEQ ID NO: 8253874 - DNA, 22 bp, Homo sapiens
tgcacacaccgtgcttcactga

SEQ ID NO: 8253875 - DNA, 20 bp, Homo sapiens
tgcacacaccctgtcctcca

SEQ ID NO: 8253876 - DNA, 20 bp, Homo sapiens
tgcacacaccctgtcctcca

SEQ ID NO: 8253877 - DNA, 22 bp, Homo sapiens
tgcacacacgcggcacatctgt

SEQ ID NO: 8253878 - DNA, 22 bp, Homo sapiens
tgcacacaccgtgcttcactga

SEQ ID NO: 8253879 - DNA, 20 bp, Homo sapiens
tgcacacaccctgtcctcca

SEQ ID NO: 8253880 - DNA, 22 bp, Homo sapiens
tgcacacacatgcagagggaga

SEQ ID NO: 8253881 - DNA, 22 bp, Homo sapiens
tgcacacacatgaagtagcatg

SEQ ID NO: 8253882 - DNA, 22 bp, Homo sapiens
tgcacacacatgaagtagcatg

SEQ ID NO: 8253883 - DNA, 22 bp, Homo sapiens
tgcacacacatgaagtagcatg

SEQ ID NO: 8253884 - DNA, 22 bp, Homo sapiens
tgcacacacaggagtctcctcc

SEQ ID NO: 8253885 - DNA, 22 bp, Homo sapiens
tgcacacacaggagtctcctcc

SEQ ID NO: 8253886 - DNA, 22 bp, Homo sapiens
tgcacacacatgaagtagcatg

SEQ ID NO: 8253887 - DNA, 22 bp, Homo sapiens
tgcacacaggtctaggacatgg

SEQ ID NO: 8253888 - DNA, 22 bp, Homo sapiens
tgcacacaggtctaggacatgg

SEQ ID NO: 8253889 - DNA, 22 bp, Homo sapiens
tgcacacagtggacaagtcttg

SEQ ID NO: 8253890 - DNA, 22 bp, Homo sapiens
tgcacacagtggacaagtcttg

SEQ ID NO: 8253891 - DNA, 22 bp, Homo sapiens
tgcacacaggtctaggacatgg

SEQ ID NO: 8253892 - DNA, 22 bp, Homo sapiens
tgcacacaggtctaggacatgg

SEQ ID NO: 8253893 - DNA, 22 bp, Homo sapiens
tgcacacagctgggcctggctg

SEQ ID NO: 8253894 - DNA, 22 bp, Homo sapiens
tgcacacagccagtgagtggca

SEQ ID NO: 8253895 - DNA, 22 bp, Homo sapiens
tgcacacagatggtacatgcat

SEQ ID NO: 8253896 - DNA, 22 bp, Homo sapiens
tgcacacagatggtacatgcat

SEQ ID NO: 8253897 - DNA, 19 bp, Homo sapiens
tgcacacagataagtatct

SEQ ID NO: 8253898 - DNA, 19 bp, Homo sapiens
tgcacacagataagtatct

SEQ ID NO: 8253899 - DNA, 20 bp, Homo sapiens
tgcacacagaaatttgcatt

SEQ ID NO: 8253900 - DNA, 22 bp, Homo sapiens
tgcacacactctgcatatactt

SEQ ID NO: 8253901 - DNA, 20 bp, Homo sapiens
tgcacacagaaatttgcatt

SEQ ID NO: 8253902 - DNA, 22 bp, Homo sapiens
tgcacacactctgcatatactt

SEQ ID NO: 8253903 - DNA, 22 bp, Homo sapiens
tgcacacactcgtgtatatgag

SEQ ID NO: 8253904 - DNA, 22 bp, Homo sapiens
tgcacacactcgtgtatatgag

SEQ ID NO: 8253905 - DNA, 22 bp, Homo sapiens
tgcacacactcgtgtatatgag

SEQ ID NO: 8253906 - DNA, 22 bp, Homo sapiens
tgcacacactctgcatatactt

SEQ ID NO: 8253907 - DNA, 22 bp, Homo sapiens
tgcacacactctgcatatactt

SEQ ID NO: 8253908 - DNA, 22 bp, Homo sapiens
tgcaacctgacccagccagccc

SEQ ID NO: 8253909 - DNA, 22 bp, Homo sapiens
tgcaacattattaaactaagca

SEQ ID NO: 8253910 - DNA, 22 bp, Homo sapiens
tgcaaatttctttagtacataa

SEQ ID NO: 8253911 - DNA, 22 bp, Homo sapiens
tgcaagatattatctttgctgc

SEQ ID NO: 8253912 - DNA, 22 bp, Homo sapiens
tgcaagataacctgcttcttcc

SEQ ID NO: 8253913 - DNA, 22 bp, Homo sapiens
tgcaagaggaattctagaagca

SEQ ID NO: 8253914 - DNA, 22 bp, Homo sapiens
tgcaagagcccagggccaggaa

SEQ ID NO: 8253915 - DNA, 22 bp, Homo sapiens
tgcaagacgtgaaattgagaca

SEQ ID NO: 8253916 - DNA, 20 bp, Homo sapiens
tgcaaggaagcaggcaagtg

SEQ ID NO: 8253917 - DNA, 19 bp, Homo sapiens
tgcaagctttttcttgtta

SEQ ID NO: 8253918 - DNA, 19 bp, Homo sapiens
tgcaagctttttcttgtta

SEQ ID NO: 8253919 - DNA, 22 bp, Homo sapiens
tgcaagcttggctgatgttgat

SEQ ID NO: 8253920 - DNA, 20 bp, Homo sapiens
tgcaaggaagcaggcaagtg

SEQ ID NO: 8253921 - DNA, 22 bp, Homo sapiens
tgcaagcaatccaggaaggcta

SEQ ID NO: 8253922 - DNA, 19 bp, Homo sapiens
tgcaagccgagcatcgcta

SEQ ID NO: 8253923 - DNA, 21 bp, Homo sapiens
tgcaagcctctgtgagattct

SEQ ID NO: 8253924 - DNA, 22 bp, Homo sapiens
tgcaagcttggctgatgttgat

SEQ ID NO: 8253925 - DNA, 22 bp, Homo sapiens
tgcaagctgacatccagagaga

SEQ ID NO: 8253926 - DNA, 22 bp, Homo sapiens
tgcaagattttgacactcgtct

SEQ ID NO: 8253927 - DNA, 22 bp, Homo sapiens
tgcaagatcacggtgttgagag

SEQ ID NO: 8253928 - DNA, 22 bp, Homo sapiens
tgcaagatcttgtctctgccac

SEQ ID NO: 8253929 - DNA, 22 bp, Homo sapiens
tgcaagatattatctttgctgc

SEQ ID NO: 8253930 - DNA, 22 bp, Homo sapiens
tgcaagcaagtttttgaagtgg

SEQ ID NO: 8253931 - DNA, 22 bp, Homo sapiens
tgcaaggctattcacatgtatt

SEQ ID NO: 8253932 - DNA, 22 bp, Homo sapiens
tgcaaggcccagacaagagctc

SEQ ID NO: 8253933 - DNA, 22 bp, Homo sapiens
tgcaaggcccagacaagagctc

SEQ ID NO: 8253934 - DNA, 22 bp, Homo sapiens
tgcaaggcccagacaagagctc

SEQ ID NO: 8253935 - DNA, 22 bp, Homo sapiens
tgcaaggctgcctctgaggacc

SEQ ID NO: 8253936 - DNA, 22 bp, Homo sapiens
tgcaaggcttgcaatggtgatc

SEQ ID NO: 8253937 - DNA, 22 bp, Homo sapiens
tgcaagggcttagggggctgtg

SEQ ID NO: 8253938 - DNA, 21 bp, Homo sapiens
tgcaatccagcctgggcgaca

SEQ ID NO: 8253939 - DNA, 21 bp, Homo sapiens
tgcaatccagcctgggcgaca

SEQ ID NO: 8253940 - DNA, 22 bp, Homo sapiens
tgcaaggtgctttttggtgtca

SEQ ID NO: 8253941 - DNA, 22 bp, Homo sapiens
tgcaaggtgctccaagggcgct

SEQ ID NO: 8253942 - DNA, 22 bp, Homo sapiens
tgcaaggtcttctctctggagg

SEQ ID NO: 8253943 - DNA, 22 bp, Homo sapiens
tgcaaggtcttctctctggagg

SEQ ID NO: 8253944 - DNA, 22 bp, Homo sapiens
tgcaaggtccagtataacttaa

SEQ ID NO: 8253945 - DNA, 21 bp, Homo sapiens
tgcaatccagcctgggcgaca

SEQ ID NO: 8253946 - DNA, 22 bp, Homo sapiens
tgcaaggggtttatgcagatga

SEQ ID NO: 8253947 - DNA, 19 bp, Homo sapiens
tgcaagggtggtctcctgg

SEQ ID NO: 8253948 - DNA, 22 bp, Homo sapiens
tgcaagggtagaagtgatggca

SEQ ID NO: 8253949 - DNA, 22 bp, Homo sapiens
tgcaaagatatgagaagctgta

SEQ ID NO: 8253950 - DNA, 22 bp, Homo sapiens
tgcaaagaagcaacatccttgt

SEQ ID NO: 8253951 - DNA, 22 bp, Homo sapiens
tgcaaagaagcctttgccttct

SEQ ID NO: 8253952 - DNA, 22 bp, Homo sapiens
tgcaaatcataaacaatagtgt

SEQ ID NO: 8253953 - DNA, 22 bp, Homo sapiens
tgcaaatgagttgcagatcagg

SEQ ID NO: 8253954 - DNA, 19 bp, Homo sapiens
tgcaaatgctgttgagaat

SEQ ID NO: 8253955 - DNA, 22 bp, Homo sapiens
tgcaaattccatttaaacacta

SEQ ID NO: 8253956 - DNA, 22 bp, Homo sapiens
tgcaaattctttactctgtgat

SEQ ID NO: 8253957 - DNA, 22 bp, Homo sapiens
tgcaaattgcgatttttattag

SEQ ID NO: 8253958 - DNA, 22 bp, Homo sapiens
tgcaaattgcatgatgtgtatc

SEQ ID NO: 8253959 - DNA, 19 bp, Homo sapiens
tgcaaatgtaggaagaata

SEQ ID NO: 8253960 - DNA, 22 bp, Homo sapiens
tgcaaatgggtgagggttagga

SEQ ID NO: 8253961 - DNA, 22 bp, Homo sapiens
tgcaaacaactgtttaatgctg

SEQ ID NO: 8253962 - DNA, 22 bp, Homo sapiens
tgcaaaatgacttctgaaaaga

SEQ ID NO: 8253963 - DNA, 23 bp, Homo sapiens
tgcaaaatttgcagagttcgatg

SEQ ID NO: 8253964 - DNA, 17 bp, Homo sapiens
tgcaaacaatcacatat

SEQ ID NO: 8253965 - DNA, 17 bp, Homo sapiens
tgcaaacaatcacatat

SEQ ID NO: 8253966 - DNA, 22 bp, Homo sapiens
tgcaaacaatttcctataaagt

SEQ ID NO: 8253967 - DNA, 22 bp, Homo sapiens
tgcaaacaatttcctataaagt

SEQ ID NO: 8253968 - DNA, 20 bp, Homo sapiens
tgcaaacacagagtgtatga

SEQ ID NO: 8253969 - DNA, 20 bp, Homo sapiens
tgcaaacacagagtgtatga

SEQ ID NO: 8253970 - DNA, 20 bp, Homo sapiens
tgcaaacacagagtgtatga

SEQ ID NO: 8253971 - DNA, 22 bp, Homo sapiens
tgcaaacacttcaacgtgcatc

SEQ ID NO: 8253972 - DNA, 22 bp, Homo sapiens
tgcaaacagaaagtttattgtg

SEQ ID NO: 8253973 - DNA, 22 bp, Homo sapiens
tgcaaacagaaaagctactttg

SEQ ID NO: 8253974 - DNA, 22 bp, Homo sapiens
tgcaaacacttcaacgtgcatc

SEQ ID NO: 8253975 - DNA, 22 bp, Homo sapiens
tgcaaacacttcaacgtgcatc

SEQ ID NO: 8253976 - DNA, 22 bp, Homo sapiens
tgcaaacaccacagagacaatt

SEQ ID NO: 8253977 - DNA, 22 bp, Homo sapiens
tgcaaactgggatactattcaa

SEQ ID NO: 8253978 - DNA, 22 bp, Homo sapiens
tgcaaactgggacactattcaa

SEQ ID NO: 8253979 - DNA, 22 bp, Homo sapiens
tgcaaacatccgactgaaagcc

SEQ ID NO: 8253980 - DNA, 20 bp, Homo sapiens
tgcaaacattacttgggtgt

SEQ ID NO: 8253981 - DNA, 22 bp, Homo sapiens
tgcaaactagcatcaactagta

SEQ ID NO: 8253982 - DNA, 22 bp, Homo sapiens
tgcaaacagaaagtttattgtg

SEQ ID NO: 8253983 - DNA, 22 bp, Homo sapiens
tgcaaacagccttgaaagaggg

SEQ ID NO: 8253984 - DNA, 22 bp, Homo sapiens
tgcaaacaggagagtaagtata

SEQ ID NO: 8253985 - DNA, 22 bp, Homo sapiens
tgcaaacagttaagatgcaggc

SEQ ID NO: 8253986 - DNA, 22 bp, Homo sapiens
tgcaaacaggcatttcacaaac

SEQ ID NO: 8253987 - DNA, 22 bp, Homo sapiens
tgcaaacagttaagatgcaggc

SEQ ID NO: 8253988 - DNA, 22 bp, Homo sapiens
tgcaaacatcaatggcctgagc

SEQ ID NO: 8253989 - DNA, 22 bp, Homo sapiens
tgcaaacatcaatggcctgagc

SEQ ID NO: 8253990 - DNA, 22 bp, Homo sapiens
tgcaaacatccgactgaaagcc

SEQ ID NO: 8253991 - DNA, 22 bp, Homo sapiens
tgattttattggtgaggaaatt

SEQ ID NO: 8253992 - DNA, 22 bp, Homo sapiens
tgatttcctctactagcaatta

SEQ ID NO: 8253993 - DNA, 22 bp, Homo sapiens
tgatttcctaggtctggagaag

SEQ ID NO: 8253994 - DNA, 22 bp, Homo sapiens
tgatttcctctactagcaatta

SEQ ID NO: 8253995 - DNA, 22 bp, Homo sapiens
tgatttcctctactagcaatta

SEQ ID NO: 8253996 - DNA, 22 bp, Homo sapiens
tgattttgaggtttcaggtctt

SEQ ID NO: 8253997 - DNA, 22 bp, Homo sapiens
tgattttgaggtttcaggtctt

SEQ ID NO: 8253998 - DNA, 20 bp, Homo sapiens
tgattttctgaaacagcaca

SEQ ID NO: 8253999 - DNA, 22 bp, Homo sapiens
tgatttttagctattctgaaga

SEQ ID NO: 8254000 - DNA, 22 bp, Homo sapiens
tgatttttagctattctgaaga

SEQ ID NO: 8254001 - DNA, 22 bp, Homo sapiens
tgatttttaaaattctccttgc

SEQ ID NO: 8254002 - DNA, 22 bp, Homo sapiens
tgatttttggatctgagctgca

SEQ ID NO: 8254003 - DNA, 22 bp, Homo sapiens
tgatttttggatctgagctgca

SEQ ID NO: 8254004 - DNA, 22 bp, Homo sapiens
tgatttttggatctgagctgca

SEQ ID NO: 8254005 - DNA, 22 bp, Homo sapiens
tgatttttggatctgagctgca

SEQ ID NO: 8254006 - DNA, 22 bp, Homo sapiens
tgcaaaataatgaacgattttt

SEQ ID NO: 8254007 - DNA, 22 bp, Homo sapiens
tgcaaaatgacttctgaaaaga

SEQ ID NO: 8254008 - DNA, 22 bp, Homo sapiens
tgcaaaatgacttctgaaaaga

SEQ ID NO: 8254009 - DNA, 22 bp, Homo sapiens
tgcaaaataatgaacgattttt

SEQ ID NO: 8254010 - DNA, 22 bp, Homo sapiens
tgatttacttctggataaatcc

SEQ ID NO: 8254011 - DNA, 22 bp, Homo sapiens
tgatttaggaaacagctacagg

SEQ ID NO: 8254012 - DNA, 22 bp, Homo sapiens
tgatttaccagttactatcttg

SEQ ID NO: 8254013 - DNA, 22 bp, Homo sapiens
tgatttacccgtaactatttct

SEQ ID NO: 8254014 - DNA, 22 bp, Homo sapiens
tgatttacccgtccaggcccta

SEQ ID NO: 8254015 - DNA, 22 bp, Homo sapiens
tgatttactcccacttagagcc

SEQ ID NO: 8254016 - DNA, 22 bp, Homo sapiens
tgatttacttcccagctgggtt

SEQ ID NO: 8254017 - DNA, 17 bp, Homo sapiens
tgatttagtaagctgcc

SEQ ID NO: 8254018 - DNA, 17 bp, Homo sapiens
tgatttagtaagctgcc

SEQ ID NO: 8254019 - DNA, 22 bp, Homo sapiens
tgatttaggaaacagctacagg

SEQ ID NO: 8254020 - DNA, 22 bp, Homo sapiens
tgatttatgaccaagttagaat

SEQ ID NO: 8254021 - DNA, 22 bp, Homo sapiens
tgatttatgcattatactgttg

SEQ ID NO: 8254022 - DNA, 22 bp, Homo sapiens
tgatttacaattgtaaaagttt

SEQ ID NO: 8254023 - DNA, 22 bp, Homo sapiens
tgatttaaaagaaacattgtct

SEQ ID NO: 8254024 - DNA, 22 bp, Homo sapiens
tgatttacaattgtaaaagttt

SEQ ID NO: 8254025 - DNA, 22 bp, Homo sapiens
tgatttacagtagtgtctaaac

SEQ ID NO: 8254026 - DNA, 22 bp, Homo sapiens
tgatttacacatcaaagcagca

SEQ ID NO: 8254027 - DNA, 22 bp, Homo sapiens
tgatttacacacctatgattta

SEQ ID NO: 8254028 - DNA, 22 bp, Homo sapiens
tgatttacacatcaaagcagca

SEQ ID NO: 8254029 - DNA, 21 bp, Homo sapiens
tgatttatgcccaagtccctg

SEQ ID NO: 8254030 - DNA, 22 bp, Homo sapiens
tgatttcaagtagtgacatgct

SEQ ID NO: 8254031 - DNA, 22 bp, Homo sapiens
tgatttatgcattatactgttg

SEQ ID NO: 8254032 - DNA, 22 bp, Homo sapiens
tgatttatgcattatactgttg

SEQ ID NO: 8254033 - DNA, 22 bp, Homo sapiens
tgatttcatagtatatacatga

SEQ ID NO: 8254034 - DNA, 22 bp, Homo sapiens
tgatttcaggaatgtcttagca

SEQ ID NO: 8254035 - DNA, 22 bp, Homo sapiens
tgatttccaaaaggcttctaag

SEQ ID NO: 8254036 - DNA, 22 bp, Homo sapiens
tgatttccaataaggagaatgt

SEQ ID NO: 8254037 - DNA, 22 bp, Homo sapiens
tgatttccctcatcataacaga

SEQ ID NO: 8254038 - DNA, 22 bp, Homo sapiens
tgatttccccagtcttgctgct

SEQ ID NO: 8254039 - DNA, 22 bp, Homo sapiens
tgatttccacgtgcacccaggt

SEQ ID NO: 8254040 - DNA, 21 bp, Homo sapiens
tgatttccagaaaattggccc

SEQ ID NO: 8254041 - DNA, 22 bp, Homo sapiens
tgatttccagttgctgggtgct

SEQ ID NO: 8254042 - DNA, 21 bp, Homo sapiens
tgatttccatcttaaaataaa

SEQ ID NO: 8254043 - DNA, 22 bp, Homo sapiens
tgatttccatgaagctgaaggc

SEQ ID NO: 8254044 - DNA, 21 bp, Homo sapiens
tgatttccatcttaaaataaa

SEQ ID NO: 8254045 - DNA, 22 bp, Homo sapiens
tgcacgtgggctctctgctctt

SEQ ID NO: 8254046 - DNA, 22 bp, Homo sapiens
tgcacgtgggctctctgctctt

SEQ ID NO: 8254047 - DNA, 22 bp, Homo sapiens
tgcacctttaaattcagcagta

SEQ ID NO: 8254048 - DNA, 22 bp, Homo sapiens
tgcacgtgtgagcattcacatg

SEQ ID NO: 8254049 - DNA, 22 bp, Homo sapiens
tgcacgtgggctctctgctctt

SEQ ID NO: 8254050 - DNA, 22 bp, Homo sapiens
tgcacgtgtgagcattcacatg

SEQ ID NO: 8254051 - DNA, 22 bp, Homo sapiens
tgcagaaacaagccatcattca

SEQ ID NO: 8254052 - DNA, 22 bp, Homo sapiens
tgcacttttatatcactctggc

SEQ ID NO: 8254053 - DNA, 22 bp, Homo sapiens
tgcactactgtgatacacagcc

SEQ ID NO: 8254054 - DNA, 21 bp, Homo sapiens
tgcactttgggggacaggctg

SEQ ID NO: 8254055 - DNA, 22 bp, Homo sapiens
tgcagaaagcattgactcttcc

SEQ ID NO: 8254056 - DNA, 22 bp, Homo sapiens
tgcagaaacagtcattaatgta

SEQ ID NO: 8254057 - DNA, 22 bp, Homo sapiens
tgcagaaataactcatattgca

SEQ ID NO: 8254058 - DNA, 21 bp, Homo sapiens
tgcagaaatggtttttctaag

SEQ ID NO: 8254059 - DNA, 22 bp, Homo sapiens
tgcagaaattcagaaagcataa

SEQ ID NO: 8254060 - DNA, 22 bp, Homo sapiens
tgcagaaattcagaaagcataa

SEQ ID NO: 8254061 - DNA, 22 bp, Homo sapiens
tgcagaagaccttccagggctg

SEQ ID NO: 8254062 - DNA, 19 bp, Homo sapiens
tgcagaagacacagtggtg

SEQ ID NO: 8254063 - DNA, 19 bp, Homo sapiens
tgcagaagacacagtggtg

SEQ ID NO: 8254064 - DNA, 19 bp, Homo sapiens
tgcagaagacacagtggtg

SEQ ID NO: 8254065 - DNA, 22 bp, Homo sapiens
tgcagaagacacaaggtaacgt

SEQ ID NO: 8254066 - DNA, 22 bp, Homo sapiens
tgcagaagaatgtaggcataag

SEQ ID NO: 8254067 - DNA, 22 bp, Homo sapiens
tgcagaagacacaaggtaacgt

SEQ ID NO: 8254068 - DNA, 22 bp, Homo sapiens
tgcagaagacacaaggtaacgt

SEQ ID NO: 8254069 - DNA, 22 bp, Homo sapiens
tgcagaagaatgtaggcataag

SEQ ID NO: 8254070 - DNA, 22 bp, Homo sapiens
tgcagaagaatgtaggcataag

SEQ ID NO: 8254071 - DNA, 22 bp, Homo sapiens
tgcagaagaatgagcttggagt

SEQ ID NO: 8254072 - DNA, 22 bp, Homo sapiens
tgcagaagaatgagcttggagt

SEQ ID NO: 8254073 - DNA, 22 bp, Homo sapiens
tgcagaagaaaacagctgtgtg

SEQ ID NO: 8254074 - DNA, 22 bp, Homo sapiens
tgcagaagaaaacagctgtgtg

SEQ ID NO: 8254075 - DNA, 22 bp, Homo sapiens
tgcagaagaaaacagctgtgtg

SEQ ID NO: 8254076 - DNA, 22 bp, Homo sapiens
tgcagaagaaaacagctgtgtg

SEQ ID NO: 8254077 - DNA, 20 bp, Homo sapiens
tgcagaagaacgttctggtt

SEQ ID NO: 8254078 - DNA, 22 bp, Homo sapiens
tgcagaagaatgagcttggagt

SEQ ID NO: 8254079 - DNA, 20 bp, Homo sapiens
tgcagaagaacgttctggtt

SEQ ID NO: 8254080 - DNA, 22 bp, Homo sapiens
tgcagaagcagagccggtggcc

SEQ ID NO: 8254081 - DNA, 22 bp, Homo sapiens
tgcagaagctgcaggtcagtgg

SEQ ID NO: 8254082 - DNA, 22 bp, Homo sapiens
tgcagaagcagagccggtggcc

SEQ ID NO: 8254083 - DNA, 22 bp, Homo sapiens
tgcagaagcagagagttgccaa

SEQ ID NO: 8254084 - DNA, 22 bp, Homo sapiens
tgcagaagcagagagttgccaa

SEQ ID NO: 8254085 - DNA, 22 bp, Homo sapiens
tgcagaagatggtctgagcacc

SEQ ID NO: 8254086 - DNA, 22 bp, Homo sapiens
tgcagaagatggtctgagcacc

SEQ ID NO: 8254087 - DNA, 22 bp, Homo sapiens
tgcagaagatggtctgagcacc

SEQ ID NO: 8254088 - DNA, 22 bp, Homo sapiens
tgcagaagaccttccagggctg

SEQ ID NO: 8254089 - DNA, 22 bp, Homo sapiens
tgcagaagtgagtcatgaggaa

SEQ ID NO: 8254090 - DNA, 22 bp, Homo sapiens
tgcagaagtgagtcatgaggaa

SEQ ID NO: 8254091 - DNA, 22 bp, Homo sapiens
tgcagaagtattccaggcccca

SEQ ID NO: 8254092 - DNA, 22 bp, Homo sapiens
tgcagaagtattccaggcccca

SEQ ID NO: 8254093 - DNA, 22 bp, Homo sapiens
tgcagaaggaggaggaaatcca

SEQ ID NO: 8254094 - DNA, 22 bp, Homo sapiens
tgcagaaggcctgacattgcac

SEQ ID NO: 8254095 - DNA, 22 bp, Homo sapiens
tgcagaaggcctgacattgcac

SEQ ID NO: 8254096 - DNA, 22 bp, Homo sapiens
tgcagaagctgcaggtcagtgg

SEQ ID NO: 8254097 - DNA, 22 bp, Homo sapiens
tgcagaaggaggaggaaatcca

SEQ ID NO: 8254098 - DNA, 22 bp, Homo sapiens
tgcagaaggaggaggaaatcca

SEQ ID NO: 8254099 - DNA, 22 bp, Homo sapiens
tgcacagtgacccctggtgact

SEQ ID NO: 8254100 - DNA, 22 bp, Homo sapiens
tgcacagtgacccctggtgact

SEQ ID NO: 8254101 - DNA, 22 bp, Homo sapiens
tgcacagtgtaatgaatcagaa

SEQ ID NO: 8254102 - DNA, 22 bp, Homo sapiens
tgcacagtaaacatgactggag

SEQ ID NO: 8254103 - DNA, 22 bp, Homo sapiens
tgcacagtgaccactgagcaag

SEQ ID NO: 8254104 - DNA, 22 bp, Homo sapiens
tgcacaggtggtccatctgcac

SEQ ID NO: 8254105 - DNA, 22 bp, Homo sapiens
tgcacaggtggtccatctgcac

SEQ ID NO: 8254106 - DNA, 22 bp, Homo sapiens
tgcacattagtgtttgagatgc

SEQ ID NO: 8254107 - DNA, 22 bp, Homo sapiens
tgcacattagtgtttgagatgc

SEQ ID NO: 8254108 - DNA, 22 bp, Homo sapiens
tgcacattcacttaggtattgt

SEQ ID NO: 8254109 - DNA, 22 bp, Homo sapiens
tgcacatggcaatgctgctccc

SEQ ID NO: 8254110 - DNA, 21 bp, Homo sapiens
tgcacctgtgccccatccttc

SEQ ID NO: 8254111 - DNA, 21 bp, Homo sapiens
tgcacctgttcactgcagttc

SEQ ID NO: 8254112 - DNA, 22 bp, Homo sapiens
tgcaccttccacaagaactacc

SEQ ID NO: 8254113 - DNA, 22 bp, Homo sapiens
tgcacctgagaggtctctgagg

SEQ ID NO: 8254114 - DNA, 22 bp, Homo sapiens
tgcacctgagaggtctctgagg

SEQ ID NO: 8254115 - DNA, 22 bp, Homo sapiens
tgcaccattaatttatgtgaga

SEQ ID NO: 8254116 - DNA, 22 bp, Homo sapiens
tgcaccattttgtcaggctact

SEQ ID NO: 8254117 - DNA, 22 bp, Homo sapiens
tgcaccattaatttatgtgaga

SEQ ID NO: 8254118 - DNA, 22 bp, Homo sapiens
tgcaccctcatcagtcaaatgg

SEQ ID NO: 8254119 - DNA, 20 bp, Homo sapiens
tgcacccagagcctgaagat

SEQ ID NO: 8254120 - DNA, 22 bp, Homo sapiens
tgcacccagggggatcaggaat

SEQ ID NO: 8254121 - DNA, 22 bp, Homo sapiens
tgcacccacttagctgaagttc

SEQ ID NO: 8254122 - DNA, 22 bp, Homo sapiens
tgcacccacttagctgaagttc

SEQ ID NO: 8254123 - DNA, 19 bp, Homo sapiens
tgcacccatgtatgcatgc

SEQ ID NO: 8254124 - DNA, 22 bp, Homo sapiens
tgcacccatagcacacactcct

SEQ ID NO: 8254125 - DNA, 22 bp, Homo sapiens
tgcacacatacatgggaagtgc

SEQ ID NO: 8254126 - DNA, 22 bp, Homo sapiens
tgcacacagttctcaggaaaga

SEQ ID NO: 8254127 - DNA, 22 bp, Homo sapiens
tgcacacagtggacaagtcttg

SEQ ID NO: 8254128 - DNA, 22 bp, Homo sapiens
tgcacacagttctcaggaaaga

SEQ ID NO: 8254129 - DNA, 21 bp, Homo sapiens
tgcacagccataccctccttg

SEQ ID NO: 8254130 - DNA, 21 bp, Homo sapiens
tgcacagccataccctccttg

SEQ ID NO: 8254131 - DNA, 22 bp, Homo sapiens
tgcacagcgggtgtctgtcagg

SEQ ID NO: 8254132 - DNA, 22 bp, Homo sapiens
tgcacagctgcctcctctctgc

SEQ ID NO: 8254133 - DNA, 22 bp, Homo sapiens
tgcacagctggctctccttttc

SEQ ID NO: 8254134 - DNA, 22 bp, Homo sapiens
tgcacagctgcctcctctctgc

SEQ ID NO: 8254135 - DNA, 20 bp, Homo sapiens
tgcacagctgtgaataggat

SEQ ID NO: 8254136 - DNA, 22 bp, Homo sapiens
tgcacaggaggctgtggagaag

SEQ ID NO: 8254137 - DNA, 22 bp, Homo sapiens
tgcacaggaggctgtggagaag

SEQ ID NO: 8254138 - DNA, 22 bp, Homo sapiens
tgcacaggaggctgtggagaag

SEQ ID NO: 8254139 - DNA, 20 bp, Homo sapiens
tgcacagggtgggaagcaac

SEQ ID NO: 8254140 - DNA, 20 bp, Homo sapiens
tgcacagggtgggaagcaac

SEQ ID NO: 8254141 - DNA, 20 bp, Homo sapiens
tgcacagggtgggaagcaac

SEQ ID NO: 8254142 - DNA, 22 bp, Homo sapiens
tgcacaggtgagactcaggaag

SEQ ID NO: 8254143 - DNA, 22 bp, Homo sapiens
tgcacaggtgagactcaggaag

SEQ ID NO: 8254144 - DNA, 22 bp, Homo sapiens
tgcacaggtgagactcaggaag

SEQ ID NO: 8254145 - DNA, 22 bp, Homo sapiens
tgcacaggtatgcaaagcatgt

SEQ ID NO: 8254146 - DNA, 22 bp, Homo sapiens
tgcacaggtatgcaaagcatgt

SEQ ID NO: 8254147 - DNA, 22 bp, Homo sapiens
tgcacaggccttgaagggagag

SEQ ID NO: 8254148 - DNA, 22 bp, Homo sapiens
tgcacaggccttgaagggagag

SEQ ID NO: 8254149 - DNA, 22 bp, Homo sapiens
tgcacaggccttgaagggagag

SEQ ID NO: 8254150 - DNA, 22 bp, Homo sapiens
tgcacagggagggggccagctc

SEQ ID NO: 8254151 - DNA, 21 bp, Homo sapiens
tgcacagggcccaggagagcc

SEQ ID NO: 8254152 - DNA, 21 bp, Homo sapiens
tgcacagggcccaggagagcc

SEQ ID NO: 8254153 - DNA, 21 bp, Homo sapiens
tgcacagggcccaggagagcc

SEQ ID NO: 8254154 - DNA, 22 bp, Homo sapiens
tgcacagggagggggccagctc

SEQ ID NO: 8254155 - DNA, 22 bp, Homo sapiens
tgcagcaaatggggcccgtcct

SEQ ID NO: 8254156 - DNA, 22 bp, Homo sapiens
tgcagcaagaaggcactgtctg

SEQ ID NO: 8254157 - DNA, 22 bp, Homo sapiens
tgcagatggggatcagtggctc

SEQ ID NO: 8254158 - DNA, 22 bp, Homo sapiens
tgcagcaagtaaccatcttcct

SEQ ID NO: 8254159 - DNA, 22 bp, Homo sapiens
tgcagcaatggtccctgccctc

SEQ ID NO: 8254160 - DNA, 22 bp, Homo sapiens
tgcagatggggatcagtggctc

SEQ ID NO: 8254161 - DNA, 22 bp, Homo sapiens
tgcagatggggatcagtggctc

SEQ ID NO: 8254162 - DNA, 22 bp, Homo sapiens
tgcagatgagggatgaaaatga

SEQ ID NO: 8254163 - DNA, 22 bp, Homo sapiens
tgcagatgagggatgaaaatga

SEQ ID NO: 8254164 - DNA, 22 bp, Homo sapiens
tgcagcaaacaggccttcaggg

SEQ ID NO: 8254165 - DNA, 22 bp, Homo sapiens
tgcagattcaaatgaaatgcaa

SEQ ID NO: 8254166 - DNA, 21 bp, Homo sapiens
tgcagcagaagtctctgtgtc

SEQ ID NO: 8254167 - DNA, 21 bp, Homo sapiens
tgcagcagaagtctctgtgtc

SEQ ID NO: 8254168 - DNA, 22 bp, Homo sapiens
tgcagcagaatatggctgcagg

SEQ ID NO: 8254169 - DNA, 22 bp, Homo sapiens
tgcagcagaatatggctgcagg

SEQ ID NO: 8254170 - DNA, 21 bp, Homo sapiens
tgcagcagaagtctctgtgtc

SEQ ID NO: 8254171 - DNA, 22 bp, Homo sapiens
tgcagcaccgtcccactggcta

SEQ ID NO: 8254172 - DNA, 22 bp, Homo sapiens
tgcagcacctatggacacttgt

SEQ ID NO: 8254173 - DNA, 20 bp, Homo sapiens
tgcagcacgggccctttcca

SEQ ID NO: 8254174 - DNA, 22 bp, Homo sapiens
tgcagatagcgtcattcttgct

SEQ ID NO: 8254175 - DNA, 22 bp, Homo sapiens
tgcagatagcgtcattcttgct

SEQ ID NO: 8254176 - DNA, 22 bp, Homo sapiens
tgcagagttgctttgatagtcc

SEQ ID NO: 8254177 - DNA, 22 bp, Homo sapiens
tgcagataatactagaacttac

SEQ ID NO: 8254178 - DNA, 22 bp, Homo sapiens
tgcagataatactagaacttac

SEQ ID NO: 8254179 - DNA, 23 bp, Homo sapiens
tgcagagtgtcacttgaaaacca

SEQ ID NO: 8254180 - DNA, 22 bp, Homo sapiens
tgcagagtggattctgtatacc

SEQ ID NO: 8254181 - DNA, 19 bp, Homo sapiens
tgcagagggtaggaaggcc

SEQ ID NO: 8254182 - DNA, 19 bp, Homo sapiens
tgcagagggtaggaaggcc

SEQ ID NO: 8254183 - DNA, 22 bp, Homo sapiens
tgcagagtagtgaggggacaga

SEQ ID NO: 8254184 - DNA, 22 bp, Homo sapiens
tgcagagggacagccacagctc

SEQ ID NO: 8254185 - DNA, 22 bp, Homo sapiens
tgcagagggacagccacagctc

SEQ ID NO: 8254186 - DNA, 22 bp, Homo sapiens
tgcagagggacagccacagctc

SEQ ID NO: 8254187 - DNA, 22 bp, Homo sapiens
tgcagagggacagccacagctc

SEQ ID NO: 8254188 - DNA, 19 bp, Homo sapiens
tgcagagggtaggaaggcc

SEQ ID NO: 8254189 - DNA, 23 bp, Homo sapiens
tgcagagggactgaagccagctt

SEQ ID NO: 8254190 - DNA, 22 bp, Homo sapiens
tgcagagggagtgacggttcac

SEQ ID NO: 8254191 - DNA, 23 bp, Homo sapiens
tgcagagggactgaagccagctt

SEQ ID NO: 8254192 - DNA, 22 bp, Homo sapiens
tgcagagcagcaactgcgtgcg

SEQ ID NO: 8254193 - DNA, 22 bp, Homo sapiens
tgcagagcagcaactgcgtgcg

SEQ ID NO: 8254194 - DNA, 22 bp, Homo sapiens
tgcagagctcttggcacttcag

SEQ ID NO: 8254195 - DNA, 22 bp, Homo sapiens
tgcagagattgaacaagaagga

SEQ ID NO: 8254196 - DNA, 22 bp, Homo sapiens
tgcagaggagctggaaggctgg

SEQ ID NO: 8254197 - DNA, 20 bp, Homo sapiens
tgcagagctggctggctcct

SEQ ID NO: 8254198 - DNA, 20 bp, Homo sapiens
tgcagagctggctggctcct

SEQ ID NO: 8254199 - DNA, 22 bp, Homo sapiens
tgcagaggaccattgtcctgga

SEQ ID NO: 8254200 - DNA, 22 bp, Homo sapiens
tgcagacctcccatggctgcct

SEQ ID NO: 8254201 - DNA, 22 bp, Homo sapiens
tgcagacctcccatggctgcct

SEQ ID NO: 8254202 - DNA, 22 bp, Homo sapiens
tgcagagatcctggactgagcg

SEQ ID NO: 8254203 - DNA, 21 bp, Homo sapiens
tgcagagatatctgaagcaga

SEQ ID NO: 8254204 - DNA, 21 bp, Homo sapiens
tgcagagatatctgaagcaga

SEQ ID NO: 8254205 - DNA, 22 bp, Homo sapiens
tgcagacagagaaatgaggccc

SEQ ID NO: 8254206 - DNA, 22 bp, Homo sapiens
tgcagaatttagggaggcagca

SEQ ID NO: 8254207 - DNA, 22 bp, Homo sapiens
tgcagaatgtggacagtgggtt

SEQ ID NO: 8254208 - DNA, 22 bp, Homo sapiens
tgcagaggctggctcgccgggt

SEQ ID NO: 8254209 - DNA, 22 bp, Homo sapiens
tgcagaggctggctcgccgggt

SEQ ID NO: 8254210 - DNA, 22 bp, Homo sapiens
tgcagaggcgccgtgggtgggg

SEQ ID NO: 8254211 - DNA, 21 bp, Homo sapiens
tgcagaggcacaaacaagccc

SEQ ID NO: 8254212 - DNA, 23 bp, Homo sapiens
tgcagaggcatgatcactgctca

SEQ ID NO: 8254213 - DNA, 23 bp, Homo sapiens
tgcagaggcatgatcactgctca

SEQ ID NO: 8254214 - DNA, 21 bp, Homo sapiens
tgcagaggcacaaacaagccc

SEQ ID NO: 8254215 - DNA, 21 bp, Homo sapiens
tgcagaggcacaaacaagccc

SEQ ID NO: 8254216 - DNA, 22 bp, Homo sapiens
tgcagaggagtcagcctgggca

SEQ ID NO: 8254217 - DNA, 22 bp, Homo sapiens
tgcagaggagtcagcctgggca

SEQ ID NO: 8254218 - DNA, 22 bp, Homo sapiens
tgcagaggagtcagcctgggca

SEQ ID NO: 8254219 - DNA, 22 bp, Homo sapiens
tgcagaggagctggaaggctgg

SEQ ID NO: 8254220 - DNA, 22 bp, Homo sapiens
tgcagaggagctggaaggctgg

SEQ ID NO: 8254221 - DNA, 22 bp, Homo sapiens
tgcagaggagctggaaggctgg

SEQ ID NO: 8254222 - DNA, 22 bp, Homo sapiens
tgcagaggagctggaaggctgg

SEQ ID NO: 8254223 - DNA, 22 bp, Homo sapiens
tgcagcttaaatcagggtttct

SEQ ID NO: 8254224 - DNA, 22 bp, Homo sapiens
tgcagcttcaaagaacctttcc

SEQ ID NO: 8254225 - DNA, 20 bp, Homo sapiens
tgcagcttcacctgtgtcat

SEQ ID NO: 8254226 - DNA, 20 bp, Homo sapiens
tgcagcttcacctgtgtcat

SEQ ID NO: 8254227 - DNA, 20 bp, Homo sapiens
tgcagcttctcatcttcaaa

SEQ ID NO: 8254228 - DNA, 22 bp, Homo sapiens
tgcagcttctccaaatattaca

SEQ ID NO: 8254229 - DNA, 22 bp, Homo sapiens
tgcagcttccacatccacactc

SEQ ID NO: 8254230 - DNA, 20 bp, Homo sapiens
tgcagcttctcatcttcaaa

SEQ ID NO: 8254231 - DNA, 22 bp, Homo sapiens
tgcagcttccacatccacactc

SEQ ID NO: 8254232 - DNA, 22 bp, Homo sapiens
tgcagcttccacatccacactc

SEQ ID NO: 8254233 - DNA, 22 bp, Homo sapiens
tgcaggaaaaccaacacgcctt

SEQ ID NO: 8254234 - DNA, 22 bp, Homo sapiens
tgcaggaaacagaggctcaaat

SEQ ID NO: 8254235 - DNA, 22 bp, Homo sapiens
tgcaggaaacagaggctcaaat

SEQ ID NO: 8254236 - DNA, 22 bp, Homo sapiens
tgcaggaaaacacctatcaccc

SEQ ID NO: 8254237 - DNA, 22 bp, Homo sapiens
tgcaggaaaaataaatagtgtt

SEQ ID NO: 8254238 - DNA, 22 bp, Homo sapiens
tgcagctttaagctttcatcag

SEQ ID NO: 8254239 - DNA, 22 bp, Homo sapiens
tgcagctttgctctggtcccca

SEQ ID NO: 8254240 - DNA, 22 bp, Homo sapiens
tgcaggaaaaataaatagtgtt

SEQ ID NO: 8254241 - DNA, 22 bp, Homo sapiens
tgcagctgtaacagaggcctca

SEQ ID NO: 8254242 - DNA, 22 bp, Homo sapiens
tgcagctgtaacagaggcctca

SEQ ID NO: 8254243 - DNA, 22 bp, Homo sapiens
tgcagctgtaacagaggcctca

SEQ ID NO: 8254244 - DNA, 19 bp, Homo sapiens
tgcagctgtatgagcttaa

SEQ ID NO: 8254245 - DNA, 22 bp, Homo sapiens
tgcagctgtgaaagggaaccaa

SEQ ID NO: 8254246 - DNA, 22 bp, Homo sapiens
tgcagctgtgaaagggaaccaa

SEQ ID NO: 8254247 - DNA, 22 bp, Homo sapiens
tgcagctgtgcctgaaaagtac

SEQ ID NO: 8254248 - DNA, 22 bp, Homo sapiens
tgcagctgtgcctgaaaagtac

SEQ ID NO: 8254249 - DNA, 22 bp, Homo sapiens
tgcagctgtgggagaatctctg

SEQ ID NO: 8254250 - DNA, 22 bp, Homo sapiens
tgcagctgtgggagaatctctg

SEQ ID NO: 8254251 - DNA, 22 bp, Homo sapiens
tgcagctgttacggaccctgtc

SEQ ID NO: 8254252 - DNA, 22 bp, Homo sapiens
tgcagctgttacggaccctgtc

SEQ ID NO: 8254253 - DNA, 22 bp, Homo sapiens
tgcaggagcccttgggctctgg

SEQ ID NO: 8254254 - DNA, 22 bp, Homo sapiens
tgcaggagcagagatggctgga

SEQ ID NO: 8254255 - DNA, 22 bp, Homo sapiens
tgcaggagcaccagctcaccct

SEQ ID NO: 8254256 - DNA, 22 bp, Homo sapiens
tgcaggagcaccagctcaccct

SEQ ID NO: 8254257 - DNA, 22 bp, Homo sapiens
tgcaggagagctggtctggccc

SEQ ID NO: 8254258 - DNA, 22 bp, Homo sapiens
tgcaggagagctggtctggccc

SEQ ID NO: 8254259 - DNA, 22 bp, Homo sapiens
tgcaggagagtgagtcagtagg

SEQ ID NO: 8254260 - DNA, 22 bp, Homo sapiens
tgcaggagataatggtgcttag

SEQ ID NO: 8254261 - DNA, 22 bp, Homo sapiens
tgcaggagataatggtgcttag

SEQ ID NO: 8254262 - DNA, 22 bp, Homo sapiens
tgcaggaacataggttccttgg

SEQ ID NO: 8254263 - DNA, 22 bp, Homo sapiens
tgcaggaacataggttccttgg

SEQ ID NO: 8254264 - DNA, 22 bp, Homo sapiens
tgcaggaacataggttccttgg

SEQ ID NO: 8254265 - DNA, 22 bp, Homo sapiens
tgcaggaacttggttttactca

SEQ ID NO: 8254266 - DNA, 22 bp, Homo sapiens
tgcaggaactgggagggatagt

SEQ ID NO: 8254267 - DNA, 22 bp, Homo sapiens
tgcaggaactcgaaaactatag

SEQ ID NO: 8254268 - DNA, 21 bp, Homo sapiens
tgcaggaaagtgctgcgaccc

SEQ ID NO: 8254269 - DNA, 21 bp, Homo sapiens
tgcaggaaagtgctgcgaccc

SEQ ID NO: 8254270 - DNA, 21 bp, Homo sapiens
tgcaggaaagtgctgcgaccc

SEQ ID NO: 8254271 - DNA, 22 bp, Homo sapiens
tgcaggaacagaactcactccc

SEQ ID NO: 8254272 - DNA, 22 bp, Homo sapiens
tgcaggaaattccagggtggcc

SEQ ID NO: 8254273 - DNA, 22 bp, Homo sapiens
tgcaggaagcaaccaggtccaa

SEQ ID NO: 8254274 - DNA, 22 bp, Homo sapiens
tgcaggaagcaaccaggtccaa

SEQ ID NO: 8254275 - DNA, 22 bp, Homo sapiens
tgcaggaagacttcccaagcca

SEQ ID NO: 8254276 - DNA, 21 bp, Homo sapiens
tgcaggaagtatggtgcctat

SEQ ID NO: 8254277 - DNA, 21 bp, Homo sapiens
tgcaggaagtatggtgcctat

SEQ ID NO: 8254278 - DNA, 22 bp, Homo sapiens
tgcaggagaaagtacggagcgt

SEQ ID NO: 8254279 - DNA, 22 bp, Homo sapiens
tgcaggagacataatagggact

SEQ ID NO: 8254280 - DNA, 22 bp, Homo sapiens
tgcaggagacataatagggact

SEQ ID NO: 8254281 - DNA, 18 bp, Homo sapiens
tgcaggagtgaccccggc

SEQ ID NO: 8254282 - DNA, 21 bp, Homo sapiens
tgcaggagtctgtgagtcagg

SEQ ID NO: 8254283 - DNA, 21 bp, Homo sapiens
tgcaggagtgtaatgtgaccc

SEQ ID NO: 8254284 - DNA, 21 bp, Homo sapiens
tgcaggagtgtaatgtgaccc

SEQ ID NO: 8254285 - DNA, 22 bp, Homo sapiens
tgcaggagttaagtgctctcct

SEQ ID NO: 8254286 - DNA, 21 bp, Homo sapiens
tgcaggagtgtaatgtgaccc

SEQ ID NO: 8254287 - DNA, 22 bp, Homo sapiens
tgcaggagttcccctctgcctg

SEQ ID NO: 8254288 - DNA, 22 bp, Homo sapiens
tgcaggagttaagtgctctcct

SEQ ID NO: 8254289 - DNA, 22 bp, Homo sapiens
tgcaggagttcccctctgcctg

SEQ ID NO: 8254290 - DNA, 22 bp, Homo sapiens
tgcaggcagctgaaaggtgcct

SEQ ID NO: 8254291 - DNA, 21 bp, Homo sapiens
tgcaggattccaggtcagtat

SEQ ID NO: 8254292 - DNA, 22 bp, Homo sapiens
tgcaggcaccattctgcctctc

SEQ ID NO: 8254293 - DNA, 22 bp, Homo sapiens
tgcaggcaccattctgcctctc

SEQ ID NO: 8254294 - DNA, 21 bp, Homo sapiens
tgcaggctacttctgactcta

SEQ ID NO: 8254295 - DNA, 21 bp, Homo sapiens
tgcaggctacttctgactcta

SEQ ID NO: 8254296 - DNA, 22 bp, Homo sapiens
tgcaggcctggactgatgtggt

SEQ ID NO: 8254297 - DNA, 21 bp, Homo sapiens
tgcaggctacttctgactcta

SEQ ID NO: 8254298 - DNA, 22 bp, Homo sapiens
tgcaggctcatctcaagagtag

SEQ ID NO: 8254299 - DNA, 19 bp, Homo sapiens
tgcaggaggactgagcaga

SEQ ID NO: 8254300 - DNA, 22 bp, Homo sapiens
tgcaggaggattttgtggagct

SEQ ID NO: 8254301 - DNA, 22 bp, Homo sapiens
tgcaggaggattttgtggagct

SEQ ID NO: 8254302 - DNA, 22 bp, Homo sapiens
tgcaggaggccccatggaaccg

SEQ ID NO: 8254303 - DNA, 22 bp, Homo sapiens
tgcaggaggccccatggaaccg

SEQ ID NO: 8254304 - DNA, 22 bp, Homo sapiens
tgcaggagggagggttacagtt

SEQ ID NO: 8254305 - DNA, 22 bp, Homo sapiens
tgcaggaggctttattcaggat

SEQ ID NO: 8254306 - DNA, 22 bp, Homo sapiens
tgcaggaggctttattcaggat

SEQ ID NO: 8254307 - DNA, 21 bp, Homo sapiens
tgcaggagtctgtgagtcagg

SEQ ID NO: 8254308 - DNA, 21 bp, Homo sapiens
tgcaggagtctgtgagtcagg

SEQ ID NO: 8254309 - DNA, 22 bp, Homo sapiens
tgcaggagtccaatcaggagac

SEQ ID NO: 8254310 - DNA, 22 bp, Homo sapiens
tgcaggagtccaatcaggagac

SEQ ID NO: 8254311 - DNA, 22 bp, Homo sapiens
tgcaggagtccaatcaggagac

SEQ ID NO: 8254312 - DNA, 22 bp, Homo sapiens
tgcaggagggagggttacagtt

SEQ ID NO: 8254313 - DNA, 22 bp, Homo sapiens
tgcaggagctgctgtcctgctc

SEQ ID NO: 8254314 - DNA, 22 bp, Homo sapiens
tgcaggagctgctgtcctgctc

SEQ ID NO: 8254315 - DNA, 22 bp, Homo sapiens
tgcaggagcccttgggctctgg

SEQ ID NO: 8254316 - DNA, 22 bp, Homo sapiens
tgcaggagccttggacttgaaa

SEQ ID NO: 8254317 - DNA, 22 bp, Homo sapiens
tgcaggagcccaggaatactat

SEQ ID NO: 8254318 - DNA, 22 bp, Homo sapiens
tgcaggagcccttgggctctgg

SEQ ID NO: 8254319 - DNA, 22 bp, Homo sapiens
tgcaggagcttggctctgtccc

SEQ ID NO: 8254320 - DNA, 22 bp, Homo sapiens
tgcaggagcttggctctgtccc

SEQ ID NO: 8254321 - DNA, 22 bp, Homo sapiens
tgcaggagctgtgcggtgaggg

SEQ ID NO: 8254322 - DNA, 22 bp, Homo sapiens
tgcaggagctgtgcggtgaggg

SEQ ID NO: 8254323 - DNA, 19 bp, Homo sapiens
tgcaggaggactgagcaga

SEQ ID NO: 8254324 - DNA, 19 bp, Homo sapiens
tgcaggaggactgagcaga

SEQ ID NO: 8254325 - DNA, 22 bp, Homo sapiens
tgcagcgaaacatgagtttaat

SEQ ID NO: 8254326 - DNA, 22 bp, Homo sapiens
tgcagccttggcaaccagggac

SEQ ID NO: 8254327 - DNA, 22 bp, Homo sapiens
tgcagcctttagaagttcagat

SEQ ID NO: 8254328 - DNA, 22 bp, Homo sapiens
tgcagcctttagaagttcagat

SEQ ID NO: 8254329 - DNA, 22 bp, Homo sapiens
tgcagctcctgtgctgagtgtg

SEQ ID NO: 8254330 - DNA, 22 bp, Homo sapiens
tgcagctcctctggctgcctga

SEQ ID NO: 8254331 - DNA, 22 bp, Homo sapiens
tgcagctcgggcttagggtggg

SEQ ID NO: 8254332 - DNA, 22 bp, Homo sapiens
tgcagctcaggattctcagggc

SEQ ID NO: 8254333 - DNA, 22 bp, Homo sapiens
tgcagctcattgctggggtctg

SEQ ID NO: 8254334 - DNA, 22 bp, Homo sapiens
tgcagctgacccactccagtcc

SEQ ID NO: 8254335 - DNA, 22 bp, Homo sapiens
tgcagctgaggccagctatgcc

SEQ ID NO: 8254336 - DNA, 22 bp, Homo sapiens
tgcagctgaggccagctatgcc

SEQ ID NO: 8254337 - DNA, 22 bp, Homo sapiens
tgcagctgaggccagctatgcc

SEQ ID NO: 8254338 - DNA, 21 bp, Homo sapiens
tgcagctgacactggtatgcc

SEQ ID NO: 8254339 - DNA, 22 bp, Homo sapiens
tgcagctgaccagcaagtcctg

SEQ ID NO: 8254340 - DNA, 22 bp, Homo sapiens
tgcagctgaccagcaagtcctg

SEQ ID NO: 8254341 - DNA, 22 bp, Homo sapiens
tgcagctcttacggagggcggg

SEQ ID NO: 8254342 - DNA, 22 bp, Homo sapiens
tgcagctgaaaggactgaatga

SEQ ID NO: 8254343 - DNA, 22 bp, Homo sapiens
tgcagctgaacctagagtctgt

SEQ ID NO: 8254344 - DNA, 22 bp, Homo sapiens
tgcagctgaacctagagtctgt

SEQ ID NO: 8254345 - DNA, 21 bp, Homo sapiens
tgcagctgacactggtatgcc

SEQ ID NO: 8254346 - DNA, 22 bp, Homo sapiens
tgcagctggtatcccatggatt

SEQ ID NO: 8254347 - DNA, 21 bp, Homo sapiens
tgcagctgggttctggtttgc

SEQ ID NO: 8254348 - DNA, 22 bp, Homo sapiens
tgcagctggtttagaactagat

SEQ ID NO: 8254349 - DNA, 22 bp, Homo sapiens
tgcagctggtttagaactagat

SEQ ID NO: 8254350 - DNA, 22 bp, Homo sapiens
tgcagctggtttagaactagat

SEQ ID NO: 8254351 - DNA, 22 bp, Homo sapiens
tgcagctggtttagaactagat

SEQ ID NO: 8254352 - DNA, 22 bp, Homo sapiens
tgcagctgggtctgccctggct

SEQ ID NO: 8254353 - DNA, 22 bp, Homo sapiens
tgcagctgggacatttttgata

SEQ ID NO: 8254354 - DNA, 22 bp, Homo sapiens
tgcagctggaacttagaggaga

SEQ ID NO: 8254355 - DNA, 22 bp, Homo sapiens
tgcagctggaacttagaggaga

SEQ ID NO: 8254356 - DNA, 22 bp, Homo sapiens
tgcagctggaacttagaggaga

SEQ ID NO: 8254357 - DNA, 22 bp, Homo sapiens
tgcagctggatttatcttttcc

SEQ ID NO: 8254358 - DNA, 22 bp, Homo sapiens
tgcagctgcttgattcatcttg

SEQ ID NO: 8254359 - DNA, 17 bp, Homo sapiens
tgcagctgatggggaaa

SEQ ID NO: 8254360 - DNA, 22 bp, Homo sapiens
tgcagctgaggccagctatgcc

SEQ ID NO: 8254361 - DNA, 22 bp, Homo sapiens
tgcagctgataattacatgttc

SEQ ID NO: 8254362 - DNA, 22 bp, Homo sapiens
tgcagctgataattacatgttc

SEQ ID NO: 8254363 - DNA, 22 bp, Homo sapiens
tgcagctgctggcccaggtgct

SEQ ID NO: 8254364 - DNA, 22 bp, Homo sapiens
tgcagctgctggtggctgaaag

SEQ ID NO: 8254365 - DNA, 22 bp, Homo sapiens
tgcagctgctggtggctgaaag

SEQ ID NO: 8254366 - DNA, 21 bp, Homo sapiens
tgcagcctctgcccagcagtg

SEQ ID NO: 8254367 - DNA, 22 bp, Homo sapiens
tgcagcctcacgcatccgcatt

SEQ ID NO: 8254368 - DNA, 22 bp, Homo sapiens
tgcagccctgtgcacatcccct

SEQ ID NO: 8254369 - DNA, 22 bp, Homo sapiens
tgcagcccttccttcctctggg

SEQ ID NO: 8254370 - DNA, 22 bp, Homo sapiens
tgcagcccttccttcctctggg

SEQ ID NO: 8254371 - DNA, 22 bp, Homo sapiens
tgcagcccctgaaaatggcagc

SEQ ID NO: 8254372 - DNA, 19 bp, Homo sapiens
tgcagcccctaccacattc

SEQ ID NO: 8254373 - DNA, 22 bp, Homo sapiens
tgcagcccctatcgcggacagg

SEQ ID NO: 8254374 - DNA, 22 bp, Homo sapiens
tgcagccccccagatggccgta

SEQ ID NO: 8254375 - DNA, 19 bp, Homo sapiens
tgcagcccctaccacattc

SEQ ID NO: 8254376 - DNA, 22 bp, Homo sapiens
tgcagcccaggcgtcaggtggt

SEQ ID NO: 8254377 - DNA, 22 bp, Homo sapiens
tgcagccatcgcagagtctgta

SEQ ID NO: 8254378 - DNA, 22 bp, Homo sapiens
tgcagccatctttcttggagga

SEQ ID NO: 8254379 - DNA, 22 bp, Homo sapiens
tgcagccatctttcttggagga

SEQ ID NO: 8254380 - DNA, 22 bp, Homo sapiens
tgcagcccagccccagaacctt

SEQ ID NO: 8254381 - DNA, 22 bp, Homo sapiens
tgcagcccagccccagaacctt

SEQ ID NO: 8254382 - DNA, 22 bp, Homo sapiens
tgcagccattttctgccaatgc

SEQ ID NO: 8254383 - DNA, 21 bp, Homo sapiens
tgcagccattcagccctatgc

SEQ ID NO: 8254384 - DNA, 23 bp, Homo sapiens
tgcagcagggtggtctacttctc

SEQ ID NO: 8254385 - DNA, 22 bp, Homo sapiens
tgcagcaggtatggcaagctcc

SEQ ID NO: 8254386 - DNA, 22 bp, Homo sapiens
tgcagcaggtatggcaagctcc

SEQ ID NO: 8254387 - DNA, 19 bp, Homo sapiens
tgcagccacgtgagagact

SEQ ID NO: 8254388 - DNA, 22 bp, Homo sapiens
tgcagccaggaaatatttgctg

SEQ ID NO: 8254389 - DNA, 23 bp, Homo sapiens
tgcagccactcaggagctcagtg

SEQ ID NO: 8254390 - DNA, 21 bp, Homo sapiens
tgcagcagatttgggggaaga

SEQ ID NO: 8254391 - DNA, 22 bp, Homo sapiens
tgcagcagcagggaggaggctc

SEQ ID NO: 8254392 - DNA, 22 bp, Homo sapiens
tgcagcagcagggaggaggctc

SEQ ID NO: 8254393 - DNA, 22 bp, Homo sapiens
tgcagcagacataatgtggatt

SEQ ID NO: 8254394 - DNA, 22 bp, Homo sapiens
tgcagcagactgagtatgagaa

SEQ ID NO: 8254395 - DNA, 21 bp, Homo sapiens
tgcagcagagtaagcagggga

SEQ ID NO: 8254396 - DNA, 21 bp, Homo sapiens
tgcagcagagtaagcagggga

SEQ ID NO: 8254397 - DNA, 21 bp, Homo sapiens
tgcagcagagtaagcagggga

SEQ ID NO: 8254398 - DNA, 22 bp, Homo sapiens
tgcagcaggcacaggacggaag

SEQ ID NO: 8254399 - DNA, 22 bp, Homo sapiens
tgcagcagggcccaggcacaga

SEQ ID NO: 8254400 - DNA, 22 bp, Homo sapiens
tgcagcagggcccaggcacaga

SEQ ID NO: 8254401 - DNA, 22 bp, Homo sapiens
tgcagcagggcccaggcacaga

SEQ ID NO: 8254402 - DNA, 22 bp, Homo sapiens
tgcagcagcagggaggaggctc

SEQ ID NO: 8254403 - DNA, 22 bp, Homo sapiens
tgcagcaggagccaggcctggt

SEQ ID NO: 8254404 - DNA, 22 bp, Homo sapiens
tgcagcagcctcatctggtttc

SEQ ID NO: 8254405 - DNA, 19 bp, Homo sapiens
tcctgctttctactctgct

SEQ ID NO: 8254406 - DNA, 22 bp, Homo sapiens
tcctggaactgggctgggcgga

SEQ ID NO: 8254407 - DNA, 22 bp, Homo sapiens
tcctggaacatggataaagaat

SEQ ID NO: 8254408 - DNA, 22 bp, Homo sapiens
tcctggaagtgcttggtgaggg

SEQ ID NO: 8254409 - DNA, 22 bp, Homo sapiens
tcctggaatcagctttggagac

SEQ ID NO: 8254410 - DNA, 22 bp, Homo sapiens
tcctggactcaggaccacagga

SEQ ID NO: 8254411 - DNA, 22 bp, Homo sapiens
tcctggactggctcagcaccct

SEQ ID NO: 8254412 - DNA, 22 bp, Homo sapiens
tcctggagaaactcagagatct

SEQ ID NO: 8254413 - DNA, 22 bp, Homo sapiens
tcctggagaaactcagagatct

SEQ ID NO: 8254414 - DNA, 22 bp, Homo sapiens
tcctggagaaactcagagatct

SEQ ID NO: 8254415 - DNA, 23 bp, Homo sapiens
tcctggagaaaagaaacatttct

SEQ ID NO: 8254416 - DNA, 23 bp, Homo sapiens
tcctggagaaaagaaacatttct

SEQ ID NO: 8254417 - DNA, 22 bp, Homo sapiens
tcctggagaaactcagagatct

SEQ ID NO: 8254418 - DNA, 22 bp, Homo sapiens
tcctggagaactgattcgcggg

SEQ ID NO: 8254419 - DNA, 22 bp, Homo sapiens
tcctggagaactgattcgcggg

SEQ ID NO: 8254420 - DNA, 22 bp, Homo sapiens
tcctggagaagaggggcttgga

SEQ ID NO: 8254421 - DNA, 22 bp, Homo sapiens
tcctggagaagaggggcttgga

SEQ ID NO: 8254422 - DNA, 22 bp, Homo sapiens
tcctggagaagaggggcttgga

SEQ ID NO: 8254423 - DNA, 22 bp, Homo sapiens
tcctggagataattgcagtgaa

SEQ ID NO: 8254424 - DNA, 22 bp, Homo sapiens
tcctggagataattgcagtgaa

SEQ ID NO: 8254425 - DNA, 22 bp, Homo sapiens
tcctggagataattgcagtgaa

SEQ ID NO: 8254426 - DNA, 22 bp, Homo sapiens
tcctggagagtgggcgagcaca

SEQ ID NO: 8254427 - DNA, 22 bp, Homo sapiens
tcctggagagtgggcgagcaca

SEQ ID NO: 8254428 - DNA, 22 bp, Homo sapiens
tcctggagagtgggcgagcaca

SEQ ID NO: 8254429 - DNA, 22 bp, Homo sapiens
tcctggagagtgggcgagcaca

SEQ ID NO: 8254430 - DNA, 22 bp, Homo sapiens
tcctggagataattgcagtgaa

SEQ ID NO: 8254431 - DNA, 22 bp, Homo sapiens
tcctggagataattgcagtgaa

SEQ ID NO: 8254432 - DNA, 22 bp, Homo sapiens
tcctggagaatcctgccacctg

SEQ ID NO: 8254433 - DNA, 22 bp, Homo sapiens
tcctggagaatcctgccacctg

SEQ ID NO: 8254434 - DNA, 22 bp, Homo sapiens
tcctggagaagaggggcttgga

SEQ ID NO: 8254435 - DNA, 22 bp, Homo sapiens
tcctggagaagaggggcttgga

SEQ ID NO: 8254436 - DNA, 22 bp, Homo sapiens
tcctggagaagaggggcttgga

SEQ ID NO: 8254437 - DNA, 22 bp, Homo sapiens
tcctggagaatggacaatgcac

SEQ ID NO: 8254438 - DNA, 22 bp, Homo sapiens
tcctggagaatcctgccacctg

SEQ ID NO: 8254439 - DNA, 22 bp, Homo sapiens
tcctggagagaggcctggaaga

SEQ ID NO: 8254440 - DNA, 22 bp, Homo sapiens
tcctggagagaggcctggaaga

SEQ ID NO: 8254441 - DNA, 22 bp, Homo sapiens
tcctggagagaggcctggaaga

SEQ ID NO: 8254442 - DNA, 22 bp, Homo sapiens
tcctggagagaggcctggaaga

SEQ ID NO: 8254443 - DNA, 22 bp, Homo sapiens
tcctggagagaggcctggaaga

SEQ ID NO: 8254444 - DNA, 22 bp, Homo sapiens
tcctggagaatggacaatgcac

SEQ ID NO: 8254445 - DNA, 22 bp, Homo sapiens
tcctggaggcaaatgagcacat

SEQ ID NO: 8254446 - DNA, 22 bp, Homo sapiens
tcctggaggcaaatgagcacat

SEQ ID NO: 8254447 - DNA, 22 bp, Homo sapiens
tcctggaggcaaatgaagactc

SEQ ID NO: 8254448 - DNA, 22 bp, Homo sapiens
tcctggaggcaaatgaagactc

SEQ ID NO: 8254449 - DNA, 22 bp, Homo sapiens
tcctggaggcaaatgaagactc

SEQ ID NO: 8254450 - DNA, 22 bp, Homo sapiens
tcctggaggcaaatgaagactc

SEQ ID NO: 8254451 - DNA, 22 bp, Homo sapiens
tcctggaggcaaatgaagactc

SEQ ID NO: 8254452 - DNA, 22 bp, Homo sapiens
tcctggagccaatgtgctgctg

SEQ ID NO: 8254453 - DNA, 22 bp, Homo sapiens
tcctggagccaatgtgctgctg

SEQ ID NO: 8254454 - DNA, 22 bp, Homo sapiens
tcctggagccaatgtgctgctg

SEQ ID NO: 8254455 - DNA, 22 bp, Homo sapiens
tcctggagccaatgtgctgctg

SEQ ID NO: 8254456 - DNA, 22 bp, Homo sapiens
tcctggagccaatgtgctgctg

SEQ ID NO: 8254457 - DNA, 22 bp, Homo sapiens
tcctggaggagatccaatctga

SEQ ID NO: 8254458 - DNA, 20 bp, Homo sapiens
tcctggaggcttcatccata

SEQ ID NO: 8254459 - DNA, 20 bp, Homo sapiens
tcctggaggcttcatccata

SEQ ID NO: 8254460 - DNA, 22 bp, Homo sapiens
tcctggagggaggcggtgctac

SEQ ID NO: 8254461 - DNA, 22 bp, Homo sapiens
tcctggagggaggcggtgctac

SEQ ID NO: 8254462 - DNA, 22 bp, Homo sapiens
tcctggagggaggcggtgctac

SEQ ID NO: 8254463 - DNA, 22 bp, Homo sapiens
tcctggaggcactcgctggggc

SEQ ID NO: 8254464 - DNA, 22 bp, Homo sapiens
tcctggaggcactcgctggggc

SEQ ID NO: 8254465 - DNA, 22 bp, Homo sapiens
tcctggaggcactcgctggggc

SEQ ID NO: 8254466 - DNA, 22 bp, Homo sapiens
tcctggaggcactcgctggggc

SEQ ID NO: 8254467 - DNA, 22 bp, Homo sapiens
tcctggaggcactcgctggggc

SEQ ID NO: 8254468 - DNA, 22 bp, Homo sapiens
tcctggaggcaaatgagcacat

SEQ ID NO: 8254469 - DNA, 22 bp, Homo sapiens
tcctggaggcaaatgagcacat

SEQ ID NO: 8254470 - DNA, 22 bp, Homo sapiens
tcctggaggggacagcatgggc

SEQ ID NO: 8254471 - DNA, 22 bp, Homo sapiens
tcctggaggggacagcatgggc

SEQ ID NO: 8254472 - DNA, 22 bp, Homo sapiens
tcctggaggggacagcatgggc

SEQ ID NO: 8254473 - DNA, 22 bp, Homo sapiens
tcctggaggggacagcatgggc

SEQ ID NO: 8254474 - DNA, 22 bp, Homo sapiens
tcctggaggggacagcatgggc

SEQ ID NO: 8254475 - DNA, 22 bp, Homo sapiens
tcctggaggggacagcatgggc

SEQ ID NO: 8254476 - DNA, 22 bp, Homo sapiens
tcctggagggctcacaggcggc

SEQ ID NO: 8254477 - DNA, 22 bp, Homo sapiens
tcctggagggctcacaggcggc

SEQ ID NO: 8254478 - DNA, 22 bp, Homo sapiens
tcctggagggctcacaggcggc

SEQ ID NO: 8254479 - DNA, 22 bp, Homo sapiens
tcctggagggctcacaggcggc

SEQ ID NO: 8254480 - DNA, 22 bp, Homo sapiens
tcctggagggaggcggtgctac

SEQ ID NO: 8254481 - DNA, 22 bp, Homo sapiens
tcctggagggaggcggtgctac

SEQ ID NO: 8254482 - DNA, 22 bp, Homo sapiens
tcctggagggctcacaggcggc

SEQ ID NO: 8254483 - DNA, 22 bp, Homo sapiens
tcctggagggctcacaggcggc

SEQ ID NO: 8254484 - DNA, 22 bp, Homo sapiens
tcctggagggctcacaggcggc

SEQ ID NO: 8254485 - DNA, 22 bp, Homo sapiens
tcctggagtaggccttagccat

SEQ ID NO: 8254486 - DNA, 22 bp, Homo sapiens
tcctggaggggacagcatgggc

SEQ ID NO: 8254487 - DNA, 22 bp, Homo sapiens
tcctggaggggacagcatgggc

SEQ ID NO: 8254488 - DNA, 22 bp, Homo sapiens
tcctggaggggacagcatgggc

SEQ ID NO: 8254489 - DNA, 22 bp, Homo sapiens
tcctggagtaggccttagccat

SEQ ID NO: 8254490 - DNA, 22 bp, Homo sapiens
tcctggagtaggccttagccat

SEQ ID NO: 8254491 - DNA, 20 bp, Homo sapiens
tcctggagtattccatgctt

SEQ ID NO: 8254492 - DNA, 22 bp, Homo sapiens
tcctggagtaggccttagccat

SEQ ID NO: 8254493 - DNA, 20 bp, Homo sapiens
tcctggagtattccatgctt

SEQ ID NO: 8254494 - DNA, 20 bp, Homo sapiens
tcctggagtattccatgctt

SEQ ID NO: 8254495 - DNA, 20 bp, Homo sapiens
tcctggagtattccatgctt

SEQ ID NO: 8254496 - DNA, 22 bp, Homo sapiens
tcctggagtatttctgtggtgt

SEQ ID NO: 8254497 - DNA, 22 bp, Homo sapiens
tcctggagtatttctgtggtgt

SEQ ID NO: 8254498 - DNA, 22 bp, Homo sapiens
tcctgcttgaaactctgccttc

SEQ ID NO: 8254499 - DNA, 22 bp, Homo sapiens
tcctgcttgaaactctgccttc

SEQ ID NO: 8254500 - DNA, 22 bp, Homo sapiens
tcctgcttgaaactctgccttc

SEQ ID NO: 8254501 - DNA, 22 bp, Homo sapiens
tcctgctgggtctaactctggt

SEQ ID NO: 8254502 - DNA, 19 bp, Homo sapiens
tcctgctgtgtgaagggga

SEQ ID NO: 8254503 - DNA, 19 bp, Homo sapiens
tcctgctgtgtgaagggga

SEQ ID NO: 8254504 - DNA, 22 bp, Homo sapiens
taagaattatctcatggataat

SEQ ID NO: 8254505 - DNA, 18 bp, Homo sapiens
taagaattgagagtttac

SEQ ID NO: 8254506 - DNA, 22 bp, Homo sapiens
taagaatattgggaatggatgg

SEQ ID NO: 8254507 - DNA, 23 bp, Homo sapiens
taagaacagacaagcatttacat

SEQ ID NO: 8254508 - DNA, 22 bp, Homo sapiens
taagaacagataaagtttcccc

SEQ ID NO: 8254509 - DNA, 22 bp, Homo sapiens
taagaacagtagaacagtaggt

SEQ ID NO: 8254510 - DNA, 22 bp, Homo sapiens
taagaacagtagaacagtaggt

SEQ ID NO: 8254511 - DNA, 22 bp, Homo sapiens
taagaacagataaagtttcccc

SEQ ID NO: 8254512 - DNA, 22 bp, Homo sapiens
taagaacagtgtttcatctcta

SEQ ID NO: 8254513 - DNA, 22 bp, Homo sapiens
taagaacagtgtctgtctcaca

SEQ ID NO: 8254514 - DNA, 22 bp, Homo sapiens
taagaacagtgtctgtctcaca

SEQ ID NO: 8254515 - DNA, 22 bp, Homo sapiens
taagaacagtgtctgtctcaca

SEQ ID NO: 8254516 - DNA, 21 bp, Homo sapiens
taagaacattatcttcttcct

SEQ ID NO: 8254517 - DNA, 22 bp, Homo sapiens
taagaacattttcggaaagata

SEQ ID NO: 8254518 - DNA, 22 bp, Homo sapiens
taagaacattttcggaaagata

SEQ ID NO: 8254519 - DNA, 22 bp, Homo sapiens
taagaacattttcggaaagata

SEQ ID NO: 8254520 - DNA, 22 bp, Homo sapiens
taagaacttggcagcaagaaat

SEQ ID NO: 8254521 - DNA, 22 bp, Homo sapiens
taagaagtgttgcctaatgcaa

SEQ ID NO: 8254522 - DNA, 22 bp, Homo sapiens
taagaatagtccctagatgtgt

SEQ ID NO: 8254523 - DNA, 22 bp, Homo sapiens
taagaatagtccctagatgtgt

SEQ ID NO: 8254524 - DNA, 22 bp, Homo sapiens
taagaagtacaaaaattttctg

SEQ ID NO: 8254525 - DNA, 22 bp, Homo sapiens
taagaagtgctgaattgaatat

SEQ ID NO: 8254526 - DNA, 20 bp, Homo sapiens
tcctggcaagccgtacctcc

SEQ ID NO: 8254527 - DNA, 22 bp, Homo sapiens
tcctggcaaagatgttggtgtt

SEQ ID NO: 8254528 - DNA, 22 bp, Homo sapiens
tcctggcaaagcaagttatgaa

SEQ ID NO: 8254529 - DNA, 22 bp, Homo sapiens
tcctggcaaagcaagttatgaa

SEQ ID NO: 8254530 - DNA, 22 bp, Homo sapiens
tcctggcaaagatgttggtgtt

SEQ ID NO: 8254531 - DNA, 22 bp, Homo sapiens
tcctggcaaagatgttggtgtt

SEQ ID NO: 8254532 - DNA, 22 bp, Homo sapiens
tcctggatttagaagagcctcc

SEQ ID NO: 8254533 - DNA, 22 bp, Homo sapiens
tcctggatttaaccctggctct

SEQ ID NO: 8254534 - DNA, 22 bp, Homo sapiens
tcctggatttaaccctggctct

SEQ ID NO: 8254535 - DNA, 22 bp, Homo sapiens
tcctggatttagaagagcctcc

SEQ ID NO: 8254536 - DNA, 22 bp, Homo sapiens
tcctggcacattgcaggggctc

SEQ ID NO: 8254537 - DNA, 22 bp, Homo sapiens
tcctggcacattgcaggggctc

SEQ ID NO: 8254538 - DNA, 19 bp, Homo sapiens
tcctggcacagtggaacca

SEQ ID NO: 8254539 - DNA, 19 bp, Homo sapiens
tcctggcacagtggaacca

SEQ ID NO: 8254540 - DNA, 20 bp, Homo sapiens
tcctggcaagccgtacctcc

SEQ ID NO: 8254541 - DNA, 20 bp, Homo sapiens
tcctggcaagccgtacctcc

SEQ ID NO: 8254542 - DNA, 22 bp, Homo sapiens
tcctggcaatggcaggttcagg

SEQ ID NO: 8254543 - DNA, 22 bp, Homo sapiens
tcctggcaatggcaggttcagg

SEQ ID NO: 8254544 - DNA, 19 bp, Homo sapiens
tcctggcacagtggaacca

SEQ ID NO: 8254545 - DNA, 19 bp, Homo sapiens
tcctggcacagtggaacca

SEQ ID NO: 8254546 - DNA, 22 bp, Homo sapiens
tcctggcacaaccctttaccag

SEQ ID NO: 8254547 - DNA, 22 bp, Homo sapiens
tcctggcacaaccctttaccag

SEQ ID NO: 8254548 - DNA, 22 bp, Homo sapiens
tcctggcacaaccctttaccag

SEQ ID NO: 8254549 - DNA, 22 bp, Homo sapiens
tcctggattaatagggagctgt

SEQ ID NO: 8254550 - DNA, 22 bp, Homo sapiens
tcctggattctgccctgaaggc

SEQ ID NO: 8254551 - DNA, 22 bp, Homo sapiens
tcctggattctgccctgaaggc

SEQ ID NO: 8254552 - DNA, 22 bp, Homo sapiens
tcctggatggagctgccctcgc

SEQ ID NO: 8254553 - DNA, 22 bp, Homo sapiens
tcctggagtttgtggtgatatg

SEQ ID NO: 8254554 - DNA, 22 bp, Homo sapiens
tcctggatatttgcttaaggtt

SEQ ID NO: 8254555 - DNA, 17 bp, Homo sapiens
tcctggatccatggtgg

SEQ ID NO: 8254556 - DNA, 17 bp, Homo sapiens
tcctggatccatggtgg

SEQ ID NO: 8254557 - DNA, 17 bp, Homo sapiens
tcctggatccatggtgg

SEQ ID NO: 8254558 - DNA, 22 bp, Homo sapiens
tcctggagtatttctgtggtgt

SEQ ID NO: 8254559 - DNA, 22 bp, Homo sapiens
tcctggagtatttctgtggtgt

SEQ ID NO: 8254560 - DNA, 22 bp, Homo sapiens
tcctggagtatttctgtggtgt

SEQ ID NO: 8254561 - DNA, 20 bp, Homo sapiens
tcctggagtctggtttggct

SEQ ID NO: 8254562 - DNA, 20 bp, Homo sapiens
tcctggagtctggtttggct

SEQ ID NO: 8254563 - DNA, 20 bp, Homo sapiens
tcctggagtctggtttggct

SEQ ID NO: 8254564 - DNA, 22 bp, Homo sapiens
tcctggagtgtcttccccaagg

SEQ ID NO: 8254565 - DNA, 22 bp, Homo sapiens
tcctggagtgtcttccccaagg

SEQ ID NO: 8254566 - DNA, 22 bp, Homo sapiens
tcctggagtggagtctgttgtt

SEQ ID NO: 8254567 - DNA, 22 bp, Homo sapiens
tcctggagtggagtctgttgtt

SEQ ID NO: 8254568 - DNA, 22 bp, Homo sapiens
tcctggagttgtctgtactcat

SEQ ID NO: 8254569 - DNA, 22 bp, Homo sapiens
tcctggagttgtctgtactcat

SEQ ID NO: 8254570 - DNA, 22 bp, Homo sapiens
tcctggagttgtctgtactcat

SEQ ID NO: 8254571 - DNA, 22 bp, Homo sapiens
tcctggagttgtgcagtgcaca

SEQ ID NO: 8254572 - DNA, 22 bp, Homo sapiens
tcctggagttgtgcagtgcaca

SEQ ID NO: 8254573 - DNA, 22 bp, Homo sapiens
tcctggagttgtgcagtgcaca

SEQ ID NO: 8254574 - DNA, 22 bp, Homo sapiens
tcctggagttgtgcagtgcaca

SEQ ID NO: 8254575 - DNA, 22 bp, Homo sapiens
tcctggagttgtgcagtgcaca

SEQ ID NO: 8254576 - DNA, 22 bp, Homo sapiens
tcctggagttgtgcagtgcaca

SEQ ID NO: 8254577 - DNA, 22 bp, Homo sapiens
tcctggagtttgtaaggtgagc

SEQ ID NO: 8254578 - DNA, 22 bp, Homo sapiens
tcctggagtttgtaaggtgagc

SEQ ID NO: 8254579 - DNA, 22 bp, Homo sapiens
tcctggagtttgtggtgatatg

SEQ ID NO: 8254580 - DNA, 22 bp, Homo sapiens
tcctggagtttgtggtgatatg

SEQ ID NO: 8254581 - DNA, 22 bp, Homo sapiens
tcctggagtttgtggtgatatg

SEQ ID NO: 8254582 - DNA, 22 bp, Homo sapiens
tcctggcacccttgggttggag

SEQ ID NO: 8254583 - DNA, 22 bp, Homo sapiens
tcctggcacccttgggttggag

SEQ ID NO: 8254584 - DNA, 17 bp, Homo sapiens
tcctggcagtcccctgg

SEQ ID NO: 8254585 - DNA, 17 bp, Homo sapiens
tcctggcagtcccctgg

SEQ ID NO: 8254586 - DNA, 17 bp, Homo sapiens
tcctggcagtcccctgg

SEQ ID NO: 8254587 - DNA, 22 bp, Homo sapiens
tcctggcagtgcttgttttgga

SEQ ID NO: 8254588 - DNA, 22 bp, Homo sapiens
tcctggcagtgcttgttttgga

SEQ ID NO: 8254589 - DNA, 22 bp, Homo sapiens
tcctggcagttcagccccctaa

SEQ ID NO: 8254590 - DNA, 22 bp, Homo sapiens
tcctggcattgtgcagggtgtg

SEQ ID NO: 8254591 - DNA, 22 bp, Homo sapiens
tcctggcattgtgcagggtgtg

SEQ ID NO: 8254592 - DNA, 22 bp, Homo sapiens
tcctggcattgtgcagggtgtg

SEQ ID NO: 8254593 - DNA, 19 bp, Homo sapiens
tcctggcatcttcctccct

SEQ ID NO: 8254594 - DNA, 22 bp, Homo sapiens
tcctggcatccgtgggtctgtg

SEQ ID NO: 8254595 - DNA, 22 bp, Homo sapiens
tcctggcatccgtgggtctgtg

SEQ ID NO: 8254596 - DNA, 22 bp, Homo sapiens
tcctggcagttcagccccctaa

SEQ ID NO: 8254597 - DNA, 22 bp, Homo sapiens
tcctggcagttcagccccctaa

SEQ ID NO: 8254598 - DNA, 22 bp, Homo sapiens
tcctggcataatggctttgctc

SEQ ID NO: 8254599 - DNA, 22 bp, Homo sapiens
tcctggcataatggctttgctc

SEQ ID NO: 8254600 - DNA, 22 bp, Homo sapiens
tcctggcatttacaaacccacc

SEQ ID NO: 8254601 - DNA, 22 bp, Homo sapiens
tcctggcatttacaaacccacc

SEQ ID NO: 8254602 - DNA, 22 bp, Homo sapiens
tcctggcattgtgcagggtgtg

SEQ ID NO: 8254603 - DNA, 22 bp, Homo sapiens
tcctggcattgtgcagggtgtg

SEQ ID NO: 8254604 - DNA, 19 bp, Homo sapiens
tcctggcatttgtaggaaa

SEQ ID NO: 8254605 - DNA, 19 bp, Homo sapiens
tcctggcatttgtaggaaa

SEQ ID NO: 8254606 - DNA, 22 bp, Homo sapiens
tcctggccaagtagatgtggcg

SEQ ID NO: 8254607 - DNA, 22 bp, Homo sapiens
tcctggccaagttactctctgc

SEQ ID NO: 8254608 - DNA, 22 bp, Homo sapiens
tcctggccaagttactctctgc

SEQ ID NO: 8254609 - DNA, 18 bp, Homo sapiens
tcctggccacactacctt

SEQ ID NO: 8254610 - DNA, 18 bp, Homo sapiens
tcctggccacactacctt

SEQ ID NO: 8254611 - DNA, 22 bp, Homo sapiens
tcctggccaggatgacctaaca

SEQ ID NO: 8254612 - DNA, 22 bp, Homo sapiens
tcctggccatgcaagatgagga

SEQ ID NO: 8254613 - DNA, 22 bp, Homo sapiens
tcctggcccaatctgcccatga

SEQ ID NO: 8254614 - DNA, 21 bp, Homo sapiens
tcctggccagggcactaggca

SEQ ID NO: 8254615 - DNA, 21 bp, Homo sapiens
tcctggccagggcactaggca

SEQ ID NO: 8254616 - DNA, 21 bp, Homo sapiens
tcctggccagggcactaggca

SEQ ID NO: 8254617 - DNA, 21 bp, Homo sapiens
tcctggccagggcactaggca

SEQ ID NO: 8254618 - DNA, 23 bp, Homo sapiens
tcctggctctgcacttgctaatg

SEQ ID NO: 8254619 - DNA, 22 bp, Homo sapiens
tcctggctctaagtcctgagtg

SEQ ID NO: 8254620 - DNA, 22 bp, Homo sapiens
tcctggctctgctgcctcctag

SEQ ID NO: 8254621 - DNA, 22 bp, Homo sapiens
tcctggctctgctgcctcctag

SEQ ID NO: 8254622 - DNA, 17 bp, Homo sapiens
tcctggctctgccactg

SEQ ID NO: 8254623 - DNA, 22 bp, Homo sapiens
tcctggctctaagtcctgagtg

SEQ ID NO: 8254624 - DNA, 22 bp, Homo sapiens
tcctggctctaagtcctgagtg

SEQ ID NO: 8254625 - DNA, 22 bp, Homo sapiens
tcctggctctaagtcctgagtg

SEQ ID NO: 8254626 - DNA, 22 bp, Homo sapiens
tcctggctcctggagacctgct

SEQ ID NO: 8254627 - DNA, 22 bp, Homo sapiens
tcctggctcggcttggggactt

SEQ ID NO: 8254628 - DNA, 22 bp, Homo sapiens
tcctggcctccgttctctgcat

SEQ ID NO: 8254629 - DNA, 20 bp, Homo sapiens
tcctggcctccctggggctc

SEQ ID NO: 8254630 - DNA, 20 bp, Homo sapiens
tcctggcctccctggggctc

SEQ ID NO: 8254631 - DNA, 20 bp, Homo sapiens
tcctggcctccctggggctc

SEQ ID NO: 8254632 - DNA, 20 bp, Homo sapiens
tcctggcctccctggggctc

SEQ ID NO: 8254633 - DNA, 22 bp, Homo sapiens
tcctggcctcgctgtccacctt

SEQ ID NO: 8254634 - DNA, 22 bp, Homo sapiens
tcctggcctcgctgtccacctt

SEQ ID NO: 8254635 - DNA, 22 bp, Homo sapiens
tcctggcctctgagtcaagaac

SEQ ID NO: 8254636 - DNA, 22 bp, Homo sapiens
tcctggctcctggagacctgct

SEQ ID NO: 8254637 - DNA, 22 bp, Homo sapiens
tcctggcctagctcaccctgga

SEQ ID NO: 8254638 - DNA, 22 bp, Homo sapiens
tcctggcctagctcaccctgga

SEQ ID NO: 8254639 - DNA, 22 bp, Homo sapiens
tcctggcctcacagtcctgggt

SEQ ID NO: 8254640 - DNA, 22 bp, Homo sapiens
tcctggcctcacagtcctgggt

SEQ ID NO: 8254641 - DNA, 22 bp, Homo sapiens
tcctggccgctggcccctgaga

SEQ ID NO: 8254642 - DNA, 22 bp, Homo sapiens
tcctggccgctggcccctgaga

SEQ ID NO: 8254643 - DNA, 22 bp, Homo sapiens
tcctggcctagctcaccctgga

SEQ ID NO: 8254644 - DNA, 22 bp, Homo sapiens
tcctggccgccgcgtggggccg

SEQ ID NO: 8254645 - DNA, 22 bp, Homo sapiens
tcctggccgccgcgtggggccg

SEQ ID NO: 8254646 - DNA, 22 bp, Homo sapiens
tcctggccgccgcgtggggccg

SEQ ID NO: 8254647 - DNA, 22 bp, Homo sapiens
tcctggccctgtggcctgcagt

SEQ ID NO: 8254648 - DNA, 22 bp, Homo sapiens
tcctggccctgtggcctgcagt

SEQ ID NO: 8254649 - DNA, 22 bp, Homo sapiens
tcctggccctgtggcctgcagt

SEQ ID NO: 8254650 - DNA, 22 bp, Homo sapiens
tcctggcccggccgggcctgct

SEQ ID NO: 8254651 - DNA, 22 bp, Homo sapiens
tcctggcccggccgggcctgct

SEQ ID NO: 8254652 - DNA, 22 bp, Homo sapiens
tcctggcccggccgggcctgct

SEQ ID NO: 8254653 - DNA, 22 bp, Homo sapiens
tcctggcccggccgggcctgct

SEQ ID NO: 8254654 - DNA, 22 bp, Homo sapiens
tcctggcccggccgggcctgct

SEQ ID NO: 8254655 - DNA, 22 bp, Homo sapiens
tcctggcccgatccctgtgaag

SEQ ID NO: 8254656 - DNA, 22 bp, Homo sapiens
tcctggcccgatccctgtgaag

SEQ ID NO: 8254657 - DNA, 22 bp, Homo sapiens
tcctggcccgatccctgtgaag

SEQ ID NO: 8254658 - DNA, 22 bp, Homo sapiens
tcctggcccgatccctgtgaag

SEQ ID NO: 8254659 - DNA, 16 bp, Homo sapiens
tcctggcccctatgga

SEQ ID NO: 8254660 - DNA, 22 bp, Homo sapiens
tcctggcccactatgccagcat

SEQ ID NO: 8254661 - DNA, 22 bp, Homo sapiens
tcctggcccactatgccagcat

SEQ ID NO: 8254662 - DNA, 22 bp, Homo sapiens
tcctggcccactatgccagcat

SEQ ID NO: 8254663 - DNA, 22 bp, Homo sapiens
tcctggcccactatgccagcat

SEQ ID NO: 8254664 - DNA, 22 bp, Homo sapiens
tcctggcccactcctagcttct

SEQ ID NO: 8254665 - DNA, 22 bp, Homo sapiens
tcctggcccactcctagcttct

SEQ ID NO: 8254666 - DNA, 22 bp, Homo sapiens
tcctgtctaaagacctgcaggc

SEQ ID NO: 8254667 - DNA, 22 bp, Homo sapiens
tcctgtctgctcacagagctgg

SEQ ID NO: 8254668 - DNA, 22 bp, Homo sapiens
tcctgtctgctcacagagctgg

SEQ ID NO: 8254669 - DNA, 22 bp, Homo sapiens
tcctgtctgtctttggtccctt

SEQ ID NO: 8254670 - DNA, 22 bp, Homo sapiens
tcctgtctgtctttggtccctt

SEQ ID NO: 8254671 - DNA, 22 bp, Homo sapiens
tcctgtctgctcacagagctgg

SEQ ID NO: 8254672 - DNA, 22 bp, Homo sapiens
tcctgtctgtctttggtccctt

SEQ ID NO: 8254673 - DNA, 21 bp, Homo sapiens
tcctgtgaggacctgtcagtg

SEQ ID NO: 8254674 - DNA, 22 bp, Homo sapiens
tcctgtgcctccacctgctccg

SEQ ID NO: 8254675 - DNA, 21 bp, Homo sapiens
tcctgtgaggacctgtcagtg

SEQ ID NO: 8254676 - DNA, 22 bp, Homo sapiens
tcctgtgaccagcttccatgct

SEQ ID NO: 8254677 - DNA, 22 bp, Homo sapiens
tcctgtggagaggactggaggt

SEQ ID NO: 8254678 - DNA, 22 bp, Homo sapiens
tcctgtggagaggactggaggt

SEQ ID NO: 8254679 - DNA, 22 bp, Homo sapiens
tcctgtggcgttatcatgtgat

SEQ ID NO: 8254680 - DNA, 22 bp, Homo sapiens
tcctgtgctttggaggatgttc

SEQ ID NO: 8254681 - DNA, 22 bp, Homo sapiens
tcctgtggaagacagtgttggg

SEQ ID NO: 8254682 - DNA, 22 bp, Homo sapiens
tcctgtgctgttaatagtgata

SEQ ID NO: 8254683 - DNA, 20 bp, Homo sapiens
tcctgtggacattgctggcc

SEQ ID NO: 8254684 - DNA, 22 bp, Homo sapiens
tcctgtgctttggatgcttaga

SEQ ID NO: 8254685 - DNA, 22 bp, Homo sapiens
tcctgtgctttggatgcttaga

SEQ ID NO: 8254686 - DNA, 22 bp, Homo sapiens
tcctgtggggaaaagcctatct

SEQ ID NO: 8254687 - DNA, 17 bp, Homo sapiens
tcctgtgggtgcagcag

SEQ ID NO: 8254688 - DNA, 17 bp, Homo sapiens
tcctgtgggtgcagcag

SEQ ID NO: 8254689 - DNA, 22 bp, Homo sapiens
tcctgtggtatgggagtgatgt

SEQ ID NO: 8254690 - DNA, 22 bp, Homo sapiens
tccttaaatatttactgttaac

SEQ ID NO: 8254691 - DNA, 22 bp, Homo sapiens
tcctgtggcttccacgacctaa

SEQ ID NO: 8254692 - DNA, 22 bp, Homo sapiens
tcctgtggcttccacgacctaa

SEQ ID NO: 8254693 - DNA, 22 bp, Homo sapiens
tcctgtgggctctcggcctcca

SEQ ID NO: 8254694 - DNA, 22 bp, Homo sapiens
tcctgtggggaaaagcctatct

SEQ ID NO: 8254695 - DNA, 22 bp, Homo sapiens
tcctggtggtttgaaaactgaa

SEQ ID NO: 8254696 - DNA, 22 bp, Homo sapiens
tcctggtgtaatggtaagcatg

SEQ ID NO: 8254697 - DNA, 22 bp, Homo sapiens
tcctggtgggacagaaaacctc

SEQ ID NO: 8254698 - DNA, 22 bp, Homo sapiens
tcctggttagagctctctgggg

SEQ ID NO: 8254699 - DNA, 22 bp, Homo sapiens
tcctggtgtttatgtcacatag

SEQ ID NO: 8254700 - DNA, 22 bp, Homo sapiens
tcctggttaccaagcagctctc

SEQ ID NO: 8254701 - DNA, 22 bp, Homo sapiens
tcctggtgtcgcctggtcagtt

SEQ ID NO: 8254702 - DNA, 22 bp, Homo sapiens
tcctggtgtcgcctggtcagtt

SEQ ID NO: 8254703 - DNA, 22 bp, Homo sapiens
tcctggtgtcgcctggtcagtt

SEQ ID NO: 8254704 - DNA, 22 bp, Homo sapiens
tcctggtgtcgcctggtcagtt

SEQ ID NO: 8254705 - DNA, 22 bp, Homo sapiens
tcctggtgtaatggtaagcatg

SEQ ID NO: 8254706 - DNA, 22 bp, Homo sapiens
tcctgtcagtgaggcagatgaa

SEQ ID NO: 8254707 - DNA, 22 bp, Homo sapiens
tcctgtctaaagacctgcaggc

SEQ ID NO: 8254708 - DNA, 22 bp, Homo sapiens
tcctgtctaaagacctgcaggc

SEQ ID NO: 8254709 - DNA, 22 bp, Homo sapiens
tcctgtctaaagacctgcaggc

SEQ ID NO: 8254710 - DNA, 22 bp, Homo sapiens
tcctggttgttgttatagtata

SEQ ID NO: 8254711 - DNA, 18 bp, Homo sapiens
tcctggttctgtggccac

SEQ ID NO: 8254712 - DNA, 22 bp, Homo sapiens
tcctggttcttgaggagccatg

SEQ ID NO: 8254713 - DNA, 22 bp, Homo sapiens
tcctggttctggaatgtttaag

SEQ ID NO: 8254714 - DNA, 22 bp, Homo sapiens
tcctggtttatagactgatggc

SEQ ID NO: 8254715 - DNA, 22 bp, Homo sapiens
tcctggtttatagcttagggaa

SEQ ID NO: 8254716 - DNA, 22 bp, Homo sapiens
tcctggtttacagagtaaacca

SEQ ID NO: 8254717 - DNA, 23 bp, Homo sapiens
tcctgtcaagtgcttgttcctgc

SEQ ID NO: 8254718 - DNA, 22 bp, Homo sapiens
tcctgtcagtgaggcagatgaa

SEQ ID NO: 8254719 - DNA, 22 bp, Homo sapiens
tcctggggttttggccgcagct

SEQ ID NO: 8254720 - DNA, 22 bp, Homo sapiens
tcctgggtagcctgtccaagat

SEQ ID NO: 8254721 - DNA, 22 bp, Homo sapiens
tcctgggtagcctgtccaagat

SEQ ID NO: 8254722 - DNA, 22 bp, Homo sapiens
tcctgggtagcctgtccaagat

SEQ ID NO: 8254723 - DNA, 22 bp, Homo sapiens
tcctgggtaaacactgaccttt

SEQ ID NO: 8254724 - DNA, 22 bp, Homo sapiens
tcctgggtaaacactgaccttt

SEQ ID NO: 8254725 - DNA, 22 bp, Homo sapiens
tcctgggtagagacctgatgaa

SEQ ID NO: 8254726 - DNA, 22 bp, Homo sapiens
tcctggggtcctgactgcttcc

SEQ ID NO: 8254727 - DNA, 22 bp, Homo sapiens
tcctggggtttagagggaagtg

SEQ ID NO: 8254728 - DNA, 22 bp, Homo sapiens
tcctggggtttagagggaagtg

SEQ ID NO: 8254729 - DNA, 22 bp, Homo sapiens
tcctggtcagctttgaggttgt

SEQ ID NO: 8254730 - DNA, 18 bp, Homo sapiens
tcctggtattgcaagcac

SEQ ID NO: 8254731 - DNA, 22 bp, Homo sapiens
tcctggtggctctttgggaagg

SEQ ID NO: 8254732 - DNA, 22 bp, Homo sapiens
tcctggtggctctttgggaagg

SEQ ID NO: 8254733 - DNA, 23 bp, Homo sapiens
tcctgggtttgaattctagtctt

SEQ ID NO: 8254734 - DNA, 23 bp, Homo sapiens
tcctgggtttgaattctagtctt

SEQ ID NO: 8254735 - DNA, 22 bp, Homo sapiens
tcctgggttcatgtcctggtgc

SEQ ID NO: 8254736 - DNA, 22 bp, Homo sapiens
tcctgggtgtgatattcataga

SEQ ID NO: 8254737 - DNA, 22 bp, Homo sapiens
tcctgggtgtgatattcataga

SEQ ID NO: 8254738 - DNA, 22 bp, Homo sapiens
tcctgggttaattatgattcac

SEQ ID NO: 8254739 - DNA, 22 bp, Homo sapiens
tcctgggtgaaagaacaggcag

SEQ ID NO: 8254740 - DNA, 22 bp, Homo sapiens
tcctgggtgaaagaacaggcag

SEQ ID NO: 8254741 - DNA, 22 bp, Homo sapiens
tcctgggtctgggtgtctgagg

SEQ ID NO: 8254742 - DNA, 22 bp, Homo sapiens
tcctgggtctgggtgtctgagg

SEQ ID NO: 8254743 - DNA, 22 bp, Homo sapiens
tcctgggtggtggtaggagcag

SEQ ID NO: 8254744 - DNA, 22 bp, Homo sapiens
tcctgggtggtggtaggagcag

SEQ ID NO: 8254745 - DNA, 22 bp, Homo sapiens
tcctgggtggctctgcccggct

SEQ ID NO: 8254746 - DNA, 22 bp, Homo sapiens
tcctgggtgaaagaacaggcag

SEQ ID NO: 8254747 - DNA, 22 bp, Homo sapiens
tcctgggtctcttccttagttc

SEQ ID NO: 8254748 - DNA, 22 bp, Homo sapiens
tcctgggtctgggtgtctgagg

SEQ ID NO: 8254749 - DNA, 22 bp, Homo sapiens
tcctgggtcctgggaagccctg

SEQ ID NO: 8254750 - DNA, 22 bp, Homo sapiens
tcctgggtcctgggaagccctg

SEQ ID NO: 8254751 - DNA, 22 bp, Homo sapiens
tcctgggtcccgcacatctgtc

SEQ ID NO: 8254752 - DNA, 22 bp, Homo sapiens
tcctgggtccatggcagccgaa

SEQ ID NO: 8254753 - DNA, 22 bp, Homo sapiens
tcctgggtcccgcacatctgtc

SEQ ID NO: 8254754 - DNA, 22 bp, Homo sapiens
tcctgggtccatggcagccgaa

SEQ ID NO: 8254755 - DNA, 22 bp, Homo sapiens
tcctgggtcccgcacatctgtc

SEQ ID NO: 8254756 - DNA, 22 bp, Homo sapiens
tcctggggctgcaaggcctgtc

SEQ ID NO: 8254757 - DNA, 21 bp, Homo sapiens
tcctggggggtaggtgagttt

SEQ ID NO: 8254758 - DNA, 20 bp, Homo sapiens
tcctggggtaagccatggtc

SEQ ID NO: 8254759 - DNA, 20 bp, Homo sapiens
tcctggggtaagccatggtc

SEQ ID NO: 8254760 - DNA, 20 bp, Homo sapiens
tcctggggtaagccatggtc

SEQ ID NO: 8254761 - DNA, 22 bp, Homo sapiens
tcctggggctctttgatgtgat

SEQ ID NO: 8254762 - DNA, 22 bp, Homo sapiens
tcctggggctctttgatgtgat

SEQ ID NO: 8254763 - DNA, 22 bp, Homo sapiens
tcctggggctgcaaggcctgtc

SEQ ID NO: 8254764 - DNA, 22 bp, Homo sapiens
tcctggggctgcaaggcctgtc

SEQ ID NO: 8254765 - DNA, 22 bp, Homo sapiens
tcctggggctgcaaggcctgtc

SEQ ID NO: 8254766 - DNA, 22 bp, Homo sapiens
tcctggggctgcaaggcctgtc

SEQ ID NO: 8254767 - DNA, 22 bp, Homo sapiens
tcctggggctgcaaggcctgtc

SEQ ID NO: 8254768 - DNA, 22 bp, Homo sapiens
tcctggggctgcaaggcctgtc

SEQ ID NO: 8254769 - DNA, 22 bp, Homo sapiens
tcctggggccagcactggtgga

SEQ ID NO: 8254770 - DNA, 22 bp, Homo sapiens
tcctggggccagcactggtgga

SEQ ID NO: 8254771 - DNA, 22 bp, Homo sapiens
tcctggggctctgagcgagaca

SEQ ID NO: 8254772 - DNA, 22 bp, Homo sapiens
tcctggggctcatgggatttgt

SEQ ID NO: 8254773 - DNA, 22 bp, Homo sapiens
tcctggggccaggcacctctgg

SEQ ID NO: 8254774 - DNA, 22 bp, Homo sapiens
tcctggggaggtcgaggctgag

SEQ ID NO: 8254775 - DNA, 22 bp, Homo sapiens
tcctggggccagcactggtgga

SEQ ID NO: 8254776 - DNA, 19 bp, Homo sapiens
tcctggggatgtggtcacc

SEQ ID NO: 8254777 - DNA, 19 bp, Homo sapiens
tcctggggatgtggtcacc

SEQ ID NO: 8254778 - DNA, 22 bp, Homo sapiens
tcctggggaggtcgaggctgag

SEQ ID NO: 8254779 - DNA, 22 bp, Homo sapiens
tcctggggaggtcgaggctgag

SEQ ID NO: 8254780 - DNA, 19 bp, Homo sapiens
tcctgggctgggccaggtc

SEQ ID NO: 8254781 - DNA, 19 bp, Homo sapiens
tcctgggctgggccaggtc

SEQ ID NO: 8254782 - DNA, 19 bp, Homo sapiens
tcctgggctgggccaggtc

SEQ ID NO: 8254783 - DNA, 22 bp, Homo sapiens
tcctgggctgtgtgccactctg

SEQ ID NO: 8254784 - DNA, 22 bp, Homo sapiens
tcctgggctgtgtgccactctg

SEQ ID NO: 8254785 - DNA, 19 bp, Homo sapiens
tcctgggcgttgactttgg

SEQ ID NO: 8254786 - DNA, 22 bp, Homo sapiens
tcctgggctgcagggaagagca

SEQ ID NO: 8254787 - DNA, 22 bp, Homo sapiens
tcctgggctgcagggaagagca

SEQ ID NO: 8254788 - DNA, 22 bp, Homo sapiens
tcctgggctgcagggaagagca

SEQ ID NO: 8254789 - DNA, 22 bp, Homo sapiens
tcctgggcgattttctgaatat

SEQ ID NO: 8254790 - DNA, 22 bp, Homo sapiens
tcctgggcggttatgtgatctg

SEQ ID NO: 8254791 - DNA, 22 bp, Homo sapiens
tcctgggcggttatgtgatctg

SEQ ID NO: 8254792 - DNA, 19 bp, Homo sapiens
tcctgggctgggccaggtc

SEQ ID NO: 8254793 - DNA, 19 bp, Homo sapiens
tcctgggctgcgtcttgcc

SEQ ID NO: 8254794 - DNA, 19 bp, Homo sapiens
tcctgggctgcgtcttgcc

SEQ ID NO: 8254795 - DNA, 22 bp, Homo sapiens
tcctgggccctccggatcaggt

SEQ ID NO: 8254796 - DNA, 22 bp, Homo sapiens
tcctgggccctccggatcaggt

SEQ ID NO: 8254797 - DNA, 22 bp, Homo sapiens
tcctgggccctccggatcaggt

SEQ ID NO: 8254798 - DNA, 22 bp, Homo sapiens
tcctgggcctgtactccatccg

SEQ ID NO: 8254799 - DNA, 22 bp, Homo sapiens
tcctgggcctgtactccatccg

SEQ ID NO: 8254800 - DNA, 22 bp, Homo sapiens
tcctgggcgaggtactggggct

SEQ ID NO: 8254801 - DNA, 22 bp, Homo sapiens
tcctgggcctgtactccatccg

SEQ ID NO: 8254802 - DNA, 22 bp, Homo sapiens
tcctgggcgaggtactggggct

SEQ ID NO: 8254803 - DNA, 22 bp, Homo sapiens
tcctgggcgagtggtggtacac

SEQ ID NO: 8254804 - DNA, 22 bp, Homo sapiens
tcctgggcgagtggtggtacac

SEQ ID NO: 8254805 - DNA, 22 bp, Homo sapiens
tcctgggcagcgggacgctcag

SEQ ID NO: 8254806 - DNA, 22 bp, Homo sapiens
tcctgggccaagggctgtgagg

SEQ ID NO: 8254807 - DNA, 22 bp, Homo sapiens
tcctgggcccaggctgccaggg

SEQ ID NO: 8254808 - DNA, 22 bp, Homo sapiens
tcctgggccaagggctgtgagg

SEQ ID NO: 8254809 - DNA, 22 bp, Homo sapiens
tcctgggcccaggctgccaggg

SEQ ID NO: 8254810 - DNA, 22 bp, Homo sapiens
tcctgggcccaggctgccaggg

SEQ ID NO: 8254811 - DNA, 22 bp, Homo sapiens
tcctgggcccaggctgccaggg

SEQ ID NO: 8254812 - DNA, 22 bp, Homo sapiens
tcctgggcccaggctgccaggg

SEQ ID NO: 8254813 - DNA, 22 bp, Homo sapiens
tcctgggatcaagtgatcctcc

SEQ ID NO: 8254814 - DNA, 22 bp, Homo sapiens
tcctgggatgaggaaacaagga

SEQ ID NO: 8254815 - DNA, 22 bp, Homo sapiens
tcctgggatgaggaaacaagga

SEQ ID NO: 8254816 - DNA, 22 bp, Homo sapiens
tcctgggatgcataaaatatgt

SEQ ID NO: 8254817 - DNA, 22 bp, Homo sapiens
tcctgggatcaagtgatcctcc

SEQ ID NO: 8254818 - DNA, 22 bp, Homo sapiens
tcctgggatcaagtgatcctcc

SEQ ID NO: 8254819 - DNA, 22 bp, Homo sapiens
tcctgggatcaagtgatcctcc

SEQ ID NO: 8254820 - DNA, 22 bp, Homo sapiens
tcctgggagtggccatgtaatg

SEQ ID NO: 8254821 - DNA, 22 bp, Homo sapiens
tcctgggagtggccatgtaatg

SEQ ID NO: 8254822 - DNA, 22 bp, Homo sapiens
tcctgggatactaagaaatttt

SEQ ID NO: 8254823 - DNA, 22 bp, Homo sapiens
tcctgggagtggccatgtaatg

SEQ ID NO: 8254824 - DNA, 21 bp, Homo sapiens
tcctgggagtctgagatcctg

SEQ ID NO: 8254825 - DNA, 21 bp, Homo sapiens
tcctgggagtctgagatcctg

SEQ ID NO: 8254826 - DNA, 22 bp, Homo sapiens
tcctgggagtaattgagtcatg

SEQ ID NO: 8254827 - DNA, 21 bp, Homo sapiens
tcctgggagtctgagatcctg

SEQ ID NO: 8254828 - DNA, 21 bp, Homo sapiens
tcctgggagtctgagatcctg

SEQ ID NO: 8254829 - DNA, 22 bp, Homo sapiens
tcctgggagtaaaagctgccct

SEQ ID NO: 8254830 - DNA, 22 bp, Homo sapiens
tcctgggaggtaaaccagcatc

SEQ ID NO: 8254831 - DNA, 22 bp, Homo sapiens
tcctgggagtaaaagctgccct

SEQ ID NO: 8254832 - DNA, 22 bp, Homo sapiens
tcctgggagtaattgagtcatg

SEQ ID NO: 8254833 - DNA, 22 bp, Homo sapiens
tcctgggagtaattgagtcatg

SEQ ID NO: 8254834 - DNA, 22 bp, Homo sapiens
tcctgggagtaattgagtcatg

SEQ ID NO: 8254835 - DNA, 22 bp, Homo sapiens
tcctgggagtaattgagtcatg

SEQ ID NO: 8254836 - DNA, 22 bp, Homo sapiens
tcctgggcagcctctctggaag

SEQ ID NO: 8254837 - DNA, 22 bp, Homo sapiens
tcctgggcagcctctctggaag

SEQ ID NO: 8254838 - DNA, 22 bp, Homo sapiens
tcctgggcagcctctctggaag

SEQ ID NO: 8254839 - DNA, 22 bp, Homo sapiens
tcctgggcagaatgggatggct

SEQ ID NO: 8254840 - DNA, 22 bp, Homo sapiens
tcctgggcacaagtgagtctcc

SEQ ID NO: 8254841 - DNA, 22 bp, Homo sapiens
tcctgggcacaagtgagtctcc

SEQ ID NO: 8254842 - DNA, 22 bp, Homo sapiens
tcctgggcagaatgggatggct

SEQ ID NO: 8254843 - DNA, 22 bp, Homo sapiens
tcctgggcagaatgggatggct

SEQ ID NO: 8254844 - DNA, 22 bp, Homo sapiens
tcctgggattaaggtggtgatt

SEQ ID NO: 8254845 - DNA, 22 bp, Homo sapiens
tcctgggattaaggtggtgatt

SEQ ID NO: 8254846 - DNA, 22 bp, Homo sapiens
tcctgggatgcataaaatatgt

SEQ ID NO: 8254847 - DNA, 22 bp, Homo sapiens
tcctgggattctgcatttctaa

SEQ ID NO: 8254848 - DNA, 22 bp, Homo sapiens
tcctgggattctgcatttctaa

SEQ ID NO: 8254849 - DNA, 22 bp, Homo sapiens
tcctgggattaaggtggtgatt

SEQ ID NO: 8254850 - DNA, 22 bp, Homo sapiens
tcctgggcaaaagtatctgtga

SEQ ID NO: 8254851 - DNA, 22 bp, Homo sapiens
tcctgggatttgcccttttctc

SEQ ID NO: 8254852 - DNA, 22 bp, Homo sapiens
tcctgggcaaagaggggcagtg

SEQ ID NO: 8254853 - DNA, 22 bp, Homo sapiens
tcctgggcaaagaggggcagtg

SEQ ID NO: 8254854 - DNA, 22 bp, Homo sapiens
tcctgggcaaagaggggcagtg

SEQ ID NO: 8254855 - DNA, 22 bp, Homo sapiens
tcctggctgagttcccaagtcg

SEQ ID NO: 8254856 - DNA, 22 bp, Homo sapiens
tcctggctcttctgagttttct

SEQ ID NO: 8254857 - DNA, 22 bp, Homo sapiens
tcctggctgcaccagtgaccct

SEQ ID NO: 8254858 - DNA, 22 bp, Homo sapiens
tcctggctggaatttctcactc

SEQ ID NO: 8254859 - DNA, 22 bp, Homo sapiens
tcctggctggaatttctcactc

SEQ ID NO: 8254860 - DNA, 22 bp, Homo sapiens
tcctggctgttagagaggcaag

SEQ ID NO: 8254861 - DNA, 22 bp, Homo sapiens
tcctggctgttagagaggcaag

SEQ ID NO: 8254862 - DNA, 22 bp, Homo sapiens
tcctggcttccacacctgtcat

SEQ ID NO: 8254863 - DNA, 22 bp, Homo sapiens
tcctggcttaggtttccagaac

SEQ ID NO: 8254864 - DNA, 22 bp, Homo sapiens
tcctggcttccactcctctgtt

SEQ ID NO: 8254865 - DNA, 22 bp, Homo sapiens
tcctggcttttcttggctcatc

SEQ ID NO: 8254866 - DNA, 18 bp, Homo sapiens
tcctgggaaaggcataca

SEQ ID NO: 8254867 - DNA, 21 bp, Homo sapiens
tcctggctttatgctacctct

SEQ ID NO: 8254868 - DNA, 22 bp, Homo sapiens
tcctgggaactcggaaagctct

SEQ ID NO: 8254869 - DNA, 18 bp, Homo sapiens
tcctgggaaaggcataca

SEQ ID NO: 8254870 - DNA, 22 bp, Homo sapiens
tcctgggaactcggaaagctct

SEQ ID NO: 8254871 - DNA, 18 bp, Homo sapiens
tcctgggaaaggcataca

SEQ ID NO: 8254872 - DNA, 18 bp, Homo sapiens
tcctgggaaaggcataca

SEQ ID NO: 8254873 - DNA, 18 bp, Homo sapiens
tcctgggaacttgctagc

SEQ ID NO: 8254874 - DNA, 22 bp, Homo sapiens
tcctgggaactcggaaagctct

SEQ ID NO: 8254875 - DNA, 22 bp, Homo sapiens
tcctgggaagagacctgagcat

SEQ ID NO: 8254876 - DNA, 22 bp, Homo sapiens
tcctgggaagagacctgagcat

SEQ ID NO: 8254877 - DNA, 22 bp, Homo sapiens
tcctgggaagactgtgaggaca

SEQ ID NO: 8254878 - DNA, 18 bp, Homo sapiens
tcctgggaacttgctagc

SEQ ID NO: 8254879 - DNA, 22 bp, Homo sapiens
tcctgggacaccccaatatgag

SEQ ID NO: 8254880 - DNA, 22 bp, Homo sapiens
tcctgggacaagccgtggaagt

SEQ ID NO: 8254881 - DNA, 22 bp, Homo sapiens
tcctgggacaagccgtggaagt

SEQ ID NO: 8254882 - DNA, 22 bp, Homo sapiens
tcctgggaccaggcacctactg

SEQ ID NO: 8254883 - DNA, 22 bp, Homo sapiens
tcctgggacaccccaatatgag

SEQ ID NO: 8254884 - DNA, 22 bp, Homo sapiens
tcctgggaagttgcatcaccgt

SEQ ID NO: 8254885 - DNA, 22 bp, Homo sapiens
tcctgggaagttgcatcaccgt

SEQ ID NO: 8254886 - DNA, 22 bp, Homo sapiens
tcctgggaagtggctggctgag

SEQ ID NO: 8254887 - DNA, 22 bp, Homo sapiens
tcctgggaagtggctggctgag

SEQ ID NO: 8254888 - DNA, 21 bp, Homo sapiens
tcctgggaagcactggggtgg

SEQ ID NO: 8254889 - DNA, 22 bp, Homo sapiens
tcctgggaagcgccggcctgcg

SEQ ID NO: 8254890 - DNA, 22 bp, Homo sapiens
tcctgggaagcgccggcctgcg

SEQ ID NO: 8254891 - DNA, 22 bp, Homo sapiens
tcctgggaagtggctggctgag

SEQ ID NO: 8254892 - DNA, 22 bp, Homo sapiens
tcctgggaagtggctggctgag

SEQ ID NO: 8254893 - DNA, 22 bp, Homo sapiens
tcctgggaagtggctggctgag

SEQ ID NO: 8254894 - DNA, 22 bp, Homo sapiens
tcctgggaagtggctggctgag

SEQ ID NO: 8254895 - DNA, 22 bp, Homo sapiens
tcctgggaagcgccggcctgcg

SEQ ID NO: 8254896 - DNA, 22 bp, Homo sapiens
tcctgggaagtggctggctgag

SEQ ID NO: 8254897 - DNA, 22 bp, Homo sapiens
tcctgggaagagacctgagcat

SEQ ID NO: 8254898 - DNA, 21 bp, Homo sapiens
tcctgggaagcactggggtgg

SEQ ID NO: 8254899 - DNA, 21 bp, Homo sapiens
tcctgggaagcactggggtgg

SEQ ID NO: 8254900 - DNA, 22 bp, Homo sapiens
tcctgggaagagacctgagcat

SEQ ID NO: 8254901 - DNA, 22 bp, Homo sapiens
tcctgggaagagacctgagcat

SEQ ID NO: 8254902 - DNA, 22 bp, Homo sapiens
tcctgggaagagacctgagcat

SEQ ID NO: 8254903 - DNA, 22 bp, Homo sapiens
tcctgggaggctgtgcctggct

SEQ ID NO: 8254904 - DNA, 22 bp, Homo sapiens
tcctgggaggctgtgcctggct

SEQ ID NO: 8254905 - DNA, 22 bp, Homo sapiens
tcctgggaggctgtgcctggct

SEQ ID NO: 8254906 - DNA, 22 bp, Homo sapiens
tcctgggaggctgtgcctggct

SEQ ID NO: 8254907 - DNA, 22 bp, Homo sapiens
tcctgggaggctgtgcctggct

SEQ ID NO: 8254908 - DNA, 22 bp, Homo sapiens
tcctgggaggcaggaccccttt

SEQ ID NO: 8254909 - DNA, 22 bp, Homo sapiens
tcctgggaggcaggaccccttt

SEQ ID NO: 8254910 - DNA, 22 bp, Homo sapiens
tcctgggaggcggaggttgcag

SEQ ID NO: 8254911 - DNA, 22 bp, Homo sapiens
tcctgggaggcaggaccccttt

SEQ ID NO: 8254912 - DNA, 22 bp, Homo sapiens
tcctgggaggaacatttaccta

SEQ ID NO: 8254913 - DNA, 22 bp, Homo sapiens
tcctgggaggaacatttaccta

SEQ ID NO: 8254914 - DNA, 22 bp, Homo sapiens
tcctgggactctgcctcaggct

SEQ ID NO: 8254915 - DNA, 22 bp, Homo sapiens
tcctgggactctgcctcaggct

SEQ ID NO: 8254916 - DNA, 22 bp, Homo sapiens
tcctgggactctgcctcaggct

SEQ ID NO: 8254917 - DNA, 22 bp, Homo sapiens
tcctgggactctgcctcaggct

SEQ ID NO: 8254918 - DNA, 22 bp, Homo sapiens
tcctgggaccgagggaagagct

SEQ ID NO: 8254919 - DNA, 22 bp, Homo sapiens
tcctgggactcaacttagaagg

SEQ ID NO: 8254920 - DNA, 22 bp, Homo sapiens
tcctgggactcaacttagaagg

SEQ ID NO: 8254921 - DNA, 22 bp, Homo sapiens
tcctgggaccgagggaagagct

SEQ ID NO: 8254922 - DNA, 22 bp, Homo sapiens
tcctgggaccgagggaagagct

SEQ ID NO: 8254923 - DNA, 22 bp, Homo sapiens
tcctgggaccgagggaagagct

SEQ ID NO: 8254924 - DNA, 22 bp, Homo sapiens
tcctgggaccctgggtgcagag

SEQ ID NO: 8254925 - DNA, 22 bp, Homo sapiens
tcctgggaccctgggtgcagag

SEQ ID NO: 8254926 - DNA, 22 bp, Homo sapiens
tcctgggaccctgggtgcagag

SEQ ID NO: 8254927 - DNA, 22 bp, Homo sapiens
tcctgggaccctgggtgcagag

SEQ ID NO: 8254928 - DNA, 22 bp, Homo sapiens
tcctttccatgcttctagaggc

SEQ ID NO: 8254929 - DNA, 20 bp, Homo sapiens
tcctttcctccttctaaatg

SEQ ID NO: 8254930 - DNA, 22 bp, Homo sapiens
tcctttctccagctggcattgt

SEQ ID NO: 8254931 - DNA, 22 bp, Homo sapiens
tccttggctagtactggccagc

SEQ ID NO: 8254932 - DNA, 22 bp, Homo sapiens
tccttggcctgggtggggtctc

SEQ ID NO: 8254933 - DNA, 22 bp, Homo sapiens
tccttgggaaacatcatgtaat

SEQ ID NO: 8254934 - DNA, 22 bp, Homo sapiens
tccttggctttctggagcttct

SEQ ID NO: 8254935 - DNA, 21 bp, Homo sapiens
tccttgggcagtgcccagctt

SEQ ID NO: 8254936 - DNA, 23 bp, Homo sapiens
tccttgggcctgcccagagtggt

SEQ ID NO: 8254937 - DNA, 19 bp, Homo sapiens
tcctttctgttcctgagat

SEQ ID NO: 8254938 - DNA, 22 bp, Homo sapiens
tcctttcttcttctgcccatgg

SEQ ID NO: 8254939 - DNA, 17 bp, Homo sapiens
tcctttctttacctgtt

SEQ ID NO: 8254940 - DNA, 17 bp, Homo sapiens
tcctttctttacctgtt

SEQ ID NO: 8254941 - DNA, 18 bp, Homo sapiens
tcctttctccctcatctt

SEQ ID NO: 8254942 - DNA, 18 bp, Homo sapiens
tcctttctccctcatctt

SEQ ID NO: 8254943 - DNA, 22 bp, Homo sapiens
tcctttctccttccgacttcat

SEQ ID NO: 8254944 - DNA, 22 bp, Homo sapiens
tcctttctgtctttactctgga

SEQ ID NO: 8254945 - DNA, 22 bp, Homo sapiens
tcctttctgtctttactctgga

SEQ ID NO: 8254946 - DNA, 22 bp, Homo sapiens
tccttttccctgaaggtattta

SEQ ID NO: 8254947 - DNA, 22 bp, Homo sapiens
tccttttctctagtaagcttta

SEQ ID NO: 8254948 - DNA, 22 bp, Homo sapiens
tccttttgagctcctatgtggg

SEQ ID NO: 8254949 - DNA, 22 bp, Homo sapiens
tccttttctcttccccagagta

SEQ ID NO: 8254950 - DNA, 22 bp, Homo sapiens
tcctttgcttctgtcattctcc

SEQ ID NO: 8254951 - DNA, 22 bp, Homo sapiens
tcgaaggaggcactcagacatg

SEQ ID NO: 8254952 - DNA, 22 bp, Homo sapiens
tcgaaggttattgtctttacgt

SEQ ID NO: 8254953 - DNA, 22 bp, Homo sapiens
tcgaatggcaaggaaagaggct

SEQ ID NO: 8254954 - DNA, 22 bp, Homo sapiens
tcgagctctggagccaaggatg

SEQ ID NO: 8254955 - DNA, 22 bp, Homo sapiens
tcgagctgggcaagcttccata

SEQ ID NO: 8254956 - DNA, 22 bp, Homo sapiens
tcgaggcagtgcgctggctgtt

SEQ ID NO: 8254957 - DNA, 22 bp, Homo sapiens
tcgcaccattgcactccagcca

SEQ ID NO: 8254958 - DNA, 22 bp, Homo sapiens
tcgataatatcttacatgtgct

SEQ ID NO: 8254959 - DNA, 19 bp, Homo sapiens
tcgagtcaagacactaggc

SEQ ID NO: 8254960 - DNA, 22 bp, Homo sapiens
tcgaaataatttagaatataga

SEQ ID NO: 8254961 - DNA, 22 bp, Homo sapiens
tcgaactcatagtcgtagctgt

SEQ ID NO: 8254962 - DNA, 22 bp, Homo sapiens
tctaaaatgcagatctactggt

SEQ ID NO: 8254963 - DNA, 22 bp, Homo sapiens
tctaaaaaagtctgttcacttg

SEQ ID NO: 8254964 - DNA, 22 bp, Homo sapiens
tctaaaaaagtctgttcacttg

SEQ ID NO: 8254965 - DNA, 23 bp, Homo sapiens
tctaaaattcatcatttacgttc

SEQ ID NO: 8254966 - DNA, 23 bp, Homo sapiens
tctaaaattcatcatttacgttc

SEQ ID NO: 8254967 - DNA, 22 bp, Homo sapiens
tctaaacagcctcttaccaact

SEQ ID NO: 8254968 - DNA, 22 bp, Homo sapiens
tctaaacagtttcactcttaat

SEQ ID NO: 8254969 - DNA, 22 bp, Homo sapiens
tctaaacagtttcactcttaat

SEQ ID NO: 8254970 - DNA, 22 bp, Homo sapiens
tctaaacactaagtcttgatgc

SEQ ID NO: 8254971 - DNA, 22 bp, Homo sapiens
tctaaacacgtctctttgaata

SEQ ID NO: 8254972 - DNA, 22 bp, Homo sapiens
tctaaacactaagtcttgatgc

SEQ ID NO: 8254973 - DNA, 22 bp, Homo sapiens
tctaaagatttggattcatttg

SEQ ID NO: 8254974 - DNA, 22 bp, Homo sapiens
tctaaagatgtttattgacata

SEQ ID NO: 8254975 - DNA, 22 bp, Homo sapiens
tctaaagatgtttattgacata

SEQ ID NO: 8254976 - DNA, 22 bp, Homo sapiens
tctaaagagagtgggtacatgt

SEQ ID NO: 8254977 - DNA, 22 bp, Homo sapiens
tctaaagagaaccttttctcat

SEQ ID NO: 8254978 - DNA, 22 bp, Homo sapiens
tctaaagacactttttacaggg

SEQ ID NO: 8254979 - DNA, 22 bp, Homo sapiens
tcgtgaggctctgcatcgcaca

SEQ ID NO: 8254980 - DNA, 21 bp, Homo sapiens
tcgtgcagcagctgaggcttg

SEQ ID NO: 8254981 - DNA, 22 bp, Homo sapiens
tcgtgatctgtccacctcggcc

SEQ ID NO: 8254982 - DNA, 22 bp, Homo sapiens
tcgtggaatatggatgcttgtc

SEQ ID NO: 8254983 - DNA, 22 bp, Homo sapiens
tcgtggagaggccatgtggagg

SEQ ID NO: 8254984 - DNA, 22 bp, Homo sapiens
tcgttaccatagccttgtccct

SEQ ID NO: 8254985 - DNA, 22 bp, Homo sapiens
tcgttaatcagcaccagaattc

SEQ ID NO: 8254986 - DNA, 19 bp, Homo sapiens
tcgtggggaggtgggcagc

SEQ ID NO: 8254987 - DNA, 17 bp, Homo sapiens
tcgttttctgaacaaag

SEQ ID NO: 8254988 - DNA, 22 bp, Homo sapiens
tcgtctgtgaaattgggataag

SEQ ID NO: 8254989 - DNA, 22 bp, Homo sapiens
tcgtctgtgaaattgggataag

SEQ ID NO: 8254990 - DNA, 22 bp, Homo sapiens
tcgtgaggctctgcatcgcaca

SEQ ID NO: 8254991 - DNA, 22 bp, Homo sapiens
tcgcccaggctggaagtgcagt

SEQ ID NO: 8254992 - DNA, 22 bp, Homo sapiens
tcgcccaggctggaagtgcagt

SEQ ID NO: 8254993 - DNA, 22 bp, Homo sapiens
tcgccagggatgctgtaaggaa

SEQ ID NO: 8254994 - DNA, 22 bp, Homo sapiens
tcgcatggtgtgccttaacatt

SEQ ID NO: 8254995 - DNA, 22 bp, Homo sapiens
tcgcatttgttaaagcatgttg

SEQ ID NO: 8254996 - DNA, 22 bp, Homo sapiens
tcgccatggaagtccttgcgga

SEQ ID NO: 8254997 - DNA, 22 bp, Homo sapiens
tcgcaccattgcactccagcca

SEQ ID NO: 8254998 - DNA, 22 bp, Homo sapiens
tcgcaccattgcactccagcca

SEQ ID NO: 8254999 - DNA, 22 bp, Homo sapiens
tcgcaccattgcactccagcca

SEQ ID NO: 8255000 - DNA, 22 bp, Homo sapiens
tccttagacaaagagtgggctt

SEQ ID NO: 8255001 - DNA, 22 bp, Homo sapiens
tccttagagatactgtcttgaa

SEQ ID NO: 8255002 - DNA, 22 bp, Homo sapiens
tccttagagacaagaccagttt

SEQ ID NO: 8255003 - DNA, 22 bp, Homo sapiens
tccttaaatgtgatctagattt

SEQ ID NO: 8255004 - DNA, 22 bp, Homo sapiens
tccttacaacttgttatttttc

SEQ ID NO: 8255005 - DNA, 22 bp, Homo sapiens
tccttcaaaagttgagagagcc

SEQ ID NO: 8255006 - DNA, 22 bp, Homo sapiens
tccttcaaagctcctagtgagc

SEQ ID NO: 8255007 - DNA, 22 bp, Homo sapiens
tccttcaactttttacttgccc

SEQ ID NO: 8255008 - DNA, 22 bp, Homo sapiens
tccttcaactttttacttgccc

SEQ ID NO: 8255009 - DNA, 22 bp, Homo sapiens
tccttcaagatgccacagcttt

SEQ ID NO: 8255010 - DNA, 22 bp, Homo sapiens
tccttcaagtgcagtacctgag

SEQ ID NO: 8255011 - DNA, 22 bp, Homo sapiens
tccttaggcaatttgggagagt

SEQ ID NO: 8255012 - DNA, 22 bp, Homo sapiens
tccttaggaaaatgatgagggg

SEQ ID NO: 8255013 - DNA, 22 bp, Homo sapiens
tccttagcttacaagtcttctg

SEQ ID NO: 8255014 - DNA, 22 bp, Homo sapiens
tccttaggcaatttgggagagt

SEQ ID NO: 8255015 - DNA, 22 bp, Homo sapiens
tccttaggcaatttgggagagt

SEQ ID NO: 8255016 - DNA, 22 bp, Homo sapiens
tccttaggcaatttgggagagt

SEQ ID NO: 8255017 - DNA, 22 bp, Homo sapiens
tccttagggatttttccagtca

SEQ ID NO: 8255018 - DNA, 22 bp, Homo sapiens
tccttaggtatttagcatgaat

SEQ ID NO: 8255019 - DNA, 22 bp, Homo sapiens
tccttcagcttatttcttagga

SEQ ID NO: 8255020 - DNA, 22 bp, Homo sapiens
tccttcagcttgttagagtgac

SEQ ID NO: 8255021 - DNA, 22 bp, Homo sapiens
tccttcagctctctatttagat

SEQ ID NO: 8255022 - DNA, 22 bp, Homo sapiens
tccttcagctgctaggaaatga

SEQ ID NO: 8255023 - DNA, 22 bp, Homo sapiens
tccttcagctactcagtttcca

SEQ ID NO: 8255024 - DNA, 22 bp, Homo sapiens
tccttcagctactcagtttcca

SEQ ID NO: 8255025 - DNA, 22 bp, Homo sapiens
tccttcagccatgggctctcca

SEQ ID NO: 8255026 - DNA, 22 bp, Homo sapiens
tccttcagcctcccagctcaaa

SEQ ID NO: 8255027 - DNA, 22 bp, Homo sapiens
tccttcaggcctcattctcata

SEQ ID NO: 8255028 - DNA, 22 bp, Homo sapiens
tccttcaggcctcattctcata

SEQ ID NO: 8255029 - DNA, 22 bp, Homo sapiens
tccttcaggcctcattctcata

SEQ ID NO: 8255030 - DNA, 23 bp, Homo sapiens
tccttcaggctcttcccctggac

SEQ ID NO: 8255031 - DNA, 22 bp, Homo sapiens
tccttcaggcctcattctcata

SEQ ID NO: 8255032 - DNA, 17 bp, Homo sapiens
tccttcagggcctcaca

SEQ ID NO: 8255033 - DNA, 22 bp, Homo sapiens
tccttcagggggccgcctgcac

SEQ ID NO: 8255034 - DNA, 22 bp, Homo sapiens
tccttcagggggccgcctgcac

SEQ ID NO: 8255035 - DNA, 22 bp, Homo sapiens
tccttcagggggccgcctgcac

SEQ ID NO: 8255036 - DNA, 22 bp, Homo sapiens
tccttcagaaaacctcagtctt

SEQ ID NO: 8255037 - DNA, 22 bp, Homo sapiens
tccttcaccttagccctcctag

SEQ ID NO: 8255038 - DNA, 22 bp, Homo sapiens
tccttcaagtgcagtacctgag

SEQ ID NO: 8255039 - DNA, 23 bp, Homo sapiens
tccttcaagttaggaagtgaaca

SEQ ID NO: 8255040 - DNA, 22 bp, Homo sapiens
tccttcagccatgggctctcca

SEQ ID NO: 8255041 - DNA, 22 bp, Homo sapiens
tccttcagattcctgcttctgg

SEQ ID NO: 8255042 - DNA, 22 bp, Homo sapiens
tccttcagaggataaggaagaa

SEQ ID NO: 8255043 - DNA, 20 bp, Homo sapiens
tccttcagactttggagttg

SEQ ID NO: 8255044 - DNA, 20 bp, Homo sapiens
tccttcagacgacaagcaag

SEQ ID NO: 8255045 - DNA, 23 bp, Homo sapiens
tccttcagagcctccctccaagc

SEQ ID NO: 8255046 - DNA, 23 bp, Homo sapiens
tccttcagagcctccctccaagc

SEQ ID NO: 8255047 - DNA, 22 bp, Homo sapiens
tccttctcctccttgagtgaca

SEQ ID NO: 8255048 - DNA, 19 bp, Homo sapiens
tccttctccggccaccccg

SEQ ID NO: 8255049 - DNA, 19 bp, Homo sapiens
tccttctccggccaccccg

SEQ ID NO: 8255050 - DNA, 19 bp, Homo sapiens
tccttctccggccaccccg

SEQ ID NO: 8255051 - DNA, 22 bp, Homo sapiens
tccttctctacaaatccaggca

SEQ ID NO: 8255052 - DNA, 22 bp, Homo sapiens
tccttctcctccttgagtgaca

SEQ ID NO: 8255053 - DNA, 22 bp, Homo sapiens
tccttctcctccttgagtgaca

SEQ ID NO: 8255054 - DNA, 22 bp, Homo sapiens
tccttctcctccttgagtgaca

SEQ ID NO: 8255055 - DNA, 21 bp, Homo sapiens
tccttctctatgattgtctga

SEQ ID NO: 8255056 - DNA, 22 bp, Homo sapiens
tccttctctggtttttactgta

SEQ ID NO: 8255057 - DNA, 22 bp, Homo sapiens
tccttctgaaaaatgcacacga

SEQ ID NO: 8255058 - DNA, 22 bp, Homo sapiens
tccttctgaaaaatgcacacga

SEQ ID NO: 8255059 - DNA, 20 bp, Homo sapiens
tccttctgaggtgaggagga

SEQ ID NO: 8255060 - DNA, 20 bp, Homo sapiens
tccttctgaggtgaggagga

SEQ ID NO: 8255061 - DNA, 22 bp, Homo sapiens
tccttctgtagtccctgtccct

SEQ ID NO: 8255062 - DNA, 22 bp, Homo sapiens
tccttctgtagtccctgtccct

SEQ ID NO: 8255063 - DNA, 22 bp, Homo sapiens
tccttctgtagtccctgtccct

SEQ ID NO: 8255064 - DNA, 22 bp, Homo sapiens
tccttctgtagtccctgtccct

SEQ ID NO: 8255065 - DNA, 22 bp, Homo sapiens
tccttctggaggctctaagggg

SEQ ID NO: 8255066 - DNA, 22 bp, Homo sapiens
tccttctggaggctgtaaagga

SEQ ID NO: 8255067 - DNA, 22 bp, Homo sapiens
tccttctggaggctctaagggg

SEQ ID NO: 8255068 - DNA, 19 bp, Homo sapiens
tccttcagtcagatctggg

SEQ ID NO: 8255069 - DNA, 19 bp, Homo sapiens
tccttcagtcagatctggg

SEQ ID NO: 8255070 - DNA, 22 bp, Homo sapiens
tccttcctggggtctctgctgc

SEQ ID NO: 8255071 - DNA, 22 bp, Homo sapiens
tccttcctggggtctctgctgc

SEQ ID NO: 8255072 - DNA, 22 bp, Homo sapiens
tccttcctggggtctctgctgc

SEQ ID NO: 8255073 - DNA, 22 bp, Homo sapiens
tccttcctggggtctctgctgc

SEQ ID NO: 8255074 - DNA, 22 bp, Homo sapiens
tccttcctggggtctctgctgc

SEQ ID NO: 8255075 - DNA, 22 bp, Homo sapiens
tccttctacactgcctctgaga

SEQ ID NO: 8255076 - DNA, 22 bp, Homo sapiens
tccttctacactgcctctgaga

SEQ ID NO: 8255077 - DNA, 23 bp, Homo sapiens
tccttcctttgagaggctccatc

SEQ ID NO: 8255078 - DNA, 21 bp, Homo sapiens
tccttccttgaggtcctttcc

SEQ ID NO: 8255079 - DNA, 23 bp, Homo sapiens
tccttcctttgagaggctccatc

SEQ ID NO: 8255080 - DNA, 22 bp, Homo sapiens
tccttccttcctgaaattttag

SEQ ID NO: 8255081 - DNA, 21 bp, Homo sapiens
tccttccttgaggtcctttcc

SEQ ID NO: 8255082 - DNA, 22 bp, Homo sapiens
tccttgcacattatctgggaaa

SEQ ID NO: 8255083 - DNA, 21 bp, Homo sapiens
tccttgctattttcctcagct

SEQ ID NO: 8255084 - DNA, 22 bp, Homo sapiens
tccttggagcccaggagtagca

SEQ ID NO: 8255085 - DNA, 22 bp, Homo sapiens
tccttggaaatttcatcagaca

SEQ ID NO: 8255086 - DNA, 21 bp, Homo sapiens
tccttgctattttcctcagct

SEQ ID NO: 8255087 - DNA, 21 bp, Homo sapiens
tccttgctattttcctcagct

SEQ ID NO: 8255088 - DNA, 22 bp, Homo sapiens
tccttggagtcatgatggaggt

SEQ ID NO: 8255089 - DNA, 22 bp, Homo sapiens
tccttggaggtcaacgggacgg

SEQ ID NO: 8255090 - DNA, 22 bp, Homo sapiens
tccttggaggtgttcatctgcc

SEQ ID NO: 8255091 - DNA, 17 bp, Homo sapiens
tccttggcaaccagttc

SEQ ID NO: 8255092 - DNA, 22 bp, Homo sapiens
tccttggcatgccgtcttctcc

SEQ ID NO: 8255093 - DNA, 22 bp, Homo sapiens
tccttggcagcagggagcatga

SEQ ID NO: 8255094 - DNA, 22 bp, Homo sapiens
tccttggcaagctgcaatggga

SEQ ID NO: 8255095 - DNA, 22 bp, Homo sapiens
tccttggcaagctgcaatggga

SEQ ID NO: 8255096 - DNA, 22 bp, Homo sapiens
tccttggcaagctgcaatggga

SEQ ID NO: 8255097 - DNA, 22 bp, Homo sapiens
tccttctttccccctagtcatt

SEQ ID NO: 8255098 - DNA, 22 bp, Homo sapiens
tccttctttccccctagtcatt

SEQ ID NO: 8255099 - DNA, 22 bp, Homo sapiens
tccttctttcacctcatagtca

SEQ ID NO: 8255100 - DNA, 22 bp, Homo sapiens
tccttcttcatgaagatatatg

SEQ ID NO: 8255101 - DNA, 22 bp, Homo sapiens
tccttcttccctggtttgcatc

SEQ ID NO: 8255102 - DNA, 22 bp, Homo sapiens
tccttctttgacaagtggcaga

SEQ ID NO: 8255103 - DNA, 22 bp, Homo sapiens
tccttgagaggacagagccata

SEQ ID NO: 8255104 - DNA, 22 bp, Homo sapiens
tccttgagaggacagagccata

SEQ ID NO: 8255105 - DNA, 22 bp, Homo sapiens
tccttgagccgtggccagggcc

SEQ ID NO: 8255106 - DNA, 22 bp, Homo sapiens
tccttgaggaggtgacactgga

SEQ ID NO: 8255107 - DNA, 22 bp, Homo sapiens
tccttgaagcttgtatctaata

SEQ ID NO: 8255108 - DNA, 22 bp, Homo sapiens
tctaggagaaccatcagggagg

SEQ ID NO: 8255109 - DNA, 17 bp, Homo sapiens
tctaggagagcagagct

SEQ ID NO: 8255110 - DNA, 22 bp, Homo sapiens
tctaggaacctgacatctctca

SEQ ID NO: 8255111 - DNA, 22 bp, Homo sapiens
tctaggaagtaaggagggacta

SEQ ID NO: 8255112 - DNA, 22 bp, Homo sapiens
tctaggaatttcatctagttct

SEQ ID NO: 8255113 - DNA, 22 bp, Homo sapiens
tctaggaatgttcttagggatt

SEQ ID NO: 8255114 - DNA, 20 bp, Homo sapiens
tctaggcaggcaggctcgtg

SEQ ID NO: 8255115 - DNA, 22 bp, Homo sapiens
tctagctctgcttatcatggct

SEQ ID NO: 8255116 - DNA, 22 bp, Homo sapiens
tctagctgagggtaggagacct

SEQ ID NO: 8255117 - DNA, 22 bp, Homo sapiens
tctagctctgcttatcatggct

SEQ ID NO: 8255118 - DNA, 22 bp, Homo sapiens
tctaggaaattgttactatatt

SEQ ID NO: 8255119 - DNA, 22 bp, Homo sapiens
tctaggaaattgttactatatt

SEQ ID NO: 8255120 - DNA, 22 bp, Homo sapiens
tctaggaaataatgactcatcc

SEQ ID NO: 8255121 - DNA, 22 bp, Homo sapiens
tctaggaaagcctttcacaact

SEQ ID NO: 8255122 - DNA, 22 bp, Homo sapiens
tctagaggccagggacactgct

SEQ ID NO: 8255123 - DNA, 22 bp, Homo sapiens
tctagagatacattggtcattt

SEQ ID NO: 8255124 - DNA, 22 bp, Homo sapiens
tctagagaaaaaactcaagtga

SEQ ID NO: 8255125 - DNA, 22 bp, Homo sapiens
tctagagactataatgtgtcct

SEQ ID NO: 8255126 - DNA, 22 bp, Homo sapiens
tctagatgaatgtgaggatatc

SEQ ID NO: 8255127 - DNA, 22 bp, Homo sapiens
tctagcaagctcgtgctcaagg

SEQ ID NO: 8255128 - DNA, 22 bp, Homo sapiens
tctagcagagggaagaggcttt

SEQ ID NO: 8255129 - DNA, 22 bp, Homo sapiens
tctagcaggcaaaagctcggca

SEQ ID NO: 8255130 - DNA, 22 bp, Homo sapiens
tctagcaggtggcggccagcga

SEQ ID NO: 8255131 - DNA, 22 bp, Homo sapiens
tctagcatgggaaaatcacagc

SEQ ID NO: 8255132 - DNA, 22 bp, Homo sapiens
tctagaaaaccaatattacatg

SEQ ID NO: 8255133 - DNA, 22 bp, Homo sapiens
tctagaaaaccaatattacatg

SEQ ID NO: 8255134 - DNA, 22 bp, Homo sapiens
tctagaaacaggtttctagaaa

SEQ ID NO: 8255135 - DNA, 23 bp, Homo sapiens
tctagaaaatgaaagaatgcagt

SEQ ID NO: 8255136 - DNA, 22 bp, Homo sapiens
tctactttataagtatataagt

SEQ ID NO: 8255137 - DNA, 22 bp, Homo sapiens
tctagaaaaaaactgctgtgga

SEQ ID NO: 8255138 - DNA, 22 bp, Homo sapiens
tctagaaaaacaaagtatctga

SEQ ID NO: 8255139 - DNA, 22 bp, Homo sapiens
tctaccctgcggtcttggggca

SEQ ID NO: 8255140 - DNA, 23 bp, Homo sapiens
tctacccacactgctctagaagg

SEQ ID NO: 8255141 - DNA, 22 bp, Homo sapiens
tctaccattgcttttcctccag

SEQ ID NO: 8255142 - DNA, 23 bp, Homo sapiens
tctacccacactgctctagaagg

SEQ ID NO: 8255143 - DNA, 22 bp, Homo sapiens
tctacattttctttatgtacat

SEQ ID NO: 8255144 - DNA, 22 bp, Homo sapiens
tctaccactttgacctctctgt

SEQ ID NO: 8255145 - DNA, 22 bp, Homo sapiens
tctaccagggtcacagaggccc

SEQ ID NO: 8255146 - DNA, 22 bp, Homo sapiens
tctactatgtttcttaaataga

SEQ ID NO: 8255147 - DNA, 22 bp, Homo sapiens
tctactctactgtctgtgccta

SEQ ID NO: 8255148 - DNA, 17 bp, Homo sapiens
tctactcctgaaggaag

SEQ ID NO: 8255149 - DNA, 22 bp, Homo sapiens
tctactgcactggtgtctcatc

SEQ ID NO: 8255150 - DNA, 22 bp, Homo sapiens
tctactgcactggtgtctcatc

SEQ ID NO: 8255151 - DNA, 22 bp, Homo sapiens
tctactgccacttaagacattt

SEQ ID NO: 8255152 - DNA, 22 bp, Homo sapiens
tctaattttggcattttaacct

SEQ ID NO: 8255153 - DNA, 22 bp, Homo sapiens
tctaattttggcattttaacct

SEQ ID NO: 8255154 - DNA, 22 bp, Homo sapiens
tctacaaagaagaattaatgtc

SEQ ID NO: 8255155 - DNA, 22 bp, Homo sapiens
tctacaaagaagaattaatgtc

SEQ ID NO: 8255156 - DNA, 23 bp, Homo sapiens
tctacaaagctgtgtcaggaccc

SEQ ID NO: 8255157 - DNA, 22 bp, Homo sapiens
tctaacttgtatgtatagtttt

SEQ ID NO: 8255158 - DNA, 22 bp, Homo sapiens
tctaacttgtgagtatagatga

SEQ ID NO: 8255159 - DNA, 22 bp, Homo sapiens
tctaacttgaactcatgactgt

SEQ ID NO: 8255160 - DNA, 22 bp, Homo sapiens
tctaagaaatcagatgatgagg

SEQ ID NO: 8255161 - DNA, 22 bp, Homo sapiens
tctaatgcttgactgggggctt

SEQ ID NO: 8255162 - DNA, 20 bp, Homo sapiens
tctaattaaaattgtctagt

SEQ ID NO: 8255163 - DNA, 22 bp, Homo sapiens
tctaaattcagtttattttgat

SEQ ID NO: 8255164 - DNA, 22 bp, Homo sapiens
tctaaatcccaacatgatatca

SEQ ID NO: 8255165 - DNA, 22 bp, Homo sapiens
tctaaatcccaacatgatatca

SEQ ID NO: 8255166 - DNA, 22 bp, Homo sapiens
tctaactaactacagtaagagg

SEQ ID NO: 8255167 - DNA, 22 bp, Homo sapiens
tctaacattgtttttcacagat

SEQ ID NO: 8255168 - DNA, 22 bp, Homo sapiens
tctaacttagggaatactttag

SEQ ID NO: 8255169 - DNA, 22 bp, Homo sapiens
tctaactatacaaagaaaacat

SEQ ID NO: 8255170 - DNA, 22 bp, Homo sapiens
tctaacttagggaatactttag

SEQ ID NO: 8255171 - DNA, 22 bp, Homo sapiens
tctaacttagggaatactttag

SEQ ID NO: 8255172 - DNA, 22 bp, Homo sapiens
tctaacttgaactcatgactgt

SEQ ID NO: 8255173 - DNA, 22 bp, Homo sapiens
tctaacttgaactcatgactgt

SEQ ID NO: 8255174 - DNA, 22 bp, Homo sapiens
tctacaaataaattactatgta

SEQ ID NO: 8255175 - DNA, 22 bp, Homo sapiens
tctacaagtcaagtctatcaag

SEQ ID NO: 8255176 - DNA, 22 bp, Homo sapiens
tctacaagtttaattccactta

SEQ ID NO: 8255177 - DNA, 22 bp, Homo sapiens
tctacagagagtcatagactca

SEQ ID NO: 8255178 - DNA, 22 bp, Homo sapiens
tctacagccattttgagcagtg

SEQ ID NO: 8255179 - DNA, 22 bp, Homo sapiens
tctacactgtagaattataagg

SEQ ID NO: 8255180 - DNA, 22 bp, Homo sapiens
tctacaggtggggcctggcaat

SEQ ID NO: 8255181 - DNA, 22 bp, Homo sapiens
tctacagggtcagagtttcatg

SEQ ID NO: 8255182 - DNA, 22 bp, Homo sapiens
tctacagggtaaggggcttgcc

SEQ ID NO: 8255183 - DNA, 22 bp, Homo sapiens
tctacagctgaacagtgtctca

SEQ ID NO: 8255184 - DNA, 22 bp, Homo sapiens
tctacataaaaattcagaaggc

SEQ ID NO: 8255185 - DNA, 22 bp, Homo sapiens
tctacagtgtttggtttgagga

SEQ ID NO: 8255186 - DNA, 22 bp, Homo sapiens
tctacagtgtcaatgtgtcttg

SEQ ID NO: 8255187 - DNA, 22 bp, Homo sapiens
tctacagtgtcaatgtgtcttg

SEQ ID NO: 8255188 - DNA, 22 bp, Homo sapiens
tctacaggtggggcctggcaat

SEQ ID NO: 8255189 - DNA, 22 bp, Homo sapiens
tctacagtagaaagatcccagt

SEQ ID NO: 8255190 - DNA, 22 bp, Homo sapiens
tctacattccttttataatatc

SEQ ID NO: 8255191 - DNA, 22 bp, Homo sapiens
tctacattttaacaagatgccc

SEQ ID NO: 8255192 - DNA, 22 bp, Homo sapiens
tctacattccttttataatatc

SEQ ID NO: 8255193 - DNA, 22 bp, Homo sapiens
tctacattttcacaaggtctcc

SEQ ID NO: 8255194 - DNA, 22 bp, Homo sapiens
tctacattttaacaagatgccc

SEQ ID NO: 8255195 - DNA, 21 bp, Homo sapiens
tctacatatcaatatgtaatt

SEQ ID NO: 8255196 - DNA, 21 bp, Homo sapiens
tctacatatcaatatgtaatt

SEQ ID NO: 8255197 - DNA, 22 bp, Homo sapiens
tctacatgcagcgaggggactt

SEQ ID NO: 8255198 - DNA, 22 bp, Homo sapiens
tctacatgcagcgaggggactt

SEQ ID NO: 8255199 - DNA, 22 bp, Homo sapiens
tctacatatgtgatttctaagt

SEQ ID NO: 8255200 - DNA, 22 bp, Homo sapiens
tctataaagggccagatagtag

SEQ ID NO: 8255201 - DNA, 22 bp, Homo sapiens
tctataaagggccagatagtag

SEQ ID NO: 8255202 - DNA, 22 bp, Homo sapiens
tctataaaactcaagagcaatt

SEQ ID NO: 8255203 - DNA, 22 bp, Homo sapiens
tctataaaactcaagagcaatt

SEQ ID NO: 8255204 - DNA, 22 bp, Homo sapiens
tctataaaactcaagagcaatt

SEQ ID NO: 8255205 - DNA, 22 bp, Homo sapiens
tctataaaactcaagagcaatt

SEQ ID NO: 8255206 - DNA, 22 bp, Homo sapiens
tctataaaactcaagagcaatt

SEQ ID NO: 8255207 - DNA, 22 bp, Homo sapiens
tctataaaactcaagagcaatt

SEQ ID NO: 8255208 - DNA, 22 bp, Homo sapiens
tctagttctagatccctgagga

SEQ ID NO: 8255209 - DNA, 22 bp, Homo sapiens
tctagttctagatccctgagga

SEQ ID NO: 8255210 - DNA, 22 bp, Homo sapiens
tctagttctagatccctgagga

SEQ ID NO: 8255211 - DNA, 22 bp, Homo sapiens
tctagtgttttggaacatggaa

SEQ ID NO: 8255212 - DNA, 22 bp, Homo sapiens
tctagttttggtatgagatgca

SEQ ID NO: 8255213 - DNA, 22 bp, Homo sapiens
tctagttttggtatgagatgca

SEQ ID NO: 8255214 - DNA, 15 bp, Homo sapiens
tctagttttgaagac

SEQ ID NO: 8255215 - DNA, 22 bp, Homo sapiens
tctagttttctcaaatgacttg

SEQ ID NO: 8255216 - DNA, 19 bp, Homo sapiens
tctagttttgagagacttc

SEQ ID NO: 8255217 - DNA, 22 bp, Homo sapiens
tctagttttctcaaatgacttg

SEQ ID NO: 8255218 - DNA, 22 bp, Homo sapiens
tctagttttagcttgagttgca

SEQ ID NO: 8255219 - DNA, 22 bp, Homo sapiens
tctagtttaagatctgttagtc

SEQ ID NO: 8255220 - DNA, 22 bp, Homo sapiens
tctagtttaagatctgttagtc

SEQ ID NO: 8255221 - DNA, 22 bp, Homo sapiens
tctagggttgaggccacaggga

SEQ ID NO: 8255222 - DNA, 22 bp, Homo sapiens
tctaggtggatgaggaacatag

SEQ ID NO: 8255223 - DNA, 22 bp, Homo sapiens
tctaggtattgtagttgctaat

SEQ ID NO: 8255224 - DNA, 22 bp, Homo sapiens
tctagtcatattttttcagtat

SEQ ID NO: 8255225 - DNA, 22 bp, Homo sapiens
tctagtcctaggagaggagtca

SEQ ID NO: 8255226 - DNA, 22 bp, Homo sapiens
tctaggcccaggcctgcggctg

SEQ ID NO: 8255227 - DNA, 22 bp, Homo sapiens
tctattatggtacttatcatga

SEQ ID NO: 8255228 - DNA, 22 bp, Homo sapiens
tctattacttaccactaattca

SEQ ID NO: 8255229 - DNA, 22 bp, Homo sapiens
tctattaatgattcaatagtgt

SEQ ID NO: 8255230 - DNA, 22 bp, Homo sapiens
tctattactcttttaaggaaaa

SEQ ID NO: 8255231 - DNA, 22 bp, Homo sapiens
tctatgttggtccatattatgg

SEQ ID NO: 8255232 - DNA, 22 bp, Homo sapiens
tctatgtgccctttgtgtgatg

SEQ ID NO: 8255233 - DNA, 22 bp, Homo sapiens
tctatgtagtgccagctagtat

SEQ ID NO: 8255234 - DNA, 22 bp, Homo sapiens
tctatgtaggagagagcttgac

SEQ ID NO: 8255235 - DNA, 21 bp, Homo sapiens
tctatgtacgcatctatgcct

SEQ ID NO: 8255236 - DNA, 22 bp, Homo sapiens
tctatggggcctcacaggcact

SEQ ID NO: 8255237 - DNA, 22 bp, Homo sapiens
tctatgcttgagacagatgggg

SEQ ID NO: 8255238 - DNA, 22 bp, Homo sapiens
tctatgtaaagccatattgata

SEQ ID NO: 8255239 - DNA, 22 bp, Homo sapiens
tctatgtaaatgtgagttggtg

SEQ ID NO: 8255240 - DNA, 22 bp, Homo sapiens
tctatgtcaaccttgcagtgca

SEQ ID NO: 8255241 - DNA, 22 bp, Homo sapiens
tctatgtatggaccttttctgt

SEQ ID NO: 8255242 - DNA, 22 bp, Homo sapiens
tctatgtgccctttgtgtgatg

SEQ ID NO: 8255243 - DNA, 22 bp, Homo sapiens
tctatattccagatacagatta

SEQ ID NO: 8255244 - DNA, 22 bp, Homo sapiens
tctatcattcgcactcctactt

SEQ ID NO: 8255245 - DNA, 22 bp, Homo sapiens
tctatattttgaaaggtattta

SEQ ID NO: 8255246 - DNA, 22 bp, Homo sapiens
tctatctgaggaggtgacattt

SEQ ID NO: 8255247 - DNA, 21 bp, Homo sapiens
tctatctctagtccgctgcac

SEQ ID NO: 8255248 - DNA, 22 bp, Homo sapiens
tctatctcccttattcctggcc

SEQ ID NO: 8255249 - DNA, 22 bp, Homo sapiens
tctatctcccttattcctggcc

SEQ ID NO: 8255250 - DNA, 22 bp, Homo sapiens
tctataaagggccagatagtag

SEQ ID NO: 8255251 - DNA, 22 bp, Homo sapiens
tctataaagggccagatagtag

SEQ ID NO: 8255252 - DNA, 22 bp, Homo sapiens
tctatattccagatacagatta

SEQ ID NO: 8255253 - DNA, 22 bp, Homo sapiens
tctatattccagatacagatta

SEQ ID NO: 8255254 - DNA, 22 bp, Homo sapiens
tctataaatgcagatatgtgtg

SEQ ID NO: 8255255 - DNA, 22 bp, Homo sapiens
tctatgaagtgcgaagaggcac

SEQ ID NO: 8255256 - DNA, 22 bp, Homo sapiens
tctatgaacctctgcaatgaca

SEQ ID NO: 8255257 - DNA, 22 bp, Homo sapiens
tctatcgcttggctatgatttt

SEQ ID NO: 8255258 - DNA, 22 bp, Homo sapiens
tctatctgggagttccccatta

SEQ ID NO: 8255259 - DNA, 22 bp, Homo sapiens
tctatgaatgacacagataata

SEQ ID NO: 8255260 - DNA, 22 bp, Homo sapiens
tctatgaatgacacagataata

SEQ ID NO: 8255261 - DNA, 22 bp, Homo sapiens
tctattttatactcaaatcttc

SEQ ID NO: 8255262 - DNA, 22 bp, Homo sapiens
tctattttatactcaaatcttc

SEQ ID NO: 8255263 - DNA, 22 bp, Homo sapiens
tctattttatactcaaatcttc

SEQ ID NO: 8255264 - DNA, 22 bp, Homo sapiens
tctattttatactcaaatcttc

SEQ ID NO: 8255265 - DNA, 22 bp, Homo sapiens
tctatttgttctcaggatcatc

SEQ ID NO: 8255266 - DNA, 22 bp, Homo sapiens
tctatttaggagaccctggttc

SEQ ID NO: 8255267 - DNA, 22 bp, Homo sapiens
tctatttaccaaatgtagttcc

SEQ ID NO: 8255268 - DNA, 22 bp, Homo sapiens
tctatttaccaaatgtagttcc

SEQ ID NO: 8255269 - DNA, 22 bp, Homo sapiens
tctatttaccaaatgtagttcc

SEQ ID NO: 8255270 - DNA, 22 bp, Homo sapiens
tctattgtccaatctttcacct

SEQ ID NO: 8255271 - DNA, 22 bp, Homo sapiens
tctattcattcaatttagctct

SEQ ID NO: 8255272 - DNA, 22 bp, Homo sapiens
tctattcaggcagagtgcagca

SEQ ID NO: 8255273 - DNA, 22 bp, Homo sapiens
tctattggtaggggctgaggca

SEQ ID NO: 8255274 - DNA, 22 bp, Homo sapiens
tctattgggactctgcggtgag

SEQ ID NO: 8255275 - DNA, 22 bp, Homo sapiens
tctattttcttgccaaaactgc

SEQ ID NO: 8255276 - DNA, 22 bp, Homo sapiens
tctattttcttgccaaaactgc

SEQ ID NO: 8255277 - DNA, 22 bp, Homo sapiens
tctatttttatagttgaagtgc

SEQ ID NO: 8255278 - DNA, 22 bp, Homo sapiens
tctatttttatagttgaagtgc

SEQ ID NO: 8255279 - DNA, 22 bp, Homo sapiens
tctatttttatagttgaagtgc

SEQ ID NO: 8255280 - DNA, 22 bp, Homo sapiens
tctcaaataggccttggtcctg

SEQ ID NO: 8255281 - DNA, 22 bp, Homo sapiens
tctcaaataggccttggtcctg

SEQ ID NO: 8255282 - DNA, 22 bp, Homo sapiens
tctcaaagtagctcccacagat

SEQ ID NO: 8255283 - DNA, 22 bp, Homo sapiens
tctcaaatatttggagagagga

SEQ ID NO: 8255284 - DNA, 22 bp, Homo sapiens
tctcaaatatttggagagagga

SEQ ID NO: 8255285 - DNA, 23 bp, Homo sapiens
tctcaaatatgatctgggtcatc

SEQ ID NO: 8255286 - DNA, 22 bp, Homo sapiens
tctcaaatatttggagagagga

SEQ ID NO: 8255287 - DNA, 22 bp, Homo sapiens
tctatttttatagttgaagtgc

SEQ ID NO: 8255288 - DNA, 19 bp, Homo sapiens
tctcacagctctactatgt

SEQ ID NO: 8255289 - DNA, 19 bp, Homo sapiens
tctcacagctctactatgt

SEQ ID NO: 8255290 - DNA, 22 bp, Homo sapiens
tctcacagggctaggccctgcc

SEQ ID NO: 8255291 - DNA, 22 bp, Homo sapiens
tctcacagctctgctgcatgct

SEQ ID NO: 8255292 - DNA, 22 bp, Homo sapiens
tctcacagcaggggccaggtct

SEQ ID NO: 8255293 - DNA, 22 bp, Homo sapiens
tctcacagcatcattgctcatg

SEQ ID NO: 8255294 - DNA, 22 bp, Homo sapiens
tctcacagcatcattgctcatg

SEQ ID NO: 8255295 - DNA, 22 bp, Homo sapiens
tctcacacttctgtgttgcaca

SEQ ID NO: 8255296 - DNA, 21 bp, Homo sapiens
tctcacaatatgatgccagat

SEQ ID NO: 8255297 - DNA, 22 bp, Homo sapiens
tctcacagcaggggccaggtct

SEQ ID NO: 8255298 - DNA, 20 bp, Homo sapiens
tctcacagacatcgtctcat

SEQ ID NO: 8255299 - DNA, 22 bp, Homo sapiens
tctcaattcatgaagttggaat

SEQ ID NO: 8255300 - DNA, 19 bp, Homo sapiens
tctcacaagcaacattgtt

SEQ ID NO: 8255301 - DNA, 19 bp, Homo sapiens
tctcacaagcaacattgtt

SEQ ID NO: 8255302 - DNA, 21 bp, Homo sapiens
tctcacaatatgatgccagat

SEQ ID NO: 8255303 - DNA, 22 bp, Homo sapiens
tctcaaatggcaaatgtgggtc

SEQ ID NO: 8255304 - DNA, 22 bp, Homo sapiens
tctcaagttatgtaacagctgt

SEQ ID NO: 8255305 - DNA, 22 bp, Homo sapiens
tctcaagttttctcataatctc

SEQ ID NO: 8255306 - DNA, 22 bp, Homo sapiens
tctcaaatggacaatattgtgg

SEQ ID NO: 8255307 - DNA, 22 bp, Homo sapiens
tctcaaatggacaatattgtgg

SEQ ID NO: 8255308 - DNA, 23 bp, Homo sapiens
tctcaaatctttgcgttgtatct

SEQ ID NO: 8255309 - DNA, 23 bp, Homo sapiens
tctcaaatctttgcgttgtatct

SEQ ID NO: 8255310 - DNA, 22 bp, Homo sapiens
tctcaaatcaaactttgagctt

SEQ ID NO: 8255311 - DNA, 19 bp, Homo sapiens
tctctcaattgcttcaatt

SEQ ID NO: 8255312 - DNA, 20 bp, Homo sapiens
tctctcacgggttggtttct

SEQ ID NO: 8255313 - DNA, 22 bp, Homo sapiens
tctctcactggtgcctctgttg

SEQ ID NO: 8255314 - DNA, 22 bp, Homo sapiens
tctctatttgcctaggcttgtg

SEQ ID NO: 8255315 - DNA, 20 bp, Homo sapiens
tctctatgaagtcaacagga

SEQ ID NO: 8255316 - DNA, 22 bp, Homo sapiens
tctctatattatatgtagtttg

SEQ ID NO: 8255317 - DNA, 22 bp, Homo sapiens
tctctcagaggaagaggcagtg

SEQ ID NO: 8255318 - DNA, 22 bp, Homo sapiens
tctctcagaactgcagctgcag

SEQ ID NO: 8255319 - DNA, 22 bp, Homo sapiens
tctctcagaactgcagctgcag

SEQ ID NO: 8255320 - DNA, 22 bp, Homo sapiens
tctctcactggtgcctctgttg

SEQ ID NO: 8255321 - DNA, 22 bp, Homo sapiens
tctctcactggtgcctctgttg

SEQ ID NO: 8255322 - DNA, 22 bp, Homo sapiens
tctctcactggtgcctctgttg

SEQ ID NO: 8255323 - DNA, 22 bp, Homo sapiens
tctctcagaaagcccatgtctg

SEQ ID NO: 8255324 - DNA, 22 bp, Homo sapiens
tctctcagaaagcccatgtctg

SEQ ID NO: 8255325 - DNA, 22 bp, Homo sapiens
tctctcagctttgagacctgct

SEQ ID NO: 8255326 - DNA, 22 bp, Homo sapiens
tctctcagctttgagacctgct

SEQ ID NO: 8255327 - DNA, 22 bp, Homo sapiens
tctctcaggctggagtgcagtg

SEQ ID NO: 8255328 - DNA, 22 bp, Homo sapiens
tctctcagaggccagggtcctg

SEQ ID NO: 8255329 - DNA, 22 bp, Homo sapiens
tctctcagatggggcactagta

SEQ ID NO: 8255330 - DNA, 22 bp, Homo sapiens
tctctcagatggggcactagta

SEQ ID NO: 8255331 - DNA, 22 bp, Homo sapiens
tctctcagcattactcttacta

SEQ ID NO: 8255332 - DNA, 18 bp, Homo sapiens
tctctcagggaaacagaa

SEQ ID NO: 8255333 - DNA, 22 bp, Homo sapiens
tctctccaacatggtggtgctg

SEQ ID NO: 8255334 - DNA, 22 bp, Homo sapiens
tctctcatagagaaaaatatat

SEQ ID NO: 8255335 - DNA, 21 bp, Homo sapiens
tctctcctcaagctcgacccc

SEQ ID NO: 8255336 - DNA, 21 bp, Homo sapiens
tctctcctcaagctcgacccc

SEQ ID NO: 8255337 - DNA, 22 bp, Homo sapiens
tctctcctgtgttctgatgttt

SEQ ID NO: 8255338 - DNA, 22 bp, Homo sapiens
tctctcctgtgttctgatgttt

SEQ ID NO: 8255339 - DNA, 22 bp, Homo sapiens
tctctcctgtgttctgatgttt

SEQ ID NO: 8255340 - DNA, 22 bp, Homo sapiens
tctctcctgcactgaattatgt

SEQ ID NO: 8255341 - DNA, 22 bp, Homo sapiens
tctctcccctggccgctacgcg

SEQ ID NO: 8255342 - DNA, 22 bp, Homo sapiens
tctctccctttccttatcagtt

SEQ ID NO: 8255343 - DNA, 22 bp, Homo sapiens
tctctcctaatttcaggtgctt

SEQ ID NO: 8255344 - DNA, 22 bp, Homo sapiens
tctctcctaatttcaggtgctt

SEQ ID NO: 8255345 - DNA, 18 bp, Homo sapiens
tctctccatctatttgtt

SEQ ID NO: 8255346 - DNA, 22 bp, Homo sapiens
tctctcccaaatctgcagatag

SEQ ID NO: 8255347 - DNA, 22 bp, Homo sapiens
tctctcccaaatctgcagatag

SEQ ID NO: 8255348 - DNA, 22 bp, Homo sapiens
tctctctgagttgagcaggagt

SEQ ID NO: 8255349 - DNA, 22 bp, Homo sapiens
tctctctgagccctgctttttc

SEQ ID NO: 8255350 - DNA, 22 bp, Homo sapiens
tctctctgagccctgctttttc

SEQ ID NO: 8255351 - DNA, 18 bp, Homo sapiens
tctctctgataacatttt

SEQ ID NO: 8255352 - DNA, 22 bp, Homo sapiens
tctctctgagttgagcaggagt

SEQ ID NO: 8255353 - DNA, 22 bp, Homo sapiens
tctctctcctagtttttagtgg

SEQ ID NO: 8255354 - DNA, 22 bp, Homo sapiens
tctctctcagccattacagaac

SEQ ID NO: 8255355 - DNA, 22 bp, Homo sapiens
tctctctcctagtttttagtgg

SEQ ID NO: 8255356 - DNA, 18 bp, Homo sapiens
tctctctgaagagttccc

SEQ ID NO: 8255357 - DNA, 18 bp, Homo sapiens
tctctctgaagagttccc

SEQ ID NO: 8255358 - DNA, 18 bp, Homo sapiens
tctctctgaagagttccc

SEQ ID NO: 8255359 - DNA, 22 bp, Homo sapiens
tctctctcctagtttttagtgg

SEQ ID NO: 8255360 - DNA, 22 bp, Homo sapiens
tctctcctgtgttctgatgttt

SEQ ID NO: 8255361 - DNA, 22 bp, Homo sapiens
tctctcctgtgttctgatgttt

SEQ ID NO: 8255362 - DNA, 22 bp, Homo sapiens
tctctccttatcattgtgttta

SEQ ID NO: 8255363 - DNA, 22 bp, Homo sapiens
tctctctactggggcactagga

SEQ ID NO: 8255364 - DNA, 22 bp, Homo sapiens
tctctctcagccattacagaac

SEQ ID NO: 8255365 - DNA, 22 bp, Homo sapiens
tctctctaggcatctattttca

SEQ ID NO: 8255366 - DNA, 22 bp, Homo sapiens
tctctctatatgtcaacagggg

SEQ ID NO: 8255367 - DNA, 22 bp, Homo sapiens
tctctgagacagtagcctctgc

SEQ ID NO: 8255368 - DNA, 21 bp, Homo sapiens
tctctgagacactctggagcc

SEQ ID NO: 8255369 - DNA, 22 bp, Homo sapiens
tctctgagacagtagcctctgc

SEQ ID NO: 8255370 - DNA, 22 bp, Homo sapiens
tctctgagcatgccatattgct

SEQ ID NO: 8255371 - DNA, 22 bp, Homo sapiens
tctctgagcccaatgtagcaat

SEQ ID NO: 8255372 - DNA, 22 bp, Homo sapiens
tctctgagcccagtgtccccct

SEQ ID NO: 8255373 - DNA, 22 bp, Homo sapiens
tctctgagcgcattcctccggc

SEQ ID NO: 8255374 - DNA, 22 bp, Homo sapiens
tctctgagcgcattcctccggc

SEQ ID NO: 8255375 - DNA, 22 bp, Homo sapiens
tctctgagctcaggagctgcag

SEQ ID NO: 8255376 - DNA, 22 bp, Homo sapiens
tctctgagcccctgcctctttc

SEQ ID NO: 8255377 - DNA, 22 bp, Homo sapiens
tctctgaggttgtttccagcac

SEQ ID NO: 8255378 - DNA, 22 bp, Homo sapiens
tctctgaggttgtttccagcac

SEQ ID NO: 8255379 - DNA, 22 bp, Homo sapiens
tctctgagttctcctccagccc

SEQ ID NO: 8255380 - DNA, 22 bp, Homo sapiens
tctctgagtatcctgaactgcc

SEQ ID NO: 8255381 - DNA, 22 bp, Homo sapiens
tctctgagtaagtgacagttca

SEQ ID NO: 8255382 - DNA, 22 bp, Homo sapiens
tctctgagtatcctgaactgcc

SEQ ID NO: 8255383 - DNA, 22 bp, Homo sapiens
tctctgagctgcttcttgcata

SEQ ID NO: 8255384 - DNA, 22 bp, Homo sapiens
tctctgagctgcttcttgcata

SEQ ID NO: 8255385 - DNA, 22 bp, Homo sapiens
tctctgagcttaaggtgtttca

SEQ ID NO: 8255386 - DNA, 20 bp, Homo sapiens
tctctgagcttctcttgggg

SEQ ID NO: 8255387 - DNA, 20 bp, Homo sapiens
tctctgagcttctcttgggg

SEQ ID NO: 8255388 - DNA, 22 bp, Homo sapiens
tctctgagggagatggcctgcc

SEQ ID NO: 8255389 - DNA, 22 bp, Homo sapiens
tctctgaggaagaggctgtaat

SEQ ID NO: 8255390 - DNA, 22 bp, Homo sapiens
tctctcttgtcaccccatctgc

SEQ ID NO: 8255391 - DNA, 23 bp, Homo sapiens
tctctctggcaaatttcacatat

SEQ ID NO: 8255392 - DNA, 22 bp, Homo sapiens
tctctctttttaatcatgtaat

SEQ ID NO: 8255393 - DNA, 22 bp, Homo sapiens
tctctctttttaatcatgtaat

SEQ ID NO: 8255394 - DNA, 22 bp, Homo sapiens
tctctctttttaatcatgtaat

SEQ ID NO: 8255395 - DNA, 22 bp, Homo sapiens
tctctctttttaatcatgtaat

SEQ ID NO: 8255396 - DNA, 22 bp, Homo sapiens
tctctcttttttgaacccgctc

SEQ ID NO: 8255397 - DNA, 22 bp, Homo sapiens
tctctgaagagtcagacataac

SEQ ID NO: 8255398 - DNA, 22 bp, Homo sapiens
tctctgaagctcaattgagata

SEQ ID NO: 8255399 - DNA, 22 bp, Homo sapiens
tctctgaagatatttattatta

SEQ ID NO: 8255400 - DNA, 22 bp, Homo sapiens
tctctgaattgtttaagttatt

SEQ ID NO: 8255401 - DNA, 22 bp, Homo sapiens
tctctgacatgcctaagacttt

SEQ ID NO: 8255402 - DNA, 18 bp, Homo sapiens
tctctgaatattttatgt

SEQ ID NO: 8255403 - DNA, 22 bp, Homo sapiens
tctctgaattctgatgcaagtg

SEQ ID NO: 8255404 - DNA, 22 bp, Homo sapiens
tctctgaattctgatgcaagtg

SEQ ID NO: 8255405 - DNA, 22 bp, Homo sapiens
tctctgaaggctgtgttgatgg

SEQ ID NO: 8255406 - DNA, 22 bp, Homo sapiens
tctctgagaagttcctttgtga

SEQ ID NO: 8255407 - DNA, 22 bp, Homo sapiens
tctctgacatgcctaagacttt

SEQ ID NO: 8255408 - DNA, 20 bp, Homo sapiens
tctctgacttctccccgcct

SEQ ID NO: 8255409 - DNA, 22 bp, Homo sapiens
tctctgactcatatttgtgcct

SEQ ID NO: 8255410 - DNA, 22 bp, Homo sapiens
tctctggctggcaccccaggga

SEQ ID NO: 8255411 - DNA, 19 bp, Homo sapiens
tctctggcttgtctgcctg

SEQ ID NO: 8255412 - DNA, 19 bp, Homo sapiens
tctctggcttgtctgcctg

SEQ ID NO: 8255413 - DNA, 19 bp, Homo sapiens
tctctggcttgtctgcctg

SEQ ID NO: 8255414 - DNA, 22 bp, Homo sapiens
tctctgggatcaggtggcccag

SEQ ID NO: 8255415 - DNA, 22 bp, Homo sapiens
tctctgggaaatggagaatttt

SEQ ID NO: 8255416 - DNA, 21 bp, Homo sapiens
tctctgggccctcctgtgggg

SEQ ID NO: 8255417 - DNA, 21 bp, Homo sapiens
tctctgggccctcctgtgggg

SEQ ID NO: 8255418 - DNA, 22 bp, Homo sapiens
tctctgggcctcagttttctca

SEQ ID NO: 8255419 - DNA, 22 bp, Homo sapiens
tctctgggcccagaccttcctt

SEQ ID NO: 8255420 - DNA, 22 bp, Homo sapiens
tctctgggatcgttttgggctc

SEQ ID NO: 8255421 - DNA, 21 bp, Homo sapiens
tctctgggccctcctgtgggg

SEQ ID NO: 8255422 - DNA, 21 bp, Homo sapiens
tctctgggccctcctgtgggg

SEQ ID NO: 8255423 - DNA, 22 bp, Homo sapiens
tctctgggatcgttttgggctc

SEQ ID NO: 8255424 - DNA, 22 bp, Homo sapiens
tctctgggcccagaccttcctt

SEQ ID NO: 8255425 - DNA, 22 bp, Homo sapiens
tctctggggaaaaggctgatac

SEQ ID NO: 8255426 - DNA, 22 bp, Homo sapiens
tctctggggaaaaggctgatac

SEQ ID NO: 8255427 - DNA, 22 bp, Homo sapiens
tctctgggctcaggagcccggc

SEQ ID NO: 8255428 - DNA, 22 bp, Homo sapiens
tctctggggatgcttattcttg

SEQ ID NO: 8255429 - DNA, 22 bp, Homo sapiens
tctctggggatgcttattcttg

SEQ ID NO: 8255430 - DNA, 22 bp, Homo sapiens
tctctggggatgcttattcttg

SEQ ID NO: 8255431 - DNA, 19 bp, Homo sapiens
tctctggggacactttcac

SEQ ID NO: 8255432 - DNA, 19 bp, Homo sapiens
tctctggggacactttcac

SEQ ID NO: 8255433 - DNA, 19 bp, Homo sapiens
tctctggggacactttcac

SEQ ID NO: 8255434 - DNA, 22 bp, Homo sapiens
tctctgggctaaaatcaaggtg

SEQ ID NO: 8255435 - DNA, 22 bp, Homo sapiens
tctctgggctcaggagcccggc

SEQ ID NO: 8255436 - DNA, 22 bp, Homo sapiens
tctctgggcctgttttctcatc

SEQ ID NO: 8255437 - DNA, 22 bp, Homo sapiens
tctctgggctaaaatcaaggtg

SEQ ID NO: 8255438 - DNA, 22 bp, Homo sapiens
tctctgggctaaaatcaaggtg

SEQ ID NO: 8255439 - DNA, 22 bp, Homo sapiens
tctctgggcctgttttctcatc

SEQ ID NO: 8255440 - DNA, 22 bp, Homo sapiens
tctctgggctaaaatcaaggtg

SEQ ID NO: 8255441 - DNA, 22 bp, Homo sapiens
tctctgggcctccctttccaag

SEQ ID NO: 8255442 - DNA, 22 bp, Homo sapiens
tctctgggcctccctttccaag

SEQ ID NO: 8255443 - DNA, 22 bp, Homo sapiens
tctctgggcctccctttccaag

SEQ ID NO: 8255444 - DNA, 22 bp, Homo sapiens
tctctgggcctccctttccaag

SEQ ID NO: 8255445 - DNA, 22 bp, Homo sapiens
tctctgggcctccctttccaag

SEQ ID NO: 8255446 - DNA, 22 bp, Homo sapiens
tctctgggcctgttttctcatc

SEQ ID NO: 8255447 - DNA, 22 bp, Homo sapiens
tctctggggatggacctgggag

SEQ ID NO: 8255448 - DNA, 22 bp, Homo sapiens
tctctggggcctttctacatca

SEQ ID NO: 8255449 - DNA, 22 bp, Homo sapiens
tctctggggcctttctacatca

SEQ ID NO: 8255450 - DNA, 22 bp, Homo sapiens
tctctggggatggacctgggag

SEQ ID NO: 8255451 - DNA, 22 bp, Homo sapiens
tctctgggggtagaactcaggc

SEQ ID NO: 8255452 - DNA, 22 bp, Homo sapiens
tctctggggtagggcccaggac

SEQ ID NO: 8255453 - DNA, 22 bp, Homo sapiens
tctctgggggtagaactcaggc

SEQ ID NO: 8255454 - DNA, 22 bp, Homo sapiens
tctctggggcctttctacatca

SEQ ID NO: 8255455 - DNA, 22 bp, Homo sapiens
tctctgggggtagaactcaggc

SEQ ID NO: 8255456 - DNA, 22 bp, Homo sapiens
tctctgggggtagaactcaggc

SEQ ID NO: 8255457 - DNA, 22 bp, Homo sapiens
tctctgggggtagaactcaggc

SEQ ID NO: 8255458 - DNA, 22 bp, Homo sapiens
tctctgggtattcactgccttc

SEQ ID NO: 8255459 - DNA, 22 bp, Homo sapiens
tctctgggtatggtaacgttgg

SEQ ID NO: 8255460 - DNA, 22 bp, Homo sapiens
tctctgggtattcactgccttc

SEQ ID NO: 8255461 - DNA, 22 bp, Homo sapiens
tctctgggtcctggcaagctca

SEQ ID NO: 8255462 - DNA, 22 bp, Homo sapiens
tctctgggtattcactgccttc

SEQ ID NO: 8255463 - DNA, 22 bp, Homo sapiens
tctctggggtagggcccaggac

SEQ ID NO: 8255464 - DNA, 22 bp, Homo sapiens
tctctggggtagggcccaggac

SEQ ID NO: 8255465 - DNA, 22 bp, Homo sapiens
tctctgggtaaagttctctcat

SEQ ID NO: 8255466 - DNA, 22 bp, Homo sapiens
tctctgggtaaagttctctcat

SEQ ID NO: 8255467 - DNA, 22 bp, Homo sapiens
tctctgggtaaagttctctcat

SEQ ID NO: 8255468 - DNA, 22 bp, Homo sapiens
tctctgggttgagaactaggac

SEQ ID NO: 8255469 - DNA, 22 bp, Homo sapiens
tctctgggttctcactcagcac

SEQ ID NO: 8255470 - DNA, 22 bp, Homo sapiens
tctctgggttgagaactaggac

SEQ ID NO: 8255471 - DNA, 22 bp, Homo sapiens
tctctgggttgagaactaggac

SEQ ID NO: 8255472 - DNA, 22 bp, Homo sapiens
tctctgggttctcactcagcac

SEQ ID NO: 8255473 - DNA, 22 bp, Homo sapiens
tctctgggttctcactcagcac

SEQ ID NO: 8255474 - DNA, 20 bp, Homo sapiens
tctctgggttctcactcagc

SEQ ID NO: 8255475 - DNA, 20 bp, Homo sapiens
tctctgggttctcactcagc

SEQ ID NO: 8255476 - DNA, 20 bp, Homo sapiens
tctctgggttctcactcagc

SEQ ID NO: 8255477 - DNA, 23 bp, Homo sapiens
tctctgggtgggctgtgtctata

SEQ ID NO: 8255478 - DNA, 23 bp, Homo sapiens
tctctgggtgggctgtgtctata

SEQ ID NO: 8255479 - DNA, 22 bp, Homo sapiens
tctctgggtgatggcagggcac

SEQ ID NO: 8255480 - DNA, 22 bp, Homo sapiens
tctctgggtgatggcagggcac

SEQ ID NO: 8255481 - DNA, 22 bp, Homo sapiens
tctctgggtgatggcagggcac

SEQ ID NO: 8255482 - DNA, 22 bp, Homo sapiens
tctctgggtgatggcagggcac

SEQ ID NO: 8255483 - DNA, 22 bp, Homo sapiens
tctctgggtgatggcagggcac

SEQ ID NO: 8255484 - DNA, 22 bp, Homo sapiens
tctctgggtctcagtttgtaca

SEQ ID NO: 8255485 - DNA, 22 bp, Homo sapiens
tctctgggtcctggcaagctca

SEQ ID NO: 8255486 - DNA, 22 bp, Homo sapiens
tctctgggtcctggcaagctca

SEQ ID NO: 8255487 - DNA, 22 bp, Homo sapiens
tctctggaattggctgaggcaa

SEQ ID NO: 8255488 - DNA, 22 bp, Homo sapiens
tctctggaattggctgaggcaa

SEQ ID NO: 8255489 - DNA, 21 bp, Homo sapiens
tctctggaattagaccatgtt

SEQ ID NO: 8255490 - DNA, 22 bp, Homo sapiens
tctctgcttggtgtatgtgagt

SEQ ID NO: 8255491 - DNA, 23 bp, Homo sapiens
tctctggaactggagagtacggt

SEQ ID NO: 8255492 - DNA, 19 bp, Homo sapiens
tctctgcttctcttggcat

SEQ ID NO: 8255493 - DNA, 22 bp, Homo sapiens
tctctggagggctccaggcggg

SEQ ID NO: 8255494 - DNA, 22 bp, Homo sapiens
tctctggagtataaccagggat

SEQ ID NO: 8255495 - DNA, 22 bp, Homo sapiens
tctctggagggctccaggcggg

SEQ ID NO: 8255496 - DNA, 22 bp, Homo sapiens
tctctggagctgcagatccagg

SEQ ID NO: 8255497 - DNA, 22 bp, Homo sapiens
tctctggaattttgagagtgac

SEQ ID NO: 8255498 - DNA, 22 bp, Homo sapiens
tctctggacttccacctctatt

SEQ ID NO: 8255499 - DNA, 19 bp, Homo sapiens
tctctgccgatcagggccc

SEQ ID NO: 8255500 - DNA, 19 bp, Homo sapiens
tctctgccgatcagggccc

SEQ ID NO: 8255501 - DNA, 22 bp, Homo sapiens
tctctgagttctcctccagccc

SEQ ID NO: 8255502 - DNA, 22 bp, Homo sapiens
tctctgagttcctgtggatttt

SEQ ID NO: 8255503 - DNA, 22 bp, Homo sapiens
tctctgctcaggcaccagccct

SEQ ID NO: 8255504 - DNA, 22 bp, Homo sapiens
tctctgctcaggcaccagccct

SEQ ID NO: 8255505 - DNA, 22 bp, Homo sapiens
tctctgctctgtgcctcagttt

SEQ ID NO: 8255506 - DNA, 22 bp, Homo sapiens
tctctgctaagattgtgtctag

SEQ ID NO: 8255507 - DNA, 22 bp, Homo sapiens
tctctgctaagattgtgtctag

SEQ ID NO: 8255508 - DNA, 22 bp, Homo sapiens
tctctgctctgtgcctcagttt

SEQ ID NO: 8255509 - DNA, 22 bp, Homo sapiens
tctctgctctgtgcctcagttt

SEQ ID NO: 8255510 - DNA, 22 bp, Homo sapiens
tctctgctctgtgcctcagttt

SEQ ID NO: 8255511 - DNA, 22 bp, Homo sapiens
tctctgctctgtgcctcagttt

SEQ ID NO: 8255512 - DNA, 22 bp, Homo sapiens
tctctgctctgtgcctcagttt

SEQ ID NO: 8255513 - DNA, 19 bp, Homo sapiens
tctctgcttctcttggcat

SEQ ID NO: 8255514 - DNA, 19 bp, Homo sapiens
tctctgcttctcttggcat

SEQ ID NO: 8255515 - DNA, 20 bp, Homo sapiens
tctctgctgtccacatttgc

SEQ ID NO: 8255516 - DNA, 20 bp, Homo sapiens
tctctgctgtccacatttgc

SEQ ID NO: 8255517 - DNA, 22 bp, Homo sapiens
tctctgctgagaagggctggca

SEQ ID NO: 8255518 - DNA, 22 bp, Homo sapiens
tctctggcagactggctgggct

SEQ ID NO: 8255519 - DNA, 22 bp, Homo sapiens
tctctggcagactggctgggct

SEQ ID NO: 8255520 - DNA, 21 bp, Homo sapiens
tctctggagttagcagagaga

SEQ ID NO: 8255521 - DNA, 21 bp, Homo sapiens
tctctggagttagcagagaga

SEQ ID NO: 8255522 - DNA, 20 bp, Homo sapiens
tctctggcaagaagctgcag

SEQ ID NO: 8255523 - DNA, 19 bp, Homo sapiens
tctctggatgacagacact

SEQ ID NO: 8255524 - DNA, 20 bp, Homo sapiens
tctctggcaagaagctgcag

SEQ ID NO: 8255525 - DNA, 22 bp, Homo sapiens
tctctggcacataataaggtct

SEQ ID NO: 8255526 - DNA, 22 bp, Homo sapiens
tctctggctggcaccccaggga

SEQ ID NO: 8255527 - DNA, 22 bp, Homo sapiens
tctctggctgatattcctctgc

SEQ ID NO: 8255528 - DNA, 23 bp, Homo sapiens
tctctggcctttgatcaggttga

SEQ ID NO: 8255529 - DNA, 22 bp, Homo sapiens
tctctggccgagagtccctggg

SEQ ID NO: 8255530 - DNA, 20 bp, Homo sapiens
tctctggccagaaacaacag

SEQ ID NO: 8255531 - DNA, 22 bp, Homo sapiens
tctctggccccatggctgagct

SEQ ID NO: 8255532 - DNA, 22 bp, Homo sapiens
tctctggccccatggctgagct

SEQ ID NO: 8255533 - DNA, 22 bp, Homo sapiens
tctctggccccatggctgagct

SEQ ID NO: 8255534 - DNA, 22 bp, Homo sapiens
tctctggccccatggctgagct

SEQ ID NO: 8255535 - DNA, 19 bp, Homo sapiens
tctctggcatagactcaat

SEQ ID NO: 8255536 - DNA, 19 bp, Homo sapiens
tctctggcagttcagagca

SEQ ID NO: 8255537 - DNA, 22 bp, Homo sapiens
tctcttcacactacccctgtgt

SEQ ID NO: 8255538 - DNA, 22 bp, Homo sapiens
tctcttattttgcctttgacaa

SEQ ID NO: 8255539 - DNA, 22 bp, Homo sapiens
tctcttcacatgcttgctccaa

SEQ ID NO: 8255540 - DNA, 22 bp, Homo sapiens
tctcttcacatgcttgctccaa

SEQ ID NO: 8255541 - DNA, 22 bp, Homo sapiens
tctcttcacattcctggcaaac

SEQ ID NO: 8255542 - DNA, 22 bp, Homo sapiens
tctcttcacatgcttgctccaa

SEQ ID NO: 8255543 - DNA, 20 bp, Homo sapiens
tctcttcaggaggtccatgt

SEQ ID NO: 8255544 - DNA, 20 bp, Homo sapiens
tctcttcaggaggtccatgt

SEQ ID NO: 8255545 - DNA, 23 bp, Homo sapiens
tctctgtgtgcctcagtttcttc

SEQ ID NO: 8255546 - DNA, 23 bp, Homo sapiens
tctctgtgtgcctcagtttcttc

SEQ ID NO: 8255547 - DNA, 22 bp, Homo sapiens
tctcttaatccggtgctttctg

SEQ ID NO: 8255548 - DNA, 23 bp, Homo sapiens
tctctgtgtgcctcagtttcttc

SEQ ID NO: 8255549 - DNA, 23 bp, Homo sapiens
tctctgtgtgcctcagtttcttc

SEQ ID NO: 8255550 - DNA, 21 bp, Homo sapiens
tctctgtgtctttaagctgga

SEQ ID NO: 8255551 - DNA, 22 bp, Homo sapiens
tctctgtgtcttagtgaaggga

SEQ ID NO: 8255552 - DNA, 21 bp, Homo sapiens
tctctgtgtctttaagctgga

SEQ ID NO: 8255553 - DNA, 21 bp, Homo sapiens
tctcttcctccgcgccgccgc

SEQ ID NO: 8255554 - DNA, 22 bp, Homo sapiens
tctcttctaacactagaaattc

SEQ ID NO: 8255555 - DNA, 22 bp, Homo sapiens
tctcttctaacactagaaattc

SEQ ID NO: 8255556 - DNA, 22 bp, Homo sapiens
tctcttctaacactagaaattc

SEQ ID NO: 8255557 - DNA, 21 bp, Homo sapiens
tctcttcccatcaggacacta

SEQ ID NO: 8255558 - DNA, 22 bp, Homo sapiens
tctcttccctttatggtatgtg

SEQ ID NO: 8255559 - DNA, 22 bp, Homo sapiens
tctcttcccggataaagtaagt

SEQ ID NO: 8255560 - DNA, 22 bp, Homo sapiens
tctcttccatgtttcagcccca

SEQ ID NO: 8255561 - DNA, 22 bp, Homo sapiens
tctcttccatgtttcagcccca

SEQ ID NO: 8255562 - DNA, 19 bp, Homo sapiens
tctcttctccctggtttta

SEQ ID NO: 8255563 - DNA, 22 bp, Homo sapiens
tctcttctctagtgagcaactg

SEQ ID NO: 8255564 - DNA, 22 bp, Homo sapiens
tctcttctctagtgagcaactg

SEQ ID NO: 8255565 - DNA, 22 bp, Homo sapiens
tctcttctatttgagactattt

SEQ ID NO: 8255566 - DNA, 22 bp, Homo sapiens
tctcttctatttgagactattt

SEQ ID NO: 8255567 - DNA, 19 bp, Homo sapiens
tctcttctccctggtttta

SEQ ID NO: 8255568 - DNA, 22 bp, Homo sapiens
tctcttctatttgagactattt

SEQ ID NO: 8255569 - DNA, 22 bp, Homo sapiens
tctcttctatttgagactattt

SEQ ID NO: 8255570 - DNA, 22 bp, Homo sapiens
tctcttctatttgagactattt

SEQ ID NO: 8255571 - DNA, 22 bp, Homo sapiens
tctcttctatttgagactattt

SEQ ID NO: 8255572 - DNA, 22 bp, Homo sapiens
tctcttctaattttcccgagta

SEQ ID NO: 8255573 - DNA, 22 bp, Homo sapiens
tctcttctaattttcccgagta

SEQ ID NO: 8255574 - DNA, 22 bp, Homo sapiens
tctcttctaattttcccgagta

SEQ ID NO: 8255575 - DNA, 22 bp, Homo sapiens
tctcttctaattagggtccatg

SEQ ID NO: 8255576 - DNA, 22 bp, Homo sapiens
tctcttctaattagggtccatg

SEQ ID NO: 8255577 - DNA, 22 bp, Homo sapiens
tctcttctaattagggtccatg

SEQ ID NO: 8255578 - DNA, 22 bp, Homo sapiens
tctcttctaacactagaaattc

SEQ ID NO: 8255579 - DNA, 22 bp, Homo sapiens
tctcttctaacactagaaattc

SEQ ID NO: 8255580 - DNA, 22 bp, Homo sapiens
tctcttctatttgagactattt

SEQ ID NO: 8255581 - DNA, 22 bp, Homo sapiens
tctcttctagcttcttgtggtt

SEQ ID NO: 8255582 - DNA, 22 bp, Homo sapiens
tctcttctagcttcttgtggtt

SEQ ID NO: 8255583 - DNA, 22 bp, Homo sapiens
tctcttctagcttcttgtggtt

SEQ ID NO: 8255584 - DNA, 18 bp, Homo sapiens
tctcttcttggcagtcaa

SEQ ID NO: 8255585 - DNA, 22 bp, Homo sapiens
tctcttcttgattttcactgga

SEQ ID NO: 8255586 - DNA, 22 bp, Homo sapiens
tctcttcttgattttcactgga

SEQ ID NO: 8255587 - DNA, 18 bp, Homo sapiens
tctcttcttggcagtcaa

SEQ ID NO: 8255588 - DNA, 22 bp, Homo sapiens
tctcttcttgattttcactgga

SEQ ID NO: 8255589 - DNA, 22 bp, Homo sapiens
tctcttcttgattttcactgga

SEQ ID NO: 8255590 - DNA, 20 bp, Homo sapiens
tctcttctggggagataaaa

SEQ ID NO: 8255591 - DNA, 20 bp, Homo sapiens
tctcttctggggagataaaa

SEQ ID NO: 8255592 - DNA, 22 bp, Homo sapiens
tctcttctgacctagccttgga

SEQ ID NO: 8255593 - DNA, 22 bp, Homo sapiens
tctcttctgacctagccttgga

SEQ ID NO: 8255594 - DNA, 22 bp, Homo sapiens
tctcttctgacctagccttgga

SEQ ID NO: 8255595 - DNA, 22 bp, Homo sapiens
tctcttctgaaacctgtcttta

SEQ ID NO: 8255596 - DNA, 22 bp, Homo sapiens
tctcttctgaaacctgtcttta

SEQ ID NO: 8255597 - DNA, 22 bp, Homo sapiens
tctcttctgaaacctgtcttta

SEQ ID NO: 8255598 - DNA, 22 bp, Homo sapiens
tctcttctgaaacctgtcttta

SEQ ID NO: 8255599 - DNA, 22 bp, Homo sapiens
tctcttctgaaacctgtcttta

SEQ ID NO: 8255600 - DNA, 22 bp, Homo sapiens
tctctgtgagatgccttcctga

SEQ ID NO: 8255601 - DNA, 22 bp, Homo sapiens
tctctgtgagatgccttcctga

SEQ ID NO: 8255602 - DNA, 22 bp, Homo sapiens
tctctgtgagatgccttcctga

SEQ ID NO: 8255603 - DNA, 22 bp, Homo sapiens
tctctgtgagatgccttcctga

SEQ ID NO: 8255604 - DNA, 22 bp, Homo sapiens
tctctgtgacatttctgagcct

SEQ ID NO: 8255605 - DNA, 22 bp, Homo sapiens
tctctgtgacatttctgagcct

SEQ ID NO: 8255606 - DNA, 22 bp, Homo sapiens
tctctgtgacatttctgagcct

SEQ ID NO: 8255607 - DNA, 22 bp, Homo sapiens
tctctgtgactgcagctttgca

SEQ ID NO: 8255608 - DNA, 22 bp, Homo sapiens
tctctgtgactgcagctttgca

SEQ ID NO: 8255609 - DNA, 22 bp, Homo sapiens
tctctgtgaatggcgtcacctg

SEQ ID NO: 8255610 - DNA, 22 bp, Homo sapiens
tctctgtgaatggcgtcacctg

SEQ ID NO: 8255611 - DNA, 22 bp, Homo sapiens
tctctgtgaatggcgtcacctg

SEQ ID NO: 8255612 - DNA, 22 bp, Homo sapiens
tctctgtgaagctcccgttagg

SEQ ID NO: 8255613 - DNA, 22 bp, Homo sapiens
tctctgtgacagctgggtatgt

SEQ ID NO: 8255614 - DNA, 22 bp, Homo sapiens
tctctgtgacatttctgagcct

SEQ ID NO: 8255615 - DNA, 22 bp, Homo sapiens
tctctgtgagtggaaggcaccc

SEQ ID NO: 8255616 - DNA, 22 bp, Homo sapiens
tctctgtgagtggaaggcaccc

SEQ ID NO: 8255617 - DNA, 22 bp, Homo sapiens
tctctgtgcaggatgctgagtt

SEQ ID NO: 8255618 - DNA, 22 bp, Homo sapiens
tctctgtgagtggaaggcaccc

SEQ ID NO: 8255619 - DNA, 22 bp, Homo sapiens
tctctgtgagtggaaggcaccc

SEQ ID NO: 8255620 - DNA, 22 bp, Homo sapiens
tctctgtgcaggatgctgagtt

SEQ ID NO: 8255621 - DNA, 22 bp, Homo sapiens
tctctgtgcaggatgctgagtt

SEQ ID NO: 8255622 - DNA, 22 bp, Homo sapiens
tctctgtgcaggatgctgagtt

SEQ ID NO: 8255623 - DNA, 22 bp, Homo sapiens
tctctgtgagccaggtcctagt

SEQ ID NO: 8255624 - DNA, 22 bp, Homo sapiens
tctctgtgagccaggtcctagt

SEQ ID NO: 8255625 - DNA, 22 bp, Homo sapiens
tctctgtgagccaggtcctagt

SEQ ID NO: 8255626 - DNA, 22 bp, Homo sapiens
tctctgtgagatttgtattaag

SEQ ID NO: 8255627 - DNA, 22 bp, Homo sapiens
tctctgtgagatttgtattaag

SEQ ID NO: 8255628 - DNA, 22 bp, Homo sapiens
tctctgtgagatttgtattaag

SEQ ID NO: 8255629 - DNA, 22 bp, Homo sapiens
tctctgtgagatttgtattaag

SEQ ID NO: 8255630 - DNA, 22 bp, Homo sapiens
tctctgtctcccgtgtgtccgg

SEQ ID NO: 8255631 - DNA, 22 bp, Homo sapiens
tctctgtctcccgtgtgtccgg

SEQ ID NO: 8255632 - DNA, 22 bp, Homo sapiens
tctctgtctcccgtgtgtccgg

SEQ ID NO: 8255633 - DNA, 22 bp, Homo sapiens
tctctgtccctaggagccttgc

SEQ ID NO: 8255634 - DNA, 22 bp, Homo sapiens
tctctgtctgagcctggcagac

SEQ ID NO: 8255635 - DNA, 22 bp, Homo sapiens
tctctgtctgcacccaatcaat

SEQ ID NO: 8255636 - DNA, 22 bp, Homo sapiens
tctctgtctttgttgtcttcac

SEQ ID NO: 8255637 - DNA, 22 bp, Homo sapiens
tctctgtctttgttgtcttcac

SEQ ID NO: 8255638 - DNA, 22 bp, Homo sapiens
tctctgtctgagcctggcagac

SEQ ID NO: 8255639 - DNA, 22 bp, Homo sapiens
tctctgtcacacaatctacaca

SEQ ID NO: 8255640 - DNA, 22 bp, Homo sapiens
tctctggttatgtcattaagca

SEQ ID NO: 8255641 - DNA, 22 bp, Homo sapiens
tctctggttattaactaactcc

SEQ ID NO: 8255642 - DNA, 21 bp, Homo sapiens
tctctggttctgaaatggttt

SEQ ID NO: 8255643 - DNA, 21 bp, Homo sapiens
tctctggttctgaaatggttt

SEQ ID NO: 8255644 - DNA, 22 bp, Homo sapiens
tctctggtggctccatcagtag

SEQ ID NO: 8255645 - DNA, 22 bp, Homo sapiens
tctctggttatgtcattaagca

SEQ ID NO: 8255646 - DNA, 22 bp, Homo sapiens
tctctgggtttttgtcctgtac

SEQ ID NO: 8255647 - DNA, 22 bp, Homo sapiens
tctctgggtttttgtcctgtac

SEQ ID NO: 8255648 - DNA, 16 bp, Homo sapiens
tctctgggttgcacag

SEQ ID NO: 8255649 - DNA, 22 bp, Homo sapiens
tctctgggtttttgtcctgtac

SEQ ID NO: 8255650 - DNA, 22 bp, Homo sapiens
tctctgggtttttgtcctgtac

SEQ ID NO: 8255651 - DNA, 22 bp, Homo sapiens
tctctgtgtctcatgttcctat

SEQ ID NO: 8255652 - DNA, 22 bp, Homo sapiens
tctctgtgtctcatgttcctat

SEQ ID NO: 8255653 - DNA, 22 bp, Homo sapiens
tctctgtgtctcatgttcctat

SEQ ID NO: 8255654 - DNA, 22 bp, Homo sapiens
tctctgtgtcttagtgaaggga

SEQ ID NO: 8255655 - DNA, 22 bp, Homo sapiens
tctctgtgtcttagtgaaggga

SEQ ID NO: 8255656 - DNA, 19 bp, Homo sapiens
tctctgtgtctctgtttat

SEQ ID NO: 8255657 - DNA, 19 bp, Homo sapiens
tctctgtgtctctgtttat

SEQ ID NO: 8255658 - DNA, 22 bp, Homo sapiens
tctctgtggtttgagagccggg

SEQ ID NO: 8255659 - DNA, 22 bp, Homo sapiens
tctctgtggtttgagagccggg

SEQ ID NO: 8255660 - DNA, 21 bp, Homo sapiens
tctctgtgtacagtctcaccc

SEQ ID NO: 8255661 - DNA, 21 bp, Homo sapiens
tctctgtgtacagtctcaccc

SEQ ID NO: 8255662 - DNA, 21 bp, Homo sapiens
tctctgtgtacagtctcaccc

SEQ ID NO: 8255663 - DNA, 22 bp, Homo sapiens
tctctgtgtcctgaaatgaagg

SEQ ID NO: 8255664 - DNA, 22 bp, Homo sapiens
tctctgtggtgggaggctgagt

SEQ ID NO: 8255665 - DNA, 21 bp, Homo sapiens
tctctgtggtccaatcccagc

SEQ ID NO: 8255666 - DNA, 21 bp, Homo sapiens
tctctgtggtccaatcccagc

SEQ ID NO: 8255667 - DNA, 22 bp, Homo sapiens
tctctgtggtgggaggctgagt

SEQ ID NO: 8255668 - DNA, 22 bp, Homo sapiens
tctctgtggtatgtcatagcaa

SEQ ID NO: 8255669 - DNA, 22 bp, Homo sapiens
tctctgtggtatgtcatagcaa

SEQ ID NO: 8255670 - DNA, 22 bp, Homo sapiens
tctctgtggtatgtcatagcaa

SEQ ID NO: 8255671 - DNA, 22 bp, Homo sapiens
tctctgtggtatgtcatagcaa

SEQ ID NO: 8255672 - DNA, 21 bp, Homo sapiens
tctctgtggtccaatcccagc

SEQ ID NO: 8255673 - DNA, 22 bp, Homo sapiens
tctctgtggtatgtcatagcaa

SEQ ID NO: 8255674 - DNA, 22 bp, Homo sapiens
tctctgtgggtttcaccagcgc

SEQ ID NO: 8255675 - DNA, 22 bp, Homo sapiens
tctctgtgggtttcaccagcgc

SEQ ID NO: 8255676 - DNA, 22 bp, Homo sapiens
tctctgtgggtttcaccagcgc

SEQ ID NO: 8255677 - DNA, 22 bp, Homo sapiens
tctctgtgggtttcaccagcgc

SEQ ID NO: 8255678 - DNA, 22 bp, Homo sapiens
tctctgtggtactgagagtcta

SEQ ID NO: 8255679 - DNA, 22 bp, Homo sapiens
tctctgtggtactgagagtcta

SEQ ID NO: 8255680 - DNA, 22 bp, Homo sapiens
tctctgtggtatgtcatagcaa

SEQ ID NO: 8255681 - DNA, 22 bp, Homo sapiens
tctctgtgcttgactttcccat

SEQ ID NO: 8255682 - DNA, 22 bp, Homo sapiens
tctctgtgcttgactttcccat

SEQ ID NO: 8255683 - DNA, 22 bp, Homo sapiens
tctctgtgcccagtagttctct

SEQ ID NO: 8255684 - DNA, 22 bp, Homo sapiens
tctctgtgcccagtagttctct

SEQ ID NO: 8255685 - DNA, 22 bp, Homo sapiens
tctctgtggagcagtgtgttca

SEQ ID NO: 8255686 - DNA, 22 bp, Homo sapiens
tctctgtggagcagtgtgttca

SEQ ID NO: 8255687 - DNA, 22 bp, Homo sapiens
tctctgtggagcagtgtgttca

SEQ ID NO: 8255688 - DNA, 22 bp, Homo sapiens
tctctgtggcaacaattcacta

SEQ ID NO: 8255689 - DNA, 22 bp, Homo sapiens
tctctgtggcaacaattcacta

SEQ ID NO: 8255690 - DNA, 22 bp, Homo sapiens
tctctgtggcaactacttagct

SEQ ID NO: 8255691 - DNA, 22 bp, Homo sapiens
tctctgtgggctttggacttga

SEQ ID NO: 8255692 - DNA, 22 bp, Homo sapiens
tctctgtgggctttggacttga

SEQ ID NO: 8255693 - DNA, 22 bp, Homo sapiens
tctctgtgggctttggacttga

SEQ ID NO: 8255694 - DNA, 21 bp, Homo sapiens
tctctgtggcctaccctctac

SEQ ID NO: 8255695 - DNA, 21 bp, Homo sapiens
tctctgtggcctaccctctac

SEQ ID NO: 8255696 - DNA, 22 bp, Homo sapiens
tctctgtggcatccactcaact

SEQ ID NO: 8255697 - DNA, 22 bp, Homo sapiens
tctctgtggcatccactcaact

SEQ ID NO: 8255698 - DNA, 22 bp, Homo sapiens
tctctgtggcatccactcaact

SEQ ID NO: 8255699 - DNA, 22 bp, Homo sapiens
tctctgtggcatccactcaact

SEQ ID NO: 8255700 - DNA, 21 bp, Homo sapiens
tctctgtggcctaccctctac

SEQ ID NO: 8255701 - DNA, 22 bp, Homo sapiens
tctctgtggcaagcatgctgct

SEQ ID NO: 8255702 - DNA, 22 bp, Homo sapiens
tctctgtggcaagcatgctgct

SEQ ID NO: 8255703 - DNA, 22 bp, Homo sapiens
tctctgtggcaactacttagct

SEQ ID NO: 8255704 - DNA, 22 bp, Homo sapiens
tctctgtggcaactacttagct

SEQ ID NO: 8255705 - DNA, 22 bp, Homo sapiens
tctctgtggcaagcatgctgct

SEQ ID NO: 8255706 - DNA, 22 bp, Homo sapiens
tctctgtggcaagcatgctgct

SEQ ID NO: 8255707 - DNA, 22 bp, Homo sapiens
tctctgtggcaagcatgctgct

SEQ ID NO: 8255708 - DNA, 22 bp, Homo sapiens
tctgaaagctagaaaatgctct

SEQ ID NO: 8255709 - DNA, 22 bp, Homo sapiens
tctgaaagtctgaaacagtgtc

SEQ ID NO: 8255710 - DNA, 22 bp, Homo sapiens
tctgaaagtatctggatctttt

SEQ ID NO: 8255711 - DNA, 22 bp, Homo sapiens
tctgaaagatgagtggtccatt

SEQ ID NO: 8255712 - DNA, 18 bp, Homo sapiens
tctgaaagcaccggtgaa

SEQ ID NO: 8255713 - DNA, 22 bp, Homo sapiens
tctgaaagccctagtttgtaat

SEQ ID NO: 8255714 - DNA, 22 bp, Homo sapiens
tctgaaagccctagtttgtaat

SEQ ID NO: 8255715 - DNA, 22 bp, Homo sapiens
tctgaaagccctagtttgtaat

SEQ ID NO: 8255716 - DNA, 22 bp, Homo sapiens
tctgaaagccctagtttgtaat

SEQ ID NO: 8255717 - DNA, 22 bp, Homo sapiens
tctgaaataactgatgccagat

SEQ ID NO: 8255718 - DNA, 22 bp, Homo sapiens
tctgaaataaatgcactgttag

SEQ ID NO: 8255719 - DNA, 22 bp, Homo sapiens
tctgaaataaatgcactgttag

SEQ ID NO: 8255720 - DNA, 22 bp, Homo sapiens
tctgaaataaatgcactgttag

SEQ ID NO: 8255721 - DNA, 22 bp, Homo sapiens
tctgaaataaatgcactgttag

SEQ ID NO: 8255722 - DNA, 22 bp, Homo sapiens
tctgaaatactgcaggttctct

SEQ ID NO: 8255723 - DNA, 22 bp, Homo sapiens
tctgaaatagaagtgtctttct

SEQ ID NO: 8255724 - DNA, 22 bp, Homo sapiens
tctgaaatactgcaggttctct

SEQ ID NO: 8255725 - DNA, 22 bp, Homo sapiens
tctgaaatactgcaggttctct

SEQ ID NO: 8255726 - DNA, 22 bp, Homo sapiens
tctgaaataagggagaagggaa

SEQ ID NO: 8255727 - DNA, 22 bp, Homo sapiens
tctgaaaatgttgactttgttt

SEQ ID NO: 8255728 - DNA, 22 bp, Homo sapiens
tctgaaaactccatgagctcgt

SEQ ID NO: 8255729 - DNA, 22 bp, Homo sapiens
tctgaaagagagtacatacagt

SEQ ID NO: 8255730 - DNA, 22 bp, Homo sapiens
tctgaaagaaagattttgtttc

SEQ ID NO: 8255731 - DNA, 22 bp, Homo sapiens
tctgaaagaaagattttgtttc

SEQ ID NO: 8255732 - DNA, 20 bp, Homo sapiens
tctcttttagcttacagctg

SEQ ID NO: 8255733 - DNA, 22 bp, Homo sapiens
tctcttttatgtacaccctgac

SEQ ID NO: 8255734 - DNA, 18 bp, Homo sapiens
tctcttttcccctcattg

SEQ ID NO: 8255735 - DNA, 22 bp, Homo sapiens
tctctttgtctgctcttagttg

SEQ ID NO: 8255736 - DNA, 22 bp, Homo sapiens
tctctttgtggccaggagagga

SEQ ID NO: 8255737 - DNA, 22 bp, Homo sapiens
tctctttgtctgctcttagttg

SEQ ID NO: 8255738 - DNA, 21 bp, Homo sapiens
tctctttctggaagcttccct

SEQ ID NO: 8255739 - DNA, 22 bp, Homo sapiens
tctctttctcagatggtggaga

SEQ ID NO: 8255740 - DNA, 22 bp, Homo sapiens
tctctttctcaaaatgtaagca

SEQ ID NO: 8255741 - DNA, 21 bp, Homo sapiens
tctctttctggaagcttccct

SEQ ID NO: 8255742 - DNA, 21 bp, Homo sapiens
tctctttctggaagcttccct

SEQ ID NO: 8255743 - DNA, 22 bp, Homo sapiens
tctctttgaccctttagctcca

SEQ ID NO: 8255744 - DNA, 22 bp, Homo sapiens
tctctttgaccctttagctcca

SEQ ID NO: 8255745 - DNA, 22 bp, Homo sapiens
tctctttctttgtatgtctatt

SEQ ID NO: 8255746 - DNA, 19 bp, Homo sapiens
tctctttcatggggctagt

SEQ ID NO: 8255747 - DNA, 17 bp, Homo sapiens
tctctttccctttctgc

SEQ ID NO: 8255748 - DNA, 17 bp, Homo sapiens
tctctttccctttctgc

SEQ ID NO: 8255749 - DNA, 17 bp, Homo sapiens
tctctttccctttctgc

SEQ ID NO: 8255750 - DNA, 22 bp, Homo sapiens
tctctttctatatgtgagtctt

SEQ ID NO: 8255751 - DNA, 18 bp, Homo sapiens
tctctttcctcagtggag

SEQ ID NO: 8255752 - DNA, 18 bp, Homo sapiens
tctctttcctcagtggag

SEQ ID NO: 8255753 - DNA, 22 bp, Homo sapiens
tctctttctattgcaccatgct

SEQ ID NO: 8255754 - DNA, 22 bp, Homo sapiens
tctctttctattgcaccatgct

SEQ ID NO: 8255755 - DNA, 22 bp, Homo sapiens
tctctttagtgcttagacgtct

SEQ ID NO: 8255756 - DNA, 23 bp, Homo sapiens
tctctttcaagagcttaatgtgc

SEQ ID NO: 8255757 - DNA, 22 bp, Homo sapiens
tctctttagtgcttagacgtct

SEQ ID NO: 8255758 - DNA, 22 bp, Homo sapiens
tctctttactttcaccaatttg

SEQ ID NO: 8255759 - DNA, 22 bp, Homo sapiens
tctctttactttcaccaatttg

SEQ ID NO: 8255760 - DNA, 22 bp, Homo sapiens
tctctttaagtataatcttata

SEQ ID NO: 8255761 - DNA, 22 bp, Homo sapiens
tctctttactttcaccaatttg

SEQ ID NO: 8255762 - DNA, 22 bp, Homo sapiens
tctctttaagtataatcttata

SEQ ID NO: 8255763 - DNA, 22 bp, Homo sapiens
tctctttaagtataatcttata

SEQ ID NO: 8255764 - DNA, 22 bp, Homo sapiens
tctctttaaagactcagagatt

SEQ ID NO: 8255765 - DNA, 22 bp, Homo sapiens
tctcttcttgtgttttcctgcc

SEQ ID NO: 8255766 - DNA, 22 bp, Homo sapiens
tctcttcttgtgttttcctgcc

SEQ ID NO: 8255767 - DNA, 22 bp, Homo sapiens
tctcttcttgtgttttcctgcc

SEQ ID NO: 8255768 - DNA, 17 bp, Homo sapiens
tctcttgttcactgctg

SEQ ID NO: 8255769 - DNA, 22 bp, Homo sapiens
tctcttctttggggtgggctca

SEQ ID NO: 8255770 - DNA, 22 bp, Homo sapiens
tctcttcttgtgttttcctgcc

SEQ ID NO: 8255771 - DNA, 22 bp, Homo sapiens
tctcttctttggggtgggctca

SEQ ID NO: 8255772 - DNA, 22 bp, Homo sapiens
tctctttaaaaatagtgaaata

SEQ ID NO: 8255773 - DNA, 22 bp, Homo sapiens
tctctttaaaaatagtgaaata

SEQ ID NO: 8255774 - DNA, 22 bp, Homo sapiens
tctctttaaagactcagagatt

SEQ ID NO: 8255775 - DNA, 22 bp, Homo sapiens
tctctttaaaaatagtgaaata

SEQ ID NO: 8255776 - DNA, 22 bp, Homo sapiens
tctcttctttggggtgggctca

SEQ ID NO: 8255777 - DNA, 22 bp, Homo sapiens
tctgaaatgcaaatttgactga

SEQ ID NO: 8255778 - DNA, 22 bp, Homo sapiens
tctgaaatgcaaatttgactga

SEQ ID NO: 8255779 - DNA, 22 bp, Homo sapiens
tctgaaatgcaggcaatttgct

SEQ ID NO: 8255780 - DNA, 22 bp, Homo sapiens
tctgaaatggcagcgggaatga

SEQ ID NO: 8255781 - DNA, 22 bp, Homo sapiens
tctgaaatggggctgaagcact

SEQ ID NO: 8255782 - DNA, 22 bp, Homo sapiens
tctgaaatggcgatggccgttg

SEQ ID NO: 8255783 - DNA, 22 bp, Homo sapiens
tctgaaatgttctcttgttttg

SEQ ID NO: 8255784 - DNA, 22 bp, Homo sapiens
tctgaaatgttctcttgttttg

SEQ ID NO: 8255785 - DNA, 22 bp, Homo sapiens
tctgaaattcacagttgagtca

SEQ ID NO: 8255786 - DNA, 22 bp, Homo sapiens
tctgaaattttagttatagaaa

SEQ ID NO: 8255787 - DNA, 22 bp, Homo sapiens
tctgaaattgttagtaaaaatg

SEQ ID NO: 8255788 - DNA, 22 bp, Homo sapiens
tctgaaattccttccagacttt

SEQ ID NO: 8255789 - DNA, 22 bp, Homo sapiens
tctgaacagaaaagatgcacaa

SEQ ID NO: 8255790 - DNA, 22 bp, Homo sapiens
tctgaacagaaaagatgcacaa

SEQ ID NO: 8255791 - DNA, 22 bp, Homo sapiens
tctgaacatgatgtcatctgga

SEQ ID NO: 8255792 - DNA, 22 bp, Homo sapiens
tctgaacatcctacaacatttt

SEQ ID NO: 8255793 - DNA, 22 bp, Homo sapiens
tctgaacatcctacaacatttt

SEQ ID NO: 8255794 - DNA, 22 bp, Homo sapiens
tctgaaattttagttatagaaa

SEQ ID NO: 8255795 - DNA, 22 bp, Homo sapiens
tctgaaattttagttatagaaa

SEQ ID NO: 8255796 - DNA, 20 bp, Homo sapiens
tctgaacaaaatgtaatgtc

SEQ ID NO: 8255797 - DNA, 22 bp, Homo sapiens
tctgaagaataggatgttgtgt

SEQ ID NO: 8255798 - DNA, 22 bp, Homo sapiens
tctgaagaactgtctagagaac

SEQ ID NO: 8255799 - DNA, 22 bp, Homo sapiens
tctgaagaaatacagctggggt

SEQ ID NO: 8255800 - DNA, 20 bp, Homo sapiens
tctgaagaaagacagggact

SEQ ID NO: 8255801 - DNA, 22 bp, Homo sapiens
tctgaaggtctgagaaccagga

SEQ ID NO: 8255802 - DNA, 22 bp, Homo sapiens
tctgaagggctgagtggaggag

SEQ ID NO: 8255803 - DNA, 22 bp, Homo sapiens
tctgaaggtgctagagaaagct

SEQ ID NO: 8255804 - DNA, 22 bp, Homo sapiens
tctgaaggtgctagagaaagct

SEQ ID NO: 8255805 - DNA, 22 bp, Homo sapiens
tctgaaggtctgagaaccagga

SEQ ID NO: 8255806 - DNA, 22 bp, Homo sapiens
tctgaaggtctgagaaccagga

SEQ ID NO: 8255807 - DNA, 21 bp, Homo sapiens
tctgaaggcattttccaaggt

SEQ ID NO: 8255808 - DNA, 17 bp, Homo sapiens
tctgaagccagtctgct

SEQ ID NO: 8255809 - DNA, 22 bp, Homo sapiens
tctgaagagtcttgcaagaaag

SEQ ID NO: 8255810 - DNA, 22 bp, Homo sapiens
tctgaagagtcatctttgggtg

SEQ ID NO: 8255811 - DNA, 22 bp, Homo sapiens
tctgaagagtcttgcaagaaag

SEQ ID NO: 8255812 - DNA, 19 bp, Homo sapiens
tctgaagaattagagagca

SEQ ID NO: 8255813 - DNA, 22 bp, Homo sapiens
tctgaagacatatgatatggtg

SEQ ID NO: 8255814 - DNA, 22 bp, Homo sapiens
tctgaagattaccagctaaatg

SEQ ID NO: 8255815 - DNA, 22 bp, Homo sapiens
tctgaagattctttccactatt

SEQ ID NO: 8255816 - DNA, 22 bp, Homo sapiens
tctgaagagtcttgcaagaaag

SEQ ID NO: 8255817 - DNA, 22 bp, Homo sapiens
tctcataaggtcagatttcaca

SEQ ID NO: 8255818 - DNA, 22 bp, Homo sapiens
tctcataattaggtaagtcaga

SEQ ID NO: 8255819 - DNA, 22 bp, Homo sapiens
tctcatacatgtttgcagaaag

SEQ ID NO: 8255820 - DNA, 22 bp, Homo sapiens
tctcatacgtttccaggtgtca

SEQ ID NO: 8255821 - DNA, 22 bp, Homo sapiens
tctcagtggacgtgtctgtctt

SEQ ID NO: 8255822 - DNA, 22 bp, Homo sapiens
tctcagtttctcattataaaag

SEQ ID NO: 8255823 - DNA, 19 bp, Homo sapiens
tctcatccagcattcaaga

SEQ ID NO: 8255824 - DNA, 22 bp, Homo sapiens
tctcatcacttaacatctgctt

SEQ ID NO: 8255825 - DNA, 22 bp, Homo sapiens
tctcatcacttaacatctgctt

SEQ ID NO: 8255826 - DNA, 22 bp, Homo sapiens
tctcatctcaaattgtaatccc

SEQ ID NO: 8255827 - DNA, 22 bp, Homo sapiens
tctcatctagactctgcccttg

SEQ ID NO: 8255828 - DNA, 22 bp, Homo sapiens
tctcatctagactctgcccttg

SEQ ID NO: 8255829 - DNA, 22 bp, Homo sapiens
tctcatggagtcaggagcagaa

SEQ ID NO: 8255830 - DNA, 22 bp, Homo sapiens
tctcatgatgcctatgcagggt

SEQ ID NO: 8255831 - DNA, 22 bp, Homo sapiens
tctcatcttgttcatctaccct

SEQ ID NO: 8255832 - DNA, 22 bp, Homo sapiens
tctcatcttgttcatctaccct

SEQ ID NO: 8255833 - DNA, 22 bp, Homo sapiens
tctcatcttcattgtctcccat

SEQ ID NO: 8255834 - DNA, 22 bp, Homo sapiens
tctcatctgccatttgcaggag

SEQ ID NO: 8255835 - DNA, 22 bp, Homo sapiens
tctcatctcggatcagaagtga

SEQ ID NO: 8255836 - DNA, 22 bp, Homo sapiens
tctcatctcggatcagaagtga

SEQ ID NO: 8255837 - DNA, 21 bp, Homo sapiens
tctcatctcctgacctgtgcc

SEQ ID NO: 8255838 - DNA, 22 bp, Homo sapiens
tctcatctgcgagctctgccag

SEQ ID NO: 8255839 - DNA, 22 bp, Homo sapiens
tctcatctgcgagctctgccag

SEQ ID NO: 8255840 - DNA, 22 bp, Homo sapiens
tctcatctgcgagctctgccag

SEQ ID NO: 8255841 - DNA, 22 bp, Homo sapiens
tctcaggtttcaagacaggaaa

SEQ ID NO: 8255842 - DNA, 22 bp, Homo sapiens
tctcaggtggcccccatgagtg

SEQ ID NO: 8255843 - DNA, 22 bp, Homo sapiens
tctcaggtctcatgccaggcct

SEQ ID NO: 8255844 - DNA, 22 bp, Homo sapiens
tctcaggtctcatgccaggcct

SEQ ID NO: 8255845 - DNA, 22 bp, Homo sapiens
tctcaggtctcatgccaggcct

SEQ ID NO: 8255846 - DNA, 20 bp, Homo sapiens
tctcagggttcagcaaagta

SEQ ID NO: 8255847 - DNA, 17 bp, Homo sapiens
tctcaggggctagccct

SEQ ID NO: 8255848 - DNA, 22 bp, Homo sapiens
tctcagggctcagagctcaggc

SEQ ID NO: 8255849 - DNA, 22 bp, Homo sapiens
tctcagggctcagagctcaggc

SEQ ID NO: 8255850 - DNA, 22 bp, Homo sapiens
tctcagggcgcagtgaggcagt

SEQ ID NO: 8255851 - DNA, 22 bp, Homo sapiens
tctcagtgcagcttgacagaga

SEQ ID NO: 8255852 - DNA, 22 bp, Homo sapiens
tctcagtgcagcaaggaattta

SEQ ID NO: 8255853 - DNA, 22 bp, Homo sapiens
tctcagtgcagcttgacagaga

SEQ ID NO: 8255854 - DNA, 22 bp, Homo sapiens
tctcagtgatggcccatttgga

SEQ ID NO: 8255855 - DNA, 22 bp, Homo sapiens
tctcagtgactgctgggtcccc

SEQ ID NO: 8255856 - DNA, 23 bp, Homo sapiens
tctcagtgaatctcagaattcgc

SEQ ID NO: 8255857 - DNA, 17 bp, Homo sapiens
tctcagtgactgatagc

SEQ ID NO: 8255858 - DNA, 23 bp, Homo sapiens
tctcagtaaatgttagtttaatc

SEQ ID NO: 8255859 - DNA, 19 bp, Homo sapiens
tctcagtagactgtatgtt

SEQ ID NO: 8255860 - DNA, 22 bp, Homo sapiens
tctcagtaattaatgttatgga

SEQ ID NO: 8255861 - DNA, 22 bp, Homo sapiens
tctcagtcagccttgatgtccc

SEQ ID NO: 8255862 - DNA, 22 bp, Homo sapiens
tctcattcataccctacatgct

SEQ ID NO: 8255863 - DNA, 22 bp, Homo sapiens
tctcattcttcagtggctttgt

SEQ ID NO: 8255864 - DNA, 22 bp, Homo sapiens
tctcattcatccaaggatttat

SEQ ID NO: 8255865 - DNA, 22 bp, Homo sapiens
tctcattcatccaaggatttat

SEQ ID NO: 8255866 - DNA, 22 bp, Homo sapiens
tctcatttacttccacaggctg

SEQ ID NO: 8255867 - DNA, 22 bp, Homo sapiens
tctcatgtgattcccgtgcatg

SEQ ID NO: 8255868 - DNA, 22 bp, Homo sapiens
tctcatgttttacctgtcctca

SEQ ID NO: 8255869 - DNA, 22 bp, Homo sapiens
tctcatgtgaagaaagaatttc

SEQ ID NO: 8255870 - DNA, 22 bp, Homo sapiens
tctcatgtattgccctggtgtg

SEQ ID NO: 8255871 - DNA, 22 bp, Homo sapiens
tctcatggtttgtgattcaaat

SEQ ID NO: 8255872 - DNA, 22 bp, Homo sapiens
tctcatggcttgtaggaggtga

SEQ ID NO: 8255873 - DNA, 20 bp, Homo sapiens
tctcattatatccaagaggc

SEQ ID NO: 8255874 - DNA, 22 bp, Homo sapiens
tctcattaaaacattttaatta

SEQ ID NO: 8255875 - DNA, 22 bp, Homo sapiens
tctcatgttttacctgtcctca

SEQ ID NO: 8255876 - DNA, 22 bp, Homo sapiens
tctcatttgcctcatctataaa

SEQ ID NO: 8255877 - DNA, 22 bp, Homo sapiens
tctcatttgcctcatctataaa

SEQ ID NO: 8255878 - DNA, 23 bp, Homo sapiens
tctcatttcccttgatctatctt

SEQ ID NO: 8255879 - DNA, 23 bp, Homo sapiens
tctcatttcccttgatctatctt

SEQ ID NO: 8255880 - DNA, 22 bp, Homo sapiens
tctcatttgtgtgcaattcaga

SEQ ID NO: 8255881 - DNA, 22 bp, Homo sapiens
tctcattttgagtcagacacta

SEQ ID NO: 8255882 - DNA, 19 bp, Homo sapiens
tctccaggcaggtgagcga

SEQ ID NO: 8255883 - DNA, 23 bp, Homo sapiens
tctccaggccttactccaggcct

SEQ ID NO: 8255884 - DNA, 22 bp, Homo sapiens
tctccaggcacttggctgctac

SEQ ID NO: 8255885 - DNA, 22 bp, Homo sapiens
tctccaggcacttggctgctac

SEQ ID NO: 8255886 - DNA, 19 bp, Homo sapiens
tctccaggcaggtgagcga

SEQ ID NO: 8255887 - DNA, 19 bp, Homo sapiens
tctccaggcaggtgagcga

SEQ ID NO: 8255888 - DNA, 19 bp, Homo sapiens
tctccaggcaggtgagcga

SEQ ID NO: 8255889 - DNA, 22 bp, Homo sapiens
tctccaggagcaagtcacccag

SEQ ID NO: 8255890 - DNA, 22 bp, Homo sapiens
tctccaggagcaagtcacccag

SEQ ID NO: 8255891 - DNA, 22 bp, Homo sapiens
tctccaggagcaagtcacccag

SEQ ID NO: 8255892 - DNA, 22 bp, Homo sapiens
tctccaggagcaagtcacccag

SEQ ID NO: 8255893 - DNA, 22 bp, Homo sapiens
tctccaggagcaagtcacccag

SEQ ID NO: 8255894 - DNA, 22 bp, Homo sapiens
tctccaggcactacctgggtaa

SEQ ID NO: 8255895 - DNA, 22 bp, Homo sapiens
tctccaggcactacctgggtaa

SEQ ID NO: 8255896 - DNA, 22 bp, Homo sapiens
tctccaggcacttggctgctac

SEQ ID NO: 8255897 - DNA, 22 bp, Homo sapiens
tctccaagcagggctgcaaggc

SEQ ID NO: 8255898 - DNA, 22 bp, Homo sapiens
tctccaaggagctcctgtgccg

SEQ ID NO: 8255899 - DNA, 22 bp, Homo sapiens
tctccaagaaaagatctcagct

SEQ ID NO: 8255900 - DNA, 22 bp, Homo sapiens
tctccaggaagccctccctgac

SEQ ID NO: 8255901 - DNA, 22 bp, Homo sapiens
tctccaaggagctcctgtgccg

SEQ ID NO: 8255902 - DNA, 17 bp, Homo sapiens
tctccaggacgagctca

SEQ ID NO: 8255903 - DNA, 22 bp, Homo sapiens
tctccaggactgagctccagcc

SEQ ID NO: 8255904 - DNA, 22 bp, Homo sapiens
tctccaggactgagctccagcc

SEQ ID NO: 8255905 - DNA, 22 bp, Homo sapiens
tctccaggactgagctccagcc

SEQ ID NO: 8255906 - DNA, 22 bp, Homo sapiens
tctcagcaaggaaagaggcagg

SEQ ID NO: 8255907 - DNA, 22 bp, Homo sapiens
tctcagcaacgatccggagtaa

SEQ ID NO: 8255908 - DNA, 23 bp, Homo sapiens
tctcagattcagagatccctaaa

SEQ ID NO: 8255909 - DNA, 22 bp, Homo sapiens
tctcagatgcccttgcatcacc

SEQ ID NO: 8255910 - DNA, 22 bp, Homo sapiens
tctcagcagggccatcctgagc

SEQ ID NO: 8255911 - DNA, 20 bp, Homo sapiens
tctcagcataagaacccttc

SEQ ID NO: 8255912 - DNA, 20 bp, Homo sapiens
tctcagcataagaacccttc

SEQ ID NO: 8255913 - DNA, 22 bp, Homo sapiens
tctcagcagccagatccagagc

SEQ ID NO: 8255914 - DNA, 22 bp, Homo sapiens
tctcagcacgttgttttcattg

SEQ ID NO: 8255915 - DNA, 22 bp, Homo sapiens
tctcagcacgttgttttcattg

SEQ ID NO: 8255916 - DNA, 22 bp, Homo sapiens
tctcagagtttagagctgagcc

SEQ ID NO: 8255917 - DNA, 22 bp, Homo sapiens
tctcagagtttgaatctggagt

SEQ ID NO: 8255918 - DNA, 22 bp, Homo sapiens
tctcagagtttttttccaggac

SEQ ID NO: 8255919 - DNA, 22 bp, Homo sapiens
tctcagagtttagagctgagcc

SEQ ID NO: 8255920 - DNA, 22 bp, Homo sapiens
tctcagagtttacggggctgaa

SEQ ID NO: 8255921 - DNA, 22 bp, Homo sapiens
tctcagagtttagagctgagcc

SEQ ID NO: 8255922 - DNA, 22 bp, Homo sapiens
tctcagagggaggattactgcc

SEQ ID NO: 8255923 - DNA, 22 bp, Homo sapiens
tctcagagggaaaggccaattt

SEQ ID NO: 8255924 - DNA, 22 bp, Homo sapiens
tctcagaggtcttcagcctctg

SEQ ID NO: 8255925 - DNA, 22 bp, Homo sapiens
tctcagaggcccgacgttctcc

SEQ ID NO: 8255926 - DNA, 22 bp, Homo sapiens
tctcagagggaaacatgagtga

SEQ ID NO: 8255927 - DNA, 22 bp, Homo sapiens
tctcagagggaaacatgagtga

SEQ ID NO: 8255928 - DNA, 22 bp, Homo sapiens
tctcagagggaaacatgagtga

SEQ ID NO: 8255929 - DNA, 22 bp, Homo sapiens
tctcagaggtgccctggcatct

SEQ ID NO: 8255930 - DNA, 22 bp, Homo sapiens
tctcagagtaattctttaaggt

SEQ ID NO: 8255931 - DNA, 22 bp, Homo sapiens
tctcagagtgacaatgagaatt

SEQ ID NO: 8255932 - DNA, 22 bp, Homo sapiens
tctcagagtgacaatgagaatt

SEQ ID NO: 8255933 - DNA, 22 bp, Homo sapiens
tctcagagttcctctggagtcc

SEQ ID NO: 8255934 - DNA, 22 bp, Homo sapiens
tctcagagtggtggtccctctg

SEQ ID NO: 8255935 - DNA, 22 bp, Homo sapiens
tctcagcctcacctctatggag

SEQ ID NO: 8255936 - DNA, 22 bp, Homo sapiens
tctcagctcatggcagccttga

SEQ ID NO: 8255937 - DNA, 22 bp, Homo sapiens
tctcagctcagcttccacagag

SEQ ID NO: 8255938 - DNA, 22 bp, Homo sapiens
tctcagctgcctgccctgctcc

SEQ ID NO: 8255939 - DNA, 22 bp, Homo sapiens
tctcagctgcctgccctgctcc

SEQ ID NO: 8255940 - DNA, 22 bp, Homo sapiens
tctcagctgactgctttcctcg

SEQ ID NO: 8255941 - DNA, 22 bp, Homo sapiens
tctcagctcttttttcacagaa

SEQ ID NO: 8255942 - DNA, 22 bp, Homo sapiens
tctcagctgactgctttcctcg

SEQ ID NO: 8255943 - DNA, 20 bp, Homo sapiens
tctcaggccccctccttgct

SEQ ID NO: 8255944 - DNA, 20 bp, Homo sapiens
tctcaggccccctccttgct

SEQ ID NO: 8255945 - DNA, 22 bp, Homo sapiens
tctcaggcccctgagtttctct

SEQ ID NO: 8255946 - DNA, 21 bp, Homo sapiens
tctcaggcgagaattctttta

SEQ ID NO: 8255947 - DNA, 22 bp, Homo sapiens
tctcaggctaccttgcacaagg

SEQ ID NO: 8255948 - DNA, 22 bp, Homo sapiens
tctcaggctcctgacatatatg

SEQ ID NO: 8255949 - DNA, 22 bp, Homo sapiens
tctcaggctagtaaaagatggg

SEQ ID NO: 8255950 - DNA, 22 bp, Homo sapiens
tctcagggccccaaaggctagt

SEQ ID NO: 8255951 - DNA, 22 bp, Homo sapiens
tctcagggcagcaaggaagcat

SEQ ID NO: 8255952 - DNA, 22 bp, Homo sapiens
tctcagggcagcaaggaagcat

SEQ ID NO: 8255953 - DNA, 22 bp, Homo sapiens
tctcagggcagcaaggaagcat

SEQ ID NO: 8255954 - DNA, 22 bp, Homo sapiens
tctcagggcgcagtgaggcagt

SEQ ID NO: 8255955 - DNA, 22 bp, Homo sapiens
tctcagggagttgaggctgcct

SEQ ID NO: 8255956 - DNA, 22 bp, Homo sapiens
tctcagggagagctgctggcat

SEQ ID NO: 8255957 - DNA, 22 bp, Homo sapiens
tctcaggcttcctggtgctgtg

SEQ ID NO: 8255958 - DNA, 22 bp, Homo sapiens
tctcagggagggcgagtcagcg

SEQ ID NO: 8255959 - DNA, 22 bp, Homo sapiens
tctcaggcttcctggtgctgtg

SEQ ID NO: 8255960 - DNA, 22 bp, Homo sapiens
tctcaggctgtgtgtggaggac

SEQ ID NO: 8255961 - DNA, 19 bp, Homo sapiens
tctcaggctgggcggctgc

SEQ ID NO: 8255962 - DNA, 19 bp, Homo sapiens
tctcaggctgggcggctgc

SEQ ID NO: 8255963 - DNA, 22 bp, Homo sapiens
tctcaggctgacattgggactc

SEQ ID NO: 8255964 - DNA, 22 bp, Homo sapiens
tctcaggctcttggaacctgtt

SEQ ID NO: 8255965 - DNA, 22 bp, Homo sapiens
tctcagagaggggccgggcctt

SEQ ID NO: 8255966 - DNA, 22 bp, Homo sapiens
tctcagagatctttctgcatgt

SEQ ID NO: 8255967 - DNA, 22 bp, Homo sapiens
tctcagagatgtcaagagtcta

SEQ ID NO: 8255968 - DNA, 22 bp, Homo sapiens
tctcagagatgttagggaagag

SEQ ID NO: 8255969 - DNA, 22 bp, Homo sapiens
tctcagagagctgtgttttcct

SEQ ID NO: 8255970 - DNA, 22 bp, Homo sapiens
tctcagagagatgaaacttcca

SEQ ID NO: 8255971 - DNA, 22 bp, Homo sapiens
tctcagagagatgaaacttcca

SEQ ID NO: 8255972 - DNA, 22 bp, Homo sapiens
tctcagaactttatatgtatca

SEQ ID NO: 8255973 - DNA, 22 bp, Homo sapiens
tctcagaaggcaagggctgggg

SEQ ID NO: 8255974 - DNA, 22 bp, Homo sapiens
tctcagaacacccttctatggt

SEQ ID NO: 8255975 - DNA, 22 bp, Homo sapiens
tctcagaacctcagtttgctct

SEQ ID NO: 8255976 - DNA, 23 bp, Homo sapiens
tctcagaaaggagaagtaatttg

SEQ ID NO: 8255977 - DNA, 23 bp, Homo sapiens
tctcagaaaggagaagtaatttg

SEQ ID NO: 8255978 - DNA, 22 bp, Homo sapiens
tctcagaaatactatgttgtca

SEQ ID NO: 8255979 - DNA, 22 bp, Homo sapiens
tctcagaaatgacaggaggtac

SEQ ID NO: 8255980 - DNA, 22 bp, Homo sapiens
tctcagagattcagggagaagt

SEQ ID NO: 8255981 - DNA, 22 bp, Homo sapiens
tctcagagattttgtttccctt

SEQ ID NO: 8255982 - DNA, 22 bp, Homo sapiens
tctcagagatttatggaaaact

SEQ ID NO: 8255983 - DNA, 22 bp, Homo sapiens
tctcagagcatcattttcttag

SEQ ID NO: 8255984 - DNA, 19 bp, Homo sapiens
tctcagagccctagaggcc

SEQ ID NO: 8255985 - DNA, 19 bp, Homo sapiens
tctcagagccctagaggcc

SEQ ID NO: 8255986 - DNA, 22 bp, Homo sapiens
tctcagagctcacacctcctgg

SEQ ID NO: 8255987 - DNA, 22 bp, Homo sapiens
tctcagagcctaactaacctaa

SEQ ID NO: 8255988 - DNA, 22 bp, Homo sapiens
tctcagagcttcagaaagcacc

SEQ ID NO: 8255989 - DNA, 22 bp, Homo sapiens
tctcagagcttcagttattttc

SEQ ID NO: 8255990 - DNA, 23 bp, Homo sapiens
tctcagaggattcctgggccttg

SEQ ID NO: 8255991 - DNA, 18 bp, Homo sapiens
tctcagaggccatcctag

SEQ ID NO: 8255992 - DNA, 19 bp, Homo sapiens
tctcagaggaaaaattgct

SEQ ID NO: 8255993 - DNA, 19 bp, Homo sapiens
tctcacagtttccttgcct

SEQ ID NO: 8255994 - DNA, 22 bp, Homo sapiens
tctcacagtgcaggtctgtctc

SEQ ID NO: 8255995 - DNA, 22 bp, Homo sapiens
tctcacagtatgaattgttcac

SEQ ID NO: 8255996 - DNA, 22 bp, Homo sapiens
tctcacagtgagcctgaggtcg

SEQ ID NO: 8255997 - DNA, 22 bp, Homo sapiens
tctcacagtgagcctgaggtcg

SEQ ID NO: 8255998 - DNA, 22 bp, Homo sapiens
tctcacccaacgtgcaatgagt

SEQ ID NO: 8255999 - DNA, 22 bp, Homo sapiens
tctcaccatggtgcttgcttat

SEQ ID NO: 8256000 - DNA, 19 bp, Homo sapiens
tctcacagtttccttgcct

SEQ ID NO: 8256001 - DNA, 22 bp, Homo sapiens
tctcactgggtataaatgagta

SEQ ID NO: 8256002 - DNA, 22 bp, Homo sapiens
tctcactgggtcacagcagagg

SEQ ID NO: 8256003 - DNA, 22 bp, Homo sapiens
tctcactgggtcacagcagagg

SEQ ID NO: 8256004 - DNA, 22 bp, Homo sapiens
tctcactgggtcacagcagagg

SEQ ID NO: 8256005 - DNA, 21 bp, Homo sapiens
tctcactgtctgctttgttta

SEQ ID NO: 8256006 - DNA, 22 bp, Homo sapiens
tctcactttgttgcccagactt

SEQ ID NO: 8256007 - DNA, 22 bp, Homo sapiens
tctcagaaaaactttgagggta

SEQ ID NO: 8256008 - DNA, 22 bp, Homo sapiens
tctcagaaaaaggagaaactgg

SEQ ID NO: 8256009 - DNA, 22 bp, Homo sapiens
tctcagaaaaaggagaaactgg

SEQ ID NO: 8256010 - DNA, 22 bp, Homo sapiens
tctcagaaaagagcttcagaaa

SEQ ID NO: 8256011 - DNA, 22 bp, Homo sapiens
tctcagaaaagagcttcagaaa

SEQ ID NO: 8256012 - DNA, 22 bp, Homo sapiens
tctcactgcaaatattatgtat

SEQ ID NO: 8256013 - DNA, 22 bp, Homo sapiens
tctcactgatttgagaccaagg

SEQ ID NO: 8256014 - DNA, 22 bp, Homo sapiens
tctcactgatttgagaccaagg

SEQ ID NO: 8256015 - DNA, 22 bp, Homo sapiens
tctcactgatttgagaccaagg

SEQ ID NO: 8256016 - DNA, 22 bp, Homo sapiens
tctcactcatttcctaggtctt

SEQ ID NO: 8256017 - DNA, 22 bp, Homo sapiens
tctcactcatttcctaggtctt

SEQ ID NO: 8256018 - DNA, 22 bp, Homo sapiens
tctcactgggtcacagcagagg

SEQ ID NO: 8256019 - DNA, 22 bp, Homo sapiens
tctcactgggtataaatgagta

SEQ ID NO: 8256020 - DNA, 22 bp, Homo sapiens
tctcactgggtataaatgagta

SEQ ID NO: 8256021 - DNA, 22 bp, Homo sapiens
tctcactgggtataaatgagta

SEQ ID NO: 8256022 - DNA, 22 bp, Homo sapiens
tctcactgggtataaatgagta

SEQ ID NO: 8256023 - DNA, 22 bp, Homo sapiens
tctcactgcaaatattatgtat

SEQ ID NO: 8256024 - DNA, 22 bp, Homo sapiens
tctccaggtagatatgtcagga

SEQ ID NO: 8256025 - DNA, 22 bp, Homo sapiens
tctccaggtgaaacttgcaggg

SEQ ID NO: 8256026 - DNA, 22 bp, Homo sapiens
tctccaggtgaaacttgcaggg

SEQ ID NO: 8256027 - DNA, 22 bp, Homo sapiens
tctccaggtgaaacttgcaggg

SEQ ID NO: 8256028 - DNA, 22 bp, Homo sapiens
tctccaggtgactctgatgtat

SEQ ID NO: 8256029 - DNA, 19 bp, Homo sapiens
tctccaggtgccccaaaca

SEQ ID NO: 8256030 - DNA, 22 bp, Homo sapiens
tctccaggtgctaagtgtgcct

SEQ ID NO: 8256031 - DNA, 22 bp, Homo sapiens
tctccaggtgctaagtgtgcct

SEQ ID NO: 8256032 - DNA, 22 bp, Homo sapiens
tctccaggtggcttgggcttct

SEQ ID NO: 8256033 - DNA, 22 bp, Homo sapiens
tctcccagaggatcccagtgga

SEQ ID NO: 8256034 - DNA, 22 bp, Homo sapiens
tctcccagaggatcccagtgga

SEQ ID NO: 8256035 - DNA, 22 bp, Homo sapiens
tctcccagaagtcctcagtaca

SEQ ID NO: 8256036 - DNA, 22 bp, Homo sapiens
tctcccactggccttgtatgat

SEQ ID NO: 8256037 - DNA, 22 bp, Homo sapiens
tctcccagaagtcctcagtaca

SEQ ID NO: 8256038 - DNA, 21 bp, Homo sapiens
tctccagtatccttctctgag

SEQ ID NO: 8256039 - DNA, 22 bp, Homo sapiens
tctccaggtggggtcacctttt

SEQ ID NO: 8256040 - DNA, 22 bp, Homo sapiens
tctccaggtggggtcacctttt

SEQ ID NO: 8256041 - DNA, 22 bp, Homo sapiens
tctccaggttcagtcgatggaa

SEQ ID NO: 8256042 - DNA, 22 bp, Homo sapiens
tctccaggtggggtcacctttt

SEQ ID NO: 8256043 - DNA, 22 bp, Homo sapiens
tctccaggtggggtcacctttt

SEQ ID NO: 8256044 - DNA, 22 bp, Homo sapiens
tctccaggcttaatctcagctt

SEQ ID NO: 8256045 - DNA, 22 bp, Homo sapiens
tctccaggcttaatctcagctt

SEQ ID NO: 8256046 - DNA, 22 bp, Homo sapiens
tctccaggcttaatctcagctt

SEQ ID NO: 8256047 - DNA, 22 bp, Homo sapiens
tctccaggcctttcccatctta

SEQ ID NO: 8256048 - DNA, 22 bp, Homo sapiens
tctccaggcctttcccatctta

SEQ ID NO: 8256049 - DNA, 22 bp, Homo sapiens
tctccaggcctttcccatctta

SEQ ID NO: 8256050 - DNA, 22 bp, Homo sapiens
tctccagggactgaggctggag

SEQ ID NO: 8256051 - DNA, 22 bp, Homo sapiens
tctccagggaggtagcccagtg

SEQ ID NO: 8256052 - DNA, 22 bp, Homo sapiens
tctccaggctttttgtgaattg

SEQ ID NO: 8256053 - DNA, 22 bp, Homo sapiens
tctccagggacatgtttctgga

SEQ ID NO: 8256054 - DNA, 22 bp, Homo sapiens
tctccagggaggtagcccagtg

SEQ ID NO: 8256055 - DNA, 22 bp, Homo sapiens
tctccagggcagagaatagcaa

SEQ ID NO: 8256056 - DNA, 22 bp, Homo sapiens
tctccaggggcagggtctggag

SEQ ID NO: 8256057 - DNA, 22 bp, Homo sapiens
tctccaggggctgctgtgccac

SEQ ID NO: 8256058 - DNA, 22 bp, Homo sapiens
tctccagggcccccgagcgttg

SEQ ID NO: 8256059 - DNA, 22 bp, Homo sapiens
tctccaggtaaatggcatcctg

SEQ ID NO: 8256060 - DNA, 22 bp, Homo sapiens
tctccaggtaaatggcatcctg

SEQ ID NO: 8256061 - DNA, 22 bp, Homo sapiens
tctccaggggctgctgtgccac

SEQ ID NO: 8256062 - DNA, 22 bp, Homo sapiens
tctccaggggctgctgtgccac

SEQ ID NO: 8256063 - DNA, 22 bp, Homo sapiens
tctccaggggctgctgtgccac

SEQ ID NO: 8256064 - DNA, 22 bp, Homo sapiens
tctccagggtgagctaggccag

SEQ ID NO: 8256065 - DNA, 22 bp, Homo sapiens
tctccagggtgagctaggccag

SEQ ID NO: 8256066 - DNA, 20 bp, Homo sapiens
tctcccaggctcagggaaga

SEQ ID NO: 8256067 - DNA, 22 bp, Homo sapiens
tctcccaggctgccctgtggac

SEQ ID NO: 8256068 - DNA, 20 bp, Homo sapiens
tctcccaggctcagggaaga

SEQ ID NO: 8256069 - DNA, 22 bp, Homo sapiens
tctcccaggcaggagtgcagtg

SEQ ID NO: 8256070 - DNA, 19 bp, Homo sapiens
tctcccagctgagaagggc

SEQ ID NO: 8256071 - DNA, 19 bp, Homo sapiens
tctcccagctgagaagggc

SEQ ID NO: 8256072 - DNA, 22 bp, Homo sapiens
tctcccaggcaggagtgcagtg

SEQ ID NO: 8256073 - DNA, 19 bp, Homo sapiens
tctcccagctgagaagggc

SEQ ID NO: 8256074 - DNA, 22 bp, Homo sapiens
tctcccagaggatcccagtgga

SEQ ID NO: 8256075 - DNA, 22 bp, Homo sapiens
tctcccagtggtgcagaaagca

SEQ ID NO: 8256076 - DNA, 22 bp, Homo sapiens
tctcccagtggtgcagaaagca

SEQ ID NO: 8256077 - DNA, 22 bp, Homo sapiens
tctcccagtggtgcagaaagca

SEQ ID NO: 8256078 - DNA, 22 bp, Homo sapiens
tctcccaggtgggtgcctggag

SEQ ID NO: 8256079 - DNA, 22 bp, Homo sapiens
tctcccaggtgggtgcctggag

SEQ ID NO: 8256080 - DNA, 22 bp, Homo sapiens
tctcccaggtgggtgcctggag

SEQ ID NO: 8256081 - DNA, 22 bp, Homo sapiens
tctcccaggtgggtgcctggag

SEQ ID NO: 8256082 - DNA, 22 bp, Homo sapiens
tctcccaggctggagtgcagtg

SEQ ID NO: 8256083 - DNA, 22 bp, Homo sapiens
tctcccaggctggagtgcagtg

SEQ ID NO: 8256084 - DNA, 22 bp, Homo sapiens
tctcccaggtcatacacagaga

SEQ ID NO: 8256085 - DNA, 22 bp, Homo sapiens
tctcccaggtcatacacagaga

SEQ ID NO: 8256086 - DNA, 22 bp, Homo sapiens
tctcccaggtgggtgcctggag

SEQ ID NO: 8256087 - DNA, 22 bp, Homo sapiens
tctcccaggtgggtgcctggag

SEQ ID NO: 8256088 - DNA, 22 bp, Homo sapiens
tctccccaaccatggcactcac

SEQ ID NO: 8256089 - DNA, 22 bp, Homo sapiens
tctccccaaccatggcactcac

SEQ ID NO: 8256090 - DNA, 22 bp, Homo sapiens
tctccccaaccatggcactcac

SEQ ID NO: 8256091 - DNA, 22 bp, Homo sapiens
tctccccaaaggactcactctc

SEQ ID NO: 8256092 - DNA, 22 bp, Homo sapiens
tctccccaaaggactcactctc

SEQ ID NO: 8256093 - DNA, 22 bp, Homo sapiens
tctccccaaaggactcactctc

SEQ ID NO: 8256094 - DNA, 22 bp, Homo sapiens
tctccccagctgagctgccctt

SEQ ID NO: 8256095 - DNA, 22 bp, Homo sapiens
tctccccagctgagctgccctt

SEQ ID NO: 8256096 - DNA, 22 bp, Homo sapiens
tctccccaggggtatgggtatt

SEQ ID NO: 8256097 - DNA, 22 bp, Homo sapiens
tctccccagctgagctgccctt

SEQ ID NO: 8256098 - DNA, 22 bp, Homo sapiens
tctccccagctgagctgccctt

SEQ ID NO: 8256099 - DNA, 22 bp, Homo sapiens
tctccccagctgagctgccctt

SEQ ID NO: 8256100 - DNA, 22 bp, Homo sapiens
tctccccagaccctggacataa

SEQ ID NO: 8256101 - DNA, 22 bp, Homo sapiens
tctccccagaccctggacataa

SEQ ID NO: 8256102 - DNA, 22 bp, Homo sapiens
tctccccagaccctggacataa

SEQ ID NO: 8256103 - DNA, 22 bp, Homo sapiens
tctccccaaaggactcactctc

SEQ ID NO: 8256104 - DNA, 19 bp, Homo sapiens
tctcccatgcctgtgtcta

SEQ ID NO: 8256105 - DNA, 19 bp, Homo sapiens
tctcccatgcctgtgtcta

SEQ ID NO: 8256106 - DNA, 22 bp, Homo sapiens
tctcccatgaggctgcggtcaa

SEQ ID NO: 8256107 - DNA, 22 bp, Homo sapiens
tctcccagtgtctggcagtcag

SEQ ID NO: 8256108 - DNA, 22 bp, Homo sapiens
tctcccagtgtctggcagtcag

SEQ ID NO: 8256109 - DNA, 22 bp, Homo sapiens
tctccctcattcctgcttccat

SEQ ID NO: 8256110 - DNA, 23 bp, Homo sapiens
tctccctcatgcctaggcctggg

SEQ ID NO: 8256111 - DNA, 22 bp, Homo sapiens
tctccctcattcctgcttccat

SEQ ID NO: 8256112 - DNA, 22 bp, Homo sapiens
tctccctcattcctgcttccat

SEQ ID NO: 8256113 - DNA, 22 bp, Homo sapiens
tctcctaaggctgaatatctct

SEQ ID NO: 8256114 - DNA, 23 bp, Homo sapiens
tctccctcatgcctaggcctggg

SEQ ID NO: 8256115 - DNA, 23 bp, Homo sapiens
tctccctcatgcctaggcctggg

SEQ ID NO: 8256116 - DNA, 19 bp, Homo sapiens
tctcccggcactcctgccc

SEQ ID NO: 8256117 - DNA, 19 bp, Homo sapiens
tctcccggcactcctgccc

SEQ ID NO: 8256118 - DNA, 22 bp, Homo sapiens
tctcccggctaagagcttcccg

SEQ ID NO: 8256119 - DNA, 18 bp, Homo sapiens
tctcccggtcaccttcac

SEQ ID NO: 8256120 - DNA, 21 bp, Homo sapiens
tctccccattcttattcccat

SEQ ID NO: 8256121 - DNA, 22 bp, Homo sapiens
tctccccagtatggattctctg

SEQ ID NO: 8256122 - DNA, 22 bp, Homo sapiens
tctccccagtatggattctctg

SEQ ID NO: 8256123 - DNA, 22 bp, Homo sapiens
tctccccaggggtatgggtatt

SEQ ID NO: 8256124 - DNA, 22 bp, Homo sapiens
tctccccaggggtatgggtatt

SEQ ID NO: 8256125 - DNA, 22 bp, Homo sapiens
tctccttgctacccagtatgtc

SEQ ID NO: 8256126 - DNA, 22 bp, Homo sapiens
tctccttgctacccagtatgtc

SEQ ID NO: 8256127 - DNA, 22 bp, Homo sapiens
tctccttgacaggcaggcagac

SEQ ID NO: 8256128 - DNA, 22 bp, Homo sapiens
tctccttgacaggcaggcagac

SEQ ID NO: 8256129 - DNA, 22 bp, Homo sapiens
tctccttcgaggcccagctccc

SEQ ID NO: 8256130 - DNA, 22 bp, Homo sapiens
tctcctttcttttaaaatgtca

SEQ ID NO: 8256131 - DNA, 22 bp, Homo sapiens
tctcgacagcctggcacagtgg

SEQ ID NO: 8256132 - DNA, 22 bp, Homo sapiens
tctcgatctcctgaccttgtga

SEQ ID NO: 8256133 - DNA, 22 bp, Homo sapiens
tctcgatctcctgaccttgtga

SEQ ID NO: 8256134 - DNA, 22 bp, Homo sapiens
tctcgctctgtcgcccaggctg

SEQ ID NO: 8256135 - DNA, 22 bp, Homo sapiens
tctctaaaattcccggccaact

SEQ ID NO: 8256136 - DNA, 22 bp, Homo sapiens
tctctaaacttatatgaactat

SEQ ID NO: 8256137 - DNA, 22 bp, Homo sapiens
tctctaaacttatatgaactat

SEQ ID NO: 8256138 - DNA, 21 bp, Homo sapiens
tctctaaaaagattctatttg

SEQ ID NO: 8256139 - DNA, 21 bp, Homo sapiens
tctctaaaaagattctatttg

SEQ ID NO: 8256140 - DNA, 21 bp, Homo sapiens
tctcgttgtatggtcttgggg

SEQ ID NO: 8256141 - DNA, 22 bp, Homo sapiens
tctcgtgcaggccttgctcgga

SEQ ID NO: 8256142 - DNA, 22 bp, Homo sapiens
tctcgtgcaggccttgctcgga

SEQ ID NO: 8256143 - DNA, 22 bp, Homo sapiens
tctctaaagatatttatggcaa

SEQ ID NO: 8256144 - DNA, 22 bp, Homo sapiens
tctctagtattaagctccattt

SEQ ID NO: 8256145 - DNA, 22 bp, Homo sapiens
tctctaaagaagcctccctaaa

SEQ ID NO: 8256146 - DNA, 22 bp, Homo sapiens
tctctaaagatagctgcctcga

SEQ ID NO: 8256147 - DNA, 22 bp, Homo sapiens
tctctagtctcctttaacctga

SEQ ID NO: 8256148 - DNA, 22 bp, Homo sapiens
tctctagtctcctttaacctga

SEQ ID NO: 8256149 - DNA, 22 bp, Homo sapiens
tctcgctctgtcgcccaggctg

SEQ ID NO: 8256150 - DNA, 22 bp, Homo sapiens
tctcgctctgtcgcccaggctg

SEQ ID NO: 8256151 - DNA, 22 bp, Homo sapiens
tctcgctctgtcgcccaggctg

SEQ ID NO: 8256152 - DNA, 22 bp, Homo sapiens
tctcgctctgtcgcccaggctg

SEQ ID NO: 8256153 - DNA, 22 bp, Homo sapiens
tctcgctctgtcgcccaggctg

SEQ ID NO: 8256154 - DNA, 22 bp, Homo sapiens
tctcgctctgtcgcccaggctg

SEQ ID NO: 8256155 - DNA, 22 bp, Homo sapiens
tctcggtggcatttggcacagt

SEQ ID NO: 8256156 - DNA, 16 bp, Homo sapiens
tctcggtgtgtagagt

SEQ ID NO: 8256157 - DNA, 22 bp, Homo sapiens
tctcgctctgtcgcccaggctg

SEQ ID NO: 8256158 - DNA, 22 bp, Homo sapiens
tctcgctctgtcgcccaggctg

SEQ ID NO: 8256159 - DNA, 23 bp, Homo sapiens
tctcctgtcctaattaccacccc

SEQ ID NO: 8256160 - DNA, 22 bp, Homo sapiens
tctcctgtatgggactggcgag

SEQ ID NO: 8256161 - DNA, 22 bp, Homo sapiens
tctcctgtatgggactggcgag

SEQ ID NO: 8256162 - DNA, 22 bp, Homo sapiens
tctcctgtgcaccctccctgtg

SEQ ID NO: 8256163 - DNA, 22 bp, Homo sapiens
tctcctgtcttctcagcacccc

SEQ ID NO: 8256164 - DNA, 18 bp, Homo sapiens
tctccttccaaatcttca

SEQ ID NO: 8256165 - DNA, 22 bp, Homo sapiens
tctcctgtgcaccctccctgtg

SEQ ID NO: 8256166 - DNA, 22 bp, Homo sapiens
tctccttccaacaaaaggtcac

SEQ ID NO: 8256167 - DNA, 18 bp, Homo sapiens
tctccttccaaatcttca

SEQ ID NO: 8256168 - DNA, 22 bp, Homo sapiens
tctccttcgaggcccagctccc

SEQ ID NO: 8256169 - DNA, 22 bp, Homo sapiens
tctccttccaacaaaaggtcac

SEQ ID NO: 8256170 - DNA, 20 bp, Homo sapiens
tctcctggtgacagtaccca

SEQ ID NO: 8256171 - DNA, 22 bp, Homo sapiens
tctcctggtttgttaaataatt

SEQ ID NO: 8256172 - DNA, 22 bp, Homo sapiens
tctcctggtcacctcagaagtc

SEQ ID NO: 8256173 - DNA, 22 bp, Homo sapiens
tctcctggtcacctcagaagtc

SEQ ID NO: 8256174 - DNA, 20 bp, Homo sapiens
tctcctggtctggtccgtgc

SEQ ID NO: 8256175 - DNA, 22 bp, Homo sapiens
tctcctggtcacctcagaagtc

SEQ ID NO: 8256176 - DNA, 20 bp, Homo sapiens
tctcctggtctggtccgtgc

SEQ ID NO: 8256177 - DNA, 22 bp, Homo sapiens
tctcctggtacccttcctagca

SEQ ID NO: 8256178 - DNA, 22 bp, Homo sapiens
tctcctggtacccttcctagca

SEQ ID NO: 8256179 - DNA, 22 bp, Homo sapiens
tctcctggtacccttcctagca

SEQ ID NO: 8256180 - DNA, 22 bp, Homo sapiens
tctcctgggtgctttatcagaa

SEQ ID NO: 8256181 - DNA, 22 bp, Homo sapiens
tctcctggtatgtatgcacctg

SEQ ID NO: 8256182 - DNA, 22 bp, Homo sapiens
tctcctggtatgtatgcacctg

SEQ ID NO: 8256183 - DNA, 22 bp, Homo sapiens
tctcctggtacccttcctagca

SEQ ID NO: 8256184 - DNA, 22 bp, Homo sapiens
tctcctggtacccttcctagca

SEQ ID NO: 8256185 - DNA, 22 bp, Homo sapiens
tctcctggtacccttcctagca

SEQ ID NO: 8256186 - DNA, 22 bp, Homo sapiens
tctcctgggtaaaagggttgat

SEQ ID NO: 8256187 - DNA, 18 bp, Homo sapiens
tctcctgggtaggggcct

SEQ ID NO: 8256188 - DNA, 21 bp, Homo sapiens
tctcctgggtccaacccatgc

SEQ ID NO: 8256189 - DNA, 18 bp, Homo sapiens
tctcctgggtaggggcct

SEQ ID NO: 8256190 - DNA, 22 bp, Homo sapiens
tctcctgggtaaaagggttgat

SEQ ID NO: 8256191 - DNA, 22 bp, Homo sapiens
tctcctgggtaaaagggttgat

SEQ ID NO: 8256192 - DNA, 22 bp, Homo sapiens
tctcctggccctgtcgccatct

SEQ ID NO: 8256193 - DNA, 22 bp, Homo sapiens
tctcctgggcttggttgaagtt

SEQ ID NO: 8256194 - DNA, 23 bp, Homo sapiens
tctcctcctagatacagtcatgg

SEQ ID NO: 8256195 - DNA, 23 bp, Homo sapiens
tctcctcctagatacagtcatgg

SEQ ID NO: 8256196 - DNA, 23 bp, Homo sapiens
tctcctcctagatacagtcatgg

SEQ ID NO: 8256197 - DNA, 22 bp, Homo sapiens
tctcctccttttttcaacatag

SEQ ID NO: 8256198 - DNA, 22 bp, Homo sapiens
tctcctctactgggtctgcaga

SEQ ID NO: 8256199 - DNA, 22 bp, Homo sapiens
tctcctctactgggtctgcaga

SEQ ID NO: 8256200 - DNA, 23 bp, Homo sapiens
tctcctcctagatacagtcatgg

SEQ ID NO: 8256201 - DNA, 22 bp, Homo sapiens
tctcctcaccaccagcagcaga

SEQ ID NO: 8256202 - DNA, 22 bp, Homo sapiens
tctcctactcactcaaggcttg

SEQ ID NO: 8256203 - DNA, 22 bp, Homo sapiens
tctcctactcactcaaggcttg

SEQ ID NO: 8256204 - DNA, 22 bp, Homo sapiens
tctcctcccaggctcttccagg

SEQ ID NO: 8256205 - DNA, 22 bp, Homo sapiens
tctcctcccaggctcttccagg

SEQ ID NO: 8256206 - DNA, 22 bp, Homo sapiens
tctcctcccaggctcttccagg

SEQ ID NO: 8256207 - DNA, 22 bp, Homo sapiens
tctcctccagaggctgtgggga

SEQ ID NO: 8256208 - DNA, 22 bp, Homo sapiens
tctcctctgtgccacagcttgg

SEQ ID NO: 8256209 - DNA, 22 bp, Homo sapiens
tctcctgaagaccatgtgcact

SEQ ID NO: 8256210 - DNA, 22 bp, Homo sapiens
tctcctgaagtttatgaaaact

SEQ ID NO: 8256211 - DNA, 22 bp, Homo sapiens
tctcctgatatctgcagaccta

SEQ ID NO: 8256212 - DNA, 22 bp, Homo sapiens
tctcctgacatgtctggaggaa

SEQ ID NO: 8256213 - DNA, 22 bp, Homo sapiens
tctcctgacatgtctggaggaa

SEQ ID NO: 8256214 - DNA, 22 bp, Homo sapiens
tctcctgatgatggtactggca

SEQ ID NO: 8256215 - DNA, 22 bp, Homo sapiens
tctcctctcttacctggtacaa

SEQ ID NO: 8256216 - DNA, 22 bp, Homo sapiens
tctcctctgcgcggcagtgccc

SEQ ID NO: 8256217 - DNA, 22 bp, Homo sapiens
tctcctctgcgcggcagtgccc

SEQ ID NO: 8256218 - DNA, 22 bp, Homo sapiens
tctcctctcttacctggtacaa

SEQ ID NO: 8256219 - DNA, 22 bp, Homo sapiens
tctcctctatttctgtatgtat

SEQ ID NO: 8256220 - DNA, 22 bp, Homo sapiens
tctcctctcctttcatgttgtt

SEQ ID NO: 8256221 - DNA, 22 bp, Homo sapiens
tctcctggcatttggttgagta

SEQ ID NO: 8256222 - DNA, 22 bp, Homo sapiens
tctcctggcatttggttgagta

SEQ ID NO: 8256223 - DNA, 22 bp, Homo sapiens
tctcctggcatgtgggtcatct

SEQ ID NO: 8256224 - DNA, 22 bp, Homo sapiens
tctcctggcatttggttgagta

SEQ ID NO: 8256225 - DNA, 22 bp, Homo sapiens
tctcctggatggaccttctctt

SEQ ID NO: 8256226 - DNA, 22 bp, Homo sapiens
tctcctggatggaccttctctt

SEQ ID NO: 8256227 - DNA, 22 bp, Homo sapiens
tctcctggagcaggaaggtggg

SEQ ID NO: 8256228 - DNA, 22 bp, Homo sapiens
tctcctggagcaggaaggtggg

SEQ ID NO: 8256229 - DNA, 22 bp, Homo sapiens
tctcctggagcaggaaggtggg

SEQ ID NO: 8256230 - DNA, 22 bp, Homo sapiens
tctcctggagcccagatgctgg

SEQ ID NO: 8256231 - DNA, 22 bp, Homo sapiens
tctcctggagcaggaaggtggg

SEQ ID NO: 8256232 - DNA, 22 bp, Homo sapiens
tctcctggagcccagatgctgg

SEQ ID NO: 8256233 - DNA, 22 bp, Homo sapiens
tctcctggagcccagatgctgg

SEQ ID NO: 8256234 - DNA, 22 bp, Homo sapiens
tctcctggagcccagatgctgg

SEQ ID NO: 8256235 - DNA, 22 bp, Homo sapiens
tctcctggatagatactatcca

SEQ ID NO: 8256236 - DNA, 22 bp, Homo sapiens
tctcctggatagatactatcca

SEQ ID NO: 8256237 - DNA, 22 bp, Homo sapiens
tctcctggatagatactatcca

SEQ ID NO: 8256238 - DNA, 22 bp, Homo sapiens
tctcctgccactgcttcccatt

SEQ ID NO: 8256239 - DNA, 22 bp, Homo sapiens
tctcctgcagtcagcagtctca

SEQ ID NO: 8256240 - DNA, 22 bp, Homo sapiens
tctcctgcagtcagcagtctca

SEQ ID NO: 8256241 - DNA, 22 bp, Homo sapiens
tctcctgctcagaacagcctca

SEQ ID NO: 8256242 - DNA, 22 bp, Homo sapiens
tctcctgccactgcttcccatt

SEQ ID NO: 8256243 - DNA, 22 bp, Homo sapiens
tctcctgccactgcttcccatt

SEQ ID NO: 8256244 - DNA, 22 bp, Homo sapiens
tctcctgctcagaacagcctca

SEQ ID NO: 8256245 - DNA, 22 bp, Homo sapiens
tctcctgcttcaactgatggac

SEQ ID NO: 8256246 - DNA, 22 bp, Homo sapiens
tctcctgcttcaactgatggac

SEQ ID NO: 8256247 - DNA, 22 bp, Homo sapiens
tctcctgctcccaactgctgca

SEQ ID NO: 8256248 - DNA, 22 bp, Homo sapiens
tctcctggaagtgattcccctg

SEQ ID NO: 8256249 - DNA, 22 bp, Homo sapiens
tctcctggaagtgattcccctg

SEQ ID NO: 8256250 - DNA, 22 bp, Homo sapiens
tctcctggaagaataccacact

SEQ ID NO: 8256251 - DNA, 22 bp, Homo sapiens
tctggagagcagatgcctctgg

SEQ ID NO: 8256252 - DNA, 22 bp, Homo sapiens
tctggagagcagatgcctctgg

SEQ ID NO: 8256253 - DNA, 22 bp, Homo sapiens
tctggagagatcttccacaaca

SEQ ID NO: 8256254 - DNA, 22 bp, Homo sapiens
tctggagacctgcatttatatt

SEQ ID NO: 8256255 - DNA, 22 bp, Homo sapiens
tctggagacctagccctgttgt

SEQ ID NO: 8256256 - DNA, 22 bp, Homo sapiens
tctggagaggaggatgtggaca

SEQ ID NO: 8256257 - DNA, 22 bp, Homo sapiens
tctggagaggaggatgtggaca

SEQ ID NO: 8256258 - DNA, 22 bp, Homo sapiens
tctggagaggggcctagaattt

SEQ ID NO: 8256259 - DNA, 22 bp, Homo sapiens
tctggagagtcacagtgccaga

SEQ ID NO: 8256260 - DNA, 22 bp, Homo sapiens
tctggagagtcacagtgccaga

SEQ ID NO: 8256261 - DNA, 22 bp, Homo sapiens
tctggagaggggcctagaattt

SEQ ID NO: 8256262 - DNA, 22 bp, Homo sapiens
tctggagaggggcctagaattt

SEQ ID NO: 8256263 - DNA, 22 bp, Homo sapiens
tctggagagtcacagtgccaga

SEQ ID NO: 8256264 - DNA, 22 bp, Homo sapiens
tctggagagtcacagtgccaga

SEQ ID NO: 8256265 - DNA, 22 bp, Homo sapiens
tctggagagtcctgctcacgtc

SEQ ID NO: 8256266 - DNA, 22 bp, Homo sapiens
tctggagataagacagacagat

SEQ ID NO: 8256267 - DNA, 22 bp, Homo sapiens
tctggagataagacagacagat

SEQ ID NO: 8256268 - DNA, 22 bp, Homo sapiens
tctggagataagcagcaatgaa

SEQ ID NO: 8256269 - DNA, 22 bp, Homo sapiens
tctggagataagcagcaatgaa

SEQ ID NO: 8256270 - DNA, 22 bp, Homo sapiens
tctggagaagaaacttgctctg

SEQ ID NO: 8256271 - DNA, 22 bp, Homo sapiens
tctggagaagcagtgagagtca

SEQ ID NO: 8256272 - DNA, 22 bp, Homo sapiens
tctggagaacttgcaagaggat

SEQ ID NO: 8256273 - DNA, 22 bp, Homo sapiens
tctggagaacttgcaagaggat

SEQ ID NO: 8256274 - DNA, 22 bp, Homo sapiens
tctggagaagaaacttgctctg

SEQ ID NO: 8256275 - DNA, 22 bp, Homo sapiens
tctggactttcggtgcaagagt

SEQ ID NO: 8256276 - DNA, 22 bp, Homo sapiens
tctggagaaagttgagtttgtg

SEQ ID NO: 8256277 - DNA, 22 bp, Homo sapiens
tctggagaaagttgagtttgtg

SEQ ID NO: 8256278 - DNA, 22 bp, Homo sapiens
tctggagaagcccagggagctg

SEQ ID NO: 8256279 - DNA, 22 bp, Homo sapiens
tctggagaagcccagggagctg

SEQ ID NO: 8256280 - DNA, 22 bp, Homo sapiens
tctggagaagcagtgagagtca

SEQ ID NO: 8256281 - DNA, 22 bp, Homo sapiens
tctggagaaggaagagtctttg

SEQ ID NO: 8256282 - DNA, 22 bp, Homo sapiens
tctggagaatctgtcagtgtgg

SEQ ID NO: 8256283 - DNA, 22 bp, Homo sapiens
tctggagaaggaagagtctttg

SEQ ID NO: 8256284 - DNA, 22 bp, Homo sapiens
tctggactcgggtgggtgacac

SEQ ID NO: 8256285 - DNA, 22 bp, Homo sapiens
tctggactaatattctggctgc

SEQ ID NO: 8256286 - DNA, 22 bp, Homo sapiens
tctggacatcctggagaatgac

SEQ ID NO: 8256287 - DNA, 22 bp, Homo sapiens
tctggacagtagagcaatgatt

SEQ ID NO: 8256288 - DNA, 22 bp, Homo sapiens
tctggacagagcttcaggagct

SEQ ID NO: 8256289 - DNA, 22 bp, Homo sapiens
tctggaattaaactcaggagac

SEQ ID NO: 8256290 - DNA, 23 bp, Homo sapiens
tctggaatggtactcactggagt

SEQ ID NO: 8256291 - DNA, 22 bp, Homo sapiens
tctggaattctcaagtcctgga

SEQ ID NO: 8256292 - DNA, 22 bp, Homo sapiens
tctggaattgctgtgtgagttc

SEQ ID NO: 8256293 - DNA, 22 bp, Homo sapiens
tctggaataggtcctgagtatt

SEQ ID NO: 8256294 - DNA, 16 bp, Homo sapiens
tctggaagtggagggg

SEQ ID NO: 8256295 - DNA, 22 bp, Homo sapiens
tctggaagtgatgttcatagtg

SEQ ID NO: 8256296 - DNA, 22 bp, Homo sapiens
tctggaagtgatgttcatagtg

SEQ ID NO: 8256297 - DNA, 22 bp, Homo sapiens
tctggaagtcccttgatgccag

SEQ ID NO: 8256298 - DNA, 19 bp, Homo sapiens
tctggaagtgggggattgc

SEQ ID NO: 8256299 - DNA, 19 bp, Homo sapiens
tctggaagtgggggattgc

SEQ ID NO: 8256300 - DNA, 22 bp, Homo sapiens
tctggaagttagaggaggaaag

SEQ ID NO: 8256301 - DNA, 22 bp, Homo sapiens
tctggaagttagaggaggaaag

SEQ ID NO: 8256302 - DNA, 22 bp, Homo sapiens
tctggaagttagaggaggaaag

SEQ ID NO: 8256303 - DNA, 22 bp, Homo sapiens
tctggaataggacaaaaccaaa

SEQ ID NO: 8256304 - DNA, 22 bp, Homo sapiens
tctggaaggaagagctgagtcc

SEQ ID NO: 8256305 - DNA, 22 bp, Homo sapiens
tctggaaggaacccttagagga

SEQ ID NO: 8256306 - DNA, 22 bp, Homo sapiens
tctggaaggggatctgtggtca

SEQ ID NO: 8256307 - DNA, 22 bp, Homo sapiens
tctggaaggggatctgtggtca

SEQ ID NO: 8256308 - DNA, 22 bp, Homo sapiens
tctggaaggcttcaaggtctaa

SEQ ID NO: 8256309 - DNA, 22 bp, Homo sapiens
tctggaaggggatctgtggtca

SEQ ID NO: 8256310 - DNA, 22 bp, Homo sapiens
tctggaagtcaccttagttcct

SEQ ID NO: 8256311 - DNA, 22 bp, Homo sapiens
tctggaagtcaccttagttcct

SEQ ID NO: 8256312 - DNA, 22 bp, Homo sapiens
tctggaaggttggctcccagtt

SEQ ID NO: 8256313 - DNA, 22 bp, Homo sapiens
tctggaagaggtgggttgggag

SEQ ID NO: 8256314 - DNA, 22 bp, Homo sapiens
tctggaagacattaatttggtt

SEQ ID NO: 8256315 - DNA, 22 bp, Homo sapiens
tctggaagacagtgagcccgct

SEQ ID NO: 8256316 - DNA, 22 bp, Homo sapiens
tctggaagacagtgagcccgct

SEQ ID NO: 8256317 - DNA, 22 bp, Homo sapiens
tctggaagctggagtccaggaa

SEQ ID NO: 8256318 - DNA, 22 bp, Homo sapiens
tctggaaggaacccttagagga

SEQ ID NO: 8256319 - DNA, 22 bp, Homo sapiens
tctggaagctggagtccaggaa

SEQ ID NO: 8256320 - DNA, 22 bp, Homo sapiens
tctggaagctggagtccaggaa

SEQ ID NO: 8256321 - DNA, 22 bp, Homo sapiens
tctgctgctacagactctctag

SEQ ID NO: 8256322 - DNA, 22 bp, Homo sapiens
tctgctgccatgcagagcagta

SEQ ID NO: 8256323 - DNA, 22 bp, Homo sapiens
tctgctgccatgcagagcagta

SEQ ID NO: 8256324 - DNA, 22 bp, Homo sapiens
tctgctgcagcaggattctctg

SEQ ID NO: 8256325 - DNA, 22 bp, Homo sapiens
tctgctgaacttgctgcccaga

SEQ ID NO: 8256326 - DNA, 22 bp, Homo sapiens
tctgctgagtaccgccatgtct

SEQ ID NO: 8256327 - DNA, 22 bp, Homo sapiens
tctgctctgtggcttcagctaa

SEQ ID NO: 8256328 - DNA, 22 bp, Homo sapiens
tctgctctgtggcttcagctaa

SEQ ID NO: 8256329 - DNA, 22 bp, Homo sapiens
tctgctctgtggcttcagctaa

SEQ ID NO: 8256330 - DNA, 22 bp, Homo sapiens
tctgctctgtactgcactggcc

SEQ ID NO: 8256331 - DNA, 22 bp, Homo sapiens
tctgctctgtactgcactggcc

SEQ ID NO: 8256332 - DNA, 22 bp, Homo sapiens
tctgctctgagagggccatcag

SEQ ID NO: 8256333 - DNA, 17 bp, Homo sapiens
tctgctctgccaatcca

SEQ ID NO: 8256334 - DNA, 22 bp, Homo sapiens
tctgctctgtactgcactggcc

SEQ ID NO: 8256335 - DNA, 22 bp, Homo sapiens
tctgctctgtactgcactggcc

SEQ ID NO: 8256336 - DNA, 22 bp, Homo sapiens
tctgctctgggccagctattaa

SEQ ID NO: 8256337 - DNA, 22 bp, Homo sapiens
tctgctctagttgcttcctgcc

SEQ ID NO: 8256338 - DNA, 22 bp, Homo sapiens
tctgctctagttgcttcctgcc

SEQ ID NO: 8256339 - DNA, 22 bp, Homo sapiens
tctgctctccatacttccgcac

SEQ ID NO: 8256340 - DNA, 22 bp, Homo sapiens
tctgctctccatacttccgcac

SEQ ID NO: 8256341 - DNA, 22 bp, Homo sapiens
tctgctctgagagggccatcag

SEQ ID NO: 8256342 - DNA, 23 bp, Homo sapiens
tctgctctgaagttcggctgagc

SEQ ID NO: 8256343 - DNA, 23 bp, Homo sapiens
tctgctctgaagttcggctgagc

SEQ ID NO: 8256344 - DNA, 22 bp, Homo sapiens
tctgctgtgaaaggtgaatatt

SEQ ID NO: 8256345 - DNA, 22 bp, Homo sapiens
tctgctgtgattctactagtgt

SEQ ID NO: 8256346 - DNA, 22 bp, Homo sapiens
tctgctgtgggtctatatttta

SEQ ID NO: 8256347 - DNA, 22 bp, Homo sapiens
tctgctgtgatttgctacctgt

SEQ ID NO: 8256348 - DNA, 22 bp, Homo sapiens
tctgctgtgatttgctacctgt

SEQ ID NO: 8256349 - DNA, 22 bp, Homo sapiens
tctgctgtctgattcccacttc

SEQ ID NO: 8256350 - DNA, 22 bp, Homo sapiens
tctgctgtctgattcccacttc

SEQ ID NO: 8256351 - DNA, 22 bp, Homo sapiens
tctgctgtattaggttgaactg

SEQ ID NO: 8256352 - DNA, 22 bp, Homo sapiens
tctgctgtacttttggtctgtt

SEQ ID NO: 8256353 - DNA, 22 bp, Homo sapiens
tctgctgtcactcatttgcttc

SEQ ID NO: 8256354 - DNA, 22 bp, Homo sapiens
tctgctgttctcatgctgattt

SEQ ID NO: 8256355 - DNA, 22 bp, Homo sapiens
tctggaagaacggggcatgctg

SEQ ID NO: 8256356 - DNA, 22 bp, Homo sapiens
tctggaagaacggggcatgctg

SEQ ID NO: 8256357 - DNA, 22 bp, Homo sapiens
tctggaagaacggggcatgctg

SEQ ID NO: 8256358 - DNA, 22 bp, Homo sapiens
tctggaagaacggggcatgctg

SEQ ID NO: 8256359 - DNA, 22 bp, Homo sapiens
tctgctgtgtccctggtctcct

SEQ ID NO: 8256360 - DNA, 22 bp, Homo sapiens
tctgctgtgtccctggtctcct

SEQ ID NO: 8256361 - DNA, 22 bp, Homo sapiens
tctgctgttcattcttttagct

SEQ ID NO: 8256362 - DNA, 22 bp, Homo sapiens
tctgctgttcattcttttagct

SEQ ID NO: 8256363 - DNA, 22 bp, Homo sapiens
tctgctgtgtccctggtctcct

SEQ ID NO: 8256364 - DNA, 22 bp, Homo sapiens
tctgctggtcaaggctgggtcc

SEQ ID NO: 8256365 - DNA, 22 bp, Homo sapiens
tctgctggtcaaggctgggtcc

SEQ ID NO: 8256366 - DNA, 22 bp, Homo sapiens
tctgctggtcaaggctgggtcc

SEQ ID NO: 8256367 - DNA, 22 bp, Homo sapiens
tctgctggttccgaattaggcc

SEQ ID NO: 8256368 - DNA, 22 bp, Homo sapiens
tctgctggtgatgacctcataa

SEQ ID NO: 8256369 - DNA, 22 bp, Homo sapiens
tctgctggtgatgacctcataa

SEQ ID NO: 8256370 - DNA, 22 bp, Homo sapiens
tctgctgtacttttggtctgtt

SEQ ID NO: 8256371 - DNA, 22 bp, Homo sapiens
tctgctgtaaagaatttctgcc

SEQ ID NO: 8256372 - DNA, 22 bp, Homo sapiens
tctgctggttccgaattaggcc

SEQ ID NO: 8256373 - DNA, 22 bp, Homo sapiens
tctgctgctgcagctacactat

SEQ ID NO: 8256374 - DNA, 22 bp, Homo sapiens
tctgctgctgcagctacactat

SEQ ID NO: 8256375 - DNA, 20 bp, Homo sapiens
tctgctggccaaaacttcac

SEQ ID NO: 8256376 - DNA, 19 bp, Homo sapiens
tctgctggcagaattccct

SEQ ID NO: 8256377 - DNA, 22 bp, Homo sapiens
tctgctggaaaaccagggaatt

SEQ ID NO: 8256378 - DNA, 22 bp, Homo sapiens
tctgctggaaaaccagggaatt

SEQ ID NO: 8256379 - DNA, 22 bp, Homo sapiens
tctggattctgtactgtaaagt

SEQ ID NO: 8256380 - DNA, 22 bp, Homo sapiens
tctggattctaaggtgtttact

SEQ ID NO: 8256381 - DNA, 22 bp, Homo sapiens
tctggatttgtggaaaatctgc

SEQ ID NO: 8256382 - DNA, 22 bp, Homo sapiens
tctggatttcagttctaaatct

SEQ ID NO: 8256383 - DNA, 22 bp, Homo sapiens
tctggatttgagctcagttgta

SEQ ID NO: 8256384 - DNA, 22 bp, Homo sapiens
tctggatggtcagctcttcctg

SEQ ID NO: 8256385 - DNA, 17 bp, Homo sapiens
tctggatgtcatggaag

SEQ ID NO: 8256386 - DNA, 17 bp, Homo sapiens
tctggatgtcatggaag

SEQ ID NO: 8256387 - DNA, 22 bp, Homo sapiens
tctggattcacctttagtacct

SEQ ID NO: 8256388 - DNA, 22 bp, Homo sapiens
tctggattcaagtccctgtttt

SEQ ID NO: 8256389 - DNA, 22 bp, Homo sapiens
tctggattagatgctttcaaga

SEQ ID NO: 8256390 - DNA, 22 bp, Homo sapiens
tctggattaactgctgtttatt

SEQ ID NO: 8256391 - DNA, 22 bp, Homo sapiens
tctggatgttgcggagtacaga

SEQ ID NO: 8256392 - DNA, 22 bp, Homo sapiens
tctggatgggatgaggcaacaa

SEQ ID NO: 8256393 - DNA, 23 bp, Homo sapiens
tctggatgccaccacatactaac

SEQ ID NO: 8256394 - DNA, 22 bp, Homo sapiens
tctggatgacagaatggtcata

SEQ ID NO: 8256395 - DNA, 22 bp, Homo sapiens
tctggatgatatgtgaacttga

SEQ ID NO: 8256396 - DNA, 22 bp, Homo sapiens
tctggagttttttctgtctgtg

SEQ ID NO: 8256397 - DNA, 22 bp, Homo sapiens
tctggagtttgagcacttcaat

SEQ ID NO: 8256398 - DNA, 22 bp, Homo sapiens
tctggagttttttctgtctgtg

SEQ ID NO: 8256399 - DNA, 22 bp, Homo sapiens
tctggagtttgaggacaagctt

SEQ ID NO: 8256400 - DNA, 22 bp, Homo sapiens
tctggagttgtgcagtggacct

SEQ ID NO: 8256401 - DNA, 22 bp, Homo sapiens
tctggagttgcatgttttggct

SEQ ID NO: 8256402 - DNA, 22 bp, Homo sapiens
tctggagttgaagttcttcccc

SEQ ID NO: 8256403 - DNA, 22 bp, Homo sapiens
tctggagttgagagtgtgcgag

SEQ ID NO: 8256404 - DNA, 22 bp, Homo sapiens
tctggagttcctgcaggctgtg

SEQ ID NO: 8256405 - DNA, 22 bp, Homo sapiens
tctggagtgtccagttctactc

SEQ ID NO: 8256406 - DNA, 22 bp, Homo sapiens
tctggagtgtccagttctactc

SEQ ID NO: 8256407 - DNA, 22 bp, Homo sapiens
tctggagtgggactttgcatct

SEQ ID NO: 8256408 - DNA, 22 bp, Homo sapiens
tctggagtggcagtcatctgaa

SEQ ID NO: 8256409 - DNA, 22 bp, Homo sapiens
tctggagtggcagtcatctgaa

SEQ ID NO: 8256410 - DNA, 22 bp, Homo sapiens
tctggagtgggactttgcatct

SEQ ID NO: 8256411 - DNA, 22 bp, Homo sapiens
tctggagtggaggtgccttggg

SEQ ID NO: 8256412 - DNA, 22 bp, Homo sapiens
tctggagtggaggtgccttggg

SEQ ID NO: 8256413 - DNA, 22 bp, Homo sapiens
tctggagtgtttctaattactg

SEQ ID NO: 8256414 - DNA, 22 bp, Homo sapiens
tctggagtgtttctaattactg

SEQ ID NO: 8256415 - DNA, 22 bp, Homo sapiens
tctggagtgtgtgtattcagct

SEQ ID NO: 8256416 - DNA, 22 bp, Homo sapiens
tctggagtgtgtgtattcagct

SEQ ID NO: 8256417 - DNA, 22 bp, Homo sapiens
tctggagttagttataatggtt

SEQ ID NO: 8256418 - DNA, 22 bp, Homo sapiens
tctggagttactgctggctttg

SEQ ID NO: 8256419 - DNA, 22 bp, Homo sapiens
tctggagttactgctggctttg

SEQ ID NO: 8256420 - DNA, 22 bp, Homo sapiens
tctggaggggtttagagggaca

SEQ ID NO: 8256421 - DNA, 22 bp, Homo sapiens
tctggaggggtttagagggaca

SEQ ID NO: 8256422 - DNA, 22 bp, Homo sapiens
tctggaggggtttagagggaca

SEQ ID NO: 8256423 - DNA, 22 bp, Homo sapiens
tctggagggcccacatccacaa

SEQ ID NO: 8256424 - DNA, 22 bp, Homo sapiens
tctggagggcccacatccacaa

SEQ ID NO: 8256425 - DNA, 22 bp, Homo sapiens
tctggaggctctgagggtgagt

SEQ ID NO: 8256426 - DNA, 22 bp, Homo sapiens
tctggaggctctgagggtgagt

SEQ ID NO: 8256427 - DNA, 22 bp, Homo sapiens
tctggaggctctgagggtgagt

SEQ ID NO: 8256428 - DNA, 22 bp, Homo sapiens
tctggaggctctgagggtgagt

SEQ ID NO: 8256429 - DNA, 21 bp, Homo sapiens
tctggagccctaagctgagaa

SEQ ID NO: 8256430 - DNA, 22 bp, Homo sapiens
tctggagcaacagagcaggaca

SEQ ID NO: 8256431 - DNA, 22 bp, Homo sapiens
tctggagatcatgtggggtgga

SEQ ID NO: 8256432 - DNA, 22 bp, Homo sapiens
tctggagatcatgtggggtgga

SEQ ID NO: 8256433 - DNA, 22 bp, Homo sapiens
tctggagatcatgtggggtgga

SEQ ID NO: 8256434 - DNA, 22 bp, Homo sapiens
tctggagataagcagcaatgaa

SEQ ID NO: 8256435 - DNA, 22 bp, Homo sapiens
tctggagtaactctgtttctgg

SEQ ID NO: 8256436 - DNA, 22 bp, Homo sapiens
tctggagtaactctgtttctgg

SEQ ID NO: 8256437 - DNA, 22 bp, Homo sapiens
tctggagtaggacctgaaaata

SEQ ID NO: 8256438 - DNA, 22 bp, Homo sapiens
tctggagtaggacctgaaaata

SEQ ID NO: 8256439 - DNA, 20 bp, Homo sapiens
tctggagtagagcacaggca

SEQ ID NO: 8256440 - DNA, 22 bp, Homo sapiens
tctggagtaattacagtgactg

SEQ ID NO: 8256441 - DNA, 21 bp, Homo sapiens
tctggagtcatctttaccata

SEQ ID NO: 8256442 - DNA, 22 bp, Homo sapiens
tctggagtatgtgtgaacggtg

SEQ ID NO: 8256443 - DNA, 22 bp, Homo sapiens
tctggagtatgtccctggtgaa

SEQ ID NO: 8256444 - DNA, 22 bp, Homo sapiens
tctggagtatgtccctggtgaa

SEQ ID NO: 8256445 - DNA, 22 bp, Homo sapiens
tctggagtagggtctgggaatt

SEQ ID NO: 8256446 - DNA, 22 bp, Homo sapiens
tctggagtgaatgaagtagtgt

SEQ ID NO: 8256447 - DNA, 22 bp, Homo sapiens
tctggagtctggtggttatggt

SEQ ID NO: 8256448 - DNA, 22 bp, Homo sapiens
tctggagtgccctgctctgccc

SEQ ID NO: 8256449 - DNA, 22 bp, Homo sapiens
tctggagtgccctgctctgccc

SEQ ID NO: 8256450 - DNA, 22 bp, Homo sapiens
tctggagtggacccagagcact

SEQ ID NO: 8256451 - DNA, 22 bp, Homo sapiens
tctggagtggagctgatcattt

SEQ ID NO: 8256452 - DNA, 22 bp, Homo sapiens
tctggagtggagctgatcattt

SEQ ID NO: 8256453 - DNA, 22 bp, Homo sapiens
tctggagtctgagatctgagga

SEQ ID NO: 8256454 - DNA, 22 bp, Homo sapiens
tctggagtctaaagaaccaaaa

SEQ ID NO: 8256455 - DNA, 22 bp, Homo sapiens
tctggagtccagatccatttgg

SEQ ID NO: 8256456 - DNA, 22 bp, Homo sapiens
tctggagtccagatccatttgg

SEQ ID NO: 8256457 - DNA, 22 bp, Homo sapiens
tctggagtcctggaatcagcta

SEQ ID NO: 8256458 - DNA, 22 bp, Homo sapiens
tctggcagttgccgcttcagtc

SEQ ID NO: 8256459 - DNA, 22 bp, Homo sapiens
tctggcagttccttgttgatat

SEQ ID NO: 8256460 - DNA, 22 bp, Homo sapiens
tctggcagttgccgcttcagtc

SEQ ID NO: 8256461 - DNA, 22 bp, Homo sapiens
tctggcagttccttgttgatat

SEQ ID NO: 8256462 - DNA, 22 bp, Homo sapiens
tctggcagtttgagaaaggcta

SEQ ID NO: 8256463 - DNA, 22 bp, Homo sapiens
tctggcagttgccgcttcagtc

SEQ ID NO: 8256464 - DNA, 21 bp, Homo sapiens
tctggcagtggtctttcaaat

SEQ ID NO: 8256465 - DNA, 21 bp, Homo sapiens
tctggcagtggtctttcaaat

SEQ ID NO: 8256466 - DNA, 22 bp, Homo sapiens
tctggcagtggatgagggcagc

SEQ ID NO: 8256467 - DNA, 22 bp, Homo sapiens
tctggcagtggatgagggcagc

SEQ ID NO: 8256468 - DNA, 22 bp, Homo sapiens
tctggcagtggatgagggcagc

SEQ ID NO: 8256469 - DNA, 22 bp, Homo sapiens
tctggcagtgatttctgtgatc

SEQ ID NO: 8256470 - DNA, 22 bp, Homo sapiens
tctggcagtgatttctgtgatc

SEQ ID NO: 8256471 - DNA, 22 bp, Homo sapiens
tctggcagtggatgagggcagc

SEQ ID NO: 8256472 - DNA, 22 bp, Homo sapiens
tctggcatagtgagagctttta

SEQ ID NO: 8256473 - DNA, 22 bp, Homo sapiens
tctggcagtttgagaaaggcta

SEQ ID NO: 8256474 - DNA, 22 bp, Homo sapiens
tctggccaacaaaaactaagtc

SEQ ID NO: 8256475 - DNA, 22 bp, Homo sapiens
tctggcatctgttttcatattt

SEQ ID NO: 8256476 - DNA, 22 bp, Homo sapiens
tctggcatcactcgcaagagca

SEQ ID NO: 8256477 - DNA, 22 bp, Homo sapiens
tctggcatggatttgagtgtct

SEQ ID NO: 8256478 - DNA, 22 bp, Homo sapiens
tctggccacccgaggcccctgc

SEQ ID NO: 8256479 - DNA, 22 bp, Homo sapiens
tctggcattttggctgggaaac

SEQ ID NO: 8256480 - DNA, 22 bp, Homo sapiens
tctggccaaccctcaagttgta

SEQ ID NO: 8256481 - DNA, 22 bp, Homo sapiens
tctggccaatgttgtgatcaca

SEQ ID NO: 8256482 - DNA, 22 bp, Homo sapiens
tctggccagcatgagacctggt

SEQ ID NO: 8256483 - DNA, 22 bp, Homo sapiens
tctggccagaaagacttgatgt

SEQ ID NO: 8256484 - DNA, 22 bp, Homo sapiens
tctggccacccgaggcccctgc

SEQ ID NO: 8256485 - DNA, 22 bp, Homo sapiens
tctggccactaataggtctcac

SEQ ID NO: 8256486 - DNA, 22 bp, Homo sapiens
tctggccagtgaaatgcagaat

SEQ ID NO: 8256487 - DNA, 22 bp, Homo sapiens
tctggccagtgaaatgcagaat

SEQ ID NO: 8256488 - DNA, 22 bp, Homo sapiens
tctggccaggatggcaagacca

SEQ ID NO: 8256489 - DNA, 22 bp, Homo sapiens
tctggccaggatggcaagacca

SEQ ID NO: 8256490 - DNA, 22 bp, Homo sapiens
tctggccatggcaagccgagtg

SEQ ID NO: 8256491 - DNA, 22 bp, Homo sapiens
tctggccatggcaagccgagtg

SEQ ID NO: 8256492 - DNA, 22 bp, Homo sapiens
tctggcccaagttttcggtgag

SEQ ID NO: 8256493 - DNA, 22 bp, Homo sapiens
tctggcccaagttttcggtgag

SEQ ID NO: 8256494 - DNA, 22 bp, Homo sapiens
tctggcccatcttctgccacca

SEQ ID NO: 8256495 - DNA, 22 bp, Homo sapiens
tctggcccagcccctgatccca

SEQ ID NO: 8256496 - DNA, 22 bp, Homo sapiens
tctggcagagtcagtgcacaca

SEQ ID NO: 8256497 - DNA, 22 bp, Homo sapiens
tctggcagagtcagtgcacaca

SEQ ID NO: 8256498 - DNA, 22 bp, Homo sapiens
tctggcagagtgataggataag

SEQ ID NO: 8256499 - DNA, 22 bp, Homo sapiens
tctggcagagtcagtgcacaca

SEQ ID NO: 8256500 - DNA, 22 bp, Homo sapiens
tctggcagaggaaggaggcctg

SEQ ID NO: 8256501 - DNA, 22 bp, Homo sapiens
tctggcagagtcagtgcacaca

SEQ ID NO: 8256502 - DNA, 22 bp, Homo sapiens
tctggcagaggaaggaggcctg

SEQ ID NO: 8256503 - DNA, 22 bp, Homo sapiens
tctggcagagatatccatccca

SEQ ID NO: 8256504 - DNA, 22 bp, Homo sapiens
tctggcagagatatccatccca

SEQ ID NO: 8256505 - DNA, 22 bp, Homo sapiens
tctggcagaagtgctgtcagta

SEQ ID NO: 8256506 - DNA, 22 bp, Homo sapiens
tctggcagaagtgctgtcagta

SEQ ID NO: 8256507 - DNA, 22 bp, Homo sapiens
tctggcagagatatccatccca

SEQ ID NO: 8256508 - DNA, 22 bp, Homo sapiens
tctggcacttaaatgagaattt

SEQ ID NO: 8256509 - DNA, 22 bp, Homo sapiens
tctggcaccactgagtctgcag

SEQ ID NO: 8256510 - DNA, 22 bp, Homo sapiens
tctggcagaagtgctgtcagta

SEQ ID NO: 8256511 - DNA, 22 bp, Homo sapiens
tctggcagaaggcagaaattca

SEQ ID NO: 8256512 - DNA, 22 bp, Homo sapiens
tctggcagaaggcagaaattca

SEQ ID NO: 8256513 - DNA, 22 bp, Homo sapiens
tctggcacatagcagggtctct

SEQ ID NO: 8256514 - DNA, 20 bp, Homo sapiens
tctggcacactgagaagctc

SEQ ID NO: 8256515 - DNA, 22 bp, Homo sapiens
tctggcacactaggtctcaggt

SEQ ID NO: 8256516 - DNA, 22 bp, Homo sapiens
tctggcagggtgtgtatttaca

SEQ ID NO: 8256517 - DNA, 19 bp, Homo sapiens
tctggcaggtaattaggga

SEQ ID NO: 8256518 - DNA, 22 bp, Homo sapiens
tctggcaggtcaatcattcttt

SEQ ID NO: 8256519 - DNA, 19 bp, Homo sapiens
tctggcaggtaattaggga

SEQ ID NO: 8256520 - DNA, 20 bp, Homo sapiens
tctggcaggtgaacgagctg

SEQ ID NO: 8256521 - DNA, 20 bp, Homo sapiens
tctggcaggtgaacgagctg

SEQ ID NO: 8256522 - DNA, 22 bp, Homo sapiens
tctggcaggtcaatcattcttt

SEQ ID NO: 8256523 - DNA, 22 bp, Homo sapiens
tctggcaggtcaatcattcttt

SEQ ID NO: 8256524 - DNA, 22 bp, Homo sapiens
tctggcagagtgataggataag

SEQ ID NO: 8256525 - DNA, 22 bp, Homo sapiens
tctggcagatcttcccacgttt

SEQ ID NO: 8256526 - DNA, 22 bp, Homo sapiens
tctggcagcaagataacaatgg

SEQ ID NO: 8256527 - DNA, 22 bp, Homo sapiens
tctggcagatcttcccacgttt

SEQ ID NO: 8256528 - DNA, 22 bp, Homo sapiens
tctggcagatcttcccacgttt

SEQ ID NO: 8256529 - DNA, 22 bp, Homo sapiens
tctggcagggtgtgtatttaca

SEQ ID NO: 8256530 - DNA, 22 bp, Homo sapiens
tctggcagcaagataacaatgg

SEQ ID NO: 8256531 - DNA, 22 bp, Homo sapiens
tctggcagggtcagggcccagg

SEQ ID NO: 8256532 - DNA, 20 bp, Homo sapiens
tctggcaggtgaacgagctg

SEQ ID NO: 8256533 - DNA, 22 bp, Homo sapiens
tctggcaggttcccatgttatg

SEQ ID NO: 8256534 - DNA, 20 bp, Homo sapiens
tctggcaggtgaacgagctg

SEQ ID NO: 8256535 - DNA, 22 bp, Homo sapiens
tctggcaggttcccatgttatg

SEQ ID NO: 8256536 - DNA, 22 bp, Homo sapiens
tctggcagtaataggggagaga

SEQ ID NO: 8256537 - DNA, 22 bp, Homo sapiens
tctggcagtgagcaacttgaca

SEQ ID NO: 8256538 - DNA, 22 bp, Homo sapiens
tctggcagtgagcaacttgaca

SEQ ID NO: 8256539 - DNA, 22 bp, Homo sapiens
tctggcagtgaagtcatgaggt

SEQ ID NO: 8256540 - DNA, 22 bp, Homo sapiens
tctggcagtgaagtcatgaggt

SEQ ID NO: 8256541 - DNA, 22 bp, Homo sapiens
tctggcagtgaagtcatgaggt

SEQ ID NO: 8256542 - DNA, 22 bp, Homo sapiens
tctggcagtaataggggagaga

SEQ ID NO: 8256543 - DNA, 22 bp, Homo sapiens
tctggctgtcattggaggcccc

SEQ ID NO: 8256544 - DNA, 22 bp, Homo sapiens
tctggctgtcattggaggcccc

SEQ ID NO: 8256545 - DNA, 22 bp, Homo sapiens
tctggctgtcattggaggcccc

SEQ ID NO: 8256546 - DNA, 22 bp, Homo sapiens
tctggctgtgtaaggtagcacc

SEQ ID NO: 8256547 - DNA, 22 bp, Homo sapiens
tctggctgtgtaatatgtgtag

SEQ ID NO: 8256548 - DNA, 22 bp, Homo sapiens
tctggctgtgtaaggtagcacc

SEQ ID NO: 8256549 - DNA, 22 bp, Homo sapiens
tctggctgggaagggggcccga

SEQ ID NO: 8256550 - DNA, 22 bp, Homo sapiens
tctggctgggaagggggcccga

SEQ ID NO: 8256551 - DNA, 22 bp, Homo sapiens
tctggctgggctgacattgaac

SEQ ID NO: 8256552 - DNA, 22 bp, Homo sapiens
tctggctgggctgacattgaac

SEQ ID NO: 8256553 - DNA, 22 bp, Homo sapiens
tctggctgggtgagagcttctc

SEQ ID NO: 8256554 - DNA, 23 bp, Homo sapiens
tctggctgtaatatgaaagttag

SEQ ID NO: 8256555 - DNA, 23 bp, Homo sapiens
tctggctgtaatatgaaagttag

SEQ ID NO: 8256556 - DNA, 22 bp, Homo sapiens
tctggctgtgtatgagagtttt

SEQ ID NO: 8256557 - DNA, 22 bp, Homo sapiens
tctggctgtgtaatatgtgtag

SEQ ID NO: 8256558 - DNA, 22 bp, Homo sapiens
tctggctgtgtatgagagtttt

SEQ ID NO: 8256559 - DNA, 22 bp, Homo sapiens
tctggctgtgtatgagagtttt

SEQ ID NO: 8256560 - DNA, 23 bp, Homo sapiens
tctggctttcacgggtattctta

SEQ ID NO: 8256561 - DNA, 23 bp, Homo sapiens
tctggctttcacgggtattctta

SEQ ID NO: 8256562 - DNA, 22 bp, Homo sapiens
tctggctttcctggagcaagaa

SEQ ID NO: 8256563 - DNA, 22 bp, Homo sapiens
tctggctggctcggccgggagt

SEQ ID NO: 8256564 - DNA, 22 bp, Homo sapiens
tctggctggctcggccgggagt

SEQ ID NO: 8256565 - DNA, 22 bp, Homo sapiens
tctggctggcagtgatggtgtg

SEQ ID NO: 8256566 - DNA, 22 bp, Homo sapiens
tctggctggcagtgatggtgtg

SEQ ID NO: 8256567 - DNA, 22 bp, Homo sapiens
tctggctggcagtgatggtgtg

SEQ ID NO: 8256568 - DNA, 22 bp, Homo sapiens
tctggctgctgcgtgagtgctt

SEQ ID NO: 8256569 - DNA, 23 bp, Homo sapiens
tctggctgctcctttcaatgctc

SEQ ID NO: 8256570 - DNA, 22 bp, Homo sapiens
tctggctgctgcgtgagtgctt

SEQ ID NO: 8256571 - DNA, 22 bp, Homo sapiens
tctggctgctgcgtgagtgctt

SEQ ID NO: 8256572 - DNA, 22 bp, Homo sapiens
tctggctgacatcctgtatgag

SEQ ID NO: 8256573 - DNA, 22 bp, Homo sapiens
tctggctgattccctgggactg

SEQ ID NO: 8256574 - DNA, 22 bp, Homo sapiens
tctggctgattccctgggactg

SEQ ID NO: 8256575 - DNA, 22 bp, Homo sapiens
tctggctgacatcctgtatgag

SEQ ID NO: 8256576 - DNA, 22 bp, Homo sapiens
tctggctgacatcctgtatgag

SEQ ID NO: 8256577 - DNA, 22 bp, Homo sapiens
tctggctgacatcctgtatgag

SEQ ID NO: 8256578 - DNA, 19 bp, Homo sapiens
tctggctgccaaggattga

SEQ ID NO: 8256579 - DNA, 22 bp, Homo sapiens
tctggctgcaccattatagtag

SEQ ID NO: 8256580 - DNA, 22 bp, Homo sapiens
tctggctgcaccattatagtag

SEQ ID NO: 8256581 - DNA, 22 bp, Homo sapiens
tctggctgattccctgggactg

SEQ ID NO: 8256582 - DNA, 22 bp, Homo sapiens
tctggctgcaccattatagtag

SEQ ID NO: 8256583 - DNA, 22 bp, Homo sapiens
tctggctgccaccatcctcccc

SEQ ID NO: 8256584 - DNA, 22 bp, Homo sapiens
tctggctgcgtggcctttagca

SEQ ID NO: 8256585 - DNA, 22 bp, Homo sapiens
tctgggaaatggctacttgtca

SEQ ID NO: 8256586 - DNA, 22 bp, Homo sapiens
tctggctttctgactctacaac

SEQ ID NO: 8256587 - DNA, 22 bp, Homo sapiens
tctggctttggatttgaagggt

SEQ ID NO: 8256588 - DNA, 22 bp, Homo sapiens
tctggcttttatgggatgagag

SEQ ID NO: 8256589 - DNA, 22 bp, Homo sapiens
tctggcttttatgggatgagag

SEQ ID NO: 8256590 - DNA, 22 bp, Homo sapiens
tctgggaacagcctggctgtgt

SEQ ID NO: 8256591 - DNA, 22 bp, Homo sapiens
tctgggaacactttgtgagctc

SEQ ID NO: 8256592 - DNA, 22 bp, Homo sapiens
tctgggaacacacgtcacttca

SEQ ID NO: 8256593 - DNA, 21 bp, Homo sapiens
tctgggaaattgggaaagaag

SEQ ID NO: 8256594 - DNA, 22 bp, Homo sapiens
tctgggaaatgggcagcttcgc

SEQ ID NO: 8256595 - DNA, 22 bp, Homo sapiens
tctgggaaatggctacttgtca

SEQ ID NO: 8256596 - DNA, 19 bp, Homo sapiens
tctgggaagccgggctcca

SEQ ID NO: 8256597 - DNA, 22 bp, Homo sapiens
tctgggaagcctgtatgcagaa

SEQ ID NO: 8256598 - DNA, 22 bp, Homo sapiens
tctgggaaggctctgcagatat

SEQ ID NO: 8256599 - DNA, 22 bp, Homo sapiens
tctgggaagctgcgtgcctgtt

SEQ ID NO: 8256600 - DNA, 22 bp, Homo sapiens
tctgggaactatatctggtggt

SEQ ID NO: 8256601 - DNA, 22 bp, Homo sapiens
tctgggaactctgtcatttccc

SEQ ID NO: 8256602 - DNA, 22 bp, Homo sapiens
tctgggaactatatctggtggt

SEQ ID NO: 8256603 - DNA, 22 bp, Homo sapiens
tctgggaaccattggtggggat

SEQ ID NO: 8256604 - DNA, 22 bp, Homo sapiens
tctgggaaccattggtggggat

SEQ ID NO: 8256605 - DNA, 22 bp, Homo sapiens
tctgggaaccagtgcggctggg

SEQ ID NO: 8256606 - DNA, 22 bp, Homo sapiens
tctggctcctgagtccatgctc

SEQ ID NO: 8256607 - DNA, 22 bp, Homo sapiens
tctggctccgtgtccgctccca

SEQ ID NO: 8256608 - DNA, 22 bp, Homo sapiens
tctggctcccagcctgctctca

SEQ ID NO: 8256609 - DNA, 22 bp, Homo sapiens
tctggctcccagcctgctctca

SEQ ID NO: 8256610 - DNA, 21 bp, Homo sapiens
tctggccctcacagtcacacc

SEQ ID NO: 8256611 - DNA, 21 bp, Homo sapiens
tctggccctcacagtcacacc

SEQ ID NO: 8256612 - DNA, 22 bp, Homo sapiens
tctggccctatggcatgtacct

SEQ ID NO: 8256613 - DNA, 22 bp, Homo sapiens
tctggccctatggcatgtacct

SEQ ID NO: 8256614 - DNA, 21 bp, Homo sapiens
tctggccctcacagtcacacc

SEQ ID NO: 8256615 - DNA, 22 bp, Homo sapiens
tctggccccggtcttcacagct

SEQ ID NO: 8256616 - DNA, 22 bp, Homo sapiens
tctggcccctggcagtcctgga

SEQ ID NO: 8256617 - DNA, 22 bp, Homo sapiens
tctggccccggtcttcacagct

SEQ ID NO: 8256618 - DNA, 22 bp, Homo sapiens
tctggccccggtcttcacagct

SEQ ID NO: 8256619 - DNA, 22 bp, Homo sapiens
tctggcccatcttctgccacca

SEQ ID NO: 8256620 - DNA, 22 bp, Homo sapiens
tctggcccatgatcctgctaac

SEQ ID NO: 8256621 - DNA, 23 bp, Homo sapiens
tctggccccattctttcccatgt

SEQ ID NO: 8256622 - DNA, 22 bp, Homo sapiens
tctggcccctggtctctggtgt

SEQ ID NO: 8256623 - DNA, 22 bp, Homo sapiens
tctggcccctggcagtcctgga

SEQ ID NO: 8256624 - DNA, 22 bp, Homo sapiens
tctggcccctggtctctggtgt

SEQ ID NO: 8256625 - DNA, 20 bp, Homo sapiens
tctggccccttcctgtcctg

SEQ ID NO: 8256626 - DNA, 20 bp, Homo sapiens
tctggccccttcctgtcctg

SEQ ID NO: 8256627 - DNA, 21 bp, Homo sapiens
tctggccctaggttgggcctc

SEQ ID NO: 8256628 - DNA, 22 bp, Homo sapiens
tctggccctatggcatgtacct

SEQ ID NO: 8256629 - DNA, 22 bp, Homo sapiens
tctggctctaactaggcatcag

SEQ ID NO: 8256630 - DNA, 22 bp, Homo sapiens
tctggctcggatttgtctagca

SEQ ID NO: 8256631 - DNA, 22 bp, Homo sapiens
tctggctctaactaggcatcag

SEQ ID NO: 8256632 - DNA, 22 bp, Homo sapiens
tctggctcggatttgtctagca

SEQ ID NO: 8256633 - DNA, 22 bp, Homo sapiens
tctggctcggatttgtctagca

SEQ ID NO: 8256634 - DNA, 22 bp, Homo sapiens
tctggctcggatttgtctagca

SEQ ID NO: 8256635 - DNA, 22 bp, Homo sapiens
tctggctcggatttgtctagca

SEQ ID NO: 8256636 - DNA, 19 bp, Homo sapiens
tctggctcctgccaggctg

SEQ ID NO: 8256637 - DNA, 19 bp, Homo sapiens
tctggctcctgccaggctg

SEQ ID NO: 8256638 - DNA, 22 bp, Homo sapiens
tctggctctcatactcgccagt

SEQ ID NO: 8256639 - DNA, 23 bp, Homo sapiens
tctggctctatgtgacagctctc

SEQ ID NO: 8256640 - DNA, 22 bp, Homo sapiens
tctggctctataactcctagct

SEQ ID NO: 8256641 - DNA, 22 bp, Homo sapiens
tctggctctctcatcacccaat

SEQ ID NO: 8256642 - DNA, 22 bp, Homo sapiens
tctggctctggagtccacctgc

SEQ ID NO: 8256643 - DNA, 22 bp, Homo sapiens
tctggctctgtgtccccaccca

SEQ ID NO: 8256644 - DNA, 22 bp, Homo sapiens
tctggctctgtgtcctcaccca

SEQ ID NO: 8256645 - DNA, 22 bp, Homo sapiens
tctggctgaaaggggctgtgcc

SEQ ID NO: 8256646 - DNA, 22 bp, Homo sapiens
tctggctgaaaggggctgtgcc

SEQ ID NO: 8256647 - DNA, 22 bp, Homo sapiens
tctggctgaaaggggctgtgcc

SEQ ID NO: 8256648 - DNA, 22 bp, Homo sapiens
tctggctgaaaggggctgtgcc

SEQ ID NO: 8256649 - DNA, 22 bp, Homo sapiens
tctggctgaagcttttgcagct

SEQ ID NO: 8256650 - DNA, 22 bp, Homo sapiens
tctggctgaattagccttgggt

SEQ ID NO: 8256651 - DNA, 22 bp, Homo sapiens
tctggctgaagcttttgcagct

SEQ ID NO: 8256652 - DNA, 22 bp, Homo sapiens
tctggctgaaattagaaggttc

SEQ ID NO: 8256653 - DNA, 22 bp, Homo sapiens
tctggctgaaattagaaggttc

SEQ ID NO: 8256654 - DNA, 22 bp, Homo sapiens
tctgggatagggccagaacatg

SEQ ID NO: 8256655 - DNA, 22 bp, Homo sapiens
tctgggatagggccagaacatg

SEQ ID NO: 8256656 - DNA, 22 bp, Homo sapiens
tctgggatgaagccagaaactt

SEQ ID NO: 8256657 - DNA, 22 bp, Homo sapiens
tctgggatgaagccagaaactt

SEQ ID NO: 8256658 - DNA, 22 bp, Homo sapiens
tctgggagtttctgtgggagct

SEQ ID NO: 8256659 - DNA, 22 bp, Homo sapiens
tctgggagtttctgtgggagct

SEQ ID NO: 8256660 - DNA, 22 bp, Homo sapiens
tctgggataagaccacagattt

SEQ ID NO: 8256661 - DNA, 22 bp, Homo sapiens
tctgggatgagatcagagacac

SEQ ID NO: 8256662 - DNA, 22 bp, Homo sapiens
tctgggatgcaaacagaatctg

SEQ ID NO: 8256663 - DNA, 22 bp, Homo sapiens
tctgggatgagatcagagacac

SEQ ID NO: 8256664 - DNA, 22 bp, Homo sapiens
tctgggatgagatcagagacac

SEQ ID NO: 8256665 - DNA, 22 bp, Homo sapiens
tctgggatgagatcagagacac

SEQ ID NO: 8256666 - DNA, 22 bp, Homo sapiens
tctgggattttatagacatgct

SEQ ID NO: 8256667 - DNA, 22 bp, Homo sapiens
tctgggatgcaaacagaatctg

SEQ ID NO: 8256668 - DNA, 22 bp, Homo sapiens
tctgggatttttgacactgaag

SEQ ID NO: 8256669 - DNA, 22 bp, Homo sapiens
tctgggattttatagacatgct

SEQ ID NO: 8256670 - DNA, 18 bp, Homo sapiens
tctgggcaatctcagtat

SEQ ID NO: 8256671 - DNA, 22 bp, Homo sapiens
tctgggcaatggatgcactcac

SEQ ID NO: 8256672 - DNA, 23 bp, Homo sapiens
tctgggcaccttgttgacatgat

SEQ ID NO: 8256673 - DNA, 22 bp, Homo sapiens
tctgggcactgctgagcctgta

SEQ ID NO: 8256674 - DNA, 22 bp, Homo sapiens
tctgggcactgctgagcctgta

SEQ ID NO: 8256675 - DNA, 22 bp, Homo sapiens
tctgggcactgctgagcctgta

SEQ ID NO: 8256676 - DNA, 22 bp, Homo sapiens
tctgggcagcagcagctagtag

SEQ ID NO: 8256677 - DNA, 22 bp, Homo sapiens
tctgggcagagggtcttagtca

SEQ ID NO: 8256678 - DNA, 22 bp, Homo sapiens
tctgggcagaagcagtgcaaag

SEQ ID NO: 8256679 - DNA, 22 bp, Homo sapiens
tctgggcagcagcagctagtag

SEQ ID NO: 8256680 - DNA, 21 bp, Homo sapiens
tctgggcagcccagtcctgag

SEQ ID NO: 8256681 - DNA, 22 bp, Homo sapiens
tctgggcagcctcaggccaggg

SEQ ID NO: 8256682 - DNA, 20 bp, Homo sapiens
tctgggcagggcacatggaa

SEQ ID NO: 8256683 - DNA, 22 bp, Homo sapiens
tctgggcagcctcaggccaggg

SEQ ID NO: 8256684 - DNA, 22 bp, Homo sapiens
tctgggccaacccttccatggg

SEQ ID NO: 8256685 - DNA, 23 bp, Homo sapiens
tctgggccacttgtctgcacttc

SEQ ID NO: 8256686 - DNA, 23 bp, Homo sapiens
tctgggccacttgtctgcacttc

SEQ ID NO: 8256687 - DNA, 22 bp, Homo sapiens
tctgggccagatctagggatct

SEQ ID NO: 8256688 - DNA, 22 bp, Homo sapiens
tctgggcccactcaacttcact

SEQ ID NO: 8256689 - DNA, 21 bp, Homo sapiens
tctgggcccatgctgcctcac

SEQ ID NO: 8256690 - DNA, 22 bp, Homo sapiens
tctgggcccactcaacttcact

SEQ ID NO: 8256691 - DNA, 21 bp, Homo sapiens
tctgggcccatgctgcctcac

SEQ ID NO: 8256692 - DNA, 22 bp, Homo sapiens
tctgggccctaaaccagctcta

SEQ ID NO: 8256693 - DNA, 22 bp, Homo sapiens
tctgggctcttagtgtaccctc

SEQ ID NO: 8256694 - DNA, 22 bp, Homo sapiens
tctgggctcttagtgtaccctc

SEQ ID NO: 8256695 - DNA, 22 bp, Homo sapiens
tctgggctcttagtgtaccctc

SEQ ID NO: 8256696 - DNA, 23 bp, Homo sapiens
tctgggctgagacttggaaggtc

SEQ ID NO: 8256697 - DNA, 23 bp, Homo sapiens
tctgggctgagacttggaaggtc

SEQ ID NO: 8256698 - DNA, 22 bp, Homo sapiens
tctgggctgaaatgaaggcctt

SEQ ID NO: 8256699 - DNA, 22 bp, Homo sapiens
tctgggctgaaatgaaggcctt

SEQ ID NO: 8256700 - DNA, 22 bp, Homo sapiens
tctgggctgctatgaggcagag

SEQ ID NO: 8256701 - DNA, 23 bp, Homo sapiens
tctgggctgagctcgagtgtaga

SEQ ID NO: 8256702 - DNA, 23 bp, Homo sapiens
tctgggctgagctcgagtgtaga

SEQ ID NO: 8256703 - DNA, 23 bp, Homo sapiens
tctgggctgagctcgagtgtaga

SEQ ID NO: 8256704 - DNA, 23 bp, Homo sapiens
tctgggctgagctcgagtgtaga

SEQ ID NO: 8256705 - DNA, 23 bp, Homo sapiens
tctgggctgagacttggaaggtc

SEQ ID NO: 8256706 - DNA, 21 bp, Homo sapiens
tctgggctgctgctgcccatc

SEQ ID NO: 8256707 - DNA, 21 bp, Homo sapiens
tctgggctgctgctgcccatc

SEQ ID NO: 8256708 - DNA, 22 bp, Homo sapiens
tctgggctgctgtgcagtgacc

SEQ ID NO: 8256709 - DNA, 23 bp, Homo sapiens
tctgggctgcttaaggatcaagg

SEQ ID NO: 8256710 - DNA, 22 bp, Homo sapiens
tctgggctgctgtgcagtgacc

SEQ ID NO: 8256711 - DNA, 22 bp, Homo sapiens
tctgggctgctatgaggcagag

SEQ ID NO: 8256712 - DNA, 22 bp, Homo sapiens
tctgggctgctatgaggcagag

SEQ ID NO: 8256713 - DNA, 22 bp, Homo sapiens
tctgggctgctatgaggcagag

SEQ ID NO: 8256714 - DNA, 22 bp, Homo sapiens
tctgggctgctatgaggcagag

SEQ ID NO: 8256715 - DNA, 22 bp, Homo sapiens
tctgggaggtgttttgagaact

SEQ ID NO: 8256716 - DNA, 22 bp, Homo sapiens
tctgggaggtgttttgagaact

SEQ ID NO: 8256717 - DNA, 22 bp, Homo sapiens
tctgggaggtggcagggtgcat

SEQ ID NO: 8256718 - DNA, 22 bp, Homo sapiens
tctgggaggtggcagggtgcat

SEQ ID NO: 8256719 - DNA, 22 bp, Homo sapiens
tctgggaggtggcagggtgcat

SEQ ID NO: 8256720 - DNA, 22 bp, Homo sapiens
tctgggagtaaggcctaggcat

SEQ ID NO: 8256721 - DNA, 22 bp, Homo sapiens
tctgggagtaaggcctaggcat

SEQ ID NO: 8256722 - DNA, 22 bp, Homo sapiens
tctgggagtgaagcaacagatg

SEQ ID NO: 8256723 - DNA, 22 bp, Homo sapiens
tctgggagtgaagcaacagatg

SEQ ID NO: 8256724 - DNA, 22 bp, Homo sapiens
tctgggagtgaagcaacagatg

SEQ ID NO: 8256725 - DNA, 22 bp, Homo sapiens
tctgggagttagaatacatggg

SEQ ID NO: 8256726 - DNA, 22 bp, Homo sapiens
tctgggagttagaatacatggg

SEQ ID NO: 8256727 - DNA, 22 bp, Homo sapiens
tctgggagttgtagtccggtgg

SEQ ID NO: 8256728 - DNA, 22 bp, Homo sapiens
tctgggagttgtagtccggtgg

SEQ ID NO: 8256729 - DNA, 22 bp, Homo sapiens
tctgggagtgggtccaaggaat

SEQ ID NO: 8256730 - DNA, 22 bp, Homo sapiens
tctgggagtgtgtctggccatc

SEQ ID NO: 8256731 - DNA, 22 bp, Homo sapiens
tctgggagtgtgtctggccatc

SEQ ID NO: 8256732 - DNA, 21 bp, Homo sapiens
tctgggagtgggaaaatggtc

SEQ ID NO: 8256733 - DNA, 21 bp, Homo sapiens
tctgggagtgggaaaatggtc

SEQ ID NO: 8256734 - DNA, 22 bp, Homo sapiens
tctgggagtgggtccaaggaat

SEQ ID NO: 8256735 - DNA, 22 bp, Homo sapiens
tctgggaggggctgccattgct

SEQ ID NO: 8256736 - DNA, 22 bp, Homo sapiens
tctgggaggggctgccattgct

SEQ ID NO: 8256737 - DNA, 22 bp, Homo sapiens
tctgggaggggctgccattgct

SEQ ID NO: 8256738 - DNA, 22 bp, Homo sapiens
tctgggagggagcctcagaatc

SEQ ID NO: 8256739 - DNA, 22 bp, Homo sapiens
tctgggagggagcctcagaatc

SEQ ID NO: 8256740 - DNA, 22 bp, Homo sapiens
tctgggagggctggttcagtat

SEQ ID NO: 8256741 - DNA, 22 bp, Homo sapiens
tctgggagagtcacaggcattg

SEQ ID NO: 8256742 - DNA, 22 bp, Homo sapiens
tctgggagagtcacaggcattg

SEQ ID NO: 8256743 - DNA, 22 bp, Homo sapiens
tctgggagggagcctcagaatc

SEQ ID NO: 8256744 - DNA, 22 bp, Homo sapiens
tctgggagagtcacaggcattg

SEQ ID NO: 8256745 - DNA, 22 bp, Homo sapiens
tctgggagagtagataaaggaa

SEQ ID NO: 8256746 - DNA, 22 bp, Homo sapiens
tctgggagagtagataaaggaa

SEQ ID NO: 8256747 - DNA, 22 bp, Homo sapiens
tctgggaggtcacattggtctt

SEQ ID NO: 8256748 - DNA, 22 bp, Homo sapiens
tctgggaggtcacattggtctt

SEQ ID NO: 8256749 - DNA, 22 bp, Homo sapiens
tctgggaggtggcagggtgcat

SEQ ID NO: 8256750 - DNA, 22 bp, Homo sapiens
tctgggaggtcacattggtctt

SEQ ID NO: 8256751 - DNA, 22 bp, Homo sapiens
tctgggaggtactgggaggtgt

SEQ ID NO: 8256752 - DNA, 22 bp, Homo sapiens
tctgggaggtactgggaggtgt

SEQ ID NO: 8256753 - DNA, 22 bp, Homo sapiens
tctgggaggtcacattggtctt

SEQ ID NO: 8256754 - DNA, 22 bp, Homo sapiens
tctgggaggtaaccatgctgat

SEQ ID NO: 8256755 - DNA, 22 bp, Homo sapiens
tctgggaggtaaccatgctgat

SEQ ID NO: 8256756 - DNA, 22 bp, Homo sapiens
tctgggaggtaaccatgctgat

SEQ ID NO: 8256757 - DNA, 22 bp, Homo sapiens
tctgggaggtaaccatgctgat

SEQ ID NO: 8256758 - DNA, 22 bp, Homo sapiens
tctgggagagctgctgtcagag

SEQ ID NO: 8256759 - DNA, 22 bp, Homo sapiens
tctgggagagcacgtggctgac

SEQ ID NO: 8256760 - DNA, 22 bp, Homo sapiens
tctgggagagcacgtggctgac

SEQ ID NO: 8256761 - DNA, 22 bp, Homo sapiens
tctgggagagcacgtggctgac

SEQ ID NO: 8256762 - DNA, 22 bp, Homo sapiens
tctgggagagcacgtggctgac

SEQ ID NO: 8256763 - DNA, 22 bp, Homo sapiens
tctgggagagggaaagaagact

SEQ ID NO: 8256764 - DNA, 22 bp, Homo sapiens
tctgggagagggaaagaagact

SEQ ID NO: 8256765 - DNA, 22 bp, Homo sapiens
tctgggagagggaaagaagact

SEQ ID NO: 8256766 - DNA, 22 bp, Homo sapiens
tctgggagagctgctgtcagag

SEQ ID NO: 8256767 - DNA, 22 bp, Homo sapiens
tctgggagagctgctgtcagag

SEQ ID NO: 8256768 - DNA, 22 bp, Homo sapiens
tctgggagagctgctgtcagag

SEQ ID NO: 8256769 - DNA, 22 bp, Homo sapiens
tctgggagagctgctgtcagag

SEQ ID NO: 8256770 - DNA, 22 bp, Homo sapiens
tctgggagagcacgtggctgac

SEQ ID NO: 8256771 - DNA, 22 bp, Homo sapiens
tctgggagagcacgtggctgac

SEQ ID NO: 8256772 - DNA, 22 bp, Homo sapiens
tctgggagagcacgtggctgac

SEQ ID NO: 8256773 - DNA, 22 bp, Homo sapiens
tctgggagagagttgataaagg

SEQ ID NO: 8256774 - DNA, 22 bp, Homo sapiens
tctgggagagagttgataaagg

SEQ ID NO: 8256775 - DNA, 22 bp, Homo sapiens
tctgggagacgtgtgttgtcag

SEQ ID NO: 8256776 - DNA, 22 bp, Homo sapiens
tctgggagacgtgtgttgtcag

SEQ ID NO: 8256777 - DNA, 22 bp, Homo sapiens
tctgggagacgtgtgttgtcag

SEQ ID NO: 8256778 - DNA, 22 bp, Homo sapiens
tctgggagacgtgtgttgtcag

SEQ ID NO: 8256779 - DNA, 22 bp, Homo sapiens
tctgggagaagctgatgtgaag

SEQ ID NO: 8256780 - DNA, 22 bp, Homo sapiens
tctgggagaagctgatgtgaag

SEQ ID NO: 8256781 - DNA, 22 bp, Homo sapiens
tctgggaatgaggcttgggcaa

SEQ ID NO: 8256782 - DNA, 19 bp, Homo sapiens
tctgggaatgatgccagca

SEQ ID NO: 8256783 - DNA, 19 bp, Homo sapiens
tctgggaatgatgccagca

SEQ ID NO: 8256784 - DNA, 19 bp, Homo sapiens
tctgggaatgatgccagca

SEQ ID NO: 8256785 - DNA, 22 bp, Homo sapiens
tctgggaagtcctctgtcatgc

SEQ ID NO: 8256786 - DNA, 22 bp, Homo sapiens
tctgggaagttggcagccagct

SEQ ID NO: 8256787 - DNA, 22 bp, Homo sapiens
tctgggaatacacactgattta

SEQ ID NO: 8256788 - DNA, 22 bp, Homo sapiens
tctgggaatacacactgattta

SEQ ID NO: 8256789 - DNA, 22 bp, Homo sapiens
tctgggaagttggcagccagct

SEQ ID NO: 8256790 - DNA, 22 bp, Homo sapiens
tctgggaataaaactagggact

SEQ ID NO: 8256791 - DNA, 22 bp, Homo sapiens
tctgccaggccacacagggcac

SEQ ID NO: 8256792 - DNA, 22 bp, Homo sapiens
tctgccaggccacacagggcac

SEQ ID NO: 8256793 - DNA, 22 bp, Homo sapiens
tctgccaggccacacagggcac

SEQ ID NO: 8256794 - DNA, 22 bp, Homo sapiens
tctgccaggtggggagaggcca

SEQ ID NO: 8256795 - DNA, 16 bp, Homo sapiens
tctgccagggacaggc

SEQ ID NO: 8256796 - DNA, 22 bp, Homo sapiens
tctgccaggcttggtgctagat

SEQ ID NO: 8256797 - DNA, 22 bp, Homo sapiens
tctgccaggcctgcttccgggg

SEQ ID NO: 8256798 - DNA, 22 bp, Homo sapiens
tctgccagtgccagagtacata

SEQ ID NO: 8256799 - DNA, 23 bp, Homo sapiens
tctgccagtgtgtgccaggagcc

SEQ ID NO: 8256800 - DNA, 22 bp, Homo sapiens
tctgccagtattcacggcccgt

SEQ ID NO: 8256801 - DNA, 22 bp, Homo sapiens
tctgccagtattcacggcccgt

SEQ ID NO: 8256802 - DNA, 22 bp, Homo sapiens
tctgcccacagcctcctgtcca

SEQ ID NO: 8256803 - DNA, 21 bp, Homo sapiens
tctgcccacactggccactgc

SEQ ID NO: 8256804 - DNA, 19 bp, Homo sapiens
tctgcccacaagaaaggga

SEQ ID NO: 8256805 - DNA, 22 bp, Homo sapiens
tctgcccaaggctgtcactaga

SEQ ID NO: 8256806 - DNA, 22 bp, Homo sapiens
tctgccatgctaacttcagtat

SEQ ID NO: 8256807 - DNA, 18 bp, Homo sapiens
tctgccatgtgaggacac

SEQ ID NO: 8256808 - DNA, 22 bp, Homo sapiens
tctgccatcaagatgctctggc

SEQ ID NO: 8256809 - DNA, 22 bp, Homo sapiens
tctgccagtttatagacaagcc

SEQ ID NO: 8256810 - DNA, 22 bp, Homo sapiens
tctgccagtttatagacaagcc

SEQ ID NO: 8256811 - DNA, 22 bp, Homo sapiens
tctgccagtttatagacaagcc

SEQ ID NO: 8256812 - DNA, 22 bp, Homo sapiens
tctgccagttagaaactggtta

SEQ ID NO: 8256813 - DNA, 23 bp, Homo sapiens
tctgccagttccttgatcatgga

SEQ ID NO: 8256814 - DNA, 23 bp, Homo sapiens
tctgccagtgtgtgccaggagcc

SEQ ID NO: 8256815 - DNA, 22 bp, Homo sapiens
tctgcagggatgtgaggggtga

SEQ ID NO: 8256816 - DNA, 22 bp, Homo sapiens
tctgcagggcccttggctcctg

SEQ ID NO: 8256817 - DNA, 22 bp, Homo sapiens
tctgcagggcccttggctcctg

SEQ ID NO: 8256818 - DNA, 22 bp, Homo sapiens
tctgcagggcccttggctcctg

SEQ ID NO: 8256819 - DNA, 17 bp, Homo sapiens
tctgcagggggccgtgt

SEQ ID NO: 8256820 - DNA, 17 bp, Homo sapiens
tctgcagggggccgtgt

SEQ ID NO: 8256821 - DNA, 22 bp, Homo sapiens
tctgcagggtcccagcctcagc

SEQ ID NO: 8256822 - DNA, 22 bp, Homo sapiens
tctgcaggtaagcgttcttgga

SEQ ID NO: 8256823 - DNA, 22 bp, Homo sapiens
tctgcagggtcccagcctcagc

SEQ ID NO: 8256824 - DNA, 22 bp, Homo sapiens
tctgcaggtagagctcaggaat

SEQ ID NO: 8256825 - DNA, 22 bp, Homo sapiens
tctgcaggcttggagtggcagc

SEQ ID NO: 8256826 - DNA, 22 bp, Homo sapiens
tctgcaggcttataggatgggt

SEQ ID NO: 8256827 - DNA, 22 bp, Homo sapiens
tctgcaggcttggagtggcagc

SEQ ID NO: 8256828 - DNA, 22 bp, Homo sapiens
tctgcaggcttggagtggcagc

SEQ ID NO: 8256829 - DNA, 22 bp, Homo sapiens
tctgcagggatgtgaggggtga

SEQ ID NO: 8256830 - DNA, 22 bp, Homo sapiens
tctgcaggctctagatgaggtt

SEQ ID NO: 8256831 - DNA, 22 bp, Homo sapiens
tctgcaggctgtacaggaagca

SEQ ID NO: 8256832 - DNA, 22 bp, Homo sapiens
tctgcaggcttataggatgggt

SEQ ID NO: 8256833 - DNA, 22 bp, Homo sapiens
tctgcatggagaggagatgcta

SEQ ID NO: 8256834 - DNA, 19 bp, Homo sapiens
tctgcatggcaggaagaga

SEQ ID NO: 8256835 - DNA, 22 bp, Homo sapiens
tctgcattacatgccatagaca

SEQ ID NO: 8256836 - DNA, 22 bp, Homo sapiens
tctgcatttttaacaagatccc

SEQ ID NO: 8256837 - DNA, 21 bp, Homo sapiens
tctgcattttagcaagatctc

SEQ ID NO: 8256838 - DNA, 22 bp, Homo sapiens
tctgcatgatgaacaaatgagc

SEQ ID NO: 8256839 - DNA, 22 bp, Homo sapiens
tctgcatgatgaacaaatgagc

SEQ ID NO: 8256840 - DNA, 22 bp, Homo sapiens
tctgcaggtgggcccctagaat

SEQ ID NO: 8256841 - DNA, 22 bp, Homo sapiens
tctgcaggtcacgctccagcct

SEQ ID NO: 8256842 - DNA, 22 bp, Homo sapiens
tctgcaggtcacgctccagcct

SEQ ID NO: 8256843 - DNA, 22 bp, Homo sapiens
tctgcaggtcacgctccagcct

SEQ ID NO: 8256844 - DNA, 22 bp, Homo sapiens
tctgcaggtgttggaagggtca

SEQ ID NO: 8256845 - DNA, 22 bp, Homo sapiens
tctgcagcttgcacaggcaggc

SEQ ID NO: 8256846 - DNA, 22 bp, Homo sapiens
tctgcagcttcttgccagagag

SEQ ID NO: 8256847 - DNA, 22 bp, Homo sapiens
tctgcagcttcttgccagagag

SEQ ID NO: 8256848 - DNA, 22 bp, Homo sapiens
tctgcagcttactttcacatga

SEQ ID NO: 8256849 - DNA, 22 bp, Homo sapiens
tctgcagcgtgcaggctggtgc

SEQ ID NO: 8256850 - DNA, 22 bp, Homo sapiens
tctgcagcttgcacaggcaggc

SEQ ID NO: 8256851 - DNA, 22 bp, Homo sapiens
tctgcaggaaaaaagtgcctgg

SEQ ID NO: 8256852 - DNA, 22 bp, Homo sapiens
tctgcaggaaaaaagtgcctgg

SEQ ID NO: 8256853 - DNA, 22 bp, Homo sapiens
tctgcagctttttggtggggtg

SEQ ID NO: 8256854 - DNA, 18 bp, Homo sapiens
tctgcaggacctcagggc

SEQ ID NO: 8256855 - DNA, 22 bp, Homo sapiens
tctgcaggaagctggcggctga

SEQ ID NO: 8256856 - DNA, 22 bp, Homo sapiens
tctgcaggagagtgccctagag

SEQ ID NO: 8256857 - DNA, 22 bp, Homo sapiens
tctgcaggagagtgccctagag

SEQ ID NO: 8256858 - DNA, 18 bp, Homo sapiens
tctgcaggacctcagggc

SEQ ID NO: 8256859 - DNA, 22 bp, Homo sapiens
tctgcaggactgaggcctgttt

SEQ ID NO: 8256860 - DNA, 22 bp, Homo sapiens
tctgcaggagcagggcgtggag

SEQ ID NO: 8256861 - DNA, 22 bp, Homo sapiens
tctgcaggagagtgccctagag

SEQ ID NO: 8256862 - DNA, 22 bp, Homo sapiens
tctgcaggagcagggcgtggag

SEQ ID NO: 8256863 - DNA, 22 bp, Homo sapiens
tctgcaggaggctggctgcagg

SEQ ID NO: 8256864 - DNA, 22 bp, Homo sapiens
tctgcaggaggctggctgcagg

SEQ ID NO: 8256865 - DNA, 22 bp, Homo sapiens
tctgcaggaggctggctgcagg

SEQ ID NO: 8256866 - DNA, 22 bp, Homo sapiens
tctgcaggatcagagccagagg

SEQ ID NO: 8256867 - DNA, 22 bp, Homo sapiens
tctgcaggatcagagccagagg

SEQ ID NO: 8256868 - DNA, 22 bp, Homo sapiens
tctgcaggatcagagccagagg

SEQ ID NO: 8256869 - DNA, 22 bp, Homo sapiens
tctgcaggatgcaaagtgtaca

SEQ ID NO: 8256870 - DNA, 22 bp, Homo sapiens
tctgcaggatgcaaagtgtaca

SEQ ID NO: 8256871 - DNA, 22 bp, Homo sapiens
tctgcaggcatttttggttgtc

SEQ ID NO: 8256872 - DNA, 22 bp, Homo sapiens
tctgcaggatggatgctcagaa

SEQ ID NO: 8256873 - DNA, 22 bp, Homo sapiens
tctgcaggcctcgacaaggcca

SEQ ID NO: 8256874 - DNA, 22 bp, Homo sapiens
tctgcaggatggatgctcagaa

SEQ ID NO: 8256875 - DNA, 22 bp, Homo sapiens
tctgcaggcctcgacaaggcca

SEQ ID NO: 8256876 - DNA, 22 bp, Homo sapiens
tctgcaggctctagatgaggtt

SEQ ID NO: 8256877 - DNA, 22 bp, Homo sapiens
tctgcacaggcgtaggttgact

SEQ ID NO: 8256878 - DNA, 22 bp, Homo sapiens
tctgcacccacgtaccttggct

SEQ ID NO: 8256879 - DNA, 22 bp, Homo sapiens
tctgcacattttaccaatactc

SEQ ID NO: 8256880 - DNA, 22 bp, Homo sapiens
tctgcacatgtagtaaatatta

SEQ ID NO: 8256881 - DNA, 22 bp, Homo sapiens
tctgcacaaaactgtcgcagaa

SEQ ID NO: 8256882 - DNA, 22 bp, Homo sapiens
tctgcaagtagatgacagtgag

SEQ ID NO: 8256883 - DNA, 22 bp, Homo sapiens
tctgcaaggggttctttaggcc

SEQ ID NO: 8256884 - DNA, 22 bp, Homo sapiens
tctgcaaggttcaggaaacctt

SEQ ID NO: 8256885 - DNA, 22 bp, Homo sapiens
tctgcaagggcacagccaaccc

SEQ ID NO: 8256886 - DNA, 22 bp, Homo sapiens
tctgcaagtttatcacttggga

SEQ ID NO: 8256887 - DNA, 19 bp, Homo sapiens
tctgcaagtgtcagaggcg

SEQ ID NO: 8256888 - DNA, 22 bp, Homo sapiens
tctgcaagtgacccgggcccag

SEQ ID NO: 8256889 - DNA, 20 bp, Homo sapiens
tctgcagcacttgacaatgt

SEQ ID NO: 8256890 - DNA, 20 bp, Homo sapiens
tctgcagcacttgacaatgt

SEQ ID NO: 8256891 - DNA, 22 bp, Homo sapiens
tctgcagccagaggcatgaaaa

SEQ ID NO: 8256892 - DNA, 22 bp, Homo sapiens
tctgcactcctgtttcacctgg

SEQ ID NO: 8256893 - DNA, 22 bp, Homo sapiens
tctgcactgggagcatgtctgg

SEQ ID NO: 8256894 - DNA, 20 bp, Homo sapiens
tctgcacctccttccaatca

SEQ ID NO: 8256895 - DNA, 18 bp, Homo sapiens
tctgcactcctgagagag

SEQ ID NO: 8256896 - DNA, 21 bp, Homo sapiens
tctgcaccccagcctgagtga

SEQ ID NO: 8256897 - DNA, 22 bp, Homo sapiens
tctgcaccctgacctctgtttc

SEQ ID NO: 8256898 - DNA, 22 bp, Homo sapiens
tctgcctgcggctgcaggtggc

SEQ ID NO: 8256899 - DNA, 22 bp, Homo sapiens
tctgcctgcggctgcaggtggc

SEQ ID NO: 8256900 - DNA, 22 bp, Homo sapiens
tctgcctgcggctgcaggtggc

SEQ ID NO: 8256901 - DNA, 22 bp, Homo sapiens
tctgcctgctaactcctgcacc

SEQ ID NO: 8256902 - DNA, 22 bp, Homo sapiens
tctgcctgctaactcctgcacc

SEQ ID NO: 8256903 - DNA, 22 bp, Homo sapiens
tctgcctgctaactcctgcacc

SEQ ID NO: 8256904 - DNA, 22 bp, Homo sapiens
tctgcctgctaactcctgcacc

SEQ ID NO: 8256905 - DNA, 22 bp, Homo sapiens
tctgcctggatgatggcagggc

SEQ ID NO: 8256906 - DNA, 22 bp, Homo sapiens
tctgcctggatgatggcagggc

SEQ ID NO: 8256907 - DNA, 22 bp, Homo sapiens
tctgcctggaccctggtgagct

SEQ ID NO: 8256908 - DNA, 22 bp, Homo sapiens
tctgcctggagagttcttctct

SEQ ID NO: 8256909 - DNA, 22 bp, Homo sapiens
tctgcctggagagttcttctct

SEQ ID NO: 8256910 - DNA, 19 bp, Homo sapiens
tctgcctgcttgtaggggc

SEQ ID NO: 8256911 - DNA, 19 bp, Homo sapiens
tctgcctgcttgtaggggc

SEQ ID NO: 8256912 - DNA, 22 bp, Homo sapiens
tctgcctgggtgtggagcagag

SEQ ID NO: 8256913 - DNA, 22 bp, Homo sapiens
tctgcctgggtgtggagcagag

SEQ ID NO: 8256914 - DNA, 22 bp, Homo sapiens
tctgcctgtaatatttggagaa

SEQ ID NO: 8256915 - DNA, 22 bp, Homo sapiens
tctgcctgtagtcccacacctc

SEQ ID NO: 8256916 - DNA, 22 bp, Homo sapiens
tctgcctggcggactcccggaa

SEQ ID NO: 8256917 - DNA, 22 bp, Homo sapiens
tctgcctggcggactcccggaa

SEQ ID NO: 8256918 - DNA, 22 bp, Homo sapiens
tctgcctggctcatggcagtga

SEQ ID NO: 8256919 - DNA, 22 bp, Homo sapiens
tctgcctggctcatggcagtga

SEQ ID NO: 8256920 - DNA, 22 bp, Homo sapiens
tctgcctggctcatggcagtga

SEQ ID NO: 8256921 - DNA, 22 bp, Homo sapiens
tctgcctggatgatggcagggc

SEQ ID NO: 8256922 - DNA, 22 bp, Homo sapiens
tctgcctggattccattctcca

SEQ ID NO: 8256923 - DNA, 22 bp, Homo sapiens
tctgcctggattccattctcca

SEQ ID NO: 8256924 - DNA, 22 bp, Homo sapiens
tctgcctggcctggagggcaca

SEQ ID NO: 8256925 - DNA, 22 bp, Homo sapiens
tctgcctggcctggagggcaca

SEQ ID NO: 8256926 - DNA, 22 bp, Homo sapiens
tctgcctggattttggaaagct

SEQ ID NO: 8256927 - DNA, 22 bp, Homo sapiens
tctgctcagggagggtcactac

SEQ ID NO: 8256928 - DNA, 22 bp, Homo sapiens
tctgctcagggagggtcactac

SEQ ID NO: 8256929 - DNA, 22 bp, Homo sapiens
tctgctcagccgatctgctccg

SEQ ID NO: 8256930 - DNA, 22 bp, Homo sapiens
tctgctcagccgatctgctccg

SEQ ID NO: 8256931 - DNA, 20 bp, Homo sapiens
tctgctcagccctcagtggc

SEQ ID NO: 8256932 - DNA, 22 bp, Homo sapiens
tctgctcagcatccctctgaga

SEQ ID NO: 8256933 - DNA, 22 bp, Homo sapiens
tctgctcaggttacctagctag

SEQ ID NO: 8256934 - DNA, 22 bp, Homo sapiens
tctgctcaggttacctagctag

SEQ ID NO: 8256935 - DNA, 22 bp, Homo sapiens
tctgctcaggttacctagctag

SEQ ID NO: 8256936 - DNA, 22 bp, Homo sapiens
tctgctctagttgcttcctgcc

SEQ ID NO: 8256937 - DNA, 22 bp, Homo sapiens
tctgctcaggttacctagctag

SEQ ID NO: 8256938 - DNA, 22 bp, Homo sapiens
tctgctcagtgcttatctctaa

SEQ ID NO: 8256939 - DNA, 22 bp, Homo sapiens
tctgctcataccccatggtttc

SEQ ID NO: 8256940 - DNA, 22 bp, Homo sapiens
tctgctcaccctcagctgatgc

SEQ ID NO: 8256941 - DNA, 22 bp, Homo sapiens
tctgctcacgtgtattctccat

SEQ ID NO: 8256942 - DNA, 22 bp, Homo sapiens
tctgctcagcatccctctgaga

SEQ ID NO: 8256943 - DNA, 22 bp, Homo sapiens
tctgccttgatggcattgagaa

SEQ ID NO: 8256944 - DNA, 22 bp, Homo sapiens
tctgccttgaggtcctcagctc

SEQ ID NO: 8256945 - DNA, 22 bp, Homo sapiens
tctgccttctatcttttgtctg

SEQ ID NO: 8256946 - DNA, 22 bp, Homo sapiens
tctgccttcgctgctccctgaa

SEQ ID NO: 8256947 - DNA, 22 bp, Homo sapiens
tctgccttcgctgctccctgaa

SEQ ID NO: 8256948 - DNA, 22 bp, Homo sapiens
tctgccttgaggtcctcagctc

SEQ ID NO: 8256949 - DNA, 22 bp, Homo sapiens
tctgccttcttttagtcatctt

SEQ ID NO: 8256950 - DNA, 22 bp, Homo sapiens
tctgcctgttcccgattccatg

SEQ ID NO: 8256951 - DNA, 22 bp, Homo sapiens
tctgccttccccataatctgat

SEQ ID NO: 8256952 - DNA, 22 bp, Homo sapiens
tctgccttcgctgctccctgaa

SEQ ID NO: 8256953 - DNA, 22 bp, Homo sapiens
tctgccttccccataatctgat

SEQ ID NO: 8256954 - DNA, 20 bp, Homo sapiens
tctgccttatgaccttcgcc

SEQ ID NO: 8256955 - DNA, 20 bp, Homo sapiens
tctgccttagggggagcctc

SEQ ID NO: 8256956 - DNA, 22 bp, Homo sapiens
tctgccttagcaattgtcaagg

SEQ ID NO: 8256957 - DNA, 22 bp, Homo sapiens
tctgcctgttcaagtcttctag

SEQ ID NO: 8256958 - DNA, 22 bp, Homo sapiens
tctgcctgttcaagtcttctag

SEQ ID NO: 8256959 - DNA, 22 bp, Homo sapiens
tctgcctgttcaagtcttctag

SEQ ID NO: 8256960 - DNA, 22 bp, Homo sapiens
tctgcctgttcaagtcttctag

SEQ ID NO: 8256961 - DNA, 22 bp, Homo sapiens
tctgcctgtgctgtgttttcat

SEQ ID NO: 8256962 - DNA, 22 bp, Homo sapiens
tctgcctgtggtggaggaagtt

SEQ ID NO: 8256963 - DNA, 22 bp, Homo sapiens
tctgcctgtggtggaggaagtt

SEQ ID NO: 8256964 - DNA, 22 bp, Homo sapiens
tctgcctgtggatacatgctct

SEQ ID NO: 8256965 - DNA, 22 bp, Homo sapiens
tctgcctgagggagctgaggaa

SEQ ID NO: 8256966 - DNA, 18 bp, Homo sapiens
tctgcctgcagggcatct

SEQ ID NO: 8256967 - DNA, 18 bp, Homo sapiens
tctgcctgcagggcatct

SEQ ID NO: 8256968 - DNA, 22 bp, Homo sapiens
tctgcctgaggactgacaccag

SEQ ID NO: 8256969 - DNA, 22 bp, Homo sapiens
tctgcctgaggactgacaccag

SEQ ID NO: 8256970 - DNA, 22 bp, Homo sapiens
tctgcctgagggagctgaggaa

SEQ ID NO: 8256971 - DNA, 22 bp, Homo sapiens
tctgcctgagggagctgaggaa

SEQ ID NO: 8256972 - DNA, 22 bp, Homo sapiens
tctgcctgagggagctgaggaa

SEQ ID NO: 8256973 - DNA, 22 bp, Homo sapiens
tctgcctgccagtctggtcctc

SEQ ID NO: 8256974 - DNA, 22 bp, Homo sapiens
tctgcctgccagtctggtcctc

SEQ ID NO: 8256975 - DNA, 22 bp, Homo sapiens
tctgcctgcgctcacggggccg

SEQ ID NO: 8256976 - DNA, 22 bp, Homo sapiens
tctgcctgccgagaacacctac

SEQ ID NO: 8256977 - DNA, 22 bp, Homo sapiens
tctgcctgcagtgtggcagggc

SEQ ID NO: 8256978 - DNA, 22 bp, Homo sapiens
tctgcctgccagtctggtcctc

SEQ ID NO: 8256979 - DNA, 22 bp, Homo sapiens
tctgcctgcagtgtggcagggc

SEQ ID NO: 8256980 - DNA, 22 bp, Homo sapiens
tctgcctgcagtgtggcagggc

SEQ ID NO: 8256981 - DNA, 21 bp, Homo sapiens
tctgcctgagactttgctggt

SEQ ID NO: 8256982 - DNA, 21 bp, Homo sapiens
tctgcctgagactttgctggt

SEQ ID NO: 8256983 - DNA, 22 bp, Homo sapiens
tctgccgtgcgaggtcccacca

SEQ ID NO: 8256984 - DNA, 22 bp, Homo sapiens
tctgccgtgcgaggtcccacca

SEQ ID NO: 8256985 - DNA, 17 bp, Homo sapiens
tctgccgactgccagct

SEQ ID NO: 8256986 - DNA, 22 bp, Homo sapiens
tctgccgactataagccaacta

SEQ ID NO: 8256987 - DNA, 22 bp, Homo sapiens
tctgccctggggtcagcctcca

SEQ ID NO: 8256988 - DNA, 22 bp, Homo sapiens
tctgcccttggctctcttgttg

SEQ ID NO: 8256989 - DNA, 22 bp, Homo sapiens
tctgccctgccattcactggaa

SEQ ID NO: 8256990 - DNA, 22 bp, Homo sapiens
tctgccctggggtcagcctcca

SEQ ID NO: 8256991 - DNA, 18 bp, Homo sapiens
tctgccctgccattcact

SEQ ID NO: 8256992 - DNA, 22 bp, Homo sapiens
tctgcccactgctctgctgccc

SEQ ID NO: 8256993 - DNA, 22 bp, Homo sapiens
tctgcccaggacacctgccact

SEQ ID NO: 8256994 - DNA, 22 bp, Homo sapiens
tctgcccagccagacccaaggt

SEQ ID NO: 8256995 - DNA, 22 bp, Homo sapiens
tctgcccagccagacccaaggt

SEQ ID NO: 8256996 - DNA, 22 bp, Homo sapiens
tctgcccacagtccaatagttg

SEQ ID NO: 8256997 - DNA, 20 bp, Homo sapiens
tctgcccaccccggctccca

SEQ ID NO: 8256998 - DNA, 20 bp, Homo sapiens
tctgcccaccccggctccca

SEQ ID NO: 8256999 - DNA, 22 bp, Homo sapiens
tctgcccaggaggtcccatggg

SEQ ID NO: 8257000 - DNA, 22 bp, Homo sapiens
tctgcccaggaggtcccatggg

SEQ ID NO: 8257001 - DNA, 22 bp, Homo sapiens
tctgcccaggacacctgccact

SEQ ID NO: 8257002 - DNA, 22 bp, Homo sapiens
tctgcccaggacacctgccact

SEQ ID NO: 8257003 - DNA, 22 bp, Homo sapiens
tctgcccagggacaggacacag

SEQ ID NO: 8257004 - DNA, 22 bp, Homo sapiens
tctgcccagggacccacaggga

SEQ ID NO: 8257005 - DNA, 22 bp, Homo sapiens
tctgcccagggacccacaggga

SEQ ID NO: 8257006 - DNA, 19 bp, Homo sapiens
tctgcccagttgtctgccc

SEQ ID NO: 8257007 - DNA, 21 bp, Homo sapiens
tctgccctccaggagctcata

SEQ ID NO: 8257008 - DNA, 21 bp, Homo sapiens
tctgccctccaggagctcata

SEQ ID NO: 8257009 - DNA, 22 bp, Homo sapiens
tctgccctcattgctgcctgga

SEQ ID NO: 8257010 - DNA, 22 bp, Homo sapiens
tctgccctcattgctgcctgga

SEQ ID NO: 8257011 - DNA, 22 bp, Homo sapiens
tctgccctcattgctgcctgga

SEQ ID NO: 8257012 - DNA, 18 bp, Homo sapiens
tctgccccagccgcactg

SEQ ID NO: 8257013 - DNA, 22 bp, Homo sapiens
tctgccctaattcagtgcttag

SEQ ID NO: 8257014 - DNA, 22 bp, Homo sapiens
tctgcccattcttagagtctag

SEQ ID NO: 8257015 - DNA, 22 bp, Homo sapiens
tctgcccagtttgtgctcaggt

SEQ ID NO: 8257016 - DNA, 22 bp, Homo sapiens
tctgatttctcttgtggatgct

SEQ ID NO: 8257017 - DNA, 22 bp, Homo sapiens
tctgcaaaagtgttcataaaga

SEQ ID NO: 8257018 - DNA, 22 bp, Homo sapiens
tctgcaaatattagcttagaca

SEQ ID NO: 8257019 - DNA, 22 bp, Homo sapiens
tctgcaacagtgccctgtaaat

SEQ ID NO: 8257020 - DNA, 22 bp, Homo sapiens
tctgcaagctaaggaagcatct

SEQ ID NO: 8257021 - DNA, 22 bp, Homo sapiens
tctgcaagctcagttctgactt

SEQ ID NO: 8257022 - DNA, 22 bp, Homo sapiens
tctgcaagcgtcacatgattct

SEQ ID NO: 8257023 - DNA, 22 bp, Homo sapiens
tctgcaagcgtcacatgattct

SEQ ID NO: 8257024 - DNA, 22 bp, Homo sapiens
tctgcaagatggtcttagaggt

SEQ ID NO: 8257025 - DNA, 23 bp, Homo sapiens
tctgcaagataatgaagatgata

SEQ ID NO: 8257026 - DNA, 22 bp, Homo sapiens
tctgcaagagcttcaaggtaga

SEQ ID NO: 8257027 - DNA, 22 bp, Homo sapiens
tctgcaacattcctctccccac

SEQ ID NO: 8257028 - DNA, 22 bp, Homo sapiens
tctgcaagatcattaaagcaga

SEQ ID NO: 8257029 - DNA, 23 bp, Homo sapiens
tctgcaagataatgaagatgata

SEQ ID NO: 8257030 - DNA, 22 bp, Homo sapiens
tctgcaacattcctctccccac

SEQ ID NO: 8257031 - DNA, 22 bp, Homo sapiens
tctgcaacattcctctccccac

SEQ ID NO: 8257032 - DNA, 22 bp, Homo sapiens
tctgcaacagtgccctgtaaat

SEQ ID NO: 8257033 - DNA, 22 bp, Homo sapiens
tctgattacttgagttatttag

SEQ ID NO: 8257034 - DNA, 22 bp, Homo sapiens
tctgatgttgtgacatcacttc

SEQ ID NO: 8257035 - DNA, 22 bp, Homo sapiens
tctgatgttgtgacatcacttc

SEQ ID NO: 8257036 - DNA, 22 bp, Homo sapiens
tctgattagagcattcttgagt

SEQ ID NO: 8257037 - DNA, 22 bp, Homo sapiens
tctgattagagcattcttgagt

SEQ ID NO: 8257038 - DNA, 22 bp, Homo sapiens
tctgattcattcatgtgcacca

SEQ ID NO: 8257039 - DNA, 22 bp, Homo sapiens
tctgattagctccatttgctaa

SEQ ID NO: 8257040 - DNA, 22 bp, Homo sapiens
tctgattcattcatgtgcacca

SEQ ID NO: 8257041 - DNA, 22 bp, Homo sapiens
tctgattccagtgaccctagga

SEQ ID NO: 8257042 - DNA, 23 bp, Homo sapiens
tctgatgttctcttatgctgtag

SEQ ID NO: 8257043 - DNA, 22 bp, Homo sapiens
tctgatgttgcttctgcagaac

SEQ ID NO: 8257044 - DNA, 22 bp, Homo sapiens
tctgatgttgtgacatcacttc

SEQ ID NO: 8257045 - DNA, 22 bp, Homo sapiens
tctgatgtggcagctgcatcta

SEQ ID NO: 8257046 - DNA, 22 bp, Homo sapiens
tctgatgtctgaaatgctcttg

SEQ ID NO: 8257047 - DNA, 21 bp, Homo sapiens
tctgatgtgtttaatggtggg

SEQ ID NO: 8257048 - DNA, 22 bp, Homo sapiens
tctgatgtgtttaagaaagaag

SEQ ID NO: 8257049 - DNA, 21 bp, Homo sapiens
tctgatggtagatgagatgtg

SEQ ID NO: 8257050 - DNA, 21 bp, Homo sapiens
tctgatggtagatgagatgtg

SEQ ID NO: 8257051 - DNA, 21 bp, Homo sapiens
tctgatggtagatgagatgtg

SEQ ID NO: 8257052 - DNA, 21 bp, Homo sapiens
tctgatggtagatgagatgtg

SEQ ID NO: 8257053 - DNA, 21 bp, Homo sapiens
tctgatggtagatgagatgtg

SEQ ID NO: 8257054 - DNA, 21 bp, Homo sapiens
tctgatggtagatgagatgtg

SEQ ID NO: 8257055 - DNA, 21 bp, Homo sapiens
tctgatggtagatgagatgtg

SEQ ID NO: 8257056 - DNA, 22 bp, Homo sapiens
tctgatgcaatgtaagtcttgg

SEQ ID NO: 8257057 - DNA, 22 bp, Homo sapiens
tctgaggttattgtctgccatt

SEQ ID NO: 8257058 - DNA, 22 bp, Homo sapiens
tctgaggttactgctttgtaga

SEQ ID NO: 8257059 - DNA, 22 bp, Homo sapiens
tctgaggttaatcctgctgcat

SEQ ID NO: 8257060 - DNA, 22 bp, Homo sapiens
tctgaggttaatcctgctgcat

SEQ ID NO: 8257061 - DNA, 22 bp, Homo sapiens
tctgaggtgtcacaaggccagg

SEQ ID NO: 8257062 - DNA, 23 bp, Homo sapiens
tctgaggtggctcttgctttgaa

SEQ ID NO: 8257063 - DNA, 23 bp, Homo sapiens
tctgaggtggctcttgctttgaa

SEQ ID NO: 8257064 - DNA, 22 bp, Homo sapiens
tctgaggtggacgatggagcct

SEQ ID NO: 8257065 - DNA, 22 bp, Homo sapiens
tctgaggtggacgatggagcct

SEQ ID NO: 8257066 - DNA, 22 bp, Homo sapiens
tctgaggtgtagctgggcttca

SEQ ID NO: 8257067 - DNA, 22 bp, Homo sapiens
tctgaggtgtagctgggcttca

SEQ ID NO: 8257068 - DNA, 22 bp, Homo sapiens
tctgaggtgtagctgggcttca

SEQ ID NO: 8257069 - DNA, 22 bp, Homo sapiens
tctgaggtggggctggagcatt

SEQ ID NO: 8257070 - DNA, 17 bp, Homo sapiens
tctgaggtgaggatgca

SEQ ID NO: 8257071 - DNA, 17 bp, Homo sapiens
tctgaggtgaggatgca

SEQ ID NO: 8257072 - DNA, 22 bp, Homo sapiens
tctgaggtctcatgacttgcat

SEQ ID NO: 8257073 - DNA, 19 bp, Homo sapiens
tctgaggtggaactggggg

SEQ ID NO: 8257074 - DNA, 18 bp, Homo sapiens
tctgaggtggacgaggag

SEQ ID NO: 8257075 - DNA, 22 bp, Homo sapiens
tctgaggtggacgatggagcct

SEQ ID NO: 8257076 - DNA, 19 bp, Homo sapiens
tctgaggtggaactggggg

SEQ ID NO: 8257077 - DNA, 22 bp, Homo sapiens
tctgaggtcctgtgatttctct

SEQ ID NO: 8257078 - DNA, 22 bp, Homo sapiens
tctgaggtctatgactttgctt

SEQ ID NO: 8257079 - DNA, 22 bp, Homo sapiens
tctgaggtctcatgacttgcat

SEQ ID NO: 8257080 - DNA, 22 bp, Homo sapiens
tctgaggtctatgactttgctt

SEQ ID NO: 8257081 - DNA, 22 bp, Homo sapiens
tctgaggtcctactataagtgg

SEQ ID NO: 8257082 - DNA, 22 bp, Homo sapiens
tctgaggtcctactataagtgg

SEQ ID NO: 8257083 - DNA, 22 bp, Homo sapiens
tctgaggtcctgtgatttctct

SEQ ID NO: 8257084 - DNA, 23 bp, Homo sapiens
tctgaggtccaccagtttgcaga

SEQ ID NO: 8257085 - DNA, 23 bp, Homo sapiens
tctgaggtccaccagtttgcaga

SEQ ID NO: 8257086 - DNA, 22 bp, Homo sapiens
tctgaggtcataaagcaacttt

SEQ ID NO: 8257087 - DNA, 22 bp, Homo sapiens
tctgaggtcattccaaggacat

SEQ ID NO: 8257088 - DNA, 22 bp, Homo sapiens
tctgaggtcattccaaggacat

SEQ ID NO: 8257089 - DNA, 22 bp, Homo sapiens
tctgaggtcagtgctgcagtta

SEQ ID NO: 8257090 - DNA, 20 bp, Homo sapiens
tctgaggtatgatagggtct

SEQ ID NO: 8257091 - DNA, 22 bp, Homo sapiens
tctgaggtcagtgctgcagtta

SEQ ID NO: 8257092 - DNA, 22 bp, Homo sapiens
tctgaggtcagtgctgcagtta

SEQ ID NO: 8257093 - DNA, 22 bp, Homo sapiens
tctgagggtgggagaaggagct

SEQ ID NO: 8257094 - DNA, 19 bp, Homo sapiens
tctgagggtccagatgcat

SEQ ID NO: 8257095 - DNA, 22 bp, Homo sapiens
tctgaggggctggaagggctgc

SEQ ID NO: 8257096 - DNA, 22 bp, Homo sapiens
tctgagggctgtactatgcacg

SEQ ID NO: 8257097 - DNA, 22 bp, Homo sapiens
tctgagggttgtagagagggac

SEQ ID NO: 8257098 - DNA, 22 bp, Homo sapiens
tctgaggtaccagctggtttat

SEQ ID NO: 8257099 - DNA, 22 bp, Homo sapiens
tctgaggtaccagctggtttat

SEQ ID NO: 8257100 - DNA, 22 bp, Homo sapiens
tctgaggtcacagatttcaaga

SEQ ID NO: 8257101 - DNA, 22 bp, Homo sapiens
tctgaggtcacagatttcaaga

SEQ ID NO: 8257102 - DNA, 20 bp, Homo sapiens
tctgaggtatgatagggtct

SEQ ID NO: 8257103 - DNA, 22 bp, Homo sapiens
tctgagggtgggagaaggagct

SEQ ID NO: 8257104 - DNA, 22 bp, Homo sapiens
tctgaggctgcatctatgtgac

SEQ ID NO: 8257105 - DNA, 22 bp, Homo sapiens
tctgaggctgcatctatgtgac

SEQ ID NO: 8257106 - DNA, 20 bp, Homo sapiens
tctgaggctgagctctactt

SEQ ID NO: 8257107 - DNA, 20 bp, Homo sapiens
tctgaggctgagcccagcgt

SEQ ID NO: 8257108 - DNA, 20 bp, Homo sapiens
tctgaggctgagctctactt

SEQ ID NO: 8257109 - DNA, 22 bp, Homo sapiens
tctgaggctatgttcaggctaa

SEQ ID NO: 8257110 - DNA, 22 bp, Homo sapiens
tctgaggctatgttcaggctaa

SEQ ID NO: 8257111 - DNA, 22 bp, Homo sapiens
tctgaggctgaatggactccgt

SEQ ID NO: 8257112 - DNA, 19 bp, Homo sapiens
tctgagggagcacgaaggc

SEQ ID NO: 8257113 - DNA, 19 bp, Homo sapiens
tctgaggcttctccccttg

SEQ ID NO: 8257114 - DNA, 22 bp, Homo sapiens
tctgaggcttcagactgtactg

SEQ ID NO: 8257115 - DNA, 22 bp, Homo sapiens
tctgaggcttcagactgtactg

SEQ ID NO: 8257116 - DNA, 22 bp, Homo sapiens
tctgaggctgtctctgggctcc

SEQ ID NO: 8257117 - DNA, 22 bp, Homo sapiens
tctgaggctgtctctgggctcc

SEQ ID NO: 8257118 - DNA, 22 bp, Homo sapiens
tctgagcttttattatcaacct

SEQ ID NO: 8257119 - DNA, 22 bp, Homo sapiens
tctgagcttttattatcaacct

SEQ ID NO: 8257120 - DNA, 22 bp, Homo sapiens
tctgagctttcttgtgctcaag

SEQ ID NO: 8257121 - DNA, 22 bp, Homo sapiens
tctgagctttcttgtgctcaag

SEQ ID NO: 8257122 - DNA, 22 bp, Homo sapiens
tctgagctttcttgtgctcaag

SEQ ID NO: 8257123 - DNA, 22 bp, Homo sapiens
tctgagctttagctgggatttt

SEQ ID NO: 8257124 - DNA, 22 bp, Homo sapiens
tctgagctttagctgggatttt

SEQ ID NO: 8257125 - DNA, 22 bp, Homo sapiens
tctgagcttctgcctgctgcaa

SEQ ID NO: 8257126 - DNA, 22 bp, Homo sapiens
tctgaggaaaagaggaggtagc

SEQ ID NO: 8257127 - DNA, 22 bp, Homo sapiens
tctgaggaaagagagtgggatg

SEQ ID NO: 8257128 - DNA, 22 bp, Homo sapiens
tctgaggaaaagttcttgtcac

SEQ ID NO: 8257129 - DNA, 22 bp, Homo sapiens
tctgaggaaagagagtgggatg

SEQ ID NO: 8257130 - DNA, 22 bp, Homo sapiens
tctgaggaaagagagtgggatg

SEQ ID NO: 8257131 - DNA, 22 bp, Homo sapiens
tctgaggaagcagcaggaagtg

SEQ ID NO: 8257132 - DNA, 22 bp, Homo sapiens
tctgaggccctaccctgagcct

SEQ ID NO: 8257133 - DNA, 22 bp, Homo sapiens
tctgaggacaaactgcatgctg

SEQ ID NO: 8257134 - DNA, 22 bp, Homo sapiens
tctgaggaattctgcagtgaga

SEQ ID NO: 8257135 - DNA, 18 bp, Homo sapiens
tctgaggaatggaagagc

SEQ ID NO: 8257136 - DNA, 18 bp, Homo sapiens
tctgaggaatggaagagc

SEQ ID NO: 8257137 - DNA, 22 bp, Homo sapiens
tctgaggaataagaaggaagtg

SEQ ID NO: 8257138 - DNA, 22 bp, Homo sapiens
tctgaggaatcttgacacattt

SEQ ID NO: 8257139 - DNA, 22 bp, Homo sapiens
tctgaggctaagagacagaggc

SEQ ID NO: 8257140 - DNA, 22 bp, Homo sapiens
tctgaggctaagagacagaggc

SEQ ID NO: 8257141 - DNA, 22 bp, Homo sapiens
tctgaggctaagagacagaggc

SEQ ID NO: 8257142 - DNA, 22 bp, Homo sapiens
tctgaggccttggcagctaagg

SEQ ID NO: 8257143 - DNA, 22 bp, Homo sapiens
tctgaggccttgggacagaagt

SEQ ID NO: 8257144 - DNA, 22 bp, Homo sapiens
tctgaggcctagagaggggctt

SEQ ID NO: 8257145 - DNA, 17 bp, Homo sapiens
tctgaggcctctaggag

SEQ ID NO: 8257146 - DNA, 22 bp, Homo sapiens
tctgaggccctgcaggcagtgt

SEQ ID NO: 8257147 - DNA, 22 bp, Homo sapiens
tctgaggccctgcaggcagtgt

SEQ ID NO: 8257148 - DNA, 22 bp, Homo sapiens
tctgaggcctgaagcagcagag

SEQ ID NO: 8257149 - DNA, 22 bp, Homo sapiens
tctgaggccttcagcatgaatc

SEQ ID NO: 8257150 - DNA, 22 bp, Homo sapiens
tctgagcttactcagggataca

SEQ ID NO: 8257151 - DNA, 22 bp, Homo sapiens
tctgagcttccctctgaggcag

SEQ ID NO: 8257152 - DNA, 22 bp, Homo sapiens
tctgagcttactcagggataca

SEQ ID NO: 8257153 - DNA, 22 bp, Homo sapiens
tctgagcttctgcatttccaac

SEQ ID NO: 8257154 - DNA, 22 bp, Homo sapiens
tctgagctgtgagttgcttagg

SEQ ID NO: 8257155 - DNA, 23 bp, Homo sapiens
tctgagctgtcttttcagcagaa

SEQ ID NO: 8257156 - DNA, 23 bp, Homo sapiens
tctgagctgtcttttcagcagaa

SEQ ID NO: 8257157 - DNA, 23 bp, Homo sapiens
tctgagctgtcttttcagcagaa

SEQ ID NO: 8257158 - DNA, 22 bp, Homo sapiens
tctgagctgtaagtagacaagg

SEQ ID NO: 8257159 - DNA, 22 bp, Homo sapiens
tctgagctgtggccattcttcc

SEQ ID NO: 8257160 - DNA, 22 bp, Homo sapiens
tctgagctgtggccattcttcc

SEQ ID NO: 8257161 - DNA, 22 bp, Homo sapiens
tctgagctgctaggtatgcatt

SEQ ID NO: 8257162 - DNA, 22 bp, Homo sapiens
tctgagctgctaggtatgcatt

SEQ ID NO: 8257163 - DNA, 22 bp, Homo sapiens
tctgagctgctaggtatgcatt

SEQ ID NO: 8257164 - DNA, 22 bp, Homo sapiens
tctgagctggagcccatcacct

SEQ ID NO: 8257165 - DNA, 22 bp, Homo sapiens
tctgagctggagcccatcacct

SEQ ID NO: 8257166 - DNA, 22 bp, Homo sapiens
tctgagctgggtcttgacagct

SEQ ID NO: 8257167 - DNA, 22 bp, Homo sapiens
tctgagctgggtcttgacagct

SEQ ID NO: 8257168 - DNA, 22 bp, Homo sapiens
tctgagctgtaagtagacaagg

SEQ ID NO: 8257169 - DNA, 22 bp, Homo sapiens
tctgagctgggggcctggcatg

SEQ ID NO: 8257170 - DNA, 22 bp, Homo sapiens
tctgagctgggcacagaaggcg

SEQ ID NO: 8257171 - DNA, 22 bp, Homo sapiens
tctgagccgtatggcttggcta

SEQ ID NO: 8257172 - DNA, 22 bp, Homo sapiens
tctgagctaatcctgttgccga

SEQ ID NO: 8257173 - DNA, 22 bp, Homo sapiens
tctgagctaatcctgttgccga

SEQ ID NO: 8257174 - DNA, 22 bp, Homo sapiens
tctgagctacgatgcctgtcac

SEQ ID NO: 8257175 - DNA, 22 bp, Homo sapiens
tctgagctagaaagtatgccct

SEQ ID NO: 8257176 - DNA, 22 bp, Homo sapiens
tctgagctagtgatttataaga

SEQ ID NO: 8257177 - DNA, 22 bp, Homo sapiens
tctgagctatccagatagtatt

SEQ ID NO: 8257178 - DNA, 22 bp, Homo sapiens
tctgagctatgtaagacttgga

SEQ ID NO: 8257179 - DNA, 19 bp, Homo sapiens
tctgagctgatatgacatt

SEQ ID NO: 8257180 - DNA, 21 bp, Homo sapiens
tctgagctgagtcctctaggt

SEQ ID NO: 8257181 - DNA, 22 bp, Homo sapiens
tctgagctgcccctttactttg

SEQ ID NO: 8257182 - DNA, 22 bp, Homo sapiens
tctgagctgcagagtggggtgg

SEQ ID NO: 8257183 - DNA, 22 bp, Homo sapiens
tctgagctcaagtgacagttag

SEQ ID NO: 8257184 - DNA, 22 bp, Homo sapiens
tctgagctatgtaagacttgga

SEQ ID NO: 8257185 - DNA, 22 bp, Homo sapiens
tctgagctcaagtgacagttag

SEQ ID NO: 8257186 - DNA, 21 bp, Homo sapiens
tctgagctgagtcctctaggt

SEQ ID NO: 8257187 - DNA, 22 bp, Homo sapiens
tctgagctctatctgtgggaat

SEQ ID NO: 8257188 - DNA, 22 bp, Homo sapiens
tctgagctctatctgtgggaat

SEQ ID NO: 8257189 - DNA, 22 bp, Homo sapiens
tctgagcagggcagtgtccatg

SEQ ID NO: 8257190 - DNA, 22 bp, Homo sapiens
tctgagccaatttctgtgtcca

SEQ ID NO: 8257191 - DNA, 22 bp, Homo sapiens
tctgagccacagatgtcctgtt

SEQ ID NO: 8257192 - DNA, 22 bp, Homo sapiens
tctgagccacctgccagtgctg

SEQ ID NO: 8257193 - DNA, 22 bp, Homo sapiens
tctgagccataagagtacagga

SEQ ID NO: 8257194 - DNA, 22 bp, Homo sapiens
tctgagcccagtgagtctcgca

SEQ ID NO: 8257195 - DNA, 22 bp, Homo sapiens
tctgagcagatgctcgctctcc

SEQ ID NO: 8257196 - DNA, 22 bp, Homo sapiens
tctgagcactgggcagtcggtg

SEQ ID NO: 8257197 - DNA, 22 bp, Homo sapiens
tctgagatttgtatggtgagac

SEQ ID NO: 8257198 - DNA, 22 bp, Homo sapiens
tctgagaatggtggatgtggtg

SEQ ID NO: 8257199 - DNA, 22 bp, Homo sapiens
tctgaattttgatgtgcattga

SEQ ID NO: 8257200 - DNA, 22 bp, Homo sapiens
tctgaattttgatgtgcattga

SEQ ID NO: 8257201 - DNA, 22 bp, Homo sapiens
tctgacaatgaacaatctatag

SEQ ID NO: 8257202 - DNA, 22 bp, Homo sapiens
tctgacagctccaggcagcaat

SEQ ID NO: 8257203 - DNA, 19 bp, Homo sapiens
tctgacagccccagtcaac

SEQ ID NO: 8257204 - DNA, 22 bp, Homo sapiens
tctgacagggccaaacatgaca

SEQ ID NO: 8257205 - DNA, 22 bp, Homo sapiens
tctgacagttatataagcacca

SEQ ID NO: 8257206 - DNA, 22 bp, Homo sapiens
tctgacattagattaattggaa

SEQ ID NO: 8257207 - DNA, 22 bp, Homo sapiens
tctgacattagattaattggaa

SEQ ID NO: 8257208 - DNA, 22 bp, Homo sapiens
tctgactcccatattccacttc

SEQ ID NO: 8257209 - DNA, 22 bp, Homo sapiens
tctgacttcctccacatctgtt

SEQ ID NO: 8257210 - DNA, 22 bp, Homo sapiens
tctgacttatttgtccttggtg

SEQ ID NO: 8257211 - DNA, 22 bp, Homo sapiens
tctgacttggcgctcttgtctt

SEQ ID NO: 8257212 - DNA, 22 bp, Homo sapiens
tctgacttgcatcttaaaggag

SEQ ID NO: 8257213 - DNA, 22 bp, Homo sapiens
tctgacattttgagaatgacat

SEQ ID NO: 8257214 - DNA, 22 bp, Homo sapiens
tctgacattttgagaatgacat

SEQ ID NO: 8257215 - DNA, 22 bp, Homo sapiens
tctgaccacagacaacctgcta

SEQ ID NO: 8257216 - DNA, 22 bp, Homo sapiens
tctgacattttgagaatgacat

SEQ ID NO: 8257217 - DNA, 22 bp, Homo sapiens
tctgaccaggctcagccaaggc

SEQ ID NO: 8257218 - DNA, 17 bp, Homo sapiens
tctgagaatgctggagg

SEQ ID NO: 8257219 - DNA, 22 bp, Homo sapiens
tctgagaagctagaggacaaag

SEQ ID NO: 8257220 - DNA, 22 bp, Homo sapiens
tctgagaaggaagctctgtgta

SEQ ID NO: 8257221 - DNA, 22 bp, Homo sapiens
tctgagaaggaagctctgtgta

SEQ ID NO: 8257222 - DNA, 22 bp, Homo sapiens
tctgagaagggtaggctccatt

SEQ ID NO: 8257223 - DNA, 22 bp, Homo sapiens
tctgagaagctagaggacaaag

SEQ ID NO: 8257224 - DNA, 22 bp, Homo sapiens
tctgagaagcgtgtctctgttt

SEQ ID NO: 8257225 - DNA, 22 bp, Homo sapiens
tctgagaagcgtgtctctgttt

SEQ ID NO: 8257226 - DNA, 22 bp, Homo sapiens
tctgagaagccctgtggggagg

SEQ ID NO: 8257227 - DNA, 22 bp, Homo sapiens
tctgagaaatcagtggtgaata

SEQ ID NO: 8257228 - DNA, 17 bp, Homo sapiens
tctgagaaaggagaatc

SEQ ID NO: 8257229 - DNA, 22 bp, Homo sapiens
tctgagaagcaccttctggaca

SEQ ID NO: 8257230 - DNA, 21 bp, Homo sapiens
tctgagaacttctgctgcagc

SEQ ID NO: 8257231 - DNA, 22 bp, Homo sapiens
tctttctctctaatcaagcaca

SEQ ID NO: 8257232 - DNA, 22 bp, Homo sapiens
tctttctctctaatcaagcaca

SEQ ID NO: 8257233 - DNA, 22 bp, Homo sapiens
tctttctctctaatcaagcaca

SEQ ID NO: 8257234 - DNA, 22 bp, Homo sapiens
tctttcttattagccattgttc

SEQ ID NO: 8257235 - DNA, 22 bp, Homo sapiens
tctttgaactctgtgtattaac

SEQ ID NO: 8257236 - DNA, 22 bp, Homo sapiens
tctttgaacttggctgatctct

SEQ ID NO: 8257237 - DNA, 22 bp, Homo sapiens
tctttgaacttggctgatctct

SEQ ID NO: 8257238 - DNA, 22 bp, Homo sapiens
tctttgaacttggctgatctct

SEQ ID NO: 8257239 - DNA, 22 bp, Homo sapiens
tctttcttaaataggtggattg

SEQ ID NO: 8257240 - DNA, 22 bp, Homo sapiens
tctttcttacaaagaaaacggt

SEQ ID NO: 8257241 - DNA, 22 bp, Homo sapiens
tctttcttattagccattgttc

SEQ ID NO: 8257242 - DNA, 22 bp, Homo sapiens
tctttctggttatgtatagaga

SEQ ID NO: 8257243 - DNA, 22 bp, Homo sapiens
tctttctggttatgtatagaga

SEQ ID NO: 8257244 - DNA, 22 bp, Homo sapiens
tctttgatgggagatctgagag

SEQ ID NO: 8257245 - DNA, 22 bp, Homo sapiens
tctttgatttagaaggaaatga

SEQ ID NO: 8257246 - DNA, 22 bp, Homo sapiens
tctttgaatttctgactgtctt

SEQ ID NO: 8257247 - DNA, 22 bp, Homo sapiens
tctttgatacagatgtaagctg

SEQ ID NO: 8257248 - DNA, 22 bp, Homo sapiens
tctttgatgcttctgaaggtgt

SEQ ID NO: 8257249 - DNA, 22 bp, Homo sapiens
tctttgaagttcccctggaaga

SEQ ID NO: 8257250 - DNA, 22 bp, Homo sapiens
tctttgaattcaaactgttcaa

SEQ ID NO: 8257251 - DNA, 22 bp, Homo sapiens
tctttgaatttctgactgtctt

SEQ ID NO: 8257252 - DNA, 22 bp, Homo sapiens
tctttgaatcctttacatctga

SEQ ID NO: 8257253 - DNA, 22 bp, Homo sapiens
tctttgaatcctttacatctga

SEQ ID NO: 8257254 - DNA, 22 bp, Homo sapiens
tctttcctgtaactgctgttca

SEQ ID NO: 8257255 - DNA, 22 bp, Homo sapiens
tctttcctgtaactgctgttca

SEQ ID NO: 8257256 - DNA, 21 bp, Homo sapiens
tctttcctgcccagttgccct

SEQ ID NO: 8257257 - DNA, 22 bp, Homo sapiens
tctttctacatcatttgcttct

SEQ ID NO: 8257258 - DNA, 22 bp, Homo sapiens
tctttcctctgagctcctgtag

SEQ ID NO: 8257259 - DNA, 22 bp, Homo sapiens
tctttcctctgagctcctgtag

SEQ ID NO: 8257260 - DNA, 22 bp, Homo sapiens
tctttcctctgagctcctgtag

SEQ ID NO: 8257261 - DNA, 22 bp, Homo sapiens
tctttcctctgagctcctgtag

SEQ ID NO: 8257262 - DNA, 22 bp, Homo sapiens
tctttcctctgagctcctgtag

SEQ ID NO: 8257263 - DNA, 21 bp, Homo sapiens
tctttcctgcccagttgccct

SEQ ID NO: 8257264 - DNA, 22 bp, Homo sapiens
tctttcctaggtgatatgcaat

SEQ ID NO: 8257265 - DNA, 22 bp, Homo sapiens
tctttcctaggtgatatgcaat

SEQ ID NO: 8257266 - DNA, 22 bp, Homo sapiens
tctttcctagaggctgatgagt

SEQ ID NO: 8257267 - DNA, 22 bp, Homo sapiens
tctttcctactttattgtgaac

SEQ ID NO: 8257268 - DNA, 22 bp, Homo sapiens
tctttcctagaggctgatgagt

SEQ ID NO: 8257269 - DNA, 22 bp, Homo sapiens
tctttccctgtgttagcctgta

SEQ ID NO: 8257270 - DNA, 17 bp, Homo sapiens
tctttccctgggagatg

SEQ ID NO: 8257271 - DNA, 22 bp, Homo sapiens
tctttcccgccagagcatgagt

SEQ ID NO: 8257272 - DNA, 17 bp, Homo sapiens
tctttccctgggagatg

SEQ ID NO: 8257273 - DNA, 22 bp, Homo sapiens
tctttcccgccagagcatgagt

SEQ ID NO: 8257274 - DNA, 23 bp, Homo sapiens
tctttcctaatgaaacagtgaaa

SEQ ID NO: 8257275 - DNA, 22 bp, Homo sapiens
tctttccctgtgttagcctgta

SEQ ID NO: 8257276 - DNA, 22 bp, Homo sapiens
tctttcccttagaacattaaca

SEQ ID NO: 8257277 - DNA, 23 bp, Homo sapiens
tctttcctaatgaaacagtgaaa

SEQ ID NO: 8257278 - DNA, 22 bp, Homo sapiens
tctttcctactttattgtgaac

SEQ ID NO: 8257279 - DNA, 22 bp, Homo sapiens
tctttcccttagaacattaaca

SEQ ID NO: 8257280 - DNA, 23 bp, Homo sapiens
tctttcctaatgaaacagtgaaa

SEQ ID NO: 8257281 - DNA, 22 bp, Homo sapiens
tctttatacaaactgggaaaca

SEQ ID NO: 8257282 - DNA, 22 bp, Homo sapiens
tctttataaaagtcattatgtc

SEQ ID NO: 8257283 - DNA, 22 bp, Homo sapiens
tctttagttttctaggttctat

SEQ ID NO: 8257284 - DNA, 22 bp, Homo sapiens
tctttatcaagtctgttctttg

SEQ ID NO: 8257285 - DNA, 22 bp, Homo sapiens
tctttatgagaaaaagattgta

SEQ ID NO: 8257286 - DNA, 21 bp, Homo sapiens
tctttatgacttgcccatttg

SEQ ID NO: 8257287 - DNA, 22 bp, Homo sapiens
tctttatctggctcagagacac

SEQ ID NO: 8257288 - DNA, 22 bp, Homo sapiens
tctttattgctactggtttgtc

SEQ ID NO: 8257289 - DNA, 22 bp, Homo sapiens
tctttattgctactggtttgtc

SEQ ID NO: 8257290 - DNA, 22 bp, Homo sapiens
tctttatgttgatttcctcagg

SEQ ID NO: 8257291 - DNA, 22 bp, Homo sapiens
tctttatgtttactccagctga

SEQ ID NO: 8257292 - DNA, 22 bp, Homo sapiens
tctttatgtttgaaagtacaat

SEQ ID NO: 8257293 - DNA, 22 bp, Homo sapiens
tctttatggaaaatgaatggca

SEQ ID NO: 8257294 - DNA, 22 bp, Homo sapiens
tctttatgtaagactgggcttg

SEQ ID NO: 8257295 - DNA, 22 bp, Homo sapiens
tctttatgcacataaagaaact

SEQ ID NO: 8257296 - DNA, 22 bp, Homo sapiens
tctttatgcctacctgggaaga

SEQ ID NO: 8257297 - DNA, 22 bp, Homo sapiens
tctttagagcctttcctcccga

SEQ ID NO: 8257298 - DNA, 22 bp, Homo sapiens
tctttagacatccagtttctct

SEQ ID NO: 8257299 - DNA, 22 bp, Homo sapiens
tctttagagcacgggaaaaaca

SEQ ID NO: 8257300 - DNA, 22 bp, Homo sapiens
tctttagatgtttagaggaaga

SEQ ID NO: 8257301 - DNA, 22 bp, Homo sapiens
tctttagagttaacaataatga

SEQ ID NO: 8257302 - DNA, 22 bp, Homo sapiens
tctttagagctcagaaatacag

SEQ ID NO: 8257303 - DNA, 20 bp, Homo sapiens
tctttagatttatcttatgt

SEQ ID NO: 8257304 - DNA, 20 bp, Homo sapiens
tctttagatttatcttatgt

SEQ ID NO: 8257305 - DNA, 20 bp, Homo sapiens
tctttagatttatcttatgt

SEQ ID NO: 8257306 - DNA, 22 bp, Homo sapiens
tctttagtattgagttatggta

SEQ ID NO: 8257307 - DNA, 22 bp, Homo sapiens
tctttagtaatgtagcagttta

SEQ ID NO: 8257308 - DNA, 22 bp, Homo sapiens
tctttcaatgtgaaaccatgta

SEQ ID NO: 8257309 - DNA, 22 bp, Homo sapiens
tctttcagccacttacctgtct

SEQ ID NO: 8257310 - DNA, 19 bp, Homo sapiens
tctttcatttctagctctg

SEQ ID NO: 8257311 - DNA, 19 bp, Homo sapiens
tctttcatttctagctctg

SEQ ID NO: 8257312 - DNA, 22 bp, Homo sapiens
tctttatttaagtctgttgtaa

SEQ ID NO: 8257313 - DNA, 22 bp, Homo sapiens
tctttatttaagtctgttgtaa

SEQ ID NO: 8257314 - DNA, 22 bp, Homo sapiens
tctttatttaagtctgttgtaa

SEQ ID NO: 8257315 - DNA, 22 bp, Homo sapiens
tctttattgctactggtttgtc

SEQ ID NO: 8257316 - DNA, 22 bp, Homo sapiens
tctttattgctactggtttgtc

SEQ ID NO: 8257317 - DNA, 22 bp, Homo sapiens
tctttattgctactggtttgtc

SEQ ID NO: 8257318 - DNA, 22 bp, Homo sapiens
tctttattgctactggtttgtc

SEQ ID NO: 8257319 - DNA, 22 bp, Homo sapiens
tctttattgctactggtttgtc

SEQ ID NO: 8257320 - DNA, 22 bp, Homo sapiens
tctttattgctactggtttgtc

SEQ ID NO: 8257321 - DNA, 21 bp, Homo sapiens
tctttccaatattcatgtctc

SEQ ID NO: 8257322 - DNA, 21 bp, Homo sapiens
tctttccaatattcatgtctc

SEQ ID NO: 8257323 - DNA, 22 bp, Homo sapiens
tctttccaagtaatacttccca

SEQ ID NO: 8257324 - DNA, 22 bp, Homo sapiens
tctttccaaggactctgtagca

SEQ ID NO: 8257325 - DNA, 22 bp, Homo sapiens
tctttccaagtaatacttccca

SEQ ID NO: 8257326 - DNA, 22 bp, Homo sapiens
tctttccacagcatgtccatgc

SEQ ID NO: 8257327 - DNA, 22 bp, Homo sapiens
tctttccacactgtatgcccat

SEQ ID NO: 8257328 - DNA, 22 bp, Homo sapiens
tctttccacattctctgtttag

SEQ ID NO: 8257329 - DNA, 22 bp, Homo sapiens
tctttccacattctctgtttag

SEQ ID NO: 8257330 - DNA, 22 bp, Homo sapiens
tctttccagaggaatttttaga

SEQ ID NO: 8257331 - DNA, 22 bp, Homo sapiens
tctttccagaggaatttttaga

SEQ ID NO: 8257332 - DNA, 22 bp, Homo sapiens
tctttccagaggaatttttaga

SEQ ID NO: 8257333 - DNA, 22 bp, Homo sapiens
tctttccatggccacacagtct

SEQ ID NO: 8257334 - DNA, 20 bp, Homo sapiens
tcttgagaacaatttctggc

SEQ ID NO: 8257335 - DNA, 20 bp, Homo sapiens
tcttgagaacaatttctggc

SEQ ID NO: 8257336 - DNA, 22 bp, Homo sapiens
tcttgaattgtactcccataag

SEQ ID NO: 8257337 - DNA, 22 bp, Homo sapiens
tcttgaataagtttcatgagct

SEQ ID NO: 8257338 - DNA, 22 bp, Homo sapiens
tcttgaattgtactcccataag

SEQ ID NO: 8257339 - DNA, 22 bp, Homo sapiens
tcttgaattgtactcccataag

SEQ ID NO: 8257340 - DNA, 22 bp, Homo sapiens
tcttgaaagtatcttattttgt

SEQ ID NO: 8257341 - DNA, 22 bp, Homo sapiens
tcttgaacttctgcacactcag

SEQ ID NO: 8257342 - DNA, 22 bp, Homo sapiens
tcttgaaagtatcttattttgt

SEQ ID NO: 8257343 - DNA, 22 bp, Homo sapiens
tcttgaaagtatcttattttgt

SEQ ID NO: 8257344 - DNA, 22 bp, Homo sapiens
tcttgaaggggggcagtgttga

SEQ ID NO: 8257345 - DNA, 22 bp, Homo sapiens
tcttgatttactctaatagctt

SEQ ID NO: 8257346 - DNA, 22 bp, Homo sapiens
tcttgagaagcggctgtctcag

SEQ ID NO: 8257347 - DNA, 22 bp, Homo sapiens
tcttgagtgcgcttgggtgttc

SEQ ID NO: 8257348 - DNA, 22 bp, Homo sapiens
tcttgaggttattaagctgtta

SEQ ID NO: 8257349 - DNA, 22 bp, Homo sapiens
tcttgctgtgtattgcatctcc

SEQ ID NO: 8257350 - DNA, 22 bp, Homo sapiens
tcttgctaaagaccaacacatt

SEQ ID NO: 8257351 - DNA, 22 bp, Homo sapiens
tcttggattttaatggatcaaa

SEQ ID NO: 8257352 - DNA, 22 bp, Homo sapiens
tcttggccagatgcacttcctc

SEQ ID NO: 8257353 - DNA, 22 bp, Homo sapiens
tcttggcaggcagtggggtaag

SEQ ID NO: 8257354 - DNA, 22 bp, Homo sapiens
tcttggcagtggaataccagga

SEQ ID NO: 8257355 - DNA, 22 bp, Homo sapiens
tcttggccccaaccctctattt

SEQ ID NO: 8257356 - DNA, 22 bp, Homo sapiens
tcttggccccacctgtgccagc

SEQ ID NO: 8257357 - DNA, 21 bp, Homo sapiens
tcttggcctaagttcactgaa

SEQ ID NO: 8257358 - DNA, 22 bp, Homo sapiens
tcttggctatccaagttatcca

SEQ ID NO: 8257359 - DNA, 22 bp, Homo sapiens
tcttggctatccaagttatcca

SEQ ID NO: 8257360 - DNA, 22 bp, Homo sapiens
tcttggctagtaccttcctgcc

SEQ ID NO: 8257361 - DNA, 22 bp, Homo sapiens
tcttggctactttcctgtctgc

SEQ ID NO: 8257362 - DNA, 22 bp, Homo sapiens
tcttggctactttcctgtctgc

SEQ ID NO: 8257363 - DNA, 22 bp, Homo sapiens
tcttggagactcttgtatattt

SEQ ID NO: 8257364 - DNA, 20 bp, Homo sapiens
tcttggagagggtggactta

SEQ ID NO: 8257365 - DNA, 22 bp, Homo sapiens
tcttggaatctccatagagtga

SEQ ID NO: 8257366 - DNA, 22 bp, Homo sapiens
tcttggactagtcctaaatcca

SEQ ID NO: 8257367 - DNA, 22 bp, Homo sapiens
tcttggaacttattattgtaga

SEQ ID NO: 8257368 - DNA, 22 bp, Homo sapiens
tcttgggaaataaacagattga

SEQ ID NO: 8257369 - DNA, 22 bp, Homo sapiens
tcttgggaaatgtttgcgagct

SEQ ID NO: 8257370 - DNA, 19 bp, Homo sapiens
tcttggctttgtctactgt

SEQ ID NO: 8257371 - DNA, 22 bp, Homo sapiens
tcttgggaagcccatttccacc

SEQ ID NO: 8257372 - DNA, 21 bp, Homo sapiens
tcttgggataaacttcaagaa

SEQ ID NO: 8257373 - DNA, 22 bp, Homo sapiens
tcttgggatcacctcctggctt

SEQ ID NO: 8257374 - DNA, 22 bp, Homo sapiens
tcttgggatagtgtctcatggc

SEQ ID NO: 8257375 - DNA, 22 bp, Homo sapiens
tcttgggattgccctgcagttc

SEQ ID NO: 8257376 - DNA, 22 bp, Homo sapiens
tcttgggcacgatgggaggctt

SEQ ID NO: 8257377 - DNA, 22 bp, Homo sapiens
tcttgggcaatttctctagagg

SEQ ID NO: 8257378 - DNA, 22 bp, Homo sapiens
tcttgggcatgtgtttgatttc

SEQ ID NO: 8257379 - DNA, 22 bp, Homo sapiens
tcttgggcacgatgggaggctt

SEQ ID NO: 8257380 - DNA, 22 bp, Homo sapiens
tcttgggcatgtgtttgatttc

SEQ ID NO: 8257381 - DNA, 22 bp, Homo sapiens
tcttgggcatgtgtttgatttc

SEQ ID NO: 8257382 - DNA, 22 bp, Homo sapiens
tcttggctgtaccattgactag

SEQ ID NO: 8257383 - DNA, 22 bp, Homo sapiens
tcttggctgtctttgaagttag

SEQ ID NO: 8257384 - DNA, 22 bp, Homo sapiens
tcttggcttctgtatttcctgt

SEQ ID NO: 8257385 - DNA, 22 bp, Homo sapiens
tcttggctgctgccaatttact

SEQ ID NO: 8257386 - DNA, 22 bp, Homo sapiens
tcttggctgcgtcctggctgtg

SEQ ID NO: 8257387 - DNA, 21 bp, Homo sapiens
tcttggctctgccacttatta

SEQ ID NO: 8257388 - DNA, 22 bp, Homo sapiens
tcttggctctgccactaattag

SEQ ID NO: 8257389 - DNA, 22 bp, Homo sapiens
tctttacatcacaattgtatgg

SEQ ID NO: 8257390 - DNA, 22 bp, Homo sapiens
tctttacatcacaattgtatgg

SEQ ID NO: 8257391 - DNA, 22 bp, Homo sapiens
tctttacatcacaattgtatgg

SEQ ID NO: 8257392 - DNA, 22 bp, Homo sapiens
tctttactggaatggaactttc

SEQ ID NO: 8257393 - DNA, 22 bp, Homo sapiens
tctttagaaacttttcttcatg

SEQ ID NO: 8257394 - DNA, 23 bp, Homo sapiens
tctttagaagaacatcagaaatg

SEQ ID NO: 8257395 - DNA, 22 bp, Homo sapiens
tctttacatagtgtggactact

SEQ ID NO: 8257396 - DNA, 22 bp, Homo sapiens
tctttacatcacaattgtatgg

SEQ ID NO: 8257397 - DNA, 22 bp, Homo sapiens
tctttacatcacaattgtatgg

SEQ ID NO: 8257398 - DNA, 23 bp, Homo sapiens
tctttacatactgatgagttctc

SEQ ID NO: 8257399 - DNA, 23 bp, Homo sapiens
tctttacatactgatgagttctc

SEQ ID NO: 8257400 - DNA, 22 bp, Homo sapiens
tctttacacaagacaagaataa

SEQ ID NO: 8257401 - DNA, 23 bp, Homo sapiens
tctttacagcagcaggatttgga

SEQ ID NO: 8257402 - DNA, 22 bp, Homo sapiens
tctttacacaagacaagaataa

SEQ ID NO: 8257403 - DNA, 22 bp, Homo sapiens
tctttacaagtcacattttctg

SEQ ID NO: 8257404 - DNA, 22 bp, Homo sapiens
tctttaattgtggaagagcagc

SEQ ID NO: 8257405 - DNA, 22 bp, Homo sapiens
tctttaattcagcatgatgcgg

SEQ ID NO: 8257406 - DNA, 21 bp, Homo sapiens
tcttggggaggagggctgcac

SEQ ID NO: 8257407 - DNA, 22 bp, Homo sapiens
tcttgggctagaatagcaggag

SEQ ID NO: 8257408 - DNA, 22 bp, Homo sapiens
tcttgggcctcaccccagacat

SEQ ID NO: 8257409 - DNA, 22 bp, Homo sapiens
tcttcatacaatttcagacatc

SEQ ID NO: 8257410 - DNA, 22 bp, Homo sapiens
tcttcatctcagattaacagga

SEQ ID NO: 8257411 - DNA, 22 bp, Homo sapiens
tcttcatgaaattgattgctta

SEQ ID NO: 8257412 - DNA, 22 bp, Homo sapiens
tcttcatctcagattaacagga

SEQ ID NO: 8257413 - DNA, 22 bp, Homo sapiens
tcttcatctcagattaacagga

SEQ ID NO: 8257414 - DNA, 22 bp, Homo sapiens
tcttcatgacctctgtgtttta

SEQ ID NO: 8257415 - DNA, 22 bp, Homo sapiens
tcttcatgataccctaagccac

SEQ ID NO: 8257416 - DNA, 22 bp, Homo sapiens
tcttcatgaatgaatctttgac

SEQ ID NO: 8257417 - DNA, 22 bp, Homo sapiens
tcttcatgaatgaatctttgac

SEQ ID NO: 8257418 - DNA, 22 bp, Homo sapiens
tcttcatgtatttgacaaccat

SEQ ID NO: 8257419 - DNA, 22 bp, Homo sapiens
tcttcatgtatactcatggtac

SEQ ID NO: 8257420 - DNA, 22 bp, Homo sapiens
tcttcatgtcatggtatattga

SEQ ID NO: 8257421 - DNA, 22 bp, Homo sapiens
tcttcatgtctctgcttgagtc

SEQ ID NO: 8257422 - DNA, 22 bp, Homo sapiens
tcttcatgttagttgggttttc

SEQ ID NO: 8257423 - DNA, 22 bp, Homo sapiens
tcttcatgttgctgtagggaga

SEQ ID NO: 8257424 - DNA, 22 bp, Homo sapiens
tcttcatgcacctcacagctag

SEQ ID NO: 8257425 - DNA, 22 bp, Homo sapiens
tcttcatgccaaatgagttttg

SEQ ID NO: 8257426 - DNA, 22 bp, Homo sapiens
tcttcatgccaaatgagttttg

SEQ ID NO: 8257427 - DNA, 22 bp, Homo sapiens
tcttcatgccaaatgagttttg

SEQ ID NO: 8257428 - DNA, 22 bp, Homo sapiens
tcttcatggtctggttctccag

SEQ ID NO: 8257429 - DNA, 23 bp, Homo sapiens
tcttcatgcccaggccttggtgc

SEQ ID NO: 8257430 - DNA, 23 bp, Homo sapiens
tcttcatggccatctggttcttc

SEQ ID NO: 8257431 - DNA, 22 bp, Homo sapiens
tcttcagctccctgttcagtac

SEQ ID NO: 8257432 - DNA, 22 bp, Homo sapiens
tcttcagctgtagtcattgttc

SEQ ID NO: 8257433 - DNA, 22 bp, Homo sapiens
tcttcagcagagaattatgatg

SEQ ID NO: 8257434 - DNA, 22 bp, Homo sapiens
tcttcagcagggcctctctgag

SEQ ID NO: 8257435 - DNA, 22 bp, Homo sapiens
tcttcaggaagggaaatcatcc

SEQ ID NO: 8257436 - DNA, 22 bp, Homo sapiens
tcttcaggagctgaaagcctgc

SEQ ID NO: 8257437 - DNA, 22 bp, Homo sapiens
tcttcagtcaatccagatgttt

SEQ ID NO: 8257438 - DNA, 22 bp, Homo sapiens
tcttcagtgcacctgatgtctt

SEQ ID NO: 8257439 - DNA, 22 bp, Homo sapiens
tcttcagtgcacctgatgtctt

SEQ ID NO: 8257440 - DNA, 22 bp, Homo sapiens
tcttcagtgaatggcaagatct

SEQ ID NO: 8257441 - DNA, 22 bp, Homo sapiens
tcttcagtgaatggcaagatct

SEQ ID NO: 8257442 - DNA, 22 bp, Homo sapiens
tcttcagtaggtcctcagaatc

SEQ ID NO: 8257443 - DNA, 22 bp, Homo sapiens
tcttcagttgtcatactgcctt

SEQ ID NO: 8257444 - DNA, 22 bp, Homo sapiens
tcttcagtgcacctgatgtctt

SEQ ID NO: 8257445 - DNA, 18 bp, Homo sapiens
tcttccaacactgacacc

SEQ ID NO: 8257446 - DNA, 22 bp, Homo sapiens
tcttccacttgcaagtttatgg

SEQ ID NO: 8257447 - DNA, 22 bp, Homo sapiens
tcttcattctcgcctttgtcgt

SEQ ID NO: 8257448 - DNA, 22 bp, Homo sapiens
tcttcattccgtagatatttat

SEQ ID NO: 8257449 - DNA, 22 bp, Homo sapiens
tcttcatgttgcttattctggg

SEQ ID NO: 8257450 - DNA, 22 bp, Homo sapiens
tcttcatgttgcttattctggg

SEQ ID NO: 8257451 - DNA, 22 bp, Homo sapiens
tcttcatgttgcttattctggg

SEQ ID NO: 8257452 - DNA, 18 bp, Homo sapiens
tcttccaacactgacacc

SEQ ID NO: 8257453 - DNA, 22 bp, Homo sapiens
tcttccagccaatagcgtcctt

SEQ ID NO: 8257454 - DNA, 22 bp, Homo sapiens
tcttccagaagtgttttcagaa

SEQ ID NO: 8257455 - DNA, 22 bp, Homo sapiens
tcttcaaagaagccttggatta

SEQ ID NO: 8257456 - DNA, 22 bp, Homo sapiens
tcttcaaagcatatgcaggcat

SEQ ID NO: 8257457 - DNA, 22 bp, Homo sapiens
tcttcaaagaattttagtaatt

SEQ ID NO: 8257458 - DNA, 22 bp, Homo sapiens
tcttcaaaaaatatccatcagt

SEQ ID NO: 8257459 - DNA, 22 bp, Homo sapiens
tcttattttttaatgacagaga

SEQ ID NO: 8257460 - DNA, 22 bp, Homo sapiens
tcttattttttaatgacagaga

SEQ ID NO: 8257461 - DNA, 22 bp, Homo sapiens
tcttcaaaccctggctcttcct

SEQ ID NO: 8257462 - DNA, 22 bp, Homo sapiens
tcttattttgttagatgctgta

SEQ ID NO: 8257463 - DNA, 22 bp, Homo sapiens
tcttatttgcaactggctcaga

SEQ ID NO: 8257464 - DNA, 22 bp, Homo sapiens
tcttatttgcaactggctcaga

SEQ ID NO: 8257465 - DNA, 22 bp, Homo sapiens
tcttattttttaatgacagaga

SEQ ID NO: 8257466 - DNA, 22 bp, Homo sapiens
tcttattgtgatgatgaagaac

SEQ ID NO: 8257467 - DNA, 22 bp, Homo sapiens
tcttattgtttaaaagtacaca

SEQ ID NO: 8257468 - DNA, 22 bp, Homo sapiens
tcttatttgcaactggctcaga

SEQ ID NO: 8257469 - DNA, 22 bp, Homo sapiens
tcttatgtcaagaatgaatatt

SEQ ID NO: 8257470 - DNA, 22 bp, Homo sapiens
tcttatgtttctagaaaataag

SEQ ID NO: 8257471 - DNA, 22 bp, Homo sapiens
tcttattattgttgtaaaagca

SEQ ID NO: 8257472 - DNA, 20 bp, Homo sapiens
tcttattgtcttgaggagtt

SEQ ID NO: 8257473 - DNA, 20 bp, Homo sapiens
tcttattgtcttgaggagtt

SEQ ID NO: 8257474 - DNA, 22 bp, Homo sapiens
tcttattggataaaaggaaacc

SEQ ID NO: 8257475 - DNA, 22 bp, Homo sapiens
tcttattggataaaaggaaacc

SEQ ID NO: 8257476 - DNA, 22 bp, Homo sapiens
tcttattcttttaaacaacgca

SEQ ID NO: 8257477 - DNA, 22 bp, Homo sapiens
tcttattggtaatgatggcatt

SEQ ID NO: 8257478 - DNA, 19 bp, Homo sapiens
tcttattgagcagctgagg

SEQ ID NO: 8257479 - DNA, 22 bp, Homo sapiens
tcttcagattgcactgagcaag

SEQ ID NO: 8257480 - DNA, 22 bp, Homo sapiens
tcttcagatggccagttgtccc

SEQ ID NO: 8257481 - DNA, 22 bp, Homo sapiens
tcttcacatgaccttcatgtct

SEQ ID NO: 8257482 - DNA, 22 bp, Homo sapiens
tcttcacatgaccttcatgtct

SEQ ID NO: 8257483 - DNA, 22 bp, Homo sapiens
tcttcacatattccttgagcta

SEQ ID NO: 8257484 - DNA, 23 bp, Homo sapiens
tcttcacagggcttcccatgtgc

SEQ ID NO: 8257485 - DNA, 22 bp, Homo sapiens
tcttcacagtcctggtcagtgg

SEQ ID NO: 8257486 - DNA, 22 bp, Homo sapiens
tcttcacacacagtcctctttc

SEQ ID NO: 8257487 - DNA, 22 bp, Homo sapiens
tcttcacacacagtcctctttc

SEQ ID NO: 8257488 - DNA, 22 bp, Homo sapiens
tcttcaatgcattctcttgttt

SEQ ID NO: 8257489 - DNA, 22 bp, Homo sapiens
tcttcaattagatttaccaatt

SEQ ID NO: 8257490 - DNA, 22 bp, Homo sapiens
tcttcaattagatttaccaatt

SEQ ID NO: 8257491 - DNA, 22 bp, Homo sapiens
tcttcaaatcctacagtgtctg

SEQ ID NO: 8257492 - DNA, 22 bp, Homo sapiens
tcttcaaccttgttactatagc

SEQ ID NO: 8257493 - DNA, 22 bp, Homo sapiens
tcttcaagaatatattgctgtc

SEQ ID NO: 8257494 - DNA, 22 bp, Homo sapiens
tcttctctcatgtaggagggaa

SEQ ID NO: 8257495 - DNA, 22 bp, Homo sapiens
tcttctctcatgtaggagggaa

SEQ ID NO: 8257496 - DNA, 20 bp, Homo sapiens
tcttctggatttcctttagg

SEQ ID NO: 8257497 - DNA, 22 bp, Homo sapiens
tcttctcctttgccatgtgttt

SEQ ID NO: 8257498 - DNA, 22 bp, Homo sapiens
tcttctcctttgccatgtgttt

SEQ ID NO: 8257499 - DNA, 22 bp, Homo sapiens
tcttctcctttgccatgtgttt

SEQ ID NO: 8257500 - DNA, 22 bp, Homo sapiens
tcttctctacaccagcagcccc

SEQ ID NO: 8257501 - DNA, 22 bp, Homo sapiens
tcttctctacaccagcagcccc

SEQ ID NO: 8257502 - DNA, 22 bp, Homo sapiens
tcttctctacaccagcagcccc

SEQ ID NO: 8257503 - DNA, 22 bp, Homo sapiens
tcttctgtcctaagtcaaagca

SEQ ID NO: 8257504 - DNA, 22 bp, Homo sapiens
tcttctgtgagaattcaagcaa

SEQ ID NO: 8257505 - DNA, 22 bp, Homo sapiens
tcttctgtgagaattcaagcaa

SEQ ID NO: 8257506 - DNA, 22 bp, Homo sapiens
tcttctgtattgttaactcagg

SEQ ID NO: 8257507 - DNA, 22 bp, Homo sapiens
tcttctgtattgttaactcagg

SEQ ID NO: 8257508 - DNA, 22 bp, Homo sapiens
tcttctgtcctaagtcaaagca

SEQ ID NO: 8257509 - DNA, 22 bp, Homo sapiens
tcttctgtgatctatgtgtttt

SEQ ID NO: 8257510 - DNA, 22 bp, Homo sapiens
tcttctgtgatctatgtgtttt

SEQ ID NO: 8257511 - DNA, 22 bp, Homo sapiens
tcttctgtgatctatgtgtttt

SEQ ID NO: 8257512 - DNA, 22 bp, Homo sapiens
tcttctgtggctctcaccaccc

SEQ ID NO: 8257513 - DNA, 22 bp, Homo sapiens
tcttctgttaccacagcgatga

SEQ ID NO: 8257514 - DNA, 22 bp, Homo sapiens
tcttctgttaccacagcgatga

SEQ ID NO: 8257515 - DNA, 22 bp, Homo sapiens
tcttctgttaccacagcgatga

SEQ ID NO: 8257516 - DNA, 22 bp, Homo sapiens
tcttctccagtgcttctgcaca

SEQ ID NO: 8257517 - DNA, 22 bp, Homo sapiens
tcttctccagtgcttctgcaca

SEQ ID NO: 8257518 - DNA, 22 bp, Homo sapiens
tcttctccagtgcttctgcaca

SEQ ID NO: 8257519 - DNA, 22 bp, Homo sapiens
tcttctccagttcatcctacca

SEQ ID NO: 8257520 - DNA, 22 bp, Homo sapiens
tcttctccagttcatcctacca

SEQ ID NO: 8257521 - DNA, 22 bp, Homo sapiens
tcttctccagttcatcctacca

SEQ ID NO: 8257522 - DNA, 22 bp, Homo sapiens
tcttctccagtgcttctgcaca

SEQ ID NO: 8257523 - DNA, 22 bp, Homo sapiens
tcttctccagtgcttctgcaca

SEQ ID NO: 8257524 - DNA, 22 bp, Homo sapiens
tcttctcccatctccaggcagg

SEQ ID NO: 8257525 - DNA, 22 bp, Homo sapiens
tcttctcccatctccaggcagg

SEQ ID NO: 8257526 - DNA, 22 bp, Homo sapiens
tcttctcccatctccaggcagg

SEQ ID NO: 8257527 - DNA, 22 bp, Homo sapiens
tcttctcccatcggccgcaggg

SEQ ID NO: 8257528 - DNA, 22 bp, Homo sapiens
tcttctcccatcggccgcaggg

SEQ ID NO: 8257529 - DNA, 22 bp, Homo sapiens
tcttctcccatctccaggcagg

SEQ ID NO: 8257530 - DNA, 22 bp, Homo sapiens
tcttctcccatcggccgcaggg

SEQ ID NO: 8257531 - DNA, 22 bp, Homo sapiens
tcttctcccagggtcgcccaag

SEQ ID NO: 8257532 - DNA, 22 bp, Homo sapiens
tcttctcccagggtcgcccaag

SEQ ID NO: 8257533 - DNA, 22 bp, Homo sapiens
tcttctccataatcaacactct

SEQ ID NO: 8257534 - DNA, 22 bp, Homo sapiens
tcttctccagttcatcctacca

SEQ ID NO: 8257535 - DNA, 22 bp, Homo sapiens
tcttctccataatcaacactct

SEQ ID NO: 8257536 - DNA, 22 bp, Homo sapiens
tcttctccataatcaacactct

SEQ ID NO: 8257537 - DNA, 22 bp, Homo sapiens
tcttgaaagcattttcttcatc

SEQ ID NO: 8257538 - DNA, 22 bp, Homo sapiens
tcttgaaagcatgagatggaca

SEQ ID NO: 8257539 - DNA, 22 bp, Homo sapiens
tcttgaaaattgaggttgaagg

SEQ ID NO: 8257540 - DNA, 21 bp, Homo sapiens
tcttgaaaagttagattctct

SEQ ID NO: 8257541 - DNA, 22 bp, Homo sapiens
tcttctttgaatcatagtgacc

SEQ ID NO: 8257542 - DNA, 22 bp, Homo sapiens
tcttctttttgtcccacagaat

SEQ ID NO: 8257543 - DNA, 22 bp, Homo sapiens
tcttctgttttagattgcatac

SEQ ID NO: 8257544 - DNA, 22 bp, Homo sapiens
tcttctgttttagattgcatac

SEQ ID NO: 8257545 - DNA, 22 bp, Homo sapiens
tcttctgttttagattgcatac

SEQ ID NO: 8257546 - DNA, 22 bp, Homo sapiens
tcttctgttttagattgcatac

SEQ ID NO: 8257547 - DNA, 22 bp, Homo sapiens
tcttctgttttagattgcatac

SEQ ID NO: 8257548 - DNA, 20 bp, Homo sapiens
tcttctgttgccttgttctg

SEQ ID NO: 8257549 - DNA, 20 bp, Homo sapiens
tcttctgttgccttgttctg

SEQ ID NO: 8257550 - DNA, 20 bp, Homo sapiens
tcttctgttgccttgttctg

SEQ ID NO: 8257551 - DNA, 22 bp, Homo sapiens
tcttctgttttagattgcatac

SEQ ID NO: 8257552 - DNA, 20 bp, Homo sapiens
tcttctgttgccttgttctg

SEQ ID NO: 8257553 - DNA, 20 bp, Homo sapiens
tcttctgttgccttgttctg

SEQ ID NO: 8257554 - DNA, 22 bp, Homo sapiens
tcttctgttaccacagcgatga

SEQ ID NO: 8257555 - DNA, 22 bp, Homo sapiens
tcttcttcctccacagggccca

SEQ ID NO: 8257556 - DNA, 22 bp, Homo sapiens
tcttcttcccatccctcaaatg

SEQ ID NO: 8257557 - DNA, 22 bp, Homo sapiens
tcttcttcctcatttatacata

SEQ ID NO: 8257558 - DNA, 22 bp, Homo sapiens
tcttcctctctaattgatcaga

SEQ ID NO: 8257559 - DNA, 22 bp, Homo sapiens
tcttcctctagatctgaggccc

SEQ ID NO: 8257560 - DNA, 22 bp, Homo sapiens
tcttcctcttctgctgagaagt

SEQ ID NO: 8257561 - DNA, 22 bp, Homo sapiens
tcttcctccctacagagctcag

SEQ ID NO: 8257562 - DNA, 22 bp, Homo sapiens
tcttcctctagatctgaggccc

SEQ ID NO: 8257563 - DNA, 22 bp, Homo sapiens
tcttcctctagatctgaggccc

SEQ ID NO: 8257564 - DNA, 22 bp, Homo sapiens
tcttcctctagatctgaggccc

SEQ ID NO: 8257565 - DNA, 21 bp, Homo sapiens
tcttcctgctccacactcccc

SEQ ID NO: 8257566 - DNA, 21 bp, Homo sapiens
tcttcctgacatatgcaaggc

SEQ ID NO: 8257567 - DNA, 23 bp, Homo sapiens
tcttcctgaactatcaggcacat

SEQ ID NO: 8257568 - DNA, 23 bp, Homo sapiens
tcttcctgaactatcaggcacat

SEQ ID NO: 8257569 - DNA, 23 bp, Homo sapiens
tcttcctgaactatcaggcacat

SEQ ID NO: 8257570 - DNA, 22 bp, Homo sapiens
tcttcctgaaaccctgttccag

SEQ ID NO: 8257571 - DNA, 23 bp, Homo sapiens
tcttcctgaactatcaggcacat

SEQ ID NO: 8257572 - DNA, 22 bp, Homo sapiens
tcttcctgaaaccctgttccag

SEQ ID NO: 8257573 - DNA, 20 bp, Homo sapiens
tcttccagcttctggtagaa

SEQ ID NO: 8257574 - DNA, 22 bp, Homo sapiens
tcttccagggagcctcaaacct

SEQ ID NO: 8257575 - DNA, 21 bp, Homo sapiens
tcttcctccacagcgtgccac

SEQ ID NO: 8257576 - DNA, 21 bp, Homo sapiens
tcttcctccacagcgtgccac

SEQ ID NO: 8257577 - DNA, 22 bp, Homo sapiens
tcttcctccctacagagctcag

SEQ ID NO: 8257578 - DNA, 22 bp, Homo sapiens
tcttcctccctacagagctcag

SEQ ID NO: 8257579 - DNA, 22 bp, Homo sapiens
tcttccaggagggtgggcaaac

SEQ ID NO: 8257580 - DNA, 22 bp, Homo sapiens
tcttccaggccctgccacagct

SEQ ID NO: 8257581 - DNA, 22 bp, Homo sapiens
tcttcctgctttggtgaggctt

SEQ ID NO: 8257582 - DNA, 22 bp, Homo sapiens
tcttcctggatgggggttgatg

SEQ ID NO: 8257583 - DNA, 22 bp, Homo sapiens
tcttcctggcattgatgctgca

SEQ ID NO: 8257584 - DNA, 22 bp, Homo sapiens
tcttcctgctttggtgaggctt

SEQ ID NO: 8257585 - DNA, 21 bp, Homo sapiens
tcttcctgctccacactcccc

SEQ ID NO: 8257586 - DNA, 21 bp, Homo sapiens
tcttcctgctccacactcccc

SEQ ID NO: 8257587 - DNA, 22 bp, Homo sapiens
tcttccttctttgatgacaagg

SEQ ID NO: 8257588 - DNA, 22 bp, Homo sapiens
tcttccttctttgatgacaagg

SEQ ID NO: 8257589 - DNA, 22 bp, Homo sapiens
tcttccttcgcccttgctgttt

SEQ ID NO: 8257590 - DNA, 22 bp, Homo sapiens
tcttccttaaatgtttggtaga

SEQ ID NO: 8257591 - DNA, 22 bp, Homo sapiens
tcttcctgtcaatgagaattaa

SEQ ID NO: 8257592 - DNA, 22 bp, Homo sapiens
tcttcctggtttctgggccatc

SEQ ID NO: 8257593 - DNA, 22 bp, Homo sapiens
tcttccttttgtaccttctgaa

SEQ ID NO: 8257594 - DNA, 16 bp, Homo sapiens
tcttccttttgatttt

SEQ ID NO: 8257595 - DNA, 22 bp, Homo sapiens
tcttccttttgtaccttctgaa

SEQ ID NO: 8257596 - DNA, 22 bp, Homo sapiens
tcttccttttgtaccttctgaa

SEQ ID NO: 8257597 - DNA, 22 bp, Homo sapiens
tcttcgggaatcggtgcatttc

SEQ ID NO: 8257598 - DNA, 22 bp, Homo sapiens
tcttctaatggttcagatatat

SEQ ID NO: 8257599 - DNA, 22 bp, Homo sapiens
tcttctagtaggccaagaagct

SEQ ID NO: 8257600 - DNA, 22 bp, Homo sapiens
tcttctatcctcagcccctgcc

SEQ ID NO: 8257601 - DNA, 22 bp, Homo sapiens
tcttccttgctccttgtcactt

SEQ ID NO: 8257602 - DNA, 22 bp, Homo sapiens
tcttccttgccttgcttcatca

SEQ ID NO: 8257603 - DNA, 22 bp, Homo sapiens
tcttcctttcattcatgtgtta

SEQ ID NO: 8257604 - DNA, 22 bp, Homo sapiens
tctgtttctccaacattgtgag

SEQ ID NO: 8257605 - DNA, 22 bp, Homo sapiens
tctgtttctccaacattgtgag

SEQ ID NO: 8257606 - DNA, 17 bp, Homo sapiens
tctgtttctcctttctt

SEQ ID NO: 8257607 - DNA, 22 bp, Homo sapiens
tctgtttcttcttctgttatat

SEQ ID NO: 8257608 - DNA, 22 bp, Homo sapiens
tctgtttattcaatttctatat

SEQ ID NO: 8257609 - DNA, 22 bp, Homo sapiens
tctgtttcctcttgtgtaaagt

SEQ ID NO: 8257610 - DNA, 22 bp, Homo sapiens
tctgttttagataagaaaggct

SEQ ID NO: 8257611 - DNA, 22 bp, Homo sapiens
tctgtttcttggctagcctctt

SEQ ID NO: 8257612 - DNA, 22 bp, Homo sapiens
tctgttttgcataatgttcttt

SEQ ID NO: 8257613 - DNA, 22 bp, Homo sapiens
tcttaaagccaagcataaacca

SEQ ID NO: 8257614 - DNA, 22 bp, Homo sapiens
tcttaaaagtatgccaattgga

SEQ ID NO: 8257615 - DNA, 22 bp, Homo sapiens
tcttaaaagtatgccaattgga

SEQ ID NO: 8257616 - DNA, 22 bp, Homo sapiens
tctgtttttgaggctatcttct

SEQ ID NO: 8257617 - DNA, 22 bp, Homo sapiens
tctgtttttgaggctatcttct

SEQ ID NO: 8257618 - DNA, 22 bp, Homo sapiens
tctgttttggtcacctttatat

SEQ ID NO: 8257619 - DNA, 22 bp, Homo sapiens
tctgttttgtaccagatacagc

SEQ ID NO: 8257620 - DNA, 22 bp, Homo sapiens
tctgttttgtaccagatacagc

SEQ ID NO: 8257621 - DNA, 22 bp, Homo sapiens
tcttatgaaaagcacttagaac

SEQ ID NO: 8257622 - DNA, 22 bp, Homo sapiens
tcttatcaataatgactgttga

SEQ ID NO: 8257623 - DNA, 22 bp, Homo sapiens
tcttatatgcacatacattggg

SEQ ID NO: 8257624 - DNA, 22 bp, Homo sapiens
tcttatacagaagatgtttaat

SEQ ID NO: 8257625 - DNA, 22 bp, Homo sapiens
tcttataatgttgaagggttgg

SEQ ID NO: 8257626 - DNA, 22 bp, Homo sapiens
tcttataatctctattttaatg

SEQ ID NO: 8257627 - DNA, 22 bp, Homo sapiens
tcttataagcaaactgctgaga

SEQ ID NO: 8257628 - DNA, 22 bp, Homo sapiens
tcttataagcaaactgctgaga

SEQ ID NO: 8257629 - DNA, 22 bp, Homo sapiens
tcttataatctctattttaatg

SEQ ID NO: 8257630 - DNA, 22 bp, Homo sapiens
tcttagcatttcataacaactg

SEQ ID NO: 8257631 - DNA, 22 bp, Homo sapiens
tcttagcaaattttctttgcct

SEQ ID NO: 8257632 - DNA, 22 bp, Homo sapiens
tcttataaaaggactcccattt

SEQ ID NO: 8257633 - DNA, 22 bp, Homo sapiens
tcttaggtgtatgtcattaggg

SEQ ID NO: 8257634 - DNA, 22 bp, Homo sapiens
tcttaaatgactgataagagga

SEQ ID NO: 8257635 - DNA, 22 bp, Homo sapiens
tcttaactatcatttgaacacc

SEQ ID NO: 8257636 - DNA, 22 bp, Homo sapiens
tcttaaatgactgataagagga

SEQ ID NO: 8257637 - DNA, 20 bp, Homo sapiens
tcttaaatccccagggccat

SEQ ID NO: 8257638 - DNA, 22 bp, Homo sapiens
tcttaagcagagaagaagttga

SEQ ID NO: 8257639 - DNA, 22 bp, Homo sapiens
tcttaactgacagtttaatggg

SEQ ID NO: 8257640 - DNA, 22 bp, Homo sapiens
tcttaactgacagtttaatggg

SEQ ID NO: 8257641 - DNA, 22 bp, Homo sapiens
tcttaagtacctcctttatcac

SEQ ID NO: 8257642 - DNA, 22 bp, Homo sapiens
tcttaagtgcccagaaaccaaa

SEQ ID NO: 8257643 - DNA, 22 bp, Homo sapiens
tcttagaattgaagtcagaggg

SEQ ID NO: 8257644 - DNA, 22 bp, Homo sapiens
tcttagaattgaagtcagaggg

SEQ ID NO: 8257645 - DNA, 23 bp, Homo sapiens
tctgttcttttagctgatcattt

SEQ ID NO: 8257646 - DNA, 22 bp, Homo sapiens
tctgttatgcataagcatcagt

SEQ ID NO: 8257647 - DNA, 20 bp, Homo sapiens
tctgttattattacattgcc

SEQ ID NO: 8257648 - DNA, 22 bp, Homo sapiens
tctgttcttgtccccacttcag

SEQ ID NO: 8257649 - DNA, 22 bp, Homo sapiens
tctgttcttggtgcagctggga

SEQ ID NO: 8257650 - DNA, 22 bp, Homo sapiens
tctgttctttagcctgcttgag

SEQ ID NO: 8257651 - DNA, 22 bp, Homo sapiens
tctgtttagactcagttgaaac

SEQ ID NO: 8257652 - DNA, 22 bp, Homo sapiens
tctgtttaatgggaatgatact

SEQ ID NO: 8257653 - DNA, 22 bp, Homo sapiens
tctgtttagatgctttatctgt

SEQ ID NO: 8257654 - DNA, 22 bp, Homo sapiens
tctgtttatgcatatttaaaac

SEQ ID NO: 8257655 - DNA, 22 bp, Homo sapiens
tctgttgtctgcaattctggga

SEQ ID NO: 8257656 - DNA, 22 bp, Homo sapiens
tctgttggagcctaggatgaca

SEQ ID NO: 8257657 - DNA, 22 bp, Homo sapiens
tctgttgcaatgtgcatggtga

SEQ ID NO: 8257658 - DNA, 22 bp, Homo sapiens
tctgttgcaatgtgcatggtga

SEQ ID NO: 8257659 - DNA, 22 bp, Homo sapiens
tctgttgcatatgctgctgggt

SEQ ID NO: 8257660 - DNA, 22 bp, Homo sapiens
tctgttgctttcttcctgtgtg

SEQ ID NO: 8257661 - DNA, 22 bp, Homo sapiens
tctgttgcatatgctgctgggt

SEQ ID NO: 8257662 - DNA, 20 bp, Homo sapiens
tctgtgtgccatcacctaac

SEQ ID NO: 8257663 - DNA, 22 bp, Homo sapiens
tctgtgtgcccacctgacacct

SEQ ID NO: 8257664 - DNA, 22 bp, Homo sapiens
tctgtgtgatttcagggaagtc

SEQ ID NO: 8257665 - DNA, 22 bp, Homo sapiens
tctgtgtgatttcagggaagtc

SEQ ID NO: 8257666 - DNA, 22 bp, Homo sapiens
tctgtgtgatttcagggaagtc

SEQ ID NO: 8257667 - DNA, 22 bp, Homo sapiens
tctgtgtgaccataagccagct

SEQ ID NO: 8257668 - DNA, 22 bp, Homo sapiens
tctgtgtgaccataagccagct

SEQ ID NO: 8257669 - DNA, 22 bp, Homo sapiens
tctgtgtggtagtttcagtgaa

SEQ ID NO: 8257670 - DNA, 22 bp, Homo sapiens
tctgtgtgggatagtttgagga

SEQ ID NO: 8257671 - DNA, 22 bp, Homo sapiens
tctgtgtgttgtcaggaggatt

SEQ ID NO: 8257672 - DNA, 22 bp, Homo sapiens
tctgtgtgttgtcaggaggatt

SEQ ID NO: 8257673 - DNA, 22 bp, Homo sapiens
tctgtgtttgccatccttgctc

SEQ ID NO: 8257674 - DNA, 22 bp, Homo sapiens
tctgtgttttaaacagtagaaa

SEQ ID NO: 8257675 - DNA, 22 bp, Homo sapiens
tctgttatatagataatgtgtg

SEQ ID NO: 8257676 - DNA, 22 bp, Homo sapiens
tctgtgggtttcagggggctgt

SEQ ID NO: 8257677 - DNA, 22 bp, Homo sapiens
tctgtgggtttcagggggctgt

SEQ ID NO: 8257678 - DNA, 22 bp, Homo sapiens
tctgtgggttttgcagagttgc

SEQ ID NO: 8257679 - DNA, 22 bp, Homo sapiens
tctgtgggttttgcagagttgc

SEQ ID NO: 8257680 - DNA, 22 bp, Homo sapiens
tctgtggtggagtgggcatgag

SEQ ID NO: 8257681 - DNA, 23 bp, Homo sapiens
tctgtggtctcatctgaaggctc

SEQ ID NO: 8257682 - DNA, 22 bp, Homo sapiens
tctgtgggtgcctccagcagtg

SEQ ID NO: 8257683 - DNA, 22 bp, Homo sapiens
tctgtgggtgcctccagcagtg

SEQ ID NO: 8257684 - DNA, 22 bp, Homo sapiens
tctgtgggtagagtgagtactt

SEQ ID NO: 8257685 - DNA, 22 bp, Homo sapiens
tctgtgggtagagtgagtactt

SEQ ID NO: 8257686 - DNA, 22 bp, Homo sapiens
tctgtgggtgcctccagcagtg

SEQ ID NO: 8257687 - DNA, 22 bp, Homo sapiens
tctgtgggtttcagggggctgt

SEQ ID NO: 8257688 - DNA, 22 bp, Homo sapiens
tctgtgggtttcagggggctgt

SEQ ID NO: 8257689 - DNA, 22 bp, Homo sapiens
tctgtgggtttcagggggctgt

SEQ ID NO: 8257690 - DNA, 22 bp, Homo sapiens
tctgtggctttcgtgtaagatg

SEQ ID NO: 8257691 - DNA, 22 bp, Homo sapiens
tctgtggctttcttatgttgta

SEQ ID NO: 8257692 - DNA, 22 bp, Homo sapiens
tctgtggcttgggcctgcctgt

SEQ ID NO: 8257693 - DNA, 22 bp, Homo sapiens
tctgtggcttcctatttcttgg

SEQ ID NO: 8257694 - DNA, 22 bp, Homo sapiens
tctgtggcttctatttaacttt

SEQ ID NO: 8257695 - DNA, 22 bp, Homo sapiens
tctgtgggcatttataatctgg

SEQ ID NO: 8257696 - DNA, 22 bp, Homo sapiens
tctgtgggcatttataatctgg

SEQ ID NO: 8257697 - DNA, 18 bp, Homo sapiens
tctgtgggatcagtgagg

SEQ ID NO: 8257698 - DNA, 18 bp, Homo sapiens
tctgtgggatcagtgagg

SEQ ID NO: 8257699 - DNA, 22 bp, Homo sapiens
tctgtgggggtgtcttaaccta

SEQ ID NO: 8257700 - DNA, 22 bp, Homo sapiens
tctgtggggagcaggagccggg

SEQ ID NO: 8257701 - DNA, 22 bp, Homo sapiens
tctgtggggagcaggagccggg

SEQ ID NO: 8257702 - DNA, 22 bp, Homo sapiens
tctgtggggagcaggagccggg

SEQ ID NO: 8257703 - DNA, 22 bp, Homo sapiens
tctgtgtcactgaggcctgtgt

SEQ ID NO: 8257704 - DNA, 22 bp, Homo sapiens
tctgtgtcagaagatatcatgg

SEQ ID NO: 8257705 - DNA, 22 bp, Homo sapiens
tctgtgtcagcagcactcagcc

SEQ ID NO: 8257706 - DNA, 22 bp, Homo sapiens
tctgtgtcctgctagctgtctt

SEQ ID NO: 8257707 - DNA, 22 bp, Homo sapiens
tctgtgtctcaatcccatgctg

SEQ ID NO: 8257708 - DNA, 22 bp, Homo sapiens
tctgtgtctcaatcccatgctg

SEQ ID NO: 8257709 - DNA, 22 bp, Homo sapiens
tctgtgtcgttctgtgctctgg

SEQ ID NO: 8257710 - DNA, 22 bp, Homo sapiens
tctgtgtcgttctgtgctctgg

SEQ ID NO: 8257711 - DNA, 22 bp, Homo sapiens
tctgtgtctgcagaagttcagc

SEQ ID NO: 8257712 - DNA, 22 bp, Homo sapiens
tctgtgtctgggcctccgcctg

SEQ ID NO: 8257713 - DNA, 22 bp, Homo sapiens
tctgtgtctggttgggccagta

SEQ ID NO: 8257714 - DNA, 22 bp, Homo sapiens
tctgtgtctgttacttcactgc

SEQ ID NO: 8257715 - DNA, 19 bp, Homo sapiens
tctgtggagctcagagtag

SEQ ID NO: 8257716 - DNA, 22 bp, Homo sapiens
tctgtggactcaagggatcaca

SEQ ID NO: 8257717 - DNA, 22 bp, Homo sapiens
tctgtggactcaagggatcaca

SEQ ID NO: 8257718 - DNA, 22 bp, Homo sapiens
tctgtggaagattccaggcgtt

SEQ ID NO: 8257719 - DNA, 18 bp, Homo sapiens
tctgtggagagggcagtt

SEQ ID NO: 8257720 - DNA, 18 bp, Homo sapiens
tctgtggagagggcagtt

SEQ ID NO: 8257721 - DNA, 22 bp, Homo sapiens
tctgtgctttccctgccttctt

SEQ ID NO: 8257722 - DNA, 22 bp, Homo sapiens
tctgtggaaatttcctgaggca

SEQ ID NO: 8257723 - DNA, 22 bp, Homo sapiens
tctgtggaaatttcctgaggca

SEQ ID NO: 8257724 - DNA, 22 bp, Homo sapiens
tctgtgcttaactactcacccc

SEQ ID NO: 8257725 - DNA, 22 bp, Homo sapiens
tctgtgcttaactactcacccc

SEQ ID NO: 8257726 - DNA, 23 bp, Homo sapiens
tctgtggctccttcaggctgctg

SEQ ID NO: 8257727 - DNA, 23 bp, Homo sapiens
tctgtggctccttcaggctgctg

SEQ ID NO: 8257728 - DNA, 22 bp, Homo sapiens
tctgtggctggtaattgcatgt

SEQ ID NO: 8257729 - DNA, 22 bp, Homo sapiens
tctgtggctggagaacttgtct

SEQ ID NO: 8257730 - DNA, 22 bp, Homo sapiens
tctgtggctgtctttccagagg

SEQ ID NO: 8257731 - DNA, 22 bp, Homo sapiens
tctgtggctgtctttccagagg

SEQ ID NO: 8257732 - DNA, 22 bp, Homo sapiens
tctgtggctgtgctgggccaga

SEQ ID NO: 8257733 - DNA, 19 bp, Homo sapiens
tctgtggctgtggggagga

SEQ ID NO: 8257734 - DNA, 22 bp, Homo sapiens
tctgtggctgttatctttatat

SEQ ID NO: 8257735 - DNA, 22 bp, Homo sapiens
tctgtggctgttatctttatat

SEQ ID NO: 8257736 - DNA, 22 bp, Homo sapiens
tctgtgctggactgatttcata

SEQ ID NO: 8257737 - DNA, 22 bp, Homo sapiens
tctgtgctggactgatttcata

SEQ ID NO: 8257738 - DNA, 21 bp, Homo sapiens
tctgtgctgccgtcaacatcc

SEQ ID NO: 8257739 - DNA, 22 bp, Homo sapiens
tctgtgctgccatcctgtggcc

SEQ ID NO: 8257740 - DNA, 21 bp, Homo sapiens
tctgtgctgccgtcaacatcc

SEQ ID NO: 8257741 - DNA, 22 bp, Homo sapiens
tctgtgctgcccaacttctcaa

SEQ ID NO: 8257742 - DNA, 22 bp, Homo sapiens
tctgtgctgagctctgagatgt

SEQ ID NO: 8257743 - DNA, 22 bp, Homo sapiens
tctgtgctcatgcatgtgaatt

SEQ ID NO: 8257744 - DNA, 22 bp, Homo sapiens
tctgtgctcattcagtcattca

SEQ ID NO: 8257745 - DNA, 22 bp, Homo sapiens
tctgtgctcatgcatgtgaatt

SEQ ID NO: 8257746 - DNA, 22 bp, Homo sapiens
tctgtgctcaagttctgcctct

SEQ ID NO: 8257747 - DNA, 20 bp, Homo sapiens
tctgtgctacactccagatt

SEQ ID NO: 8257748 - DNA, 22 bp, Homo sapiens
tctgtgacttacaagaagggac

SEQ ID NO: 8257749 - DNA, 22 bp, Homo sapiens
tctgtgagaaccagtgccaggg

SEQ ID NO: 8257750 - DNA, 22 bp, Homo sapiens
tctgtgatagtttttcagctat

SEQ ID NO: 8257751 - DNA, 22 bp, Homo sapiens
tctgtgcaagaccaactttcaa

SEQ ID NO: 8257752 - DNA, 22 bp, Homo sapiens
tctgtgcaagtatttgacattt

SEQ ID NO: 8257753 - DNA, 22 bp, Homo sapiens
tctgtgcaccagaatgatattt

SEQ ID NO: 8257754 - DNA, 22 bp, Homo sapiens
tctgtgcacaataggcattttt

SEQ ID NO: 8257755 - DNA, 22 bp, Homo sapiens
tctgtgcactaacattcctggt

SEQ ID NO: 8257756 - DNA, 22 bp, Homo sapiens
tctgtgcaccttctaatgagta

SEQ ID NO: 8257757 - DNA, 20 bp, Homo sapiens
tctgtgcacctgctacaagg

SEQ ID NO: 8257758 - DNA, 20 bp, Homo sapiens
tctgtgcacctgctacaagg

SEQ ID NO: 8257759 - DNA, 22 bp, Homo sapiens
tctgtctgccttgtgagggcac

SEQ ID NO: 8257760 - DNA, 22 bp, Homo sapiens
tctgtctgcctgtgtccccacc

SEQ ID NO: 8257761 - DNA, 22 bp, Homo sapiens
tctgtctgagggagtgacattt

SEQ ID NO: 8257762 - DNA, 22 bp, Homo sapiens
tctgtctgcttcacttgcattt

SEQ ID NO: 8257763 - DNA, 22 bp, Homo sapiens
tctgtctgctcatttacctcag

SEQ ID NO: 8257764 - DNA, 22 bp, Homo sapiens
tctgtctgcttcacttgcattt

SEQ ID NO: 8257765 - DNA, 22 bp, Homo sapiens
tctgtctttgagatctcagcct

SEQ ID NO: 8257766 - DNA, 22 bp, Homo sapiens
tctgtgcagatgtagaccagtt

SEQ ID NO: 8257767 - DNA, 22 bp, Homo sapiens
tctgtgcaggaagtcattatga

SEQ ID NO: 8257768 - DNA, 22 bp, Homo sapiens
tctgtgcaggatttgaggaacc

SEQ ID NO: 8257769 - DNA, 22 bp, Homo sapiens
tctgtgcagaactcacagaagg

SEQ ID NO: 8257770 - DNA, 22 bp, Homo sapiens
tctgtgcagaatcaaggagctt

SEQ ID NO: 8257771 - DNA, 22 bp, Homo sapiens
tctgtgcactgtgtcattaggt

SEQ ID NO: 8257772 - DNA, 20 bp, Homo sapiens
tctgtgcagtggaggggcag

SEQ ID NO: 8257773 - DNA, 20 bp, Homo sapiens
tctgtgcagtggaggggcag

SEQ ID NO: 8257774 - DNA, 22 bp, Homo sapiens
tctgtgcagttcttgtcttgac

SEQ ID NO: 8257775 - DNA, 22 bp, Homo sapiens
tctgtgcagggaccccaagagt

SEQ ID NO: 8257776 - DNA, 20 bp, Homo sapiens
tctgtgcattgcctgctggt

SEQ ID NO: 8257777 - DNA, 22 bp, Homo sapiens
tctgtgcatttcaggacctgaa

SEQ ID NO: 8257778 - DNA, 22 bp, Homo sapiens
tctgtgccaagcttatatctgt

SEQ ID NO: 8257779 - DNA, 23 bp, Homo sapiens
tctgtgccagtttccatgtctgt

SEQ ID NO: 8257780 - DNA, 23 bp, Homo sapiens
tctgtgccagtttccatgtctgt

SEQ ID NO: 8257781 - DNA, 22 bp, Homo sapiens
tctgtgccacctctccagtgtc

SEQ ID NO: 8257782 - DNA, 22 bp, Homo sapiens
tctgtgccacctctccagtgtc

SEQ ID NO: 8257783 - DNA, 22 bp, Homo sapiens
tctgtgccagcagcctcctgga

SEQ ID NO: 8257784 - DNA, 22 bp, Homo sapiens
tctgtgccatgcccgtctacca

SEQ ID NO: 8257785 - DNA, 22 bp, Homo sapiens
tctgtgccatgcccgtctacca

SEQ ID NO: 8257786 - DNA, 22 bp, Homo sapiens
tctgtgccatcagtctccagag

SEQ ID NO: 8257787 - DNA, 23 bp, Homo sapiens
tctgtgccagtttccatgtctgt

SEQ ID NO: 8257788 - DNA, 22 bp, Homo sapiens
tctgtgccctcggtgctgggcc

SEQ ID NO: 8257789 - DNA, 22 bp, Homo sapiens
tctgtgccgcgccggagaccct

SEQ ID NO: 8257790 - DNA, 22 bp, Homo sapiens
tctgtgccctcggtgctgggcc

SEQ ID NO: 8257791 - DNA, 22 bp, Homo sapiens
tctgtgctaatttatccttcct

SEQ ID NO: 8257792 - DNA, 22 bp, Homo sapiens
tctgtgctaatgcttcacaata

SEQ ID NO: 8257793 - DNA, 22 bp, Homo sapiens
tctgtgcctttaagaagctcat

SEQ ID NO: 8257794 - DNA, 22 bp, Homo sapiens
tctgtgcctcatctggttcagg

SEQ ID NO: 8257795 - DNA, 22 bp, Homo sapiens
tctgtgcctcatctggttcagg

SEQ ID NO: 8257796 - DNA, 21 bp, Homo sapiens
tctgtgcctcaaccctcatct

SEQ ID NO: 8257797 - DNA, 22 bp, Homo sapiens
tctgtgcctccgtaacacacca

SEQ ID NO: 8257798 - DNA, 22 bp, Homo sapiens
tctgtgcctgcttccccaccca

SEQ ID NO: 8257799 - DNA, 22 bp, Homo sapiens
tctggggtcacctggggtgctt

SEQ ID NO: 8257800 - DNA, 22 bp, Homo sapiens
tctggggtcacctggggtgctt

SEQ ID NO: 8257801 - DNA, 22 bp, Homo sapiens
tctgggggttaagtgaggacaa

SEQ ID NO: 8257802 - DNA, 22 bp, Homo sapiens
tctggggtgaggcctggttatc

SEQ ID NO: 8257803 - DNA, 22 bp, Homo sapiens
tctggggtgcagcctaggcatc

SEQ ID NO: 8257804 - DNA, 22 bp, Homo sapiens
tctggggtgcagcctaggcatc

SEQ ID NO: 8257805 - DNA, 20 bp, Homo sapiens
tctggggtgaagcccaggaa

SEQ ID NO: 8257806 - DNA, 22 bp, Homo sapiens
tctggggtcacctggggtgctt

SEQ ID NO: 8257807 - DNA, 20 bp, Homo sapiens
tctggggtgaagcccaggaa

SEQ ID NO: 8257808 - DNA, 22 bp, Homo sapiens
tctggggtgtgacctgagcatg

SEQ ID NO: 8257809 - DNA, 22 bp, Homo sapiens
tctggggtgtgacctgagcatg

SEQ ID NO: 8257810 - DNA, 22 bp, Homo sapiens
tctggggtggagccctggagtc

SEQ ID NO: 8257811 - DNA, 22 bp, Homo sapiens
tctggggtgcagcctggacata

SEQ ID NO: 8257812 - DNA, 22 bp, Homo sapiens
tctggggtgcagcctggacata

SEQ ID NO: 8257813 - DNA, 22 bp, Homo sapiens
tctggggtggagccctggagtc

SEQ ID NO: 8257814 - DNA, 22 bp, Homo sapiens
tctggggtggagccctggagtc

SEQ ID NO: 8257815 - DNA, 22 bp, Homo sapiens
tctggggtgtgacctgagcatg

SEQ ID NO: 8257816 - DNA, 18 bp, Homo sapiens
tctggggtgtgctgtgta

SEQ ID NO: 8257817 - DNA, 18 bp, Homo sapiens
tctggggtgtgctgtgta

SEQ ID NO: 8257818 - DNA, 18 bp, Homo sapiens
tctggggtgtgctgtgta

SEQ ID NO: 8257819 - DNA, 22 bp, Homo sapiens
tctggggttaagcccaggaatg

SEQ ID NO: 8257820 - DNA, 19 bp, Homo sapiens
tctggggtgtggcctggca

SEQ ID NO: 8257821 - DNA, 19 bp, Homo sapiens
tctggggtgtggcctggca

SEQ ID NO: 8257822 - DNA, 22 bp, Homo sapiens
tctggggttgagtctgggtcag

SEQ ID NO: 8257823 - DNA, 22 bp, Homo sapiens
tctggggttaagcccaggaatg

SEQ ID NO: 8257824 - DNA, 22 bp, Homo sapiens
tctggggttgagtctgggtcag

SEQ ID NO: 8257825 - DNA, 22 bp, Homo sapiens
tctggggtttgtggttcttctg

SEQ ID NO: 8257826 - DNA, 22 bp, Homo sapiens
tctggggttggtgcttacacca

SEQ ID NO: 8257827 - DNA, 22 bp, Homo sapiens
tctggggttttcacgctgtctc

SEQ ID NO: 8257828 - DNA, 22 bp, Homo sapiens
tctgggtccgggactgtggatg

SEQ ID NO: 8257829 - DNA, 22 bp, Homo sapiens
tctgggtctatcccatgccttt

SEQ ID NO: 8257830 - DNA, 22 bp, Homo sapiens
tctgggtctattcctactgtga

SEQ ID NO: 8257831 - DNA, 22 bp, Homo sapiens
tctgggtctggctgctggtgca

SEQ ID NO: 8257832 - DNA, 22 bp, Homo sapiens
tctgggtctggctgctggtgca

SEQ ID NO: 8257833 - DNA, 22 bp, Homo sapiens
tctgggtctcagagtgaccatg

SEQ ID NO: 8257834 - DNA, 22 bp, Homo sapiens
tctgggtgaccctgggcaaggc

SEQ ID NO: 8257835 - DNA, 22 bp, Homo sapiens
tctgggtgaccctgggcaaggc

SEQ ID NO: 8257836 - DNA, 22 bp, Homo sapiens
tctgggtgatgaaatgcactgt

SEQ ID NO: 8257837 - DNA, 22 bp, Homo sapiens
tctgggtgatgaaatgcactgt

SEQ ID NO: 8257838 - DNA, 22 bp, Homo sapiens
tctgggtgagctgcctcgggtc

SEQ ID NO: 8257839 - DNA, 22 bp, Homo sapiens
tctgggtgccactgtctgtaca

SEQ ID NO: 8257840 - DNA, 22 bp, Homo sapiens
tctgggtgccctttgctctgtt

SEQ ID NO: 8257841 - DNA, 22 bp, Homo sapiens
tctgggtgctacaaacagtatt

SEQ ID NO: 8257842 - DNA, 22 bp, Homo sapiens
tctgggtgccctttgctctgtt

SEQ ID NO: 8257843 - DNA, 22 bp, Homo sapiens
tctgggtgccctttgctctgtt

SEQ ID NO: 8257844 - DNA, 21 bp, Homo sapiens
tctgggtgctagtgtttgctt

SEQ ID NO: 8257845 - DNA, 22 bp, Homo sapiens
tctgggtggcagtgatggcgtg

SEQ ID NO: 8257846 - DNA, 22 bp, Homo sapiens
tctgggtggctgccaatctgcc

SEQ ID NO: 8257847 - DNA, 22 bp, Homo sapiens
tctgggtggcttcagaggccac

SEQ ID NO: 8257848 - DNA, 22 bp, Homo sapiens
tctgggtgggcccgagaaatct

SEQ ID NO: 8257849 - DNA, 22 bp, Homo sapiens
tctgggtggtgtcttccaagac

SEQ ID NO: 8257850 - DNA, 21 bp, Homo sapiens
tctgggtgtaaatcttatttg

SEQ ID NO: 8257851 - DNA, 22 bp, Homo sapiens
tctgggttgggagaaaagaggg

SEQ ID NO: 8257852 - DNA, 22 bp, Homo sapiens
tctgggttgaattggataaaca

SEQ ID NO: 8257853 - DNA, 20 bp, Homo sapiens
tctgggttgaaatcaagatc

SEQ ID NO: 8257854 - DNA, 22 bp, Homo sapiens
tctgggttcttgatgctacctt

SEQ ID NO: 8257855 - DNA, 22 bp, Homo sapiens
tctgggttcaaggggagtctgc

SEQ ID NO: 8257856 - DNA, 22 bp, Homo sapiens
tctgggttattatgatggctac

SEQ ID NO: 8257857 - DNA, 22 bp, Homo sapiens
tctgggttcttcgattcttccc

SEQ ID NO: 8257858 - DNA, 23 bp, Homo sapiens
tctgggttctaatcatgtgtgat

SEQ ID NO: 8257859 - DNA, 22 bp, Homo sapiens
tctgggtgtagggcctggcaac

SEQ ID NO: 8257860 - DNA, 22 bp, Homo sapiens
tctgggtgtcactcctgcctgc

SEQ ID NO: 8257861 - DNA, 22 bp, Homo sapiens
tctgggtgtcactcctgcctgc

SEQ ID NO: 8257862 - DNA, 22 bp, Homo sapiens
tctgggtgtggtatcttagcca

SEQ ID NO: 8257863 - DNA, 18 bp, Homo sapiens
tctggtttctaggggagt

SEQ ID NO: 8257864 - DNA, 22 bp, Homo sapiens
tctgggttgggttcctggaatt

SEQ ID NO: 8257865 - DNA, 22 bp, Homo sapiens
tctgtaaaacttctttgtaaat

SEQ ID NO: 8257866 - DNA, 22 bp, Homo sapiens
tctgggggcgaccagggactgc

SEQ ID NO: 8257867 - DNA, 22 bp, Homo sapiens
tctgggggcgaccagggactgc

SEQ ID NO: 8257868 - DNA, 22 bp, Homo sapiens
tctgggggaggaggcatggccc

SEQ ID NO: 8257869 - DNA, 21 bp, Homo sapiens
tctgggggtgagcctagaaat

SEQ ID NO: 8257870 - DNA, 22 bp, Homo sapiens
tctgggggaggaggcatggccc

SEQ ID NO: 8257871 - DNA, 22 bp, Homo sapiens
tctggggcagttactggggcct

SEQ ID NO: 8257872 - DNA, 22 bp, Homo sapiens
tctggggcagttactggggcct

SEQ ID NO: 8257873 - DNA, 22 bp, Homo sapiens
tctggggcagttactggggcct

SEQ ID NO: 8257874 - DNA, 22 bp, Homo sapiens
tctggggatgagtgatgtcgta

SEQ ID NO: 8257875 - DNA, 22 bp, Homo sapiens
tctgggctttgtaatgggaggt

SEQ ID NO: 8257876 - DNA, 22 bp, Homo sapiens
tctgggctttgtaatgggaggt

SEQ ID NO: 8257877 - DNA, 22 bp, Homo sapiens
tctgggctttgtaatgggaggt

SEQ ID NO: 8257878 - DNA, 22 bp, Homo sapiens
tctgggctttgtaatgggaggt

SEQ ID NO: 8257879 - DNA, 22 bp, Homo sapiens
tctgggcttttccatgcctgtg

SEQ ID NO: 8257880 - DNA, 22 bp, Homo sapiens
tctgggcttttccatgcctgtg

SEQ ID NO: 8257881 - DNA, 21 bp, Homo sapiens
tctgggctttcttataaggca

SEQ ID NO: 8257882 - DNA, 21 bp, Homo sapiens
tctgggctttcttataaggca

SEQ ID NO: 8257883 - DNA, 21 bp, Homo sapiens
tctgggctttcttataaggca

SEQ ID NO: 8257884 - DNA, 22 bp, Homo sapiens
tctgggctttagtttgttatct

SEQ ID NO: 8257885 - DNA, 22 bp, Homo sapiens
tctgggctttagtttgttatct

SEQ ID NO: 8257886 - DNA, 22 bp, Homo sapiens
tctgggctttgtaatgggaggt

SEQ ID NO: 8257887 - DNA, 22 bp, Homo sapiens
tctgggctttgtaatgggaggt

SEQ ID NO: 8257888 - DNA, 22 bp, Homo sapiens
tctgggctttgtaatgggaggt

SEQ ID NO: 8257889 - DNA, 22 bp, Homo sapiens
tctgggctttacactgtgctta

SEQ ID NO: 8257890 - DNA, 22 bp, Homo sapiens
tctgggctttacactgtgctta

SEQ ID NO: 8257891 - DNA, 22 bp, Homo sapiens
tctgggctttacactgtgctta

SEQ ID NO: 8257892 - DNA, 22 bp, Homo sapiens
tctgggctttacactgtgctta

SEQ ID NO: 8257893 - DNA, 22 bp, Homo sapiens
tctgggctttaagaactctgtt

SEQ ID NO: 8257894 - DNA, 22 bp, Homo sapiens
tctgggctttacactgtgctta

SEQ ID NO: 8257895 - DNA, 22 bp, Homo sapiens
tctgggcttgggtagaaatcac

SEQ ID NO: 8257896 - DNA, 22 bp, Homo sapiens
tctgggcttgggtagaaatcac

SEQ ID NO: 8257897 - DNA, 22 bp, Homo sapiens
tctgggcttggttagggctgtt

SEQ ID NO: 8257898 - DNA, 22 bp, Homo sapiens
tctgggcttggattggctctgc

SEQ ID NO: 8257899 - DNA, 22 bp, Homo sapiens
tctgggcttggattggctctgc

SEQ ID NO: 8257900 - DNA, 22 bp, Homo sapiens
tctgggctttaagaactctgtt

SEQ ID NO: 8257901 - DNA, 22 bp, Homo sapiens
tctgggcttggttagggctgtt

SEQ ID NO: 8257902 - DNA, 22 bp, Homo sapiens
tctgggcttggttagggctgtt

SEQ ID NO: 8257903 - DNA, 22 bp, Homo sapiens
tctgggctttaagaactctgtt

SEQ ID NO: 8257904 - DNA, 22 bp, Homo sapiens
tctgggcttggttagggctgtt

SEQ ID NO: 8257905 - DNA, 22 bp, Homo sapiens
tctgggctttaagaactctgtt

SEQ ID NO: 8257906 - DNA, 22 bp, Homo sapiens
tctgggctttaagaactctgtt

SEQ ID NO: 8257907 - DNA, 22 bp, Homo sapiens
tctgggctggtgctcatgaatt

SEQ ID NO: 8257908 - DNA, 22 bp, Homo sapiens
tctgggctggtgctcatgaatt

SEQ ID NO: 8257909 - DNA, 22 bp, Homo sapiens
tctgggctgggcttaggaaccc

SEQ ID NO: 8257910 - DNA, 22 bp, Homo sapiens
tctgggctggtgctcatgaatt

SEQ ID NO: 8257911 - DNA, 22 bp, Homo sapiens
tctgggctggttgtgcttgctt

SEQ ID NO: 8257912 - DNA, 22 bp, Homo sapiens
tctgggctggttgtgcttgctt

SEQ ID NO: 8257913 - DNA, 22 bp, Homo sapiens
tctgggctggttgtgcttgctt

SEQ ID NO: 8257914 - DNA, 22 bp, Homo sapiens
tctgggctgtctacaggttggc

SEQ ID NO: 8257915 - DNA, 22 bp, Homo sapiens
tctgggctgtctacaggttggc

SEQ ID NO: 8257916 - DNA, 15 bp, Homo sapiens
tctgggctgtgagca

SEQ ID NO: 8257917 - DNA, 15 bp, Homo sapiens
tctgggctgtgagca

SEQ ID NO: 8257918 - DNA, 22 bp, Homo sapiens
tctgggctgtctacaggttggc

SEQ ID NO: 8257919 - DNA, 22 bp, Homo sapiens
tctgggctgcttcagccttcgc

SEQ ID NO: 8257920 - DNA, 22 bp, Homo sapiens
tctgggctgcttcagccttcgc

SEQ ID NO: 8257921 - DNA, 22 bp, Homo sapiens
tctgggctggctttatgctgac

SEQ ID NO: 8257922 - DNA, 23 bp, Homo sapiens
tctgggctgcttaaggatcaagg

SEQ ID NO: 8257923 - DNA, 22 bp, Homo sapiens
tctgggctgcttcagccttcgc

SEQ ID NO: 8257924 - DNA, 22 bp, Homo sapiens
tctgggctgggagcgtgtggac

SEQ ID NO: 8257925 - DNA, 22 bp, Homo sapiens
tctgggctggctttatgctgac

SEQ ID NO: 8257926 - DNA, 22 bp, Homo sapiens
tctgggctgggagcgtgtggac

SEQ ID NO: 8257927 - DNA, 22 bp, Homo sapiens
tctgggctgggcttaggaaccc

SEQ ID NO: 8257928 - DNA, 22 bp, Homo sapiens
tctgggctgggagcgtgtggac

SEQ ID NO: 8257929 - DNA, 22 bp, Homo sapiens
tctgggctgggagcgtgtggac

SEQ ID NO: 8257930 - DNA, 17 bp, Homo sapiens
tctgggcttcagtggtc

SEQ ID NO: 8257931 - DNA, 17 bp, Homo sapiens
tctgggcttcagtggtc

SEQ ID NO: 8257932 - DNA, 22 bp, Homo sapiens
tctgggctgtgccaaagctctt

SEQ ID NO: 8257933 - DNA, 22 bp, Homo sapiens
tctgggctgtgccaaagctctt

SEQ ID NO: 8257934 - DNA, 22 bp, Homo sapiens
tctgggctgtgggaattcaaca

SEQ ID NO: 8257935 - DNA, 22 bp, Homo sapiens
tctgggctgtgggaattcaaca

SEQ ID NO: 8257936 - DNA, 17 bp, Homo sapiens
tctgggcttcagtggtc

SEQ ID NO: 8257937 - DNA, 22 bp, Homo sapiens
tctgggctgtggttccactccg

SEQ ID NO: 8257938 - DNA, 22 bp, Homo sapiens
tctgggctgtggttccactccg

SEQ ID NO: 8257939 - DNA, 22 bp, Homo sapiens
tctgggcttggattggctctgc

SEQ ID NO: 8257940 - DNA, 22 bp, Homo sapiens
tctgggcttgcctggttgtgca

SEQ ID NO: 8257941 - DNA, 22 bp, Homo sapiens
tctgggcttgcctggttgtgca

SEQ ID NO: 8257942 - DNA, 22 bp, Homo sapiens
tctgggcttgcctggttgtgca

SEQ ID NO: 8257943 - DNA, 22 bp, Homo sapiens
tctgggcttgcctggttgtgca

SEQ ID NO: 8257944 - DNA, 20 bp, Homo sapiens
tctgggcttcccccagctcc

SEQ ID NO: 8257945 - DNA, 20 bp, Homo sapiens
tctgggcttcccccagctcc

SEQ ID NO: 8257946 - DNA, 18 bp, Homo sapiens
tctgggcttcccgaggct

SEQ ID NO: 8257947 - DNA, 18 bp, Homo sapiens
tctgggcttcccgaggct

SEQ ID NO: 8257948 - DNA, 18 bp, Homo sapiens
tctgggcttcccgaggct

SEQ ID NO: 8257949 - DNA, 18 bp, Homo sapiens
tctgggcttcccgaggct

SEQ ID NO: 8257950 - DNA, 22 bp, Homo sapiens
tctgtaatcaagatatttgaga

SEQ ID NO: 8257951 - DNA, 22 bp, Homo sapiens
tctgtaagggaaggtgatttgc

SEQ ID NO: 8257952 - DNA, 22 bp, Homo sapiens
tctgtacaaaggctatttggag

SEQ ID NO: 8257953 - DNA, 20 bp, Homo sapiens
tctgtaaagactccagaagc

SEQ ID NO: 8257954 - DNA, 22 bp, Homo sapiens
tctgtaaagactccaaaagcca

SEQ ID NO: 8257955 - DNA, 22 bp, Homo sapiens
tctgtaaagactccaaaagcca

SEQ ID NO: 8257956 - DNA, 22 bp, Homo sapiens
tctgtaaacaccatgttagagt

SEQ ID NO: 8257957 - DNA, 20 bp, Homo sapiens
tctgtacactcatcttctgc

SEQ ID NO: 8257958 - DNA, 22 bp, Homo sapiens
tctgtacaccaggggccattct

SEQ ID NO: 8257959 - DNA, 20 bp, Homo sapiens
tctgtacactcatcttctgc

SEQ ID NO: 8257960 - DNA, 20 bp, Homo sapiens
tctgtacactcatcttctgc

SEQ ID NO: 8257961 - DNA, 20 bp, Homo sapiens
tctgtacactcatcttctgc

SEQ ID NO: 8257962 - DNA, 22 bp, Homo sapiens
tctgtacaacaaagggatgaga

SEQ ID NO: 8257963 - DNA, 22 bp, Homo sapiens
tctgtacaacaaagggatgaga

SEQ ID NO: 8257964 - DNA, 23 bp, Homo sapiens
tctgtacacatcagcatctccca

SEQ ID NO: 8257965 - DNA, 22 bp, Homo sapiens
tctgtacagtaccagatagtaa

SEQ ID NO: 8257966 - DNA, 22 bp, Homo sapiens
tctgtacagtaccagatagtaa

SEQ ID NO: 8257967 - DNA, 22 bp, Homo sapiens
tctgtacagtaccagatagtaa

SEQ ID NO: 8257968 - DNA, 21 bp, Homo sapiens
tctgtacatcattgagtcccc

SEQ ID NO: 8257969 - DNA, 22 bp, Homo sapiens
tctgtacatgagttgagaatca

SEQ ID NO: 8257970 - DNA, 22 bp, Homo sapiens
tctgtcacccaggctggagtgc

SEQ ID NO: 8257971 - DNA, 22 bp, Homo sapiens
tctgtcacccagagtgcagtgg

SEQ ID NO: 8257972 - DNA, 22 bp, Homo sapiens
tctgtcacccaggctggagtgc

SEQ ID NO: 8257973 - DNA, 22 bp, Homo sapiens
tctgtcacaatttgcttactct

SEQ ID NO: 8257974 - DNA, 22 bp, Homo sapiens
tctgtcaccattcagcttgaat

SEQ ID NO: 8257975 - DNA, 22 bp, Homo sapiens
tctgtcaatatatgtgctgcag

SEQ ID NO: 8257976 - DNA, 22 bp, Homo sapiens
tctgtcacaagtaatccttttc

SEQ ID NO: 8257977 - DNA, 22 bp, Homo sapiens
tctgtcacaagtaatccttttc

SEQ ID NO: 8257978 - DNA, 22 bp, Homo sapiens
tctgtcacaatttgcttactct

SEQ ID NO: 8257979 - DNA, 22 bp, Homo sapiens
tctgtatatattaatgaaattc

SEQ ID NO: 8257980 - DNA, 22 bp, Homo sapiens
tctgtatcgtaatcatgtctgg

SEQ ID NO: 8257981 - DNA, 22 bp, Homo sapiens
tctgtattgagaaagccggaca

SEQ ID NO: 8257982 - DNA, 22 bp, Homo sapiens
tctgtattctatggcagttggt

SEQ ID NO: 8257983 - DNA, 20 bp, Homo sapiens
tctgtagtctgtggcaagac

SEQ ID NO: 8257984 - DNA, 22 bp, Homo sapiens
tctgtataaggacaaacattta

SEQ ID NO: 8257985 - DNA, 22 bp, Homo sapiens
tctgtagtctgtgccatagctg

SEQ ID NO: 8257986 - DNA, 22 bp, Homo sapiens
tctgtagtctctgatatatctg

SEQ ID NO: 8257987 - DNA, 22 bp, Homo sapiens
tctgtacctcacatgcaccatc

SEQ ID NO: 8257988 - DNA, 22 bp, Homo sapiens
tctgtacatttgtgttgtgaat

SEQ ID NO: 8257989 - DNA, 22 bp, Homo sapiens
tctgtacatgagttgagaatca

SEQ ID NO: 8257990 - DNA, 22 bp, Homo sapiens
tctgtacatttgtgttgtgaat

SEQ ID NO: 8257991 - DNA, 22 bp, Homo sapiens
tctgtacatttggggaccccag

SEQ ID NO: 8257992 - DNA, 22 bp, Homo sapiens
tctgtactttacatgcagtgct

SEQ ID NO: 8257993 - DNA, 20 bp, Homo sapiens
tctgtactggagacctttat

SEQ ID NO: 8257994 - DNA, 22 bp, Homo sapiens
tctgtacttttattttggcact

SEQ ID NO: 8257995 - DNA, 21 bp, Homo sapiens
tctgtactttgcttccatgct

SEQ ID NO: 8257996 - DNA, 22 bp, Homo sapiens
tctgtagcaagtgagaggcatt

SEQ ID NO: 8257997 - DNA, 22 bp, Homo sapiens
tctgtaggggccggcggagccc

SEQ ID NO: 8257998 - DNA, 22 bp, Homo sapiens
tctgtagtaggttgtagttctt

SEQ ID NO: 8257999 - DNA, 22 bp, Homo sapiens
tctgtcctctccctgaccacaa

SEQ ID NO: 8258000 - DNA, 22 bp, Homo sapiens
tctgtcctccggagctcccagt

SEQ ID NO: 8258001 - DNA, 22 bp, Homo sapiens
tctgtcctccggagctcccagt

SEQ ID NO: 8258002 - DNA, 22 bp, Homo sapiens
tctgtccggcaggcaggcaagt

SEQ ID NO: 8258003 - DNA, 22 bp, Homo sapiens
tctgtccctgagagctcaggag

SEQ ID NO: 8258004 - DNA, 22 bp, Homo sapiens
tctgtccaggcttactatatat

SEQ ID NO: 8258005 - DNA, 22 bp, Homo sapiens
tctgtccattcagccatccatc

SEQ ID NO: 8258006 - DNA, 22 bp, Homo sapiens
tctgtccatgcctggaggagag

SEQ ID NO: 8258007 - DNA, 22 bp, Homo sapiens
tctgtccatgcttttctctcac

SEQ ID NO: 8258008 - DNA, 22 bp, Homo sapiens
tctgtcatgccacaggacttgg

SEQ ID NO: 8258009 - DNA, 22 bp, Homo sapiens
tctgtcatgccacaggacttgg

SEQ ID NO: 8258010 - DNA, 22 bp, Homo sapiens
tctgtcatctgttcagtgctca

SEQ ID NO: 8258011 - DNA, 22 bp, Homo sapiens
tctgtcatctctaaaatagaaa

SEQ ID NO: 8258012 - DNA, 22 bp, Homo sapiens
tctgtcacccaggctggagtgc

SEQ ID NO: 8258013 - DNA, 22 bp, Homo sapiens
tctgtcattagccttgactgta

SEQ ID NO: 8258014 - DNA, 22 bp, Homo sapiens
tctgtcatgtttccattacatg

SEQ ID NO: 8258015 - DNA, 21 bp, Homo sapiens
tctgtcatttgttagatgcaa

SEQ ID NO: 8258016 - DNA, 21 bp, Homo sapiens
tctgtcatttgttagatgcaa

SEQ ID NO: 8258017 - DNA, 19 bp, Homo sapiens
tctgtcatttcttctgtac

SEQ ID NO: 8258018 - DNA, 18 bp, Homo sapiens
tctgtccaccctgtgctg

SEQ ID NO: 8258019 - DNA, 23 bp, Homo sapiens
tctgtccaccgcatgcagcggcc

SEQ ID NO: 8258020 - DNA, 22 bp, Homo sapiens
tctgtcattttgtatctacatg

SEQ ID NO: 8258021 - DNA, 22 bp, Homo sapiens
tctgtcattttgtatctacatg

SEQ ID NO: 8258022 - DNA, 22 bp, Homo sapiens
tctgtccagaacgtacatcttg

SEQ ID NO: 8258023 - DNA, 22 bp, Homo sapiens
tctgtccagaacgtacatcttg

SEQ ID NO: 8258024 - DNA, 22 bp, Homo sapiens
tctgtccagctctcaggagaca

SEQ ID NO: 8258025 - DNA, 22 bp, Homo sapiens
tctgtccagctctggggctcac

SEQ ID NO: 8258026 - DNA, 22 bp, Homo sapiens
tctgtctctttgttctgtgagt

SEQ ID NO: 8258027 - DNA, 22 bp, Homo sapiens
tctgtctgactaccatgaggca

SEQ ID NO: 8258028 - DNA, 20 bp, Homo sapiens
tctgtctctgagctagactt

SEQ ID NO: 8258029 - DNA, 18 bp, Homo sapiens
tctgtctctgtccttgct

SEQ ID NO: 8258030 - DNA, 18 bp, Homo sapiens
tctgtctctgtccttgct

SEQ ID NO: 8258031 - DNA, 18 bp, Homo sapiens
tctgtctctgtccttgct

SEQ ID NO: 8258032 - DNA, 18 bp, Homo sapiens
tctgtctctgtccttgct

SEQ ID NO: 8258033 - DNA, 18 bp, Homo sapiens
tctgtctctgtccttgct

SEQ ID NO: 8258034 - DNA, 21 bp, Homo sapiens
tctgtctctccactgccctgc

SEQ ID NO: 8258035 - DNA, 22 bp, Homo sapiens
tctgtctctcaagggccgtcct

SEQ ID NO: 8258036 - DNA, 21 bp, Homo sapiens
tctgtctctccactgccctgc

SEQ ID NO: 8258037 - DNA, 21 bp, Homo sapiens
tctgtctctccactgccctgc

SEQ ID NO: 8258038 - DNA, 22 bp, Homo sapiens
tctgtctcctctgaggtgccag

SEQ ID NO: 8258039 - DNA, 22 bp, Homo sapiens
tctgtctcctgccagtgcctct

SEQ ID NO: 8258040 - DNA, 22 bp, Homo sapiens
tctgtctcctgccagtgcctct

SEQ ID NO: 8258041 - DNA, 22 bp, Homo sapiens
tctgtctcctgccagtgcctct

SEQ ID NO: 8258042 - DNA, 22 bp, Homo sapiens
tctgtctcctgccagtgcctct

SEQ ID NO: 8258043 - DNA, 22 bp, Homo sapiens
tctgtctcctctgaggtgccag

SEQ ID NO: 8258044 - DNA, 22 bp, Homo sapiens
tctgtctcctcagatgactcca

SEQ ID NO: 8258045 - DNA, 22 bp, Homo sapiens
tctgtctcctcagatgactcca

SEQ ID NO: 8258046 - DNA, 22 bp, Homo sapiens
tctgtctcaagttcttgcactc

SEQ ID NO: 8258047 - DNA, 22 bp, Homo sapiens
tctgtctcctctgaggtgccag

SEQ ID NO: 8258048 - DNA, 22 bp, Homo sapiens
tctgtctcctctgaggtgccag

SEQ ID NO: 8258049 - DNA, 22 bp, Homo sapiens
tctgtctcaagttcttgcactc

SEQ ID NO: 8258050 - DNA, 22 bp, Homo sapiens
tctgtctcaagttcttgcactc

SEQ ID NO: 8258051 - DNA, 22 bp, Homo sapiens
tctgtctcaagttcttgcactc

SEQ ID NO: 8258052 - DNA, 22 bp, Homo sapiens
tctgtctcaagttcttgcactc

SEQ ID NO: 8258053 - DNA, 22 bp, Homo sapiens
tctgtctcaagttcttgcactc

SEQ ID NO: 8258054 - DNA, 22 bp, Homo sapiens
tctgtctcaagttcttgcactc

SEQ ID NO: 8258055 - DNA, 22 bp, Homo sapiens
tctgtctcaagttcttgcactc

SEQ ID NO: 8258056 - DNA, 22 bp, Homo sapiens
tctgtcctgtttcctcctgaca

SEQ ID NO: 8258057 - DNA, 22 bp, Homo sapiens
tctgtcctgtttcctcctgaca

SEQ ID NO: 8258058 - DNA, 18 bp, Homo sapiens
tctgtccttccattcttc

SEQ ID NO: 8258059 - DNA, 22 bp, Homo sapiens
tctgtcctgtttcctcctgaca

SEQ ID NO: 8258060 - DNA, 22 bp, Homo sapiens
ttccaggaacaaactcacctta

SEQ ID NO: 8258061 - DNA, 22 bp, Homo sapiens
ttccaggaacaaactcacctta

SEQ ID NO: 8258062 - DNA, 22 bp, Homo sapiens
ttccaggaacaaactcacctta

SEQ ID NO: 8258063 - DNA, 22 bp, Homo sapiens
aaggagagtacaggagttggta

SEQ ID NO: 8258064 - DNA, 22 bp, Homo sapiens
aaggagagtacaggagttggta

SEQ ID NO: 8258065 - DNA, 22 bp, Homo sapiens
aaggagagagctttgctggaac

SEQ ID NO: 8258066 - DNA, 22 bp, Homo sapiens
aaggagagagctttgctggaac

SEQ ID NO: 8258067 - DNA, 22 bp, Homo sapiens
aaggaggaataaagaggtggtg

SEQ ID NO: 8258068 - DNA, 22 bp, Homo sapiens
aaggaggaataaagaggtggtg

SEQ ID NO: 8258069 - DNA, 16 bp, Homo sapiens
acagtgtctcaagcac

SEQ ID NO: 8258070 - DNA, 17 bp, Homo sapiens
acagtgtctatgaaatg

SEQ ID NO: 8258071 - DNA, 22 bp, Homo sapiens
aaggcagagattagcagaatga

SEQ ID NO: 8258072 - DNA, 22 bp, Homo sapiens
aaggcagagggctggatcagag

SEQ ID NO: 8258073 - DNA, 22 bp, Homo sapiens
aaggaggaatgtagccagctcc

SEQ ID NO: 8258074 - DNA, 22 bp, Homo sapiens
aaggaggaatttcagggtgaat

SEQ ID NO: 8258075 - DNA, 22 bp, Homo sapiens
aaggaggaatttcagggtgaat

SEQ ID NO: 8258076 - DNA, 22 bp, Homo sapiens
aaggaggacacccaggactggg

SEQ ID NO: 8258077 - DNA, 22 bp, Homo sapiens
aaggaggacacccaggactggg

SEQ ID NO: 8258078 - DNA, 22 bp, Homo sapiens
aaggaggacacccaggactggg

SEQ ID NO: 8258079 - DNA, 22 bp, Homo sapiens
aaggaggagtggggtcctggaa

SEQ ID NO: 8258080 - DNA, 22 bp, Homo sapiens
aaggaggagtggggtcctggaa

SEQ ID NO: 8258081 - DNA, 22 bp, Homo sapiens
aaggaggagcggaggcttgttg

SEQ ID NO: 8258082 - DNA, 22 bp, Homo sapiens
aagctctgaggtgagcaatcgg

SEQ ID NO: 8258083 - DNA, 22 bp, Homo sapiens
aagctctgaggtgagcaatcgg

SEQ ID NO: 8258084 - DNA, 22 bp, Homo sapiens
aagctctgtctcttgggagtta

SEQ ID NO: 8258085 - DNA, 22 bp, Homo sapiens
aagctctgctcagcagactagg

SEQ ID NO: 8258086 - DNA, 22 bp, Homo sapiens
aagctctgctcagcagactagg

SEQ ID NO: 8258087 - DNA, 22 bp, Homo sapiens
aagctctgatacttcctacctg

SEQ ID NO: 8258088 - DNA, 20 bp, Homo sapiens
aagctctgcttcatgtggtc

SEQ ID NO: 8258089 - DNA, 20 bp, Homo sapiens
aagctctgcttcatgtggtc

SEQ ID NO: 8258090 - DNA, 22 bp, Homo sapiens
aagctctgctcatgatgacgtt

SEQ ID NO: 8258091 - DNA, 22 bp, Homo sapiens
aagctctgctcatgatgacgtt

SEQ ID NO: 8258092 - DNA, 22 bp, Homo sapiens
aagctctgatacttcctacctg

SEQ ID NO: 8258093 - DNA, 22 bp, Homo sapiens
aagctctggggtacacatctgc

SEQ ID NO: 8258094 - DNA, 22 bp, Homo sapiens
aagctctggggtacacatctgc

SEQ ID NO: 8258095 - DNA, 18 bp, Homo sapiens
aagctctggctaggaaaa

SEQ ID NO: 8258096 - DNA, 18 bp, Homo sapiens
aagctctggctaggaaaa

SEQ ID NO: 8258097 - DNA, 22 bp, Homo sapiens
aagctctgtctcttgggagtta

SEQ ID NO: 8258098 - DNA, 22 bp, Homo sapiens
aagctctgtagctcatgtgata

SEQ ID NO: 8258099 - DNA, 22 bp, Homo sapiens
aagctctgtagctcatgtgata

SEQ ID NO: 8258100 - DNA, 22 bp, Homo sapiens
aagctctggttaaaaggcctgg

SEQ ID NO: 8258101 - DNA, 22 bp, Homo sapiens
aagctctggttaaaaggcctgg

SEQ ID NO: 8258102 - DNA, 22 bp, Homo sapiens
aagcattttgccacttgaagtt

SEQ ID NO: 8258103 - DNA, 22 bp, Homo sapiens
aagcatttgtgaaattcagatg

SEQ ID NO: 8258104 - DNA, 21 bp, Homo sapiens
accaggccaggaggctggcac

SEQ ID NO: 8258105 - DNA, 22 bp, Homo sapiens
aaggccaggggctggcgcctcc

SEQ ID NO: 8258106 - DNA, 22 bp, Homo sapiens
aaggccagggatgccagctcgg

SEQ ID NO: 8258107 - DNA, 20 bp, Homo sapiens
aaggcagagtgggttggagc

SEQ ID NO: 8258108 - DNA, 20 bp, Homo sapiens
aaggcagagtgggttggagc

SEQ ID NO: 8258109 - DNA, 22 bp, Homo sapiens
acatttcttccacatgctgctg

SEQ ID NO: 8258110 - DNA, 22 bp, Homo sapiens
acattgttctacttctagttag

SEQ ID NO: 8258111 - DNA, 22 bp, Homo sapiens
acattgttgtgcaattatagtt

SEQ ID NO: 8258112 - DNA, 22 bp, Homo sapiens
actttatgtttgatatctatgg

SEQ ID NO: 8258113 - DNA, 22 bp, Homo sapiens
actttatgtgcttgctctttcc

SEQ ID NO: 8258114 - DNA, 22 bp, Homo sapiens
actttatgatacagggaagggt

SEQ ID NO: 8258115 - DNA, 22 bp, Homo sapiens
actttatgctaaactttactct

SEQ ID NO: 8258116 - DNA, 20 bp, Homo sapiens
actttatgagttcaattttg

SEQ ID NO: 8258117 - DNA, 21 bp, Homo sapiens
actttatgacctacccttttt

SEQ ID NO: 8258118 - DNA, 22 bp, Homo sapiens
actttatttcctattgcatcca

SEQ ID NO: 8258119 - DNA, 23 bp, Homo sapiens
actttattgaccccaggtcagtt

SEQ ID NO: 8258120 - DNA, 22 bp, Homo sapiens
actttatgacaccctttagtga

SEQ ID NO: 8258121 - DNA, 22 bp, Homo sapiens
aatatactatactactttctgg

SEQ ID NO: 8258122 - DNA, 22 bp, Homo sapiens
aatatagaatcactttccttca

SEQ ID NO: 8258123 - DNA, 22 bp, Homo sapiens
aatactatgtagccaaaataat

SEQ ID NO: 8258124 - DNA, 22 bp, Homo sapiens
aatcagacagttctggattcaa

SEQ ID NO: 8258125 - DNA, 22 bp, Homo sapiens
aatcagtttcttggcaagttta

SEQ ID NO: 8258126 - DNA, 22 bp, Homo sapiens
aatcagttgtccaaagttcaca

SEQ ID NO: 8258127 - DNA, 22 bp, Homo sapiens
aatgagttctggttcattttat

SEQ ID NO: 8258128 - DNA, 23 bp, Homo sapiens
aatgagttgggcagcatacaggc

SEQ ID NO: 8258129 - DNA, 22 bp, Homo sapiens
agaagcagaaggaagcagggcc

SEQ ID NO: 8258130 - DNA, 22 bp, Homo sapiens
aatgattgtcattccaaaaagt

SEQ ID NO: 8258131 - DNA, 22 bp, Homo sapiens
actctgcttgggccatatctgg

SEQ ID NO: 8258132 - DNA, 22 bp, Homo sapiens
actgagtgggaggtttgtgtga

SEQ ID NO: 8258133 - DNA, 20 bp, Homo sapiens
actggagttcatgctaagag

SEQ ID NO: 8258134 - DNA, 22 bp, Homo sapiens
actggacagaggaaatatggag

SEQ ID NO: 8258135 - DNA, 22 bp, Homo sapiens
actggcccttgattgcatcagc

SEQ ID NO: 8258136 - DNA, 22 bp, Homo sapiens
actatacaccaaaatattaagg

SEQ ID NO: 8258137 - DNA, 22 bp, Homo sapiens
actatacagtatgtacgtgcac

SEQ ID NO: 8258138 - DNA, 22 bp, Homo sapiens
aagtctaagtttgtaacttgga

SEQ ID NO: 8258139 - DNA, 22 bp, Homo sapiens
aagtctaacctattccggtgtt

SEQ ID NO: 8258140 - DNA, 22 bp, Homo sapiens
aagtctaaacacatatttaaaa

SEQ ID NO: 8258141 - DNA, 22 bp, Homo sapiens
aagtctctttacctctccaggc

SEQ ID NO: 8258142 - DNA, 22 bp, Homo sapiens
agagcctgcatcaggcttgggg

SEQ ID NO: 8258143 - DNA, 22 bp, Homo sapiens
agagcctgcatctagcctcaga

SEQ ID NO: 8258144 - DNA, 22 bp, Homo sapiens
agagcctggacctgggctctga

SEQ ID NO: 8258145 - DNA, 22 bp, Homo sapiens
agagccaggctctacctgggtt

SEQ ID NO: 8258146 - DNA, 22 bp, Homo sapiens
agagccaggctcccatggggca

SEQ ID NO: 8258147 - DNA, 22 bp, Homo sapiens
agagccaggtgtagtctcggag

SEQ ID NO: 8258148 - DNA, 22 bp, Homo sapiens
aatggagaggctgtgagtgaga

SEQ ID NO: 8258149 - DNA, 22 bp, Homo sapiens
aatggtatcacctcacagaatt

SEQ ID NO: 8258150 - DNA, 22 bp, Homo sapiens
acaatctggaaaagttaactat

SEQ ID NO: 8258151 - DNA, 22 bp, Homo sapiens
acaacaaagacacttgaaatga

SEQ ID NO: 8258152 - DNA, 22 bp, Homo sapiens
agataactcattttgtatatcc

SEQ ID NO: 8258153 - DNA, 22 bp, Homo sapiens
agataactggtttacattattg

SEQ ID NO: 8258154 - DNA, 22 bp, Homo sapiens
agataatgattctgcatttcta

SEQ ID NO: 8258155 - DNA, 22 bp, Homo sapiens
agataatggagggatttgcatt

SEQ ID NO: 8258156 - DNA, 22 bp, Homo sapiens
agaggctgtgcagagggagtgc

SEQ ID NO: 8258157 - DNA, 22 bp, Homo sapiens
acaaagcttagacctaagagat

SEQ ID NO: 8258158 - DNA, 19 bp, Homo sapiens
acaaagctgtgagcagctt

SEQ ID NO: 8258159 - DNA, 22 bp, Homo sapiens
agaggctctggtgggagttggt

SEQ ID NO: 8258160 - DNA, 22 bp, Homo sapiens
agaggctctttgagctgggaga

SEQ ID NO: 8258161 - DNA, 22 bp, Homo sapiens
agaggccctctctgctcagtct

SEQ ID NO: 8258162 - DNA, 22 bp, Homo sapiens
acagagcatttgggacagagag

SEQ ID NO: 8258163 - DNA, 22 bp, Homo sapiens
acagagctgggatctgaaccca

SEQ ID NO: 8258164 - DNA, 21 bp, Homo sapiens
acagatatttcattgaacatt

SEQ ID NO: 8258165 - DNA, 22 bp, Homo sapiens
acagagctcccagccatctcct

SEQ ID NO: 8258166 - DNA, 22 bp, Homo sapiens
agctcctgccaacactgatggg

SEQ ID NO: 8258167 - DNA, 22 bp, Homo sapiens
agccaggggattcatcagggac

SEQ ID NO: 8258168 - DNA, 22 bp, Homo sapiens
acactttatctcatctcagaca

SEQ ID NO: 8258169 - DNA, 22 bp, Homo sapiens
acactttatcaatattcaaaaa

SEQ ID NO: 8258170 - DNA, 19 bp, Homo sapiens
agccagggtgagaaggagc

SEQ ID NO: 8258171 - DNA, 22 bp, Homo sapiens
acagagagaaacaatcagcagc

SEQ ID NO: 8258172 - DNA, 22 bp, Homo sapiens
acagagacttggagcaggctga

SEQ ID NO: 8258173 - DNA, 22 bp, Homo sapiens
acagagactgggagcaagaggc

SEQ ID NO: 8258174 - DNA, 22 bp, Homo sapiens
acacagagtccttactgaggta

SEQ ID NO: 8258175 - DNA, 22 bp, Homo sapiens
acacagagtatttagaaggggt

SEQ ID NO: 8258176 - DNA, 22 bp, Homo sapiens
acacagagtttgacacatggga

SEQ ID NO: 8258177 - DNA, 22 bp, Homo sapiens
acacagaggaaagtgtgaaggg

SEQ ID NO: 8258178 - DNA, 22 bp, Homo sapiens
acacagaggcatgacagtggct

SEQ ID NO: 8258179 - DNA, 22 bp, Homo sapiens
acacagaggctccagagataga

SEQ ID NO: 8258180 - DNA, 22 bp, Homo sapiens
agcagctggtgagcaagctcag

SEQ ID NO: 8258181 - DNA, 22 bp, Homo sapiens
agcagagcatggtgggaagggc

SEQ ID NO: 8258182 - DNA, 22 bp, Homo sapiens
agcagagcatgctaagtgactc

SEQ ID NO: 8258183 - DNA, 19 bp, Homo sapiens
agcagagcagggccgtggg

SEQ ID NO: 8258184 - DNA, 19 bp, Homo sapiens
agcagagcaaagtggctga

SEQ ID NO: 8258185 - DNA, 22 bp, Homo sapiens
agcagagcagaatgtgaaggtg

SEQ ID NO: 8258186 - DNA, 18 bp, Homo sapiens
agcagagcccatgcattc

SEQ ID NO: 8258187 - DNA, 22 bp, Homo sapiens
agcagagtgtgaaggcagggct

SEQ ID NO: 8258188 - DNA, 22 bp, Homo sapiens
agcagagcctgggctaggggtg

SEQ ID NO: 8258189 - DNA, 22 bp, Homo sapiens
aaaattctcttgatcttgacag

SEQ ID NO: 8258190 - DNA, 22 bp, Homo sapiens
aaaaggaggtcactttattcct

SEQ ID NO: 8258191 - DNA, 22 bp, Homo sapiens
aaaaggcagtgcaagagagggt

SEQ ID NO: 8258192 - DNA, 22 bp, Homo sapiens
aaaacctgattgaattctattt

SEQ ID NO: 8258193 - DNA, 22 bp, Homo sapiens
aaaaccaggtagcaaaggagac

SEQ ID NO: 8258194 - DNA, 22 bp, Homo sapiens
aaaaggaggacatggttacaga

SEQ ID NO: 8258195 - DNA, 22 bp, Homo sapiens
aaactgtaagagaataaactac

SEQ ID NO: 8258196 - DNA, 22 bp, Homo sapiens
aaactgtaaacacagcagtaca

SEQ ID NO: 8258197 - DNA, 22 bp, Homo sapiens
aaacactgaaaattttggtcat

SEQ ID NO: 8258198 - DNA, 22 bp, Homo sapiens
aaacactgaagacctatctggt

SEQ ID NO: 8258199 - DNA, 22 bp, Homo sapiens
aaacagataatgctataaatgg

SEQ ID NO: 8258200 - DNA, 22 bp, Homo sapiens
aaacatgatgtcatatatgcca

SEQ ID NO: 8258201 - DNA, 22 bp, Homo sapiens
aaactgtcattttatatagtta

SEQ ID NO: 8258202 - DNA, 22 bp, Homo sapiens
aagatatagatggtggtataaa

SEQ ID NO: 8258203 - DNA, 22 bp, Homo sapiens
aagcaggccctgggccagggga

SEQ ID NO: 8258204 - DNA, 22 bp, Homo sapiens
aagcaggcattccagagacaat

SEQ ID NO: 8258205 - DNA, 22 bp, Homo sapiens
aagatatattttggtgatttca

SEQ ID NO: 8258206 - DNA, 22 bp, Homo sapiens
aagatcctgcttttgcttctgt

SEQ ID NO: 8258207 - DNA, 22 bp, Homo sapiens
aactgtaagagaataaatgtgt

SEQ ID NO: 8258208 - DNA, 18 bp, Homo sapiens
aaaggcagattactggga

SEQ ID NO: 8258209 - DNA, 22 bp, Homo sapiens
aaagcctgggttcctcactatc

SEQ ID NO: 8258210 - DNA, 22 bp, Homo sapiens
aaggcagcacagcaactgctca

SEQ ID NO: 8258211 - DNA, 22 bp, Homo sapiens
aaggaagacacagatgaagtga

SEQ ID NO: 8258212 - DNA, 22 bp, Homo sapiens
aaggaagactcgcaggtctatg

SEQ ID NO: 8258213 - DNA, 22 bp, Homo sapiens
aaatgtcaaggtgatagatgca

SEQ ID NO: 8258214 - DNA, 22 bp, Homo sapiens
aaggaagagtctagaacaggca

SEQ ID NO: 8258215 - DNA, 22 bp, Homo sapiens
aagtggttttaagaggttcctt

SEQ ID NO: 8258216 - DNA, 23 bp, Homo sapiens
aagtggttttgaacccggaccct

SEQ ID NO: 8258217 - DNA, 22 bp, Homo sapiens
aagtgtacatagaaagcttggt

SEQ ID NO: 8258218 - DNA, 22 bp, Homo sapiens
aagtggtttgattcagtttatg

SEQ ID NO: 8258219 - DNA, 21 bp, Homo sapiens
aagtggtttaggttaccgggg

SEQ ID NO: 8258220 - DNA, 21 bp, Homo sapiens
aagtggtttacatccagctgt

SEQ ID NO: 8258221 - DNA, 22 bp, Homo sapiens
aagtggttgcttgtgagtcccc

SEQ ID NO: 8258222 - DNA, 22 bp, Homo sapiens
aagtggttattttgatctagaa

SEQ ID NO: 8258223 - DNA, 22 bp, Homo sapiens
aagtgtctagcacctggatgca

SEQ ID NO: 8258224 - DNA, 22 bp, Homo sapiens
aagtgtctaactggttacttct

SEQ ID NO: 8258225 - DNA, 22 bp, Homo sapiens
aagtgtctacatttgctaacca

SEQ ID NO: 8258226 - DNA, 22 bp, Homo sapiens
aagtgtcctcattcaacatgca

SEQ ID NO: 8258227 - DNA, 22 bp, Homo sapiens
aacatgtcttactttgctttct

SEQ ID NO: 8258228 - DNA, 22 bp, Homo sapiens
aacatgaaaagcccagagaggt

SEQ ID NO: 8258229 - DNA, 22 bp, Homo sapiens
aacatctttgataaacttagtg

SEQ ID NO: 8258230 - DNA, 22 bp, Homo sapiens
aacatgaaaacctccacagcaa

SEQ ID NO: 8258231 - DNA, 22 bp, Homo sapiens
aacatgaaaactacctgtgatt

SEQ ID NO: 8258232 - DNA, 22 bp, Homo sapiens
aactagaaagaacatatttcca

SEQ ID NO: 8258233 - DNA, 20 bp, Homo sapiens
aactagaaagcacccatgga

SEQ ID NO: 8258234 - DNA, 22 bp, Homo sapiens
aactagaaaacaagatgctgat

SEQ ID NO: 8258235 - DNA, 22 bp, Homo sapiens
aactagaaaaagactttctgag

SEQ ID NO: 8258236 - DNA, 22 bp, Homo sapiens
aactagaaatcactacaggtat

SEQ ID NO: 8258237 - DNA, 22 bp, Homo sapiens
aactagaacgtctagttgctgg

SEQ ID NO: 8258238 - DNA, 23 bp, Homo sapiens
aacctagactacttactatgtgg

SEQ ID NO: 8258239 - DNA, 19 bp, Homo sapiens
aacctttagatcattctcc

SEQ ID NO: 8258240 - DNA, 22 bp, Homo sapiens
aacctttatttggtactattct

SEQ ID NO: 8258241 - DNA, 22 bp, Homo sapiens
aagaaactgttgcgtgacagcg

SEQ ID NO: 8258242 - DNA, 22 bp, Homo sapiens
aagagcactaacagagctgata

SEQ ID NO: 8258243 - DNA, 22 bp, Homo sapiens
aagagacttgtccgaagttgta

SEQ ID NO: 8258244 - DNA, 22 bp, Homo sapiens
acacaaaatcaaagtcctaggc

SEQ ID NO: 8258245 - DNA, 22 bp, Homo sapiens
aatttgttagcatactctagtt

SEQ ID NO: 8258246 - DNA, 22 bp, Homo sapiens
aatttgttacacagcaatataa

SEQ ID NO: 8258247 - DNA, 22 bp, Homo sapiens
aatttgttataacttgggctga

SEQ ID NO: 8258248 - DNA, 22 bp, Homo sapiens
aatttgttttcaagtcactgga

SEQ ID NO: 8258249 - DNA, 22 bp, Homo sapiens
acagcagagacactcaggaggc

SEQ ID NO: 8258250 - DNA, 22 bp, Homo sapiens
aagcagaggaccgacggaggga

SEQ ID NO: 8258251 - DNA, 22 bp, Homo sapiens
aagcagaggccacagagtgggc

SEQ ID NO: 8258252 - DNA, 22 bp, Homo sapiens
aagcagagggtatggccaggtt

SEQ ID NO: 8258253 - DNA, 22 bp, Homo sapiens
aagcagagaatctgggagcgag

SEQ ID NO: 8258254 - DNA, 22 bp, Homo sapiens
aagcagagcctgagacagggat

SEQ ID NO: 8258255 - DNA, 22 bp, Homo sapiens
aagcaaagacagtttgagtgga

SEQ ID NO: 8258256 - DNA, 22 bp, Homo sapiens
aagatatagataaaactatgca

SEQ ID NO: 8258257 - DNA, 22 bp, Homo sapiens
aagagcaggctgtcaatggggc

SEQ ID NO: 8258258 - DNA, 22 bp, Homo sapiens
agctgccccatgagaggcaggt

SEQ ID NO: 8258259 - DNA, 17 bp, Homo sapiens
agctgccagggagtgtg

SEQ ID NO: 8258260 - DNA, 22 bp, Homo sapiens
agctgcccaatcctgcagggcg

SEQ ID NO: 8258261 - DNA, 22 bp, Homo sapiens
agctgcccagataggaggaggc

SEQ ID NO: 8258262 - DNA, 21 bp, Homo sapiens
agctgcccagagtagggaagg

SEQ ID NO: 8258263 - DNA, 22 bp, Homo sapiens
acagctgcatgatggtccagat

SEQ ID NO: 8258264 - DNA, 22 bp, Homo sapiens
acagctgcaaattgttagagga

SEQ ID NO: 8258265 - DNA, 19 bp, Homo sapiens
agctggggcggtgtgtgtt

SEQ ID NO: 8258266 - DNA, 22 bp, Homo sapiens
agctgggggttggataagggta

SEQ ID NO: 8258267 - DNA, 22 bp, Homo sapiens
agctggggctgtggttgtgatt

SEQ ID NO: 8258268 - DNA, 22 bp, Homo sapiens
acagctctgagatattactatt

SEQ ID NO: 8258269 - DNA, 22 bp, Homo sapiens
acagctctgggtgcaggaggtg

SEQ ID NO: 8258270 - DNA, 22 bp, Homo sapiens
acagctctgcatggcagttatt

SEQ ID NO: 8258271 - DNA, 22 bp, Homo sapiens
acagctctccctcagagaaatg

SEQ ID NO: 8258272 - DNA, 22 bp, Homo sapiens
acagctcttaggcagaaccaac

SEQ ID NO: 8258273 - DNA, 22 bp, Homo sapiens
acagctctgttgccagatctgc

SEQ ID NO: 8258274 - DNA, 22 bp, Homo sapiens
acagctctgtgtattgtcatct

SEQ ID NO: 8258275 - DNA, 22 bp, Homo sapiens
acagctctggtcctttagagag

SEQ ID NO: 8258276 - DNA, 22 bp, Homo sapiens
acaggccataaaggcaggccct

SEQ ID NO: 8258277 - DNA, 22 bp, Homo sapiens
acagctgtgttttataatcagc

SEQ ID NO: 8258278 - DNA, 19 bp, Homo sapiens
aggaatggaattaattctg

SEQ ID NO: 8258279 - DNA, 22 bp, Homo sapiens
acaggtggccccgagggagtgg

SEQ ID NO: 8258280 - DNA, 22 bp, Homo sapiens
acaggtggcttattggctgatt

SEQ ID NO: 8258281 - DNA, 22 bp, Homo sapiens
acaggtggtaaaatggactgtc

SEQ ID NO: 8258282 - DNA, 22 bp, Homo sapiens
aggagggtgatccgggctggtc

SEQ ID NO: 8258283 - DNA, 22 bp, Homo sapiens
aggagtgccttttcatgagtgt

SEQ ID NO: 8258284 - DNA, 22 bp, Homo sapiens
aggagtgctgcaagttgacaga

SEQ ID NO: 8258285 - DNA, 21 bp, Homo sapiens
aggaggaacccgtggctgggc

SEQ ID NO: 8258286 - DNA, 21 bp, Homo sapiens
aggaggaacccgtggctgggc

SEQ ID NO: 8258287 - DNA, 22 bp, Homo sapiens
acagtgaggacagggactgtgt

SEQ ID NO: 8258288 - DNA, 21 bp, Homo sapiens
aggcaggattcaaacacagag

SEQ ID NO: 8258289 - DNA, 22 bp, Homo sapiens
aggcaggattgctgacaacaat

SEQ ID NO: 8258290 - DNA, 22 bp, Homo sapiens
aggcaggcactccggaagtgtc

SEQ ID NO: 8258291 - DNA, 22 bp, Homo sapiens
aggcagcatccagaggagaatg

SEQ ID NO: 8258292 - DNA, 22 bp, Homo sapiens
aggcagcatgctctgcttctac

SEQ ID NO: 8258293 - DNA, 21 bp, Homo sapiens
aggcagcatctgatttatatg

SEQ ID NO: 8258294 - DNA, 19 bp, Homo sapiens
acagtttgggaaatgagca

SEQ ID NO: 8258295 - DNA, 22 bp, Homo sapiens
aggccttggcagaggccaggct

SEQ ID NO: 8258296 - DNA, 22 bp, Homo sapiens
aggcccttggactcatgctcga

SEQ ID NO: 8258297 - DNA, 22 bp, Homo sapiens
aggcctgcctggagcctggctg

SEQ ID NO: 8258298 - DNA, 22 bp, Homo sapiens
aggcaggctggtctgaagagtg

SEQ ID NO: 8258299 - DNA, 22 bp, Homo sapiens
aggcagggaccagttgttttct

SEQ ID NO: 8258300 - DNA, 17 bp, Homo sapiens
aggcaggcagagcggga

SEQ ID NO: 8258301 - DNA, 22 bp, Homo sapiens
aggcagggctgggattagactc

SEQ ID NO: 8258302 - DNA, 22 bp, Homo sapiens
aggcagggctcatttcttaggc

SEQ ID NO: 8258303 - DNA, 22 bp, Homo sapiens
aggcaggggagctggaagggta

SEQ ID NO: 8258304 - DNA, 16 bp, Homo sapiens
accctcagaaactgct

SEQ ID NO: 8258305 - DNA, 22 bp, Homo sapiens
accctcagacatattccatcat

SEQ ID NO: 8258306 - DNA, 22 bp, Homo sapiens
accctcagacagctgtggccag

SEQ ID NO: 8258307 - DNA, 22 bp, Homo sapiens
accccagctctgagccacacca

SEQ ID NO: 8258308 - DNA, 22 bp, Homo sapiens
agggcctgggaagaggaaccct

SEQ ID NO: 8258309 - DNA, 22 bp, Homo sapiens
acccaggctggagtgcagtagc

SEQ ID NO: 8258310 - DNA, 22 bp, Homo sapiens
acccaggcctgagagacaggag

SEQ ID NO: 8258311 - DNA, 22 bp, Homo sapiens
accatttaaggaaaatgtatca

SEQ ID NO: 8258312 - DNA, 23 bp, Homo sapiens
accatgtttgaaaaggagtaaat

SEQ ID NO: 8258313 - DNA, 22 bp, Homo sapiens
accatgtttagtgcagtgttca

SEQ ID NO: 8258314 - DNA, 22 bp, Homo sapiens
agggcagcttccatagtctggc

SEQ ID NO: 8258315 - DNA, 23 bp, Homo sapiens
agggcatgaagcagaggacgtgg

SEQ ID NO: 8258316 - DNA, 22 bp, Homo sapiens
agggcatgaagcagtggacagc

SEQ ID NO: 8258317 - DNA, 22 bp, Homo sapiens
agggcatgaaatgggcagaagc

SEQ ID NO: 8258318 - DNA, 17 bp, Homo sapiens
agggacagcagtttagg

SEQ ID NO: 8258319 - DNA, 23 bp, Homo sapiens
agggagctaaaaggctggagcag

SEQ ID NO: 8258320 - DNA, 22 bp, Homo sapiens
accaggcctagcaagtacatta

SEQ ID NO: 8258321 - DNA, 20 bp, Homo sapiens
accaggcccggtgtctcctc

SEQ ID NO: 8258322 - DNA, 22 bp, Homo sapiens
accaggccctccagctgcgtgg

SEQ ID NO: 8258323 - DNA, 20 bp, Homo sapiens
accaggccccgggccctgca

SEQ ID NO: 8258324 - DNA, 22 bp, Homo sapiens
accaggcccatgtggattacta

SEQ ID NO: 8258325 - DNA, 22 bp, Homo sapiens
accaggcccgctgctatggtgg

SEQ ID NO: 8258326 - DNA, 22 bp, Homo sapiens
accaggcccaccgcatgctcct

SEQ ID NO: 8258327 - DNA, 19 bp, Homo sapiens
accaaaggagtggggtata

SEQ ID NO: 8258328 - DNA, 22 bp, Homo sapiens
aggctggagtgtgcagtggcgc

SEQ ID NO: 8258329 - DNA, 22 bp, Homo sapiens
aggctggcaaggcagatgtgtg

SEQ ID NO: 8258330 - DNA, 22 bp, Homo sapiens
actaaaacagtggctagtagac

SEQ ID NO: 8258331 - DNA, 19 bp, Homo sapiens
actcaggcttcctctgagg

SEQ ID NO: 8258332 - DNA, 22 bp, Homo sapiens
actatacattgaatgttaaggt

SEQ ID NO: 8258333 - DNA, 22 bp, Homo sapiens
actagtgtccttatataagagg

SEQ ID NO: 8258334 - DNA, 22 bp, Homo sapiens
actatatacacattatcttgtt

SEQ ID NO: 8258335 - DNA, 22 bp, Homo sapiens
actatatgtgaaggtagaattt

SEQ ID NO: 8258336 - DNA, 22 bp, Homo sapiens
agggctgtgtttgcaccctctg

SEQ ID NO: 8258337 - DNA, 22 bp, Homo sapiens
agggctgtcagactgaggaggc

SEQ ID NO: 8258338 - DNA, 22 bp, Homo sapiens
accctcagcttcttggattaat

SEQ ID NO: 8258339 - DNA, 22 bp, Homo sapiens
accctcaggcagaatgtattct

SEQ ID NO: 8258340 - DNA, 22 bp, Homo sapiens
accctcagctggagattgaatt

SEQ ID NO: 8258341 - DNA, 22 bp, Homo sapiens
accctcagagtaggcactgctg

SEQ ID NO: 8258342 - DNA, 22 bp, Homo sapiens
aggtaccatatgcgggagcaac

SEQ ID NO: 8258343 - DNA, 22 bp, Homo sapiens
actggagttttaaaggaacttg

SEQ ID NO: 8258344 - DNA, 22 bp, Homo sapiens
agtggctgctgactttaataca

SEQ ID NO: 8258345 - DNA, 22 bp, Homo sapiens
agtggctgctggagtggagatg

SEQ ID NO: 8258346 - DNA, 22 bp, Homo sapiens
agtggctgagtgactgtgactc

SEQ ID NO: 8258347 - DNA, 22 bp, Homo sapiens
actgcacagaaccttagaatat

SEQ ID NO: 8258348 - DNA, 22 bp, Homo sapiens
actgaataaggtgaatgctctg

SEQ ID NO: 8258349 - DNA, 22 bp, Homo sapiens
actgaataatggtctgtgatct

SEQ ID NO: 8258350 - DNA, 22 bp, Homo sapiens
actgaatagaaatgctcatagg

SEQ ID NO: 8258351 - DNA, 22 bp, Homo sapiens
actgaatagcccttctgtctcc

SEQ ID NO: 8258352 - DNA, 22 bp, Homo sapiens
actgaatagtgctgcattgtac

SEQ ID NO: 8258353 - DNA, 22 bp, Homo sapiens
actgaatatattccattgcatg

SEQ ID NO: 8258354 - DNA, 20 bp, Homo sapiens
agtctggcacctattcctgt

SEQ ID NO: 8258355 - DNA, 22 bp, Homo sapiens
agtctctgtcgtagatcagcgt

SEQ ID NO: 8258356 - DNA, 22 bp, Homo sapiens
agtctctggactgggagatggc

SEQ ID NO: 8258357 - DNA, 22 bp, Homo sapiens
agtctctgccagcttgtcctct

SEQ ID NO: 8258358 - DNA, 22 bp, Homo sapiens
atatcttttagagcaagcttgt

SEQ ID NO: 8258359 - DNA, 22 bp, Homo sapiens
atatatttgagaatattcatga

SEQ ID NO: 8258360 - DNA, 22 bp, Homo sapiens
atatatttgagaatattcatga

SEQ ID NO: 8258361 - DNA, 22 bp, Homo sapiens
acttggtggaacgtgtatttta

SEQ ID NO: 8258362 - DNA, 22 bp, Homo sapiens
atatacacatctttttaaatat

SEQ ID NO: 8258363 - DNA, 22 bp, Homo sapiens
atatacacagagcttatggtga

SEQ ID NO: 8258364 - DNA, 21 bp, Homo sapiens
agttgcataggccagccatcc

SEQ ID NO: 8258365 - DNA, 19 bp, Homo sapiens
actggcagggctgcggtgg

SEQ ID NO: 8258366 - DNA, 22 bp, Homo sapiens
acttgcatgatattcaacagag

SEQ ID NO: 8258367 - DNA, 22 bp, Homo sapiens
acttgcatatatccctccacat

SEQ ID NO: 8258368 - DNA, 22 bp, Homo sapiens
acttgcatcttagagactcacc

SEQ ID NO: 8258369 - DNA, 22 bp, Homo sapiens
acttgcatttcaggcacttgtg

SEQ ID NO: 8258370 - DNA, 22 bp, Homo sapiens
acttgcatttaaatattgaata

SEQ ID NO: 8258371 - DNA, 22 bp, Homo sapiens
acttgcattatatttatcacaa

SEQ ID NO: 8258372 - DNA, 22 bp, Homo sapiens
acttgcatgttatttttatagg

SEQ ID NO: 8258373 - DNA, 22 bp, Homo sapiens
acttgcatgtcaggaaattaac

SEQ ID NO: 8258374 - DNA, 22 bp, Homo sapiens
acttgcatgtgtaaatcttcct

SEQ ID NO: 8258375 - DNA, 22 bp, Homo sapiens
acttgcatgattaatttggtga

SEQ ID NO: 8258376 - DNA, 22 bp, Homo sapiens
acttgcatgattttatgttgat

SEQ ID NO: 8258377 - DNA, 22 bp, Homo sapiens
acttgcatgatcctgagagtat

SEQ ID NO: 8258378 - DNA, 22 bp, Homo sapiens
acttgcatgctatttgttgaac

SEQ ID NO: 8258379 - DNA, 22 bp, Homo sapiens
acttcaaacaattaacagagaa

SEQ ID NO: 8258380 - DNA, 22 bp, Homo sapiens
actgttatgggtgtcagcttaa

SEQ ID NO: 8258381 - DNA, 22 bp, Homo sapiens
acttcaaattttcagaagaaat

SEQ ID NO: 8258382 - DNA, 22 bp, Homo sapiens
agatgtgactgggcaagttact

SEQ ID NO: 8258383 - DNA, 20 bp, Homo sapiens
agcaaacaggctccaccaga

SEQ ID NO: 8258384 - DNA, 22 bp, Homo sapiens
agcaaacagatgtctcctttag

SEQ ID NO: 8258385 - DNA, 22 bp, Homo sapiens
agcaaacacaagaggtaatttc

SEQ ID NO: 8258386 - DNA, 22 bp, Homo sapiens
agcaaacagtttctggggatct

SEQ ID NO: 8258387 - DNA, 22 bp, Homo sapiens
agcaaacattcagcagattggc

SEQ ID NO: 8258388 - DNA, 22 bp, Homo sapiens
agcaaacagtgtgctaagaaat

SEQ ID NO: 8258389 - DNA, 22 bp, Homo sapiens
agatccagggttggatttgcat

SEQ ID NO: 8258390 - DNA, 22 bp, Homo sapiens
agatccaggatgtcccaaaata

SEQ ID NO: 8258391 - DNA, 21 bp, Homo sapiens
agatccagtgccataaggccc

SEQ ID NO: 8258392 - DNA, 22 bp, Homo sapiens
attatacattttgtgtagagat

SEQ ID NO: 8258393 - DNA, 22 bp, Homo sapiens
attcacagaatagttttaccag

SEQ ID NO: 8258394 - DNA, 22 bp, Homo sapiens
attcacagagtggttagtggta

SEQ ID NO: 8258395 - DNA, 20 bp, Homo sapiens
attcacaggcacaaaaccct

SEQ ID NO: 8258396 - DNA, 22 bp, Homo sapiens
attcacagggctttccgcatgg

SEQ ID NO: 8258397 - DNA, 22 bp, Homo sapiens
attcacagggacaatgggagag

SEQ ID NO: 8258398 - DNA, 22 bp, Homo sapiens
attcacagggggagaagggtat

SEQ ID NO: 8258399 - DNA, 22 bp, Homo sapiens
attcacagtatggacgaaatga

SEQ ID NO: 8258400 - DNA, 21 bp, Homo sapiens
attcacaggtatcctctccct

SEQ ID NO: 8258401 - DNA, 22 bp, Homo sapiens
attcacagttactgctgaacca

SEQ ID NO: 8258402 - DNA, 22 bp, Homo sapiens
attcacagttcattagctgtaa

SEQ ID NO: 8258403 - DNA, 22 bp, Homo sapiens
agaggggctcatatcctgtcat

SEQ ID NO: 8258404 - DNA, 22 bp, Homo sapiens
agagggagcccagtcatagctg

SEQ ID NO: 8258405 - DNA, 23 bp, Homo sapiens
agagggagatgtttttctcaaga

SEQ ID NO: 8258406 - DNA, 22 bp, Homo sapiens
agagggagctttatttttctgt

SEQ ID NO: 8258407 - DNA, 22 bp, Homo sapiens
agagggagtgaaatggaataga

SEQ ID NO: 8258408 - DNA, 21 bp, Homo sapiens
agagggagagtggcccttcca

SEQ ID NO: 8258409 - DNA, 22 bp, Homo sapiens
attctgtcagatcttactggat

SEQ ID NO: 8258410 - DNA, 22 bp, Homo sapiens
attctggattatcagtccacca

SEQ ID NO: 8258411 - DNA, 22 bp, Homo sapiens
attctggacaaggcaagctcct

SEQ ID NO: 8258412 - DNA, 22 bp, Homo sapiens
atgttacacataggcataaatg

SEQ ID NO: 8258413 - DNA, 22 bp, Homo sapiens
atgttacaattcaaaatgctgc

SEQ ID NO: 8258414 - DNA, 22 bp, Homo sapiens
atgttacaatccaacaaaatta

SEQ ID NO: 8258415 - DNA, 22 bp, Homo sapiens
attagctgacctctaaggagcc

SEQ ID NO: 8258416 - DNA, 22 bp, Homo sapiens
attagctgttgtgaaaggggtg

SEQ ID NO: 8258417 - DNA, 22 bp, Homo sapiens
atcttgttaaagtgcagatttt

SEQ ID NO: 8258418 - DNA, 22 bp, Homo sapiens
atcttgttaaagtgcagattct

SEQ ID NO: 8258419 - DNA, 22 bp, Homo sapiens
atcttgttaaaaagcagattct

SEQ ID NO: 8258420 - DNA, 22 bp, Homo sapiens
atcttgttaaaatgcagattct

SEQ ID NO: 8258421 - DNA, 22 bp, Homo sapiens
agaaggcatcagaagtgtgtag

SEQ ID NO: 8258422 - DNA, 22 bp, Homo sapiens
atctttatatatctcctctgaa

SEQ ID NO: 8258423 - DNA, 22 bp, Homo sapiens
agaatcagatgaagactcctgc

SEQ ID NO: 8258424 - DNA, 22 bp, Homo sapiens
agaatgctccagagctgaaaga

SEQ ID NO: 8258425 - DNA, 22 bp, Homo sapiens
agaatgcttcctttgaaactga

SEQ ID NO: 8258426 - DNA, 22 bp, Homo sapiens
agaatgggggctacaggccaca

SEQ ID NO: 8258427 - DNA, 22 bp, Homo sapiens
agaatgtcaacagcctctcaag

SEQ ID NO: 8258428 - DNA, 22 bp, Homo sapiens
agaatcaggacctgtggctgtc

SEQ ID NO: 8258429 - DNA, 22 bp, Homo sapiens
agaatcaggaagacagcctggc

SEQ ID NO: 8258430 - DNA, 22 bp, Homo sapiens
agacaggcatgaggctggattg

SEQ ID NO: 8258431 - DNA, 22 bp, Homo sapiens
atgggaggatgctcgggtgctc

SEQ ID NO: 8258432 - DNA, 22 bp, Homo sapiens
atgggaggcagcagagcccagc

SEQ ID NO: 8258433 - DNA, 22 bp, Homo sapiens
atgggaggatcacttgaggcca

SEQ ID NO: 8258434 - DNA, 22 bp, Homo sapiens
atgggaggaaggaggcccttga

SEQ ID NO: 8258435 - DNA, 22 bp, Homo sapiens
atgtccagtacttctaaatggt

SEQ ID NO: 8258436 - DNA, 22 bp, Homo sapiens
atgtccagggggcttgactggt

SEQ ID NO: 8258437 - DNA, 22 bp, Homo sapiens
atgtccagctcatgatactatc

SEQ ID NO: 8258438 - DNA, 22 bp, Homo sapiens
atgtccagagtaaagcacattc

SEQ ID NO: 8258439 - DNA, 22 bp, Homo sapiens
atgtccagagccggcctgctga

SEQ ID NO: 8258440 - DNA, 22 bp, Homo sapiens
atgtccagagaacatttgcttt

SEQ ID NO: 8258441 - DNA, 22 bp, Homo sapiens
atgtccagagaacatttgcttt

SEQ ID NO: 8258442 - DNA, 22 bp, Homo sapiens
atggcagcaaatgtctggctgg

SEQ ID NO: 8258443 - DNA, 22 bp, Homo sapiens
atggagtgtcaccttcctggtt

SEQ ID NO: 8258444 - DNA, 22 bp, Homo sapiens
atggagtgtggccaggcagtaa

SEQ ID NO: 8258445 - DNA, 22 bp, Homo sapiens
atggagtgcctgtggcagtggg

SEQ ID NO: 8258446 - DNA, 22 bp, Homo sapiens
atggagtgctgttgatcaaggt

SEQ ID NO: 8258447 - DNA, 22 bp, Homo sapiens
atggagtggggactgcagtgga

SEQ ID NO: 8258448 - DNA, 22 bp, Homo sapiens
atggacagtactgagtggacta

SEQ ID NO: 8258449 - DNA, 22 bp, Homo sapiens
atggcagatggctggagcaggt

SEQ ID NO: 8258450 - DNA, 22 bp, Homo sapiens
atggagttctgccagcgctgct

SEQ ID NO: 8258451 - DNA, 22 bp, Homo sapiens
agcataagttggtacagccact

SEQ ID NO: 8258452 - DNA, 22 bp, Homo sapiens
agcagggcctctggcactggtc

SEQ ID NO: 8258453 - DNA, 22 bp, Homo sapiens
agcagggctcctgaaagccgcg

SEQ ID NO: 8258454 - DNA, 22 bp, Homo sapiens
agcagggcctggcactcctggg

SEQ ID NO: 8258455 - DNA, 22 bp, Homo sapiens
cacagggcagtgattgtccaca

SEQ ID NO: 8258456 - DNA, 19 bp, Homo sapiens
cacagggcaggtctcatgt

SEQ ID NO: 8258457 - DNA, 22 bp, Homo sapiens
cacagggcctggggcagctgct

SEQ ID NO: 8258458 - DNA, 22 bp, Homo sapiens
cacagggccttgtgtgactgca

SEQ ID NO: 8258459 - DNA, 22 bp, Homo sapiens
cacagggccactttcccagtaa

SEQ ID NO: 8258460 - DNA, 22 bp, Homo sapiens
cacagggcttctcatggggtgc

SEQ ID NO: 8258461 - DNA, 22 bp, Homo sapiens
cacagggctaaatgaagggttg

SEQ ID NO: 8258462 - DNA, 22 bp, Homo sapiens
agcaggagacatgggggtggtg

SEQ ID NO: 8258463 - DNA, 22 bp, Homo sapiens
agcaggagacatgggggtggtg

SEQ ID NO: 8258464 - DNA, 22 bp, Homo sapiens
agcaggagaacactgtggctct

SEQ ID NO: 8258465 - DNA, 22 bp, Homo sapiens
agcaggagagcagtgcgtggtc

SEQ ID NO: 8258466 - DNA, 22 bp, Homo sapiens
agcaggagagcagtgcgtggtc

SEQ ID NO: 8258467 - DNA, 22 bp, Homo sapiens
agcaggagatggggcgtgatgt

SEQ ID NO: 8258468 - DNA, 22 bp, Homo sapiens
cacaggaggaggtgcccgggcc

SEQ ID NO: 8258469 - DNA, 22 bp, Homo sapiens
cacaggaggcaatggtaagatt

SEQ ID NO: 8258470 - DNA, 22 bp, Homo sapiens
cacaggaggaggccagagcgta

SEQ ID NO: 8258471 - DNA, 22 bp, Homo sapiens
cacaggagggagcgggcagcca

SEQ ID NO: 8258472 - DNA, 22 bp, Homo sapiens
agcaggagaacactgtggctct

SEQ ID NO: 8258473 - DNA, 18 bp, Homo sapiens
agcagctgtgccacactg

SEQ ID NO: 8258474 - DNA, 22 bp, Homo sapiens
agcagcttatcttggagaggca

SEQ ID NO: 8258475 - DNA, 22 bp, Homo sapiens
cacaggagccctgaggcctccc

SEQ ID NO: 8258476 - DNA, 22 bp, Homo sapiens
cacaggagctgtggggcagtgt

SEQ ID NO: 8258477 - DNA, 22 bp, Homo sapiens
agcagcagggtgtaattgggca

SEQ ID NO: 8258478 - DNA, 22 bp, Homo sapiens
caatctgagttgggaatgtatt

SEQ ID NO: 8258479 - DNA, 22 bp, Homo sapiens
agcagacaacccagatgaccca

SEQ ID NO: 8258480 - DNA, 22 bp, Homo sapiens
agcagcagaagggagacccagg

SEQ ID NO: 8258481 - DNA, 22 bp, Homo sapiens
agcagcacccagagccatgtct

SEQ ID NO: 8258482 - DNA, 22 bp, Homo sapiens
caaattaatgtgtctcaaaata

SEQ ID NO: 8258483 - DNA, 22 bp, Homo sapiens
cagaagctttgtctagtcttga

SEQ ID NO: 8258484 - DNA, 22 bp, Homo sapiens
agccacagcacattgtaagaaa

SEQ ID NO: 8258485 - DNA, 22 bp, Homo sapiens
agccacagcccacaggactctt

SEQ ID NO: 8258486 - DNA, 22 bp, Homo sapiens
agccacagagcaggagaccttt

SEQ ID NO: 8258487 - DNA, 22 bp, Homo sapiens
agccacagagagggagctgcaa

SEQ ID NO: 8258488 - DNA, 22 bp, Homo sapiens
agcccagctttgaaccatatca

SEQ ID NO: 8258489 - DNA, 22 bp, Homo sapiens
agccctcaggctttgctgggcc

SEQ ID NO: 8258490 - DNA, 22 bp, Homo sapiens
agccctccaaaggttgggggag

SEQ ID NO: 8258491 - DNA, 22 bp, Homo sapiens
agccctcatggaacagctccta

SEQ ID NO: 8258492 - DNA, 22 bp, Homo sapiens
agcccgagcgcacctgtggaaa

SEQ ID NO: 8258493 - DNA, 17 bp, Homo sapiens
agcccccactcccaagt

SEQ ID NO: 8258494 - DNA, 22 bp, Homo sapiens
cagagatggggccagctgctcc

SEQ ID NO: 8258495 - DNA, 22 bp, Homo sapiens
cagagatggcggctgttgtgtt

SEQ ID NO: 8258496 - DNA, 22 bp, Homo sapiens
cagagcaacaccctttacatcg

SEQ ID NO: 8258497 - DNA, 22 bp, Homo sapiens
cagagcacacatgcatagagtg

SEQ ID NO: 8258498 - DNA, 22 bp, Homo sapiens
agcccagccggattcccagttc

SEQ ID NO: 8258499 - DNA, 22 bp, Homo sapiens
cagagatgtgatccagctgtct

SEQ ID NO: 8258500 - DNA, 22 bp, Homo sapiens
cagagatgggtcgcagagatgg

SEQ ID NO: 8258501 - DNA, 22 bp, Homo sapiens
cagacagctgctttcttgctgt

SEQ ID NO: 8258502 - DNA, 22 bp, Homo sapiens
cagacagcgagcggaggggctt

SEQ ID NO: 8258503 - DNA, 22 bp, Homo sapiens
cagacagcaggcctggatgtgt

SEQ ID NO: 8258504 - DNA, 22 bp, Homo sapiens
cagccctggccccaggtggtct

SEQ ID NO: 8258505 - DNA, 22 bp, Homo sapiens
cagccctgggtccctgccctgg

SEQ ID NO: 8258506 - DNA, 22 bp, Homo sapiens
agcctcagggctctgcgcagac

SEQ ID NO: 8258507 - DNA, 22 bp, Homo sapiens
agcctcagtttcaggcctcctc

SEQ ID NO: 8258508 - DNA, 22 bp, Homo sapiens
agcctcagtgtcaccatctacc

SEQ ID NO: 8258509 - DNA, 22 bp, Homo sapiens
cagcagagcttatgttgggtca

SEQ ID NO: 8258510 - DNA, 22 bp, Homo sapiens
cagcagaggcacgtctgtgaat

SEQ ID NO: 8258511 - DNA, 22 bp, Homo sapiens
cagcagcagcttagtggtcccc

SEQ ID NO: 8258512 - DNA, 22 bp, Homo sapiens
cagcagcatgaattcgagccac

SEQ ID NO: 8258513 - DNA, 22 bp, Homo sapiens
agctggctttatggttggctaa

SEQ ID NO: 8258514 - DNA, 22 bp, Homo sapiens
agctggctttgagctgggaggt

SEQ ID NO: 8258515 - DNA, 22 bp, Homo sapiens
agctggcttctctgcagacatt

SEQ ID NO: 8258516 - DNA, 22 bp, Homo sapiens
agctggcctccgggtgcctggg

SEQ ID NO: 8258517 - DNA, 22 bp, Homo sapiens
agctggctgccttctccttagg

SEQ ID NO: 8258518 - DNA, 22 bp, Homo sapiens
agctggctggccccttcctgcc

SEQ ID NO: 8258519 - DNA, 22 bp, Homo sapiens
caggagtccagagtgtcatttt

SEQ ID NO: 8258520 - DNA, 22 bp, Homo sapiens
agctgctgaagtgagagaattg

SEQ ID NO: 8258521 - DNA, 22 bp, Homo sapiens
agctgctgagccaggctgatgt

SEQ ID NO: 8258522 - DNA, 22 bp, Homo sapiens
agctgctgagagtctgccgggc

SEQ ID NO: 8258523 - DNA, 22 bp, Homo sapiens
agctggaggataactcacttct

SEQ ID NO: 8258524 - DNA, 22 bp, Homo sapiens
cagctctgaagaaaggtgtcta

SEQ ID NO: 8258525 - DNA, 22 bp, Homo sapiens
cagctctgacacagtacaaaat

SEQ ID NO: 8258526 - DNA, 22 bp, Homo sapiens
agctctgactgaagagatgcaa

SEQ ID NO: 8258527 - DNA, 22 bp, Homo sapiens
agctctgagaaagttagaaagt

SEQ ID NO: 8258528 - DNA, 22 bp, Homo sapiens
agctctgactgaagagatgcaa

SEQ ID NO: 8258529 - DNA, 22 bp, Homo sapiens
agctctgacattgattctcagc

SEQ ID NO: 8258530 - DNA, 22 bp, Homo sapiens
agctctgacattgattctcagc

SEQ ID NO: 8258531 - DNA, 22 bp, Homo sapiens
agctctgacaaggattttctgc

SEQ ID NO: 8258532 - DNA, 22 bp, Homo sapiens
agctctgacaaggattttctgc

SEQ ID NO: 8258533 - DNA, 22 bp, Homo sapiens
agctctgatctttacaacaaag

SEQ ID NO: 8258534 - DNA, 22 bp, Homo sapiens
agctctgatctttacaacaaag

SEQ ID NO: 8258535 - DNA, 22 bp, Homo sapiens
agctctgattagagacattctt

SEQ ID NO: 8258536 - DNA, 22 bp, Homo sapiens
agctctgattagagacattctt

SEQ ID NO: 8258537 - DNA, 22 bp, Homo sapiens
agctctgatgactttacaactt

SEQ ID NO: 8258538 - DNA, 22 bp, Homo sapiens
agctctgagaaagttagaaagt

SEQ ID NO: 8258539 - DNA, 22 bp, Homo sapiens
agctctgagttggggaggagca

SEQ ID NO: 8258540 - DNA, 16 bp, Homo sapiens
agctctgagtagagtt

SEQ ID NO: 8258541 - DNA, 16 bp, Homo sapiens
agctctgagtagagtt

SEQ ID NO: 8258542 - DNA, 22 bp, Homo sapiens
agctctgagttggggaggagca

SEQ ID NO: 8258543 - DNA, 22 bp, Homo sapiens
agctctgatccataatttatac

SEQ ID NO: 8258544 - DNA, 22 bp, Homo sapiens
agctctgatccataatttatac

SEQ ID NO: 8258545 - DNA, 23 bp, Homo sapiens
agctctgaaatagggaaagagga

SEQ ID NO: 8258546 - DNA, 22 bp, Homo sapiens
agctctgaagcttatctgatgt

SEQ ID NO: 8258547 - DNA, 22 bp, Homo sapiens
agctctgaagcttatctgatgt

SEQ ID NO: 8258548 - DNA, 23 bp, Homo sapiens
agctctgaaatagggaaagagga

SEQ ID NO: 8258549 - DNA, 22 bp, Homo sapiens
agctctgaaagttatgtcgccg

SEQ ID NO: 8258550 - DNA, 22 bp, Homo sapiens
agctctgaaagttatgtcgccg

SEQ ID NO: 8258551 - DNA, 22 bp, Homo sapiens
cagctcctgcctgggcagctgt

SEQ ID NO: 8258552 - DNA, 22 bp, Homo sapiens
agctctggaagccctggtagtt

SEQ ID NO: 8258553 - DNA, 22 bp, Homo sapiens
agctctgatgactttacaactt

SEQ ID NO: 8258554 - DNA, 22 bp, Homo sapiens
agctctgctactctgtggggtg

SEQ ID NO: 8258555 - DNA, 22 bp, Homo sapiens
agctctgcttcttgggaagatg

SEQ ID NO: 8258556 - DNA, 22 bp, Homo sapiens
cagggccagcgcccaggcccag

SEQ ID NO: 8258557 - DNA, 18 bp, Homo sapiens
aggaaagacgaagagggc

SEQ ID NO: 8258558 - DNA, 22 bp, Homo sapiens
cagggccactgtagatgaggag

SEQ ID NO: 8258559 - DNA, 22 bp, Homo sapiens
cagggccagcccactagcgagg

SEQ ID NO: 8258560 - DNA, 21 bp, Homo sapiens
aggaaaggaagtccccagggt

SEQ ID NO: 8258561 - DNA, 22 bp, Homo sapiens
agctgtggcagcagccgtggca

SEQ ID NO: 8258562 - DNA, 22 bp, Homo sapiens
caggcctgggcttcggggctga

SEQ ID NO: 8258563 - DNA, 21 bp, Homo sapiens
caggccgggtgagcaggcagc

SEQ ID NO: 8258564 - DNA, 22 bp, Homo sapiens
caggccggtgattctggatgta

SEQ ID NO: 8258565 - DNA, 22 bp, Homo sapiens
agctgttccaggcctcattgct

SEQ ID NO: 8258566 - DNA, 20 bp, Homo sapiens
aggagctgaattagagggtt

SEQ ID NO: 8258567 - DNA, 22 bp, Homo sapiens
aggagctgtgaatgggaggggt

SEQ ID NO: 8258568 - DNA, 21 bp, Homo sapiens
aggaggagagcttggcctacc

SEQ ID NO: 8258569 - DNA, 22 bp, Homo sapiens
aggaggactctctgagccagcc

SEQ ID NO: 8258570 - DNA, 22 bp, Homo sapiens
aggagagaattactgggtgtca

SEQ ID NO: 8258571 - DNA, 22 bp, Homo sapiens
aggagagagaacacttgggtcc

SEQ ID NO: 8258572 - DNA, 22 bp, Homo sapiens
aggagagaggttttaaatgggg

SEQ ID NO: 8258573 - DNA, 22 bp, Homo sapiens
aggagagagctgagctttgctg

SEQ ID NO: 8258574 - DNA, 22 bp, Homo sapiens
aggagactcagagacctggccg

SEQ ID NO: 8258575 - DNA, 22 bp, Homo sapiens
aggagaggctctaactctgtgt

SEQ ID NO: 8258576 - DNA, 22 bp, Homo sapiens
aggagaggggtaggattaattt

SEQ ID NO: 8258577 - DNA, 22 bp, Homo sapiens
aggagaggctctaactctgtgt

SEQ ID NO: 8258578 - DNA, 22 bp, Homo sapiens
aggagaggaatcattattacaa

SEQ ID NO: 8258579 - DNA, 22 bp, Homo sapiens
aggagaggcatcaagaaaatcg

SEQ ID NO: 8258580 - DNA, 22 bp, Homo sapiens
aggagctcagcctgcagggagc

SEQ ID NO: 8258581 - DNA, 22 bp, Homo sapiens
aggagcctggctggcccacagg

SEQ ID NO: 8258582 - DNA, 22 bp, Homo sapiens
aggagatcagcctccctgcaac

SEQ ID NO: 8258583 - DNA, 22 bp, Homo sapiens
aggagccatgagcaggaggcaa

SEQ ID NO: 8258584 - DNA, 22 bp, Homo sapiens
aggagaggtctcccttccccag

SEQ ID NO: 8258585 - DNA, 22 bp, Homo sapiens
aggagaggtctcccttccccag

SEQ ID NO: 8258586 - DNA, 22 bp, Homo sapiens
cagtcctgctagtgtgaaaagc

SEQ ID NO: 8258587 - DNA, 20 bp, Homo sapiens
aggaaggaagtttgcatgga

SEQ ID NO: 8258588 - DNA, 22 bp, Homo sapiens
aggaaggactccatggtccgtc

SEQ ID NO: 8258589 - DNA, 19 bp, Homo sapiens
aggaaggaacctgagtctg

SEQ ID NO: 8258590 - DNA, 22 bp, Homo sapiens
aggaagctggtgtgaggatgaa

SEQ ID NO: 8258591 - DNA, 21 bp, Homo sapiens
aggacaggaactggctgaata

SEQ ID NO: 8258592 - DNA, 22 bp, Homo sapiens
aggacagcagttggtgaggttc

SEQ ID NO: 8258593 - DNA, 22 bp, Homo sapiens
cagtctctggtgagttgacagt

SEQ ID NO: 8258594 - DNA, 22 bp, Homo sapiens
cagtctctgggaaagaggacag

SEQ ID NO: 8258595 - DNA, 22 bp, Homo sapiens
catgcagatgtcatgaggcatg

SEQ ID NO: 8258596 - DNA, 21 bp, Homo sapiens
catgcagattctggagccaga

SEQ ID NO: 8258597 - DNA, 22 bp, Homo sapiens
catgcgaggcgggaggaggcct

SEQ ID NO: 8258598 - DNA, 22 bp, Homo sapiens
aggaggtgctagagaagatgtt

SEQ ID NO: 8258599 - DNA, 22 bp, Homo sapiens
aggaggtggctgaacttgaggg

SEQ ID NO: 8258600 - DNA, 22 bp, Homo sapiens
catgaaattgctcctttggtgc

SEQ ID NO: 8258601 - DNA, 22 bp, Homo sapiens
catgaaatgtgttaatctcttg

SEQ ID NO: 8258602 - DNA, 22 bp, Homo sapiens
aggaggcactcactctcagggt

SEQ ID NO: 8258603 - DNA, 22 bp, Homo sapiens
aggcagcagtcatgaggaaaga

SEQ ID NO: 8258604 - DNA, 22 bp, Homo sapiens
catttacatttaaggttaatat

SEQ ID NO: 8258605 - DNA, 22 bp, Homo sapiens
aggcagcagcttgctggttgcc

SEQ ID NO: 8258606 - DNA, 22 bp, Homo sapiens
aggcagcagaggttgaggaaag

SEQ ID NO: 8258607 - DNA, 22 bp, Homo sapiens
catttacataacagtaacgctg

SEQ ID NO: 8258608 - DNA, 22 bp, Homo sapiens
catttacagcagactgatgaaa

SEQ ID NO: 8258609 - DNA, 18 bp, Homo sapiens
cattccccatctctgagc

SEQ ID NO: 8258610 - DNA, 22 bp, Homo sapiens
cattatctcttctatatgctag

SEQ ID NO: 8258611 - DNA, 22 bp, Homo sapiens
catggcctgcctcctcctggtg

SEQ ID NO: 8258612 - DNA, 22 bp, Homo sapiens
catggccccaaatcccatgcat

SEQ ID NO: 8258613 - DNA, 22 bp, Homo sapiens
catggccttcacctcccctgcc

SEQ ID NO: 8258614 - DNA, 22 bp, Homo sapiens
ccccagcagactcagggcaggt

SEQ ID NO: 8258615 - DNA, 22 bp, Homo sapiens
ccccatcctattcatgtttctg

SEQ ID NO: 8258616 - DNA, 22 bp, Homo sapiens
ccccatcccacctgagtgtcac

SEQ ID NO: 8258617 - DNA, 21 bp, Homo sapiens
ccccatggagtacagttgggc

SEQ ID NO: 8258618 - DNA, 22 bp, Homo sapiens
ccccatgggtgtagggaggtgg

SEQ ID NO: 8258619 - DNA, 22 bp, Homo sapiens
agggagcaaaggtttcagggtt

SEQ ID NO: 8258620 - DNA, 22 bp, Homo sapiens
agggagagtttgatgtttcctc

SEQ ID NO: 8258621 - DNA, 22 bp, Homo sapiens
agggagcatgggtgaagcaggc

SEQ ID NO: 8258622 - DNA, 23 bp, Homo sapiens
agggaagggggcttattccacag

SEQ ID NO: 8258623 - DNA, 22 bp, Homo sapiens
agggaagggcagggtctatgca

SEQ ID NO: 8258624 - DNA, 22 bp, Homo sapiens
agggaaggtagaggtcaccggc

SEQ ID NO: 8258625 - DNA, 22 bp, Homo sapiens
agggagaaggtttagctgtgag

SEQ ID NO: 8258626 - DNA, 22 bp, Homo sapiens
agggagaggttgaaacctcagt

SEQ ID NO: 8258627 - DNA, 22 bp, Homo sapiens
agggaaggaggccatgtgtccc

SEQ ID NO: 8258628 - DNA, 22 bp, Homo sapiens
agggaaggaaaagctgtcgctt

SEQ ID NO: 8258629 - DNA, 22 bp, Homo sapiens
agggaaggaaaagctgtcgctt

SEQ ID NO: 8258630 - DNA, 22 bp, Homo sapiens
agggaaggaaaagctgtcgctt

SEQ ID NO: 8258631 - DNA, 22 bp, Homo sapiens
agggaaggcttttgacatttcc

SEQ ID NO: 8258632 - DNA, 19 bp, Homo sapiens
agggaaggattctgtcatt

SEQ ID NO: 8258633 - DNA, 22 bp, Homo sapiens
agggaaggcttttgacatttcc

SEQ ID NO: 8258634 - DNA, 22 bp, Homo sapiens
agggaagggaaaaacactcgtc

SEQ ID NO: 8258635 - DNA, 22 bp, Homo sapiens
agggaaggaggccatgtgtccc

SEQ ID NO: 8258636 - DNA, 22 bp, Homo sapiens
agggaaggaggttagaacccac

SEQ ID NO: 8258637 - DNA, 22 bp, Homo sapiens
agggaaggaggttagaacccac

SEQ ID NO: 8258638 - DNA, 19 bp, Homo sapiens
agggaaggattctgtcatt

SEQ ID NO: 8258639 - DNA, 22 bp, Homo sapiens
cccagctctaggagtggtggca

SEQ ID NO: 8258640 - DNA, 22 bp, Homo sapiens
cccagctctggaaggtggggga

SEQ ID NO: 8258641 - DNA, 22 bp, Homo sapiens
cccagctctgcagacctgccct

SEQ ID NO: 8258642 - DNA, 22 bp, Homo sapiens
cccagctccttacagggccgaa

SEQ ID NO: 8258643 - DNA, 22 bp, Homo sapiens
cccagctccttggatgggcagg

SEQ ID NO: 8258644 - DNA, 22 bp, Homo sapiens
cccagcagtacccaagcccttg

SEQ ID NO: 8258645 - DNA, 22 bp, Homo sapiens
cccagcagtgacccagtgatac

SEQ ID NO: 8258646 - DNA, 22 bp, Homo sapiens
cccagcagtagagctcatatgg

SEQ ID NO: 8258647 - DNA, 22 bp, Homo sapiens
cccagcagttgttggtgcacat

SEQ ID NO: 8258648 - DNA, 22 bp, Homo sapiens
cccagcagtggttctcaaactt

SEQ ID NO: 8258649 - DNA, 22 bp, Homo sapiens
cccagcagtttgcttagagtga

SEQ ID NO: 8258650 - DNA, 22 bp, Homo sapiens
cccagcatcctcagggagcggg

SEQ ID NO: 8258651 - DNA, 23 bp, Homo sapiens
cccttcagcgagggcattaaggt

SEQ ID NO: 8258652 - DNA, 22 bp, Homo sapiens
cccttcagctgagtgggacagc

SEQ ID NO: 8258653 - DNA, 22 bp, Homo sapiens
cctcccatggagctctgtccat

SEQ ID NO: 8258654 - DNA, 22 bp, Homo sapiens
cctcccatccctgcaagagagc

SEQ ID NO: 8258655 - DNA, 22 bp, Homo sapiens
agggccaggatcacagccaaga

SEQ ID NO: 8258656 - DNA, 22 bp, Homo sapiens
agggccagctagagccctcgcc

SEQ ID NO: 8258657 - DNA, 22 bp, Homo sapiens
agggccagggaaacgatcagca

SEQ ID NO: 8258658 - DNA, 22 bp, Homo sapiens
agggcagcctctcagcctaggt

SEQ ID NO: 8258659 - DNA, 22 bp, Homo sapiens
agggcagcctgagtgctggccc

SEQ ID NO: 8258660 - DNA, 22 bp, Homo sapiens
agggcagctggaaggtggcttc

SEQ ID NO: 8258661 - DNA, 22 bp, Homo sapiens
agggaggaccaatgtgtggtta

SEQ ID NO: 8258662 - DNA, 22 bp, Homo sapiens
agggaggaaggatgttccaaag

SEQ ID NO: 8258663 - DNA, 22 bp, Homo sapiens
agggaggagaatggactccttc

SEQ ID NO: 8258664 - DNA, 22 bp, Homo sapiens
agggcagcccttctgggagggc

SEQ ID NO: 8258665 - DNA, 21 bp, Homo sapiens
ccaggctcctgaggctggtca

SEQ ID NO: 8258666 - DNA, 22 bp, Homo sapiens
aggctccattttcctgcagctg

SEQ ID NO: 8258667 - DNA, 22 bp, Homo sapiens
aggctccacggcaggatgctgt

SEQ ID NO: 8258668 - DNA, 22 bp, Homo sapiens
ccaggccctgctcctcacacca

SEQ ID NO: 8258669 - DNA, 22 bp, Homo sapiens
ccaggcccttgcaagtcccacc

SEQ ID NO: 8258670 - DNA, 22 bp, Homo sapiens
ccaggccctgcctgtggttcct

SEQ ID NO: 8258671 - DNA, 22 bp, Homo sapiens
ccaggccctgcctgtggttcct

SEQ ID NO: 8258672 - DNA, 22 bp, Homo sapiens
ccaggcccgttcccttctccag

SEQ ID NO: 8258673 - DNA, 22 bp, Homo sapiens
aggcctcacacaacagatgcat

SEQ ID NO: 8258674 - DNA, 22 bp, Homo sapiens
aggcctctgagcagcactcatg

SEQ ID NO: 8258675 - DNA, 22 bp, Homo sapiens
aggctctgatcaggtggctgtg

SEQ ID NO: 8258676 - DNA, 19 bp, Homo sapiens
aggctctgagctcctggag

SEQ ID NO: 8258677 - DNA, 22 bp, Homo sapiens
aggctctgcagtgctggaggac

SEQ ID NO: 8258678 - DNA, 22 bp, Homo sapiens
aggctctgatgcaagcccaggg

SEQ ID NO: 8258679 - DNA, 22 bp, Homo sapiens
ccagttatccagcatgctgtct

SEQ ID NO: 8258680 - DNA, 20 bp, Homo sapiens
ccagtttctttcccagcctc

SEQ ID NO: 8258681 - DNA, 22 bp, Homo sapiens
aggcagtggcttttgttgtgtt

SEQ ID NO: 8258682 - DNA, 23 bp, Homo sapiens
aggcagtggtggtaacatgtcaa

SEQ ID NO: 8258683 - DNA, 22 bp, Homo sapiens
ccactgctcctgaccaaggtca

SEQ ID NO: 8258684 - DNA, 22 bp, Homo sapiens
aggcagtgctcaagacagcagc

SEQ ID NO: 8258685 - DNA, 22 bp, Homo sapiens
aggcagtgctcaagacagcagc

SEQ ID NO: 8258686 - DNA, 22 bp, Homo sapiens
aggcagtgagcagggtgtcatg

SEQ ID NO: 8258687 - DNA, 22 bp, Homo sapiens
aggccccaaagcagtgcaagta

SEQ ID NO: 8258688 - DNA, 20 bp, Homo sapiens
aggccccaggtggacactag

SEQ ID NO: 8258689 - DNA, 22 bp, Homo sapiens
aggccccatcaggaaggaggcc

SEQ ID NO: 8258690 - DNA, 22 bp, Homo sapiens
aggcccagtgtggcttcctgga

SEQ ID NO: 8258691 - DNA, 22 bp, Homo sapiens
aggcccagttatcctacttgtt

SEQ ID NO: 8258692 - DNA, 22 bp, Homo sapiens
aggccgtgtgagcatgtgtgag

SEQ ID NO: 8258693 - DNA, 22 bp, Homo sapiens
aggccgaggcgggcggatcacc

SEQ ID NO: 8258694 - DNA, 22 bp, Homo sapiens
aggcccagtagtcgacggcgct

SEQ ID NO: 8258695 - DNA, 22 bp, Homo sapiens
aggcccagtgccattagttttg

SEQ ID NO: 8258696 - DNA, 22 bp, Homo sapiens
aggcccagtcctctgccgtctg

SEQ ID NO: 8258697 - DNA, 20 bp, Homo sapiens
aggcccagtgaatatattgc

SEQ ID NO: 8258698 - DNA, 22 bp, Homo sapiens
aggcccagtagtgctgccttta

SEQ ID NO: 8258699 - DNA, 22 bp, Homo sapiens
aggccagcttccagaggggcag

SEQ ID NO: 8258700 - DNA, 22 bp, Homo sapiens
aggccagcttctaccctctgtt

SEQ ID NO: 8258701 - DNA, 22 bp, Homo sapiens
aggccagctgttactagagcca

SEQ ID NO: 8258702 - DNA, 22 bp, Homo sapiens
aggccagctcaccctggctcct

SEQ ID NO: 8258703 - DNA, 22 bp, Homo sapiens
aggccagctctacccttggact

SEQ ID NO: 8258704 - DNA, 22 bp, Homo sapiens
aggccagatgtcgggctagaag

SEQ ID NO: 8258705 - DNA, 22 bp, Homo sapiens
aggccagcgctgctagctcccg

SEQ ID NO: 8258706 - DNA, 22 bp, Homo sapiens
aggccagcgctgctagctcccg

SEQ ID NO: 8258707 - DNA, 22 bp, Homo sapiens
aggccagctatgactctgctcc

SEQ ID NO: 8258708 - DNA, 22 bp, Homo sapiens
aggccaagtagctagcattgaa

SEQ ID NO: 8258709 - DNA, 22 bp, Homo sapiens
aggccaagtgctgggacaggtg

SEQ ID NO: 8258710 - DNA, 22 bp, Homo sapiens
aggccaagattttggatcagct

SEQ ID NO: 8258711 - DNA, 22 bp, Homo sapiens
aggtggggtgagctgcagacta

SEQ ID NO: 8258712 - DNA, 22 bp, Homo sapiens
aggtggggtgagctgcagacta

SEQ ID NO: 8258713 - DNA, 22 bp, Homo sapiens
ccttttaagggagactagagat

SEQ ID NO: 8258714 - DNA, 22 bp, Homo sapiens
ccttttataaagttgtattgaa

SEQ ID NO: 8258715 - DNA, 22 bp, Homo sapiens
cgaggcagggaagctgcaaaag

SEQ ID NO: 8258716 - DNA, 18 bp, Homo sapiens
cgaggcaggcggatcacg

SEQ ID NO: 8258717 - DNA, 22 bp, Homo sapiens
cgaggaggaaacgcggagaact

SEQ ID NO: 8258718 - DNA, 22 bp, Homo sapiens
cgaggcaatagagcccagaggt

SEQ ID NO: 8258719 - DNA, 22 bp, Homo sapiens
cgaggcagacaaaagttggaag

SEQ ID NO: 8258720 - DNA, 22 bp, Homo sapiens
cgaggcaggcaggcggaggata

SEQ ID NO: 8258721 - DNA, 22 bp, Homo sapiens
cgaggcagaggctgaaacggct

SEQ ID NO: 8258722 - DNA, 22 bp, Homo sapiens
cggaggggtttgaacagaggag

SEQ ID NO: 8258723 - DNA, 22 bp, Homo sapiens
cggaggggatacattttctgaa

SEQ ID NO: 8258724 - DNA, 22 bp, Homo sapiens
cctggcacataatagtggctca

SEQ ID NO: 8258725 - DNA, 22 bp, Homo sapiens
agggtgaatctcacaactctta

SEQ ID NO: 8258726 - DNA, 20 bp, Homo sapiens
agggtcagtagcacagagct

SEQ ID NO: 8258727 - DNA, 21 bp, Homo sapiens
agggtcaggaaccagggtacc

SEQ ID NO: 8258728 - DNA, 22 bp, Homo sapiens
cctctgcatctggctgctgcag

SEQ ID NO: 8258729 - DNA, 22 bp, Homo sapiens
cctctgagtgacagcctcctct

SEQ ID NO: 8258730 - DNA, 22 bp, Homo sapiens
cctctgagtcctttgggctctc

SEQ ID NO: 8258731 - DNA, 22 bp, Homo sapiens
cctctgagtgacagcctcctct

SEQ ID NO: 8258732 - DNA, 22 bp, Homo sapiens
cctctgagttagagatctagat

SEQ ID NO: 8258733 - DNA, 22 bp, Homo sapiens
cctctgagttggcctgtcttgt

SEQ ID NO: 8258734 - DNA, 22 bp, Homo sapiens
ctctggagaactccttgtgtct

SEQ ID NO: 8258735 - DNA, 22 bp, Homo sapiens
ctctggagaggttcccatggga

SEQ ID NO: 8258736 - DNA, 22 bp, Homo sapiens
ctctgtacaggagacatctcta

SEQ ID NO: 8258737 - DNA, 22 bp, Homo sapiens
ctctgtacctggcatagcaacc

SEQ ID NO: 8258738 - DNA, 22 bp, Homo sapiens
agtggtctgggctaaatgaggt

SEQ ID NO: 8258739 - DNA, 22 bp, Homo sapiens
agtggtctccccagtagaataa

SEQ ID NO: 8258740 - DNA, 22 bp, Homo sapiens
ctcctgaggacttctattgggt

SEQ ID NO: 8258741 - DNA, 22 bp, Homo sapiens
ctcctgagggatgcttaggctt

SEQ ID NO: 8258742 - DNA, 22 bp, Homo sapiens
ctcctgaggaaaagcttggtca

SEQ ID NO: 8258743 - DNA, 22 bp, Homo sapiens
ctcctgagctgcagccttgtgt

SEQ ID NO: 8258744 - DNA, 22 bp, Homo sapiens
ctcctgaggggacaggactcat

SEQ ID NO: 8258745 - DNA, 22 bp, Homo sapiens
ctcctgagtagtagcattgtca

SEQ ID NO: 8258746 - DNA, 22 bp, Homo sapiens
ctcgcctgcctgtgtctctccc

SEQ ID NO: 8258747 - DNA, 22 bp, Homo sapiens
ctcagacaaatgattaaggtta

SEQ ID NO: 8258748 - DNA, 22 bp, Homo sapiens
agtatctgcatgattttgagaa

SEQ ID NO: 8258749 - DNA, 22 bp, Homo sapiens
ctcagctacgctttcaccagct

SEQ ID NO: 8258750 - DNA, 22 bp, Homo sapiens
ctcagcccggtgctcgtgccac

SEQ ID NO: 8258751 - DNA, 22 bp, Homo sapiens
agtctcatcaggcatgtagtca

SEQ ID NO: 8258752 - DNA, 21 bp, Homo sapiens
ctcaggcatttgaggagagtc

SEQ ID NO: 8258753 - DNA, 22 bp, Homo sapiens
agtgacaggaccaggtctggaa

SEQ ID NO: 8258754 - DNA, 22 bp, Homo sapiens
agtgacagagcttggtgccccc

SEQ ID NO: 8258755 - DNA, 22 bp, Homo sapiens
agtgacagattaccggcagagc

SEQ ID NO: 8258756 - DNA, 22 bp, Homo sapiens
agtgacaagagctaggcttttt

SEQ ID NO: 8258757 - DNA, 22 bp, Homo sapiens
agtgacaacatcaattggggct

SEQ ID NO: 8258758 - DNA, 22 bp, Homo sapiens
agtgacaaggcctgaagctcct

SEQ ID NO: 8258759 - DNA, 22 bp, Homo sapiens
agtgacaaggtagttagttgga

SEQ ID NO: 8258760 - DNA, 22 bp, Homo sapiens
agtgacaaaacggaacatacag

SEQ ID NO: 8258761 - DNA, 22 bp, Homo sapiens
agtgacaaagattctccttgtt

SEQ ID NO: 8258762 - DNA, 22 bp, Homo sapiens
agtgacaacaagttgactagaa

SEQ ID NO: 8258763 - DNA, 22 bp, Homo sapiens
agtgacaaggtggtaatgaagc

SEQ ID NO: 8258764 - DNA, 23 bp, Homo sapiens
agtgacaatgggccagaggtggc

SEQ ID NO: 8258765 - DNA, 22 bp, Homo sapiens
agtgacaatatgtgctaggtat

SEQ ID NO: 8258766 - DNA, 20 bp, Homo sapiens
agtgacagagactgtgtggc

SEQ ID NO: 8258767 - DNA, 22 bp, Homo sapiens
ctcagtgtgagtgagaagtgca

SEQ ID NO: 8258768 - DNA, 22 bp, Homo sapiens
ctcagtggttgagagcctgggc

SEQ ID NO: 8258769 - DNA, 19 bp, Homo sapiens
ctggcagcctgtctgtgtc

SEQ ID NO: 8258770 - DNA, 22 bp, Homo sapiens
atactttagagctagattgcct

SEQ ID NO: 8258771 - DNA, 22 bp, Homo sapiens
ctggagggctgcagcgaggctg

SEQ ID NO: 8258772 - DNA, 22 bp, Homo sapiens
ctggagggagattcaaaggagg

SEQ ID NO: 8258773 - DNA, 22 bp, Homo sapiens
ctggagccactttttatccttt

SEQ ID NO: 8258774 - DNA, 22 bp, Homo sapiens
ctggagccactgggtcttgtat

SEQ ID NO: 8258775 - DNA, 17 bp, Homo sapiens
ctggagccaagagggcc

SEQ ID NO: 8258776 - DNA, 22 bp, Homo sapiens
ctggagccatgtcttgactgct

SEQ ID NO: 8258777 - DNA, 22 bp, Homo sapiens
ctggagccagccagggccctct

SEQ ID NO: 8258778 - DNA, 22 bp, Homo sapiens
ctggagccatgtatagcctatg

SEQ ID NO: 8258779 - DNA, 22 bp, Homo sapiens
ctggagcccaggcctggtgtct

SEQ ID NO: 8258780 - DNA, 22 bp, Homo sapiens
ctggagccccagacagggagag

SEQ ID NO: 8258781 - DNA, 22 bp, Homo sapiens
ctgctctgagtattaacggagg

SEQ ID NO: 8258782 - DNA, 22 bp, Homo sapiens
ataatacatggttgatcttttc

SEQ ID NO: 8258783 - DNA, 18 bp, Homo sapiens
ctgcccagagcacttgtg

SEQ ID NO: 8258784 - DNA, 22 bp, Homo sapiens
ctgaggggtcgtgggagcccag

SEQ ID NO: 8258785 - DNA, 22 bp, Homo sapiens
ctgcagcctccaccttttgggt

SEQ ID NO: 8258786 - DNA, 22 bp, Homo sapiens
atatgacagcggattcacatat

SEQ ID NO: 8258787 - DNA, 22 bp, Homo sapiens
atatatctgcagtactgaagaa

SEQ ID NO: 8258788 - DNA, 22 bp, Homo sapiens
atatatattgcccaggctggtt

SEQ ID NO: 8258789 - DNA, 22 bp, Homo sapiens
atatgctggagtacaggaaata

SEQ ID NO: 8258790 - DNA, 22 bp, Homo sapiens
atataactcttgttcttatagt

SEQ ID NO: 8258791 - DNA, 22 bp, Homo sapiens
atataactcttgttcttatagt

SEQ ID NO: 8258792 - DNA, 22 bp, Homo sapiens
atataacatacatacagaaaag

SEQ ID NO: 8258793 - DNA, 20 bp, Homo sapiens
atataataaattttggttac

SEQ ID NO: 8258794 - DNA, 22 bp, Homo sapiens
ctggcagctggaggctagaggc

SEQ ID NO: 8258795 - DNA, 22 bp, Homo sapiens
ctggcagctgcccgagatgccc

SEQ ID NO: 8258796 - DNA, 22 bp, Homo sapiens
atatatatcgagttcatgtctc

SEQ ID NO: 8258797 - DNA, 22 bp, Homo sapiens
atatatactttgacacattctg

SEQ ID NO: 8258798 - DNA, 19 bp, Homo sapiens
ctgggaggtgttcagagaa

SEQ ID NO: 8258799 - DNA, 22 bp, Homo sapiens
atatatatcgagttcatgtctc

SEQ ID NO: 8258800 - DNA, 22 bp, Homo sapiens
atatatatgctgatggctgcca

SEQ ID NO: 8258801 - DNA, 22 bp, Homo sapiens
ctgtggagatgcagaccaggcc

SEQ ID NO: 8258802 - DNA, 22 bp, Homo sapiens
ctgtggagcttgtggcagtggg

SEQ ID NO: 8258803 - DNA, 22 bp, Homo sapiens
atccctcccagagcaagccatt

SEQ ID NO: 8258804 - DNA, 22 bp, Homo sapiens
atccctcccagagcaagccatt

SEQ ID NO: 8258805 - DNA, 22 bp, Homo sapiens
atcctttataagacttgtattc

SEQ ID NO: 8258806 - DNA, 22 bp, Homo sapiens
atcctttaagttaataaaattc

SEQ ID NO: 8258807 - DNA, 22 bp, Homo sapiens
ctgtgcaatgcctaatcacaaa

SEQ ID NO: 8258808 - DNA, 22 bp, Homo sapiens
ctgggtagggcaaggaactggc

SEQ ID NO: 8258809 - DNA, 22 bp, Homo sapiens
cagcccagcagggtctggccct

SEQ ID NO: 8258810 - DNA, 22 bp, Homo sapiens
cagcccagcactaagtagattt

SEQ ID NO: 8258811 - DNA, 22 bp, Homo sapiens
cagccacttgtgatgctgggga

SEQ ID NO: 8258812 - DNA, 22 bp, Homo sapiens
cagcatgcccagactgagctaa

SEQ ID NO: 8258813 - DNA, 22 bp, Homo sapiens
cagcatttagaatttgaagtgt

SEQ ID NO: 8258814 - DNA, 22 bp, Homo sapiens
cagcatgcttgggggagggagc

SEQ ID NO: 8258815 - DNA, 22 bp, Homo sapiens
cagcatttggtgatcatcttaa

SEQ ID NO: 8258816 - DNA, 22 bp, Homo sapiens
cagcagagctgtgtgggaaggg

SEQ ID NO: 8258817 - DNA, 20 bp, Homo sapiens
gggtgggagagtctgagggt

SEQ ID NO: 8258818 - DNA, 22 bp, Homo sapiens
ggtggggctaggacctcaggat

SEQ ID NO: 8258819 - DNA, 22 bp, Homo sapiens
ggtggggctaggacctcaggat

SEQ ID NO: 8258820 - DNA, 22 bp, Homo sapiens
ggtgggacaggtaggagtggct

SEQ ID NO: 8258821 - DNA, 22 bp, Homo sapiens
gggtgggactgaagtctgaggg

SEQ ID NO: 8258822 - DNA, 22 bp, Homo sapiens
ggtgggggagacttggtcaaga

SEQ ID NO: 8258823 - DNA, 22 bp, Homo sapiens
ggtgggggagacttggtcaaga

SEQ ID NO: 8258824 - DNA, 22 bp, Homo sapiens
ggtgggagagctctgtctccag

SEQ ID NO: 8258825 - DNA, 22 bp, Homo sapiens
ggtggggctgcaagcagttcgg

SEQ ID NO: 8258826 - DNA, 22 bp, Homo sapiens
ggtggggctcagcaatctgtgt

SEQ ID NO: 8258827 - DNA, 22 bp, Homo sapiens
cagcaagggataaacaaggacg

SEQ ID NO: 8258828 - DNA, 22 bp, Homo sapiens
cagcagctacctgctcttgtgg

SEQ ID NO: 8258829 - DNA, 22 bp, Homo sapiens
cagcagctacttggagcagcag

SEQ ID NO: 8258830 - DNA, 22 bp, Homo sapiens
cagcagcctgccttgggagctt

SEQ ID NO: 8258831 - DNA, 22 bp, Homo sapiens
cagcaggcccaggtgctggtga

SEQ ID NO: 8258832 - DNA, 22 bp, Homo sapiens
cagcaggcccagagtttcatgg

SEQ ID NO: 8258833 - DNA, 22 bp, Homo sapiens
cagcaggcaagaggttttatca

SEQ ID NO: 8258834 - DNA, 22 bp, Homo sapiens
cagcaggcagccatttcactgt

SEQ ID NO: 8258835 - DNA, 22 bp, Homo sapiens
cagcaggccatgctgcttttca

SEQ ID NO: 8258836 - DNA, 22 bp, Homo sapiens
cagcaggcaggtgggccaagtc

SEQ ID NO: 8258837 - DNA, 22 bp, Homo sapiens
gtatctgtggattttggtatcc

SEQ ID NO: 8258838 - DNA, 22 bp, Homo sapiens
cagcagcaaggtgagggtggag

SEQ ID NO: 8258839 - DNA, 22 bp, Homo sapiens
cagcagcagattcagcgtctgg

SEQ ID NO: 8258840 - DNA, 22 bp, Homo sapiens
gtagggataggtgtccagagac

SEQ ID NO: 8258841 - DNA, 22 bp, Homo sapiens
gtagggagcccagagcccagtg

SEQ ID NO: 8258842 - DNA, 22 bp, Homo sapiens
gtagggattcttctcactgagc

SEQ ID NO: 8258843 - DNA, 22 bp, Homo sapiens
gtagggatggaagccatgaaat

SEQ ID NO: 8258844 - DNA, 22 bp, Homo sapiens
gtagggatgaggccctcattcc

SEQ ID NO: 8258845 - DNA, 22 bp, Homo sapiens
cagcagagtatggcactcaact

SEQ ID NO: 8258846 - DNA, 22 bp, Homo sapiens
cagcagcaacaatagcggtcac

SEQ ID NO: 8258847 - DNA, 22 bp, Homo sapiens
gggacagacccatgggccaggt

SEQ ID NO: 8258848 - DNA, 22 bp, Homo sapiens
gggactggatagatgtgggtga

SEQ ID NO: 8258849 - DNA, 22 bp, Homo sapiens
gggactggcacagggctgggag

SEQ ID NO: 8258850 - DNA, 19 bp, Homo sapiens
gggactggaggatgtggag

SEQ ID NO: 8258851 - DNA, 22 bp, Homo sapiens
gggactggaactactggtgcag

SEQ ID NO: 8258852 - DNA, 22 bp, Homo sapiens
cagaaggctttgtggagtagac

SEQ ID NO: 8258853 - DNA, 22 bp, Homo sapiens
cagaaggctggcagattgagat

SEQ ID NO: 8258854 - DNA, 22 bp, Homo sapiens
ggcttttgctgtgttttccaga

SEQ ID NO: 8258855 - DNA, 22 bp, Homo sapiens
gggcaagttacttaatctctct

SEQ ID NO: 8258856 - DNA, 22 bp, Homo sapiens
gggcaagtccggtgcccagagc

SEQ ID NO: 8258857 - DNA, 20 bp, Homo sapiens
gggcaaggaaacagccccca

SEQ ID NO: 8258858 - DNA, 20 bp, Homo sapiens
gggatgagagtcctagctct

SEQ ID NO: 8258859 - DNA, 22 bp, Homo sapiens
gggagggcttggacccagatgt

SEQ ID NO: 8258860 - DNA, 22 bp, Homo sapiens
gggaggggttgcatgtttgagt

SEQ ID NO: 8258861 - DNA, 22 bp, Homo sapiens
gggagggccagtgctctctaga

SEQ ID NO: 8258862 - DNA, 20 bp, Homo sapiens
gggaggccagcctcagagaa

SEQ ID NO: 8258863 - DNA, 22 bp, Homo sapiens
gggaggtcctaaaggggaccag

SEQ ID NO: 8258864 - DNA, 22 bp, Homo sapiens
gggaggtagcaagcctgcagct

SEQ ID NO: 8258865 - DNA, 22 bp, Homo sapiens
gggaggtaaagatgagctcagt

SEQ ID NO: 8258866 - DNA, 22 bp, Homo sapiens
gggagcagcctgcctcccacct

SEQ ID NO: 8258867 - DNA, 22 bp, Homo sapiens
cagagcccagggcctacgtccc

SEQ ID NO: 8258868 - DNA, 22 bp, Homo sapiens
gggcagagaaatggacagttgg

SEQ ID NO: 8258869 - DNA, 22 bp, Homo sapiens
cagagccctcaaggccgatgca

SEQ ID NO: 8258870 - DNA, 22 bp, Homo sapiens
cagagccctagtcctgatggcc

SEQ ID NO: 8258871 - DNA, 22 bp, Homo sapiens
cagagccctgtgtgccatgtga

SEQ ID NO: 8258872 - DNA, 22 bp, Homo sapiens
cagagccctagtcctgatggcc

SEQ ID NO: 8258873 - DNA, 22 bp, Homo sapiens
cagagcccctgggttgggagct

SEQ ID NO: 8258874 - DNA, 22 bp, Homo sapiens
cagagcccctgggttgggagct

SEQ ID NO: 8258875 - DNA, 22 bp, Homo sapiens
cagagctgcacattctatgatg

SEQ ID NO: 8258876 - DNA, 22 bp, Homo sapiens
cagagctgagtcttcaaggttg

SEQ ID NO: 8258877 - DNA, 23 bp, Homo sapiens
cagagctgattaaacttaatctc

SEQ ID NO: 8258878 - DNA, 22 bp, Homo sapiens
cagagctgattggatccagaga

SEQ ID NO: 8258879 - DNA, 22 bp, Homo sapiens
gggcgcagccaatcctggccct

SEQ ID NO: 8258880 - DNA, 22 bp, Homo sapiens
ggggaaaggccatggcaagaac

SEQ ID NO: 8258881 - DNA, 22 bp, Homo sapiens
ggggaacaccgggcagaggcgc

SEQ ID NO: 8258882 - DNA, 22 bp, Homo sapiens
gggctgtgtactatgaggaggg

SEQ ID NO: 8258883 - DNA, 19 bp, Homo sapiens
cagagctgctggcctcgtc

SEQ ID NO: 8258884 - DNA, 22 bp, Homo sapiens
cagaggcctatccagtgtccat

SEQ ID NO: 8258885 - DNA, 22 bp, Homo sapiens
cagaggcctcacttccagccag

SEQ ID NO: 8258886 - DNA, 22 bp, Homo sapiens
cagagctgtcatttgccagtga

SEQ ID NO: 8258887 - DNA, 22 bp, Homo sapiens
cagagctggtgttacaagtcca

SEQ ID NO: 8258888 - DNA, 22 bp, Homo sapiens
cagagctgtcatttgccagtga

SEQ ID NO: 8258889 - DNA, 22 bp, Homo sapiens
cagagctggtgtgtcctggcat

SEQ ID NO: 8258890 - DNA, 20 bp, Homo sapiens
ggggaagaaaaggatgtgat

SEQ ID NO: 8258891 - DNA, 22 bp, Homo sapiens
gggtctaggagacatgggcaag

SEQ ID NO: 8258892 - DNA, 22 bp, Homo sapiens
gggtgcagggtctccagcagct

SEQ ID NO: 8258893 - DNA, 22 bp, Homo sapiens
gggtgctgactggggcctgaaa

SEQ ID NO: 8258894 - DNA, 22 bp, Homo sapiens
gctgccaagggaagcgcagtgc

SEQ ID NO: 8258895 - DNA, 22 bp, Homo sapiens
gctgccaatccagctgtgggag

SEQ ID NO: 8258896 - DNA, 22 bp, Homo sapiens
gctgctggcactggagtgagcc

SEQ ID NO: 8258897 - DNA, 22 bp, Homo sapiens
gctgctggcactggagtgagcc

SEQ ID NO: 8258898 - DNA, 22 bp, Homo sapiens
gctgctggagctttgcagaagg

SEQ ID NO: 8258899 - DNA, 22 bp, Homo sapiens
gctgctggatgcgcttgatggt

SEQ ID NO: 8258900 - DNA, 22 bp, Homo sapiens
gctgctggagagcgagactgtt

SEQ ID NO: 8258901 - DNA, 22 bp, Homo sapiens
gctgctggagagcgagactgtt

SEQ ID NO: 8258902 - DNA, 22 bp, Homo sapiens
gctgctggccccacatgctcca

SEQ ID NO: 8258903 - DNA, 22 bp, Homo sapiens
gctgctggcactggagtgagcc

SEQ ID NO: 8258904 - DNA, 22 bp, Homo sapiens
gctgctggcatctagggggtgg

SEQ ID NO: 8258905 - DNA, 22 bp, Homo sapiens
caaggagagtaattgaatgaga

SEQ ID NO: 8258906 - DNA, 22 bp, Homo sapiens
caaggagataaaatgttgagct

SEQ ID NO: 8258907 - DNA, 22 bp, Homo sapiens
caaggaggaagatgcaggggac

SEQ ID NO: 8258908 - DNA, 22 bp, Homo sapiens
caaggagaaaacggcttctgaa

SEQ ID NO: 8258909 - DNA, 22 bp, Homo sapiens
caaggagaaaacggcttctgaa

SEQ ID NO: 8258910 - DNA, 22 bp, Homo sapiens
cacacatttcagatgctacaat

SEQ ID NO: 8258911 - DNA, 22 bp, Homo sapiens
cacaatattggccgggctggtc

SEQ ID NO: 8258912 - DNA, 23 bp, Homo sapiens
cacaaaggttccattctctcacc

SEQ ID NO: 8258913 - DNA, 22 bp, Homo sapiens
cacaaaggagaatgtcagcata

SEQ ID NO: 8258914 - DNA, 22 bp, Homo sapiens
cacaaagccctccctgcgccag

SEQ ID NO: 8258915 - DNA, 22 bp, Homo sapiens
gctgtacaaggcctctgccatc

SEQ ID NO: 8258916 - DNA, 22 bp, Homo sapiens
caaggcagctattgtctccata

SEQ ID NO: 8258917 - DNA, 19 bp, Homo sapiens
gctgtctgatgctgaggtc

SEQ ID NO: 8258918 - DNA, 22 bp, Homo sapiens
gctgtctgccgcaggctgccac

SEQ ID NO: 8258919 - DNA, 22 bp, Homo sapiens
gctgtctgcatctctagagctt

SEQ ID NO: 8258920 - DNA, 22 bp, Homo sapiens
cacagggcagagggtccgtggc

SEQ ID NO: 8258921 - DNA, 22 bp, Homo sapiens
cacagggcagagacctgggtgc

SEQ ID NO: 8258922 - DNA, 22 bp, Homo sapiens
ggcagagcattcgatggacctg

SEQ ID NO: 8258923 - DNA, 22 bp, Homo sapiens
ggcagagcctcagccctccacc

SEQ ID NO: 8258924 - DNA, 22 bp, Homo sapiens
ggcagagcagccccagggtttg

SEQ ID NO: 8258925 - DNA, 22 bp, Homo sapiens
ggcagagatgtgggtcagaatc

SEQ ID NO: 8258926 - DNA, 22 bp, Homo sapiens
ggcagagctagtggcttctctt

SEQ ID NO: 8258927 - DNA, 22 bp, Homo sapiens
ggcagagccttctggagctcgc

SEQ ID NO: 8258928 - DNA, 17 bp, Homo sapiens
ggcagagctgacagggc

SEQ ID NO: 8258929 - DNA, 22 bp, Homo sapiens
ggcagagctctggactgagaac

SEQ ID NO: 8258930 - DNA, 22 bp, Homo sapiens
ggcagagctgcatgagcactca

SEQ ID NO: 8258931 - DNA, 22 bp, Homo sapiens
cacagtggtccccgaagcccct

SEQ ID NO: 8258932 - DNA, 22 bp, Homo sapiens
cacagtggaaacagctaagcct

SEQ ID NO: 8258933 - DNA, 22 bp, Homo sapiens
cacagtggattgggtgatgccc

SEQ ID NO: 8258934 - DNA, 21 bp, Homo sapiens
ggcagagctggggcctccagc

SEQ ID NO: 8258935 - DNA, 22 bp, Homo sapiens
ggcagagcttgcagtgagccga

SEQ ID NO: 8258936 - DNA, 22 bp, Homo sapiens
ggcagcatatattcagtgggca

SEQ ID NO: 8258937 - DNA, 22 bp, Homo sapiens
ggcagcagttacaaatgtgcag

SEQ ID NO: 8258938 - DNA, 22 bp, Homo sapiens
cacagctgtgagaagggagcct

SEQ ID NO: 8258939 - DNA, 22 bp, Homo sapiens
cacagctgtatccaggagatcc

SEQ ID NO: 8258940 - DNA, 22 bp, Homo sapiens
cacagctggtgcactagctctg

SEQ ID NO: 8258941 - DNA, 22 bp, Homo sapiens
cacagctgaagtagccatgtgg

SEQ ID NO: 8258942 - DNA, 22 bp, Homo sapiens
ggaggcggagcttgcagtgagc

SEQ ID NO: 8258943 - DNA, 22 bp, Homo sapiens
ggaggcggaagttgcagtgagc

SEQ ID NO: 8258944 - DNA, 22 bp, Homo sapiens
ggaggccttgcctgcaggcaca

SEQ ID NO: 8258945 - DNA, 22 bp, Homo sapiens
ggaggccttgaggccaggagct

SEQ ID NO: 8258946 - DNA, 22 bp, Homo sapiens
cacagcttgggctctgacaata

SEQ ID NO: 8258947 - DNA, 22 bp, Homo sapiens
ggagggagtcagctgattagaa

SEQ ID NO: 8258948 - DNA, 22 bp, Homo sapiens
ggatccttaactatcacagtga

SEQ ID NO: 8258949 - DNA, 22 bp, Homo sapiens
ggatgggaacttggtagggcat

SEQ ID NO: 8258950 - DNA, 22 bp, Homo sapiens
ggagggagcatccccttgctga

SEQ ID NO: 8258951 - DNA, 22 bp, Homo sapiens
ggagggaggttagattcaagct

SEQ ID NO: 8258952 - DNA, 22 bp, Homo sapiens
ggagggagggctagaccaaaga

SEQ ID NO: 8258953 - DNA, 22 bp, Homo sapiens
ggaggcggaggctgcagtgagc

SEQ ID NO: 8258954 - DNA, 22 bp, Homo sapiens
ggatgggcagacaggacggcac

SEQ ID NO: 8258955 - DNA, 22 bp, Homo sapiens
ggctagggatctagaccaggac

SEQ ID NO: 8258956 - DNA, 22 bp, Homo sapiens
ggctagggatctagaccaggac

SEQ ID NO: 8258957 - DNA, 22 bp, Homo sapiens
ggctaggggaataatctgtggt

SEQ ID NO: 8258958 - DNA, 22 bp, Homo sapiens
ggctatgggaagatggcagggg

SEQ ID NO: 8258959 - DNA, 22 bp, Homo sapiens
ggctatggaaatggcaggacat

SEQ ID NO: 8258960 - DNA, 22 bp, Homo sapiens
ggcctcgcggcttctggtggct

SEQ ID NO: 8258961 - DNA, 22 bp, Homo sapiens
cacccatgtttccctctgtctt

SEQ ID NO: 8258962 - DNA, 22 bp, Homo sapiens
ggcagctgacctagcaccatcc

SEQ ID NO: 8258963 - DNA, 22 bp, Homo sapiens
ggcagctgagcatggctacctt

SEQ ID NO: 8258964 - DNA, 22 bp, Homo sapiens
caccatgactggttgagagagg

SEQ ID NO: 8258965 - DNA, 17 bp, Homo sapiens
gaggagctccagtaggt

SEQ ID NO: 8258966 - DNA, 22 bp, Homo sapiens
gaggagctgggctgagagggtc

SEQ ID NO: 8258967 - DNA, 21 bp, Homo sapiens
atggtaggtggagcaggtgat

SEQ ID NO: 8258968 - DNA, 22 bp, Homo sapiens
gagctgggcctgcgagtgctgc

SEQ ID NO: 8258969 - DNA, 22 bp, Homo sapiens
gaggggagcccccatcctccag

SEQ ID NO: 8258970 - DNA, 22 bp, Homo sapiens
gaggggagcatgatctagattg

SEQ ID NO: 8258971 - DNA, 16 bp, Homo sapiens
gaggggagcagtaggc

SEQ ID NO: 8258972 - DNA, 22 bp, Homo sapiens
gaggggagacagggaaatcagt

SEQ ID NO: 8258973 - DNA, 22 bp, Homo sapiens
gaggggagaaggcactaaccag

SEQ ID NO: 8258974 - DNA, 22 bp, Homo sapiens
gaggggagaggcttatggatca

SEQ ID NO: 8258975 - DNA, 22 bp, Homo sapiens
gaggcctgggcaagggggtctg

SEQ ID NO: 8258976 - DNA, 22 bp, Homo sapiens
gaggcctgggcaagggggtctg

SEQ ID NO: 8258977 - DNA, 22 bp, Homo sapiens
atggccctggaaagagcttgag

SEQ ID NO: 8258978 - DNA, 22 bp, Homo sapiens
atggccctggcccagaccccac

SEQ ID NO: 8258979 - DNA, 22 bp, Homo sapiens
atggccctgctaccacttttct

SEQ ID NO: 8258980 - DNA, 22 bp, Homo sapiens
atggccctgctggtttgatcgt

SEQ ID NO: 8258981 - DNA, 22 bp, Homo sapiens
atggccctgccaggaggaacaa

SEQ ID NO: 8258982 - DNA, 22 bp, Homo sapiens
atggccctcagtccttccttgg

SEQ ID NO: 8258983 - DNA, 22 bp, Homo sapiens
atggccctctccttaggtcagc

SEQ ID NO: 8258984 - DNA, 22 bp, Homo sapiens
atggccctgaccttgatgacct

SEQ ID NO: 8258985 - DNA, 22 bp, Homo sapiens
atggccctaatgagttggtgtt

SEQ ID NO: 8258986 - DNA, 22 bp, Homo sapiens
atggccctatcacctttgcttc

SEQ ID NO: 8258987 - DNA, 22 bp, Homo sapiens
gagccagcctccgcctctctcc

SEQ ID NO: 8258988 - DNA, 22 bp, Homo sapiens
gagccagccttcttctgaggtc

SEQ ID NO: 8258989 - DNA, 22 bp, Homo sapiens
gagccagctacatggtctgcaa

SEQ ID NO: 8258990 - DNA, 22 bp, Homo sapiens
atggacagtgtgaagcagatag

SEQ ID NO: 8258991 - DNA, 21 bp, Homo sapiens
atggagcctaagagtggaggt

SEQ ID NO: 8258992 - DNA, 22 bp, Homo sapiens
atggagccattcctgaagactt

SEQ ID NO: 8258993 - DNA, 20 bp, Homo sapiens
atggaggaagggcaagagaa

SEQ ID NO: 8258994 - DNA, 22 bp, Homo sapiens
atggagagagaaggcttgctgt

SEQ ID NO: 8258995 - DNA, 22 bp, Homo sapiens
atgcaaacatgaagagaaagag

SEQ ID NO: 8258996 - DNA, 22 bp, Homo sapiens
atgcaaacattcgcttgtctct

SEQ ID NO: 8258997 - DNA, 22 bp, Homo sapiens
atgcaaacatgtttcctctaag

SEQ ID NO: 8258998 - DNA, 22 bp, Homo sapiens
atgcagagcttccagtggcctg

SEQ ID NO: 8258999 - DNA, 22 bp, Homo sapiens
atgcagagacagatgtggcatg

SEQ ID NO: 8259000 - DNA, 23 bp, Homo sapiens
atgcaggacttataaggtaaggt

SEQ ID NO: 8259001 - DNA, 22 bp, Homo sapiens
atgcaggaagagccctggagct

SEQ ID NO: 8259002 - DNA, 22 bp, Homo sapiens
atgcatttatgtgtgtacattg

SEQ ID NO: 8259003 - DNA, 21 bp, Homo sapiens
atgcatggatttcagtgagag

SEQ ID NO: 8259004 - DNA, 22 bp, Homo sapiens
atgcatggtctgaagtcaacct

SEQ ID NO: 8259005 - DNA, 22 bp, Homo sapiens
atgaggcagctgacagctgttc

SEQ ID NO: 8259006 - DNA, 19 bp, Homo sapiens
gaaagatttcagttgagga

SEQ ID NO: 8259007 - DNA, 22 bp, Homo sapiens
atgagtgtgaagttagctcagt

SEQ ID NO: 8259008 - DNA, 18 bp, Homo sapiens
cttgttcttctcttggcg

SEQ ID NO: 8259009 - DNA, 22 bp, Homo sapiens
atcttgctgctacaaagtgccc

SEQ ID NO: 8259010 - DNA, 22 bp, Homo sapiens
cttgctggcagtcactgttgcg

SEQ ID NO: 8259011 - DNA, 22 bp, Homo sapiens
atctatatcatggggtaaggta

SEQ ID NO: 8259012 - DNA, 23 bp, Homo sapiens
cttgcctggcctctctgcccaga

SEQ ID NO: 8259013 - DNA, 22 bp, Homo sapiens
cttgcctttgtcttcaaaggct

SEQ ID NO: 8259014 - DNA, 22 bp, Homo sapiens
atttcatagattgtaaatccct

SEQ ID NO: 8259015 - DNA, 22 bp, Homo sapiens
atttattatgggatttggcaca

SEQ ID NO: 8259016 - DNA, 22 bp, Homo sapiens
gccaggcctgcaagtgctggtg

SEQ ID NO: 8259017 - DNA, 22 bp, Homo sapiens
gccaggccctgggcacttcgtg

SEQ ID NO: 8259018 - DNA, 22 bp, Homo sapiens
gccaggccactcccgggtcctg

SEQ ID NO: 8259019 - DNA, 19 bp, Homo sapiens
gccaggagggctctggctg

SEQ ID NO: 8259020 - DNA, 22 bp, Homo sapiens
gccagctggagtgagagtgggc

SEQ ID NO: 8259021 - DNA, 17 bp, Homo sapiens
gccaggaggtttgagct

SEQ ID NO: 8259022 - DNA, 22 bp, Homo sapiens
gccaggaggggagagtgtgtca

SEQ ID NO: 8259023 - DNA, 20 bp, Homo sapiens
gccaggagggtgtgatgagc

SEQ ID NO: 8259024 - DNA, 22 bp, Homo sapiens
atttaatttggagagagaaacc

SEQ ID NO: 8259025 - DNA, 22 bp, Homo sapiens
atttaattttctcaacagtgct

SEQ ID NO: 8259026 - DNA, 22 bp, Homo sapiens
atttaatttacatttgacagag

SEQ ID NO: 8259027 - DNA, 22 bp, Homo sapiens
atttaaattttctgatggagag

SEQ ID NO: 8259028 - DNA, 22 bp, Homo sapiens
attggaaatacagtagaaaaat

SEQ ID NO: 8259029 - DNA, 22 bp, Homo sapiens
attggaaatactgagagataaa

SEQ ID NO: 8259030 - DNA, 22 bp, Homo sapiens
attggaaagttcttaagggata

SEQ ID NO: 8259031 - DNA, 22 bp, Homo sapiens
gcctgggagcacatcggggtcc

SEQ ID NO: 8259032 - DNA, 22 bp, Homo sapiens
gcctgctgaacctcatgcagtc

SEQ ID NO: 8259033 - DNA, 22 bp, Homo sapiens
gcctccagggtagaggaggaag

SEQ ID NO: 8259034 - DNA, 22 bp, Homo sapiens
gcctgggagggcagcagtgtgg

SEQ ID NO: 8259035 - DNA, 22 bp, Homo sapiens
gcgagggcacgcggttgaaggc

SEQ ID NO: 8259036 - DNA, 22 bp, Homo sapiens
gcgaggaggggtgctgggcccc

SEQ ID NO: 8259037 - DNA, 17 bp, Homo sapiens
gcgcagctcctggcgcg

SEQ ID NO: 8259038 - DNA, 22 bp, Homo sapiens
gcgcagagtgaagatctccgtg

SEQ ID NO: 8259039 - DNA, 22 bp, Homo sapiens
gctcaggcaggagtgcagtggc

SEQ ID NO: 8259040 - DNA, 22 bp, Homo sapiens
gctcaggcaccatatgatgtgt

SEQ ID NO: 8259041 - DNA, 22 bp, Homo sapiens
gctcaggcaaatttctggtgaa

SEQ ID NO: 8259042 - DNA, 22 bp, Homo sapiens
caaactttcagttataacatga

SEQ ID NO: 8259043 - DNA, 22 bp, Homo sapiens
gcaagtgatgatggcaacttca

SEQ ID NO: 8259044 - DNA, 22 bp, Homo sapiens
gcaagtgattgtcacgtccctt

SEQ ID NO: 8259045 - DNA, 22 bp, Homo sapiens
gcaagtgagaggcatcattaga

SEQ ID NO: 8259046 - DNA, 23 bp, Homo sapiens
gcaagtgaggcgtcagcagtcaa

SEQ ID NO: 8259047 - DNA, 22 bp, Homo sapiens
gcaagtgaatgaggttgagatt

SEQ ID NO: 8259048 - DNA, 20 bp, Homo sapiens
gcaagtgaaaactatgggtg

SEQ ID NO: 8259049 - DNA, 21 bp, Homo sapiens
gcaagtgtttctgacagtggc

SEQ ID NO: 8259050 - DNA, 22 bp, Homo sapiens
attaatatcctgctggctaaat

SEQ ID NO: 8259051 - DNA, 22 bp, Homo sapiens
attaatattggttcattagctg

SEQ ID NO: 8259052 - DNA, 22 bp, Homo sapiens
attacaagtagactaactttca

SEQ ID NO: 8259053 - DNA, 23 bp, Homo sapiens
gatgaggacctacaggtggccag

SEQ ID NO: 8259054 - DNA, 22 bp, Homo sapiens
gatgaggcaagccagaggactg

SEQ ID NO: 8259055 - DNA, 22 bp, Homo sapiens
gatgaggctgtagagggtggca

SEQ ID NO: 8259056 - DNA, 22 bp, Homo sapiens
attgacaaaaacaggtggttga

SEQ ID NO: 8259057 - DNA, 22 bp, Homo sapiens
attgacaagtgagctgggctgc

SEQ ID NO: 8259058 - DNA, 22 bp, Homo sapiens
attgacaatctactatgttctg

SEQ ID NO: 8259059 - DNA, 22 bp, Homo sapiens
attgacaagacaatggctctta

SEQ ID NO: 8259060 - DNA, 22 bp, Homo sapiens
attgacaaatggatgttgacat

SEQ ID NO: 8259061 - DNA, 22 bp, Homo sapiens
attgacaatgtatttgtatctg

SEQ ID NO: 8259062 - DNA, 22 bp, Homo sapiens
attgacaattctatgcagagca

SEQ ID NO: 8259063 - DNA, 22 bp, Homo sapiens
attcttaattgccatgctgtat

SEQ ID NO: 8259064 - DNA, 22 bp, Homo sapiens
attctgtcattacaaaaggcag

SEQ ID NO: 8259065 - DNA, 22 bp, Homo sapiens
attctggaattctaagattctg

SEQ ID NO: 8259066 - DNA, 22 bp, Homo sapiens
attctggaagcaagcttttaaa

SEQ ID NO: 8259067 - DNA, 22 bp, Homo sapiens
attctgtcatttcaagaaaaac

SEQ ID NO: 8259068 - DNA, 22 bp, Homo sapiens
attctgtctttttaaaataata

SEQ ID NO: 8259069 - DNA, 23 bp, Homo sapiens
catgtctgctttcatgctacaac

SEQ ID NO: 8259070 - DNA, 20 bp, Homo sapiens
tccagcccagcagcctgaca

SEQ ID NO: 8259071 - DNA, 22 bp, Homo sapiens
tccagcccagctcctctcagaa

SEQ ID NO: 8259072 - DNA, 22 bp, Homo sapiens
tccagccatatcttgtagccct

SEQ ID NO: 8259073 - DNA, 22 bp, Homo sapiens
tccagccacttgcacagttaaa

SEQ ID NO: 8259074 - DNA, 22 bp, Homo sapiens
tccagccaggatggcccaggga

SEQ ID NO: 8259075 - DNA, 22 bp, Homo sapiens
tcagtttcacagtctgtgcaga

SEQ ID NO: 8259076 - DNA, 17 bp, Homo sapiens
tcatttgttgtgactag

SEQ ID NO: 8259077 - DNA, 18 bp, Homo sapiens
tcatttgttttgcatgaa

SEQ ID NO: 8259078 - DNA, 22 bp, Homo sapiens
tcatggttcatgagtgtccttt

SEQ ID NO: 8259079 - DNA, 22 bp, Homo sapiens
tcagctcttaaccctctggcct

SEQ ID NO: 8259080 - DNA, 22 bp, Homo sapiens
tcagctctgttttgagtggaac

SEQ ID NO: 8259081 - DNA, 20 bp, Homo sapiens
tcagctctgtgcctgggatg

SEQ ID NO: 8259082 - DNA, 22 bp, Homo sapiens
tcagctctggttcatgtggtct

SEQ ID NO: 8259083 - DNA, 22 bp, Homo sapiens
catactattactaggagcagga

SEQ ID NO: 8259084 - DNA, 22 bp, Homo sapiens
catactttttagatctgccttc

SEQ ID NO: 8259085 - DNA, 22 bp, Homo sapiens
tcagctgcataagtcaccttgc

SEQ ID NO: 8259086 - DNA, 22 bp, Homo sapiens
cagtttcttatcttcaaaattg

SEQ ID NO: 8259087 - DNA, 22 bp, Homo sapiens
cagtttcttaagactgagatct

SEQ ID NO: 8259088 - DNA, 22 bp, Homo sapiens
cagtttcttcatctgcagaatc

SEQ ID NO: 8259089 - DNA, 22 bp, Homo sapiens
cagtttcttcaattcagacact

SEQ ID NO: 8259090 - DNA, 22 bp, Homo sapiens
cagtttcttcatcagttaagca

SEQ ID NO: 8259091 - DNA, 22 bp, Homo sapiens
cagtttctctcatacatatttg

SEQ ID NO: 8259092 - DNA, 22 bp, Homo sapiens
catatacacttccacctctgtg

SEQ ID NO: 8259093 - DNA, 22 bp, Homo sapiens
catatcttctgacatgatcagg

SEQ ID NO: 8259094 - DNA, 22 bp, Homo sapiens
catatactgcatacatatgtgt

SEQ ID NO: 8259095 - DNA, 22 bp, Homo sapiens
catatacttttctatagctttc

SEQ ID NO: 8259096 - DNA, 22 bp, Homo sapiens
tcagggcatggctgcacttggc

SEQ ID NO: 8259097 - DNA, 20 bp, Homo sapiens
tcagggcatgggacagcccc

SEQ ID NO: 8259098 - DNA, 22 bp, Homo sapiens
tcagggcattcaagaggcctgg

SEQ ID NO: 8259099 - DNA, 22 bp, Homo sapiens
cagtctaagttaatttccacaa

SEQ ID NO: 8259100 - DNA, 22 bp, Homo sapiens
cagtctaagactcacgccaaga

SEQ ID NO: 8259101 - DNA, 22 bp, Homo sapiens
cagtctaacttcacagcctgga

SEQ ID NO: 8259102 - DNA, 18 bp, Homo sapiens
cagtctaattcccttccc

SEQ ID NO: 8259103 - DNA, 22 bp, Homo sapiens
cagtctaatctgttactcatta

SEQ ID NO: 8259104 - DNA, 22 bp, Homo sapiens
cagtcctgtgtcccttggtggg

SEQ ID NO: 8259105 - DNA, 22 bp, Homo sapiens
cagtgctggaggctggagggaa

SEQ ID NO: 8259106 - DNA, 22 bp, Homo sapiens
cagtgctcctgatgtacccttg

SEQ ID NO: 8259107 - DNA, 22 bp, Homo sapiens
tcacattgaatggaagaataga

SEQ ID NO: 8259108 - DNA, 22 bp, Homo sapiens
caggtctggtgagagaacagtt

SEQ ID NO: 8259109 - DNA, 22 bp, Homo sapiens
caggtctgttttcaaggtcagt

SEQ ID NO: 8259110 - DNA, 22 bp, Homo sapiens
tatacagtcttttgctatattc

SEQ ID NO: 8259111 - DNA, 22 bp, Homo sapiens
tatacagttaagtttcttcagt

SEQ ID NO: 8259112 - DNA, 22 bp, Homo sapiens
cagggtggcacatcacagcatt

SEQ ID NO: 8259113 - DNA, 22 bp, Homo sapiens
cagggtggcacatcacagcatt

SEQ ID NO: 8259114 - DNA, 22 bp, Homo sapiens
caggtctgggttgatggcctgg

SEQ ID NO: 8259115 - DNA, 17 bp, Homo sapiens
caggtctgaggccaggc

SEQ ID NO: 8259116 - DNA, 22 bp, Homo sapiens
caggggccaagggtccagacct

SEQ ID NO: 8259117 - DNA, 22 bp, Homo sapiens
caggggccggctgtccgtgccc

SEQ ID NO: 8259118 - DNA, 22 bp, Homo sapiens
tataatctggttttattaagag

SEQ ID NO: 8259119 - DNA, 22 bp, Homo sapiens
caggggcaagaatgctgtcagc

SEQ ID NO: 8259120 - DNA, 22 bp, Homo sapiens
ccaggaggatggttgttaggtg

SEQ ID NO: 8259121 - DNA, 22 bp, Homo sapiens
ccaggaggcagaagttgcagtg

SEQ ID NO: 8259122 - DNA, 22 bp, Homo sapiens
tctgtcttctgtagctaataat

SEQ ID NO: 8259123 - DNA, 23 bp, Homo sapiens
tctgtctgtgtatgtgcagaaag

SEQ ID NO: 8259124 - DNA, 18 bp, Homo sapiens
tctgtctgtgttgtcttt

SEQ ID NO: 8259125 - DNA, 22 bp, Homo sapiens
ccaggaggcggaaggtacagtg

SEQ ID NO: 8259126 - DNA, 22 bp, Homo sapiens
ccagctgctttttgtcacatgg

SEQ ID NO: 8259127 - DNA, 22 bp, Homo sapiens
ccagctggggaagtggggcata

SEQ ID NO: 8259128 - DNA, 22 bp, Homo sapiens
ccagctggtaagtgatggagcc

SEQ ID NO: 8259129 - DNA, 21 bp, Homo sapiens
tctggagccctaagctgagaa

SEQ ID NO: 8259130 - DNA, 22 bp, Homo sapiens
ccagctgtgccgtgtggatagc

SEQ ID NO: 8259131 - DNA, 22 bp, Homo sapiens
tctggcttggacacaatcttcc

SEQ ID NO: 8259132 - DNA, 22 bp, Homo sapiens
tctggcttctcctagagcaatg

SEQ ID NO: 8259133 - DNA, 22 bp, Homo sapiens
tctggagcttgaagctttggtt

SEQ ID NO: 8259134 - DNA, 22 bp, Homo sapiens
tctggagcttgtttcagatggt

SEQ ID NO: 8259135 - DNA, 22 bp, Homo sapiens
tctggagcttcctcatttacag

SEQ ID NO: 8259136 - DNA, 22 bp, Homo sapiens
tctggagctggagggcaaggca

SEQ ID NO: 8259137 - DNA, 22 bp, Homo sapiens
tctggagctggcagggccctgg

SEQ ID NO: 8259138 - DNA, 19 bp, Homo sapiens
tctggagctgatgcaggtg

SEQ ID NO: 8259139 - DNA, 21 bp, Homo sapiens
tctggagctgcaggctgggca

SEQ ID NO: 8259140 - DNA, 22 bp, Homo sapiens
tctggagctggagggcaaggca

SEQ ID NO: 8259141 - DNA, 22 bp, Homo sapiens
ccagcccatgcccttatagcat

SEQ ID NO: 8259142 - DNA, 22 bp, Homo sapiens
ccagccccgggaacctggccgt

SEQ ID NO: 8259143 - DNA, 22 bp, Homo sapiens
ccagcccctatcctcgctccac

SEQ ID NO: 8259144 - DNA, 22 bp, Homo sapiens
ccagccataaacccagatgact

SEQ ID NO: 8259145 - DNA, 22 bp, Homo sapiens
ccagctctaaacggctctgtgg

SEQ ID NO: 8259146 - DNA, 22 bp, Homo sapiens
ccagctcctcttgtctctagca

SEQ ID NO: 8259147 - DNA, 22 bp, Homo sapiens
ccagctccaggactgggagctg

SEQ ID NO: 8259148 - DNA, 21 bp, Homo sapiens
ccagctccaggaccttggatc

SEQ ID NO: 8259149 - DNA, 22 bp, Homo sapiens
ccagctccagcatagccaccat

SEQ ID NO: 8259150 - DNA, 22 bp, Homo sapiens
ccagctccactgtcagatgaga

SEQ ID NO: 8259151 - DNA, 22 bp, Homo sapiens
ccagctccaagtttgggcatca

SEQ ID NO: 8259152 - DNA, 20 bp, Homo sapiens
ccacagaggacagggctgtg

SEQ ID NO: 8259153 - DNA, 22 bp, Homo sapiens
ccacagccattccagggaggct

SEQ ID NO: 8259154 - DNA, 17 bp, Homo sapiens
ccacagcctggcacttg

SEQ ID NO: 8259155 - DNA, 22 bp, Homo sapiens
tcctcccaacttttccatctca

SEQ ID NO: 8259156 - DNA, 22 bp, Homo sapiens
tcctcccacataggacaatggg

SEQ ID NO: 8259157 - DNA, 22 bp, Homo sapiens
tccctgcctgacagcacccacc

SEQ ID NO: 8259158 - DNA, 22 bp, Homo sapiens
catttgctgtaatgacaataag

SEQ ID NO: 8259159 - DNA, 22 bp, Homo sapiens
ccacagtctagctagaaggcat

SEQ ID NO: 8259160 - DNA, 22 bp, Homo sapiens
ccagaggtgctctttggaagtg

SEQ ID NO: 8259161 - DNA, 19 bp, Homo sapiens
caggccctggacccatctg

SEQ ID NO: 8259162 - DNA, 18 bp, Homo sapiens
caggccctgtctggcctc

SEQ ID NO: 8259163 - DNA, 22 bp, Homo sapiens
caggccggccggccccagctct

SEQ ID NO: 8259164 - DNA, 22 bp, Homo sapiens
caggccctggcagggctgagtc

SEQ ID NO: 8259165 - DNA, 22 bp, Homo sapiens
caggccctggcagggctgagtc

SEQ ID NO: 8259166 - DNA, 19 bp, Homo sapiens
tacaagcttttttggcagg

SEQ ID NO: 8259167 - DNA, 22 bp, Homo sapiens
caggcagagaggagcatttaat

SEQ ID NO: 8259168 - DNA, 17 bp, Homo sapiens
caggcagacatgtaagc

SEQ ID NO: 8259169 - DNA, 22 bp, Homo sapiens
taattgtacgatgttaaatcag

SEQ ID NO: 8259170 - DNA, 22 bp, Homo sapiens
taattgtaaagtagtagtacag

SEQ ID NO: 8259171 - DNA, 22 bp, Homo sapiens
taattgtatggagaaggctgca

SEQ ID NO: 8259172 - DNA, 22 bp, Homo sapiens
taattgtactccctgtgggaaa

SEQ ID NO: 8259173 - DNA, 22 bp, Homo sapiens
taattgtagctttgtaatcagc

SEQ ID NO: 8259174 - DNA, 22 bp, Homo sapiens
caggcagcaggagccctgctcg

SEQ ID NO: 8259175 - DNA, 22 bp, Homo sapiens
caggcaggagccagggattcca

SEQ ID NO: 8259176 - DNA, 22 bp, Homo sapiens
caggcagctgctgggttcagcc

SEQ ID NO: 8259177 - DNA, 20 bp, Homo sapiens
taacacttgctttttgactt

SEQ ID NO: 8259178 - DNA, 22 bp, Homo sapiens
taactttaggaataggtaatct

SEQ ID NO: 8259179 - DNA, 22 bp, Homo sapiens
taactttagtgtatgaggtaag

SEQ ID NO: 8259180 - DNA, 21 bp, Homo sapiens
taacttttgtgcctatcttgt

SEQ ID NO: 8259181 - DNA, 22 bp, Homo sapiens
caggatggtggcatgatcagaa

SEQ ID NO: 8259182 - DNA, 22 bp, Homo sapiens
caggatgccatctgctgctgct

SEQ ID NO: 8259183 - DNA, 21 bp, Homo sapiens
caggatgatgggaaggtggtg

SEQ ID NO: 8259184 - DNA, 22 bp, Homo sapiens
caggcaagttcatttccaggca

SEQ ID NO: 8259185 - DNA, 22 bp, Homo sapiens
caggcaaggaggcactgaggga

SEQ ID NO: 8259186 - DNA, 22 bp, Homo sapiens
caggcaagcacggtgaacctgg

SEQ ID NO: 8259187 - DNA, 22 bp, Homo sapiens
caggcaagatccagaggctgct

SEQ ID NO: 8259188 - DNA, 22 bp, Homo sapiens
caggatggtgtgagtgtgagga

SEQ ID NO: 8259189 - DNA, 22 bp, Homo sapiens
taagacacaaatatcttttaca

SEQ ID NO: 8259190 - DNA, 19 bp, Homo sapiens
taagacacaaatgcaagcc

SEQ ID NO: 8259191 - DNA, 22 bp, Homo sapiens
taagacacgggctgatctaaag

SEQ ID NO: 8259192 - DNA, 22 bp, Homo sapiens
taagacacctctctgcccttca

SEQ ID NO: 8259193 - DNA, 23 bp, Homo sapiens
taagacacccgactccagagatg

SEQ ID NO: 8259194 - DNA, 22 bp, Homo sapiens
taagacacagtccgcactctct

SEQ ID NO: 8259195 - DNA, 22 bp, Homo sapiens
taagacacattcatatctgtct

SEQ ID NO: 8259196 - DNA, 22 bp, Homo sapiens
taagacacatgcgtacaagata

SEQ ID NO: 8259197 - DNA, 22 bp, Homo sapiens
taagacacattggagtagatga

SEQ ID NO: 8259198 - DNA, 22 bp, Homo sapiens
taagacacattgagaaacacaa

SEQ ID NO: 8259199 - DNA, 22 bp, Homo sapiens
caggaaggaaagggtgtggaga

SEQ ID NO: 8259200 - DNA, 22 bp, Homo sapiens
caggaatgaaaggtcagggttg

SEQ ID NO: 8259201 - DNA, 22 bp, Homo sapiens
caggaagtgtgagggtggtgta

SEQ ID NO: 8259202 - DNA, 22 bp, Homo sapiens
gtttggagccccgtgggaagga

SEQ ID NO: 8259203 - DNA, 22 bp, Homo sapiens
caggacaggccctgtggggtct

SEQ ID NO: 8259204 - DNA, 22 bp, Homo sapiens
caggacaggagtggggtcaaag

SEQ ID NO: 8259205 - DNA, 22 bp, Homo sapiens
caggacagctcaacacctcctc

SEQ ID NO: 8259206 - DNA, 22 bp, Homo sapiens
caggacccatcagccaggcact

SEQ ID NO: 8259207 - DNA, 19 bp, Homo sapiens
caggacagtttgccaagaa

SEQ ID NO: 8259208 - DNA, 22 bp, Homo sapiens
caggagaaggtttggagtgcag

SEQ ID NO: 8259209 - DNA, 22 bp, Homo sapiens
caggagaagtctctagggggtg

SEQ ID NO: 8259210 - DNA, 22 bp, Homo sapiens
caggagacaatggctgtggggc

SEQ ID NO: 8259211 - DNA, 22 bp, Homo sapiens
taaaaatcttatgaatggcaag

SEQ ID NO: 8259212 - DNA, 22 bp, Homo sapiens
caggaggaacaagaggttctgg

SEQ ID NO: 8259213 - DNA, 22 bp, Homo sapiens
caggaggaagaactctgcaaca

SEQ ID NO: 8259214 - DNA, 22 bp, Homo sapiens
caggaggaaatgtgaccctgct

SEQ ID NO: 8259215 - DNA, 22 bp, Homo sapiens
caggaggcagcgctctcaggac

SEQ ID NO: 8259216 - DNA, 22 bp, Homo sapiens
caggaggcagtttcagaagtca

SEQ ID NO: 8259217 - DNA, 22 bp, Homo sapiens
caggaggccaactgtgggactt

SEQ ID NO: 8259218 - DNA, 22 bp, Homo sapiens
caggaggcatcatggagcggac

SEQ ID NO: 8259219 - DNA, 22 bp, Homo sapiens
caggaggcgtcttcagtttgtt

SEQ ID NO: 8259220 - DNA, 23 bp, Homo sapiens
caggagggaatgaagttagacaa

SEQ ID NO: 8259221 - DNA, 22 bp, Homo sapiens
caggagtgaaatgaggcccagg

SEQ ID NO: 8259222 - DNA, 22 bp, Homo sapiens
caggagtgcaggtggtgaggca

SEQ ID NO: 8259223 - DNA, 22 bp, Homo sapiens
taaatcaagaatatcagcttgt

SEQ ID NO: 8259224 - DNA, 22 bp, Homo sapiens
caggagccctggtgggtggaca

SEQ ID NO: 8259225 - DNA, 22 bp, Homo sapiens
caggagcccgttgctccggcgg

SEQ ID NO: 8259226 - DNA, 22 bp, Homo sapiens
caggagccccaggctgacaata

SEQ ID NO: 8259227 - DNA, 22 bp, Homo sapiens
taaagcagtgtggttgtgtccc

SEQ ID NO: 8259228 - DNA, 22 bp, Homo sapiens
taaagcagtgttgggtcggacg

SEQ ID NO: 8259229 - DNA, 22 bp, Homo sapiens
caggagatgtacctgtttttga

SEQ ID NO: 8259230 - DNA, 22 bp, Homo sapiens
caggagataaaagagatgcttt

SEQ ID NO: 8259231 - DNA, 22 bp, Homo sapiens
caggagatcttaggaattctta

SEQ ID NO: 8259232 - DNA, 22 bp, Homo sapiens
gtgtatgttctacttaatatta

SEQ ID NO: 8259233 - DNA, 22 bp, Homo sapiens
gtggtaggcacagagaacaaga

SEQ ID NO: 8259234 - DNA, 22 bp, Homo sapiens
cagctgtctttgcacagtttag

SEQ ID NO: 8259235 - DNA, 22 bp, Homo sapiens
cagctgtctggggagtgctcgc

SEQ ID NO: 8259236 - DNA, 22 bp, Homo sapiens
cagctgtctcagggaggtgatc

SEQ ID NO: 8259237 - DNA, 22 bp, Homo sapiens
cagctgtctgaagcaggagtcc

SEQ ID NO: 8259238 - DNA, 22 bp, Homo sapiens
cagctgtctaagttgagcagga

SEQ ID NO: 8259239 - DNA, 22 bp, Homo sapiens
cagctggggcagccacgtgcgg

SEQ ID NO: 8259240 - DNA, 22 bp, Homo sapiens
gtgtggccgtgtatccatggct

SEQ ID NO: 8259241 - DNA, 19 bp, Homo sapiens
gtgtggcagagagtgacca

SEQ ID NO: 8259242 - DNA, 22 bp, Homo sapiens
cagctggcctgagcggtggcgg

SEQ ID NO: 8259243 - DNA, 22 bp, Homo sapiens
cagctgcctgtattgtcctcat

SEQ ID NO: 8259244 - DNA, 22 bp, Homo sapiens
cagctgcctgtattgtcctcat

SEQ ID NO: 8259245 - DNA, 22 bp, Homo sapiens
cagctgcctgtctggaggcaat

SEQ ID NO: 8259246 - DNA, 19 bp, Homo sapiens
cagctgccttttctttgca

SEQ ID NO: 8259247 - DNA, 22 bp, Homo sapiens
cagctgccctgccttgccctta

SEQ ID NO: 8259248 - DNA, 22 bp, Homo sapiens
cagctgcctatgacctagcctc

SEQ ID NO: 8259249 - DNA, 20 bp, Homo sapiens
cagctgcctggctctgggat

SEQ ID NO: 8259250 - DNA, 18 bp, Homo sapiens
cagctgcaggctcaggac

SEQ ID NO: 8259251 - DNA, 22 bp, Homo sapiens
gtggggagggagatgctgaagt

SEQ ID NO: 8259252 - DNA, 22 bp, Homo sapiens
gtggggctgcttaggctgcgca

SEQ ID NO: 8259253 - DNA, 22 bp, Homo sapiens
gtggagccctgccttgctcatg

SEQ ID NO: 8259254 - DNA, 22 bp, Homo sapiens
gtggagccaggggctgtaggta

SEQ ID NO: 8259255 - DNA, 22 bp, Homo sapiens
cagcccaggactgcaggtgttt

SEQ ID NO: 8259256 - DNA, 22 bp, Homo sapiens
cagcccaggccgacagttcctc

SEQ ID NO: 8259257 - DNA, 21 bp, Homo sapiens
cagcccagcttcttccccagt

SEQ ID NO: 8259258 - DNA, 22 bp, Homo sapiens
gtggcagagaacaaggagaggt

SEQ ID NO: 8259259 - DNA, 22 bp, Homo sapiens
gtggcagaaactggcagaggag

SEQ ID NO: 8259260 - DNA, 22 bp, Homo sapiens
gtggcagagccaaggctggagc

SEQ ID NO: 8259261 - DNA, 22 bp, Homo sapiens
gtggccagtgggaatgggctca

SEQ ID NO: 8259262 - DNA, 22 bp, Homo sapiens
gtggccagtcccgatgcttgtt

SEQ ID NO: 8259263 - DNA, 22 bp, Homo sapiens
gtggccaggccgactgccaggc

SEQ ID NO: 8259264 - DNA, 22 bp, Homo sapiens
cagctctgctggtggtgccagg

SEQ ID NO: 8259265 - DNA, 22 bp, Homo sapiens
cagctctgcttccttgtacagg

SEQ ID NO: 8259266 - DNA, 22 bp, Homo sapiens
cagctctggccagatctatcct

SEQ ID NO: 8259267 - DNA, 22 bp, Homo sapiens
cagctctggcagagcccaaccc

SEQ ID NO: 8259268 - DNA, 22 bp, Homo sapiens
cagctctggcagagcccaaccc

SEQ ID NO: 8259269 - DNA, 22 bp, Homo sapiens
cagctctggcgtcagggagcga

SEQ ID NO: 8259270 - DNA, 22 bp, Homo sapiens
cagctctggctattgaggacca

SEQ ID NO: 8259271 - DNA, 22 bp, Homo sapiens
cagctctggctttggggagctt

SEQ ID NO: 8259272 - DNA, 22 bp, Homo sapiens
cagctctgggagtcccacccct

SEQ ID NO: 8259273 - DNA, 20 bp, Homo sapiens
cagctctgggaaagaggcca

SEQ ID NO: 8259274 - DNA, 22 bp, Homo sapiens
cagctctgggagtcccacccct

SEQ ID NO: 8259275 - DNA, 22 bp, Homo sapiens
cagctctgtctgtagaaacttc

SEQ ID NO: 8259276 - DNA, 22 bp, Homo sapiens
cagctctgtgcaggcctgggga

SEQ ID NO: 8259277 - DNA, 22 bp, Homo sapiens
cagctctgtgggagcgtatgtg

SEQ ID NO: 8259278 - DNA, 22 bp, Homo sapiens
cagctctgtgtattttccccac

SEQ ID NO: 8259279 - DNA, 22 bp, Homo sapiens
gtggccttgctcacatgtccag

SEQ ID NO: 8259280 - DNA, 22 bp, Homo sapiens
gtgggcagtggggtcttctgcc

SEQ ID NO: 8259281 - DNA, 22 bp, Homo sapiens
gtgggcaggtaggcaccagcta

SEQ ID NO: 8259282 - DNA, 22 bp, Homo sapiens
gtgggacagctggagggtccct

SEQ ID NO: 8259283 - DNA, 22 bp, Homo sapiens
gtgggacagcggggtgggacag

SEQ ID NO: 8259284 - DNA, 22 bp, Homo sapiens
gtggcctgtcagaagccgtggg

SEQ ID NO: 8259285 - DNA, 22 bp, Homo sapiens
cagctctgttgccaaagtgggc

SEQ ID NO: 8259286 - DNA, 22 bp, Homo sapiens
cagctctgttgccctggaaacg

SEQ ID NO: 8259287 - DNA, 22 bp, Homo sapiens
cagctctgttcaaactatccag

SEQ ID NO: 8259288 - DNA, 22 bp, Homo sapiens
cagctctgttcatagatggtgc

SEQ ID NO: 8259289 - DNA, 22 bp, Homo sapiens
gttcacagaaggccagatggta

SEQ ID NO: 8259290 - DNA, 22 bp, Homo sapiens
cagctttagagaaaacatattt

SEQ ID NO: 8259291 - DNA, 17 bp, Homo sapiens
cagctttatgctactgt

SEQ ID NO: 8259292 - DNA, 22 bp, Homo sapiens
cagctttaggactcataataaa

SEQ ID NO: 8259293 - DNA, 20 bp, Homo sapiens
cagcttggatgagaggctga

SEQ ID NO: 8259294 - DNA, 22 bp, Homo sapiens
cagcttgctaactggtaggggt

SEQ ID NO: 8259295 - DNA, 22 bp, Homo sapiens
cagctgtgtaaacacatgtgta

SEQ ID NO: 8259296 - DNA, 22 bp, Homo sapiens
cagctgtggctgccactgctcc

SEQ ID NO: 8259297 - DNA, 22 bp, Homo sapiens
gtgttttggccattagtgtgat

SEQ ID NO: 8259298 - DNA, 23 bp, Homo sapiens
gtgtgtggaaagtgcatgggcct

SEQ ID NO: 8259299 - DNA, 22 bp, Homo sapiens
tgtggggctgtcaggcaactgg

SEQ ID NO: 8259300 - DNA, 22 bp, Homo sapiens
tgtggggcagctagccggcctg

SEQ ID NO: 8259301 - DNA, 22 bp, Homo sapiens
tgtggggctccctggcagcctg

SEQ ID NO: 8259302 - DNA, 22 bp, Homo sapiens
cctgggtgatgtgctgccctcg

SEQ ID NO: 8259303 - DNA, 22 bp, Homo sapiens
cctgggcttccacgagcagagg

SEQ ID NO: 8259304 - DNA, 22 bp, Homo sapiens
cctggggaatcttgcaggggaa

SEQ ID NO: 8259305 - DNA, 22 bp, Homo sapiens
tgtgtgtatatgcatttatcta

SEQ ID NO: 8259306 - DNA, 22 bp, Homo sapiens
cctggctgtggcggtgctctca

SEQ ID NO: 8259307 - DNA, 22 bp, Homo sapiens
tgtgctgggagatagagggagg

SEQ ID NO: 8259308 - DNA, 22 bp, Homo sapiens
tgtgctgggaaatggcaggata

SEQ ID NO: 8259309 - DNA, 22 bp, Homo sapiens
tgtgaagaattaatgtgaatca

SEQ ID NO: 8259310 - DNA, 22 bp, Homo sapiens
tgtgagcagctctgtggactca

SEQ ID NO: 8259311 - DNA, 22 bp, Homo sapiens
tgtctttagttgcttagatttg

SEQ ID NO: 8259312 - DNA, 22 bp, Homo sapiens
tgtctgtctttagtgagattgc

SEQ ID NO: 8259313 - DNA, 22 bp, Homo sapiens
tgtctgtcagatattaagtttc

SEQ ID NO: 8259314 - DNA, 17 bp, Homo sapiens
tgtctgtcatcagttcc

SEQ ID NO: 8259315 - DNA, 23 bp, Homo sapiens
cctggcagcaaacgaggaggtta

SEQ ID NO: 8259316 - DNA, 22 bp, Homo sapiens
cctggctctctgcagatcctgg

SEQ ID NO: 8259317 - DNA, 22 bp, Homo sapiens
cctggctcctgcacagatcttt

SEQ ID NO: 8259318 - DNA, 22 bp, Homo sapiens
cctggctcctgcctctgcaggg

SEQ ID NO: 8259319 - DNA, 22 bp, Homo sapiens
tgtctcagaatggctcataata

SEQ ID NO: 8259320 - DNA, 22 bp, Homo sapiens
tgtctcagatacgccatcaagg

SEQ ID NO: 8259321 - DNA, 18 bp, Homo sapiens
tgtctcaggctgaaacag

SEQ ID NO: 8259322 - DNA, 19 bp, Homo sapiens
tgtctcagtgtcccttcct

SEQ ID NO: 8259323 - DNA, 22 bp, Homo sapiens
cctggcacatgatagatgctca

SEQ ID NO: 8259324 - DNA, 22 bp, Homo sapiens
cctggcagaaagagttacacct

SEQ ID NO: 8259325 - DNA, 22 bp, Homo sapiens
tgtattcagggacatatatgta

SEQ ID NO: 8259326 - DNA, 22 bp, Homo sapiens
tgtattatgattgttgttcatg

SEQ ID NO: 8259327 - DNA, 22 bp, Homo sapiens
tgtattcaacttcttaaaaatt

SEQ ID NO: 8259328 - DNA, 22 bp, Homo sapiens
tgtattacaaagaagaggctgg

SEQ ID NO: 8259329 - DNA, 22 bp, Homo sapiens
tgtagtccaggaattgtgtctg

SEQ ID NO: 8259330 - DNA, 22 bp, Homo sapiens
cctggagattatttggtccaat

SEQ ID NO: 8259331 - DNA, 23 bp, Homo sapiens
tgtaccaggagtttcagcagact

SEQ ID NO: 8259332 - DNA, 22 bp, Homo sapiens
tgtagggacttggcgatcactt

SEQ ID NO: 8259333 - DNA, 22 bp, Homo sapiens
tgtagggagaagagaggcacct

SEQ ID NO: 8259334 - DNA, 22 bp, Homo sapiens
tgtagggagagggagttgcacc

SEQ ID NO: 8259335 - DNA, 22 bp, Homo sapiens
tgtaggagtccaatcaggagac

SEQ ID NO: 8259336 - DNA, 21 bp, Homo sapiens
cctggagacaaagacagggtg

SEQ ID NO: 8259337 - DNA, 22 bp, Homo sapiens
tggtgggacatctgaggagagg

SEQ ID NO: 8259338 - DNA, 22 bp, Homo sapiens
cctggagacgaggctggaccat

SEQ ID NO: 8259339 - DNA, 22 bp, Homo sapiens
cctggagacctgatggcagcgg

SEQ ID NO: 8259340 - DNA, 22 bp, Homo sapiens
tggtggctaccaggtcctgggg

SEQ ID NO: 8259341 - DNA, 22 bp, Homo sapiens
tggtggctgctccctgccttga

SEQ ID NO: 8259342 - DNA, 17 bp, Homo sapiens
tggtggctggagtcagg

SEQ ID NO: 8259343 - DNA, 22 bp, Homo sapiens
tggtggctgttgcagaactgag

SEQ ID NO: 8259344 - DNA, 22 bp, Homo sapiens
tggtgctgtggaggggcagaag

SEQ ID NO: 8259345 - DNA, 22 bp, Homo sapiens
tggtgctgataatggcaggatt

SEQ ID NO: 8259346 - DNA, 17 bp, Homo sapiens
cctgcccagagacagat

SEQ ID NO: 8259347 - DNA, 22 bp, Homo sapiens
cctgccatcagaaacactcaaa

SEQ ID NO: 8259348 - DNA, 22 bp, Homo sapiens
tggtccagtttagcattgagtg

SEQ ID NO: 8259349 - DNA, 22 bp, Homo sapiens
tggtagggacactatgcagaaa

SEQ ID NO: 8259350 - DNA, 22 bp, Homo sapiens
tggtccagtaagggtggagaga

SEQ ID NO: 8259351 - DNA, 22 bp, Homo sapiens
tgctcccacactactcggaggc

SEQ ID NO: 8259352 - DNA, 22 bp, Homo sapiens
tgctgaataataagattactca

SEQ ID NO: 8259353 - DNA, 22 bp, Homo sapiens
tgctggagagccttggccaagg

SEQ ID NO: 8259354 - DNA, 22 bp, Homo sapiens
tgctggagaggaaggtggggtc

SEQ ID NO: 8259355 - DNA, 22 bp, Homo sapiens
tgctggagatgaaagggccctg

SEQ ID NO: 8259356 - DNA, 22 bp, Homo sapiens
tgctggagcatctgagagcatc

SEQ ID NO: 8259357 - DNA, 22 bp, Homo sapiens
tgctggagacatagcaggcagc

SEQ ID NO: 8259358 - DNA, 22 bp, Homo sapiens
ccccagcaggaatacaggggtc

SEQ ID NO: 8259359 - DNA, 18 bp, Homo sapiens
ccccagcagtgtggtgcc

SEQ ID NO: 8259360 - DNA, 22 bp, Homo sapiens
ccccagcatatcatggtttcgt

SEQ ID NO: 8259361 - DNA, 22 bp, Homo sapiens
ccccagcagcacctggggcagt

SEQ ID NO: 8259362 - DNA, 22 bp, Homo sapiens
ccccagccagcaggacctctga

SEQ ID NO: 8259363 - DNA, 22 bp, Homo sapiens
ccccagccagcttgtagtagaa

SEQ ID NO: 8259364 - DNA, 16 bp, Homo sapiens
cccctcaggaagtaca

SEQ ID NO: 8259365 - DNA, 22 bp, Homo sapiens
cccctcaggtacccgtgcagca

SEQ ID NO: 8259366 - DNA, 22 bp, Homo sapiens
cccccagctctgctgggtcccg

SEQ ID NO: 8259367 - DNA, 22 bp, Homo sapiens
cccccagccagcagtgctcagc

SEQ ID NO: 8259368 - DNA, 18 bp, Homo sapiens
cccccagccaaattctct

SEQ ID NO: 8259369 - DNA, 22 bp, Homo sapiens
ccctcagcttctccctgcagct

SEQ ID NO: 8259370 - DNA, 22 bp, Homo sapiens
cccctccctgacctggttgggc

SEQ ID NO: 8259371 - DNA, 19 bp, Homo sapiens
cccagctgttcttccacca

SEQ ID NO: 8259372 - DNA, 22 bp, Homo sapiens
tgcatgtttctgtatgttaatg

SEQ ID NO: 8259373 - DNA, 22 bp, Homo sapiens
cccagctgatttttgcagagat

SEQ ID NO: 8259374 - DNA, 23 bp, Homo sapiens
cccagctgagacttcctgaactc

SEQ ID NO: 8259375 - DNA, 22 bp, Homo sapiens
cccagctgtaacgggtctgcac

SEQ ID NO: 8259376 - DNA, 22 bp, Homo sapiens
cccagctgcacctctatggcct

SEQ ID NO: 8259377 - DNA, 23 bp, Homo sapiens
cccagctgcagacaagggagggt

SEQ ID NO: 8259378 - DNA, 23 bp, Homo sapiens
cccagctggaagttagaggacca

SEQ ID NO: 8259379 - DNA, 17 bp, Homo sapiens
cccagctgcgtctgagg

SEQ ID NO: 8259380 - DNA, 23 bp, Homo sapiens
cccagcgctgagccctgcaggca

SEQ ID NO: 8259381 - DNA, 22 bp, Homo sapiens
tgcagggacaggctctggggat

SEQ ID NO: 8259382 - DNA, 22 bp, Homo sapiens
cccaggcagccccagaagcttg

SEQ ID NO: 8259383 - DNA, 22 bp, Homo sapiens
cccaggcagcctgcagggaagg

SEQ ID NO: 8259384 - DNA, 22 bp, Homo sapiens
cccaggagggtggcctctgccc

SEQ ID NO: 8259385 - DNA, 22 bp, Homo sapiens
cccaggaggtgtgcccaactcg

SEQ ID NO: 8259386 - DNA, 22 bp, Homo sapiens
cctctctgtcacaccagtggcc

SEQ ID NO: 8259387 - DNA, 22 bp, Homo sapiens
cctctgggtgacagactcttgg

SEQ ID NO: 8259388 - DNA, 22 bp, Homo sapiens
cctctgggtatctgtggaagta

SEQ ID NO: 8259389 - DNA, 22 bp, Homo sapiens
cctctgtgcaggaaatacatgt

SEQ ID NO: 8259390 - DNA, 22 bp, Homo sapiens
cctctggtatttgcacagatat

SEQ ID NO: 8259391 - DNA, 22 bp, Homo sapiens
cctctgagaccagctctgcacc

SEQ ID NO: 8259392 - DNA, 22 bp, Homo sapiens
cctctgagagaaggccttcagc

SEQ ID NO: 8259393 - DNA, 22 bp, Homo sapiens
cctctgagccacatgcgtttgt

SEQ ID NO: 8259394 - DNA, 22 bp, Homo sapiens
cctctgagctggcctgtggggc

SEQ ID NO: 8259395 - DNA, 22 bp, Homo sapiens
cctctgaggtgagcccagctgg

SEQ ID NO: 8259396 - DNA, 22 bp, Homo sapiens
cctctgaggtgagcccagctgg

SEQ ID NO: 8259397 - DNA, 20 bp, Homo sapiens
tggcccagtggggcagggtg

SEQ ID NO: 8259398 - DNA, 22 bp, Homo sapiens
tggcccagtgcttatgctctga

SEQ ID NO: 8259399 - DNA, 22 bp, Homo sapiens
tggcccagcagttctgccccag

SEQ ID NO: 8259400 - DNA, 22 bp, Homo sapiens
cctccctgtctacctgttgtgg

SEQ ID NO: 8259401 - DNA, 22 bp, Homo sapiens
cctcggctgcccagcccagctg

SEQ ID NO: 8259402 - DNA, 22 bp, Homo sapiens
tggatctatctccaggggtcct

SEQ ID NO: 8259403 - DNA, 22 bp, Homo sapiens
tggatctaaatgggcagtgctg

SEQ ID NO: 8259404 - DNA, 22 bp, Homo sapiens
tggatctgtcccaaggctaggc

SEQ ID NO: 8259405 - DNA, 22 bp, Homo sapiens
tggatctgacaaggacgggaaa

SEQ ID NO: 8259406 - DNA, 22 bp, Homo sapiens
tggatctgattaggggagccag

SEQ ID NO: 8259407 - DNA, 22 bp, Homo sapiens
tggatgagaaactctggtgact

SEQ ID NO: 8259408 - DNA, 22 bp, Homo sapiens
tggatgagattaaagtgaggtt

SEQ ID NO: 8259409 - DNA, 22 bp, Homo sapiens
tggatgaggctgggttaggcag

SEQ ID NO: 8259410 - DNA, 22 bp, Homo sapiens
tggatgagtctgagattgggca

SEQ ID NO: 8259411 - DNA, 22 bp, Homo sapiens
tggatgagttcaatgaggcaga

SEQ ID NO: 8259412 - DNA, 22 bp, Homo sapiens
ccctggcaaaacactctcttga

SEQ ID NO: 8259413 - DNA, 22 bp, Homo sapiens
ccctccagggagccatgctggg

SEQ ID NO: 8259414 - DNA, 22 bp, Homo sapiens
tggcagaggtatattgggagga

SEQ ID NO: 8259415 - DNA, 22 bp, Homo sapiens
tggcaagtggcatagaatagcc

SEQ ID NO: 8259416 - DNA, 22 bp, Homo sapiens
tggcaagtggcaccggctgtgg

SEQ ID NO: 8259417 - DNA, 15 bp, Homo sapiens
tggcaagtgctagta

SEQ ID NO: 8259418 - DNA, 22 bp, Homo sapiens
tggcaagttaaaatgtggtctt

SEQ ID NO: 8259419 - DNA, 22 bp, Homo sapiens
tggcaagtggcttgtatacgcc

SEQ ID NO: 8259420 - DNA, 22 bp, Homo sapiens
tggcaagtcttgcaggcagagg

SEQ ID NO: 8259421 - DNA, 23 bp, Homo sapiens
tggcaagtcatttctagtaacct

SEQ ID NO: 8259422 - DNA, 18 bp, Homo sapiens
tggcaagtaatgacaaaa

SEQ ID NO: 8259423 - DNA, 22 bp, Homo sapiens
tggcaagttcatatggtttaag

SEQ ID NO: 8259424 - DNA, 22 bp, Homo sapiens
ctggccctgtggaggcaggaac

SEQ ID NO: 8259425 - DNA, 22 bp, Homo sapiens
ctggcccttaggaaaacaaagt

SEQ ID NO: 8259426 - DNA, 22 bp, Homo sapiens
ctggccctgtggcctaaggact

SEQ ID NO: 8259427 - DNA, 22 bp, Homo sapiens
ctggccctgtggcctaaggact

SEQ ID NO: 8259428 - DNA, 22 bp, Homo sapiens
ctggcctgagaatgctaccctt

SEQ ID NO: 8259429 - DNA, 22 bp, Homo sapiens
ctggcccagagctctggccttt

SEQ ID NO: 8259430 - DNA, 22 bp, Homo sapiens
ctggcccaggagagcaggcatt

SEQ ID NO: 8259431 - DNA, 21 bp, Homo sapiens
ctggcccagggatctgcattt

SEQ ID NO: 8259432 - DNA, 22 bp, Homo sapiens
ctggcccagagagcagagctta

SEQ ID NO: 8259433 - DNA, 22 bp, Homo sapiens
ctggcagatagccacgcctgtc

SEQ ID NO: 8259434 - DNA, 22 bp, Homo sapiens
ctggcagcagcttctggatcga

SEQ ID NO: 8259435 - DNA, 22 bp, Homo sapiens
ctggatgtttatgaaggaccca

SEQ ID NO: 8259436 - DNA, 22 bp, Homo sapiens
ctggatggtcccatgagcagct

SEQ ID NO: 8259437 - DNA, 22 bp, Homo sapiens
ctggatccatcgggtcccgagt

SEQ ID NO: 8259438 - DNA, 22 bp, Homo sapiens
ctggcagcattaacagagagca

SEQ ID NO: 8259439 - DNA, 22 bp, Homo sapiens
ctggaggagaacttgaggaagg

SEQ ID NO: 8259440 - DNA, 22 bp, Homo sapiens
ctggaggcaaagcagaggcatg

SEQ ID NO: 8259441 - DNA, 22 bp, Homo sapiens
ctggaggaccacagaagctggt

SEQ ID NO: 8259442 - DNA, 23 bp, Homo sapiens
ctggactcaggggatgtgaagga

SEQ ID NO: 8259443 - DNA, 22 bp, Homo sapiens
ctggacatcagtgtgcctggct

SEQ ID NO: 8259444 - DNA, 22 bp, Homo sapiens
ctggacagtgggcagaggagac

SEQ ID NO: 8259445 - DNA, 22 bp, Homo sapiens
ctggagttcttgttttgcctac

SEQ ID NO: 8259446 - DNA, 22 bp, Homo sapiens
ctggagttctatgtgcttgtga

SEQ ID NO: 8259447 - DNA, 22 bp, Homo sapiens
ctggagttcgactgagttgaat

SEQ ID NO: 8259448 - DNA, 22 bp, Homo sapiens
ctggagttagagtagacactga

SEQ ID NO: 8259449 - DNA, 22 bp, Homo sapiens
ctggagttcagtggcgtgaaca

SEQ ID NO: 8259450 - DNA, 22 bp, Homo sapiens
ctggagttgggatgtgcctgga

SEQ ID NO: 8259451 - DNA, 22 bp, Homo sapiens
ctggagtttgcggggacagaga

SEQ ID NO: 8259452 - DNA, 22 bp, Homo sapiens
ctggagttttggaaaaatgctt

SEQ ID NO: 8259453 - DNA, 22 bp, Homo sapiens
ctggagtttgtggcttgctcaa

SEQ ID NO: 8259454 - DNA, 22 bp, Homo sapiens
ctggagtttttggccataacgt

SEQ ID NO: 8259455 - DNA, 22 bp, Homo sapiens
ctggaggtgggggcaagagtgt

SEQ ID NO: 8259456 - DNA, 22 bp, Homo sapiens
ctggaggggccatccacagtct

SEQ ID NO: 8259457 - DNA, 22 bp, Homo sapiens
ctggagggctggactaaggaaa

SEQ ID NO: 8259458 - DNA, 22 bp, Homo sapiens
ctggagggtggagagaagtctc

SEQ ID NO: 8259459 - DNA, 21 bp, Homo sapiens
ctggagggtagagttgggctg

SEQ ID NO: 8259460 - DNA, 22 bp, Homo sapiens
ctgcctggcatggagaagagaa

SEQ ID NO: 8259461 - DNA, 22 bp, Homo sapiens
ctgcctggatgaatggcgcctt

SEQ ID NO: 8259462 - DNA, 22 bp, Homo sapiens
ctgcctggaatgccagcttctc

SEQ ID NO: 8259463 - DNA, 22 bp, Homo sapiens
ctgcctggaccggcagccctcc

SEQ ID NO: 8259464 - DNA, 22 bp, Homo sapiens
ctgattaggctaagcaagaggg

SEQ ID NO: 8259465 - DNA, 22 bp, Homo sapiens
ctgattagagtgttaatgagga

SEQ ID NO: 8259466 - DNA, 22 bp, Homo sapiens
ctgatgcctctcttcttggctt

SEQ ID NO: 8259467 - DNA, 22 bp, Homo sapiens
ctgatccctccatagggcacag

SEQ ID NO: 8259468 - DNA, 22 bp, Homo sapiens
ctgatcccctggaaagttgaat

SEQ ID NO: 8259469 - DNA, 22 bp, Homo sapiens
ctgaggagtttgggttgttcaa

SEQ ID NO: 8259470 - DNA, 22 bp, Homo sapiens
ctgaggagttggtgaataagcc

SEQ ID NO: 8259471 - DNA, 22 bp, Homo sapiens
ctgaggagtcagttccactcag

SEQ ID NO: 8259472 - DNA, 22 bp, Homo sapiens
ctgaggaggggcctgagtgaga

SEQ ID NO: 8259473 - DNA, 22 bp, Homo sapiens
ctgaggagtgggtgggcagtga

SEQ ID NO: 8259474 - DNA, 22 bp, Homo sapiens
ctgagagaatcatgctgcaggt

SEQ ID NO: 8259475 - DNA, 22 bp, Homo sapiens
ctgaggagggaagtccccaaag

SEQ ID NO: 8259476 - DNA, 22 bp, Homo sapiens
ctgaggaggctaatttgaggat

SEQ ID NO: 8259477 - DNA, 22 bp, Homo sapiens
ctgaggagaaagatggtccaag

SEQ ID NO: 8259478 - DNA, 22 bp, Homo sapiens
ctgaggagaaatgggatggttc

SEQ ID NO: 8259479 - DNA, 22 bp, Homo sapiens
ctgagacacggagaggctgtgt

SEQ ID NO: 8259480 - DNA, 22 bp, Homo sapiens
ctgagagaaacatgactcagga

SEQ ID NO: 8259481 - DNA, 22 bp, Homo sapiens
ctgcctatcaaatggggagggc

SEQ ID NO: 8259482 - DNA, 22 bp, Homo sapiens
ctgccatgtagtctatggggcg

SEQ ID NO: 8259483 - DNA, 17 bp, Homo sapiens
ctgccagtggggaggca

SEQ ID NO: 8259484 - DNA, 22 bp, Homo sapiens
ctagggagcactagctgccttg

SEQ ID NO: 8259485 - DNA, 22 bp, Homo sapiens
ctattcactgtggcagagggag

SEQ ID NO: 8259486 - DNA, 22 bp, Homo sapiens
ctcagcagagaccagggaggaa

SEQ ID NO: 8259487 - DNA, 22 bp, Homo sapiens
ctcagcagcagggaagaggtca

SEQ ID NO: 8259488 - DNA, 17 bp, Homo sapiens
ctcagcagggctcactt

SEQ ID NO: 8259489 - DNA, 22 bp, Homo sapiens
ttgagtttacattgtattagcc

SEQ ID NO: 8259490 - DNA, 22 bp, Homo sapiens
ttgaggagtggcgctggactta

SEQ ID NO: 8259491 - DNA, 21 bp, Homo sapiens
ttgaggagtgagagtgggttt

SEQ ID NO: 8259492 - DNA, 23 bp, Homo sapiens
ttgaggagtgctttttctatcca

SEQ ID NO: 8259493 - DNA, 22 bp, Homo sapiens
ttgaggagaagactttgcttcc

SEQ ID NO: 8259494 - DNA, 22 bp, Homo sapiens
ttgaggagcactagtcaggtat

SEQ ID NO: 8259495 - DNA, 22 bp, Homo sapiens
ttgaggaggtatgactaggtac

SEQ ID NO: 8259496 - DNA, 22 bp, Homo sapiens
ttgaggaggtcctgggtttact

SEQ ID NO: 8259497 - DNA, 22 bp, Homo sapiens
ttgaggagtagaagctttgaat

SEQ ID NO: 8259498 - DNA, 22 bp, Homo sapiens
ttgaggagtacaaagcatgctt

SEQ ID NO: 8259499 - DNA, 22 bp, Homo sapiens
ttgaggagtcaggggcacggaa

SEQ ID NO: 8259500 - DNA, 22 bp, Homo sapiens
ttgaggaggcctttcagggctt

SEQ ID NO: 8259501 - DNA, 22 bp, Homo sapiens
ttgaggagcaggatgggaggct

SEQ ID NO: 8259502 - DNA, 22 bp, Homo sapiens
ttgaggaggaaaagggggtacc

SEQ ID NO: 8259503 - DNA, 22 bp, Homo sapiens
ttgaggaggaactgtgaggcaa

SEQ ID NO: 8259504 - DNA, 22 bp, Homo sapiens
ttgactttatgtcaacttgcct

SEQ ID NO: 8259505 - DNA, 22 bp, Homo sapiens
ttcacagactgcagactttttg

SEQ ID NO: 8259506 - DNA, 22 bp, Homo sapiens
ttcacagaccaggaggctgtga

SEQ ID NO: 8259507 - DNA, 22 bp, Homo sapiens
ttcacagacattgcagactgaa

SEQ ID NO: 8259508 - DNA, 22 bp, Homo sapiens
cgctgggggaacagcgagggtg

SEQ ID NO: 8259509 - DNA, 22 bp, Homo sapiens
ttcattcttatttgtgatctgg

SEQ ID NO: 8259510 - DNA, 22 bp, Homo sapiens
cggctctgtcctcagcactgct

SEQ ID NO: 8259511 - DNA, 22 bp, Homo sapiens
ctaataacatgaactactttct

SEQ ID NO: 8259512 - DNA, 22 bp, Homo sapiens
ctaattgtttgtgttgtcacct

SEQ ID NO: 8259513 - DNA, 22 bp, Homo sapiens
ctaattgtaccagatttctctt

SEQ ID NO: 8259514 - DNA, 20 bp, Homo sapiens
ttggatctaaaatgtgggga

SEQ ID NO: 8259515 - DNA, 22 bp, Homo sapiens
ttggatcttatgaaggtggcat

SEQ ID NO: 8259516 - DNA, 20 bp, Homo sapiens
ttggatcttatgggaggggg

SEQ ID NO: 8259517 - DNA, 22 bp, Homo sapiens
ctcagtgctttggatcctggat

SEQ ID NO: 8259518 - DNA, 22 bp, Homo sapiens
ttgggcagatgtttcctgtgga

SEQ ID NO: 8259519 - DNA, 22 bp, Homo sapiens
ttgggcagaggctgtgcagagg

SEQ ID NO: 8259520 - DNA, 22 bp, Homo sapiens
ttgggcagaggctgtgcagagg

SEQ ID NO: 8259521 - DNA, 22 bp, Homo sapiens
ttgggcagaggccaggaggatg

SEQ ID NO: 8259522 - DNA, 22 bp, Homo sapiens
ttgggcaggatgacaccacttg

SEQ ID NO: 8259523 - DNA, 22 bp, Homo sapiens
ttgggcagcattgcagttccct

SEQ ID NO: 8259524 - DNA, 23 bp, Homo sapiens
ttgggcaggagagtaatgtgatc

SEQ ID NO: 8259525 - DNA, 22 bp, Homo sapiens
ttgggcaggaacagatgcttga

SEQ ID NO: 8259526 - DNA, 22 bp, Homo sapiens
ctccagtgcacccagaggattt

SEQ ID NO: 8259527 - DNA, 22 bp, Homo sapiens
ttgggtaggattcagcagtgtg

SEQ ID NO: 8259528 - DNA, 22 bp, Homo sapiens
ctccagggaggtctgcaggact

SEQ ID NO: 8259529 - DNA, 22 bp, Homo sapiens
ttgtatttgggtagtatagaga

SEQ ID NO: 8259530 - DNA, 22 bp, Homo sapiens
ttgtatttgattgtcatatcgt

SEQ ID NO: 8259531 - DNA, 22 bp, Homo sapiens
ttgtatttctccactttctgtt

SEQ ID NO: 8259532 - DNA, 22 bp, Homo sapiens
ttgtatttcttccggtctcatt

SEQ ID NO: 8259533 - DNA, 22 bp, Homo sapiens
ctcctgagaggatctctgttgt

SEQ ID NO: 8259534 - DNA, 22 bp, Homo sapiens
ctcctgagaattttcagttgga

SEQ ID NO: 8259535 - DNA, 22 bp, Homo sapiens
tttagacatagctgaaatcatt

SEQ ID NO: 8259536 - DNA, 22 bp, Homo sapiens
tttagaatgttagcgttaaagg

SEQ ID NO: 8259537 - DNA, 22 bp, Homo sapiens
ctcctcccaattgccaagtgct

SEQ ID NO: 8259538 - DNA, 22 bp, Homo sapiens
tttaaattctgtctgccgctta

SEQ ID NO: 8259539 - DNA, 22 bp, Homo sapiens
tttacatttccctctgtcagtt

SEQ ID NO: 8259540 - DNA, 22 bp, Homo sapiens
ctcctgggagtcttcctggatg

SEQ ID NO: 8259541 - DNA, 22 bp, Homo sapiens
ctcctgggctcaagtgatcctc

SEQ ID NO: 8259542 - DNA, 22 bp, Homo sapiens
ctcctgggctatgtctgcttgg

SEQ ID NO: 8259543 - DNA, 22 bp, Homo sapiens
ctcctgggctgtcggcgctctg

SEQ ID NO: 8259544 - DNA, 22 bp, Homo sapiens
ctctcctccaggaactcacagt

SEQ ID NO: 8259545 - DNA, 22 bp, Homo sapiens
gcctggagcctcagcaaggagg

SEQ ID NO: 8259546 - DNA, 22 bp, Homo sapiens
gcctggagggctctagagaggc

SEQ ID NO: 8259547 - DNA, 22 bp, Homo sapiens
gcctggaggggccagggtggta

SEQ ID NO: 8259548 - DNA, 22 bp, Homo sapiens
gcctggaggggccagggtggta

SEQ ID NO: 8259549 - DNA, 22 bp, Homo sapiens
gcctgctgttgagggaagagct

SEQ ID NO: 8259550 - DNA, 22 bp, Homo sapiens
gcctgctgttaactgcaggaat

SEQ ID NO: 8259551 - DNA, 22 bp, Homo sapiens
gcctgggaaatggtggggtcag

SEQ ID NO: 8259552 - DNA, 22 bp, Homo sapiens
gcctgggaaatggtggggtcag

SEQ ID NO: 8259553 - DNA, 22 bp, Homo sapiens
gccgggccctgacctcagagtt

SEQ ID NO: 8259554 - DNA, 22 bp, Homo sapiens
gccgtgggtgtcatggcccata

SEQ ID NO: 8259555 - DNA, 22 bp, Homo sapiens
gccgtgcgtgcgcaggtgctgt

SEQ ID NO: 8259556 - DNA, 22 bp, Homo sapiens
gccgtggggagagagggtgcgt

SEQ ID NO: 8259557 - DNA, 22 bp, Homo sapiens
gcctctgcggagctgtacatca

SEQ ID NO: 8259558 - DNA, 22 bp, Homo sapiens
gccctcagtggattcttattgt

SEQ ID NO: 8259559 - DNA, 19 bp, Homo sapiens
gccctcaggcagctccatc

SEQ ID NO: 8259560 - DNA, 22 bp, Homo sapiens
gccctcaggcagggagtctttc

SEQ ID NO: 8259561 - DNA, 15 bp, Homo sapiens
gccctcaggcgacac

SEQ ID NO: 8259562 - DNA, 20 bp, Homo sapiens
gccctcagtcttgtctttat

SEQ ID NO: 8259563 - DNA, 22 bp, Homo sapiens
gccctcagtgaccactgattca

SEQ ID NO: 8259564 - DNA, 21 bp, Homo sapiens
gccctcaggggaggatggcct

SEQ ID NO: 8259565 - DNA, 21 bp, Homo sapiens
gccctcaggggaggatggcct

SEQ ID NO: 8259566 - DNA, 23 bp, Homo sapiens
gccctcagtagaaaatgttagaa

SEQ ID NO: 8259567 - DNA, 22 bp, Homo sapiens
gccctcagcaggaaagatcaac

SEQ ID NO: 8259568 - DNA, 22 bp, Homo sapiens
gccctcagcatcctcagggcca

SEQ ID NO: 8259569 - DNA, 22 bp, Homo sapiens
gccctcagctcctggacacatg

SEQ ID NO: 8259570 - DNA, 22 bp, Homo sapiens
gccctcagcttgatgttgttct

SEQ ID NO: 8259571 - DNA, 19 bp, Homo sapiens
gccctcaggcagctccatc

SEQ ID NO: 8259572 - DNA, 22 bp, Homo sapiens
gccctcaggacaaggttacgct

SEQ ID NO: 8259573 - DNA, 17 bp, Homo sapiens
gccctcagctttaacca

SEQ ID NO: 8259574 - DNA, 22 bp, Homo sapiens
gccctcagatgggaaaggaggg

SEQ ID NO: 8259575 - DNA, 22 bp, Homo sapiens
gccctcagatgggaaaggaggg

SEQ ID NO: 8259576 - DNA, 22 bp, Homo sapiens
gccctcagagttccccacagtg

SEQ ID NO: 8259577 - DNA, 22 bp, Homo sapiens
gccctcagagttccccacagtg

SEQ ID NO: 8259578 - DNA, 22 bp, Homo sapiens
gcccaggctggagtgcagtggc

SEQ ID NO: 8259579 - DNA, 20 bp, Homo sapiens
gccctctgcctccctcagcg

SEQ ID NO: 8259580 - DNA, 22 bp, Homo sapiens
gccctctgcacagctctgagca

SEQ ID NO: 8259581 - DNA, 22 bp, Homo sapiens
gcccaggagttggaggctgcag

SEQ ID NO: 8259582 - DNA, 22 bp, Homo sapiens
gcccaggaggagaggctgcagt

SEQ ID NO: 8259583 - DNA, 22 bp, Homo sapiens
gccatgggtctgctggctcagc

SEQ ID NO: 8259584 - DNA, 22 bp, Homo sapiens
gccatgtgggcagaggaggctg

SEQ ID NO: 8259585 - DNA, 22 bp, Homo sapiens
gccatgttttggtaaataccat

SEQ ID NO: 8259586 - DNA, 22 bp, Homo sapiens
gccatgggtctgctggctcagc

SEQ ID NO: 8259587 - DNA, 20 bp, Homo sapiens
gcccaggatctctgaggcat

SEQ ID NO: 8259588 - DNA, 22 bp, Homo sapiens
gcccaggatggctggaggtgct

SEQ ID NO: 8259589 - DNA, 22 bp, Homo sapiens
gcccaggctggagtgcagtagc

SEQ ID NO: 8259590 - DNA, 22 bp, Homo sapiens
gctggagatgctatgcagaggg

SEQ ID NO: 8259591 - DNA, 22 bp, Homo sapiens
gctggagccaagctgctcttgg

SEQ ID NO: 8259592 - DNA, 22 bp, Homo sapiens
gctggagcgtgatccttgatct

SEQ ID NO: 8259593 - DNA, 22 bp, Homo sapiens
gctggagccttctgctctgttg

SEQ ID NO: 8259594 - DNA, 22 bp, Homo sapiens
gctggagcgggttcgggccgct

SEQ ID NO: 8259595 - DNA, 22 bp, Homo sapiens
gctgcctggagctcagcctgcc

SEQ ID NO: 8259596 - DNA, 22 bp, Homo sapiens
gctgcctggagaggcagggatg

SEQ ID NO: 8259597 - DNA, 22 bp, Homo sapiens
gctgcctggaataacggctggc

SEQ ID NO: 8259598 - DNA, 22 bp, Homo sapiens
gctgcctgctcacccggcctgg

SEQ ID NO: 8259599 - DNA, 22 bp, Homo sapiens
gctgagccctcatccctagttt

SEQ ID NO: 8259600 - DNA, 22 bp, Homo sapiens
gctgagccatgaggcctcttgc

SEQ ID NO: 8259601 - DNA, 22 bp, Homo sapiens
gctgagcccccctgcgtgggtc

SEQ ID NO: 8259602 - DNA, 22 bp, Homo sapiens
gctgcctgggcaggaggcgctg

SEQ ID NO: 8259603 - DNA, 22 bp, Homo sapiens
gctgcctgtcccaggatgagga

SEQ ID NO: 8259604 - DNA, 21 bp, Homo sapiens
gctggagagccaggcaggggc

SEQ ID NO: 8259605 - DNA, 22 bp, Homo sapiens
gctccaggagagggaagcagat

SEQ ID NO: 8259606 - DNA, 22 bp, Homo sapiens
gctccagcacctagagcaggtc

SEQ ID NO: 8259607 - DNA, 22 bp, Homo sapiens
gctcagagcccgaggcttgcat

SEQ ID NO: 8259608 - DNA, 22 bp, Homo sapiens
gctcagagataaaactgatcag

SEQ ID NO: 8259609 - DNA, 22 bp, Homo sapiens
gctctgagcactgtgcggctgg

SEQ ID NO: 8259610 - DNA, 22 bp, Homo sapiens
gctctgagcagggagaaacagg

SEQ ID NO: 8259611 - DNA, 23 bp, Homo sapiens
gctctgagggcttatccctccca

SEQ ID NO: 8259612 - DNA, 22 bp, Homo sapiens
gctctgagtaaatgaaagcatt

SEQ ID NO: 8259613 - DNA, 23 bp, Homo sapiens
gctctgagggcttatccctccca

SEQ ID NO: 8259614 - DNA, 22 bp, Homo sapiens
gctctgagtaaatgaaagcatt

SEQ ID NO: 8259615 - DNA, 22 bp, Homo sapiens
gctctgaggagccaagaatgtg

SEQ ID NO: 8259616 - DNA, 22 bp, Homo sapiens
gctctgaggctgggagcactct

SEQ ID NO: 8259617 - DNA, 22 bp, Homo sapiens
gctctgaggctgtgaggtgctg

SEQ ID NO: 8259618 - DNA, 22 bp, Homo sapiens
gctctgaggctgggagcactct

SEQ ID NO: 8259619 - DNA, 22 bp, Homo sapiens
gctctgagccgggggcctgtcc

SEQ ID NO: 8259620 - DNA, 22 bp, Homo sapiens
gctctgagcccccagaagcaga

SEQ ID NO: 8259621 - DNA, 22 bp, Homo sapiens
gctctgagcccccagaagcaga

SEQ ID NO: 8259622 - DNA, 22 bp, Homo sapiens
gctctgagctcagcgtcagagt

SEQ ID NO: 8259623 - DNA, 23 bp, Homo sapiens
gctctgaggaagttgggcacggg

SEQ ID NO: 8259624 - DNA, 22 bp, Homo sapiens
gctctgagctcagcgtcagagt

SEQ ID NO: 8259625 - DNA, 22 bp, Homo sapiens
gctctgagctgtcttgcaggtc

SEQ ID NO: 8259626 - DNA, 22 bp, Homo sapiens
gctctgagctgtcttgcaggtc

SEQ ID NO: 8259627 - DNA, 22 bp, Homo sapiens
gctctgaggaatatataattgg

SEQ ID NO: 8259628 - DNA, 22 bp, Homo sapiens
gctctgaggaccaattcctgtg

SEQ ID NO: 8259629 - DNA, 22 bp, Homo sapiens
gctctgaggaccaattcctgtg

SEQ ID NO: 8259630 - DNA, 22 bp, Homo sapiens
gctctgagtgatcagctgggaa

SEQ ID NO: 8259631 - DNA, 22 bp, Homo sapiens
gctctgagtgagactagattta

SEQ ID NO: 8259632 - DNA, 22 bp, Homo sapiens
gctctgagtgagactagattta

SEQ ID NO: 8259633 - DNA, 22 bp, Homo sapiens
gctctgagtcacactgccctgt

SEQ ID NO: 8259634 - DNA, 22 bp, Homo sapiens
gctctgagtcacactgccctgt

SEQ ID NO: 8259635 - DNA, 22 bp, Homo sapiens
gctctgagtctcagctaccaca

SEQ ID NO: 8259636 - DNA, 22 bp, Homo sapiens
gctctgagtgattaaggagctt

SEQ ID NO: 8259637 - DNA, 22 bp, Homo sapiens
gctctgagtgcacatttacaca

SEQ ID NO: 8259638 - DNA, 22 bp, Homo sapiens
gctctgagtgatcagctgggaa

SEQ ID NO: 8259639 - DNA, 22 bp, Homo sapiens
gctctgagtgattaaggagctt

SEQ ID NO: 8259640 - DNA, 22 bp, Homo sapiens
gctctgagtgcatgcttttggg

SEQ ID NO: 8259641 - DNA, 22 bp, Homo sapiens
gctctgtgttgtcagaggcacc

SEQ ID NO: 8259642 - DNA, 22 bp, Homo sapiens
gcatggtggagtctgagcaggg

SEQ ID NO: 8259643 - DNA, 22 bp, Homo sapiens
gcatggtggccttagggtagcc

SEQ ID NO: 8259644 - DNA, 22 bp, Homo sapiens
gccaatgccttctagaggagtc

SEQ ID NO: 8259645 - DNA, 22 bp, Homo sapiens
gccacagccgaacccttgggcc

SEQ ID NO: 8259646 - DNA, 22 bp, Homo sapiens
gccacagcccgagcaccatgag

SEQ ID NO: 8259647 - DNA, 22 bp, Homo sapiens
gccacagcagggccctctcagg

SEQ ID NO: 8259648 - DNA, 19 bp, Homo sapiens
gccagcagaatgatgaggc

SEQ ID NO: 8259649 - DNA, 22 bp, Homo sapiens
gccagcagccacagaagtcact

SEQ ID NO: 8259650 - DNA, 22 bp, Homo sapiens
gccagcagctgtggggtggcca

SEQ ID NO: 8259651 - DNA, 22 bp, Homo sapiens
gccagcagctgtggggtggcca

SEQ ID NO: 8259652 - DNA, 22 bp, Homo sapiens
gccagcagcttcttctcatcct

SEQ ID NO: 8259653 - DNA, 22 bp, Homo sapiens
gccagcagggaagccttgggct

SEQ ID NO: 8259654 - DNA, 22 bp, Homo sapiens
gccagcagctcttgggcgggca

SEQ ID NO: 8259655 - DNA, 22 bp, Homo sapiens
gccagcagcgagagtttaacct

SEQ ID NO: 8259656 - DNA, 22 bp, Homo sapiens
gccagcagcccagaaggacttt

SEQ ID NO: 8259657 - DNA, 22 bp, Homo sapiens
gccacaggaaagcaccctggag

SEQ ID NO: 8259658 - DNA, 22 bp, Homo sapiens
gccacagcttttaacctcgggg

SEQ ID NO: 8259659 - DNA, 22 bp, Homo sapiens
gccacagcggggccgctagagc

SEQ ID NO: 8259660 - DNA, 22 bp, Homo sapiens
gccacagctccagtcaggtgac

SEQ ID NO: 8259661 - DNA, 22 bp, Homo sapiens
gccacaggcacttaagggctgg

SEQ ID NO: 8259662 - DNA, 22 bp, Homo sapiens
gcagtgggcaacaagagctgga

SEQ ID NO: 8259663 - DNA, 22 bp, Homo sapiens
gcagtgtcagtgcctgggtggt

SEQ ID NO: 8259664 - DNA, 19 bp, Homo sapiens
gcagtgtcatggtaggagc

SEQ ID NO: 8259665 - DNA, 22 bp, Homo sapiens
gcagtgtctttgacctccaccc

SEQ ID NO: 8259666 - DNA, 21 bp, Homo sapiens
gcagtgtcatggtttcaagtt

SEQ ID NO: 8259667 - DNA, 22 bp, Homo sapiens
gcagtgtccagggtggtctgca

SEQ ID NO: 8259668 - DNA, 22 bp, Homo sapiens
gcaggacaggcgttggtccagt

SEQ ID NO: 8259669 - DNA, 22 bp, Homo sapiens
gcaggaccaggcacgagggcca

SEQ ID NO: 8259670 - DNA, 22 bp, Homo sapiens
gcaggagaaatgaagattgggt

SEQ ID NO: 8259671 - DNA, 22 bp, Homo sapiens
gcaggagagccagcaggcttcc

SEQ ID NO: 8259672 - DNA, 22 bp, Homo sapiens
gcaggagacaactgtaaggaga

SEQ ID NO: 8259673 - DNA, 22 bp, Homo sapiens
gcaggcaccacggctcaggtct

SEQ ID NO: 8259674 - DNA, 22 bp, Homo sapiens
gcaggcaccgcggcggcaggtt

SEQ ID NO: 8259675 - DNA, 22 bp, Homo sapiens
gcaggagttagggtaaaaatga

SEQ ID NO: 8259676 - DNA, 22 bp, Homo sapiens
gcaggagttcaattgcccatga

SEQ ID NO: 8259677 - DNA, 22 bp, Homo sapiens
gcaggagttaggcgtcgtggat

SEQ ID NO: 8259678 - DNA, 22 bp, Homo sapiens
gcaggagctcgtttccaggctg

SEQ ID NO: 8259679 - DNA, 22 bp, Homo sapiens
gcaggagccacttcagggatgc

SEQ ID NO: 8259680 - DNA, 22 bp, Homo sapiens
gcaggagccagggattccagga

SEQ ID NO: 8259681 - DNA, 22 bp, Homo sapiens
gcaggagccctggcatgttctt

SEQ ID NO: 8259682 - DNA, 22 bp, Homo sapiens
gcaggagccaggccgagctggt

SEQ ID NO: 8259683 - DNA, 22 bp, Homo sapiens
gcagctcccttgaacttctcct

SEQ ID NO: 8259684 - DNA, 22 bp, Homo sapiens
gcagctcccatcagggcacaga

SEQ ID NO: 8259685 - DNA, 22 bp, Homo sapiens
gcagctcccagcttgaaaggtc

SEQ ID NO: 8259686 - DNA, 22 bp, Homo sapiens
gcagctcctcctgggctggaga

SEQ ID NO: 8259687 - DNA, 22 bp, Homo sapiens
gcagctccttcaatctcaccat

SEQ ID NO: 8259688 - DNA, 22 bp, Homo sapiens
gcagctccttcaatctcaccat

SEQ ID NO: 8259689 - DNA, 22 bp, Homo sapiens
gcagctcttttcttaaagagat

SEQ ID NO: 8259690 - DNA, 22 bp, Homo sapiens
gcagctctgagactctacagaa

SEQ ID NO: 8259691 - DNA, 22 bp, Homo sapiens
gcagctctgattggttcagcct

SEQ ID NO: 8259692 - DNA, 22 bp, Homo sapiens
gcagctcttcacttactccttt

SEQ ID NO: 8259693 - DNA, 22 bp, Homo sapiens
gcagctctgtctttcttaaagt

SEQ ID NO: 8259694 - DNA, 22 bp, Homo sapiens
gcagctctggggcaggcctgag

SEQ ID NO: 8259695 - DNA, 22 bp, Homo sapiens
gcagctctcctctgtgaggaac

SEQ ID NO: 8259696 - DNA, 22 bp, Homo sapiens
gcagctctatgtgatggtaaat

SEQ ID NO: 8259697 - DNA, 22 bp, Homo sapiens
gcagctctgacaatgcctggaa

SEQ ID NO: 8259698 - DNA, 22 bp, Homo sapiens
gcagctctctggcctgccctgg

SEQ ID NO: 8259699 - DNA, 22 bp, Homo sapiens
gcagagcctgtgtctgagcaaa

SEQ ID NO: 8259700 - DNA, 22 bp, Homo sapiens
gcagagccttgcgtcatgtgcc

SEQ ID NO: 8259701 - DNA, 20 bp, Homo sapiens
gcagagcctcactgcaaggg

SEQ ID NO: 8259702 - DNA, 22 bp, Homo sapiens
gcagagccctgggggtatggtg

SEQ ID NO: 8259703 - DNA, 22 bp, Homo sapiens
gcagcctctgatgatggccgta

SEQ ID NO: 8259704 - DNA, 22 bp, Homo sapiens
gcagagctcaaggtgttcagct

SEQ ID NO: 8259705 - DNA, 22 bp, Homo sapiens
gcagggcagacctccagcctat

SEQ ID NO: 8259706 - DNA, 22 bp, Homo sapiens
gcaggggctgagcaccagcggg

SEQ ID NO: 8259707 - DNA, 22 bp, Homo sapiens
gcaggggctgctgggaactcgg

SEQ ID NO: 8259708 - DNA, 22 bp, Homo sapiens
gcaggggctaaggacacagaga

SEQ ID NO: 8259709 - DNA, 22 bp, Homo sapiens
gcaggggcaggagatctcaggc

SEQ ID NO: 8259710 - DNA, 21 bp, Homo sapiens
gcaggcactctagaggagctg

SEQ ID NO: 8259711 - DNA, 22 bp, Homo sapiens
gcagggaaacaggtgctaagga

SEQ ID NO: 8259712 - DNA, 22 bp, Homo sapiens
gcagggcaaacccaggtgttca

SEQ ID NO: 8259713 - DNA, 22 bp, Homo sapiens
gcagggaagacccggagcagcg

SEQ ID NO: 8259714 - DNA, 22 bp, Homo sapiens
gcagagccaggagcccaggatc

SEQ ID NO: 8259715 - DNA, 22 bp, Homo sapiens
gcagagccagaatggccaggac

SEQ ID NO: 8259716 - DNA, 22 bp, Homo sapiens
gcagagccaggagagacccttg

SEQ ID NO: 8259717 - DNA, 22 bp, Homo sapiens
gcagagcccctcaagccagcct

SEQ ID NO: 8259718 - DNA, 22 bp, Homo sapiens
gcagaagctgggcagcgaggtg

SEQ ID NO: 8259719 - DNA, 22 bp, Homo sapiens
gcacccagtttgtctcagggtt

SEQ ID NO: 8259720 - DNA, 22 bp, Homo sapiens
gcacccaggcttgggcagcaac

SEQ ID NO: 8259721 - DNA, 22 bp, Homo sapiens
gcacaataatttttttaagagg

SEQ ID NO: 8259722 - DNA, 19 bp, Homo sapiens
gcaccccatcttcctcctg

SEQ ID NO: 8259723 - DNA, 22 bp, Homo sapiens
gatttgtttcaagttagcatct

SEQ ID NO: 8259724 - DNA, 22 bp, Homo sapiens
gatttctgtggcttgtacatat

SEQ ID NO: 8259725 - DNA, 22 bp, Homo sapiens
gcaaacatgctgagaaataaga

SEQ ID NO: 8259726 - DNA, 22 bp, Homo sapiens
gcaaacatctttatttggcaag

SEQ ID NO: 8259727 - DNA, 22 bp, Homo sapiens
gcaaacatgtgctcattttgtg

SEQ ID NO: 8259728 - DNA, 22 bp, Homo sapiens
gcaatgggcacagcccagccca

SEQ ID NO: 8259729 - DNA, 22 bp, Homo sapiens
gatggaggagatggcagggtgc

SEQ ID NO: 8259730 - DNA, 22 bp, Homo sapiens
gatgccctgcatgagtcctgct

SEQ ID NO: 8259731 - DNA, 22 bp, Homo sapiens
gatgtcaccatcttcacatctc

SEQ ID NO: 8259732 - DNA, 22 bp, Homo sapiens
gatggtgcaggtgaagtgctgg

SEQ ID NO: 8259733 - DNA, 22 bp, Homo sapiens
gatgggtagaagtggaagaggt

SEQ ID NO: 8259734 - DNA, 22 bp, Homo sapiens
gatgggggccagggcctgcttt

SEQ ID NO: 8259735 - DNA, 22 bp, Homo sapiens
gatttacaaagctctctagtgt

SEQ ID NO: 8259736 - DNA, 22 bp, Homo sapiens
gattgggggtcaggctcaggtc

SEQ ID NO: 8259737 - DNA, 22 bp, Homo sapiens
gattcacagtttaggctgggct

SEQ ID NO: 8259738 - DNA, 22 bp, Homo sapiens
ctggctgggttccaggattcca

SEQ ID NO: 8259739 - DNA, 22 bp, Homo sapiens
ctggctggtcatgtcatgagcc

SEQ ID NO: 8259740 - DNA, 22 bp, Homo sapiens
ctggctggtcctcggggacagc

SEQ ID NO: 8259741 - DNA, 22 bp, Homo sapiens
cttctcattcaagcaaaacaga

SEQ ID NO: 8259742 - DNA, 21 bp, Homo sapiens
cttggctgcagtgacaggcat

SEQ ID NO: 8259743 - DNA, 22 bp, Homo sapiens
cttggggctttgtgtgtaggat

SEQ ID NO: 8259744 - DNA, 22 bp, Homo sapiens
cttgggaggggagcattggcct

SEQ ID NO: 8259745 - DNA, 22 bp, Homo sapiens
ctttagatttctatgtatcact

SEQ ID NO: 8259746 - DNA, 22 bp, Homo sapiens
ctttacaattcaagggaactct

SEQ ID NO: 8259747 - DNA, 22 bp, Homo sapiens
ctttatgaacctgttcagcttg

SEQ ID NO: 8259748 - DNA, 22 bp, Homo sapiens
gaactcagagcctgagctagga

SEQ ID NO: 8259749 - DNA, 22 bp, Homo sapiens
ctttgtgtctgttaataattat

SEQ ID NO: 8259750 - DNA, 22 bp, Homo sapiens
ctttgttttactcagaggcatg

SEQ ID NO: 8259751 - DNA, 22 bp, Homo sapiens
gaattgtattgatttttcagag

SEQ ID NO: 8259752 - DNA, 22 bp, Homo sapiens
gaattgtagagggaacagaagc

SEQ ID NO: 8259753 - DNA, 22 bp, Homo sapiens
gaattgtactgcaatcagggga

SEQ ID NO: 8259754 - DNA, 22 bp, Homo sapiens
gaattgtacgctttacataggt

SEQ ID NO: 8259755 - DNA, 22 bp, Homo sapiens
gaattgtaagtaccagcatgct

SEQ ID NO: 8259756 - DNA, 22 bp, Homo sapiens
gacaggaagtctgaaggaggga

SEQ ID NO: 8259757 - DNA, 22 bp, Homo sapiens
gaaggagagggtcaaggataat

SEQ ID NO: 8259758 - DNA, 22 bp, Homo sapiens
gaaggagaggattgtgaggctg

SEQ ID NO: 8259759 - DNA, 19 bp, Homo sapiens
gaaggagagctgagttagg

SEQ ID NO: 8259760 - DNA, 22 bp, Homo sapiens
gaaggagagagacatcgtccct

SEQ ID NO: 8259761 - DNA, 22 bp, Homo sapiens
gaaggagaccctgaagatgctg

SEQ ID NO: 8259762 - DNA, 22 bp, Homo sapiens
gaaggagagaaaggcaattctg

SEQ ID NO: 8259763 - DNA, 21 bp, Homo sapiens
gaaggagaaagcaagtgctgc

SEQ ID NO: 8259764 - DNA, 22 bp, Homo sapiens
gaagtgggtggtgatatcactg

SEQ ID NO: 8259765 - DNA, 22 bp, Homo sapiens
gaagtgggctttgtggtcagct

SEQ ID NO: 8259766 - DNA, 22 bp, Homo sapiens
gaccattagctgctattcagta

SEQ ID NO: 8259767 - DNA, 22 bp, Homo sapiens
gacccagcttaagtcacatgtt

SEQ ID NO: 8259768 - DNA, 20 bp, Homo sapiens
gacaggagagttaggtaggt

SEQ ID NO: 8259769 - DNA, 22 bp, Homo sapiens
gacaggaggcagagctcaggtg

SEQ ID NO: 8259770 - DNA, 22 bp, Homo sapiens
gacaggaggcagagctcaggtg

SEQ ID NO: 8259771 - DNA, 22 bp, Homo sapiens
gacttgggtgtcggggcagtct

SEQ ID NO: 8259772 - DNA, 22 bp, Homo sapiens
gactttaaaagtttgtgcttgg

SEQ ID NO: 8259773 - DNA, 22 bp, Homo sapiens
gactttaaaatgctagaacagg

SEQ ID NO: 8259774 - DNA, 22 bp, Homo sapiens
gactggggtaaggtgaggaggt

SEQ ID NO: 8259775 - DNA, 22 bp, Homo sapiens
gactttatcctgcctgaccacg

SEQ ID NO: 8259776 - DNA, 22 bp, Homo sapiens
gactttataaatgagaggcgga

SEQ ID NO: 8259777 - DNA, 22 bp, Homo sapiens
gactttataaatgagaggcgga

SEQ ID NO: 8259778 - DNA, 22 bp, Homo sapiens
gactttatcttgtccttcctgc

SEQ ID NO: 8259779 - DNA, 22 bp, Homo sapiens
gactttatgaagagatgaccaa

SEQ ID NO: 8259780 - DNA, 22 bp, Homo sapiens
gactttattactaaccctgtga

SEQ ID NO: 8259781 - DNA, 22 bp, Homo sapiens
gactttattttaacggagattc

SEQ ID NO: 8259782 - DNA, 22 bp, Homo sapiens
gactttatttccttatttgtga

SEQ ID NO: 8259783 - DNA, 22 bp, Homo sapiens
gactttattcgttaactgttaa

SEQ ID NO: 8259784 - DNA, 22 bp, Homo sapiens
gactttattatagtggcaatag

SEQ ID NO: 8259785 - DNA, 17 bp, Homo sapiens
gagagtctaatgggaga

SEQ ID NO: 8259786 - DNA, 22 bp, Homo sapiens
gagagctgcagccgagaggggg

SEQ ID NO: 8259787 - DNA, 22 bp, Homo sapiens
gagctggaggcagtgctgaggt

SEQ ID NO: 8259788 - DNA, 22 bp, Homo sapiens
gaggaagatggttgagtggtcc

SEQ ID NO: 8259789 - DNA, 22 bp, Homo sapiens
gaggaagggctgcctgccgggc

SEQ ID NO: 8259790 - DNA, 22 bp, Homo sapiens
gaggaaggtcccatcagaattt

SEQ ID NO: 8259791 - DNA, 19 bp, Homo sapiens
gaggaggcttcagctttct

SEQ ID NO: 8259792 - DNA, 22 bp, Homo sapiens
gaggaggcttccgggaggcacg

SEQ ID NO: 8259793 - DNA, 22 bp, Homo sapiens
gaggaggctgtttctctgcatt

SEQ ID NO: 8259794 - DNA, 22 bp, Homo sapiens
gaggcagagtgcaccccaggag

SEQ ID NO: 8259795 - DNA, 22 bp, Homo sapiens
gaggcagaggttgcagtgagct

SEQ ID NO: 8259796 - DNA, 22 bp, Homo sapiens
gaggagggttggccttaggtag

SEQ ID NO: 8259797 - DNA, 23 bp, Homo sapiens
gaggcagctcctgcagtgccctg

SEQ ID NO: 8259798 - DNA, 22 bp, Homo sapiens
gaggcccaggtcaagcagccac

SEQ ID NO: 8259799 - DNA, 22 bp, Homo sapiens
gaggcccagggtacaggccgct

SEQ ID NO: 8259800 - DNA, 22 bp, Homo sapiens
gaggcccagcattcagggcagg

SEQ ID NO: 8259801 - DNA, 22 bp, Homo sapiens
gaggcagctgggctggtggttt

SEQ ID NO: 8259802 - DNA, 22 bp, Homo sapiens
gaggcagctgaaggagtgacag

SEQ ID NO: 8259803 - DNA, 22 bp, Homo sapiens
gaggcccagtggagggccatgg

SEQ ID NO: 8259804 - DNA, 19 bp, Homo sapiens
gaggcccatgagggtgctc

SEQ ID NO: 8259805 - DNA, 22 bp, Homo sapiens
gaggcccagtcctgcaagcacg

SEQ ID NO: 8259806 - DNA, 22 bp, Homo sapiens
gaggccctcttgccacaatgaa

SEQ ID NO: 8259807 - DNA, 22 bp, Homo sapiens
gaggccctgaagacagctgggg

SEQ ID NO: 8259808 - DNA, 22 bp, Homo sapiens
gaggccctgaagacagctgggg

SEQ ID NO: 8259809 - DNA, 22 bp, Homo sapiens
gaggtcaggctcaagctgggcc

SEQ ID NO: 8259810 - DNA, 22 bp, Homo sapiens
gaggtccactgaggcaacaggg

SEQ ID NO: 8259811 - DNA, 22 bp, Homo sapiens
gaggtccagccaagcggcaagg

SEQ ID NO: 8259812 - DNA, 22 bp, Homo sapiens
gaggtccagagcaggttcagtg

SEQ ID NO: 8259813 - DNA, 22 bp, Homo sapiens
gaggtccagggtggggcctgag

SEQ ID NO: 8259814 - DNA, 22 bp, Homo sapiens
gaggggcctggcactgagctgg

SEQ ID NO: 8259815 - DNA, 22 bp, Homo sapiens
gaggggccggcatgtgcctctc

SEQ ID NO: 8259816 - DNA, 22 bp, Homo sapiens
gaggtaggtgtaggaggcctgc

SEQ ID NO: 8259817 - DNA, 22 bp, Homo sapiens
gagtccagttgttcacagaggc

SEQ ID NO: 8259818 - DNA, 22 bp, Homo sapiens
gagtccctgctgtcaggtgctg

SEQ ID NO: 8259819 - DNA, 22 bp, Homo sapiens
gagtccagttctttccagcagt

SEQ ID NO: 8259820 - DNA, 22 bp, Homo sapiens
gaggggcaggattattgggatt

SEQ ID NO: 8259821 - DNA, 22 bp, Homo sapiens
gaggggcagttgattgtgctat

SEQ ID NO: 8259822 - DNA, 22 bp, Homo sapiens
gaggggcagtgcacccgggccc

SEQ ID NO: 8259823 - DNA, 22 bp, Homo sapiens
gaggggcacagtaaagggtccc

SEQ ID NO: 8259824 - DNA, 22 bp, Homo sapiens
gaggggcaagaagttggcctct

SEQ ID NO: 8259825 - DNA, 22 bp, Homo sapiens
gaggggcaatgagggaaagagt

SEQ ID NO: 8259826 - DNA, 22 bp, Homo sapiens
gaggggagtaaagtcatgttac

SEQ ID NO: 8259827 - DNA, 22 bp, Homo sapiens
gaggggagtgtcctccgggccc

SEQ ID NO: 8259828 - DNA, 22 bp, Homo sapiens
gagggcaggggtcttgcacggt

SEQ ID NO: 8259829 - DNA, 22 bp, Homo sapiens
gagggcagtagcctcgtaccct

SEQ ID NO: 8259830 - DNA, 22 bp, Homo sapiens
gaggcctgctttggcactctgg

SEQ ID NO: 8259831 - DNA, 22 bp, Homo sapiens
gaggcctgaggctgcctggagc

SEQ ID NO: 8259832 - DNA, 22 bp, Homo sapiens
gaggctggaggtcaaagatgaa

SEQ ID NO: 8259833 - DNA, 22 bp, Homo sapiens
gagggatgcagaaacagaggcc

SEQ ID NO: 8259834 - DNA, 22 bp, Homo sapiens
gataaagtagatttgttctaga

SEQ ID NO: 8259835 - DNA, 22 bp, Homo sapiens
gagtgtctcacagtagcatttt

SEQ ID NO: 8259836 - DNA, 22 bp, Homo sapiens
gagtgtctgaattagagcacaa

SEQ ID NO: 8259837 - DNA, 22 bp, Homo sapiens
gagtgtctgtattttgggcaag

SEQ ID NO: 8259838 - DNA, 22 bp, Homo sapiens
gagtgtctatgtttagtctttc

SEQ ID NO: 8259839 - DNA, 21 bp, Homo sapiens
gagtgtctaatccaggctgtc

SEQ ID NO: 8259840 - DNA, 22 bp, Homo sapiens
gagtgtcagtgcctggcttgtt

SEQ ID NO: 8259841 - DNA, 22 bp, Homo sapiens
gagtgtctaatcacgtttcaca

SEQ ID NO: 8259842 - DNA, 22 bp, Homo sapiens
gagtggggtctgggcatcagtc

SEQ ID NO: 8259843 - DNA, 22 bp, Homo sapiens
gagtggggggtccgtctcagtg

SEQ ID NO: 8259844 - DNA, 22 bp, Homo sapiens
gagtgtctgtggggcatggaca

SEQ ID NO: 8259845 - DNA, 22 bp, Homo sapiens
gagtgtctgtgacagctcatga

SEQ ID NO: 8259846 - DNA, 22 bp, Homo sapiens
gagtgtggatcccagaagcaga

SEQ ID NO: 8259847 - DNA, 22 bp, Homo sapiens
gagtgtggtgaacaggagcacc

SEQ ID NO: 8259848 - DNA, 22 bp, Homo sapiens
gagtgtgtcggtcagcgtggcg

SEQ ID NO: 8259849 - DNA, 22 bp, Homo sapiens
gagttaaaaatgcctccatgga

SEQ ID NO: 8259850 - DNA, 22 bp, Homo sapiens
gagtcctggaaccctgaatgct

SEQ ID NO: 8259851 - DNA, 22 bp, Homo sapiens
gagtctaagtagaatgtgaaaa

SEQ ID NO: 8259852 - DNA, 22 bp, Homo sapiens
gagtctaaggaaaaatagagta

SEQ ID NO: 8259853 - DNA, 22 bp, Homo sapiens
gagtctagctgcagaggaccct

SEQ ID NO: 8259854 - DNA, 22 bp, Homo sapiens
gagtgagggcagcaggggctgc

SEQ ID NO: 8259855 - DNA, 22 bp, Homo sapiens
gagtgagtgctgggctgaggct

SEQ ID NO: 8259856 - DNA, 22 bp, Homo sapiens
gagtctgaggggagagctgggt

SEQ ID NO: 8259857 - DNA, 22 bp, Homo sapiens
gagtgcagttggggtgagggga

SEQ ID NO: 8259858 - DNA, 17 bp, Homo sapiens
gagtgctggtggagctc

SEQ ID NO: 8259859 - DNA, 22 bp, Homo sapiens
gagtgctgtatctgagaaagca

SEQ ID NO: 8259860 - DNA, 22 bp, Homo sapiens
gagtgctgaatgcgagaacaga

SEQ ID NO: 8259861 - DNA, 22 bp, Homo sapiens
gagtgctgctaatgcaagggtg

SEQ ID NO: 8259862 - DNA, 22 bp, Homo sapiens
gagtggagcaaaagaggtagat

SEQ ID NO: 8259863 - DNA, 22 bp, Homo sapiens
gagtgctgtatctgagaaagca

SEQ ID NO: 8259864 - DNA, 21 bp, Homo sapiens
gagtgggacatgggagtggtt

SEQ ID NO: 8259865 - DNA, 22 bp, Homo sapiens
gatccagcttctacacagagct

SEQ ID NO: 8259866 - DNA, 22 bp, Homo sapiens
gatgcagggctggcaggagctt

SEQ ID NO: 8259867 - DNA, 22 bp, Homo sapiens
gatatacataggtttctatgca

SEQ ID NO: 8259868 - DNA, 22 bp, Homo sapiens
gatcaggaatattggaaagtac

SEQ ID NO: 8259869 - DNA, 22 bp, Homo sapiens
gatatacagagcattctttgat

SEQ ID NO: 8259870 - DNA, 22 bp, Homo sapiens
gatatacaatccacagttgatt

SEQ ID NO: 8259871 - DNA, 22 bp, Homo sapiens
gatagataaaactatattttca

SEQ ID NO: 8259872 - DNA, 22 bp, Homo sapiens
gggcccagcactggctgggatc

SEQ ID NO: 8259873 - DNA, 23 bp, Homo sapiens
gggcccagcacaggacctggcag

SEQ ID NO: 8259874 - DNA, 22 bp, Homo sapiens
gggcccagccctctgctcactg

SEQ ID NO: 8259875 - DNA, 19 bp, Homo sapiens
gggcccagcatggagggtt

SEQ ID NO: 8259876 - DNA, 22 bp, Homo sapiens
gggcccagcgtggttccatctg

SEQ ID NO: 8259877 - DNA, 22 bp, Homo sapiens
gggcggggggagctggaatgaa

SEQ ID NO: 8259878 - DNA, 22 bp, Homo sapiens
gggcggggggagctggaatgaa

SEQ ID NO: 8259879 - DNA, 22 bp, Homo sapiens
gggcagcaaatctgagtctggt

SEQ ID NO: 8259880 - DNA, 20 bp, Homo sapiens
gggcagcaagacatttgaca

SEQ ID NO: 8259881 - DNA, 22 bp, Homo sapiens
gggcagaggttcaacttcaaca

SEQ ID NO: 8259882 - DNA, 22 bp, Homo sapiens
gggaccaggtgggtgcattccg

SEQ ID NO: 8259883 - DNA, 22 bp, Homo sapiens
gggacgggcacggagggccctc

SEQ ID NO: 8259884 - DNA, 20 bp, Homo sapiens
gggaggccccagagtccagg

SEQ ID NO: 8259885 - DNA, 20 bp, Homo sapiens
gggagaagggctgatgagag

SEQ ID NO: 8259886 - DNA, 22 bp, Homo sapiens
gggagaaggaggactgtgctgt

SEQ ID NO: 8259887 - DNA, 22 bp, Homo sapiens
gggagaaggaggactgtgctgt

SEQ ID NO: 8259888 - DNA, 20 bp, Homo sapiens
gggaggcgagggctgagcag

SEQ ID NO: 8259889 - DNA, 22 bp, Homo sapiens
gggatggactgacggtagcgcg

SEQ ID NO: 8259890 - DNA, 22 bp, Homo sapiens
gggatggagggtagagcaagtg

SEQ ID NO: 8259891 - DNA, 22 bp, Homo sapiens
gggatggatcttggctgaggct

SEQ ID NO: 8259892 - DNA, 22 bp, Homo sapiens
gggcagaggggcgcttccctct

SEQ ID NO: 8259893 - DNA, 22 bp, Homo sapiens
gggatggggagctggaaagggg

SEQ ID NO: 8259894 - DNA, 19 bp, Homo sapiens
gggatgggccctcaccctc

SEQ ID NO: 8259895 - DNA, 22 bp, Homo sapiens
gggatgggagagcatttagaga

SEQ ID NO: 8259896 - DNA, 22 bp, Homo sapiens
gggagggaaggtacctgtgtga

SEQ ID NO: 8259897 - DNA, 22 bp, Homo sapiens
gggagggaaggaggcgccgtgt

SEQ ID NO: 8259898 - DNA, 22 bp, Homo sapiens
gggagggaaagcttgatctgtc

SEQ ID NO: 8259899 - DNA, 22 bp, Homo sapiens
gggtctggcatgctgagatgga

SEQ ID NO: 8259900 - DNA, 22 bp, Homo sapiens
gggtgggaacaggatgccagga

SEQ ID NO: 8259901 - DNA, 22 bp, Homo sapiens
ggggactgaggcactgaaggtg

SEQ ID NO: 8259902 - DNA, 22 bp, Homo sapiens
gggggctcctcccagctgccag

SEQ ID NO: 8259903 - DNA, 22 bp, Homo sapiens
ggggtaggcaggtgatctgatc

SEQ ID NO: 8259904 - DNA, 22 bp, Homo sapiens
gggtccaggcgtggcccagatg

SEQ ID NO: 8259905 - DNA, 22 bp, Homo sapiens
ggggggctgttctggacaggaa

SEQ ID NO: 8259906 - DNA, 20 bp, Homo sapiens
ggggggcttcagggcctgtg

SEQ ID NO: 8259907 - DNA, 22 bp, Homo sapiens
gggctctgtgcaccccagcacc

SEQ ID NO: 8259908 - DNA, 22 bp, Homo sapiens
gggctgagacgatggggtcttc

SEQ ID NO: 8259909 - DNA, 22 bp, Homo sapiens
gggctggacatctaaggtagct

SEQ ID NO: 8259910 - DNA, 22 bp, Homo sapiens
gggctgcttgctggagacagac

SEQ ID NO: 8259911 - DNA, 22 bp, Homo sapiens
ggggacagtcgatctagtgatt

SEQ ID NO: 8259912 - DNA, 22 bp, Homo sapiens
ggggacagttaaagaccaagac

SEQ ID NO: 8259913 - DNA, 22 bp, Homo sapiens
ggggacagttaaagaccaagac

SEQ ID NO: 8259914 - DNA, 23 bp, Homo sapiens
ggggacagttcccactggggtct

SEQ ID NO: 8259915 - DNA, 23 bp, Homo sapiens
ggggacagagggcagcccgcatc

SEQ ID NO: 8259916 - DNA, 23 bp, Homo sapiens
ggggaagtggcagtgagtgaggc

SEQ ID NO: 8259917 - DNA, 20 bp, Homo sapiens
ggggaagtcactgcagtcag

SEQ ID NO: 8259918 - DNA, 22 bp, Homo sapiens
ggggaaggattgagttgaccca

SEQ ID NO: 8259919 - DNA, 22 bp, Homo sapiens
ggggaaggattgagttgaccca

SEQ ID NO: 8259920 - DNA, 22 bp, Homo sapiens
ggggaagggagtccaagtgtta

SEQ ID NO: 8259921 - DNA, 22 bp, Homo sapiens
gggctggagccagctgtggctg

SEQ ID NO: 8259922 - DNA, 22 bp, Homo sapiens
gggctggagcctggcggtggtt

SEQ ID NO: 8259923 - DNA, 22 bp, Homo sapiens
gggctggagagtcccacgtggg

SEQ ID NO: 8259924 - DNA, 22 bp, Homo sapiens
gggaaaggatcagtgggaggct

SEQ ID NO: 8259925 - DNA, 22 bp, Homo sapiens
gggaacagggcctgagctgggg

SEQ ID NO: 8259926 - DNA, 22 bp, Homo sapiens
ggctgctgaacaagggaaccct

SEQ ID NO: 8259927 - DNA, 22 bp, Homo sapiens
ggctgctctgccttccagctgg

SEQ ID NO: 8259928 - DNA, 22 bp, Homo sapiens
ggctgccttcatagaccatggg

SEQ ID NO: 8259929 - DNA, 22 bp, Homo sapiens
ggctgcctgtgcccaggcacac

SEQ ID NO: 8259930 - DNA, 22 bp, Homo sapiens
ggctgcctggtttagtgctgac

SEQ ID NO: 8259931 - DNA, 19 bp, Homo sapiens
ggctgcctggagcgagggc

SEQ ID NO: 8259932 - DNA, 22 bp, Homo sapiens
ggctgcaggatgcccagccgtg

SEQ ID NO: 8259933 - DNA, 18 bp, Homo sapiens
ggctgatccaggcagccc

SEQ ID NO: 8259934 - DNA, 22 bp, Homo sapiens
ggctgatcaggtgcaaatgcat

SEQ ID NO: 8259935 - DNA, 22 bp, Homo sapiens
ggctgatctcgtgtgaccttgt

SEQ ID NO: 8259936 - DNA, 22 bp, Homo sapiens
ggctgatcctgagcaggcagtg

SEQ ID NO: 8259937 - DNA, 19 bp, Homo sapiens
ggctgcagagccccggcgc

SEQ ID NO: 8259938 - DNA, 22 bp, Homo sapiens
ggccagagaagtcagacccttg

SEQ ID NO: 8259939 - DNA, 22 bp, Homo sapiens
ggcaggtgcttgtcgaaggcct

SEQ ID NO: 8259940 - DNA, 22 bp, Homo sapiens
ggccagagagcagccaggattc

SEQ ID NO: 8259941 - DNA, 22 bp, Homo sapiens
ggccagagaatatgccttacgt

SEQ ID NO: 8259942 - DNA, 22 bp, Homo sapiens
ggccagagagccgctgttagga

SEQ ID NO: 8259943 - DNA, 22 bp, Homo sapiens
ggccagagctcaaacagtcgca

SEQ ID NO: 8259944 - DNA, 22 bp, Homo sapiens
ggccagaggccacagctgtgtc

SEQ ID NO: 8259945 - DNA, 22 bp, Homo sapiens
ggccagaggacctctcatagcc

SEQ ID NO: 8259946 - DNA, 22 bp, Homo sapiens
ggccagaggccatcctcctgct

SEQ ID NO: 8259947 - DNA, 22 bp, Homo sapiens
ggccagaggtggtacatagctt

SEQ ID NO: 8259948 - DNA, 18 bp, Homo sapiens
ggccagagggagggtccc

SEQ ID NO: 8259949 - DNA, 17 bp, Homo sapiens
ggccagaggcggggctg

SEQ ID NO: 8259950 - DNA, 22 bp, Homo sapiens
ggccccagttcactcctggccg

SEQ ID NO: 8259951 - DNA, 22 bp, Homo sapiens
ggccccaggtctgaacacgctg

SEQ ID NO: 8259952 - DNA, 22 bp, Homo sapiens
ggccccagattctgggctgggt

SEQ ID NO: 8259953 - DNA, 22 bp, Homo sapiens
ggcccagccttggggtttcttt

SEQ ID NO: 8259954 - DNA, 22 bp, Homo sapiens
ggcccagcctggcaacaatgac

SEQ ID NO: 8259955 - DNA, 22 bp, Homo sapiens
ggcccagcctcagacatgccct

SEQ ID NO: 8259956 - DNA, 22 bp, Homo sapiens
ggcccacactgacagctgagct

SEQ ID NO: 8259957 - DNA, 22 bp, Homo sapiens
ggcccaaggcccaggtcgagct

SEQ ID NO: 8259958 - DNA, 22 bp, Homo sapiens
ggcccagccggcgagtctcgcg

SEQ ID NO: 8259959 - DNA, 22 bp, Homo sapiens
ggccctctgtggctgccatgga

SEQ ID NO: 8259960 - DNA, 22 bp, Homo sapiens
ggcctgggcctttgtgttttga

SEQ ID NO: 8259961 - DNA, 22 bp, Homo sapiens
ggccttggctcctgcagggagt

SEQ ID NO: 8259962 - DNA, 22 bp, Homo sapiens
ggctcagcgcgctgggagggag

SEQ ID NO: 8259963 - DNA, 22 bp, Homo sapiens
ggctcagcttatctgggcaggc

SEQ ID NO: 8259964 - DNA, 22 bp, Homo sapiens
ggctcaggactgcagcgtagag

SEQ ID NO: 8259965 - DNA, 22 bp, Homo sapiens
ggctccaccctgcttccagaag

SEQ ID NO: 8259966 - DNA, 23 bp, Homo sapiens
ggcacagatgctgagcatgtgca

SEQ ID NO: 8259967 - DNA, 22 bp, Homo sapiens
ggcacagagttggcagagctgc

SEQ ID NO: 8259968 - DNA, 22 bp, Homo sapiens
ggcacagcacagagcacatgta

SEQ ID NO: 8259969 - DNA, 22 bp, Homo sapiens
ggcacagcactgtaggcctggg

SEQ ID NO: 8259970 - DNA, 23 bp, Homo sapiens
ggcagagagcatggctggggccc

SEQ ID NO: 8259971 - DNA, 22 bp, Homo sapiens
ggcagagactgggttggcagag

SEQ ID NO: 8259972 - DNA, 21 bp, Homo sapiens
ggcagagaagctggaagttgg

SEQ ID NO: 8259973 - DNA, 22 bp, Homo sapiens
ggagtggcctctcctgtgcagg

SEQ ID NO: 8259974 - DNA, 22 bp, Homo sapiens
ggagtggccacgactgggagat

SEQ ID NO: 8259975 - DNA, 22 bp, Homo sapiens
ggagtggtggtcaggccatggc

SEQ ID NO: 8259976 - DNA, 19 bp, Homo sapiens
ggagtgggtagttagtggt

SEQ ID NO: 8259977 - DNA, 22 bp, Homo sapiens
ggagtggctatttgtgctggtt

SEQ ID NO: 8259978 - DNA, 22 bp, Homo sapiens
ggcaaggaagaagccatgatgt

SEQ ID NO: 8259979 - DNA, 22 bp, Homo sapiens
ggagtggtgtcactgagaggaa

SEQ ID NO: 8259980 - DNA, 22 bp, Homo sapiens
ggcacagacttttgcttgcgtt

SEQ ID NO: 8259981 - DNA, 22 bp, Homo sapiens
ggcagaggaagctggaagtggg

SEQ ID NO: 8259982 - DNA, 22 bp, Homo sapiens
ggcagctcgtcaggctgcggcg

SEQ ID NO: 8259983 - DNA, 20 bp, Homo sapiens
ggcagctctagtcgaggccc

SEQ ID NO: 8259984 - DNA, 22 bp, Homo sapiens
ggcagctctgtgtctgggaagc

SEQ ID NO: 8259985 - DNA, 22 bp, Homo sapiens
ggcagctctgctaattgagcct

SEQ ID NO: 8259986 - DNA, 22 bp, Homo sapiens
ggcagctctgatgatgctctgg

SEQ ID NO: 8259987 - DNA, 22 bp, Homo sapiens
ggcagctggggcagtgccctgt

SEQ ID NO: 8259988 - DNA, 22 bp, Homo sapiens
ggcaggtgaggcatgtgcctgg

SEQ ID NO: 8259989 - DNA, 22 bp, Homo sapiens
ggcaggcctgagaggcagggct

SEQ ID NO: 8259990 - DNA, 22 bp, Homo sapiens
ggcaggcgtggtggcctcagaa

SEQ ID NO: 8259991 - DNA, 22 bp, Homo sapiens
ggcaggctgcttgggtcatgtc

SEQ ID NO: 8259992 - DNA, 22 bp, Homo sapiens
ggaggggtggaaggagtgcctg

SEQ ID NO: 8259993 - DNA, 22 bp, Homo sapiens
ggaggggaggtccagctgatct

SEQ ID NO: 8259994 - DNA, 22 bp, Homo sapiens
ggaggggagtctcccaaagccg

SEQ ID NO: 8259995 - DNA, 22 bp, Homo sapiens
ggagggggaattcagccccagc

SEQ ID NO: 8259996 - DNA, 22 bp, Homo sapiens
ggagggggaagaagctaaagac

SEQ ID NO: 8259997 - DNA, 22 bp, Homo sapiens
ggagggggaagaagctaaagac

SEQ ID NO: 8259998 - DNA, 22 bp, Homo sapiens
ggaggtagtctgagtcataggc

SEQ ID NO: 8259999 - DNA, 22 bp, Homo sapiens
ggaggtagcctcaaaagcagct

SEQ ID NO: 8260000 - DNA, 22 bp, Homo sapiens
ggagggtggcagcgtcctgggc

SEQ ID NO: 8260001 - DNA, 20 bp, Homo sapiens
ggagggtggaagaaagcaag

SEQ ID NO: 8260002 - DNA, 22 bp, Homo sapiens
ggaggtggaggttgcagtgagc

SEQ ID NO: 8260003 - DNA, 22 bp, Homo sapiens
ggagggacccactctagaggtg

SEQ ID NO: 8260004 - DNA, 22 bp, Homo sapiens
ggagggagagtgaccctaccaa

SEQ ID NO: 8260005 - DNA, 22 bp, Homo sapiens
ggagggcccctccagtgggcag

SEQ ID NO: 8260006 - DNA, 22 bp, Homo sapiens
ggagggctccctgggagtggat

SEQ ID NO: 8260007 - DNA, 22 bp, Homo sapiens
ggagggctccctgggagtggat

SEQ ID NO: 8260008 - DNA, 22 bp, Homo sapiens
ggagggctgagactggggtctg

SEQ ID NO: 8260009 - DNA, 22 bp, Homo sapiens
ggagggctgagactggggtctg

SEQ ID NO: 8260010 - DNA, 22 bp, Homo sapiens
ggaggcggaggttgcagtgagt

SEQ ID NO: 8260011 - DNA, 22 bp, Homo sapiens
ggaggcggggaaggcatcccat

SEQ ID NO: 8260012 - DNA, 22 bp, Homo sapiens
ggaggcggaggttgcagtgagc

SEQ ID NO: 8260013 - DNA, 22 bp, Homo sapiens
ggaggcctagccagctccagtt

SEQ ID NO: 8260014 - DNA, 22 bp, Homo sapiens
ggaggcctcatcttgccccgtg

SEQ ID NO: 8260015 - DNA, 22 bp, Homo sapiens
ggaggctgctgcctcacgtggg

SEQ ID NO: 8260016 - DNA, 22 bp, Homo sapiens
gctgggccagagcagcagcact

SEQ ID NO: 8260017 - DNA, 22 bp, Homo sapiens
gctgggctcatttgtgtgtctg

SEQ ID NO: 8260018 - DNA, 22 bp, Homo sapiens
gcttagtcaattataaataggc

SEQ ID NO: 8260019 - DNA, 22 bp, Homo sapiens
gcttctggaggagctgggctga

SEQ ID NO: 8260020 - DNA, 22 bp, Homo sapiens
ggaaggggtgggtgagcctcag

SEQ ID NO: 8260021 - DNA, 22 bp, Homo sapiens
ggagctcaccttggagtctctg

SEQ ID NO: 8260022 - DNA, 22 bp, Homo sapiens
ggaggaagcacacggcttgtat

SEQ ID NO: 8260023 - DNA, 22 bp, Homo sapiens
ggaggaagccctcggtgcccca

SEQ ID NO: 8260024 - DNA, 16 bp, Homo sapiens
ggaggaaggcatagtg

SEQ ID NO: 8260025 - DNA, 22 bp, Homo sapiens
ggaggaagggcccaggctttat

SEQ ID NO: 8260026 - DNA, 22 bp, Homo sapiens
ggaggaccccagcagctcccca

SEQ ID NO: 8260027 - DNA, 22 bp, Homo sapiens
ggaggacctgctggccctgcaa

SEQ ID NO: 8260028 - DNA, 22 bp, Homo sapiens
ggaggagcatgagagggtagtg

SEQ ID NO: 8260029 - DNA, 22 bp, Homo sapiens
ggaggagcatgagagggtagtg

SEQ ID NO: 8260030 - DNA, 22 bp, Homo sapiens
ggaggagcccactcaaagggga

SEQ ID NO: 8260031 - DNA, 22 bp, Homo sapiens
ggaggaggcggcagaagttcct

SEQ ID NO: 8260032 - DNA, 22 bp, Homo sapiens
ggaggcagaatagagtgtgggt

SEQ ID NO: 8260033 - DNA, 22 bp, Homo sapiens
ggaggagctgctgtgggggccc

SEQ ID NO: 8260034 - DNA, 22 bp, Homo sapiens
ggaggaggcaagtaccagatgc

SEQ ID NO: 8260035 - DNA, 22 bp, Homo sapiens
ggaggaggcaagtaccagatgc

SEQ ID NO: 8260036 - DNA, 22 bp, Homo sapiens
ggaggccatgaggctctaggtg

SEQ ID NO: 8260037 - DNA, 22 bp, Homo sapiens
ggagaggcttggcccagcctgg

SEQ ID NO: 8260038 - DNA, 22 bp, Homo sapiens
ggagaggtgtattcagtgggtc

SEQ ID NO: 8260039 - DNA, 17 bp, Homo sapiens
ggagatctggcagaggg

SEQ ID NO: 8260040 - DNA, 22 bp, Homo sapiens
ggagaggtgcaggtcagtggca

SEQ ID NO: 8260041 - DNA, 22 bp, Homo sapiens
ggagcctggttactagagcctg

SEQ ID NO: 8260042 - DNA, 20 bp, Homo sapiens
ggagatgcagcccaggtgcc

SEQ ID NO: 8260043 - DNA, 22 bp, Homo sapiens
ggagcctgtgcccaagcccaga

SEQ ID NO: 8260044 - DNA, 19 bp, Homo sapiens
ggagaagcccaggaatcct

SEQ ID NO: 8260045 - DNA, 22 bp, Homo sapiens
ggaaggtttttctcctggtggg

SEQ ID NO: 8260046 - DNA, 22 bp, Homo sapiens
ggagaaggaatattggagtagg

SEQ ID NO: 8260047 - DNA, 22 bp, Homo sapiens
ggagaaggaatattggagtagg

SEQ ID NO: 8260048 - DNA, 22 bp, Homo sapiens
taaatgagggctgacatgattg

SEQ ID NO: 8260049 - DNA, 22 bp, Homo sapiens
taaatgagtaatatagctgttt

SEQ ID NO: 8260050 - DNA, 22 bp, Homo sapiens
taaatgagatgtacataactca

SEQ ID NO: 8260051 - DNA, 22 bp, Homo sapiens
taaaggagtgtgatgaaaggga

SEQ ID NO: 8260052 - DNA, 22 bp, Homo sapiens
taaaggaggagttaatgagact

SEQ ID NO: 8260053 - DNA, 22 bp, Homo sapiens
taaagcagtgcaaaagcgtttt

SEQ ID NO: 8260054 - DNA, 22 bp, Homo sapiens
taaagcagtatgatggaaggat

SEQ ID NO: 8260055 - DNA, 22 bp, Homo sapiens
taaaaccataaggctggaagga

SEQ ID NO: 8260056 - DNA, 22 bp, Homo sapiens
gtttaaataattaggggcctgt

SEQ ID NO: 8260057 - DNA, 22 bp, Homo sapiens
gtgggccttgcagggtgcaggg

SEQ ID NO: 8260058 - DNA, 22 bp, Homo sapiens
gtgggcctgatgctgccatgag

SEQ ID NO: 8260059 - DNA, 22 bp, Homo sapiens
gtgggccagttcctcacaggta

SEQ ID NO: 8260060 - DNA, 22 bp, Homo sapiens
gtgggccaggcgtctaggccct

SEQ ID NO: 8260061 - DNA, 22 bp, Homo sapiens
gtgggctgcccttgaggtcagc

SEQ ID NO: 8260062 - DNA, 22 bp, Homo sapiens
gtggggctggaagatgggtact

SEQ ID NO: 8260063 - DNA, 22 bp, Homo sapiens
gtgggggacccaggtgctgtcc

SEQ ID NO: 8260064 - DNA, 22 bp, Homo sapiens
gtgggggatgctgagttggaaa

SEQ ID NO: 8260065 - DNA, 22 bp, Homo sapiens
gtggggcttcctggggcaagtt

SEQ ID NO: 8260066 - DNA, 22 bp, Homo sapiens
gtgggggcaggcagtgctagga

SEQ ID NO: 8260067 - DNA, 22 bp, Homo sapiens
gtgggcagacagtgctttgcag

SEQ ID NO: 8260068 - DNA, 22 bp, Homo sapiens
gtgggcagattatagatgatgc

SEQ ID NO: 8260069 - DNA, 20 bp, Homo sapiens
gtgggcagatgtgtgcatgg

SEQ ID NO: 8260070 - DNA, 22 bp, Homo sapiens
gtgggcagcaccagggaagtgt

SEQ ID NO: 8260071 - DNA, 22 bp, Homo sapiens
gtgggccacatcccagggctct

SEQ ID NO: 8260072 - DNA, 22 bp, Homo sapiens
gtgggcagttggtgattctcgt

SEQ ID NO: 8260073 - DNA, 19 bp, Homo sapiens
gtgggccaggcagaaggct

SEQ ID NO: 8260074 - DNA, 22 bp, Homo sapiens
gtgggcagcctgtccggagacc

SEQ ID NO: 8260075 - DNA, 22 bp, Homo sapiens
gtgggcagttcaattctgggag

SEQ ID NO: 8260076 - DNA, 22 bp, Homo sapiens
gtgggcagtgtgtcagtatctt

SEQ ID NO: 8260077 - DNA, 22 bp, Homo sapiens
gtgggcaggaggccctgccctg

SEQ ID NO: 8260078 - DNA, 22 bp, Homo sapiens
gtgggcagtggtttgcgcggtc

SEQ ID NO: 8260079 - DNA, 22 bp, Homo sapiens
gtgggcagtggtttgcgcggtc

SEQ ID NO: 8260080 - DNA, 22 bp, Homo sapiens
gtggtcaggggctgtggctatg

SEQ ID NO: 8260081 - DNA, 22 bp, Homo sapiens
gtggtcaggggctgaggtgccc

SEQ ID NO: 8260082 - DNA, 22 bp, Homo sapiens
gtgggtggagactgggtgcaag

SEQ ID NO: 8260083 - DNA, 22 bp, Homo sapiens
gtggggggagctgcaagctgga

SEQ ID NO: 8260084 - DNA, 22 bp, Homo sapiens
gtggggtagatctttctcagga

SEQ ID NO: 8260085 - DNA, 22 bp, Homo sapiens
gtgtaaacaatgaaaacagagc

SEQ ID NO: 8260086 - DNA, 22 bp, Homo sapiens
gtgtcactggaatactgtctgt

SEQ ID NO: 8260087 - DNA, 22 bp, Homo sapiens
gtggtccccagagctgtgtaca

SEQ ID NO: 8260088 - DNA, 22 bp, Homo sapiens
gtggtgagattgctggatcaaa

SEQ ID NO: 8260089 - DNA, 22 bp, Homo sapiens
gtgtccagtcatagcccagggc

SEQ ID NO: 8260090 - DNA, 22 bp, Homo sapiens
gtgtccagagaaactcacagct

SEQ ID NO: 8260091 - DNA, 22 bp, Homo sapiens
gtgtccttttgagggtccacag

SEQ ID NO: 8260092 - DNA, 22 bp, Homo sapiens
gtgtgcaactttcattaatatt

SEQ ID NO: 8260093 - DNA, 22 bp, Homo sapiens
gtgtgtatgtagaactatgtat

SEQ ID NO: 8260094 - DNA, 22 bp, Homo sapiens
gtgtgggcagggccgtgctccc

SEQ ID NO: 8260095 - DNA, 22 bp, Homo sapiens
gtgtgtcctcagtagtggcatg

SEQ ID NO: 8260096 - DNA, 23 bp, Homo sapiens
ggtggcaggagtggatgctgagc

SEQ ID NO: 8260097 - DNA, 22 bp, Homo sapiens
ggtggcaggccctgagcatccc

SEQ ID NO: 8260098 - DNA, 22 bp, Homo sapiens
ggtggcagttacaggggcaaat

SEQ ID NO: 8260099 - DNA, 22 bp, Homo sapiens
ggtggccataggaccagcctgg

SEQ ID NO: 8260100 - DNA, 22 bp, Homo sapiens
ggtggttgcataggccagcagc

SEQ ID NO: 8260101 - DNA, 22 bp, Homo sapiens
ggtggttgcataggccagcagc

SEQ ID NO: 8260102 - DNA, 22 bp, Homo sapiens
ggtggtggtcccgacttgggag

SEQ ID NO: 8260103 - DNA, 22 bp, Homo sapiens
ggtgcaggcggtggggcaagta

SEQ ID NO: 8260104 - DNA, 22 bp, Homo sapiens
ggtgcaggcggtggggcaagta

SEQ ID NO: 8260105 - DNA, 22 bp, Homo sapiens
ggtggcagaggtgcatcagccc

SEQ ID NO: 8260106 - DNA, 22 bp, Homo sapiens
ggtgcaaaagtaatttggtttt

SEQ ID NO: 8260107 - DNA, 22 bp, Homo sapiens
ggtgatcagccttctgatttct

SEQ ID NO: 8260108 - DNA, 22 bp, Homo sapiens
ggtgaggggcgcctctgcccag

SEQ ID NO: 8260109 - DNA, 22 bp, Homo sapiens
ggtgaggggcacctctgcccgg

SEQ ID NO: 8260110 - DNA, 22 bp, Homo sapiens
ggtgaggggctcctctgcccgg

SEQ ID NO: 8260111 - DNA, 22 bp, Homo sapiens
ggtgaggggcgcctctgcccgg

SEQ ID NO: 8260112 - DNA, 22 bp, Homo sapiens
gtacagattaataatatactga

SEQ ID NO: 8260113 - DNA, 20 bp, Homo sapiens
gtatataaccatagtgacta

SEQ ID NO: 8260114 - DNA, 22 bp, Homo sapiens
gtccagtcactgtcaatgttcc

SEQ ID NO: 8260115 - DNA, 19 bp, Homo sapiens
gtcagctggaactctgaaa

SEQ ID NO: 8260116 - DNA, 22 bp, Homo sapiens
gtctggctctggaaggcaaagg

SEQ ID NO: 8260117 - DNA, 22 bp, Homo sapiens
gtctgaatacgtacttgtgaag

SEQ ID NO: 8260118 - DNA, 22 bp, Homo sapiens
gtctgaatgatgagtgggactc

SEQ ID NO: 8260119 - DNA, 22 bp, Homo sapiens
gtccttgagtaagtcatggtgg

SEQ ID NO: 8260120 - DNA, 22 bp, Homo sapiens
gtgggagaagatttggtcatct

SEQ ID NO: 8260121 - DNA, 22 bp, Homo sapiens
gtgggagaagatttggtcatct

SEQ ID NO: 8260122 - DNA, 22 bp, Homo sapiens
gtgggagcatggtcccagtgcc

SEQ ID NO: 8260123 - DNA, 22 bp, Homo sapiens
gtgggagccatttccagtatgc

SEQ ID NO: 8260124 - DNA, 22 bp, Homo sapiens
gtggcctggaaaggctggtctg

SEQ ID NO: 8260125 - DNA, 22 bp, Homo sapiens
gtggcctgcaggcaccttgggg

SEQ ID NO: 8260126 - DNA, 22 bp, Homo sapiens
gtggcctgatgccagccctgtg

SEQ ID NO: 8260127 - DNA, 22 bp, Homo sapiens
gtggcctgagcttcagagttgg

SEQ ID NO: 8260128 - DNA, 20 bp, Homo sapiens
gtggcccttaaagagggaag

SEQ ID NO: 8260129 - DNA, 22 bp, Homo sapiens
gtggccctgtgaacagcgcagt

SEQ ID NO: 8260130 - DNA, 22 bp, Homo sapiens
gtggcccttggagttgtgacct

SEQ ID NO: 8260131 - DNA, 22 bp, Homo sapiens
gtggcccttgaagcagcttcat

SEQ ID NO: 8260132 - DNA, 21 bp, Homo sapiens
gtggccctggtgtggctgcac

SEQ ID NO: 8260133 - DNA, 22 bp, Homo sapiens
gtggccctgtcccaggcctcct

SEQ ID NO: 8260134 - DNA, 22 bp, Homo sapiens
gtggccctggagttgtgacact

SEQ ID NO: 8260135 - DNA, 22 bp, Homo sapiens
gtggccctttgttttgatacct

SEQ ID NO: 8260136 - DNA, 22 bp, Homo sapiens
gtggcagggagaagccattggg

SEQ ID NO: 8260137 - DNA, 22 bp, Homo sapiens
gtggcagggcaatgctccctct

SEQ ID NO: 8260138 - DNA, 22 bp, Homo sapiens
gtggcagggctttgctgttctt

SEQ ID NO: 8260139 - DNA, 22 bp, Homo sapiens
gtggcaggatcacggctcactg

SEQ ID NO: 8260140 - DNA, 22 bp, Homo sapiens
gtggcaggagagacacagccat

SEQ ID NO: 8260141 - DNA, 22 bp, Homo sapiens
gtggcaggagtgggccttgaag

SEQ ID NO: 8260142 - DNA, 22 bp, Homo sapiens
gtggcaggagtgggccttgaag

SEQ ID NO: 8260143 - DNA, 22 bp, Homo sapiens
gtggccaaggtgcagagcagct

SEQ ID NO: 8260144 - DNA, 22 bp, Homo sapiens
gtggcaggggcgggctgttccg

SEQ ID NO: 8260145 - DNA, 22 bp, Homo sapiens
gtggccaggacattgccaggca

SEQ ID NO: 8260146 - DNA, 22 bp, Homo sapiens
gtggccctatttgaggacccca

SEQ ID NO: 8260147 - DNA, 22 bp, Homo sapiens
gtggccctaacaccgtttctca

SEQ ID NO: 8260148 - DNA, 22 bp, Homo sapiens
gtggccctcagcagttgccaag

SEQ ID NO: 8260149 - DNA, 22 bp, Homo sapiens
gtggccctctgatagggtcagg

SEQ ID NO: 8260150 - DNA, 22 bp, Homo sapiens
gtggccctgagccctttgacag

SEQ ID NO: 8260151 - DNA, 21 bp, Homo sapiens
gtggccctgccgcagtgtcca

SEQ ID NO: 8260152 - DNA, 22 bp, Homo sapiens
gtggcccagccctacagaggac

SEQ ID NO: 8260153 - DNA, 22 bp, Homo sapiens
gtggccagaatcttgaggcctt

SEQ ID NO: 8260154 - DNA, 22 bp, Homo sapiens
gtggccagccccatggacagtt

SEQ ID NO: 8260155 - DNA, 22 bp, Homo sapiens
gtggagagagtgacagcatctt

SEQ ID NO: 8260156 - DNA, 22 bp, Homo sapiens
gtggagagcaaataattggaat

SEQ ID NO: 8260157 - DNA, 22 bp, Homo sapiens
gtggagaggaacccagctctgt

SEQ ID NO: 8260158 - DNA, 22 bp, Homo sapiens
gtggagccctggtagggacccc

SEQ ID NO: 8260159 - DNA, 22 bp, Homo sapiens
gtggcagagggtgagctggact

SEQ ID NO: 8260160 - DNA, 22 bp, Homo sapiens
gtggcagaggctgtgaggatgc

SEQ ID NO: 8260161 - DNA, 22 bp, Homo sapiens
gtggcagagccgtgcaggtagg

SEQ ID NO: 8260162 - DNA, 21 bp, Homo sapiens
gtggcaagagtaggcattcat

SEQ ID NO: 8260163 - DNA, 22 bp, Homo sapiens
gtggcaagatgactactcactg

SEQ ID NO: 8260164 - DNA, 22 bp, Homo sapiens
gtggcaaggagcatgaaaagtc

SEQ ID NO: 8260165 - DNA, 22 bp, Homo sapiens
gtggcaagtgttccaagaggcg

SEQ ID NO: 8260166 - DNA, 22 bp, Homo sapiens
gtggcaaggctggaatggaacc

SEQ ID NO: 8260167 - DNA, 22 bp, Homo sapiens
gtgctactagtttcatttttca

SEQ ID NO: 8260168 - DNA, 22 bp, Homo sapiens
gtgcgggggttcccagcagccg

SEQ ID NO: 8260169 - DNA, 22 bp, Homo sapiens
gtgacaggccactgcggctctg

SEQ ID NO: 8260170 - DNA, 22 bp, Homo sapiens
gtgacaggcccagtgggatgca

SEQ ID NO: 8260171 - DNA, 22 bp, Homo sapiens
gtgacagggagtgatatagcag

SEQ ID NO: 8260172 - DNA, 22 bp, Homo sapiens
gtgacaggtatactcaccattg

SEQ ID NO: 8260173 - DNA, 22 bp, Homo sapiens
gtgacagggggcttggtttcta

SEQ ID NO: 8260174 - DNA, 22 bp, Homo sapiens
gtgacaggcatggggtcatgca

SEQ ID NO: 8260175 - DNA, 22 bp, Homo sapiens
gtgacaggatagtcagctttgt

SEQ ID NO: 8260176 - DNA, 20 bp, Homo sapiens
gtgaagggagtcaggtgtgc

SEQ ID NO: 8260177 - DNA, 22 bp, Homo sapiens
gtgacaaaaacactgattattt

SEQ ID NO: 8260178 - DNA, 22 bp, Homo sapiens
gtgacaaatgcaaattgggctg

SEQ ID NO: 8260179 - DNA, 22 bp, Homo sapiens
gtgacaaaggtcaagcttttga

SEQ ID NO: 8260180 - DNA, 22 bp, Homo sapiens
tctgtccatttacagatatgca

SEQ ID NO: 8260181 - DNA, 22 bp, Homo sapiens
tctgtagcattcaccagccctg

SEQ ID NO: 8260182 - DNA, 22 bp, Homo sapiens
tctgtcaatatatgtgctgcag

SEQ ID NO: 8260183 - DNA, 22 bp, Homo sapiens
tctgtacacttcagcatgcatc

SEQ ID NO: 8260184 - DNA, 22 bp, Homo sapiens
tctgtaatcaagatatttgaga

SEQ ID NO: 8260185 - DNA, 19 bp, Homo sapiens
tctggggtgtggcctggca

SEQ ID NO: 8260186 - DNA, 22 bp, Homo sapiens
tctggggttaagcccaggaatg

SEQ ID NO: 8260187 - DNA, 18 bp, Homo sapiens
tctggggtgtgctgtgta

SEQ ID NO: 8260188 - DNA, 22 bp, Homo sapiens
tctggggtgcagcctggacata

SEQ ID NO: 8260189 - DNA, 22 bp, Homo sapiens
tctggggtgtgacctgagcatg

SEQ ID NO: 8260190 - DNA, 20 bp, Homo sapiens
tctggggtgaagcccaggaa

SEQ ID NO: 8260191 - DNA, 22 bp, Homo sapiens
tctggggtgaggcctggttatc

SEQ ID NO: 8260192 - DNA, 22 bp, Homo sapiens
tctggggtgcagcctaggcatc

SEQ ID NO: 8260193 - DNA, 22 bp, Homo sapiens
tctgggggttaagtgaggacaa

SEQ ID NO: 8260194 - DNA, 22 bp, Homo sapiens
tctgtgctaatgcttcacaata

SEQ ID NO: 8260195 - DNA, 20 bp, Homo sapiens
tctgtgcagtggaggggcag

SEQ ID NO: 8260196 - DNA, 22 bp, Homo sapiens
tctgtctgcttcacttgcattt

SEQ ID NO: 8260197 - DNA, 22 bp, Homo sapiens
tctgtctgagggagtgacattt

SEQ ID NO: 8260198 - DNA, 22 bp, Homo sapiens
tctgtctgccttgtgagggcac

SEQ ID NO: 8260199 - DNA, 21 bp, Homo sapiens
tctgtgctgccgtcaacatcc

SEQ ID NO: 8260200 - DNA, 22 bp, Homo sapiens
tctgtggggagcaggagccggg

SEQ ID NO: 8260201 - DNA, 22 bp, Homo sapiens
tctgtgggggtgtcttaaccta

SEQ ID NO: 8260202 - DNA, 22 bp, Homo sapiens
tctgtgggcatttataatctgg

SEQ ID NO: 8260203 - DNA, 22 bp, Homo sapiens
tctgtgggtttcagggggctgt

SEQ ID NO: 8260204 - DNA, 23 bp, Homo sapiens
tctgttcttttagctgatcattt

SEQ ID NO: 8260205 - DNA, 22 bp, Homo sapiens
tcttagcaaattttctttgcct

SEQ ID NO: 8260206 - DNA, 22 bp, Homo sapiens
tcttctgttttagattgcatac

SEQ ID NO: 8260207 - DNA, 22 bp, Homo sapiens
tcttctttttgtcccacagaat

SEQ ID NO: 8260208 - DNA, 22 bp, Homo sapiens
tcttcatgttgcttattctggg

SEQ ID NO: 8260209 - DNA, 22 bp, Homo sapiens
tcttcaggaagggaaatcatcc

SEQ ID NO: 8260210 - DNA, 22 bp, Homo sapiens
tcttcatgccaaatgagttttg

SEQ ID NO: 8260211 - DNA, 22 bp, Homo sapiens
tcttcatctcagattaacagga

SEQ ID NO: 8260212 - DNA, 22 bp, Homo sapiens
tctttaattgtggaagagcagc

SEQ ID NO: 8260213 - DNA, 22 bp, Homo sapiens
tctttaatgtgattgtaattat

SEQ ID NO: 8260214 - DNA, 22 bp, Homo sapiens
tcttgaataagtttcatgagct

SEQ ID NO: 8260215 - DNA, 22 bp, Homo sapiens
tctttatttaagtctgttgtaa

SEQ ID NO: 8260216 - DNA, 22 bp, Homo sapiens
tctttatgcctacctgggaaga

SEQ ID NO: 8260217 - DNA, 22 bp, Homo sapiens
tctttatgcacataaagaaact

SEQ ID NO: 8260218 - DNA, 22 bp, Homo sapiens
tctttatgtaagactgggcttg

SEQ ID NO: 8260219 - DNA, 22 bp, Homo sapiens
tctttatggaaaatgaatggca

SEQ ID NO: 8260220 - DNA, 22 bp, Homo sapiens
tctttatgtttgaaagtacaat

SEQ ID NO: 8260221 - DNA, 22 bp, Homo sapiens
tctttatgtttactccagctga

SEQ ID NO: 8260222 - DNA, 22 bp, Homo sapiens
tctttatgttgatttcctcagg

SEQ ID NO: 8260223 - DNA, 22 bp, Homo sapiens
tctttattgctactggtttgtc

SEQ ID NO: 8260224 - DNA, 21 bp, Homo sapiens
tctttatgacttgcccatttg

SEQ ID NO: 8260225 - DNA, 22 bp, Homo sapiens
tctttatgagaaaaagattgta

SEQ ID NO: 8260226 - DNA, 22 bp, Homo sapiens
tctgacttgcatcttaaaggag

SEQ ID NO: 8260227 - DNA, 22 bp, Homo sapiens
tctgactagggacttggtgtat

SEQ ID NO: 8260228 - DNA, 22 bp, Homo sapiens
tctgagcccagtgagtctcgca

SEQ ID NO: 8260229 - DNA, 22 bp, Homo sapiens
tctgagcccctagaactgagcg

SEQ ID NO: 8260230 - DNA, 22 bp, Homo sapiens
tctgagccataagagtacagga

SEQ ID NO: 8260231 - DNA, 22 bp, Homo sapiens
tctgagccacctgccagtgctg

SEQ ID NO: 8260232 - DNA, 22 bp, Homo sapiens
tctgagccagacaagacagcca

SEQ ID NO: 8260233 - DNA, 22 bp, Homo sapiens
tctgagccagggtctcctccct

SEQ ID NO: 8260234 - DNA, 22 bp, Homo sapiens
tctgagccagccacctccttca

SEQ ID NO: 8260235 - DNA, 22 bp, Homo sapiens
tctgagccacagatgtcctgtt

SEQ ID NO: 8260236 - DNA, 22 bp, Homo sapiens
tctgagccacctgagcccatgg

SEQ ID NO: 8260237 - DNA, 22 bp, Homo sapiens
tctgagccaatttctgtgtcca

SEQ ID NO: 8260238 - DNA, 22 bp, Homo sapiens
tctgagccaaaataaacagcat

SEQ ID NO: 8260239 - DNA, 22 bp, Homo sapiens
tctgagctatgtaagacttgga

SEQ ID NO: 8260240 - DNA, 22 bp, Homo sapiens
tctgagctaatcctgttgccga

SEQ ID NO: 8260241 - DNA, 22 bp, Homo sapiens
tctgagcctatttcaaattcct

SEQ ID NO: 8260242 - DNA, 22 bp, Homo sapiens
tctgagccgtatggcttggcta

SEQ ID NO: 8260243 - DNA, 22 bp, Homo sapiens
tctgagccctgctgtttattga

SEQ ID NO: 8260244 - DNA, 22 bp, Homo sapiens
tctgagccctcttttgcagccc

SEQ ID NO: 8260245 - DNA, 22 bp, Homo sapiens
tctgagctgctaggtatgcatt

SEQ ID NO: 8260246 - DNA, 22 bp, Homo sapiens
tctgatcctttgtcttcttggg

SEQ ID NO: 8260247 - DNA, 22 bp, Homo sapiens
tctgccaacccgtattggtgcc

SEQ ID NO: 8260248 - DNA, 22 bp, Homo sapiens
tctgccatgggtatttaggatt

SEQ ID NO: 8260249 - DNA, 18 bp, Homo sapiens
tctgccatgtgaggacac

SEQ ID NO: 8260250 - DNA, 22 bp, Homo sapiens
tctgccatgtgaggatatagga

SEQ ID NO: 8260251 - DNA, 22 bp, Homo sapiens
tctgccatcttacatggtcact

SEQ ID NO: 8260252 - DNA, 22 bp, Homo sapiens
tctgggagaagctgatgtgaag

SEQ ID NO: 8260253 - DNA, 22 bp, Homo sapiens
tctgggaggtaaccatgctgat

SEQ ID NO: 8260254 - DNA, 22 bp, Homo sapiens
tctgggagagtcacaggcattg

SEQ ID NO: 8260255 - DNA, 22 bp, Homo sapiens
tctgggagtgtgtctggccatc

SEQ ID NO: 8260256 - DNA, 22 bp, Homo sapiens
tctgggagtttctgtgggagct

SEQ ID NO: 8260257 - DNA, 22 bp, Homo sapiens
tctggctgaattagccttgggt

SEQ ID NO: 8260258 - DNA, 22 bp, Homo sapiens
tctggccccggtcttcacagct

SEQ ID NO: 8260259 - DNA, 22 bp, Homo sapiens
tctggccctatggcatgtacct

SEQ ID NO: 8260260 - DNA, 21 bp, Homo sapiens
tctggccctcacagtcacacc

SEQ ID NO: 8260261 - DNA, 22 bp, Homo sapiens
tctggctgacatcctgtatgag

SEQ ID NO: 8260262 - DNA, 22 bp, Homo sapiens
tctggcccaagttttcggtgag

SEQ ID NO: 8260263 - DNA, 22 bp, Homo sapiens
tctggagtctaaagaaccaaaa

SEQ ID NO: 8260264 - DNA, 22 bp, Homo sapiens
tctggagtcctggaatcagcta

SEQ ID NO: 8260265 - DNA, 22 bp, Homo sapiens
tctggagtccagatccatttgg

SEQ ID NO: 8260266 - DNA, 22 bp, Homo sapiens
tctggagtctgagatctgagga

SEQ ID NO: 8260267 - DNA, 22 bp, Homo sapiens
tctggagtctggtggttatggt

SEQ ID NO: 8260268 - DNA, 22 bp, Homo sapiens
tctggagtggaggtgccttggg

SEQ ID NO: 8260269 - DNA, 22 bp, Homo sapiens
tctggagtggagctgatcattt

SEQ ID NO: 8260270 - DNA, 22 bp, Homo sapiens
tctggagtggacccagagcact

SEQ ID NO: 8260271 - DNA, 22 bp, Homo sapiens
tctggagtgaatgaagtagtgt

SEQ ID NO: 8260272 - DNA, 22 bp, Homo sapiens
tctggagtgccctgctctgccc

SEQ ID NO: 8260273 - DNA, 22 bp, Homo sapiens
tctggagtatgtccctggtgaa

SEQ ID NO: 8260274 - DNA, 22 bp, Homo sapiens
tctggagtatgtgtgaacggtg

SEQ ID NO: 8260275 - DNA, 21 bp, Homo sapiens
tctggagtcatctttaccata

SEQ ID NO: 8260276 - DNA, 20 bp, Homo sapiens
tctggagtagagcacaggca

SEQ ID NO: 8260277 - DNA, 22 bp, Homo sapiens
tctggagtaggacctgaaaata

SEQ ID NO: 8260278 - DNA, 22 bp, Homo sapiens
tctggagtagggtctgggaatt

SEQ ID NO: 8260279 - DNA, 22 bp, Homo sapiens
tctggagtaattacagtgactg

SEQ ID NO: 8260280 - DNA, 22 bp, Homo sapiens
tctggagtaactctgtttctgg

SEQ ID NO: 8260281 - DNA, 22 bp, Homo sapiens
tctggagatcatgtggggtgga

SEQ ID NO: 8260282 - DNA, 22 bp, Homo sapiens
tctggaggggtttagagggaca

SEQ ID NO: 8260283 - DNA, 22 bp, Homo sapiens
tctggagttagttataatggtt

SEQ ID NO: 8260284 - DNA, 22 bp, Homo sapiens
tctggagttactgctggctttg

SEQ ID NO: 8260285 - DNA, 22 bp, Homo sapiens
tctggagttcctgcaggctgtg

SEQ ID NO: 8260286 - DNA, 22 bp, Homo sapiens
tctggagtgtttctaattactg

SEQ ID NO: 8260287 - DNA, 22 bp, Homo sapiens
tctggagtggcagtcatctgaa

SEQ ID NO: 8260288 - DNA, 22 bp, Homo sapiens
tctggagtgggactttgcatct

SEQ ID NO: 8260289 - DNA, 22 bp, Homo sapiens
tctggagtgtccagttctactc

SEQ ID NO: 8260290 - DNA, 22 bp, Homo sapiens
tctggagtgtgtgtattcagct

SEQ ID NO: 8260291 - DNA, 22 bp, Homo sapiens
tctggagttgaagttcttcccc

SEQ ID NO: 8260292 - DNA, 22 bp, Homo sapiens
tctggagttgagagtgtgcgag

SEQ ID NO: 8260293 - DNA, 22 bp, Homo sapiens
tctggagttgcatgttttggct

SEQ ID NO: 8260294 - DNA, 22 bp, Homo sapiens
tctggagttgtgcagtggacct

SEQ ID NO: 8260295 - DNA, 22 bp, Homo sapiens
tctggagtttgagcacttcaat

SEQ ID NO: 8260296 - DNA, 22 bp, Homo sapiens
tctggagttttttctgtctgtg

SEQ ID NO: 8260297 - DNA, 22 bp, Homo sapiens
tctggagtttgaggacaagctt

SEQ ID NO: 8260298 - DNA, 22 bp, Homo sapiens
tctgctgctgcagctacactat

SEQ ID NO: 8260299 - DNA, 22 bp, Homo sapiens
tctgctgctgcagctacactat

SEQ ID NO: 8260300 - DNA, 22 bp, Homo sapiens
tctgctggtgatgacctcataa

SEQ ID NO: 8260301 - DNA, 22 bp, Homo sapiens
tctgctggttccgaattaggcc

SEQ ID NO: 8260302 - DNA, 22 bp, Homo sapiens
tctgctggtcaaggctgggtcc

SEQ ID NO: 8260303 - DNA, 22 bp, Homo sapiens
tctgctggtcaaggctgggtcc

SEQ ID NO: 8260304 - DNA, 22 bp, Homo sapiens
tctgctgccatgcagagcagta

SEQ ID NO: 8260305 - DNA, 22 bp, Homo sapiens
tctggaataggtcctgagtatt

SEQ ID NO: 8260306 - DNA, 22 bp, Homo sapiens
tctggaattgctgtgtgagttc

SEQ ID NO: 8260307 - DNA, 22 bp, Homo sapiens
tctcctactcactcaaggcttg

SEQ ID NO: 8260308 - DNA, 23 bp, Homo sapiens
tctcctcctagatacagtcatgg

SEQ ID NO: 8260309 - DNA, 22 bp, Homo sapiens
tctccttccaacaaaaggtcac

SEQ ID NO: 8260310 - DNA, 22 bp, Homo sapiens
tctcaggctcttggaacctgtt

SEQ ID NO: 8260311 - DNA, 22 bp, Homo sapiens
tctcaggctgacattgggactc

SEQ ID NO: 8260312 - DNA, 19 bp, Homo sapiens
tctcaggctgggcggctgc

SEQ ID NO: 8260313 - DNA, 22 bp, Homo sapiens
tctcaggctgtgtgtggaggac

SEQ ID NO: 8260314 - DNA, 22 bp, Homo sapiens
tctcagggagcccagtacttac

SEQ ID NO: 8260315 - DNA, 22 bp, Homo sapiens
tctcaggcttcctggtgctgtg

SEQ ID NO: 8260316 - DNA, 22 bp, Homo sapiens
tctcaggctagtaaaagatggg

SEQ ID NO: 8260317 - DNA, 22 bp, Homo sapiens
tctcaggctcctgacatatatg

SEQ ID NO: 8260318 - DNA, 22 bp, Homo sapiens
tctcaggctaccttgcacaagg

SEQ ID NO: 8260319 - DNA, 21 bp, Homo sapiens
tctcaggcgagaattctttta

SEQ ID NO: 8260320 - DNA, 22 bp, Homo sapiens
tctcaggcccctgagtttctct

SEQ ID NO: 8260321 - DNA, 20 bp, Homo sapiens
tctcaggccccctccttgct

SEQ ID NO: 8260322 - DNA, 22 bp, Homo sapiens
tctcagctcagcttccacagag

SEQ ID NO: 8260323 - DNA, 22 bp, Homo sapiens
tctcatggtttgtgattcaaat

SEQ ID NO: 8260324 - DNA, 17 bp, Homo sapiens
tctcagtgactgatagc

SEQ ID NO: 8260325 - DNA, 23 bp, Homo sapiens
tctcagtgaatctcagaattcgc

SEQ ID NO: 8260326 - DNA, 22 bp, Homo sapiens
tctcagtgactgctgggtcccc

SEQ ID NO: 8260327 - DNA, 22 bp, Homo sapiens
tctcagtgatggcccatttgga

SEQ ID NO: 8260328 - DNA, 22 bp, Homo sapiens
tctcagtgcagcttgacagaga

SEQ ID NO: 8260329 - DNA, 22 bp, Homo sapiens
tctcagtgcagcaaggaattta

SEQ ID NO: 8260330 - DNA, 22 bp, Homo sapiens
tctcagtggacgtgtctgtctt

SEQ ID NO: 8260331 - DNA, 22 bp, Homo sapiens
tctgaaattttagttatagaaa

SEQ ID NO: 8260332 - DNA, 22 bp, Homo sapiens
tctgaaataaatgcactgttag

SEQ ID NO: 8260333 - DNA, 22 bp, Homo sapiens
tctctgtggcatccactcaact

SEQ ID NO: 8260334 - DNA, 22 bp, Homo sapiens
tctctgtggtatgtcatagcaa

SEQ ID NO: 8260335 - DNA, 22 bp, Homo sapiens
tctctgagttctcctccagccc

SEQ ID NO: 8260336 - DNA, 22 bp, Homo sapiens
tctctggggtagggcccaggac

SEQ ID NO: 8260337 - DNA, 22 bp, Homo sapiens
tctctgagaagttcctttgtga

SEQ ID NO: 8260338 - DNA, 20 bp, Homo sapiens
tctctgagcttctcttgggg

SEQ ID NO: 8260339 - DNA, 22 bp, Homo sapiens
tctctgagcccctgcctctttc

SEQ ID NO: 8260340 - DNA, 23 bp, Homo sapiens
tctctgagccatagcagtcccaa

SEQ ID NO: 8260341 - DNA, 22 bp, Homo sapiens
tctctgagacagtagcctctgc

SEQ ID NO: 8260342 - DNA, 20 bp, Homo sapiens
tctctatgaagtcaacagga

SEQ ID NO: 8260343 - DNA, 22 bp, Homo sapiens
tctagtgttttggaacatggaa

SEQ ID NO: 8260344 - DNA, 22 bp, Homo sapiens
tctaacttgaactcatgactgt

SEQ ID NO: 8260345 - DNA, 22 bp, Homo sapiens
tctaacttagggaatactttag

SEQ ID NO: 8260346 - DNA, 22 bp, Homo sapiens
tctaattgcaattctcagagat

SEQ ID NO: 8260347 - DNA, 22 bp, Homo sapiens
tctagaaaaacaaagtatctga

SEQ ID NO: 8260348 - DNA, 22 bp, Homo sapiens
tctagaaaaaaactgctgtgga

SEQ ID NO: 8260349 - DNA, 23 bp, Homo sapiens
tctagaaaatgaaagaatgcagt

SEQ ID NO: 8260350 - DNA, 22 bp, Homo sapiens
tctagaaacaggtttctagaaa

SEQ ID NO: 8260351 - DNA, 22 bp, Homo sapiens
tctagaaaaccaatattacatg

SEQ ID NO: 8260352 - DNA, 22 bp, Homo sapiens
tccttgagaggacagagccata

SEQ ID NO: 8260353 - DNA, 22 bp, Homo sapiens
tccttaggtatttagcatgaat

SEQ ID NO: 8260354 - DNA, 22 bp, Homo sapiens
tccttagggatttttccagtca

SEQ ID NO: 8260355 - DNA, 22 bp, Homo sapiens
tccttaggcaatttgggagagt

SEQ ID NO: 8260356 - DNA, 22 bp, Homo sapiens
tccttaggaaaatgatgagggg

SEQ ID NO: 8260357 - DNA, 22 bp, Homo sapiens
tctaaagacactttttacaggg

SEQ ID NO: 8260358 - DNA, 22 bp, Homo sapiens
tcctgggactctgcctcaggct

SEQ ID NO: 8260359 - DNA, 22 bp, Homo sapiens
tcctgggaggcaggaccccttt

SEQ ID NO: 8260360 - DNA, 22 bp, Homo sapiens
tcctgggaagtggctggctgag

SEQ ID NO: 8260361 - DNA, 21 bp, Homo sapiens
tcctgggagtctgagatcctg

SEQ ID NO: 8260362 - DNA, 21 bp, Homo sapiens
tcctggggggtaggtgagttt

SEQ ID NO: 8260363 - DNA, 22 bp, Homo sapiens
tcctggggttttggccgcagct

SEQ ID NO: 8260364 - DNA, 22 bp, Homo sapiens
tcctggatcagcgggggcaggc

SEQ ID NO: 8260365 - DNA, 22 bp, Homo sapiens
tcctggagccaatgtgctgctg

SEQ ID NO: 8260366 - DNA, 22 bp, Homo sapiens
tgcagcagcctcatctggtttc

SEQ ID NO: 8260367 - DNA, 22 bp, Homo sapiens
tgcagcagggacctctatgtga

SEQ ID NO: 8260368 - DNA, 22 bp, Homo sapiens
tgcagcagagtgggcctgggtg

SEQ ID NO: 8260369 - DNA, 22 bp, Homo sapiens
tgcagctctgggtgtagaggct

SEQ ID NO: 8260370 - DNA, 22 bp, Homo sapiens
tgcagctctggggtaaggggtg

SEQ ID NO: 8260371 - DNA, 22 bp, Homo sapiens
tgcagctctgcatggctggttc

SEQ ID NO: 8260372 - DNA, 22 bp, Homo sapiens
tgcagctcattggtgtcctggt

SEQ ID NO: 8260373 - DNA, 22 bp, Homo sapiens
tgcagctcattgctggggtctg

SEQ ID NO: 8260374 - DNA, 22 bp, Homo sapiens
tgcagctcaggattctcagggc

SEQ ID NO: 8260375 - DNA, 22 bp, Homo sapiens
tgcagctcatattagagagaag

SEQ ID NO: 8260376 - DNA, 19 bp, Homo sapiens
tgcagctcagggcaggggc

SEQ ID NO: 8260377 - DNA, 22 bp, Homo sapiens
tgcagctcgggcttagggtggg

SEQ ID NO: 8260378 - DNA, 22 bp, Homo sapiens
tgcagctctgaacagtcatgaa

SEQ ID NO: 8260379 - DNA, 22 bp, Homo sapiens
tgcagctcctctggctgcctga

SEQ ID NO: 8260380 - DNA, 22 bp, Homo sapiens
tgcagctcctgtgctgagtgtg

SEQ ID NO: 8260381 - DNA, 22 bp, Homo sapiens
tgcagctcaagctggtgaggtg

SEQ ID NO: 8260382 - DNA, 22 bp, Homo sapiens
tgcaggagccttggacttgaaa

SEQ ID NO: 8260383 - DNA, 22 bp, Homo sapiens
tgcaggagggagggttacagtt

SEQ ID NO: 8260384 - DNA, 22 bp, Homo sapiens
tgcaggagtccaatcaggagac

SEQ ID NO: 8260385 - DNA, 22 bp, Homo sapiens
tgcaggaggattttgtggagct

SEQ ID NO: 8260386 - DNA, 22 bp, Homo sapiens
tgcaggcctcagacttagccat

SEQ ID NO: 8260387 - DNA, 21 bp, Homo sapiens
tgcaggagtgtaatgtgaccc

SEQ ID NO: 8260388 - DNA, 21 bp, Homo sapiens
tgcaggagtctgtgagtcagg

SEQ ID NO: 8260389 - DNA, 22 bp, Homo sapiens
tgcaggagacataatagggact

SEQ ID NO: 8260390 - DNA, 22 bp, Homo sapiens
tgcaggagagtgagtcagtagg

SEQ ID NO: 8260391 - DNA, 22 bp, Homo sapiens
tgcaggagcagagatggctgga

SEQ ID NO: 8260392 - DNA, 22 bp, Homo sapiens
tgcaaacatccgactgaaagcc

SEQ ID NO: 8260393 - DNA, 22 bp, Homo sapiens
tgcaaacatcaatggcctgagc

SEQ ID NO: 8260394 - DNA, 22 bp, Homo sapiens
tgcaaacaggcatttcacaaac

SEQ ID NO: 8260395 - DNA, 22 bp, Homo sapiens
tgcaaacagttaagatgcaggc

SEQ ID NO: 8260396 - DNA, 22 bp, Homo sapiens
tgcaaacaggagagtaagtata

SEQ ID NO: 8260397 - DNA, 22 bp, Homo sapiens
tgcaaacagccttgaaagaggg

SEQ ID NO: 8260398 - DNA, 22 bp, Homo sapiens
tgcaaacagaaagtttattgtg

SEQ ID NO: 8260399 - DNA, 20 bp, Homo sapiens
tgcaaacattacttgggtgt

SEQ ID NO: 8260400 - DNA, 22 bp, Homo sapiens
tgcaaactgggacactattcaa

SEQ ID NO: 8260401 - DNA, 22 bp, Homo sapiens
tgcaaactgggatactattcaa

SEQ ID NO: 8260402 - DNA, 22 bp, Homo sapiens
tgcaaacaccacagagacaatt

SEQ ID NO: 8260403 - DNA, 22 bp, Homo sapiens
tgcaaacacttcaacgtgcatc

SEQ ID NO: 8260404 - DNA, 22 bp, Homo sapiens
tgcaaacagaaaagctactttg

SEQ ID NO: 8260405 - DNA, 20 bp, Homo sapiens
tgcaaacacagagtgtatga

SEQ ID NO: 8260406 - DNA, 22 bp, Homo sapiens
tgcaaacaatttcctataaagt

SEQ ID NO: 8260407 - DNA, 17 bp, Homo sapiens
tgcaaacaatcacatat

SEQ ID NO: 8260408 - DNA, 17 bp, Homo sapiens
tgcaaacaatcacatat

SEQ ID NO: 8260409 - DNA, 22 bp, Homo sapiens
tgcaaacaactgtttaatgctg

SEQ ID NO: 8260410 - DNA, 22 bp, Homo sapiens
tgcaagatattatctttgctgc

SEQ ID NO: 8260411 - DNA, 22 bp, Homo sapiens
tgatgctgagcctgggactgac

SEQ ID NO: 8260412 - DNA, 23 bp, Homo sapiens
tgatgggaaggaacgactaccac

SEQ ID NO: 8260413 - DNA, 20 bp, Homo sapiens
tgatccctggcggcctttcc

SEQ ID NO: 8260414 - DNA, 22 bp, Homo sapiens
tgatccctcacttctctttggg

SEQ ID NO: 8260415 - DNA, 22 bp, Homo sapiens
tgatccctggacttgagtaagt

SEQ ID NO: 8260416 - DNA, 22 bp, Homo sapiens
tgatccctgattgccttgactc

SEQ ID NO: 8260417 - DNA, 22 bp, Homo sapiens
tgatcccttctccttcccttgg

SEQ ID NO: 8260418 - DNA, 21 bp, Homo sapiens
tgatcctttcccccatgttgc

SEQ ID NO: 8260419 - DNA, 22 bp, Homo sapiens
tgatcactttggaagttggggg

SEQ ID NO: 8260420 - DNA, 22 bp, Homo sapiens
tgcctgaggagtcagggcaggt

SEQ ID NO: 8260421 - DNA, 22 bp, Homo sapiens
tgcctgagggagtaagagtcct

SEQ ID NO: 8260422 - DNA, 22 bp, Homo sapiens
tgcctcagctgaggccgctcca

SEQ ID NO: 8260423 - DNA, 18 bp, Homo sapiens
tgcctggaaggaacagga

SEQ ID NO: 8260424 - DNA, 19 bp, Homo sapiens
tgcctggcaccagctccac

SEQ ID NO: 8260425 - DNA, 22 bp, Homo sapiens
tgcctggcagcttgaaagaaat

SEQ ID NO: 8260426 - DNA, 19 bp, Homo sapiens
tgccagctcacaggagctc

SEQ ID NO: 8260427 - DNA, 22 bp, Homo sapiens
tgcccaggctggagtgcagagg

SEQ ID NO: 8260428 - DNA, 19 bp, Homo sapiens
tgcccaggccaggttgggc

SEQ ID NO: 8260429 - DNA, 20 bp, Homo sapiens
tgccccaggcctgcacctgc

SEQ ID NO: 8260430 - DNA, 22 bp, Homo sapiens
tgccccagactctgctcacctc

SEQ ID NO: 8260431 - DNA, 22 bp, Homo sapiens
tgccccagacctactgaatggg

SEQ ID NO: 8260432 - DNA, 22 bp, Homo sapiens
tgccccaggtgctgaggttgga

SEQ ID NO: 8260433 - DNA, 23 bp, Homo sapiens
tgcccagtgcctttgcccatgca

SEQ ID NO: 8260434 - DNA, 22 bp, Homo sapiens
tgcccagtctccgggccagccc

SEQ ID NO: 8260435 - DNA, 20 bp, Homo sapiens
tgcccagcaagagtgcagtt

SEQ ID NO: 8260436 - DNA, 22 bp, Homo sapiens
tgcagggattagaggccgggga

SEQ ID NO: 8260437 - DNA, 23 bp, Homo sapiens
tgcagggcaagttagagacccca

SEQ ID NO: 8260438 - DNA, 22 bp, Homo sapiens
tgcagggattgttggcatccat

SEQ ID NO: 8260439 - DNA, 22 bp, Homo sapiens
tgcagggaagtcccagctcctg

SEQ ID NO: 8260440 - DNA, 22 bp, Homo sapiens
tgcagggaaagggcactgggct

SEQ ID NO: 8260441 - DNA, 22 bp, Homo sapiens
tgcaggtggcagcggggcacca

SEQ ID NO: 8260442 - DNA, 19 bp, Homo sapiens
tgcagggctgcgcctgggg

SEQ ID NO: 8260443 - DNA, 22 bp, Homo sapiens
tgcaggggcttgtctgggcctg

SEQ ID NO: 8260444 - DNA, 22 bp, Homo sapiens
tgcaggtgtctccagggcaggt

SEQ ID NO: 8260445 - DNA, 22 bp, Homo sapiens
tgcaggtgtctgggggcaacag

SEQ ID NO: 8260446 - DNA, 22 bp, Homo sapiens
tgcattcctttctaggatagct

SEQ ID NO: 8260447 - DNA, 22 bp, Homo sapiens
tgcattcctttgtctgttaaag

SEQ ID NO: 8260448 - DNA, 22 bp, Homo sapiens
tgcattcctttagcagatttga

SEQ ID NO: 8260449 - DNA, 21 bp, Homo sapiens
tgcattcctccatccaacagg

SEQ ID NO: 8260450 - DNA, 22 bp, Homo sapiens
tgcattgggagtcagtgctgaa

SEQ ID NO: 8260451 - DNA, 22 bp, Homo sapiens
tgcatttccagatttctggagt

SEQ ID NO: 8260452 - DNA, 22 bp, Homo sapiens
tgcatttcagaagaaaattcgg

SEQ ID NO: 8260453 - DNA, 22 bp, Homo sapiens
tgcatttcagaagaaaattcgg

SEQ ID NO: 8260454 - DNA, 22 bp, Homo sapiens
tgcatttatttgaattgatcta

SEQ ID NO: 8260455 - DNA, 22 bp, Homo sapiens
tgccagagagtggctgggtgtc

SEQ ID NO: 8260456 - DNA, 22 bp, Homo sapiens
tgcagttcaaggttgtacagct

SEQ ID NO: 8260457 - DNA, 22 bp, Homo sapiens
tgcatggacgtgacttggccaa

SEQ ID NO: 8260458 - DNA, 22 bp, Homo sapiens
tgcatggaacggtctcctggtc

SEQ ID NO: 8260459 - DNA, 22 bp, Homo sapiens
tgcattccatgtgtttcctgag

SEQ ID NO: 8260460 - DNA, 23 bp, Homo sapiens
tgcattcctcacagggcagaaga

SEQ ID NO: 8260461 - DNA, 22 bp, Homo sapiens
tgcattcctccacctcctgcac

SEQ ID NO: 8260462 - DNA, 22 bp, Homo sapiens
tgcattccacacccatagagat

SEQ ID NO: 8260463 - DNA, 22 bp, Homo sapiens
tgcattccacagaagggaaaac

SEQ ID NO: 8260464 - DNA, 22 bp, Homo sapiens
tgcattccacataaagcgataa

SEQ ID NO: 8260465 - DNA, 22 bp, Homo sapiens
tgcattccacagtagtattttg

SEQ ID NO: 8260466 - DNA, 22 bp, Homo sapiens
tgcatggtaaccaggatgtcta

SEQ ID NO: 8260467 - DNA, 22 bp, Homo sapiens
tgcatggagctgtctgcatggt

SEQ ID NO: 8260468 - DNA, 22 bp, Homo sapiens
tgcatggatatataccctaggc

SEQ ID NO: 8260469 - DNA, 22 bp, Homo sapiens
tgaggggccagaccccacctag

SEQ ID NO: 8260470 - DNA, 22 bp, Homo sapiens
tgaggggcatgtgtttacacat

SEQ ID NO: 8260471 - DNA, 19 bp, Homo sapiens
tgaggggctcacagtctca

SEQ ID NO: 8260472 - DNA, 22 bp, Homo sapiens
tgaggggcgctggcaggttcct

SEQ ID NO: 8260473 - DNA, 22 bp, Homo sapiens
tgagtcacacatttcttcatac

SEQ ID NO: 8260474 - DNA, 22 bp, Homo sapiens
tgagggagagggcgaaaatgaa

SEQ ID NO: 8260475 - DNA, 22 bp, Homo sapiens
tgagggaggcctccatctgcca

SEQ ID NO: 8260476 - DNA, 20 bp, Homo sapiens
tgagggagtattgatttccc

SEQ ID NO: 8260477 - DNA, 22 bp, Homo sapiens
tgagggagtcatgattaaggaa

SEQ ID NO: 8260478 - DNA, 22 bp, Homo sapiens
tgagggaggccctttgagcaga

SEQ ID NO: 8260479 - DNA, 22 bp, Homo sapiens
tgagggagctgacctttctgtg

SEQ ID NO: 8260480 - DNA, 22 bp, Homo sapiens
tgagggagcacacactgaagtg

SEQ ID NO: 8260481 - DNA, 22 bp, Homo sapiens
tgaggggcagagaggtgtccag

SEQ ID NO: 8260482 - DNA, 22 bp, Homo sapiens
tgagggagttgggtgtatagga

SEQ ID NO: 8260483 - DNA, 22 bp, Homo sapiens
tgagggagtgtggatacagtag

SEQ ID NO: 8260484 - DNA, 19 bp, Homo sapiens
tgaggcaagatggctctgg

SEQ ID NO: 8260485 - DNA, 22 bp, Homo sapiens
tgaggcaaagttcaagctgaaa

SEQ ID NO: 8260486 - DNA, 22 bp, Homo sapiens
tgaggcaaagacaaagcagcat

SEQ ID NO: 8260487 - DNA, 22 bp, Homo sapiens
tgaggcaagtctcaatctttga

SEQ ID NO: 8260488 - DNA, 22 bp, Homo sapiens
tgaggcaagctgggcccatgga

SEQ ID NO: 8260489 - DNA, 22 bp, Homo sapiens
tgaggcaagggatggccccgtg

SEQ ID NO: 8260490 - DNA, 22 bp, Homo sapiens
tgaggcagctttttctgtgtgt

SEQ ID NO: 8260491 - DNA, 22 bp, Homo sapiens
tgaggcaggaatggggaaaagt

SEQ ID NO: 8260492 - DNA, 22 bp, Homo sapiens
tgaggcaggaagttatataatg

SEQ ID NO: 8260493 - DNA, 22 bp, Homo sapiens
tgaggcaggacatggacaactg

SEQ ID NO: 8260494 - DNA, 22 bp, Homo sapiens
tgaggcaggactgagcgggatg

SEQ ID NO: 8260495 - DNA, 22 bp, Homo sapiens
tgaggcaggacttgcataaagt

SEQ ID NO: 8260496 - DNA, 22 bp, Homo sapiens
tgaggcaggagaatcacatgaa

SEQ ID NO: 8260497 - DNA, 22 bp, Homo sapiens
tgaggcaggagaatcaccggaa

SEQ ID NO: 8260498 - DNA, 20 bp, Homo sapiens
tgaggcaggagaatggcatg

SEQ ID NO: 8260499 - DNA, 22 bp, Homo sapiens
tgaggaagggtgtgacggcacc

SEQ ID NO: 8260500 - DNA, 18 bp, Homo sapiens
tgaggaaggggaagtatt

SEQ ID NO: 8260501 - DNA, 22 bp, Homo sapiens
tgaggaggtgggcacacagagt

SEQ ID NO: 8260502 - DNA, 23 bp, Homo sapiens
tgaggagcatagctgactgacag

SEQ ID NO: 8260503 - DNA, 22 bp, Homo sapiens
tgaggagccactctagcagtca

SEQ ID NO: 8260504 - DNA, 22 bp, Homo sapiens
tgaggagcgggcagggatgcag

SEQ ID NO: 8260505 - DNA, 22 bp, Homo sapiens
tgaggagcttctggaaagtgca

SEQ ID NO: 8260506 - DNA, 22 bp, Homo sapiens
tgaggaggcccaggttggggct

SEQ ID NO: 8260507 - DNA, 22 bp, Homo sapiens
tgaggaggtcagagtctggctg

SEQ ID NO: 8260508 - DNA, 22 bp, Homo sapiens
tgaggccctctgggctggtcct

SEQ ID NO: 8260509 - DNA, 22 bp, Homo sapiens
tgaggcaggatgcttgcacagg

SEQ ID NO: 8260510 - DNA, 22 bp, Homo sapiens
tgaggcaggagttcaggctgcg

SEQ ID NO: 8260511 - DNA, 22 bp, Homo sapiens
tgaggcaggagttaatgtgctc

SEQ ID NO: 8260512 - DNA, 22 bp, Homo sapiens
tgaggcaggaggattgcaggat

SEQ ID NO: 8260513 - DNA, 22 bp, Homo sapiens
tgaggcaggaggttgagaactg

SEQ ID NO: 8260514 - DNA, 22 bp, Homo sapiens
tgaggcaggagaatggcgggaa

SEQ ID NO: 8260515 - DNA, 22 bp, Homo sapiens
tgaggcagggagtttaattgtc

SEQ ID NO: 8260516 - DNA, 22 bp, Homo sapiens
tgaggcagttcttacttgtatt

SEQ ID NO: 8260517 - DNA, 22 bp, Homo sapiens
tgaggcagggagagtggatatg

SEQ ID NO: 8260518 - DNA, 23 bp, Homo sapiens
tgaggcaggcggatcacgaggtc

SEQ ID NO: 8260519 - DNA, 22 bp, Homo sapiens
tgaggcagttgagcttcctgag

SEQ ID NO: 8260520 - DNA, 22 bp, Homo sapiens
tgagcagatggaggcttctgca

SEQ ID NO: 8260521 - DNA, 22 bp, Homo sapiens
tgagccaggagtttgaggctgt

SEQ ID NO: 8260522 - DNA, 22 bp, Homo sapiens
tgagcagggagctgggctgagc

SEQ ID NO: 8260523 - DNA, 22 bp, Homo sapiens
tgagcctgcaataagcacagcc

SEQ ID NO: 8260524 - DNA, 22 bp, Homo sapiens
tgagccctacctgctcatctcc

SEQ ID NO: 8260525 - DNA, 23 bp, Homo sapiens
tgagcccagttttccctcttgcc

SEQ ID NO: 8260526 - DNA, 22 bp, Homo sapiens
tgagccctcggctggggcagag

SEQ ID NO: 8260527 - DNA, 22 bp, Homo sapiens
tgagccctggagccctctgtta

SEQ ID NO: 8260528 - DNA, 22 bp, Homo sapiens
tgagccctgtgactgctttgag

SEQ ID NO: 8260529 - DNA, 18 bp, Homo sapiens
tgagcccttatctttggc

SEQ ID NO: 8260530 - DNA, 22 bp, Homo sapiens
tgagacagcctctgcactcatg

SEQ ID NO: 8260531 - DNA, 22 bp, Homo sapiens
tgagatccccaggaaggacaac

SEQ ID NO: 8260532 - DNA, 22 bp, Homo sapiens
tgagatatctgttaattttctt

SEQ ID NO: 8260533 - DNA, 22 bp, Homo sapiens
tgagatcattgacttgttcctg

SEQ ID NO: 8260534 - DNA, 22 bp, Homo sapiens
tgagatgtcatagttcagttca

SEQ ID NO: 8260535 - DNA, 17 bp, Homo sapiens
tgagagcagggctgggc

SEQ ID NO: 8260536 - DNA, 21 bp, Homo sapiens
tgagagagtagcaggacatat

SEQ ID NO: 8260537 - DNA, 22 bp, Homo sapiens
tgagaggatattttgggaggat

SEQ ID NO: 8260538 - DNA, 22 bp, Homo sapiens
tgagaggaacaggcagtaggtt

SEQ ID NO: 8260539 - DNA, 22 bp, Homo sapiens
tgaataatccacagtcattcat

SEQ ID NO: 8260540 - DNA, 22 bp, Homo sapiens
tgaaggagatttttagggaggc

SEQ ID NO: 8260541 - DNA, 19 bp, Homo sapiens
tgaaggagggggatggcca

SEQ ID NO: 8260542 - DNA, 22 bp, Homo sapiens
tgacaaaggcaggccagaagag

SEQ ID NO: 8260543 - DNA, 22 bp, Homo sapiens
tgacaaaggtgttgccagaggg

SEQ ID NO: 8260544 - DNA, 22 bp, Homo sapiens
tgacaaagcatgatggtgacag

SEQ ID NO: 8260545 - DNA, 22 bp, Homo sapiens
tgacaaagcctcatccttcaga

SEQ ID NO: 8260546 - DNA, 23 bp, Homo sapiens
tgacaaagcgagactccagctca

SEQ ID NO: 8260547 - DNA, 20 bp, Homo sapiens
tgacaaagagtaagaggagg

SEQ ID NO: 8260548 - DNA, 22 bp, Homo sapiens
tgacaaagaccttcaacaagat

SEQ ID NO: 8260549 - DNA, 22 bp, Homo sapiens
tgacaaagaggaacagcagggg

SEQ ID NO: 8260550 - DNA, 22 bp, Homo sapiens
tgacaaagacaaagatatgtcc

SEQ ID NO: 8260551 - DNA, 22 bp, Homo sapiens
tgacaaagtggttgtttggttg

SEQ ID NO: 8260552 - DNA, 23 bp, Homo sapiens
tgacaaagtggtcgttcaaggtg

SEQ ID NO: 8260553 - DNA, 22 bp, Homo sapiens
tgacaaagtgaggtcttcagta

SEQ ID NO: 8260554 - DNA, 22 bp, Homo sapiens
tgacaaagtgctagtcggtgaa

SEQ ID NO: 8260555 - DNA, 23 bp, Homo sapiens
tgacaaagtcatctctccttctt

SEQ ID NO: 8260556 - DNA, 20 bp, Homo sapiens
tgacaaagtcccttcttttc

SEQ ID NO: 8260557 - DNA, 22 bp, Homo sapiens
tgaatagatggtgacagtatga

SEQ ID NO: 8260558 - DNA, 22 bp, Homo sapiens
tgaatatggcaactcttgtaac

SEQ ID NO: 8260559 - DNA, 22 bp, Homo sapiens
tgaatagttctactacttgaca

SEQ ID NO: 8260560 - DNA, 18 bp, Homo sapiens
tgaatgttttctggaccc

SEQ ID NO: 8260561 - DNA, 22 bp, Homo sapiens
tgaatggatataacaacagtgt

SEQ ID NO: 8260562 - DNA, 22 bp, Homo sapiens
tgacatttgagagagatataca

SEQ ID NO: 8260563 - DNA, 18 bp, Homo sapiens
tgaccctttctccctgtg

SEQ ID NO: 8260564 - DNA, 22 bp, Homo sapiens
tgactattacggccacgaattt

SEQ ID NO: 8260565 - DNA, 22 bp, Homo sapiens
tgactttaaaataacaagttta

SEQ ID NO: 8260566 - DNA, 22 bp, Homo sapiens
tgactggattgtcattacgacg

SEQ ID NO: 8260567 - DNA, 22 bp, Homo sapiens
tgacagggtcagagctgagctg

SEQ ID NO: 8260568 - DNA, 22 bp, Homo sapiens
tgacaggcgtttttctctagta

SEQ ID NO: 8260569 - DNA, 22 bp, Homo sapiens
tgacaggctaggaggctgaagg

SEQ ID NO: 8260570 - DNA, 22 bp, Homo sapiens
tgacaggctaggaggctgaagg

SEQ ID NO: 8260571 - DNA, 23 bp, Homo sapiens
tgacaggctgcttctggctgagg

SEQ ID NO: 8260572 - DNA, 22 bp, Homo sapiens
tgacaggcagtgctgggcatgt

SEQ ID NO: 8260573 - DNA, 22 bp, Homo sapiens
tgacaggcagtgctgggcatgt

SEQ ID NO: 8260574 - DNA, 23 bp, Homo sapiens
tgacaggccagaagagcagctgg

SEQ ID NO: 8260575 - DNA, 22 bp, Homo sapiens
tgacaggcttgctaagacatag

SEQ ID NO: 8260576 - DNA, 19 bp, Homo sapiens
tgacaggctgttgccttga

SEQ ID NO: 8260577 - DNA, 23 bp, Homo sapiens
tgacaggctttgctccttctgcc

SEQ ID NO: 8260578 - DNA, 22 bp, Homo sapiens
tgacaggcactgctgtagtgct

SEQ ID NO: 8260579 - DNA, 22 bp, Homo sapiens
tgacaggcaggacagaggtgtg

SEQ ID NO: 8260580 - DNA, 21 bp, Homo sapiens
tgacaggcaccctggctgtga

SEQ ID NO: 8260581 - DNA, 22 bp, Homo sapiens
tgaaagatgaaagcaggctggt

SEQ ID NO: 8260582 - DNA, 22 bp, Homo sapiens
tgaaatctttagtttctgtccc

SEQ ID NO: 8260583 - DNA, 22 bp, Homo sapiens
tgaaatcttagccattctgcct

SEQ ID NO: 8260584 - DNA, 22 bp, Homo sapiens
tgaacatgctgttgatggcctg

SEQ ID NO: 8260585 - DNA, 22 bp, Homo sapiens
tgaacttttatttgatgacagg

SEQ ID NO: 8260586 - DNA, 20 bp, Homo sapiens
tggctcctggctcctccctc

SEQ ID NO: 8260587 - DNA, 22 bp, Homo sapiens
tggctgatggagattttaggac

SEQ ID NO: 8260588 - DNA, 22 bp, Homo sapiens
tggctgattgatttcctatgta

SEQ ID NO: 8260589 - DNA, 22 bp, Homo sapiens
tggctgattggtaccatcttca

SEQ ID NO: 8260590 - DNA, 22 bp, Homo sapiens
tggctccacaggccagggtgtg

SEQ ID NO: 8260591 - DNA, 22 bp, Homo sapiens
tggctcagataattcaaggggc

SEQ ID NO: 8260592 - DNA, 22 bp, Homo sapiens
tggcggctcaggaggggcagtt

SEQ ID NO: 8260593 - DNA, 21 bp, Homo sapiens
tgggagacacagccttgagct

SEQ ID NO: 8260594 - DNA, 22 bp, Homo sapiens
tgggagacactggtgggagctt

SEQ ID NO: 8260595 - DNA, 21 bp, Homo sapiens
tgggagaccgccttcctggga

SEQ ID NO: 8260596 - DNA, 23 bp, Homo sapiens
tgggagacttttcattttgttct

SEQ ID NO: 8260597 - DNA, 22 bp, Homo sapiens
tgggagactccagaactgatcc

SEQ ID NO: 8260598 - DNA, 22 bp, Homo sapiens
tgggagaagcagtgggacagta

SEQ ID NO: 8260599 - DNA, 22 bp, Homo sapiens
tgggagaagcatggggtgcaga

SEQ ID NO: 8260600 - DNA, 22 bp, Homo sapiens
tgggagcaaatgactgggagat

SEQ ID NO: 8260601 - DNA, 19 bp, Homo sapiens
tgggagaggcaacagagta

SEQ ID NO: 8260602 - DNA, 21 bp, Homo sapiens
tgggagagggctcagctaccc

SEQ ID NO: 8260603 - DNA, 22 bp, Homo sapiens
tgggagcactctttgggaagca

SEQ ID NO: 8260604 - DNA, 22 bp, Homo sapiens
tgggagcaagctggtgctggag

SEQ ID NO: 8260605 - DNA, 22 bp, Homo sapiens
tgggagcaagctggtgctggag

SEQ ID NO: 8260606 - DNA, 22 bp, Homo sapiens
tgggagctcctggagggcagga

SEQ ID NO: 8260607 - DNA, 22 bp, Homo sapiens
tgggagcagcattgccatgtgc

SEQ ID NO: 8260608 - DNA, 22 bp, Homo sapiens
tgggaggaagtgctaatgggag

SEQ ID NO: 8260609 - DNA, 22 bp, Homo sapiens
tgggaggacttgtgggcttcat

SEQ ID NO: 8260610 - DNA, 22 bp, Homo sapiens
tgggaggaatgtcactgagcca

SEQ ID NO: 8260611 - DNA, 22 bp, Homo sapiens
tgggaggaatgtcactgagcca

SEQ ID NO: 8260612 - DNA, 22 bp, Homo sapiens
tgggaggagccctctgggaagg

SEQ ID NO: 8260613 - DNA, 22 bp, Homo sapiens
tgggaggatcgcttgagcccag

SEQ ID NO: 8260614 - DNA, 22 bp, Homo sapiens
tgggaggatctcttgaggccag

SEQ ID NO: 8260615 - DNA, 22 bp, Homo sapiens
tgggaggatctcttgaggccag

SEQ ID NO: 8260616 - DNA, 22 bp, Homo sapiens
tgggactgctcttgctggggtc

SEQ ID NO: 8260617 - DNA, 22 bp, Homo sapiens
tgggacagttgtcctccactct

SEQ ID NO: 8260618 - DNA, 22 bp, Homo sapiens
tgggacagtgaccccagaggtc

SEQ ID NO: 8260619 - DNA, 22 bp, Homo sapiens
tgggacaggttggagagaagca

SEQ ID NO: 8260620 - DNA, 22 bp, Homo sapiens
tgggacaggttggagagaagca

SEQ ID NO: 8260621 - DNA, 22 bp, Homo sapiens
tgggacagggaatctgatcccc

SEQ ID NO: 8260622 - DNA, 22 bp, Homo sapiens
tgggaaggttagcagtttgtca

SEQ ID NO: 8260623 - DNA, 22 bp, Homo sapiens
tgggaagggagtttcttggagt

SEQ ID NO: 8260624 - DNA, 22 bp, Homo sapiens
tgggaaggcgtggaagtagaag

SEQ ID NO: 8260625 - DNA, 22 bp, Homo sapiens
tgggaagggagagtgtcctgga

SEQ ID NO: 8260626 - DNA, 22 bp, Homo sapiens
tgggaagggagagtgtcctgga

SEQ ID NO: 8260627 - DNA, 22 bp, Homo sapiens
tgggaagggtcaacagctggaa

SEQ ID NO: 8260628 - DNA, 22 bp, Homo sapiens
tgggaagggtctgaatctgaga

SEQ ID NO: 8260629 - DNA, 22 bp, Homo sapiens
tggctgggccgggccttgtgcc

SEQ ID NO: 8260630 - DNA, 22 bp, Homo sapiens
tggctgggtgctatccagtact

SEQ ID NO: 8260631 - DNA, 22 bp, Homo sapiens
tggctgggggtgctatagctgc

SEQ ID NO: 8260632 - DNA, 19 bp, Homo sapiens
tggctgggtgccaatggcc

SEQ ID NO: 8260633 - DNA, 19 bp, Homo sapiens
tggctgtggggaaatgctt

SEQ ID NO: 8260634 - DNA, 22 bp, Homo sapiens
tggctgtgtgccaggctgtctg

SEQ ID NO: 8260635 - DNA, 22 bp, Homo sapiens
tggctgggagctggaactgggc

SEQ ID NO: 8260636 - DNA, 22 bp, Homo sapiens
tggctgggagctggaactgggc

SEQ ID NO: 8260637 - DNA, 22 bp, Homo sapiens
tggctggacagtgggcagtgga

SEQ ID NO: 8260638 - DNA, 22 bp, Homo sapiens
tggctggaatggagctgagcct

SEQ ID NO: 8260639 - DNA, 22 bp, Homo sapiens
tggctggagggttagtgagata

SEQ ID NO: 8260640 - DNA, 22 bp, Homo sapiens
tggctggattattggctagtac

SEQ ID NO: 8260641 - DNA, 22 bp, Homo sapiens
tggcctggaacctggcagggac

SEQ ID NO: 8260642 - DNA, 22 bp, Homo sapiens
tggcccttcaaattccctagtc

SEQ ID NO: 8260643 - DNA, 22 bp, Homo sapiens
tggcccttctgagcacagggcc

SEQ ID NO: 8260644 - DNA, 22 bp, Homo sapiens
tggccctttggtttatgactga

SEQ ID NO: 8260645 - DNA, 22 bp, Homo sapiens
tggcccttttgtgaagtggcca

SEQ ID NO: 8260646 - DNA, 22 bp, Homo sapiens
tggccctttgggtgcaggggca

SEQ ID NO: 8260647 - DNA, 22 bp, Homo sapiens
tggccctttgggtgcaggggca

SEQ ID NO: 8260648 - DNA, 22 bp, Homo sapiens
tggcccttgtcctgggagagtt

SEQ ID NO: 8260649 - DNA, 22 bp, Homo sapiens
tggcccttctgagcacagggcc

SEQ ID NO: 8260650 - DNA, 22 bp, Homo sapiens
tggcctcaaccgtcctaagcac

SEQ ID NO: 8260651 - DNA, 22 bp, Homo sapiens
tggcccagactctgctcttatc

SEQ ID NO: 8260652 - DNA, 22 bp, Homo sapiens
tggcccagccctgctctagggc

SEQ ID NO: 8260653 - DNA, 22 bp, Homo sapiens
tggcccagctcagggtgggcgg

SEQ ID NO: 8260654 - DNA, 22 bp, Homo sapiens
tggcccaggaggccagagggca

SEQ ID NO: 8260655 - DNA, 22 bp, Homo sapiens
tggcccagctgcagatggtgga

SEQ ID NO: 8260656 - DNA, 22 bp, Homo sapiens
tggcccaggccaaagccctgga

SEQ ID NO: 8260657 - DNA, 22 bp, Homo sapiens
tggcccagggagttcatggtgt

SEQ ID NO: 8260658 - DNA, 22 bp, Homo sapiens
tggcccaggcgaggtgggcaga

SEQ ID NO: 8260659 - DNA, 22 bp, Homo sapiens
tggcccagggtctacagcctca

SEQ ID NO: 8260660 - DNA, 22 bp, Homo sapiens
tggcccaggtctctctgagccc

SEQ ID NO: 8260661 - DNA, 22 bp, Homo sapiens
tggcccaggggctcttggtgtt

SEQ ID NO: 8260662 - DNA, 22 bp, Homo sapiens
tggcccagggcacagcagggag

SEQ ID NO: 8260663 - DNA, 22 bp, Homo sapiens
tggccctcagtcttgctcctgc

SEQ ID NO: 8260664 - DNA, 22 bp, Homo sapiens
tggccctcagcactgagacctt

SEQ ID NO: 8260665 - DNA, 22 bp, Homo sapiens
tggccctcgtccgacaggtggg

SEQ ID NO: 8260666 - DNA, 22 bp, Homo sapiens
tggcccaggtgcaagagacaga

SEQ ID NO: 8260667 - DNA, 22 bp, Homo sapiens
tggcccaggtgcacccagaggc

SEQ ID NO: 8260668 - DNA, 22 bp, Homo sapiens
tggcccagtatgtataatctta

SEQ ID NO: 8260669 - DNA, 22 bp, Homo sapiens
tggcccagtagaaaagggatcg

SEQ ID NO: 8260670 - DNA, 22 bp, Homo sapiens
tggcccagtcagcaggagaggg

SEQ ID NO: 8260671 - DNA, 22 bp, Homo sapiens
tggcagggtcttgctgtgttgc

SEQ ID NO: 8260672 - DNA, 22 bp, Homo sapiens
tggcagggtacaccttaacacc

SEQ ID NO: 8260673 - DNA, 22 bp, Homo sapiens
tggcagggtgccagttgcgagt

SEQ ID NO: 8260674 - DNA, 21 bp, Homo sapiens
tggcaggttcaaaggcctatc

SEQ ID NO: 8260675 - DNA, 22 bp, Homo sapiens
tggcaggttatgcgggccacat

SEQ ID NO: 8260676 - DNA, 22 bp, Homo sapiens
tggcatggcgtggcatcgtgtg

SEQ ID NO: 8260677 - DNA, 21 bp, Homo sapiens
tggcatggaggtagcagtgtg

SEQ ID NO: 8260678 - DNA, 22 bp, Homo sapiens
tggccagcctggtgcttgctcc

SEQ ID NO: 8260679 - DNA, 22 bp, Homo sapiens
tggccagaacctgcagtaggcc

SEQ ID NO: 8260680 - DNA, 17 bp, Homo sapiens
tggccagagcaggcccc

SEQ ID NO: 8260681 - DNA, 22 bp, Homo sapiens
tggcagggagttgcaggatttc

SEQ ID NO: 8260682 - DNA, 22 bp, Homo sapiens
tggcagggcctaccccaatatc

SEQ ID NO: 8260683 - DNA, 22 bp, Homo sapiens
tggcagggcctgaatcttatac

SEQ ID NO: 8260684 - DNA, 22 bp, Homo sapiens
tggcagggcctgctcatcatcc

SEQ ID NO: 8260685 - DNA, 21 bp, Homo sapiens
tggcaggggtagtagtacagc

SEQ ID NO: 8260686 - DNA, 18 bp, Homo sapiens
tggcaggggcagtacgcc

SEQ ID NO: 8260687 - DNA, 18 bp, Homo sapiens
tggcaggggcagtacgcc

SEQ ID NO: 8260688 - DNA, 22 bp, Homo sapiens
tggcaggggaggtgcttgctta

SEQ ID NO: 8260689 - DNA, 18 bp, Homo sapiens
tggcagggaggaaatata

SEQ ID NO: 8260690 - DNA, 19 bp, Homo sapiens
tggcagggagtgatattag

SEQ ID NO: 8260691 - DNA, 22 bp, Homo sapiens
tggcagggagttcgttcacaac

SEQ ID NO: 8260692 - DNA, 22 bp, Homo sapiens
tggcagggagccaccggtcatg

SEQ ID NO: 8260693 - DNA, 22 bp, Homo sapiens
tggcaggatctttgagagtgaa

SEQ ID NO: 8260694 - DNA, 21 bp, Homo sapiens
tggcaggcagctggaagcttg

SEQ ID NO: 8260695 - DNA, 22 bp, Homo sapiens
tggcaggaagacgtggggcacc

SEQ ID NO: 8260696 - DNA, 22 bp, Homo sapiens
tggcagccatctgagggtgggg

SEQ ID NO: 8260697 - DNA, 22 bp, Homo sapiens
tggcagagtggaccatactcaa

SEQ ID NO: 8260698 - DNA, 18 bp, Homo sapiens
tggcagagtgtctgttct

SEQ ID NO: 8260699 - DNA, 22 bp, Homo sapiens
tggcagagttatgggtatttat

SEQ ID NO: 8260700 - DNA, 22 bp, Homo sapiens
tggcagagttcgctcctattca

SEQ ID NO: 8260701 - DNA, 22 bp, Homo sapiens
tggcagagttcgctgtgccttt

SEQ ID NO: 8260702 - DNA, 21 bp, Homo sapiens
tggcagagttgagtagttatg

SEQ ID NO: 8260703 - DNA, 22 bp, Homo sapiens
tggcagagttggaggtggaaga

SEQ ID NO: 8260704 - DNA, 20 bp, Homo sapiens
tggcagagttgtcccaccca

SEQ ID NO: 8260705 - DNA, 22 bp, Homo sapiens
tggcagagtctgggcttgggca

SEQ ID NO: 8260706 - DNA, 22 bp, Homo sapiens
tggcagagtctctcctttccag

SEQ ID NO: 8260707 - DNA, 22 bp, Homo sapiens
tggcagagtaggatggccctgt

SEQ ID NO: 8260708 - DNA, 22 bp, Homo sapiens
tggcagagtcatcacatctgga

SEQ ID NO: 8260709 - DNA, 22 bp, Homo sapiens
tggcagagtgcggcatcccctg

SEQ ID NO: 8260710 - DNA, 21 bp, Homo sapiens
tggcagagtgcagtctataca

SEQ ID NO: 8260711 - DNA, 22 bp, Homo sapiens
tggcagagtgcagaagaggcat

SEQ ID NO: 8260712 - DNA, 22 bp, Homo sapiens
tggcaattcctgagctctgaga

SEQ ID NO: 8260713 - DNA, 23 bp, Homo sapiens
tggcaattcctgagctctgagaa

SEQ ID NO: 8260714 - DNA, 23 bp, Homo sapiens
tggcaagtttgactttcctttac

SEQ ID NO: 8260715 - DNA, 22 bp, Homo sapiens
tggcaagttggtgggtttagtg

SEQ ID NO: 8260716 - DNA, 22 bp, Homo sapiens
tggattagtttcaaggcagcaa

SEQ ID NO: 8260717 - DNA, 18 bp, Homo sapiens
tggattagaggagaaggt

SEQ ID NO: 8260718 - DNA, 22 bp, Homo sapiens
tggcagaggaaaaagtcactgg

SEQ ID NO: 8260719 - DNA, 16 bp, Homo sapiens
tggcagaggttcagcc

SEQ ID NO: 8260720 - DNA, 22 bp, Homo sapiens
tggcagagctggctgcggatga

SEQ ID NO: 8260721 - DNA, 22 bp, Homo sapiens
tggcagagcccagactccagtc

SEQ ID NO: 8260722 - DNA, 22 bp, Homo sapiens
tggcagagccttgccaaactcc

SEQ ID NO: 8260723 - DNA, 22 bp, Homo sapiens
tggcagagcccagaactgagca

SEQ ID NO: 8260724 - DNA, 22 bp, Homo sapiens
tggcagagcaaaaagatagaat

SEQ ID NO: 8260725 - DNA, 22 bp, Homo sapiens
tggcagagatgaagagttgttt

SEQ ID NO: 8260726 - DNA, 22 bp, Homo sapiens
tggcagagaacacggctgatct

SEQ ID NO: 8260727 - DNA, 22 bp, Homo sapiens
tggcagagaacctgggctttgt

SEQ ID NO: 8260728 - DNA, 22 bp, Homo sapiens
tggcagagaataaatcttgact

SEQ ID NO: 8260729 - DNA, 22 bp, Homo sapiens
tggcagagacaaggccgggcct

SEQ ID NO: 8260730 - DNA, 23 bp, Homo sapiens
tggcagagacccagaatctacat

SEQ ID NO: 8260731 - DNA, 22 bp, Homo sapiens
tggcagagactcctcctgggag

SEQ ID NO: 8260732 - DNA, 22 bp, Homo sapiens
tggcagagagactctccttgat

SEQ ID NO: 8260733 - DNA, 22 bp, Homo sapiens
tggcagagagagtgcagtcgac

SEQ ID NO: 8260734 - DNA, 22 bp, Homo sapiens
tgctcccaggctctgtggtctg

SEQ ID NO: 8260735 - DNA, 22 bp, Homo sapiens
tgctcccaggcattctctgttg

SEQ ID NO: 8260736 - DNA, 22 bp, Homo sapiens
tgctcgccccacatgccctcat

SEQ ID NO: 8260737 - DNA, 22 bp, Homo sapiens
tgctgaggaggtggctgtgctt

SEQ ID NO: 8260738 - DNA, 22 bp, Homo sapiens
tgctctgggtcctgggcctcct

SEQ ID NO: 8260739 - DNA, 22 bp, Homo sapiens
tgctctgtaacaaattgacatg

SEQ ID NO: 8260740 - DNA, 22 bp, Homo sapiens
tgctgaggtcacggcggccaga

SEQ ID NO: 8260741 - DNA, 22 bp, Homo sapiens
tgctgaggcagatgtctgtgac

SEQ ID NO: 8260742 - DNA, 22 bp, Homo sapiens
tgctgaggcatttggacagagt

SEQ ID NO: 8260743 - DNA, 20 bp, Homo sapiens
tgctgaggcctgaggcctgg

SEQ ID NO: 8260744 - DNA, 22 bp, Homo sapiens
tgctgagtctgaaacagctcag

SEQ ID NO: 8260745 - DNA, 22 bp, Homo sapiens
tgctgatctatcacctctgaga

SEQ ID NO: 8260746 - DNA, 22 bp, Homo sapiens
tgctcagctggtgccagggtcc

SEQ ID NO: 8260747 - DNA, 22 bp, Homo sapiens
tgctcattggcgatctgaggga

SEQ ID NO: 8260748 - DNA, 22 bp, Homo sapiens
tgctatttttatcttgatcaaa

SEQ ID NO: 8260749 - DNA, 22 bp, Homo sapiens
tgcggaggtcggtgctgcgggc

SEQ ID NO: 8260750 - DNA, 22 bp, Homo sapiens
tgcggcagccaccgcgtggccc

SEQ ID NO: 8260751 - DNA, 19 bp, Homo sapiens
tgcctgtggcgagcatctt

SEQ ID NO: 8260752 - DNA, 22 bp, Homo sapiens
tgcctggctgaggtgacaggtt

SEQ ID NO: 8260753 - DNA, 17 bp, Homo sapiens
tgctggaggcggggtat

SEQ ID NO: 8260754 - DNA, 22 bp, Homo sapiens
tgctggaggggcctgaccagga

SEQ ID NO: 8260755 - DNA, 19 bp, Homo sapiens
tgctggagggtagtgagtc

SEQ ID NO: 8260756 - DNA, 19 bp, Homo sapiens
tgctggaggttgacagggt

SEQ ID NO: 8260757 - DNA, 22 bp, Homo sapiens
tgctggaggcagtggaggtgcc

SEQ ID NO: 8260758 - DNA, 22 bp, Homo sapiens
tgctggaggccgagaagcagca

SEQ ID NO: 8260759 - DNA, 22 bp, Homo sapiens
tgctggagtggcactgtgtggc

SEQ ID NO: 8260760 - DNA, 22 bp, Homo sapiens
tgctgcctcaactgtcaggaac

SEQ ID NO: 8260761 - DNA, 22 bp, Homo sapiens
tgctgctgaggctaaagtatag

SEQ ID NO: 8260762 - DNA, 22 bp, Homo sapiens
tgctgccagagagacagggact

SEQ ID NO: 8260763 - DNA, 18 bp, Homo sapiens
tgctgccagatctatttc

SEQ ID NO: 8260764 - DNA, 22 bp, Homo sapiens
tgctgccacctggtggctgaag

SEQ ID NO: 8260765 - DNA, 22 bp, Homo sapiens
tgctgccaatttctggtcttga

SEQ ID NO: 8260766 - DNA, 23 bp, Homo sapiens
tgctgccaagcacgagttgagtt

SEQ ID NO: 8260767 - DNA, 22 bp, Homo sapiens
tgctgcatttatcttctcaaac

SEQ ID NO: 8260768 - DNA, 22 bp, Homo sapiens
tgctggaggagaaggttgctca

SEQ ID NO: 8260769 - DNA, 22 bp, Homo sapiens
tgctggagctccgggctgtagg

SEQ ID NO: 8260770 - DNA, 22 bp, Homo sapiens
tgctggagcggaggtgagccag

SEQ ID NO: 8260771 - DNA, 23 bp, Homo sapiens
tgctggagacaagtgtgagaagg

SEQ ID NO: 8260772 - DNA, 23 bp, Homo sapiens
tgctggagaagcaaagttctgag

SEQ ID NO: 8260773 - DNA, 20 bp, Homo sapiens
tgctgctgtgagcgtccctg

SEQ ID NO: 8260774 - DNA, 23 bp, Homo sapiens
tgctgggcagagctggtgctgag

SEQ ID NO: 8260775 - DNA, 22 bp, Homo sapiens
tgctgggcactgtctctgggga

SEQ ID NO: 8260776 - DNA, 22 bp, Homo sapiens
tgctgggctagaagctgaggcc

SEQ ID NO: 8260777 - DNA, 21 bp, Homo sapiens
tgctgggctgcaggggatgca

SEQ ID NO: 8260778 - DNA, 21 bp, Homo sapiens
tgctggtgagctcatgtggct

SEQ ID NO: 8260779 - DNA, 22 bp, Homo sapiens
tgctggtggagaaagtggaggt

SEQ ID NO: 8260780 - DNA, 22 bp, Homo sapiens
tgctggtaccgcgcctccgcca

SEQ ID NO: 8260781 - DNA, 22 bp, Homo sapiens
tgctgtattacttttacaaact

SEQ ID NO: 8260782 - DNA, 22 bp, Homo sapiens
tgctgtatatattttgaagtga

SEQ ID NO: 8260783 - DNA, 23 bp, Homo sapiens
tgctggggtagtttgtggcacag

SEQ ID NO: 8260784 - DNA, 22 bp, Homo sapiens
tgctggggcagaagagccaaga

SEQ ID NO: 8260785 - DNA, 20 bp, Homo sapiens
tgctggggacatacagggtg

SEQ ID NO: 8260786 - DNA, 22 bp, Homo sapiens
tgcttccctgaaggcacaggag

SEQ ID NO: 8260787 - DNA, 22 bp, Homo sapiens
tgcttacgagctattttcactt

SEQ ID NO: 8260788 - DNA, 19 bp, Homo sapiens
tgctgtcctcagagtaagt

SEQ ID NO: 8260789 - DNA, 22 bp, Homo sapiens
tgctgtctgcaacagtactaca

SEQ ID NO: 8260790 - DNA, 22 bp, Homo sapiens
tggaggagaatttatggtcgaa

SEQ ID NO: 8260791 - DNA, 22 bp, Homo sapiens
tggaggagaactccctggctac

SEQ ID NO: 8260792 - DNA, 22 bp, Homo sapiens
tggaggcactaaatggccacaa

SEQ ID NO: 8260793 - DNA, 20 bp, Homo sapiens
tggaggcagagccagaggga

SEQ ID NO: 8260794 - DNA, 22 bp, Homo sapiens
tggaggcaccactggctgcccg

SEQ ID NO: 8260795 - DNA, 22 bp, Homo sapiens
tggaggcaggtggaggagtgaa

SEQ ID NO: 8260796 - DNA, 22 bp, Homo sapiens
tggaggccggactgagaggcat

SEQ ID NO: 8260797 - DNA, 22 bp, Homo sapiens
tggaggccatgccagagcccta

SEQ ID NO: 8260798 - DNA, 22 bp, Homo sapiens
tggagggcgcttagatggaggg

SEQ ID NO: 8260799 - DNA, 20 bp, Homo sapiens
tggagggattgttggcaaat

SEQ ID NO: 8260800 - DNA, 22 bp, Homo sapiens
tggagggatacaaagatgaaaa

SEQ ID NO: 8260801 - DNA, 22 bp, Homo sapiens
tggagggaacaaaggagtccca

SEQ ID NO: 8260802 - DNA, 22 bp, Homo sapiens
tggagtccgctccaagttctct

SEQ ID NO: 8260803 - DNA, 22 bp, Homo sapiens
tggagtggacttcatgaggcca

SEQ ID NO: 8260804 - DNA, 22 bp, Homo sapiens
tggagtgggcaatgtaggcaag

SEQ ID NO: 8260805 - DNA, 22 bp, Homo sapiens
tggatggattgacgaaggcagc

SEQ ID NO: 8260806 - DNA, 22 bp, Homo sapiens
tggatgctcacttctgcagggt

SEQ ID NO: 8260807 - DNA, 22 bp, Homo sapiens
tggatgctgctgtcagggatgg

SEQ ID NO: 8260808 - DNA, 22 bp, Homo sapiens
tggagcaggtgccaggtgtgtg

SEQ ID NO: 8260809 - DNA, 22 bp, Homo sapiens
tggagcagctctagcgggcgcc

SEQ ID NO: 8260810 - DNA, 22 bp, Homo sapiens
tggagcccagacactggcattg

SEQ ID NO: 8260811 - DNA, 22 bp, Homo sapiens
tggagcccagacactggcattg

SEQ ID NO: 8260812 - DNA, 22 bp, Homo sapiens
tggagccataaccctttcgtac

SEQ ID NO: 8260813 - DNA, 22 bp, Homo sapiens
tggagcccacggatgtcgcttt

SEQ ID NO: 8260814 - DNA, 22 bp, Homo sapiens
tggagcccacggatgtcgcttt

SEQ ID NO: 8260815 - DNA, 22 bp, Homo sapiens
tggagagtggtttgggggacat

SEQ ID NO: 8260816 - DNA, 22 bp, Homo sapiens
tggagagtggatatgggagcaa

SEQ ID NO: 8260817 - DNA, 22 bp, Homo sapiens
tggagagtgtagacttcagagt

SEQ ID NO: 8260818 - DNA, 19 bp, Homo sapiens
tggagaggaaatgctgctc

SEQ ID NO: 8260819 - DNA, 19 bp, Homo sapiens
tggagaggaaatgctgctc

SEQ ID NO: 8260820 - DNA, 22 bp, Homo sapiens
tggagagtaatttctgaagacc

SEQ ID NO: 8260821 - DNA, 22 bp, Homo sapiens
tggagagtctcaaggcaggaaa

SEQ ID NO: 8260822 - DNA, 22 bp, Homo sapiens
tggagaggttgaataacttgtc

SEQ ID NO: 8260823 - DNA, 22 bp, Homo sapiens
tggagcagagatggtggccttc

SEQ ID NO: 8260824 - DNA, 22 bp, Homo sapiens
tggagcagaggaagaaggcttt

SEQ ID NO: 8260825 - DNA, 22 bp, Homo sapiens
tggagcagaggctgaggttggg

SEQ ID NO: 8260826 - DNA, 22 bp, Homo sapiens
tggagcagagttcagcggggag

SEQ ID NO: 8260827 - DNA, 22 bp, Homo sapiens
tggagagagtcgggatagtaca

SEQ ID NO: 8260828 - DNA, 22 bp, Homo sapiens
tggagagaaagttgaatggagg

SEQ ID NO: 8260829 - DNA, 22 bp, Homo sapiens
tggagaggaaagtgcagttttg

SEQ ID NO: 8260830 - DNA, 22 bp, Homo sapiens
tggaagccaggcccgctcctaa

SEQ ID NO: 8260831 - DNA, 22 bp, Homo sapiens
tggaagtgtcctcttctgagtc

SEQ ID NO: 8260832 - DNA, 22 bp, Homo sapiens
tggaaggagactgggaagtgtg

SEQ ID NO: 8260833 - DNA, 22 bp, Homo sapiens
tggaaggaagccaaggaaggtt

SEQ ID NO: 8260834 - DNA, 22 bp, Homo sapiens
tggaaggggagctggaaagggg

SEQ ID NO: 8260835 - DNA, 22 bp, Homo sapiens
tggaaggggagctggaaagggg

SEQ ID NO: 8260836 - DNA, 22 bp, Homo sapiens
tggaaggggagctggaaagggg

SEQ ID NO: 8260837 - DNA, 23 bp, Homo sapiens
tggacagggtaactggtggtttt

SEQ ID NO: 8260838 - DNA, 22 bp, Homo sapiens
tggacaggctcctaggggttcc

SEQ ID NO: 8260839 - DNA, 22 bp, Homo sapiens
tggacagggcagagaccgagtc

SEQ ID NO: 8260840 - DNA, 22 bp, Homo sapiens
tggaccagcagccccagtgcct

SEQ ID NO: 8260841 - DNA, 22 bp, Homo sapiens
tggaccagggtcccagagtatg

SEQ ID NO: 8260842 - DNA, 22 bp, Homo sapiens
tggacaggtgagtgactcaggg

SEQ ID NO: 8260843 - DNA, 22 bp, Homo sapiens
tggacaggatctgagactgaga

SEQ ID NO: 8260844 - DNA, 20 bp, Homo sapiens
tggacagaattagacacttt

SEQ ID NO: 8260845 - DNA, 22 bp, Homo sapiens
tgctttctttagctcctgagtc

SEQ ID NO: 8260846 - DNA, 22 bp, Homo sapiens
tgcttgtcttcaggattatggt

SEQ ID NO: 8260847 - DNA, 21 bp, Homo sapiens
tgcttgtctgcctagaggctt

SEQ ID NO: 8260848 - DNA, 22 bp, Homo sapiens
tgcttgtcttcaggaatgctga

SEQ ID NO: 8260849 - DNA, 22 bp, Homo sapiens
tgcttgctatgcatcctgaact

SEQ ID NO: 8260850 - DNA, 23 bp, Homo sapiens
tggaaatctgggtgaggacagaa

SEQ ID NO: 8260851 - DNA, 22 bp, Homo sapiens
tggaaattaacttggtacatat

SEQ ID NO: 8260852 - DNA, 18 bp, Homo sapiens
tggaaattgaaacagaaa

SEQ ID NO: 8260853 - DNA, 21 bp, Homo sapiens
tggtggagtgtgctgagcatg

SEQ ID NO: 8260854 - DNA, 22 bp, Homo sapiens
tggtggacatcccagggtgaaa

SEQ ID NO: 8260855 - DNA, 22 bp, Homo sapiens
tggtgcccttgacagagccagc

SEQ ID NO: 8260856 - DNA, 22 bp, Homo sapiens
tggtggcagagcaagagctgga

SEQ ID NO: 8260857 - DNA, 16 bp, Homo sapiens
tggtggggaggacagc

SEQ ID NO: 8260858 - DNA, 22 bp, Homo sapiens
tggtgggcacagtgcccaggct

SEQ ID NO: 8260859 - DNA, 22 bp, Homo sapiens
tggtccagaagatattcaacca

SEQ ID NO: 8260860 - DNA, 22 bp, Homo sapiens
tggtccagggtgtagtacagag

SEQ ID NO: 8260861 - DNA, 20 bp, Homo sapiens
tggtgagagcacctgatggg

SEQ ID NO: 8260862 - DNA, 22 bp, Homo sapiens
tggtgaggaagacctgctcctg

SEQ ID NO: 8260863 - DNA, 23 bp, Homo sapiens
tggtctcacttggtaagatgaag

SEQ ID NO: 8260864 - DNA, 22 bp, Homo sapiens
tgtaattttacgtgacacagtt

SEQ ID NO: 8260865 - DNA, 22 bp, Homo sapiens
tgtacagaggtgtacatatgat

SEQ ID NO: 8260866 - DNA, 22 bp, Homo sapiens
tggtggggtcatcgtcagatgc

SEQ ID NO: 8260867 - DNA, 22 bp, Homo sapiens
tggtgggtcggctgggagagct

SEQ ID NO: 8260868 - DNA, 18 bp, Homo sapiens
tggtggtgacagggtcat

SEQ ID NO: 8260869 - DNA, 22 bp, Homo sapiens
tggtgtctcttagtacatagat

SEQ ID NO: 8260870 - DNA, 22 bp, Homo sapiens
tggtgtgggcagcagcaggtac

SEQ ID NO: 8260871 - DNA, 22 bp, Homo sapiens
tggttggggtctgcagccatcc

SEQ ID NO: 8260872 - DNA, 22 bp, Homo sapiens
tgtacttattttatgtcagcac

SEQ ID NO: 8260873 - DNA, 22 bp, Homo sapiens
tgtagaggaggaaactgaggct

SEQ ID NO: 8260874 - DNA, 22 bp, Homo sapiens
tgtagatattaattattccttt

SEQ ID NO: 8260875 - DNA, 22 bp, Homo sapiens
tgtagatagtgatttatgacca

SEQ ID NO: 8260876 - DNA, 22 bp, Homo sapiens
tgtcacagagcgtgcaacagaa

SEQ ID NO: 8260877 - DNA, 21 bp, Homo sapiens
tgtcacagattctcagcttgc

SEQ ID NO: 8260878 - DNA, 22 bp, Homo sapiens
tgtatttcctggtttagatcaa

SEQ ID NO: 8260879 - DNA, 22 bp, Homo sapiens
tgtatttattcaggatgtaact

SEQ ID NO: 8260880 - DNA, 22 bp, Homo sapiens
tgtatttattcttctggtgttt

SEQ ID NO: 8260881 - DNA, 17 bp, Homo sapiens
tgtatttatcatgtcag

SEQ ID NO: 8260882 - DNA, 22 bp, Homo sapiens
tgtatttaagctttacctaaaa

SEQ ID NO: 8260883 - DNA, 22 bp, Homo sapiens
tgtatttagtccagtctctcat

SEQ ID NO: 8260884 - DNA, 22 bp, Homo sapiens
tgtatttatattagaatggttg

SEQ ID NO: 8260885 - DNA, 22 bp, Homo sapiens
tgtatttaattgtatcatcaca

SEQ ID NO: 8260886 - DNA, 20 bp, Homo sapiens
tgtatttaatgaaggctttt

SEQ ID NO: 8260887 - DNA, 22 bp, Homo sapiens
tgtccagctcgagacactatct

SEQ ID NO: 8260888 - DNA, 21 bp, Homo sapiens
tgtcactttaagctagctcta

SEQ ID NO: 8260889 - DNA, 22 bp, Homo sapiens
tgtccttatattgtggaagggg

SEQ ID NO: 8260890 - DNA, 21 bp, Homo sapiens
tgggatgggtctgggaccagc

SEQ ID NO: 8260891 - DNA, 22 bp, Homo sapiens
tgggcaagcaggagggcctcag

SEQ ID NO: 8260892 - DNA, 21 bp, Homo sapiens
tgggcaagtttgggggtcctc

SEQ ID NO: 8260893 - DNA, 22 bp, Homo sapiens
tgggcagaggacagggaagatc

SEQ ID NO: 8260894 - DNA, 22 bp, Homo sapiens
tgggcagagagtagaggcaacg

SEQ ID NO: 8260895 - DNA, 23 bp, Homo sapiens
tgggatggattcaccagtgtgct

SEQ ID NO: 8260896 - DNA, 22 bp, Homo sapiens
tgggatagtagctgagagacaa

SEQ ID NO: 8260897 - DNA, 22 bp, Homo sapiens
tgggagtactatgtgataggat

SEQ ID NO: 8260898 - DNA, 22 bp, Homo sapiens
tgggagtgaggcagagtctatc

SEQ ID NO: 8260899 - DNA, 20 bp, Homo sapiens
tgggagtacaatcatgagca

SEQ ID NO: 8260900 - DNA, 22 bp, Homo sapiens
tgggaggcttccagaccttgct

SEQ ID NO: 8260901 - DNA, 22 bp, Homo sapiens
tgggaggccaaggcaggcggat

SEQ ID NO: 8260902 - DNA, 22 bp, Homo sapiens
tgggaggcaggtaggtgatgat

SEQ ID NO: 8260903 - DNA, 22 bp, Homo sapiens
tgggaggccgaggcaggtggat

SEQ ID NO: 8260904 - DNA, 22 bp, Homo sapiens
tgggaggcccaggcctggcagg

SEQ ID NO: 8260905 - DNA, 22 bp, Homo sapiens
tgggaggcccaggcctggcagg

SEQ ID NO: 8260906 - DNA, 22 bp, Homo sapiens
tgggcagcagaaccaggccgac

SEQ ID NO: 8260907 - DNA, 22 bp, Homo sapiens
tgggcagattaatgcagtggct

SEQ ID NO: 8260908 - DNA, 22 bp, Homo sapiens
tgggcagatctttggtggctag

SEQ ID NO: 8260909 - DNA, 22 bp, Homo sapiens
tgggcagagttgtgatgaactg

SEQ ID NO: 8260910 - DNA, 22 bp, Homo sapiens
tgggcagggatctcttttgcaa

SEQ ID NO: 8260911 - DNA, 22 bp, Homo sapiens
tgggcagggagctggaaccaca

SEQ ID NO: 8260912 - DNA, 22 bp, Homo sapiens
tgggccaagttaaatgccaggg

SEQ ID NO: 8260913 - DNA, 22 bp, Homo sapiens
tgggccagctccctgcccctgg

SEQ ID NO: 8260914 - DNA, 22 bp, Homo sapiens
tgggcaggtgctattttccatg

SEQ ID NO: 8260915 - DNA, 19 bp, Homo sapiens
tgggcaggttcagtaatgg

SEQ ID NO: 8260916 - DNA, 22 bp, Homo sapiens
tgggcagggtctctgttatcag

SEQ ID NO: 8260917 - DNA, 22 bp, Homo sapiens
tgggcaggggccctgcttccgt

SEQ ID NO: 8260918 - DNA, 22 bp, Homo sapiens
tgggcaggttgttatttgacat

SEQ ID NO: 8260919 - DNA, 20 bp, Homo sapiens
tgggcctgagcctgtgggct

SEQ ID NO: 8260920 - DNA, 22 bp, Homo sapiens
tgggccagttggtgactacaaa

SEQ ID NO: 8260921 - DNA, 22 bp, Homo sapiens
tgggccagggcacccagtccag

SEQ ID NO: 8260922 - DNA, 23 bp, Homo sapiens
tgggcgaggcaggagtggagcac

SEQ ID NO: 8260923 - DNA, 22 bp, Homo sapiens
tgggctggtgagggatcattta

SEQ ID NO: 8260924 - DNA, 22 bp, Homo sapiens
tgggctggctgaggcattcact

SEQ ID NO: 8260925 - DNA, 22 bp, Homo sapiens
tgggctggctgaacttcaacct

SEQ ID NO: 8260926 - DNA, 22 bp, Homo sapiens
tgggctggcgtggagagtttag

SEQ ID NO: 8260927 - DNA, 22 bp, Homo sapiens
tggggaagcactttgaacttaa

SEQ ID NO: 8260928 - DNA, 22 bp, Homo sapiens
tggggaagaataatgtatgtac

SEQ ID NO: 8260929 - DNA, 22 bp, Homo sapiens
tggggaagggcaccctggagac

SEQ ID NO: 8260930 - DNA, 22 bp, Homo sapiens
tggggaagggcaccctggagac

SEQ ID NO: 8260931 - DNA, 22 bp, Homo sapiens
tggggaaggcggagcttgcagc

SEQ ID NO: 8260932 - DNA, 22 bp, Homo sapiens
tggggaaggatcaccacaatct

SEQ ID NO: 8260933 - DNA, 22 bp, Homo sapiens
tggggaggttcgggaatcttgt

SEQ ID NO: 8260934 - DNA, 22 bp, Homo sapiens
tggggaggttcgggaatcttgt

SEQ ID NO: 8260935 - DNA, 22 bp, Homo sapiens
tggggaggtaacaatttcaggc

SEQ ID NO: 8260936 - DNA, 21 bp, Homo sapiens
tggggaggggacctgattatg

SEQ ID NO: 8260937 - DNA, 22 bp, Homo sapiens
tggggagtgatgcctcggataa

SEQ ID NO: 8260938 - DNA, 22 bp, Homo sapiens
tggggcaagaagtgccctgaag

SEQ ID NO: 8260939 - DNA, 23 bp, Homo sapiens
tggggagggaagtcatttctgta

SEQ ID NO: 8260940 - DNA, 22 bp, Homo sapiens
tggggaggatatgtgagttatt

SEQ ID NO: 8260941 - DNA, 22 bp, Homo sapiens
tggggaggacgggcgccttcct

SEQ ID NO: 8260942 - DNA, 22 bp, Homo sapiens
tggggacattcatgcaggttgt

SEQ ID NO: 8260943 - DNA, 22 bp, Homo sapiens
tggggaggaagtcagatttcag

SEQ ID NO: 8260944 - DNA, 22 bp, Homo sapiens
tggggaggaagtcagatttcag

SEQ ID NO: 8260945 - DNA, 22 bp, Homo sapiens
tggggctgtccttagtctgaga

SEQ ID NO: 8260946 - DNA, 22 bp, Homo sapiens
tggggctggggatcttgagcct

SEQ ID NO: 8260947 - DNA, 22 bp, Homo sapiens
tgggggcacttcgaggtcgcct

SEQ ID NO: 8260948 - DNA, 22 bp, Homo sapiens
tgggggagattgtgcatctcta

SEQ ID NO: 8260949 - DNA, 22 bp, Homo sapiens
tggggcagcagacctttcttgg

SEQ ID NO: 8260950 - DNA, 22 bp, Homo sapiens
tggggccagagctgcagggagc

SEQ ID NO: 8260951 - DNA, 22 bp, Homo sapiens
tggggcagagtaggattttggc

SEQ ID NO: 8260952 - DNA, 22 bp, Homo sapiens
tggggccagggaggaccagaca

SEQ ID NO: 8260953 - DNA, 22 bp, Homo sapiens
tgggtgaggatgatgaggcagc

SEQ ID NO: 8260954 - DNA, 17 bp, Homo sapiens
tgggtggtagggagagg

SEQ ID NO: 8260955 - DNA, 22 bp, Homo sapiens
tgggttggaagcaggaggcacc

SEQ ID NO: 8260956 - DNA, 22 bp, Homo sapiens
tggtaaagaaatgtcagggcag

SEQ ID NO: 8260957 - DNA, 22 bp, Homo sapiens
tggtaaagtggcttcacagtgt

SEQ ID NO: 8260958 - DNA, 22 bp, Homo sapiens
tggtaaagttgattggtgctct

SEQ ID NO: 8260959 - DNA, 22 bp, Homo sapiens
tggtcacacatgtatctcaatg

SEQ ID NO: 8260960 - DNA, 20 bp, Homo sapiens
tggggtctagttggcctggg

SEQ ID NO: 8260961 - DNA, 22 bp, Homo sapiens
tgggtccatggaacagaggtgc

SEQ ID NO: 8260962 - DNA, 22 bp, Homo sapiens
tgggtccagtgcagctgcgcgt

SEQ ID NO: 8260963 - DNA, 22 bp, Homo sapiens
ttaggaagagctttcaatcact

SEQ ID NO: 8260964 - DNA, 22 bp, Homo sapiens
ttaggtaaggatggtgacagta

SEQ ID NO: 8260965 - DNA, 22 bp, Homo sapiens
ttagcagatttcatgtacattt

SEQ ID NO: 8260966 - DNA, 22 bp, Homo sapiens
ttagatcattttgaactaattt

SEQ ID NO: 8260967 - DNA, 22 bp, Homo sapiens
ttagatatgtttttgctaatgc

SEQ ID NO: 8260968 - DNA, 22 bp, Homo sapiens
ttagtagtaagagtcatatgta

SEQ ID NO: 8260969 - DNA, 22 bp, Homo sapiens
ttagtgatgaagaattactagg

SEQ ID NO: 8260970 - DNA, 22 bp, Homo sapiens
ttagtgattacagatatataaa

SEQ ID NO: 8260971 - DNA, 22 bp, Homo sapiens
ttatatgtttctgtttggaggc

SEQ ID NO: 8260972 - DNA, 22 bp, Homo sapiens
ttatgagatatttatactgctg

SEQ ID NO: 8260973 - DNA, 22 bp, Homo sapiens
ttatgagactgttttacacact

SEQ ID NO: 8260974 - DNA, 22 bp, Homo sapiens
ttatgaaaacaatcagtaggca

SEQ ID NO: 8260975 - DNA, 22 bp, Homo sapiens
ttacacttttgacaaacctgag

SEQ ID NO: 8260976 - DNA, 22 bp, Homo sapiens
ttaatacaagcatatgcacaca

SEQ ID NO: 8260977 - DNA, 22 bp, Homo sapiens
ttaatacatttcagactgttat

SEQ ID NO: 8260978 - DNA, 22 bp, Homo sapiens
ttccagctaactcacatccctt

SEQ ID NO: 8260979 - DNA, 22 bp, Homo sapiens
ttccagagttgggggagtggtt

SEQ ID NO: 8260980 - DNA, 22 bp, Homo sapiens
tgtgacagttagtttggtgtta

SEQ ID NO: 8260981 - DNA, 22 bp, Homo sapiens
tgtgacagtgccagcttcatag

SEQ ID NO: 8260982 - DNA, 23 bp, Homo sapiens
tgtgacagtgacaatactgactt

SEQ ID NO: 8260983 - DNA, 22 bp, Homo sapiens
tgtgacagtaacttgggatgga

SEQ ID NO: 8260984 - DNA, 22 bp, Homo sapiens
tgtgacagtcgttaggagctca

SEQ ID NO: 8260985 - DNA, 22 bp, Homo sapiens
tgtgacaggaactatgtggatg

SEQ ID NO: 8260986 - DNA, 23 bp, Homo sapiens
tgtgacagggtcattgaaaaggg

SEQ ID NO: 8260987 - DNA, 21 bp, Homo sapiens
tgtgacagaggcggtgcctac

SEQ ID NO: 8260988 - DNA, 22 bp, Homo sapiens
tgtgacagaattggtctgttct

SEQ ID NO: 8260989 - DNA, 22 bp, Homo sapiens
tgtgacagaaagtggatgggac

SEQ ID NO: 8260990 - DNA, 22 bp, Homo sapiens
tgtgacagatctctatacatga

SEQ ID NO: 8260991 - DNA, 22 bp, Homo sapiens
tgtgacagatctttaaataatg

SEQ ID NO: 8260992 - DNA, 22 bp, Homo sapiens
tgtgacagcaataactacttaa

SEQ ID NO: 8260993 - DNA, 22 bp, Homo sapiens
tgtgacagccagtaaagtaagc

SEQ ID NO: 8260994 - DNA, 22 bp, Homo sapiens
tgtgacagcacggttcaactgc

SEQ ID NO: 8260995 - DNA, 22 bp, Homo sapiens
tgtgatcacatctgggctgaag

SEQ ID NO: 8260996 - DNA, 22 bp, Homo sapiens
tgtgccctcagaagagtacatc

SEQ ID NO: 8260997 - DNA, 22 bp, Homo sapiens
tgtggaaaattggaacgttcct

SEQ ID NO: 8260998 - DNA, 22 bp, Homo sapiens
tgtgctccatcatccataatct

SEQ ID NO: 8260999 - DNA, 23 bp, Homo sapiens
tgtgctcccaaatgtaggtctat

SEQ ID NO: 8261000 - DNA, 23 bp, Homo sapiens
tgtctccatctcattacttgggg

SEQ ID NO: 8261001 - DNA, 22 bp, Homo sapiens
tgtctccattttcaagtagcag

SEQ ID NO: 8261002 - DNA, 22 bp, Homo sapiens
tgtctccaaaacaatctcagat

SEQ ID NO: 8261003 - DNA, 22 bp, Homo sapiens
tgtctccaactcactgtatact

SEQ ID NO: 8261004 - DNA, 22 bp, Homo sapiens
tgtctccacaggtgtcagctca

SEQ ID NO: 8261005 - DNA, 22 bp, Homo sapiens
tgtctccaccatcatcttacca

SEQ ID NO: 8261006 - DNA, 22 bp, Homo sapiens
tgtctccatagaagagactgca

SEQ ID NO: 8261007 - DNA, 22 bp, Homo sapiens
tgtctctgaggtgagggtcagc

SEQ ID NO: 8261008 - DNA, 19 bp, Homo sapiens
tgtctggaagagctgcagg

SEQ ID NO: 8261009 - DNA, 19 bp, Homo sapiens
tgtctgctgatgactctat

SEQ ID NO: 8261010 - DNA, 22 bp, Homo sapiens
tgtctggacattgacaatcatg

SEQ ID NO: 8261011 - DNA, 22 bp, Homo sapiens
tgtctggacagagattctcaat

SEQ ID NO: 8261012 - DNA, 22 bp, Homo sapiens
tgtctgggagggacagggctac

SEQ ID NO: 8261013 - DNA, 22 bp, Homo sapiens
tgtcttatgtagatactgagaa

SEQ ID NO: 8261014 - DNA, 22 bp, Homo sapiens
tgtcttctaccttgacagcatt

SEQ ID NO: 8261015 - DNA, 22 bp, Homo sapiens
tgtgtattaccattttacagct

SEQ ID NO: 8261016 - DNA, 22 bp, Homo sapiens
tgtgtatttctggaacagacta

SEQ ID NO: 8261017 - DNA, 22 bp, Homo sapiens
tgtggggacccatgccatgggc

SEQ ID NO: 8261018 - DNA, 22 bp, Homo sapiens
tgtggggacccatgccatgggc

SEQ ID NO: 8261019 - DNA, 22 bp, Homo sapiens
tgtggggactgagtggaggctt

SEQ ID NO: 8261020 - DNA, 22 bp, Homo sapiens
tgtgggaggaattagaatggga

SEQ ID NO: 8261021 - DNA, 22 bp, Homo sapiens
tgtgggaggtctggaaggctcc

SEQ ID NO: 8261022 - DNA, 22 bp, Homo sapiens
tgtgggcactaatgacatgcag

SEQ ID NO: 8261023 - DNA, 22 bp, Homo sapiens
tgtgggctgtactgagggcagg

SEQ ID NO: 8261024 - DNA, 22 bp, Homo sapiens
tgtgggctctaatggcagcaga

SEQ ID NO: 8261025 - DNA, 22 bp, Homo sapiens
tgtgggcctcagcaggactcca

SEQ ID NO: 8261026 - DNA, 22 bp, Homo sapiens
tgtgggccaggaggcctcagtg

SEQ ID NO: 8261027 - DNA, 22 bp, Homo sapiens
tgtgggacagggacagcaagag

SEQ ID NO: 8261028 - DNA, 22 bp, Homo sapiens
tgtgggacctcagagggtcccc

SEQ ID NO: 8261029 - DNA, 22 bp, Homo sapiens
tgtgggaggaacacagccagaa

SEQ ID NO: 8261030 - DNA, 22 bp, Homo sapiens
tgtgggagaaggaagcaagctg

SEQ ID NO: 8261031 - DNA, 20 bp, Homo sapiens
tgttgggatgaagttaacct

SEQ ID NO: 8261032 - DNA, 22 bp, Homo sapiens
tgttgggatcgaatggtggaac

SEQ ID NO: 8261033 - DNA, 22 bp, Homo sapiens
tgttgggaagctctgccagggg

SEQ ID NO: 8261034 - DNA, 22 bp, Homo sapiens
tgttgggaattgtgagtaatgg

SEQ ID NO: 8261035 - DNA, 22 bp, Homo sapiens
tgtttggaaacactggcagaaa

SEQ ID NO: 8261036 - DNA, 22 bp, Homo sapiens
tgtttggaaacactggcagaaa

SEQ ID NO: 8261037 - DNA, 22 bp, Homo sapiens
acacggcactttaggaaggggc

SEQ ID NO: 8261038 - DNA, 22 bp, Homo sapiens
aagaggaggattgatgtgggag

SEQ ID NO: 8261039 - DNA, 22 bp, Homo sapiens
aagaggaggattgatgtgggag

SEQ ID NO: 8261040 - DNA, 22 bp, Homo sapiens
aagaggagtagatgtggttggt

SEQ ID NO: 8261041 - DNA, 23 bp, Homo sapiens
aagaggaggccctgctcccgtcc

SEQ ID NO: 8261042 - DNA, 22 bp, Homo sapiens
acagatatttggggaaagacgt

SEQ ID NO: 8261043 - DNA, 22 bp, Homo sapiens
aagatataataactgttgtcat

SEQ ID NO: 8261044 - DNA, 22 bp, Homo sapiens
aagatatagataaaactatgca

SEQ ID NO: 8261045 - DNA, 22 bp, Homo sapiens
aagatatactattaagtaccat

SEQ ID NO: 8261046 - DNA, 22 bp, Homo sapiens
aactttattgttaggggctaaa

SEQ ID NO: 8261047 - DNA, 22 bp, Homo sapiens
aactttatcggaacaggtactc

SEQ ID NO: 8261048 - DNA, 22 bp, Homo sapiens
aactttattgttaggggctaaa

SEQ ID NO: 8261049 - DNA, 22 bp, Homo sapiens
aactttatcggaacaggtactc

SEQ ID NO: 8261050 - DNA, 22 bp, Homo sapiens
acaactctcagttaaataaaga

SEQ ID NO: 8261051 - DNA, 22 bp, Homo sapiens
aattcacaaaaccagattgctt

SEQ ID NO: 8261052 - DNA, 22 bp, Homo sapiens
aagctgtcagtgtcaggctaaa

SEQ ID NO: 8261053 - DNA, 22 bp, Homo sapiens
aagctgtcaggaggttaccttt

SEQ ID NO: 8261054 - DNA, 22 bp, Homo sapiens
aagctgtcaatgtatctagtct

SEQ ID NO: 8261055 - DNA, 22 bp, Homo sapiens
aagctgggacttagcgcagata

SEQ ID NO: 8261056 - DNA, 22 bp, Homo sapiens
aagggagcggggagaccctatg

SEQ ID NO: 8261057 - DNA, 21 bp, Homo sapiens
aagggagataggaatcaggcc

SEQ ID NO: 8261058 - DNA, 22 bp, Homo sapiens
aagggaggaggatttattgtac

SEQ ID NO: 8261059 - DNA, 22 bp, Homo sapiens
aaggggagttagtgataaaacc

SEQ ID NO: 8261060 - DNA, 22 bp, Homo sapiens
aaggggagatgtcatgggccct

SEQ ID NO: 8261061 - DNA, 21 bp, Homo sapiens
aaggggcaaacccaggacacc

SEQ ID NO: 8261062 - DNA, 22 bp, Homo sapiens
aaggggcacaattgtacccaag

SEQ ID NO: 8261063 - DNA, 21 bp, Homo sapiens
aaggggcaaacccaggacacc

SEQ ID NO: 8261064 - DNA, 22 bp, Homo sapiens
aaggggcatgcttttgccagga

SEQ ID NO: 8261065 - DNA, 22 bp, Homo sapiens
aagggagacagttgtgtgagga

SEQ ID NO: 8261066 - DNA, 22 bp, Homo sapiens
aaggccagacaggaccacatct

SEQ ID NO: 8261067 - DNA, 22 bp, Homo sapiens
aaggccagactctggaatgaca

SEQ ID NO: 8261068 - DNA, 23 bp, Homo sapiens
aaggccagaatttcaatggtgcc

SEQ ID NO: 8261069 - DNA, 20 bp, Homo sapiens
aataaactactgagagatgt

SEQ ID NO: 8261070 - DNA, 22 bp, Homo sapiens
aataaactgctcaattgcatca

SEQ ID NO: 8261071 - DNA, 22 bp, Homo sapiens
aataaacttccactgtgttttt

SEQ ID NO: 8261072 - DNA, 22 bp, Homo sapiens
aactcagttacatattagaata

SEQ ID NO: 8261073 - DNA, 22 bp, Homo sapiens
aactcagttacatattagaata

SEQ ID NO: 8261074 - DNA, 22 bp, Homo sapiens
aaccatgaatgggttctggtgt

SEQ ID NO: 8261075 - DNA, 22 bp, Homo sapiens
aaccagatcgactgttaacagc

SEQ ID NO: 8261076 - DNA, 22 bp, Homo sapiens
aaccagaggggccctgcctggg

SEQ ID NO: 8261077 - DNA, 22 bp, Homo sapiens
aaccagagtgacactctacaga

SEQ ID NO: 8261078 - DNA, 22 bp, Homo sapiens
aagagcagtgttttactcagct

SEQ ID NO: 8261079 - DNA, 22 bp, Homo sapiens
aagagagagttcctaggcaaaa

SEQ ID NO: 8261080 - DNA, 22 bp, Homo sapiens
aagagccatatatgcagctaga

SEQ ID NO: 8261081 - DNA, 22 bp, Homo sapiens
aagaaagggctattgttctcca

SEQ ID NO: 8261082 - DNA, 22 bp, Homo sapiens
aaatatcattctggtgcacaga

SEQ ID NO: 8261083 - DNA, 18 bp, Homo sapiens
aagaggaggagcaggttg

SEQ ID NO: 8261084 - DNA, 22 bp, Homo sapiens
aagaggagacttcagcaacttg

SEQ ID NO: 8261085 - DNA, 22 bp, Homo sapiens
aagaggagacttcagcaacttg

SEQ ID NO: 8261086 - DNA, 22 bp, Homo sapiens
aacagcagctgaggagctgggc

SEQ ID NO: 8261087 - DNA, 22 bp, Homo sapiens
aaatggtccatcctaaagaagt

SEQ ID NO: 8261088 - DNA, 23 bp, Homo sapiens
aactgagataatgtatgtaaagc

SEQ ID NO: 8261089 - DNA, 22 bp, Homo sapiens
aactcagtgtgtttcttagtat

SEQ ID NO: 8261090 - DNA, 22 bp, Homo sapiens
aactcacagctgtttggattag

SEQ ID NO: 8261091 - DNA, 22 bp, Homo sapiens
aaacaaatttcaagctgtgaca

SEQ ID NO: 8261092 - DNA, 22 bp, Homo sapiens
aaacaaatagtgcatgggaatt

SEQ ID NO: 8261093 - DNA, 22 bp, Homo sapiens
aaacatgagcatctcttcaagc

SEQ ID NO: 8261094 - DNA, 22 bp, Homo sapiens
aaacatgagcacttgcttcata

SEQ ID NO: 8261095 - DNA, 22 bp, Homo sapiens
aaacatgagcatttctgtttaa

SEQ ID NO: 8261096 - DNA, 22 bp, Homo sapiens
aaactttaaatttgtacctctg

SEQ ID NO: 8261097 - DNA, 22 bp, Homo sapiens
aaactttaagacagtcctcaag

SEQ ID NO: 8261098 - DNA, 22 bp, Homo sapiens
aaactttaggaaggaatttaca

SEQ ID NO: 8261099 - DNA, 22 bp, Homo sapiens
aaacttgatctgtgaccttgct

SEQ ID NO: 8261100 - DNA, 22 bp, Homo sapiens
aaacttgaaaggtactgttggt

SEQ ID NO: 8261101 - DNA, 20 bp, Homo sapiens
agagagacctaggcctagtc

SEQ ID NO: 8261102 - DNA, 22 bp, Homo sapiens
agagagacgggggctgctgctt

SEQ ID NO: 8261103 - DNA, 19 bp, Homo sapiens
agagatccagcttctagct

SEQ ID NO: 8261104 - DNA, 22 bp, Homo sapiens
agagatcccttctgcctgggga

SEQ ID NO: 8261105 - DNA, 22 bp, Homo sapiens
agagatccttcaatctagtttt

SEQ ID NO: 8261106 - DNA, 22 bp, Homo sapiens
agagatctagcacctgctggtc

SEQ ID NO: 8261107 - DNA, 22 bp, Homo sapiens
agagatctctgaagctgctgct

SEQ ID NO: 8261108 - DNA, 22 bp, Homo sapiens
aattcacaattatgttgggaga

SEQ ID NO: 8261109 - DNA, 22 bp, Homo sapiens
agactctggagtcagctaggat

SEQ ID NO: 8261110 - DNA, 22 bp, Homo sapiens
agactggatagctttggacttg

SEQ ID NO: 8261111 - DNA, 23 bp, Homo sapiens
agactggggcataagaagatggc

SEQ ID NO: 8261112 - DNA, 22 bp, Homo sapiens
agaatcagtgctggctattagc

SEQ ID NO: 8261113 - DNA, 23 bp, Homo sapiens
aatgctggaaattcaggcatgat

SEQ ID NO: 8261114 - DNA, 22 bp, Homo sapiens
agagggcccatgttgggctgct

SEQ ID NO: 8261115 - DNA, 22 bp, Homo sapiens
agaggccaatagtaggtggcat

SEQ ID NO: 8261116 - DNA, 19 bp, Homo sapiens
agaggcagtctccaacagg

SEQ ID NO: 8261117 - DNA, 22 bp, Homo sapiens
agaggcagtatacaatccgagc

SEQ ID NO: 8261118 - DNA, 21 bp, Homo sapiens
agaggcaggcattaagtacac

SEQ ID NO: 8261119 - DNA, 22 bp, Homo sapiens
agagcagctgcattcagcacct

SEQ ID NO: 8261120 - DNA, 22 bp, Homo sapiens
aattcacaggatcacaggagag

SEQ ID NO: 8261121 - DNA, 22 bp, Homo sapiens
aattcacatgcatgtctgtgca

SEQ ID NO: 8261122 - DNA, 21 bp, Homo sapiens
agatcctggggtctggggagg

SEQ ID NO: 8261123 - DNA, 22 bp, Homo sapiens
agatcctgccaatggaagcagg

SEQ ID NO: 8261124 - DNA, 22 bp, Homo sapiens
agatccagttaatagcttcatt

SEQ ID NO: 8261125 - DNA, 22 bp, Homo sapiens
agatatgtttgtatatatttgt

SEQ ID NO: 8261126 - DNA, 22 bp, Homo sapiens
agatatgtccctgtctaatatt

SEQ ID NO: 8261127 - DNA, 22 bp, Homo sapiens
agataatgttctgatccatttc

SEQ ID NO: 8261128 - DNA, 22 bp, Homo sapiens
acaaaaagctccattactgtcc

SEQ ID NO: 8261129 - DNA, 22 bp, Homo sapiens
agaggtggccatgggcgctgga

SEQ ID NO: 8261130 - DNA, 22 bp, Homo sapiens
agcaggccaaggaactttgtgg

SEQ ID NO: 8261131 - DNA, 22 bp, Homo sapiens
agcagctctggcactgtagcat

SEQ ID NO: 8261132 - DNA, 22 bp, Homo sapiens
agcagctcttaacaaagcatgg

SEQ ID NO: 8261133 - DNA, 22 bp, Homo sapiens
agcagctctgtttacctggagg

SEQ ID NO: 8261134 - DNA, 22 bp, Homo sapiens
agcagctcctgtttttgggata

SEQ ID NO: 8261135 - DNA, 22 bp, Homo sapiens
agcagctcgggctacagagggg

SEQ ID NO: 8261136 - DNA, 22 bp, Homo sapiens
agcagctcggccagtcaccagg

SEQ ID NO: 8261137 - DNA, 22 bp, Homo sapiens
agcagctctgagaggccagcac

SEQ ID NO: 8261138 - DNA, 22 bp, Homo sapiens
agcagctcctgccatgagtgct

SEQ ID NO: 8261139 - DNA, 22 bp, Homo sapiens
agcagcccaaacagactaagac

SEQ ID NO: 8261140 - DNA, 22 bp, Homo sapiens
agcaggagggttttgtagagtc

SEQ ID NO: 8261141 - DNA, 21 bp, Homo sapiens
agcaggaggcagtcacagctc

SEQ ID NO: 8261142 - DNA, 22 bp, Homo sapiens
agcaggagggttttgtagagtc

SEQ ID NO: 8261143 - DNA, 22 bp, Homo sapiens
agcaggagggttttgtagagtc

SEQ ID NO: 8261144 - DNA, 22 bp, Homo sapiens
agcaggagctgtgggaagatgg

SEQ ID NO: 8261145 - DNA, 22 bp, Homo sapiens
agcaggaggagagcctggcggt

SEQ ID NO: 8261146 - DNA, 19 bp, Homo sapiens
agcagcagcaccagggatt

SEQ ID NO: 8261147 - DNA, 23 bp, Homo sapiens
agcagcagcaattaagtggatat

SEQ ID NO: 8261148 - DNA, 22 bp, Homo sapiens
agcagcagattcagcaggaatg

SEQ ID NO: 8261149 - DNA, 22 bp, Homo sapiens
agcagcagattatggtctacat

SEQ ID NO: 8261150 - DNA, 22 bp, Homo sapiens
agatttgaaacttgcttcataa

SEQ ID NO: 8261151 - DNA, 22 bp, Homo sapiens
agcatctggtgagggcctagtt

SEQ ID NO: 8261152 - DNA, 22 bp, Homo sapiens
agcatctgcttaatggcttaac

SEQ ID NO: 8261153 - DNA, 22 bp, Homo sapiens
agcccctgtcctctctgatgac

SEQ ID NO: 8261154 - DNA, 22 bp, Homo sapiens
agccctgcaggatgagggaggt

SEQ ID NO: 8261155 - DNA, 22 bp, Homo sapiens
agccctgccattctctggagct

SEQ ID NO: 8261156 - DNA, 22 bp, Homo sapiens
agccctgggttagggtgggagc

SEQ ID NO: 8261157 - DNA, 22 bp, Homo sapiens
agcctgtggaaactgggtgcag

SEQ ID NO: 8261158 - DNA, 22 bp, Homo sapiens
agcctgtgttgctctggcgata

SEQ ID NO: 8261159 - DNA, 22 bp, Homo sapiens
agctccaggtcagtgcacccct

SEQ ID NO: 8261160 - DNA, 22 bp, Homo sapiens
acagatttttggtaaataattt

SEQ ID NO: 8261161 - DNA, 21 bp, Homo sapiens
acaggagaccgcctggcagtc

SEQ ID NO: 8261162 - DNA, 21 bp, Homo sapiens
acaggagaccgcctggcagtc

SEQ ID NO: 8261163 - DNA, 22 bp, Homo sapiens
acaggaggagctgtttcaggga

SEQ ID NO: 8261164 - DNA, 22 bp, Homo sapiens
acaggaggagcagctgtgtgcc

SEQ ID NO: 8261165 - DNA, 22 bp, Homo sapiens
acagtgtccttgtggtccctgt

SEQ ID NO: 8261166 - DNA, 22 bp, Homo sapiens
acagtgtcatgtcgtgttcccc

SEQ ID NO: 8261167 - DNA, 22 bp, Homo sapiens
acagtgtccccagctctgtgag

SEQ ID NO: 8261168 - DNA, 22 bp, Homo sapiens
acagtgtcatcagtttctcaac

SEQ ID NO: 8261169 - DNA, 20 bp, Homo sapiens
acagtgggtggggagcactg

SEQ ID NO: 8261170 - DNA, 22 bp, Homo sapiens
acagtggtaggataactgtttt

SEQ ID NO: 8261171 - DNA, 22 bp, Homo sapiens
acagtggtgagtgactgatagg

SEQ ID NO: 8261172 - DNA, 22 bp, Homo sapiens
acagtggtggctttgctatgct

SEQ ID NO: 8261173 - DNA, 18 bp, Homo sapiens
acagtggtttgatgtgct

SEQ ID NO: 8261174 - DNA, 22 bp, Homo sapiens
aaggccaggacaccaggggact

SEQ ID NO: 8261175 - DNA, 22 bp, Homo sapiens
aaggccagcttgtagggctggt

SEQ ID NO: 8261176 - DNA, 22 bp, Homo sapiens
aaggccaggagacttggagtca

SEQ ID NO: 8261177 - DNA, 22 bp, Homo sapiens
acatacttctttacattccata

SEQ ID NO: 8261178 - DNA, 22 bp, Homo sapiens
acatacttagagtaaacaagta

SEQ ID NO: 8261179 - DNA, 22 bp, Homo sapiens
acatacttaacattaaagtcat

SEQ ID NO: 8261180 - DNA, 23 bp, Homo sapiens
accagctgccctgaactttgtgc

SEQ ID NO: 8261181 - DNA, 22 bp, Homo sapiens
accagctgccttttcttagtag

SEQ ID NO: 8261182 - DNA, 22 bp, Homo sapiens
accaggccaaaatcatatttac

SEQ ID NO: 8261183 - DNA, 22 bp, Homo sapiens
accaggccaacagctaagttaa

SEQ ID NO: 8261184 - DNA, 22 bp, Homo sapiens
accagctggcccatgagcacgt

SEQ ID NO: 8261185 - DNA, 22 bp, Homo sapiens
accagctggtcagggcttttct

SEQ ID NO: 8261186 - DNA, 22 bp, Homo sapiens
acttagtgccctggcccttaca

SEQ ID NO: 8261187 - DNA, 22 bp, Homo sapiens
acttatactaaagtattatttg

SEQ ID NO: 8261188 - DNA, 22 bp, Homo sapiens
aatctgtcccttaactagtcat

SEQ ID NO: 8261189 - DNA, 22 bp, Homo sapiens
actcagtgaattttcatcaaat

SEQ ID NO: 8261190 - DNA, 23 bp, Homo sapiens
actcagtgagggccttgggctgc

SEQ ID NO: 8261191 - DNA, 22 bp, Homo sapiens
actcagagcagagcagcctgag

SEQ ID NO: 8261192 - DNA, 22 bp, Homo sapiens
actcagtggcactttggaattt

SEQ ID NO: 8261193 - DNA, 22 bp, Homo sapiens
actcagttatcatgtgtccaca

SEQ ID NO: 8261194 - DNA, 22 bp, Homo sapiens
aagtgacataccttacatatgt

SEQ ID NO: 8261195 - DNA, 22 bp, Homo sapiens
aagtgacataaaatctcccagg

SEQ ID NO: 8261196 - DNA, 17 bp, Homo sapiens
aagtgacatcaggctgc

SEQ ID NO: 8261197 - DNA, 22 bp, Homo sapiens
aagtgacacctcttccctttcc

SEQ ID NO: 8261198 - DNA, 22 bp, Homo sapiens
aagtgacagtttacaattctta

SEQ ID NO: 8261199 - DNA, 22 bp, Homo sapiens
aagtgacagtgaactgggactc

SEQ ID NO: 8261200 - DNA, 22 bp, Homo sapiens
aagtgacacatttgtgatgaat

SEQ ID NO: 8261201 - DNA, 22 bp, Homo sapiens
aagtgacacatggcacttctat

SEQ ID NO: 8261202 - DNA, 22 bp, Homo sapiens
aagtgacaaaagggtatccaaa

SEQ ID NO: 8261203 - DNA, 21 bp, Homo sapiens
acctttaattcaagcatcagg

SEQ ID NO: 8261204 - DNA, 22 bp, Homo sapiens
aagtctcttttcttcctgtatt

SEQ ID NO: 8261205 - DNA, 22 bp, Homo sapiens
agcggcagcagatgtgatcagg

SEQ ID NO: 8261206 - DNA, 22 bp, Homo sapiens
agctagagaatgacagagtctg

SEQ ID NO: 8261207 - DNA, 22 bp, Homo sapiens
agctcctgtggcagctcttctg

SEQ ID NO: 8261208 - DNA, 22 bp, Homo sapiens
agctcctgtggctgaaagagga

SEQ ID NO: 8261209 - DNA, 22 bp, Homo sapiens
agctctgtggccttgggtgaat

SEQ ID NO: 8261210 - DNA, 22 bp, Homo sapiens
agctctgtgcaggcagaggcat

SEQ ID NO: 8261211 - DNA, 22 bp, Homo sapiens
agctctggtttagaaggggaaa

SEQ ID NO: 8261212 - DNA, 19 bp, Homo sapiens
agctctgtcaggctacata

SEQ ID NO: 8261213 - DNA, 22 bp, Homo sapiens
agctcttacatttaggtctatg

SEQ ID NO: 8261214 - DNA, 22 bp, Homo sapiens
agctcctggcaaggtcatggtg

SEQ ID NO: 8261215 - DNA, 22 bp, Homo sapiens
agctccagccctagtacagctg

SEQ ID NO: 8261216 - DNA, 22 bp, Homo sapiens
agctccagccctagtacagctg

SEQ ID NO: 8261217 - DNA, 22 bp, Homo sapiens
agctagccatgtggctcctgtg

SEQ ID NO: 8261218 - DNA, 21 bp, Homo sapiens
agctccaggctcctggggttc

SEQ ID NO: 8261219 - DNA, 22 bp, Homo sapiens
agctccaggataagacaggtgc

SEQ ID NO: 8261220 - DNA, 22 bp, Homo sapiens
agccctgattaaccttggcttt

SEQ ID NO: 8261221 - DNA, 23 bp, Homo sapiens
agccctgctgagacccagctccc

SEQ ID NO: 8261222 - DNA, 22 bp, Homo sapiens
agccccagttccctggaagtct

SEQ ID NO: 8261223 - DNA, 22 bp, Homo sapiens
agccccagtccgctgcgggcgg

SEQ ID NO: 8261224 - DNA, 22 bp, Homo sapiens
agccctgagctggcctgggctt

SEQ ID NO: 8261225 - DNA, 22 bp, Homo sapiens
agcccccaaaagtgcttatgat

SEQ ID NO: 8261226 - DNA, 22 bp, Homo sapiens
agccctggagcaaaggtgtctt

SEQ ID NO: 8261227 - DNA, 22 bp, Homo sapiens
agccctggattctgaggtccaa

SEQ ID NO: 8261228 - DNA, 22 bp, Homo sapiens
agccctgggcacctgtgagggg

SEQ ID NO: 8261229 - DNA, 22 bp, Homo sapiens
agcccagttgctccacgctgca

SEQ ID NO: 8261230 - DNA, 22 bp, Homo sapiens
agcccagtgggccgaggcgggg

SEQ ID NO: 8261231 - DNA, 22 bp, Homo sapiens
agcccatgcaacaggcctagcg

SEQ ID NO: 8261232 - DNA, 22 bp, Homo sapiens
agccccagtaagggagggcctg

SEQ ID NO: 8261233 - DNA, 22 bp, Homo sapiens
agccccaggcccggacgcctct

SEQ ID NO: 8261234 - DNA, 22 bp, Homo sapiens
agccccaggatgggccgcagga

SEQ ID NO: 8261235 - DNA, 22 bp, Homo sapiens
agccccagcccctctctcacaa

SEQ ID NO: 8261236 - DNA, 19 bp, Homo sapiens
agccagagtggcccagggg

SEQ ID NO: 8261237 - DNA, 22 bp, Homo sapiens
cactttatgggaagcaaaaatt

SEQ ID NO: 8261238 - DNA, 22 bp, Homo sapiens
cactttatattctaagacggcc

SEQ ID NO: 8261239 - DNA, 22 bp, Homo sapiens
cactttataaaattggtgtgag

SEQ ID NO: 8261240 - DNA, 22 bp, Homo sapiens
cactttatatgcattacctcat

SEQ ID NO: 8261241 - DNA, 22 bp, Homo sapiens
cactttattataaatttgagag

SEQ ID NO: 8261242 - DNA, 19 bp, Homo sapiens
cactttatttctgttttgt

SEQ ID NO: 8261243 - DNA, 22 bp, Homo sapiens
cagagcccaagagcaagccatg

SEQ ID NO: 8261244 - DNA, 22 bp, Homo sapiens
cagagccattatggagacttgc

SEQ ID NO: 8261245 - DNA, 17 bp, Homo sapiens
agcagggagtcaaggga

SEQ ID NO: 8261246 - DNA, 17 bp, Homo sapiens
agcagggagtcaaggga

SEQ ID NO: 8261247 - DNA, 22 bp, Homo sapiens
agcagggaggtctagcacgtgg

SEQ ID NO: 8261248 - DNA, 22 bp, Homo sapiens
agcagggaggcggtgtgctggc

SEQ ID NO: 8261249 - DNA, 22 bp, Homo sapiens
agcagggaggcccagggcactg

SEQ ID NO: 8261250 - DNA, 21 bp, Homo sapiens
agcagctgggcaacatggagg

SEQ ID NO: 8261251 - DNA, 22 bp, Homo sapiens
agcagggcaaagtcaggctaac

SEQ ID NO: 8261252 - DNA, 19 bp, Homo sapiens
agcagggagtggttgtggg

SEQ ID NO: 8261253 - DNA, 19 bp, Homo sapiens
agcagggagtggttgtggg

SEQ ID NO: 8261254 - DNA, 22 bp, Homo sapiens
agcagggcactggaaggcactg

SEQ ID NO: 8261255 - DNA, 22 bp, Homo sapiens
agcagggcagctgatgcgcacg

SEQ ID NO: 8261256 - DNA, 22 bp, Homo sapiens
agcagggcaggtaaggatcaga

SEQ ID NO: 8261257 - DNA, 22 bp, Homo sapiens
agcagggctgcagtgtgtcttt

SEQ ID NO: 8261258 - DNA, 22 bp, Homo sapiens
agcagggctctgccatgggccc

SEQ ID NO: 8261259 - DNA, 22 bp, Homo sapiens
caccagccccctcacgctgtca

SEQ ID NO: 8261260 - DNA, 22 bp, Homo sapiens
agcatggccacgggggtaggta

SEQ ID NO: 8261261 - DNA, 22 bp, Homo sapiens
agcatggctttggaggatagca

SEQ ID NO: 8261262 - DNA, 22 bp, Homo sapiens
agcatggcattattggaaggac

SEQ ID NO: 8261263 - DNA, 22 bp, Homo sapiens
agcagtggacctcagtgctatt

SEQ ID NO: 8261264 - DNA, 22 bp, Homo sapiens
agcagctcccctcatgctccac

SEQ ID NO: 8261265 - DNA, 22 bp, Homo sapiens
agcagctcatggagtaggcact

SEQ ID NO: 8261266 - DNA, 22 bp, Homo sapiens
cacagagaggcttgtctccaag

SEQ ID NO: 8261267 - DNA, 22 bp, Homo sapiens
cacagagatcggaacagaagta

SEQ ID NO: 8261268 - DNA, 21 bp, Homo sapiens
cacagagatattggtgagcct

SEQ ID NO: 8261269 - DNA, 19 bp, Homo sapiens
agcagctcagggaggcacc

SEQ ID NO: 8261270 - DNA, 22 bp, Homo sapiens
agcagctcagaggcaccagggc

SEQ ID NO: 8261271 - DNA, 22 bp, Homo sapiens
agcagctcaaagcctgcaagga

SEQ ID NO: 8261272 - DNA, 22 bp, Homo sapiens
agcagctcaacagtgtctctat

SEQ ID NO: 8261273 - DNA, 22 bp, Homo sapiens
cacagagattagaattagacta

SEQ ID NO: 8261274 - DNA, 22 bp, Homo sapiens
cacagagatggtctggcaggtg

SEQ ID NO: 8261275 - DNA, 22 bp, Homo sapiens
cacagagatggccagggcacat

SEQ ID NO: 8261276 - DNA, 17 bp, Homo sapiens
agcagctggcacaggag

SEQ ID NO: 8261277 - DNA, 21 bp, Homo sapiens
agcagcagatctggtgagggc

SEQ ID NO: 8261278 - DNA, 23 bp, Homo sapiens
agcagcccagatgccttccatcc

SEQ ID NO: 8261279 - DNA, 22 bp, Homo sapiens
agcagcccagttgtactgagtg

SEQ ID NO: 8261280 - DNA, 22 bp, Homo sapiens
agcagcccgaggatcatgtgtc

SEQ ID NO: 8261281 - DNA, 22 bp, Homo sapiens
agcagcccctcggcgggtgcgc

SEQ ID NO: 8261282 - DNA, 23 bp, Homo sapiens
agcagccctgggacctggcctgc

SEQ ID NO: 8261283 - DNA, 22 bp, Homo sapiens
agcagcagaggtcagaaaggta

SEQ ID NO: 8261284 - DNA, 22 bp, Homo sapiens
agcagcagagctctggtctgca

SEQ ID NO: 8261285 - DNA, 22 bp, Homo sapiens
agcagcagatcaaacaggcttg

SEQ ID NO: 8261286 - DNA, 22 bp, Homo sapiens
agcactgggaacgcatggggcc

SEQ ID NO: 8261287 - DNA, 22 bp, Homo sapiens
agcactggagtttagtgggatt

SEQ ID NO: 8261288 - DNA, 22 bp, Homo sapiens
agcacctgtgccctgatggaga

SEQ ID NO: 8261289 - DNA, 22 bp, Homo sapiens
agcacctgtgtggtagggaggt

SEQ ID NO: 8261290 - DNA, 22 bp, Homo sapiens
agcacctgcttaatgtgcagtg

SEQ ID NO: 8261291 - DNA, 22 bp, Homo sapiens
agcacctgcttgtgactaggga

SEQ ID NO: 8261292 - DNA, 22 bp, Homo sapiens
agcagagctgggatcctgggtc

SEQ ID NO: 8261293 - DNA, 22 bp, Homo sapiens
agcagagctttttggactcaga

SEQ ID NO: 8261294 - DNA, 22 bp, Homo sapiens
agcagagctattcttgtgcaat

SEQ ID NO: 8261295 - DNA, 22 bp, Homo sapiens
agcagagctgcagtggcctgct

SEQ ID NO: 8261296 - DNA, 22 bp, Homo sapiens
agcagagcggggcctccggaag

SEQ ID NO: 8261297 - DNA, 22 bp, Homo sapiens
agcagagcgcctgctcagaggg

SEQ ID NO: 8261298 - DNA, 22 bp, Homo sapiens
caagtgactgtgctggcaacat

SEQ ID NO: 8261299 - DNA, 22 bp, Homo sapiens
caagtgacattcaatactagag

SEQ ID NO: 8261300 - DNA, 22 bp, Homo sapiens
caagtgacttctttgagcccgt

SEQ ID NO: 8261301 - DNA, 22 bp, Homo sapiens
caagtgacagtttgaaagccag

SEQ ID NO: 8261302 - DNA, 22 bp, Homo sapiens
caagtgacaagacctgtgggcc

SEQ ID NO: 8261303 - DNA, 22 bp, Homo sapiens
agaatatatgactgcaagacta

SEQ ID NO: 8261304 - DNA, 22 bp, Homo sapiens
atgaagggtgtccctgtgagca

SEQ ID NO: 8261305 - DNA, 22 bp, Homo sapiens
atgaggctctcaacaccttgag

SEQ ID NO: 8261306 - DNA, 22 bp, Homo sapiens
atgcctggtcccacctctaggt

SEQ ID NO: 8261307 - DNA, 22 bp, Homo sapiens
agactgggtttgagacttagca

SEQ ID NO: 8261308 - DNA, 22 bp, Homo sapiens
agactggggttctggcaaggag

SEQ ID NO: 8261309 - DNA, 22 bp, Homo sapiens
agacctggatgtgagggaagta

SEQ ID NO: 8261310 - DNA, 22 bp, Homo sapiens
agacctttgctgcttcttatag

SEQ ID NO: 8261311 - DNA, 22 bp, Homo sapiens
agacctggtaagcaggttgggc

SEQ ID NO: 8261312 - DNA, 22 bp, Homo sapiens
agacctggtaagcaggttgggc

SEQ ID NO: 8261313 - DNA, 22 bp, Homo sapiens
agacctggagacctgagtggta

SEQ ID NO: 8261314 - DNA, 22 bp, Homo sapiens
atgcatttttgagtatgaatga

SEQ ID NO: 8261315 - DNA, 22 bp, Homo sapiens
atgcatttgtaaaatataatcg

SEQ ID NO: 8261316 - DNA, 22 bp, Homo sapiens
atgatacatcttgtttatttca

SEQ ID NO: 8261317 - DNA, 22 bp, Homo sapiens
atgatacattgcaaaattttaa

SEQ ID NO: 8261318 - DNA, 22 bp, Homo sapiens
atgatatacttcctagaacagt

SEQ ID NO: 8261319 - DNA, 22 bp, Homo sapiens
atgatatagagagtagattaaa

SEQ ID NO: 8261320 - DNA, 22 bp, Homo sapiens
agagaagggtgtagcctgggcc

SEQ ID NO: 8261321 - DNA, 22 bp, Homo sapiens
agagaagggtgtagcctgggcc

SEQ ID NO: 8261322 - DNA, 22 bp, Homo sapiens
agagagcctgagtggcagctat

SEQ ID NO: 8261323 - DNA, 22 bp, Homo sapiens
agagagctctgatgggaggtga

SEQ ID NO: 8261324 - DNA, 22 bp, Homo sapiens
agagaggcattcggtgatccca

SEQ ID NO: 8261325 - DNA, 22 bp, Homo sapiens
agagaggcgagttacctgtgct

SEQ ID NO: 8261326 - DNA, 19 bp, Homo sapiens
agagaggctgtgtgaggga

SEQ ID NO: 8261327 - DNA, 22 bp, Homo sapiens
agagaggctgctggactatatg

SEQ ID NO: 8261328 - DNA, 22 bp, Homo sapiens
agagaggctgggcgtagggctt

SEQ ID NO: 8261329 - DNA, 22 bp, Homo sapiens
agagctggctgctgcggtgctt

SEQ ID NO: 8261330 - DNA, 22 bp, Homo sapiens
agagctggctggtagccctgat

SEQ ID NO: 8261331 - DNA, 22 bp, Homo sapiens
agagctggatggtcaagatggc

SEQ ID NO: 8261332 - DNA, 22 bp, Homo sapiens
agagcctgaggccctgagaggg

SEQ ID NO: 8261333 - DNA, 22 bp, Homo sapiens
agagcctgaggccctgagaggg

SEQ ID NO: 8261334 - DNA, 22 bp, Homo sapiens
agagcctgagaggataatgggg

SEQ ID NO: 8261335 - DNA, 22 bp, Homo sapiens
agagccctgagtcagttctgga

SEQ ID NO: 8261336 - DNA, 22 bp, Homo sapiens
agagcctctgtcatggagagaa

SEQ ID NO: 8261337 - DNA, 22 bp, Homo sapiens
agagccctttctccaggcacct

SEQ ID NO: 8261338 - DNA, 22 bp, Homo sapiens
agagccctggagggcagtcccg

SEQ ID NO: 8261339 - DNA, 22 bp, Homo sapiens
agagcccaggcaggcatccagg

SEQ ID NO: 8261340 - DNA, 22 bp, Homo sapiens
agagcccatcagtggcagtgga

SEQ ID NO: 8261341 - DNA, 22 bp, Homo sapiens
agagcccaggtcctggagaggg

SEQ ID NO: 8261342 - DNA, 22 bp, Homo sapiens
agagcactttcgagagccggag

SEQ ID NO: 8261343 - DNA, 22 bp, Homo sapiens
agagcactgagtgagcaaggcc

SEQ ID NO: 8261344 - DNA, 22 bp, Homo sapiens
agaggccagcactgcagggaag

SEQ ID NO: 8261345 - DNA, 18 bp, Homo sapiens
agaggctggacaggggat

SEQ ID NO: 8261346 - DNA, 22 bp, Homo sapiens
agaggcaagggacctttctggg

SEQ ID NO: 8261347 - DNA, 19 bp, Homo sapiens
agaggcaagggctcatgac

SEQ ID NO: 8261348 - DNA, 22 bp, Homo sapiens
agagctggctgtgggtgacttt

SEQ ID NO: 8261349 - DNA, 22 bp, Homo sapiens
agagctgggaccgtctggaagt

SEQ ID NO: 8261350 - DNA, 22 bp, Homo sapiens
agaggaggctgggtccagataa

SEQ ID NO: 8261351 - DNA, 21 bp, Homo sapiens
agagctgggacttgcctgaga

SEQ ID NO: 8261352 - DNA, 22 bp, Homo sapiens
attacactaatgtgacaacaat

SEQ ID NO: 8261353 - DNA, 23 bp, Homo sapiens
agaggcaggagtggcttgcccgg

SEQ ID NO: 8261354 - DNA, 22 bp, Homo sapiens
agagtccatgaagacagctgag

SEQ ID NO: 8261355 - DNA, 22 bp, Homo sapiens
agagtccatatgtgggaggagt

SEQ ID NO: 8261356 - DNA, 22 bp, Homo sapiens
agagtgccctgctctgagctct

SEQ ID NO: 8261357 - DNA, 22 bp, Homo sapiens
agagtgcccaagcctggcaggg

SEQ ID NO: 8261358 - DNA, 22 bp, Homo sapiens
agagtgccactgacaggtccct

SEQ ID NO: 8261359 - DNA, 22 bp, Homo sapiens
agagtccaaatgtgcagttatg

SEQ ID NO: 8261360 - DNA, 22 bp, Homo sapiens
agagtcagcttatgacacagtc

SEQ ID NO: 8261361 - DNA, 22 bp, Homo sapiens
agaggggctcaagcagtggtct

SEQ ID NO: 8261362 - DNA, 22 bp, Homo sapiens
agaggggcgggaactcaacctc

SEQ ID NO: 8261363 - DNA, 22 bp, Homo sapiens
agaggggcaagtaaagagtctt

SEQ ID NO: 8261364 - DNA, 22 bp, Homo sapiens
agatgtggcctttgggagatta

SEQ ID NO: 8261365 - DNA, 20 bp, Homo sapiens
agcaagagtaaggacagcga

SEQ ID NO: 8261366 - DNA, 22 bp, Homo sapiens
caaaggcaggtcatggccactt

SEQ ID NO: 8261367 - DNA, 22 bp, Homo sapiens
caaagcagacgcagtaagggta

SEQ ID NO: 8261368 - DNA, 22 bp, Homo sapiens
agatattaatcgtacataaggt

SEQ ID NO: 8261369 - DNA, 22 bp, Homo sapiens
agatattaccagcagtctatgc

SEQ ID NO: 8261370 - DNA, 22 bp, Homo sapiens
agatattaggaggattcataat

SEQ ID NO: 8261371 - DNA, 17 bp, Homo sapiens
agatggcaggaggcaga

SEQ ID NO: 8261372 - DNA, 22 bp, Homo sapiens
agctgcagctacagtgttggtt

SEQ ID NO: 8261373 - DNA, 22 bp, Homo sapiens
agctgctgggatacagtagtga

SEQ ID NO: 8261374 - DNA, 22 bp, Homo sapiens
agctgcagccgcagctgtggcc

SEQ ID NO: 8261375 - DNA, 22 bp, Homo sapiens
agctccaggtgcaagtcatggt

SEQ ID NO: 8261376 - DNA, 21 bp, Homo sapiens
agctggctctctctggagaga

SEQ ID NO: 8261377 - DNA, 22 bp, Homo sapiens
agctggctatacttgaaaagtc

SEQ ID NO: 8261378 - DNA, 22 bp, Homo sapiens
agctggcctgttagagctgagt

SEQ ID NO: 8261379 - DNA, 21 bp, Homo sapiens
agctgctgtggccagaatcca

SEQ ID NO: 8261380 - DNA, 22 bp, Homo sapiens
agctgctgtgtgctcaggcagg

SEQ ID NO: 8261381 - DNA, 22 bp, Homo sapiens
agctgctggtttaagggatggg

SEQ ID NO: 8261382 - DNA, 22 bp, Homo sapiens
agctgctgtcctaggcactgta

SEQ ID NO: 8261383 - DNA, 22 bp, Homo sapiens
agctgtggggcaggcagcgagg

SEQ ID NO: 8261384 - DNA, 22 bp, Homo sapiens
agctgtgggcctgggagagctg

SEQ ID NO: 8261385 - DNA, 22 bp, Homo sapiens
agctgtggggaggaggctagca

SEQ ID NO: 8261386 - DNA, 22 bp, Homo sapiens
agctgtggttctgggcagcgac

SEQ ID NO: 8261387 - DNA, 22 bp, Homo sapiens
agctgtggtcttcaagttgcct

SEQ ID NO: 8261388 - DNA, 22 bp, Homo sapiens
agcttagtggttgtatgagtta

SEQ ID NO: 8261389 - DNA, 22 bp, Homo sapiens
agctgtgggatttgggtgtgcc

SEQ ID NO: 8261390 - DNA, 22 bp, Homo sapiens
agctgtggccagatgtgagcgg

SEQ ID NO: 8261391 - DNA, 21 bp, Homo sapiens
agctgtggcgaggggaacatg

SEQ ID NO: 8261392 - DNA, 22 bp, Homo sapiens
agctgggcaaaatgtgaggttg

SEQ ID NO: 8261393 - DNA, 22 bp, Homo sapiens
aggagacagtttggacgtgtag

SEQ ID NO: 8261394 - DNA, 22 bp, Homo sapiens
aggagacatactataggaatat

SEQ ID NO: 8261395 - DNA, 20 bp, Homo sapiens
aggaaggagaatctgagcaa

SEQ ID NO: 8261396 - DNA, 23 bp, Homo sapiens
aggagcccctaattctgggcagc

SEQ ID NO: 8261397 - DNA, 22 bp, Homo sapiens
aggagcccctcttcagtcctgg

SEQ ID NO: 8261398 - DNA, 22 bp, Homo sapiens
aggagccctgcgggaggcagag

SEQ ID NO: 8261399 - DNA, 22 bp, Homo sapiens
aggagccattttccaagggcga

SEQ ID NO: 8261400 - DNA, 22 bp, Homo sapiens
aggagccattgcaggatggcag

SEQ ID NO: 8261401 - DNA, 22 bp, Homo sapiens
aggagccatggaggtgaggcgg

SEQ ID NO: 8261402 - DNA, 22 bp, Homo sapiens
acaggggctccgaaggtgaggg

SEQ ID NO: 8261403 - DNA, 20 bp, Homo sapiens
aggagggacctggattggcg

SEQ ID NO: 8261404 - DNA, 22 bp, Homo sapiens
aggaggggcatagaaatgtaat

SEQ ID NO: 8261405 - DNA, 22 bp, Homo sapiens
aggagggtacaatgggtggaaa

SEQ ID NO: 8261406 - DNA, 22 bp, Homo sapiens
aggaggggttctcgggtgctga

SEQ ID NO: 8261407 - DNA, 21 bp, Homo sapiens
aggaggggtctttcccactga

SEQ ID NO: 8261408 - DNA, 22 bp, Homo sapiens
aggcaaagcgataccagagcta

SEQ ID NO: 8261409 - DNA, 22 bp, Homo sapiens
aggcaaagaagttggtcaggag

SEQ ID NO: 8261410 - DNA, 17 bp, Homo sapiens
aggcaacctttggtaca

SEQ ID NO: 8261411 - DNA, 22 bp, Homo sapiens
aggcacaagaaactgctcccca

SEQ ID NO: 8261412 - DNA, 22 bp, Homo sapiens
aggcaacctacatttttttgaa

SEQ ID NO: 8261413 - DNA, 22 bp, Homo sapiens
aggcaaccctggtgagcagatg

SEQ ID NO: 8261414 - DNA, 19 bp, Homo sapiens
aggcaaccaatgaggcaaa

SEQ ID NO: 8261415 - DNA, 22 bp, Homo sapiens
aggcacagagaatgccctccat

SEQ ID NO: 8261416 - DNA, 22 bp, Homo sapiens
aggcacagaatggcattcagtg

SEQ ID NO: 8261417 - DNA, 23 bp, Homo sapiens
acatacataagcaccacattttg

SEQ ID NO: 8261418 - DNA, 19 bp, Homo sapiens
aggcatgggaagagaagtc

SEQ ID NO: 8261419 - DNA, 22 bp, Homo sapiens
aggcatggcatggggcagatgt

SEQ ID NO: 8261420 - DNA, 20 bp, Homo sapiens
aggcagttagaaggagatga

SEQ ID NO: 8261421 - DNA, 22 bp, Homo sapiens
aggcagtgttcttctaagggca

SEQ ID NO: 8261422 - DNA, 22 bp, Homo sapiens
aggccacagcctgggaggtgac

SEQ ID NO: 8261423 - DNA, 22 bp, Homo sapiens
aggccacagatactgtgaagta

SEQ ID NO: 8261424 - DNA, 22 bp, Homo sapiens
aggccacaggagtactgtcggt

SEQ ID NO: 8261425 - DNA, 22 bp, Homo sapiens
aggccagcaagaaagagagtct

SEQ ID NO: 8261426 - DNA, 22 bp, Homo sapiens
aggcatgggtagaagagaagcc

SEQ ID NO: 8261427 - DNA, 18 bp, Homo sapiens
aggcatggtggtgcgcac

SEQ ID NO: 8261428 - DNA, 22 bp, Homo sapiens
aggccacagagagtgcatgtgc

SEQ ID NO: 8261429 - DNA, 22 bp, Homo sapiens
aggccagccctgggctgagaga

SEQ ID NO: 8261430 - DNA, 22 bp, Homo sapiens
aggccagccctcacctgtgttc

SEQ ID NO: 8261431 - DNA, 22 bp, Homo sapiens
aggccagcattctctctccagg

SEQ ID NO: 8261432 - DNA, 22 bp, Homo sapiens
aggccagcattctctctccagg

SEQ ID NO: 8261433 - DNA, 22 bp, Homo sapiens
aggcccagcttgaagtgggaag

SEQ ID NO: 8261434 - DNA, 22 bp, Homo sapiens
aggcccagctgggccaggaaca

SEQ ID NO: 8261435 - DNA, 23 bp, Homo sapiens
aggcccaggtatgtttgttttgg

SEQ ID NO: 8261436 - DNA, 21 bp, Homo sapiens
aggcccagctttcctcttgct

SEQ ID NO: 8261437 - DNA, 21 bp, Homo sapiens
aggcccaggaatatgcatttt

SEQ ID NO: 8261438 - DNA, 22 bp, Homo sapiens
aggcccagggctgctctctgaa

SEQ ID NO: 8261439 - DNA, 22 bp, Homo sapiens
aggctccagcagccagaggaag

SEQ ID NO: 8261440 - DNA, 22 bp, Homo sapiens
aggctccaggcctccctgcatg

SEQ ID NO: 8261441 - DNA, 22 bp, Homo sapiens
aggctgtgattccaccactctc

SEQ ID NO: 8261442 - DNA, 18 bp, Homo sapiens
aggcttcccaggcaggcc

SEQ ID NO: 8261443 - DNA, 19 bp, Homo sapiens
acattcccatcagcaatgt

SEQ ID NO: 8261444 - DNA, 22 bp, Homo sapiens
acccagggtagaacctcagagc

SEQ ID NO: 8261445 - DNA, 22 bp, Homo sapiens
acccagggtttgagctctgcag

SEQ ID NO: 8261446 - DNA, 22 bp, Homo sapiens
acccagggtcaccccgtagggt

SEQ ID NO: 8261447 - DNA, 22 bp, Homo sapiens
acccagggttcctgggtcccag

SEQ ID NO: 8261448 - DNA, 22 bp, Homo sapiens
accccagccctgcttctgggag

SEQ ID NO: 8261449 - DNA, 20 bp, Homo sapiens
accccagcccctctatctga

SEQ ID NO: 8261450 - DNA, 22 bp, Homo sapiens
accccagcgcatatggtctgcg

SEQ ID NO: 8261451 - DNA, 18 bp, Homo sapiens
accctctggcttctgagc

SEQ ID NO: 8261452 - DNA, 22 bp, Homo sapiens
accagtctgttgttgcagagtg

SEQ ID NO: 8261453 - DNA, 22 bp, Homo sapiens
accagtcttgttgccatgtctg

SEQ ID NO: 8261454 - DNA, 22 bp, Homo sapiens
accagtggatgaatgctggacc

SEQ ID NO: 8261455 - DNA, 22 bp, Homo sapiens
accagtgtcaccccaaccagga

SEQ ID NO: 8261456 - DNA, 22 bp, Homo sapiens
atacatcatgctccatatattt

SEQ ID NO: 8261457 - DNA, 22 bp, Homo sapiens
atacatctagagtcataaaaac

SEQ ID NO: 8261458 - DNA, 22 bp, Homo sapiens
atagatacattgttatatttgt

SEQ ID NO: 8261459 - DNA, 20 bp, Homo sapiens
atagatatcatctttagaag

SEQ ID NO: 8261460 - DNA, 22 bp, Homo sapiens
atagatatttgagttgtttcca

SEQ ID NO: 8261461 - DNA, 22 bp, Homo sapiens
atagatattagcaaaattttat

SEQ ID NO: 8261462 - DNA, 22 bp, Homo sapiens
actttgttcctttcacaaagaa

SEQ ID NO: 8261463 - DNA, 22 bp, Homo sapiens
actttaaagcagaatggctatg

SEQ ID NO: 8261464 - DNA, 21 bp, Homo sapiens
actttaatatacatgaggagg

SEQ ID NO: 8261465 - DNA, 18 bp, Homo sapiens
agtttttaggaagaaatg

SEQ ID NO: 8261466 - DNA, 22 bp, Homo sapiens
atctgccaagagaacgtgggtc

SEQ ID NO: 8261467 - DNA, 22 bp, Homo sapiens
agaaggcatcagaagtgtgtag

SEQ ID NO: 8261468 - DNA, 22 bp, Homo sapiens
agaaggcagatgggacggagca

SEQ ID NO: 8261469 - DNA, 22 bp, Homo sapiens
agaacagtcgtggtgagagaaa

SEQ ID NO: 8261470 - DNA, 22 bp, Homo sapiens
agtgctcctttcattgctgccc

SEQ ID NO: 8261471 - DNA, 22 bp, Homo sapiens
agtgctcctgccagctttctgg

SEQ ID NO: 8261472 - DNA, 22 bp, Homo sapiens
agtgctcctgaagcttgaggca

SEQ ID NO: 8261473 - DNA, 22 bp, Homo sapiens
agtgctccctagagttgtgcaa

SEQ ID NO: 8261474 - DNA, 22 bp, Homo sapiens
agtgctcctatggatcagttgt

SEQ ID NO: 8261475 - DNA, 22 bp, Homo sapiens
agtgctcctcagaagagttgga

SEQ ID NO: 8261476 - DNA, 22 bp, Homo sapiens
agtgctccaaaggttggtcatt

SEQ ID NO: 8261477 - DNA, 23 bp, Homo sapiens
agtgctcccaggacctggggcag

SEQ ID NO: 8261478 - DNA, 22 bp, Homo sapiens
agtgctccacattgcactattc

SEQ ID NO: 8261479 - DNA, 22 bp, Homo sapiens
agtgaagaggaagtggggcaca

SEQ ID NO: 8261480 - DNA, 22 bp, Homo sapiens
actgcacttacatagaggaggc

SEQ ID NO: 8261481 - DNA, 22 bp, Homo sapiens
actgagcctgtgccctcatcag

SEQ ID NO: 8261482 - DNA, 22 bp, Homo sapiens
actgagatttacatgttctagt

SEQ ID NO: 8261483 - DNA, 22 bp, Homo sapiens
actctgcctgaacctcctgcaa

SEQ ID NO: 8261484 - DNA, 22 bp, Homo sapiens
agtgtccttagttagctttggg

SEQ ID NO: 8261485 - DNA, 22 bp, Homo sapiens
agtgtccttgttattactgctc

SEQ ID NO: 8261486 - DNA, 22 bp, Homo sapiens
agtgtctcagccccaactagag

SEQ ID NO: 8261487 - DNA, 21 bp, Homo sapiens
agtgtctctggaagcacgtgt

SEQ ID NO: 8261488 - DNA, 22 bp, Homo sapiens
actgggcagggaaggagaccga

SEQ ID NO: 8261489 - DNA, 22 bp, Homo sapiens
agtgtcctggcaagggtttcag

SEQ ID NO: 8261490 - DNA, 22 bp, Homo sapiens
agtaccatctatgtgccaagca

SEQ ID NO: 8261491 - DNA, 22 bp, Homo sapiens
agtaccatctctgcctctgcct

SEQ ID NO: 8261492 - DNA, 22 bp, Homo sapiens
agtaccatgcttcctgactggt

SEQ ID NO: 8261493 - DNA, 22 bp, Homo sapiens
agtaccatcatttagatgtgtt

SEQ ID NO: 8261494 - DNA, 22 bp, Homo sapiens
agtaccattagattaggatgac

SEQ ID NO: 8261495 - DNA, 23 bp, Homo sapiens
agtaccatgtgttccttctcgtt

SEQ ID NO: 8261496 - DNA, 22 bp, Homo sapiens
agtaccattactcacttatttt

SEQ ID NO: 8261497 - DNA, 22 bp, Homo sapiens
agtaccattatccagtaaagga

SEQ ID NO: 8261498 - DNA, 22 bp, Homo sapiens
agtaccattccgttggagctgg

SEQ ID NO: 8261499 - DNA, 22 bp, Homo sapiens
aggtggggaaaccagcgatccc

SEQ ID NO: 8261500 - DNA, 22 bp, Homo sapiens
agtatacaaataaatgtgtaat

SEQ ID NO: 8261501 - DNA, 22 bp, Homo sapiens
agtatacagtaatgacatatct

SEQ ID NO: 8261502 - DNA, 22 bp, Homo sapiens
actctctggtattggcaagttt

SEQ ID NO: 8261503 - DNA, 22 bp, Homo sapiens
actctctgtggttctactttgc

SEQ ID NO: 8261504 - DNA, 22 bp, Homo sapiens
actctctgtctaaatgcagttt

SEQ ID NO: 8261505 - DNA, 22 bp, Homo sapiens
agtcaccaggttttagagacct

SEQ ID NO: 8261506 - DNA, 22 bp, Homo sapiens
aggtgaagttgaggaggcagaa

SEQ ID NO: 8261507 - DNA, 23 bp, Homo sapiens
actagaaaatgactttctccctg

SEQ ID NO: 8261508 - DNA, 22 bp, Homo sapiens
actagaaagcactaagctaggc

SEQ ID NO: 8261509 - DNA, 20 bp, Homo sapiens
actagaaagtcactgggggg

SEQ ID NO: 8261510 - DNA, 22 bp, Homo sapiens
actagaaagaagttttttgaga

SEQ ID NO: 8261511 - DNA, 22 bp, Homo sapiens
actagaaagcaaaagccatttc

SEQ ID NO: 8261512 - DNA, 22 bp, Homo sapiens
actagaaactaatggattatta

SEQ ID NO: 8261513 - DNA, 22 bp, Homo sapiens
actagaaaattcctagaaacta

SEQ ID NO: 8261514 - DNA, 22 bp, Homo sapiens
actagaaatgtattggtagctg

SEQ ID NO: 8261515 - DNA, 22 bp, Homo sapiens
actagaaagtttccagagttat

SEQ ID NO: 8261516 - DNA, 22 bp, Homo sapiens
actagaaattactcagaataaa

SEQ ID NO: 8261517 - DNA, 22 bp, Homo sapiens
aggtccaggcctcatgatggcc

SEQ ID NO: 8261518 - DNA, 22 bp, Homo sapiens
aggtccaggcatttgggttggg

SEQ ID NO: 8261519 - DNA, 22 bp, Homo sapiens
aggtccagctgttgcagcctcc

SEQ ID NO: 8261520 - DNA, 22 bp, Homo sapiens
aggtccaggagatttggcaatt

SEQ ID NO: 8261521 - DNA, 22 bp, Homo sapiens
aggtccaggatttgtggggtct

SEQ ID NO: 8261522 - DNA, 22 bp, Homo sapiens
aggtccagaggttgaacggtgg

SEQ ID NO: 8261523 - DNA, 22 bp, Homo sapiens
aggtccagagttgagatacaga

SEQ ID NO: 8261524 - DNA, 22 bp, Homo sapiens
acctttgagtgtattgtctttc

SEQ ID NO: 8261525 - DNA, 22 bp, Homo sapiens
aggtccagtgctcttggtggtt

SEQ ID NO: 8261526 - DNA, 21 bp, Homo sapiens
aggtccagttctgtcttggac

SEQ ID NO: 8261527 - DNA, 22 bp, Homo sapiens
aggtcaagggcaagagtgaggt

SEQ ID NO: 8261528 - DNA, 22 bp, Homo sapiens
aggtcaaggctgcagtgagctg

SEQ ID NO: 8261529 - DNA, 22 bp, Homo sapiens
aggtcaagtttagatagagtta

SEQ ID NO: 8261530 - DNA, 22 bp, Homo sapiens
aggtcaaggccaaaagagtggt

SEQ ID NO: 8261531 - DNA, 22 bp, Homo sapiens
agtggtaggggccatgccaaca

SEQ ID NO: 8261532 - DNA, 22 bp, Homo sapiens
agtggtagcattgggacttgca

SEQ ID NO: 8261533 - DNA, 22 bp, Homo sapiens
agtggtagaaaatgcagctcga

SEQ ID NO: 8261534 - DNA, 22 bp, Homo sapiens
agtggtagaattccatataccc

SEQ ID NO: 8261535 - DNA, 19 bp, Homo sapiens
agtggtagatgagcaggag

SEQ ID NO: 8261536 - DNA, 22 bp, Homo sapiens
agtggtagagtcaaggttgtaa

SEQ ID NO: 8261537 - DNA, 22 bp, Homo sapiens
agtggtagagagatactttagg

SEQ ID NO: 8261538 - DNA, 22 bp, Homo sapiens
agtggtagacaatttaaaaata

SEQ ID NO: 8261539 - DNA, 21 bp, Homo sapiens
ctctggagtttgaaggctggg

SEQ ID NO: 8261540 - DNA, 22 bp, Homo sapiens
ctctggagtgtctggccagggt

SEQ ID NO: 8261541 - DNA, 22 bp, Homo sapiens
agtgggtgagcttggtctagat

SEQ ID NO: 8261542 - DNA, 22 bp, Homo sapiens
agtggcccttagtggcaaagtc

SEQ ID NO: 8261543 - DNA, 22 bp, Homo sapiens
agtggccatggcaggtgagcat

SEQ ID NO: 8261544 - DNA, 22 bp, Homo sapiens
agtggccatccctcaggtaggc

SEQ ID NO: 8261545 - DNA, 22 bp, Homo sapiens
agtgtcctcaggctttgttcct

SEQ ID NO: 8261546 - DNA, 22 bp, Homo sapiens
ctctggatatgcactgggtgag

SEQ ID NO: 8261547 - DNA, 22 bp, Homo sapiens
agtgtcaatgccaacagtatat

SEQ ID NO: 8261548 - DNA, 22 bp, Homo sapiens
agtgtcacagacccaatcagga

SEQ ID NO: 8261549 - DNA, 22 bp, Homo sapiens
ctgagccagctggcatgtgcta

SEQ ID NO: 8261550 - DNA, 22 bp, Homo sapiens
agttccagctgtgaccagaaaa

SEQ ID NO: 8261551 - DNA, 22 bp, Homo sapiens
agtgtgctgtttccagaagggc

SEQ ID NO: 8261552 - DNA, 22 bp, Homo sapiens
agtgtggagccactgagtggct

SEQ ID NO: 8261553 - DNA, 22 bp, Homo sapiens
agtgtggcaggaatgactagaa

SEQ ID NO: 8261554 - DNA, 22 bp, Homo sapiens
agtgtttgtcccgttagaaatg

SEQ ID NO: 8261555 - DNA, 20 bp, Homo sapiens
agtgtttctcaacatggggc

SEQ ID NO: 8261556 - DNA, 22 bp, Homo sapiens
agtgtttgagacacatttcact

SEQ ID NO: 8261557 - DNA, 22 bp, Homo sapiens
agtgtttctggaatcagtgttt

SEQ ID NO: 8261558 - DNA, 22 bp, Homo sapiens
agtgcagggcctgcccagcagg

SEQ ID NO: 8261559 - DNA, 19 bp, Homo sapiens
agtgcattttatgtttcaa

SEQ ID NO: 8261560 - DNA, 22 bp, Homo sapiens
agtggcagtttgggagctacag

SEQ ID NO: 8261561 - DNA, 20 bp, Homo sapiens
agtggccactgcagagatgc

SEQ ID NO: 8261562 - DNA, 22 bp, Homo sapiens
agtggcaattgacaacaaagga

SEQ ID NO: 8261563 - DNA, 22 bp, Homo sapiens
agtggcaatgggagtggagaca

SEQ ID NO: 8261564 - DNA, 20 bp, Homo sapiens
agtggcaaggtctctgctca

SEQ ID NO: 8261565 - DNA, 22 bp, Homo sapiens
agtggcaaagtcttcagaagtt

SEQ ID NO: 8261566 - DNA, 22 bp, Homo sapiens
agtggagaagaggatggtctcc

SEQ ID NO: 8261567 - DNA, 22 bp, Homo sapiens
agtgagtttagggtgcaggtgt

SEQ ID NO: 8261568 - DNA, 22 bp, Homo sapiens
agtgaggggattcaggcaaggt

SEQ ID NO: 8261569 - DNA, 22 bp, Homo sapiens
agtctcaagggatgtctctata

SEQ ID NO: 8261570 - DNA, 18 bp, Homo sapiens
agtcttctgatccatttt

SEQ ID NO: 8261571 - DNA, 22 bp, Homo sapiens
ctatatctacatttgctgtttg

SEQ ID NO: 8261572 - DNA, 22 bp, Homo sapiens
agtcaggatatgccttgtgggc

SEQ ID NO: 8261573 - DNA, 22 bp, Homo sapiens
agtcacactggttgtttacagt

SEQ ID NO: 8261574 - DNA, 22 bp, Homo sapiens
agtcacacactgtcagttctgc

SEQ ID NO: 8261575 - DNA, 21 bp, Homo sapiens
ctaggaggcccagaagacctc

SEQ ID NO: 8261576 - DNA, 22 bp, Homo sapiens
ctagctgtgtaaaccgagctgc

SEQ ID NO: 8261577 - DNA, 22 bp, Homo sapiens
agtagggagaccggaggccgcc

SEQ ID NO: 8261578 - DNA, 22 bp, Homo sapiens
agtagcttggccctttgttctt

SEQ ID NO: 8261579 - DNA, 22 bp, Homo sapiens
agtaggaggcgggagcatgaag

SEQ ID NO: 8261580 - DNA, 22 bp, Homo sapiens
aggtggcagagctggcccagcg

SEQ ID NO: 8261581 - DNA, 22 bp, Homo sapiens
cctgtggggccatctcagtcac

SEQ ID NO: 8261582 - DNA, 22 bp, Homo sapiens
cctgtgggtacaacagggtcac

SEQ ID NO: 8261583 - DNA, 22 bp, Homo sapiens
cctgtgggagcccaggcagata

SEQ ID NO: 8261584 - DNA, 22 bp, Homo sapiens
aggtggcagcaggagatgtgga

SEQ ID NO: 8261585 - DNA, 18 bp, Homo sapiens
aggtcaggaaagcagagt

SEQ ID NO: 8261586 - DNA, 22 bp, Homo sapiens
aggtcagctgtgtgtgcatgag

SEQ ID NO: 8261587 - DNA, 22 bp, Homo sapiens
aggtcagaaaaggagagcattg

SEQ ID NO: 8261588 - DNA, 22 bp, Homo sapiens
cctgggaggctgaggctgcagt

SEQ ID NO: 8261589 - DNA, 21 bp, Homo sapiens
cctgggagaattgggtgtggc

SEQ ID NO: 8261590 - DNA, 22 bp, Homo sapiens
aggtaatagggttcagaattat

SEQ ID NO: 8261591 - DNA, 22 bp, Homo sapiens
aggtaaagaaaggtgtaacatt

SEQ ID NO: 8261592 - DNA, 22 bp, Homo sapiens
ataaactggtaggaaaacagta

SEQ ID NO: 8261593 - DNA, 22 bp, Homo sapiens
ataaacttgagtctcagagtat

SEQ ID NO: 8261594 - DNA, 22 bp, Homo sapiens
ataaactttagcggaaggagga

SEQ ID NO: 8261595 - DNA, 22 bp, Homo sapiens
ctgcctgggttcaagtcctgtt

SEQ ID NO: 8261596 - DNA, 22 bp, Homo sapiens
ctgcctggtgcggtgcccaccc

SEQ ID NO: 8261597 - DNA, 22 bp, Homo sapiens
ctgctgggcagaggctgcatga

SEQ ID NO: 8261598 - DNA, 22 bp, Homo sapiens
atacacatctatttaagagaca

SEQ ID NO: 8261599 - DNA, 22 bp, Homo sapiens
atacacatatgtgtgtatatgt

SEQ ID NO: 8261600 - DNA, 21 bp, Homo sapiens
atacacatacacataaatgtg

SEQ ID NO: 8261601 - DNA, 22 bp, Homo sapiens
ctgctggggtcagagcactggg

SEQ ID NO: 8261602 - DNA, 22 bp, Homo sapiens
ctggctgacacaaaggtatcga

SEQ ID NO: 8261603 - DNA, 22 bp, Homo sapiens
atagtgggtacaggggcagaga

SEQ ID NO: 8261604 - DNA, 22 bp, Homo sapiens
atatacacatgtgtatacattt

SEQ ID NO: 8261605 - DNA, 22 bp, Homo sapiens
atatacactccactgatacagg

SEQ ID NO: 8261606 - DNA, 22 bp, Homo sapiens
atatacatgggaatatgtggag

SEQ ID NO: 8261607 - DNA, 22 bp, Homo sapiens
atatacctcattctttgagtgc

SEQ ID NO: 8261608 - DNA, 22 bp, Homo sapiens
atatacttggagactatcattg

SEQ ID NO: 8261609 - DNA, 22 bp, Homo sapiens
atatacttggagactatcattg

SEQ ID NO: 8261610 - DNA, 22 bp, Homo sapiens
ctggcaggttatagagctgccc

SEQ ID NO: 8261611 - DNA, 22 bp, Homo sapiens
ctggccctaggcaaacacagat

SEQ ID NO: 8261612 - DNA, 22 bp, Homo sapiens
ctggcccttctcttgcttcctg

SEQ ID NO: 8261613 - DNA, 22 bp, Homo sapiens
ctggcccttgacttacagcagg

SEQ ID NO: 8261614 - DNA, 22 bp, Homo sapiens
ctggagtggccggtgctgtggc

SEQ ID NO: 8261615 - DNA, 18 bp, Homo sapiens
atattcaagaagacagag

SEQ ID NO: 8261616 - DNA, 22 bp, Homo sapiens
atattcactcctggtgagacta

SEQ ID NO: 8261617 - DNA, 23 bp, Homo sapiens
atattcacgccgccagaggtccc

SEQ ID NO: 8261618 - DNA, 22 bp, Homo sapiens
ctgggtggcgtctggggccagt

SEQ ID NO: 8261619 - DNA, 22 bp, Homo sapiens
ctgggaggcggaggttgcagtg

SEQ ID NO: 8261620 - DNA, 22 bp, Homo sapiens
ctgggaggcggaggttgcagtg

SEQ ID NO: 8261621 - DNA, 22 bp, Homo sapiens
atcacactgttattttagttaa

SEQ ID NO: 8261622 - DNA, 18 bp, Homo sapiens
atcacagagggggagtct

SEQ ID NO: 8261623 - DNA, 22 bp, Homo sapiens
ctgtaacttaatgagaggcaga

SEQ ID NO: 8261624 - DNA, 22 bp, Homo sapiens
ctgtctctgataagctcgaggg

SEQ ID NO: 8261625 - DNA, 22 bp, Homo sapiens
atcagtttttattaatgtagct

SEQ ID NO: 8261626 - DNA, 22 bp, Homo sapiens
atcagtttggtgctttcagtga

SEQ ID NO: 8261627 - DNA, 22 bp, Homo sapiens
atcataaagtgctatctgattg

SEQ ID NO: 8261628 - DNA, 23 bp, Homo sapiens
atctgttcatctgacacagattc

SEQ ID NO: 8261629 - DNA, 22 bp, Homo sapiens
atctgtctatgatatagtctgt

SEQ ID NO: 8261630 - DNA, 22 bp, Homo sapiens
catgtctgagtagagtgtgatt

SEQ ID NO: 8261631 - DNA, 22 bp, Homo sapiens
aggagtttcaaagcttccatgt

SEQ ID NO: 8261632 - DNA, 22 bp, Homo sapiens
aggatcaggccctctagggtag

SEQ ID NO: 8261633 - DNA, 19 bp, Homo sapiens
aggcacaggttgtctggac

SEQ ID NO: 8261634 - DNA, 19 bp, Homo sapiens
aggcacaggttgtctggac

SEQ ID NO: 8261635 - DNA, 22 bp, Homo sapiens
aggcactgattctcagagttac

SEQ ID NO: 8261636 - DNA, 22 bp, Homo sapiens
aggcagagagcagtggccgtct

SEQ ID NO: 8261637 - DNA, 16 bp, Homo sapiens
aggcagagatttaccc

SEQ ID NO: 8261638 - DNA, 22 bp, Homo sapiens
aggcagaggagaatgatcttcc

SEQ ID NO: 8261639 - DNA, 22 bp, Homo sapiens
aggcagaggaagggtggatttg

SEQ ID NO: 8261640 - DNA, 22 bp, Homo sapiens
aggcagagctgggttttgaaat

SEQ ID NO: 8261641 - DNA, 22 bp, Homo sapiens
aggcagagctaggaagaattgt

SEQ ID NO: 8261642 - DNA, 22 bp, Homo sapiens
aggcagagctgatgttctgtga

SEQ ID NO: 8261643 - DNA, 20 bp, Homo sapiens
aggcagagcgcacttttaga

SEQ ID NO: 8261644 - DNA, 23 bp, Homo sapiens
aggcagagccaaggtcaaaaccc

SEQ ID NO: 8261645 - DNA, 20 bp, Homo sapiens
aggcagctggccaggcaggt

SEQ ID NO: 8261646 - DNA, 22 bp, Homo sapiens
aggcagctggcagcacccaggg

SEQ ID NO: 8261647 - DNA, 19 bp, Homo sapiens
aggcagaggcttggctagc

SEQ ID NO: 8261648 - DNA, 22 bp, Homo sapiens
aggcagctttctggtgcaccat

SEQ ID NO: 8261649 - DNA, 22 bp, Homo sapiens
aggcagctttctgtaggggtgt

SEQ ID NO: 8261650 - DNA, 22 bp, Homo sapiens
aggcagcttaagccctggccca

SEQ ID NO: 8261651 - DNA, 22 bp, Homo sapiens
aggcagctttaactggtagtag

SEQ ID NO: 8261652 - DNA, 22 bp, Homo sapiens
aggcaggccctctggaaaggta

SEQ ID NO: 8261653 - DNA, 22 bp, Homo sapiens
aggcaggcccctgagaatagac

SEQ ID NO: 8261654 - DNA, 22 bp, Homo sapiens
aggagcagcccactcctgtcct

SEQ ID NO: 8261655 - DNA, 22 bp, Homo sapiens
aggagccaaattactagctctg

SEQ ID NO: 8261656 - DNA, 22 bp, Homo sapiens
aggagccaagatggggcaagta

SEQ ID NO: 8261657 - DNA, 22 bp, Homo sapiens
aggagctgggcccaaggatgct

SEQ ID NO: 8261658 - DNA, 22 bp, Homo sapiens
cagtgcaggaagtgagatgcct

SEQ ID NO: 8261659 - DNA, 22 bp, Homo sapiens
aggagggttctctggacagagg

SEQ ID NO: 8261660 - DNA, 22 bp, Homo sapiens
aggagggtttcaatgggatgag

SEQ ID NO: 8261661 - DNA, 22 bp, Homo sapiens
aggaggtgttgatagaaggttt

SEQ ID NO: 8261662 - DNA, 22 bp, Homo sapiens
catcattttattaaccaagaaa

SEQ ID NO: 8261663 - DNA, 22 bp, Homo sapiens
aggaggctgcaaccctgaggcc

SEQ ID NO: 8261664 - DNA, 22 bp, Homo sapiens
agctggtccttggcagttctca

SEQ ID NO: 8261665 - DNA, 22 bp, Homo sapiens
agctgggctccaagagggatct

SEQ ID NO: 8261666 - DNA, 22 bp, Homo sapiens
agctgggctgatgactcatgtt

SEQ ID NO: 8261667 - DNA, 22 bp, Homo sapiens
agctgggcagactgcagtggtt

SEQ ID NO: 8261668 - DNA, 20 bp, Homo sapiens
agctggagaagggcccttcc

SEQ ID NO: 8261669 - DNA, 22 bp, Homo sapiens
agctggagatgcccagcaccgg

SEQ ID NO: 8261670 - DNA, 22 bp, Homo sapiens
agctggagccagtgtgaggctt

SEQ ID NO: 8261671 - DNA, 22 bp, Homo sapiens
agctgctgggaccccagatcca

SEQ ID NO: 8261672 - DNA, 22 bp, Homo sapiens
agctgctgggagaagtgagcca

SEQ ID NO: 8261673 - DNA, 18 bp, Homo sapiens
agctgccctgggctggag

SEQ ID NO: 8261674 - DNA, 22 bp, Homo sapiens
caggaagaccagggctgtggct

SEQ ID NO: 8261675 - DNA, 22 bp, Homo sapiens
aggaaggtgcagtagggtgtgc

SEQ ID NO: 8261676 - DNA, 22 bp, Homo sapiens
aggaagggtgtcatgagccctt

SEQ ID NO: 8261677 - DNA, 22 bp, Homo sapiens
aggaagatgtgcaaagttggaa

SEQ ID NO: 8261678 - DNA, 22 bp, Homo sapiens
agcttctggaaggcaaggcttg

SEQ ID NO: 8261679 - DNA, 20 bp, Homo sapiens
agcttctgctgcctttcggc

SEQ ID NO: 8261680 - DNA, 22 bp, Homo sapiens
agcttctgttcatcttccaggc

SEQ ID NO: 8261681 - DNA, 23 bp, Homo sapiens
agcttctggttcaggtcaagcag

SEQ ID NO: 8261682 - DNA, 22 bp, Homo sapiens
agctttctggttacagtcttca

SEQ ID NO: 8261683 - DNA, 22 bp, Homo sapiens
ccaggctggagtatagtggcgc

SEQ ID NO: 8261684 - DNA, 22 bp, Homo sapiens
aggctacaataattcccatgca

SEQ ID NO: 8261685 - DNA, 22 bp, Homo sapiens
aggctaagatgtggtctgagca

SEQ ID NO: 8261686 - DNA, 22 bp, Homo sapiens
ccagggcctgccacttagcaag

SEQ ID NO: 8261687 - DNA, 22 bp, Homo sapiens
ccagggcctgagggcgacgccc

SEQ ID NO: 8261688 - DNA, 22 bp, Homo sapiens
ccagggcctcgtgttctgagtg

SEQ ID NO: 8261689 - DNA, 22 bp, Homo sapiens
ccatttgtgcttcttcaaagca

SEQ ID NO: 8261690 - DNA, 22 bp, Homo sapiens
ccatttgtgatgtggcagcatc

SEQ ID NO: 8261691 - DNA, 22 bp, Homo sapiens
ccatttgttgtgtattaatatt

SEQ ID NO: 8261692 - DNA, 22 bp, Homo sapiens
aggctgggaaggtaaagttgta

SEQ ID NO: 8261693 - DNA, 22 bp, Homo sapiens
aggctggggaattgaatttgct

SEQ ID NO: 8261694 - DNA, 22 bp, Homo sapiens
aggctgctcagtagatggagct

SEQ ID NO: 8261695 - DNA, 22 bp, Homo sapiens
aggctgcttccttacgtggctg

SEQ ID NO: 8261696 - DNA, 22 bp, Homo sapiens
aggctggaaatcactagattcc

SEQ ID NO: 8261697 - DNA, 22 bp, Homo sapiens
aggctggaaagggaccagagtg

SEQ ID NO: 8261698 - DNA, 22 bp, Homo sapiens
aggctggagacccgccaagaaa

SEQ ID NO: 8261699 - DNA, 22 bp, Homo sapiens
aggctggagagtgcagtggcgt

SEQ ID NO: 8261700 - DNA, 22 bp, Homo sapiens
aggctggagcaagggggcatat

SEQ ID NO: 8261701 - DNA, 22 bp, Homo sapiens
aggctggagtgtagcagtgcag

SEQ ID NO: 8261702 - DNA, 22 bp, Homo sapiens
aggccagaaatgtcagggagtg

SEQ ID NO: 8261703 - DNA, 22 bp, Homo sapiens
aggccacatagcttgcatgtag

SEQ ID NO: 8261704 - DNA, 22 bp, Homo sapiens
aggccaggatagcatggatcag

SEQ ID NO: 8261705 - DNA, 22 bp, Homo sapiens
aggccatgaggtcatgggagat

SEQ ID NO: 8261706 - DNA, 22 bp, Homo sapiens
aggccatgaggtcatgggagat

SEQ ID NO: 8261707 - DNA, 22 bp, Homo sapiens
ccagcagctttgcatacactaa

SEQ ID NO: 8261708 - DNA, 19 bp, Homo sapiens
ccagcagctttgattctct

SEQ ID NO: 8261709 - DNA, 22 bp, Homo sapiens
aggcccagactcagcggggcgg

SEQ ID NO: 8261710 - DNA, 22 bp, Homo sapiens
ccagacatgtgcccttgaggaa

SEQ ID NO: 8261711 - DNA, 22 bp, Homo sapiens
ccagactgcttgcttcccagcc

SEQ ID NO: 8261712 - DNA, 22 bp, Homo sapiens
aggcggggaggcgctgctgtag

SEQ ID NO: 8261713 - DNA, 22 bp, Homo sapiens
aggcggcttctgaggaggctgc

SEQ ID NO: 8261714 - DNA, 22 bp, Homo sapiens
aggcggctccgggagtgtgggc

SEQ ID NO: 8261715 - DNA, 22 bp, Homo sapiens
ccagctcttttggctgagtgag

SEQ ID NO: 8261716 - DNA, 22 bp, Homo sapiens
ccagctctgtaagctgtgaaat

SEQ ID NO: 8261717 - DNA, 22 bp, Homo sapiens
ccagcaggagatgcctgtgtct

SEQ ID NO: 8261718 - DNA, 22 bp, Homo sapiens
ccagctggcccagctgtgctcc

SEQ ID NO: 8261719 - DNA, 22 bp, Homo sapiens
aggcctgctgtcttgaggccaa

SEQ ID NO: 8261720 - DNA, 22 bp, Homo sapiens
ccagctggcaggagagtcaggg

SEQ ID NO: 8261721 - DNA, 22 bp, Homo sapiens
ccagctggagccaaggtggact

SEQ ID NO: 8261722 - DNA, 22 bp, Homo sapiens
ccctcactctgcctcctggggt

SEQ ID NO: 8261723 - DNA, 22 bp, Homo sapiens
ccccagcacaggctcctcagat

SEQ ID NO: 8261724 - DNA, 21 bp, Homo sapiens
ccccagcaccttgccagcctg

SEQ ID NO: 8261725 - DNA, 22 bp, Homo sapiens
ccccagcactctgactcttacc

SEQ ID NO: 8261726 - DNA, 22 bp, Homo sapiens
ccccagcactaccagaagccag

SEQ ID NO: 8261727 - DNA, 22 bp, Homo sapiens
ccccagcacttggagtggggag

SEQ ID NO: 8261728 - DNA, 18 bp, Homo sapiens
cccatgttgccagtcagc

SEQ ID NO: 8261729 - DNA, 22 bp, Homo sapiens
ccctgctgtcaggtgctgggag

SEQ ID NO: 8261730 - DNA, 22 bp, Homo sapiens
ccctgctgtgtagcggaggaac

SEQ ID NO: 8261731 - DNA, 22 bp, Homo sapiens
ccctgcccaccacatgctggga

SEQ ID NO: 8261732 - DNA, 22 bp, Homo sapiens
ccctcccaggagtggccagaga

SEQ ID NO: 8261733 - DNA, 22 bp, Homo sapiens
ccctcccagatgggcttgaggt

SEQ ID NO: 8261734 - DNA, 20 bp, Homo sapiens
ccctcccagatgcttcccaa

SEQ ID NO: 8261735 - DNA, 22 bp, Homo sapiens
ccctcccaagcactctgacata

SEQ ID NO: 8261736 - DNA, 22 bp, Homo sapiens
ccctcagctcaagcccctgtgc

SEQ ID NO: 8261737 - DNA, 22 bp, Homo sapiens
ccctcagcagatatttgtgttt

SEQ ID NO: 8261738 - DNA, 22 bp, Homo sapiens
ccctcagctccaccctcagcag

SEQ ID NO: 8261739 - DNA, 22 bp, Homo sapiens
cccagtcatcctgcaggtgaaa

SEQ ID NO: 8261740 - DNA, 22 bp, Homo sapiens
cccaggagcttctctctgcctc

SEQ ID NO: 8261741 - DNA, 20 bp, Homo sapiens
cccaggagctgtgccccatc

SEQ ID NO: 8261742 - DNA, 23 bp, Homo sapiens
cccaggagcctgagtcctctctg

SEQ ID NO: 8261743 - DNA, 22 bp, Homo sapiens
cccaggagatggtgcgtggtct

SEQ ID NO: 8261744 - DNA, 22 bp, Homo sapiens
cctcaggcaagtcacttaacat

SEQ ID NO: 8261745 - DNA, 22 bp, Homo sapiens
cctcaggcaggaaactgtcccg

SEQ ID NO: 8261746 - DNA, 22 bp, Homo sapiens
cctcaggccctgtccctgcgcc

SEQ ID NO: 8261747 - DNA, 22 bp, Homo sapiens
cctcaggccagggggcggccag

SEQ ID NO: 8261748 - DNA, 20 bp, Homo sapiens
cctcaggccagttttaaagt

SEQ ID NO: 8261749 - DNA, 22 bp, Homo sapiens
cctcaggcagtggtatggatgg

SEQ ID NO: 8261750 - DNA, 22 bp, Homo sapiens
agggctggcaagggattgaaat

SEQ ID NO: 8261751 - DNA, 22 bp, Homo sapiens
agggctggagccacagctggga

SEQ ID NO: 8261752 - DNA, 22 bp, Homo sapiens
agggcctggaactggagaccac

SEQ ID NO: 8261753 - DNA, 22 bp, Homo sapiens
agggcctggaactgtgggcagg

SEQ ID NO: 8261754 - DNA, 22 bp, Homo sapiens
cctcagcttgatttctgcagag

SEQ ID NO: 8261755 - DNA, 22 bp, Homo sapiens
cctcagcttgatttctgcagag

SEQ ID NO: 8261756 - DNA, 22 bp, Homo sapiens
aggggatggagctggaaggcag

SEQ ID NO: 8261757 - DNA, 22 bp, Homo sapiens
aggggatggagctggaaggcag

SEQ ID NO: 8261758 - DNA, 22 bp, Homo sapiens
aggggatgcctgaggatctgta

SEQ ID NO: 8261759 - DNA, 22 bp, Homo sapiens
aggggcagcctcacaatcctct

SEQ ID NO: 8261760 - DNA, 23 bp, Homo sapiens
aggggcagcaagttttggtgtta

SEQ ID NO: 8261761 - DNA, 22 bp, Homo sapiens
aggggatgatcctcccgcagcg

SEQ ID NO: 8261762 - DNA, 22 bp, Homo sapiens
aggggaggtgtccccaaatctc

SEQ ID NO: 8261763 - DNA, 22 bp, Homo sapiens
aggggaggtgtccccaaatctc

SEQ ID NO: 8261764 - DNA, 22 bp, Homo sapiens
aggggaggagcttttcttgcct

SEQ ID NO: 8261765 - DNA, 22 bp, Homo sapiens
aggggaggcagcgataaacctg

SEQ ID NO: 8261766 - DNA, 22 bp, Homo sapiens
aggggaggcagcgataaacctg

SEQ ID NO: 8261767 - DNA, 22 bp, Homo sapiens
agggtagggccgtagggccatg

SEQ ID NO: 8261768 - DNA, 22 bp, Homo sapiens
gctatttattaaaatggtgaag

SEQ ID NO: 8261769 - DNA, 23 bp, Homo sapiens
gctcaggcatcattcttcctggc

SEQ ID NO: 8261770 - DNA, 22 bp, Homo sapiens
gctaatgactgagtttttagca

SEQ ID NO: 8261771 - DNA, 22 bp, Homo sapiens
gctaatgaaaaatagattatag

SEQ ID NO: 8261772 - DNA, 22 bp, Homo sapiens
gcctggctctgagggagctcct

SEQ ID NO: 8261773 - DNA, 22 bp, Homo sapiens
gcctggctcctaagagcacaac

SEQ ID NO: 8261774 - DNA, 22 bp, Homo sapiens
gcctggctcctaaggactggct

SEQ ID NO: 8261775 - DNA, 22 bp, Homo sapiens
gctccaggcgagctggaccaga

SEQ ID NO: 8261776 - DNA, 22 bp, Homo sapiens
gctctgaagggtgagctgttcg

SEQ ID NO: 8261777 - DNA, 22 bp, Homo sapiens
gctctgagaagtattatttctt

SEQ ID NO: 8261778 - DNA, 22 bp, Homo sapiens
gctctgagaaccaggaacacag

SEQ ID NO: 8261779 - DNA, 22 bp, Homo sapiens
gctctgagaggatgctgagcag

SEQ ID NO: 8261780 - DNA, 22 bp, Homo sapiens
gctctgagaggatgctgagcag

SEQ ID NO: 8261781 - DNA, 22 bp, Homo sapiens
gctctgagagctacacagggta

SEQ ID NO: 8261782 - DNA, 22 bp, Homo sapiens
gctctgagagctacacagggta

SEQ ID NO: 8261783 - DNA, 22 bp, Homo sapiens
gctctgagagagcaaagtcacc

SEQ ID NO: 8261784 - DNA, 22 bp, Homo sapiens
gctctgagacagtagagatggc

SEQ ID NO: 8261785 - DNA, 22 bp, Homo sapiens
gctctgagacacaaagggtgca

SEQ ID NO: 8261786 - DNA, 22 bp, Homo sapiens
gctctgagacacaaagggtgca

SEQ ID NO: 8261787 - DNA, 19 bp, Homo sapiens
gctctgagaggggcatggg

SEQ ID NO: 8261788 - DNA, 19 bp, Homo sapiens
gctctgagaggggcatggg

SEQ ID NO: 8261789 - DNA, 22 bp, Homo sapiens
gctctgagaggtgcagcagtaa

SEQ ID NO: 8261790 - DNA, 22 bp, Homo sapiens
gctctgagaggtgcagcagtaa

SEQ ID NO: 8261791 - DNA, 22 bp, Homo sapiens
gctctgagagtgcatgatagca

SEQ ID NO: 8261792 - DNA, 22 bp, Homo sapiens
gctctgagagtgcatgatagca

SEQ ID NO: 8261793 - DNA, 22 bp, Homo sapiens
caaatcctggagccatggtaac

SEQ ID NO: 8261794 - DNA, 22 bp, Homo sapiens
gctctggtggtgatcagacgct

SEQ ID NO: 8261795 - DNA, 22 bp, Homo sapiens
gctgaggaaaggctggaaggga

SEQ ID NO: 8261796 - DNA, 22 bp, Homo sapiens
gctgaggacatcatggaaggaa

SEQ ID NO: 8261797 - DNA, 22 bp, Homo sapiens
caaatgtgttttttcttctaca

SEQ ID NO: 8261798 - DNA, 22 bp, Homo sapiens
caaatgtgtagagcttttgggg

SEQ ID NO: 8261799 - DNA, 22 bp, Homo sapiens
gcctggctcacagagcagcctt

SEQ ID NO: 8261800 - DNA, 22 bp, Homo sapiens
gcccaggaggtggaggtgcagt

SEQ ID NO: 8261801 - DNA, 22 bp, Homo sapiens
gcccaggagttcaaggctgcag

SEQ ID NO: 8261802 - DNA, 22 bp, Homo sapiens
gccctccatgagacacagtgta

SEQ ID NO: 8261803 - DNA, 23 bp, Homo sapiens
gccctccctcccaggtgggtgtt

SEQ ID NO: 8261804 - DNA, 22 bp, Homo sapiens
gccctcccctctgggtggtgag

SEQ ID NO: 8261805 - DNA, 19 bp, Homo sapiens
gccctgcaggaggtggggc

SEQ ID NO: 8261806 - DNA, 22 bp, Homo sapiens
gccagagggattcctggtgtgt

SEQ ID NO: 8261807 - DNA, 17 bp, Homo sapiens
atttacattgtcaccga

SEQ ID NO: 8261808 - DNA, 22 bp, Homo sapiens
gcccagcaggggatggcagctc

SEQ ID NO: 8261809 - DNA, 22 bp, Homo sapiens
gcccagcaggacagagtggttt

SEQ ID NO: 8261810 - DNA, 22 bp, Homo sapiens
gcagatgccagatcatgcaggg

SEQ ID NO: 8261811 - DNA, 22 bp, Homo sapiens
gcaggagagtctgtgccaggtt

SEQ ID NO: 8261812 - DNA, 22 bp, Homo sapiens
gcagcctgggcaacagagtgag

SEQ ID NO: 8261813 - DNA, 16 bp, Homo sapiens
gcagaggaaaggggag

SEQ ID NO: 8261814 - DNA, 22 bp, Homo sapiens
gcagaggctgggtgtcccagtc

SEQ ID NO: 8261815 - DNA, 23 bp, Homo sapiens
gcacagagcagttaggggaagat

SEQ ID NO: 8261816 - DNA, 22 bp, Homo sapiens
gcacagggagcaggtctctggt

SEQ ID NO: 8261817 - DNA, 17 bp, Homo sapiens
gcaaccagcccccatct

SEQ ID NO: 8261818 - DNA, 21 bp, Homo sapiens
gcaaccagaccacagggcagt

SEQ ID NO: 8261819 - DNA, 22 bp, Homo sapiens
gcaaaagtacagccggatttct

SEQ ID NO: 8261820 - DNA, 22 bp, Homo sapiens
gcagggtacattgggatgggat

SEQ ID NO: 8261821 - DNA, 22 bp, Homo sapiens
gcaggatgccagggcagcagcg

SEQ ID NO: 8261822 - DNA, 22 bp, Homo sapiens
gcaggatggtggaaggcctgct

SEQ ID NO: 8261823 - DNA, 22 bp, Homo sapiens
gcaggagcagtcaggggcagct

SEQ ID NO: 8261824 - DNA, 23 bp, Homo sapiens
gcaggagttcctggactccagga

SEQ ID NO: 8261825 - DNA, 22 bp, Homo sapiens
gcaggagcaaactgcagtgtgg

SEQ ID NO: 8261826 - DNA, 18 bp, Homo sapiens
gcaggagatgggtggggt

SEQ ID NO: 8261827 - DNA, 22 bp, Homo sapiens
gcagggactgtgatctcacaga

SEQ ID NO: 8261828 - DNA, 22 bp, Homo sapiens
gcagtgccacaagatgggagga

SEQ ID NO: 8261829 - DNA, 21 bp, Homo sapiens
gcagtgcagcttggagggtag

SEQ ID NO: 8261830 - DNA, 22 bp, Homo sapiens
atttaaatgcttaagagggttt

SEQ ID NO: 8261831 - DNA, 22 bp, Homo sapiens
gcattcccaaaagacacttacc

SEQ ID NO: 8261832 - DNA, 22 bp, Homo sapiens
cttgagcacagcggcttcagga

SEQ ID NO: 8261833 - DNA, 22 bp, Homo sapiens
atgaatatgtacacatctgtca

SEQ ID NO: 8261834 - DNA, 22 bp, Homo sapiens
gaaatcttttcatctcatttga

SEQ ID NO: 8261835 - DNA, 22 bp, Homo sapiens
gaactttaggattttcacaggt

SEQ ID NO: 8261836 - DNA, 22 bp, Homo sapiens
gacagggactccctggttagaa

SEQ ID NO: 8261837 - DNA, 22 bp, Homo sapiens
gacagggcaagactctgtctaa

SEQ ID NO: 8261838 - DNA, 22 bp, Homo sapiens
gacagggcgagactcagtctca

SEQ ID NO: 8261839 - DNA, 22 bp, Homo sapiens
gacagggccgcagatggagact

SEQ ID NO: 8261840 - DNA, 22 bp, Homo sapiens
gacagggcatggtgcagagttc

SEQ ID NO: 8261841 - DNA, 23 bp, Homo sapiens
gacagggctgacttggcagctgc

SEQ ID NO: 8261842 - DNA, 22 bp, Homo sapiens
gaccctcattgtcaccgtgagc

SEQ ID NO: 8261843 - DNA, 21 bp, Homo sapiens
gaccccagaccagcagacaca

SEQ ID NO: 8261844 - DNA, 22 bp, Homo sapiens
gaggctgttaggagggactctg

SEQ ID NO: 8261845 - DNA, 22 bp, Homo sapiens
atgtcacccagctcccaacttt

SEQ ID NO: 8261846 - DNA, 22 bp, Homo sapiens
gagggggctctgccaacctgtc

SEQ ID NO: 8261847 - DNA, 22 bp, Homo sapiens
gagggggctagcgcagtgccca

SEQ ID NO: 8261848 - DNA, 22 bp, Homo sapiens
gagggggcgtgcaaggctccgc

SEQ ID NO: 8261849 - DNA, 19 bp, Homo sapiens
gaggggaggaattgacaag

SEQ ID NO: 8261850 - DNA, 22 bp, Homo sapiens
gagggcagaaaattatgcggtg

SEQ ID NO: 8261851 - DNA, 17 bp, Homo sapiens
gaggtaggaagtgagtc

SEQ ID NO: 8261852 - DNA, 17 bp, Homo sapiens
gaggtaggaagtgagtc

SEQ ID NO: 8261853 - DNA, 22 bp, Homo sapiens
gaggggtcacatgggctggctt

SEQ ID NO: 8261854 - DNA, 22 bp, Homo sapiens
gaggttggggctgcagtgagct

SEQ ID NO: 8261855 - DNA, 20 bp, Homo sapiens
gagtccaggggcctgtagca

SEQ ID NO: 8261856 - DNA, 22 bp, Homo sapiens
gatcctgggactgaatgggtgc

SEQ ID NO: 8261857 - DNA, 22 bp, Homo sapiens
atgtatttctatgtagtgaaga

SEQ ID NO: 8261858 - DNA, 22 bp, Homo sapiens
gaggaaggatttagtttgaggg

SEQ ID NO: 8261859 - DNA, 22 bp, Homo sapiens
gaggaaggagggaaagcgcgcg

SEQ ID NO: 8261860 - DNA, 22 bp, Homo sapiens
gaggaaggaatgcagtgtatgc

SEQ ID NO: 8261861 - DNA, 22 bp, Homo sapiens
gagctctgggaaacaaagtgta

SEQ ID NO: 8261862 - DNA, 22 bp, Homo sapiens
gagctctgggtggcaggtgtct

SEQ ID NO: 8261863 - DNA, 22 bp, Homo sapiens
gagctctgggtgtgttgtcagt

SEQ ID NO: 8261864 - DNA, 22 bp, Homo sapiens
gagctctggttcatgatctatt

SEQ ID NO: 8261865 - DNA, 22 bp, Homo sapiens
gagctctgtacacagagggtgt

SEQ ID NO: 8261866 - DNA, 22 bp, Homo sapiens
gagctctgtccacacttggaga

SEQ ID NO: 8261867 - DNA, 22 bp, Homo sapiens
gagctctgtgaatgtggggagg

SEQ ID NO: 8261868 - DNA, 22 bp, Homo sapiens
gagctctgcttgggttcttagg

SEQ ID NO: 8261869 - DNA, 22 bp, Homo sapiens
gagctctgctactcaaagtatg

SEQ ID NO: 8261870 - DNA, 22 bp, Homo sapiens
gagctctgcggaaaacgtgccg

SEQ ID NO: 8261871 - DNA, 22 bp, Homo sapiens
gagctctggacgaggggagtgg

SEQ ID NO: 8261872 - DNA, 22 bp, Homo sapiens
gagctctggcagggcaggtctg

SEQ ID NO: 8261873 - DNA, 22 bp, Homo sapiens
gagcagctctgggtgacccagt

SEQ ID NO: 8261874 - DNA, 22 bp, Homo sapiens
gagccctcttgtctatatggta

SEQ ID NO: 8261875 - DNA, 18 bp, Homo sapiens
gagctctgcctcccagtc

SEQ ID NO: 8261876 - DNA, 22 bp, Homo sapiens
gagctctgccatggctcccacc

SEQ ID NO: 8261877 - DNA, 22 bp, Homo sapiens
gagcggaggcttggaggccagc

SEQ ID NO: 8261878 - DNA, 23 bp, Homo sapiens
gagctctgcactaggccctggga

SEQ ID NO: 8261879 - DNA, 22 bp, Homo sapiens
gagctctgcagattgttttagg

SEQ ID NO: 8261880 - DNA, 22 bp, Homo sapiens
gagcagctcgagaaggaagcag

SEQ ID NO: 8261881 - DNA, 22 bp, Homo sapiens
gagcagctaaaattctcatgca

SEQ ID NO: 8261882 - DNA, 22 bp, Homo sapiens
gagaggctctgaggactggggt

SEQ ID NO: 8261883 - DNA, 22 bp, Homo sapiens
cagagagcttagtgtgctgcat

SEQ ID NO: 8261884 - DNA, 21 bp, Homo sapiens
cagagcagcgttctgctgtgg

SEQ ID NO: 8261885 - DNA, 22 bp, Homo sapiens
cagagactggagtgcagtggcg

SEQ ID NO: 8261886 - DNA, 22 bp, Homo sapiens
cagagagaatcttggcagctga

SEQ ID NO: 8261887 - DNA, 22 bp, Homo sapiens
cagaggcagaccctccagggcg

SEQ ID NO: 8261888 - DNA, 22 bp, Homo sapiens
cagaggcagccgggggagaacg

SEQ ID NO: 8261889 - DNA, 22 bp, Homo sapiens
gggggcagaatgtactcttgtc

SEQ ID NO: 8261890 - DNA, 22 bp, Homo sapiens
gggggcagtaaggatatggaaa

SEQ ID NO: 8261891 - DNA, 22 bp, Homo sapiens
gggggcaggtctggaactttga

SEQ ID NO: 8261892 - DNA, 22 bp, Homo sapiens
gggggcaggtctggaactttga

SEQ ID NO: 8261893 - DNA, 22 bp, Homo sapiens
cagaggacaactggggcaagga

SEQ ID NO: 8261894 - DNA, 22 bp, Homo sapiens
cagaggacaactggggcaagga

SEQ ID NO: 8261895 - DNA, 22 bp, Homo sapiens
gggggaggtgaatgcaataagg

SEQ ID NO: 8261896 - DNA, 22 bp, Homo sapiens
gggggagctgttattggcaggg

SEQ ID NO: 8261897 - DNA, 22 bp, Homo sapiens
cagaggaccagaaaggggccca

SEQ ID NO: 8261898 - DNA, 22 bp, Homo sapiens
cagaggacctgtgtggccagag

SEQ ID NO: 8261899 - DNA, 22 bp, Homo sapiens
cagaggacctgtgtggccagag

SEQ ID NO: 8261900 - DNA, 22 bp, Homo sapiens
gggctcagtcctggttctaccc

SEQ ID NO: 8261901 - DNA, 22 bp, Homo sapiens
gggctcagggacacatgtgtgt

SEQ ID NO: 8261902 - DNA, 22 bp, Homo sapiens
gggctcaggagtttgaggctgc

SEQ ID NO: 8261903 - DNA, 22 bp, Homo sapiens
ggtggcagtgcttgcgggtcta

SEQ ID NO: 8261904 - DNA, 22 bp, Homo sapiens
cagatgcttgttggctggtctc

SEQ ID NO: 8261905 - DNA, 22 bp, Homo sapiens
ggtggcagtcttaagagatctt

SEQ ID NO: 8261906 - DNA, 22 bp, Homo sapiens
ggtggcagtagcactgggcctg

SEQ ID NO: 8261907 - DNA, 20 bp, Homo sapiens
cagcagagacccatggggag

SEQ ID NO: 8261908 - DNA, 22 bp, Homo sapiens
cagcagagaaattaaacttctg

SEQ ID NO: 8261909 - DNA, 22 bp, Homo sapiens
cagaggctgaccctgctgttgt

SEQ ID NO: 8261910 - DNA, 22 bp, Homo sapiens
ggggtagggtgattgtgaagta

SEQ ID NO: 8261911 - DNA, 22 bp, Homo sapiens
ggggtagtcctggtgatggctg

SEQ ID NO: 8261912 - DNA, 22 bp, Homo sapiens
ggggtagtaccttcgtatgctg

SEQ ID NO: 8261913 - DNA, 22 bp, Homo sapiens
ggtgcaaacgtaattgtggttt

SEQ ID NO: 8261914 - DNA, 22 bp, Homo sapiens
ggtgcaaaagtagttctgcttt

SEQ ID NO: 8261915 - DNA, 22 bp, Homo sapiens
gtgctgagattacaggtgtgag

SEQ ID NO: 8261916 - DNA, 22 bp, Homo sapiens
gtgctgagcatcatgaggcact

SEQ ID NO: 8261917 - DNA, 22 bp, Homo sapiens
gtgctgaggtgggtgggcagcc

SEQ ID NO: 8261918 - DNA, 22 bp, Homo sapiens
cagctcccagtggcagctcctt

SEQ ID NO: 8261919 - DNA, 22 bp, Homo sapiens
cagctccccatggttcctgaag

SEQ ID NO: 8261920 - DNA, 22 bp, Homo sapiens
cagctcccagagtgaccagcag

SEQ ID NO: 8261921 - DNA, 22 bp, Homo sapiens
gtgcatggtaagatgcttcaca

SEQ ID NO: 8261922 - DNA, 22 bp, Homo sapiens
gtgcattcaggggttgacagga

SEQ ID NO: 8261923 - DNA, 22 bp, Homo sapiens
gtgcatggggagggaagcgctc

SEQ ID NO: 8261924 - DNA, 21 bp, Homo sapiens
gtgcatggagaaaggcttgct

SEQ ID NO: 8261925 - DNA, 22 bp, Homo sapiens
gtgcatggccagggtggtctgg

SEQ ID NO: 8261926 - DNA, 22 bp, Homo sapiens
cagctcccctctgtggggcagt

SEQ ID NO: 8261927 - DNA, 22 bp, Homo sapiens
cagctcccgccatcgggaggca

SEQ ID NO: 8261928 - DNA, 22 bp, Homo sapiens
cagctccctatggtgaggcgac

SEQ ID NO: 8261929 - DNA, 22 bp, Homo sapiens
cagctctgatgaaatgtaccag

SEQ ID NO: 8261930 - DNA, 22 bp, Homo sapiens
cagctctgaggaacactccttt

SEQ ID NO: 8261931 - DNA, 21 bp, Homo sapiens
cagctctgagatttctactag

SEQ ID NO: 8261932 - DNA, 17 bp, Homo sapiens
cagctctgcagacttcc

SEQ ID NO: 8261933 - DNA, 22 bp, Homo sapiens
cagcagtggccatctgtgtggt

SEQ ID NO: 8261934 - DNA, 22 bp, Homo sapiens
cagcagagcatttggtaggagg

SEQ ID NO: 8261935 - DNA, 22 bp, Homo sapiens
cagcagagacggtaagcagaac

SEQ ID NO: 8261936 - DNA, 22 bp, Homo sapiens
gtctcagagtcctacttattcc

SEQ ID NO: 8261937 - DNA, 22 bp, Homo sapiens
gtcctgaatgcctttaggcaga

SEQ ID NO: 8261938 - DNA, 22 bp, Homo sapiens
cagcagtgtacaaggtgtcaga

SEQ ID NO: 8261939 - DNA, 20 bp, Homo sapiens
gtctccactgggggttaacc

SEQ ID NO: 8261940 - DNA, 22 bp, Homo sapiens
ggcaggtgtggtgaccagagat

SEQ ID NO: 8261941 - DNA, 22 bp, Homo sapiens
ggcagtagccagggactggcag

SEQ ID NO: 8261942 - DNA, 22 bp, Homo sapiens
ggcaggtgccttctgtgctagc

SEQ ID NO: 8261943 - DNA, 22 bp, Homo sapiens
ggcaggagaaaggtctcttctt

SEQ ID NO: 8261944 - DNA, 22 bp, Homo sapiens
ggcaggagaaaggtctcttctt

SEQ ID NO: 8261945 - DNA, 19 bp, Homo sapiens
ggatccagaggatctgcca

SEQ ID NO: 8261946 - DNA, 19 bp, Homo sapiens
ggataaggttggagtgatc

SEQ ID NO: 8261947 - DNA, 22 bp, Homo sapiens
ggccccagggattaggccaacc

SEQ ID NO: 8261948 - DNA, 22 bp, Homo sapiens
ggccccagggaagaaggtggtc

SEQ ID NO: 8261949 - DNA, 22 bp, Homo sapiens
ggccccaggcctttggtctggc

SEQ ID NO: 8261950 - DNA, 22 bp, Homo sapiens
ggccccagctgtggtgaataga

SEQ ID NO: 8261951 - DNA, 22 bp, Homo sapiens
ggccccagcttcaaccccgtgg

SEQ ID NO: 8261952 - DNA, 22 bp, Homo sapiens
ggccccaggacctccacggtcc

SEQ ID NO: 8261953 - DNA, 22 bp, Homo sapiens
ggcgagggagcagtgcggtggg

SEQ ID NO: 8261954 - DNA, 22 bp, Homo sapiens
ggcgccagcccaggccgtcgtg

SEQ ID NO: 8261955 - DNA, 22 bp, Homo sapiens
ggcccagagctctgggggagct

SEQ ID NO: 8261956 - DNA, 22 bp, Homo sapiens
ggcccagagggtcaggagctga

SEQ ID NO: 8261957 - DNA, 22 bp, Homo sapiens
ggccccagcagtgcttgtttat

SEQ ID NO: 8261958 - DNA, 19 bp, Homo sapiens
ggccccagccagggtatca

SEQ ID NO: 8261959 - DNA, 22 bp, Homo sapiens
ggccccagcctcagtcccctga

SEQ ID NO: 8261960 - DNA, 21 bp, Homo sapiens
ggccccagcccatgggttctc

SEQ ID NO: 8261961 - DNA, 22 bp, Homo sapiens
ggcccagcatcttgtgaagttt

SEQ ID NO: 8261962 - DNA, 22 bp, Homo sapiens
ggcccagcacagtgcttggggg

SEQ ID NO: 8261963 - DNA, 22 bp, Homo sapiens
ggcccagcccgagtcagccttc

SEQ ID NO: 8261964 - DNA, 22 bp, Homo sapiens
ggccccagcagaccctcctctg

SEQ ID NO: 8261965 - DNA, 22 bp, Homo sapiens
ggcgctcagtgttgccccagag

SEQ ID NO: 8261966 - DNA, 22 bp, Homo sapiens
ggctcctgtggcaagacagctt

SEQ ID NO: 8261967 - DNA, 22 bp, Homo sapiens
ggctgcagatagccagccacca

SEQ ID NO: 8261968 - DNA, 22 bp, Homo sapiens
ggctgcagattgtagtctgtta

SEQ ID NO: 8261969 - DNA, 22 bp, Homo sapiens
cactgtcttttgtgaagacaat

SEQ ID NO: 8261970 - DNA, 22 bp, Homo sapiens
cagaacagtcgcctgcatggat

SEQ ID NO: 8261971 - DNA, 22 bp, Homo sapiens
ggctgggagccccacagagtca

SEQ ID NO: 8261972 - DNA, 20 bp, Homo sapiens
ggctgctggtttggctctgt

SEQ ID NO: 8261973 - DNA, 22 bp, Homo sapiens
ggctgctggtaggggtaggaag

SEQ ID NO: 8261974 - DNA, 22 bp, Homo sapiens
ggctgctggtggaatggtaggc

SEQ ID NO: 8261975 - DNA, 21 bp, Homo sapiens
ggctgctgtcaccgctgtcac

SEQ ID NO: 8261976 - DNA, 22 bp, Homo sapiens
caagtgtctatatcagtgcttg

SEQ ID NO: 8261977 - DNA, 22 bp, Homo sapiens
caagtgtcttcaaaggctaaaa

SEQ ID NO: 8261978 - DNA, 22 bp, Homo sapiens
caagtgtccatgatagtcttag

SEQ ID NO: 8261979 - DNA, 20 bp, Homo sapiens
gctggtgggggcttgacatg

SEQ ID NO: 8261980 - DNA, 22 bp, Homo sapiens
gctggccatggggagtgaggag

SEQ ID NO: 8261981 - DNA, 22 bp, Homo sapiens
gctggcccagcgcccagggcag

SEQ ID NO: 8261982 - DNA, 22 bp, Homo sapiens
gctgggccgacctgggctgcag

SEQ ID NO: 8261983 - DNA, 21 bp, Homo sapiens
gctgggcctgtacttgccctg

SEQ ID NO: 8261984 - DNA, 22 bp, Homo sapiens
gctgggccgacctgggctgcag

SEQ ID NO: 8261985 - DNA, 19 bp, Homo sapiens
gctggcagatgtggccgtg

SEQ ID NO: 8261986 - DNA, 22 bp, Homo sapiens
gctggcagcattagaccctggg

SEQ ID NO: 8261987 - DNA, 22 bp, Homo sapiens
gctggcagagctctgggctggg

SEQ ID NO: 8261988 - DNA, 22 bp, Homo sapiens
gctggcagagagctggtgagga

SEQ ID NO: 8261989 - DNA, 22 bp, Homo sapiens
ggacagcatatcagcagggcag

SEQ ID NO: 8261990 - DNA, 18 bp, Homo sapiens
ggagagtgagatcaaaca

SEQ ID NO: 8261991 - DNA, 22 bp, Homo sapiens
ggagagtggattccagctgtat

SEQ ID NO: 8261992 - DNA, 17 bp, Homo sapiens
ggagagtgggaatggcc

SEQ ID NO: 8261993 - DNA, 22 bp, Homo sapiens
ggagatagacttggtgagccac

SEQ ID NO: 8261994 - DNA, 22 bp, Homo sapiens
ggagatatttgtattctgtctc

SEQ ID NO: 8261995 - DNA, 19 bp, Homo sapiens
ggagatcccgctgcagatg

SEQ ID NO: 8261996 - DNA, 22 bp, Homo sapiens
ggagatccaggcaaggccgcag

SEQ ID NO: 8261997 - DNA, 22 bp, Homo sapiens
ggagatccaggctgagtctttc

SEQ ID NO: 8261998 - DNA, 22 bp, Homo sapiens
cacagagaatactgctcttgct

SEQ ID NO: 8261999 - DNA, 22 bp, Homo sapiens
ggagatctgagagctggaagtg

SEQ ID NO: 8262000 - DNA, 22 bp, Homo sapiens
cacagagaactgtgggagtgtg

SEQ ID NO: 8262001 - DNA, 22 bp, Homo sapiens
cacagagacagatctattttgc

SEQ ID NO: 8262002 - DNA, 22 bp, Homo sapiens
cacagagacagaagcacttatg

SEQ ID NO: 8262003 - DNA, 22 bp, Homo sapiens
cacagagaatgatgagtcactg

SEQ ID NO: 8262004 - DNA, 22 bp, Homo sapiens
cacagagaattcccatatgtga

SEQ ID NO: 8262005 - DNA, 22 bp, Homo sapiens
cacagagacatgatgtcattgc

SEQ ID NO: 8262006 - DNA, 22 bp, Homo sapiens
ggacagattgagctaggcgttt

SEQ ID NO: 8262007 - DNA, 22 bp, Homo sapiens
ggacaaaggtctggggaacctg

SEQ ID NO: 8262008 - DNA, 22 bp, Homo sapiens
ggacaaaggggagcctgccccg

SEQ ID NO: 8262009 - DNA, 22 bp, Homo sapiens
ggaaggggtcacctcctgatga

SEQ ID NO: 8262010 - DNA, 22 bp, Homo sapiens
ggaggggcagccatggaactcc

SEQ ID NO: 8262011 - DNA, 22 bp, Homo sapiens
ggaggggcaggtcccaagttgt

SEQ ID NO: 8262012 - DNA, 22 bp, Homo sapiens
ggaggggcatagttcaccatca

SEQ ID NO: 8262013 - DNA, 22 bp, Homo sapiens
ggaggggccggctgcctgccac

SEQ ID NO: 8262014 - DNA, 22 bp, Homo sapiens
cacaggagagctgggaggtgcc

SEQ ID NO: 8262015 - DNA, 22 bp, Homo sapiens
cacaggagaaaggggaagctcg

SEQ ID NO: 8262016 - DNA, 22 bp, Homo sapiens
cacaggagaacccacagattct

SEQ ID NO: 8262017 - DNA, 18 bp, Homo sapiens
cacaggagatgacctgac

SEQ ID NO: 8262018 - DNA, 22 bp, Homo sapiens
cacaggagaggttaatgggggc

SEQ ID NO: 8262019 - DNA, 22 bp, Homo sapiens
ggaggagcacttctgagctcag

SEQ ID NO: 8262020 - DNA, 22 bp, Homo sapiens
ggaggagcacttgacggggtct

SEQ ID NO: 8262021 - DNA, 22 bp, Homo sapiens
ggaggagacggagtgattagtg

SEQ ID NO: 8262022 - DNA, 22 bp, Homo sapiens
cacagcaggcactatacagggc

SEQ ID NO: 8262023 - DNA, 22 bp, Homo sapiens
ggagcagccacgtctcagggca

SEQ ID NO: 8262024 - DNA, 22 bp, Homo sapiens
ggagcagccgcgtctcagggca

SEQ ID NO: 8262025 - DNA, 22 bp, Homo sapiens
tagtgtctgtccatcagtaact

SEQ ID NO: 8262026 - DNA, 22 bp, Homo sapiens
tagtgtctgttgcttttgttca

SEQ ID NO: 8262027 - DNA, 21 bp, Homo sapiens
tagtgtcttaagagccttgca

SEQ ID NO: 8262028 - DNA, 22 bp, Homo sapiens
tagtgtctgacatttaagagca

SEQ ID NO: 8262029 - DNA, 22 bp, Homo sapiens
tagtgtctgatccgtagttaca

SEQ ID NO: 8262030 - DNA, 22 bp, Homo sapiens
tagtgtcttccaggacatggta

SEQ ID NO: 8262031 - DNA, 22 bp, Homo sapiens
tagtgtcttcaggagatatgag

SEQ ID NO: 8262032 - DNA, 22 bp, Homo sapiens
tagtgtggccccaagaggatct

SEQ ID NO: 8262033 - DNA, 22 bp, Homo sapiens
tagtgtggtatcttctatggaa

SEQ ID NO: 8262034 - DNA, 22 bp, Homo sapiens
tagtgttctaagaacatccatg

SEQ ID NO: 8262035 - DNA, 22 bp, Homo sapiens
tatatacaaggtaggtttaggt

SEQ ID NO: 8262036 - DNA, 22 bp, Homo sapiens
tatatactttcttcctgggtag

SEQ ID NO: 8262037 - DNA, 22 bp, Homo sapiens
tatatatatgcacacacaccta

SEQ ID NO: 8262038 - DNA, 22 bp, Homo sapiens
cagggctgagtcatatagcctt

SEQ ID NO: 8262039 - DNA, 22 bp, Homo sapiens
cagggctggatcctccagactc

SEQ ID NO: 8262040 - DNA, 22 bp, Homo sapiens
tagtgtctcggggcccaggatt

SEQ ID NO: 8262041 - DNA, 22 bp, Homo sapiens
tagtgtctcttcctgtttgaaa

SEQ ID NO: 8262042 - DNA, 22 bp, Homo sapiens
tagtgtctgaatgcacctgttt

SEQ ID NO: 8262043 - DNA, 22 bp, Homo sapiens
tagtgtctagtgagtttgatgc

SEQ ID NO: 8262044 - DNA, 22 bp, Homo sapiens
tagtgtctattgaccggaaaga

SEQ ID NO: 8262045 - DNA, 20 bp, Homo sapiens
cagggccacgctccaaggca

SEQ ID NO: 8262046 - DNA, 22 bp, Homo sapiens
cagggccaagctgcagcatctg

SEQ ID NO: 8262047 - DNA, 18 bp, Homo sapiens
tatattctgtgccctggt

SEQ ID NO: 8262048 - DNA, 22 bp, Homo sapiens
tatattcttaccagtgtatgta

SEQ ID NO: 8262049 - DNA, 22 bp, Homo sapiens
tatgatattctaaattgacacc

SEQ ID NO: 8262050 - DNA, 22 bp, Homo sapiens
caggtggcttattagggtcagt

SEQ ID NO: 8262051 - DNA, 22 bp, Homo sapiens
cagtggcacccacgggctgggc

SEQ ID NO: 8262052 - DNA, 22 bp, Homo sapiens
cagtggcaatgggacagagcac

SEQ ID NO: 8262053 - DNA, 21 bp, Homo sapiens
cagtggttgctgaattagtgg

SEQ ID NO: 8262054 - DNA, 22 bp, Homo sapiens
cagtggttgcttgcatggctcc

SEQ ID NO: 8262055 - DNA, 22 bp, Homo sapiens
cagtggttggtagatacttgag

SEQ ID NO: 8262056 - DNA, 22 bp, Homo sapiens
cagtggttgtcagcaacaatat

SEQ ID NO: 8262057 - DNA, 22 bp, Homo sapiens
cagtggtttaggtcaaggggag

SEQ ID NO: 8262058 - DNA, 22 bp, Homo sapiens
tcacactaagacaaaataattt

SEQ ID NO: 8262059 - DNA, 22 bp, Homo sapiens
cagtacttggtcaaggaagcag

SEQ ID NO: 8262060 - DNA, 22 bp, Homo sapiens
tcaaaacctaggctctctgctt

SEQ ID NO: 8262061 - DNA, 20 bp, Homo sapiens
tcaaaggcaaaggtgggtgt

SEQ ID NO: 8262062 - DNA, 22 bp, Homo sapiens
cagtcttatcctgaaaacaaca

SEQ ID NO: 8262063 - DNA, 22 bp, Homo sapiens
caggctgcagcagcagtggccc

SEQ ID NO: 8262064 - DNA, 22 bp, Homo sapiens
tacctcaagttccaggaaagcg

SEQ ID NO: 8262065 - DNA, 22 bp, Homo sapiens
tagacatattgtatttacttaa

SEQ ID NO: 8262066 - DNA, 22 bp, Homo sapiens
tagacatagtttttatgactta

SEQ ID NO: 8262067 - DNA, 22 bp, Homo sapiens
tagacaggagtcaggctagaat

SEQ ID NO: 8262068 - DNA, 22 bp, Homo sapiens
cagggagaggcatcatagggaa

SEQ ID NO: 8262069 - DNA, 22 bp, Homo sapiens
cagggcatccgtgctccatgct

SEQ ID NO: 8262070 - DNA, 22 bp, Homo sapiens
cagggagtcaacaaacagatca

SEQ ID NO: 8262071 - DNA, 22 bp, Homo sapiens
cagggagggacaattgtcacct

SEQ ID NO: 8262072 - DNA, 22 bp, Homo sapiens
cagggaggctgtcttatgcctg

SEQ ID NO: 8262073 - DNA, 22 bp, Homo sapiens
cagggagggaggaaaatttgct

SEQ ID NO: 8262074 - DNA, 22 bp, Homo sapiens
cagggaggatgggctgttttgc

SEQ ID NO: 8262075 - DNA, 23 bp, Homo sapiens
cagggaggagatactgtgtatct

SEQ ID NO: 8262076 - DNA, 22 bp, Homo sapiens
caggctcggaagtgctggcttt

SEQ ID NO: 8262077 - DNA, 22 bp, Homo sapiens
caggccttgcgtcccatggcct

SEQ ID NO: 8262078 - DNA, 22 bp, Homo sapiens
tacagagactttatggcacaaa

SEQ ID NO: 8262079 - DNA, 22 bp, Homo sapiens
tacagagagctccggacattca

SEQ ID NO: 8262080 - DNA, 22 bp, Homo sapiens
caggccctcgtggtgagctggg

SEQ ID NO: 8262081 - DNA, 22 bp, Homo sapiens
caggccctcgcccgcagcgacc

SEQ ID NO: 8262082 - DNA, 22 bp, Homo sapiens
caggccctcctgtgatctgcct

SEQ ID NO: 8262083 - DNA, 22 bp, Homo sapiens
caggcccaggggtctggcccac

SEQ ID NO: 8262084 - DNA, 22 bp, Homo sapiens
tacagagaataataggacaggt

SEQ ID NO: 8262085 - DNA, 22 bp, Homo sapiens
tacactttatggatcctacttt

SEQ ID NO: 8262086 - DNA, 22 bp, Homo sapiens
gtggagccaggatctccgcaca

SEQ ID NO: 8262087 - DNA, 22 bp, Homo sapiens
cagctctgcctctggggctgag

SEQ ID NO: 8262088 - DNA, 22 bp, Homo sapiens
cagctctgccatcatctgcctt

SEQ ID NO: 8262089 - DNA, 22 bp, Homo sapiens
gtggagaggagcagctacctca

SEQ ID NO: 8262090 - DNA, 22 bp, Homo sapiens
cagctctgctgggaggatgcag

SEQ ID NO: 8262091 - DNA, 17 bp, Homo sapiens
cagctctgcatcttcct

SEQ ID NO: 8262092 - DNA, 22 bp, Homo sapiens
cagctctgccacttcctagcta

SEQ ID NO: 8262093 - DNA, 23 bp, Homo sapiens
gtggagccacatcacaggctcct

SEQ ID NO: 8262094 - DNA, 23 bp, Homo sapiens
gtggagccacatcacaggctcct

SEQ ID NO: 8262095 - DNA, 22 bp, Homo sapiens
gtggagccaggatctccgcaca

SEQ ID NO: 8262096 - DNA, 21 bp, Homo sapiens
gtggagagtgattttgatgca

SEQ ID NO: 8262097 - DNA, 20 bp, Homo sapiens
gtggagaggctggcgggact

SEQ ID NO: 8262098 - DNA, 18 bp, Homo sapiens
tccagagagggagaagtg

SEQ ID NO: 8262099 - DNA, 18 bp, Homo sapiens
tccagaggtgttggagcc

SEQ ID NO: 8262100 - DNA, 22 bp, Homo sapiens
tccagcagaaccagagacctgg

SEQ ID NO: 8262101 - DNA, 22 bp, Homo sapiens
tccagcagaaaagaggtaggga

SEQ ID NO: 8262102 - DNA, 22 bp, Homo sapiens
catgctgttgaatatgacattg

SEQ ID NO: 8262103 - DNA, 22 bp, Homo sapiens
catgcttttcaatctatcttaa

SEQ ID NO: 8262104 - DNA, 22 bp, Homo sapiens
catgtggcacaaagaaggaaat

SEQ ID NO: 8262105 - DNA, 22 bp, Homo sapiens
catgtggctttggcatgtgccc

SEQ ID NO: 8262106 - DNA, 22 bp, Homo sapiens
catgtgctgtagcagagaggaa

SEQ ID NO: 8262107 - DNA, 22 bp, Homo sapiens
catgtgccccgggtcccttggt

SEQ ID NO: 8262108 - DNA, 22 bp, Homo sapiens
tccaggggacactgtttctcca

SEQ ID NO: 8262109 - DNA, 22 bp, Homo sapiens
tccaggtcatcttggagagctg

SEQ ID NO: 8262110 - DNA, 22 bp, Homo sapiens
tccaggggtgatttttgacttg

SEQ ID NO: 8262111 - DNA, 22 bp, Homo sapiens
cattaatttaatattcaaagaa

SEQ ID NO: 8262112 - DNA, 22 bp, Homo sapiens
tcaggcagaggatggggagcgt

SEQ ID NO: 8262113 - DNA, 22 bp, Homo sapiens
cagtggtttctgaacagtgtgc

SEQ ID NO: 8262114 - DNA, 22 bp, Homo sapiens
cagtggtttccaaacttgttcc

SEQ ID NO: 8262115 - DNA, 22 bp, Homo sapiens
cagtggttttatatctaagctt

SEQ ID NO: 8262116 - DNA, 22 bp, Homo sapiens
cagtggttttgagattcagggt

SEQ ID NO: 8262117 - DNA, 22 bp, Homo sapiens
cagtgtcaccaggcgagtctcc

SEQ ID NO: 8262118 - DNA, 22 bp, Homo sapiens
cagtgtaagctctagactagaa

SEQ ID NO: 8262119 - DNA, 22 bp, Homo sapiens
cagtgtcaggatcagtatattt

SEQ ID NO: 8262120 - DNA, 22 bp, Homo sapiens
cagtgtctacagtggctggagg

SEQ ID NO: 8262121 - DNA, 22 bp, Homo sapiens
cagtgtctacagtggctggagg

SEQ ID NO: 8262122 - DNA, 22 bp, Homo sapiens
cagtgtctcaaaacaagttgct

SEQ ID NO: 8262123 - DNA, 22 bp, Homo sapiens
tcaggaggcgtgctggggtaca

SEQ ID NO: 8262124 - DNA, 22 bp, Homo sapiens
tcaggaggcggaggttgcagtg

SEQ ID NO: 8262125 - DNA, 22 bp, Homo sapiens
tcaggaatgaggataaacattg

SEQ ID NO: 8262126 - DNA, 22 bp, Homo sapiens
tcaggaggccaccaggacctgt

SEQ ID NO: 8262127 - DNA, 22 bp, Homo sapiens
tcaggaggccggcaggatttga

SEQ ID NO: 8262128 - DNA, 22 bp, Homo sapiens
tcagtgctgctttatgacagtt

SEQ ID NO: 8262129 - DNA, 22 bp, Homo sapiens
tcagtgtctgtgggcaggatgg

SEQ ID NO: 8262130 - DNA, 22 bp, Homo sapiens
tcagtgtcttctctttcctacc

SEQ ID NO: 8262131 - DNA, 22 bp, Homo sapiens
tcagtgtcttgacctgggtgtg

SEQ ID NO: 8262132 - DNA, 22 bp, Homo sapiens
tcagtgtcttgggcttgaatgc

SEQ ID NO: 8262133 - DNA, 22 bp, Homo sapiens
tcatcagctcatctgctcctag

SEQ ID NO: 8262134 - DNA, 21 bp, Homo sapiens
catttctaagcctggctatag

SEQ ID NO: 8262135 - DNA, 22 bp, Homo sapiens
catttcattcctttgaaagtgg

SEQ ID NO: 8262136 - DNA, 22 bp, Homo sapiens
catttcatagttgtcacaataa

SEQ ID NO: 8262137 - DNA, 21 bp, Homo sapiens
catttcatgattatagaaatg

SEQ ID NO: 8262138 - DNA, 22 bp, Homo sapiens
ccaagaggcagaatgcagagaa

SEQ ID NO: 8262139 - DNA, 22 bp, Homo sapiens
ccaagaggggcagagggctgca

SEQ ID NO: 8262140 - DNA, 20 bp, Homo sapiens
ccaagagcatgcatgaggaa

SEQ ID NO: 8262141 - DNA, 22 bp, Homo sapiens
ccagaggtgaacaggaggctgt

SEQ ID NO: 8262142 - DNA, 22 bp, Homo sapiens
ccagcacacagtgggtgcccag

SEQ ID NO: 8262143 - DNA, 23 bp, Homo sapiens
tctcaggcaaaccaggacaagtt

SEQ ID NO: 8262144 - DNA, 22 bp, Homo sapiens
tctcaggcactgggtgccaact

SEQ ID NO: 8262145 - DNA, 17 bp, Homo sapiens
tctcaggcacgtgtggc

SEQ ID NO: 8262146 - DNA, 22 bp, Homo sapiens
tctcaggcatctgtgtggcaca

SEQ ID NO: 8262147 - DNA, 22 bp, Homo sapiens
tctcaggcatggtttgttcatc

SEQ ID NO: 8262148 - DNA, 20 bp, Homo sapiens
tctcaggccccagttttctt

SEQ ID NO: 8262149 - DNA, 22 bp, Homo sapiens
tctcagtggatctcagaatttt

SEQ ID NO: 8262150 - DNA, 22 bp, Homo sapiens
tctcaggcccactgtgttgaaa

SEQ ID NO: 8262151 - DNA, 22 bp, Homo sapiens
tctcaggcattcccacatagaa

SEQ ID NO: 8262152 - DNA, 22 bp, Homo sapiens
tctcagtgtgttgagaggtctg

SEQ ID NO: 8262153 - DNA, 22 bp, Homo sapiens
tctcagtggtgttttgagtcca

SEQ ID NO: 8262154 - DNA, 22 bp, Homo sapiens
tctcagtgggttaaaagagaag

SEQ ID NO: 8262155 - DNA, 22 bp, Homo sapiens
tctcagtgtgttttctctcaga

SEQ ID NO: 8262156 - DNA, 22 bp, Homo sapiens
tctcagtgtttaaaaagatttc

SEQ ID NO: 8262157 - DNA, 21 bp, Homo sapiens
tctataactatagtgacagat

SEQ ID NO: 8262158 - DNA, 22 bp, Homo sapiens
tctagaaacatgacattgatct

SEQ ID NO: 8262159 - DNA, 21 bp, Homo sapiens
tctaatgacatcctctgacaa

SEQ ID NO: 8262160 - DNA, 22 bp, Homo sapiens
tctagaaattttgccttgtatt

SEQ ID NO: 8262161 - DNA, 22 bp, Homo sapiens
tctagaaagtttgtactgattt

SEQ ID NO: 8262162 - DNA, 22 bp, Homo sapiens
tctagaaagtactagagctggt

SEQ ID NO: 8262163 - DNA, 18 bp, Homo sapiens
tctagaaacttctctcct

SEQ ID NO: 8262164 - DNA, 22 bp, Homo sapiens
tctagaaagccaaattaggaat

SEQ ID NO: 8262165 - DNA, 18 bp, Homo sapiens
tctagaaacccagactct

SEQ ID NO: 8262166 - DNA, 22 bp, Homo sapiens
tgcttgggcggccagcatggcg

SEQ ID NO: 8262167 - DNA, 22 bp, Homo sapiens
tgcttgtcaccctgcctgagtg

SEQ ID NO: 8262168 - DNA, 22 bp, Homo sapiens
tgcttgtcacatacaggagcat

SEQ ID NO: 8262169 - DNA, 22 bp, Homo sapiens
tgcttgctgggccaatggcaat

SEQ ID NO: 8262170 - DNA, 22 bp, Homo sapiens
tgcttggctagcttggcagctc

SEQ ID NO: 8262171 - DNA, 22 bp, Homo sapiens
ccctccagtgtcccagtgggga

SEQ ID NO: 8262172 - DNA, 20 bp, Homo sapiens
tgcttgtcatgcactcaggc

SEQ ID NO: 8262173 - DNA, 22 bp, Homo sapiens
tgcttgtcaggataagctctgg

SEQ ID NO: 8262174 - DNA, 21 bp, Homo sapiens
tgcttccctgggccacactga

SEQ ID NO: 8262175 - DNA, 22 bp, Homo sapiens
tgcttccctgctctgcacacct

SEQ ID NO: 8262176 - DNA, 22 bp, Homo sapiens
tgctgcgggacccactgtgggc

SEQ ID NO: 8262177 - DNA, 22 bp, Homo sapiens
cccagtgtctccaacatcagat

SEQ ID NO: 8262178 - DNA, 22 bp, Homo sapiens
cccagtgtcaccaacaggacac

SEQ ID NO: 8262179 - DNA, 22 bp, Homo sapiens
ccccagctgcatacttgccaag

SEQ ID NO: 8262180 - DNA, 22 bp, Homo sapiens
ccccagctcagtgcagggacat

SEQ ID NO: 8262181 - DNA, 22 bp, Homo sapiens
ccccagctgagatttgaggaga

SEQ ID NO: 8262182 - DNA, 18 bp, Homo sapiens
tgctggggtagaatccac

SEQ ID NO: 8262183 - DNA, 22 bp, Homo sapiens
tgctgggggttcagatgagtaa

SEQ ID NO: 8262184 - DNA, 22 bp, Homo sapiens
tgctgggggctttctggatacc

SEQ ID NO: 8262185 - DNA, 22 bp, Homo sapiens
tgctgggggtgtctcaccaggc

SEQ ID NO: 8262186 - DNA, 19 bp, Homo sapiens
cccagtccttgtcctgggc

SEQ ID NO: 8262187 - DNA, 22 bp, Homo sapiens
cccagtgccaggcacaggcagc

SEQ ID NO: 8262188 - DNA, 22 bp, Homo sapiens
cccagtggagataggagtgtgg

SEQ ID NO: 8262189 - DNA, 22 bp, Homo sapiens
cccagtggaaggagtagaagac

SEQ ID NO: 8262190 - DNA, 22 bp, Homo sapiens
cccagtgctatgcctattacat

SEQ ID NO: 8262191 - DNA, 22 bp, Homo sapiens
tgctctgaaggaagagccccat

SEQ ID NO: 8262192 - DNA, 22 bp, Homo sapiens
tgctctgaactgaacttagggt

SEQ ID NO: 8262193 - DNA, 22 bp, Homo sapiens
tgctctgaaggaagagccccat

SEQ ID NO: 8262194 - DNA, 22 bp, Homo sapiens
tgctctgaaggggaagggatgg

SEQ ID NO: 8262195 - DNA, 22 bp, Homo sapiens
cccagtggcccagcatgtggtg

SEQ ID NO: 8262196 - DNA, 22 bp, Homo sapiens
cccagtggctgtccccatgggc

SEQ ID NO: 8262197 - DNA, 22 bp, Homo sapiens
tgctctgattggagtctgttgc

SEQ ID NO: 8262198 - DNA, 22 bp, Homo sapiens
tgctctgaggcacatgccatcg

SEQ ID NO: 8262199 - DNA, 22 bp, Homo sapiens
tgctctgatggggtggacatag

SEQ ID NO: 8262200 - DNA, 22 bp, Homo sapiens
tgctgcctgtgccaggagggtc

SEQ ID NO: 8262201 - DNA, 22 bp, Homo sapiens
tgctgcctgttgtggggccacg

SEQ ID NO: 8262202 - DNA, 22 bp, Homo sapiens
tgctgcctgctacgagggaaga

SEQ ID NO: 8262203 - DNA, 22 bp, Homo sapiens
tgctgcctctgctgatatggcc

SEQ ID NO: 8262204 - DNA, 22 bp, Homo sapiens
tgctgcctttctgaatggtgga

SEQ ID NO: 8262205 - DNA, 22 bp, Homo sapiens
tgctgccttctaggcgtgccct

SEQ ID NO: 8262206 - DNA, 22 bp, Homo sapiens
tgcagggctaagtcagagcctg

SEQ ID NO: 8262207 - DNA, 22 bp, Homo sapiens
tgctcagggacaatggagaggg

SEQ ID NO: 8262208 - DNA, 22 bp, Homo sapiens
tgctcaggagcttagagcacag

SEQ ID NO: 8262209 - DNA, 22 bp, Homo sapiens
ccctttaattccaacacaggaa

SEQ ID NO: 8262210 - DNA, 20 bp, Homo sapiens
ccctttaagctttagtatgc

SEQ ID NO: 8262211 - DNA, 22 bp, Homo sapiens
ccctttaaggtctgattttcag

SEQ ID NO: 8262212 - DNA, 22 bp, Homo sapiens
ccctttaagtagaatatattat

SEQ ID NO: 8262213 - DNA, 19 bp, Homo sapiens
tggcagggagagtttgaag

SEQ ID NO: 8262214 - DNA, 22 bp, Homo sapiens
tggcagggaatacagatgttta

SEQ ID NO: 8262215 - DNA, 22 bp, Homo sapiens
cccttgcaagcaaggattagcc

SEQ ID NO: 8262216 - DNA, 22 bp, Homo sapiens
tggcagagaacacacatgattc

SEQ ID NO: 8262217 - DNA, 22 bp, Homo sapiens
tggaggcatcagagtgcttggc

SEQ ID NO: 8262218 - DNA, 22 bp, Homo sapiens
tggaaactatagtcacaataga

SEQ ID NO: 8262219 - DNA, 22 bp, Homo sapiens
tggaaactaggatggaagaaat

SEQ ID NO: 8262220 - DNA, 22 bp, Homo sapiens
tggaaactaagactagagagac

SEQ ID NO: 8262221 - DNA, 22 bp, Homo sapiens
tggagagaaaaaagacagttct

SEQ ID NO: 8262222 - DNA, 22 bp, Homo sapiens
tggagagtttagcctactggaa

SEQ ID NO: 8262223 - DNA, 19 bp, Homo sapiens
tggagactgagagtgagca

SEQ ID NO: 8262224 - DNA, 22 bp, Homo sapiens
tggagactgataaaggctattg

SEQ ID NO: 8262225 - DNA, 22 bp, Homo sapiens
tggagactgtgctaagggagtt

SEQ ID NO: 8262226 - DNA, 22 bp, Homo sapiens
tggagactgactgcctgtattt

SEQ ID NO: 8262227 - DNA, 22 bp, Homo sapiens
tggagactctgcatctgtgaca

SEQ ID NO: 8262228 - DNA, 22 bp, Homo sapiens
tggagactcagaaggggaagca

SEQ ID NO: 8262229 - DNA, 22 bp, Homo sapiens
tgggacagggaatctgatcccc

SEQ ID NO: 8262230 - DNA, 22 bp, Homo sapiens
tgggacagggaatctgatcccc

SEQ ID NO: 8262231 - DNA, 22 bp, Homo sapiens
tgggagagaattctggtgactg

SEQ ID NO: 8262232 - DNA, 22 bp, Homo sapiens
tgggacaggaggcctctggaga

SEQ ID NO: 8262233 - DNA, 22 bp, Homo sapiens
tgggacaggatgaccagaaggt

SEQ ID NO: 8262234 - DNA, 22 bp, Homo sapiens
tgggcagaaggaagagccacct

SEQ ID NO: 8262235 - DNA, 22 bp, Homo sapiens
tgggaaggcagtcactgtccta

SEQ ID NO: 8262236 - DNA, 21 bp, Homo sapiens
tggccaaggaatagaagctct

SEQ ID NO: 8262237 - DNA, 22 bp, Homo sapiens
cctcctgggccttgctctgtga

SEQ ID NO: 8262238 - DNA, 22 bp, Homo sapiens
cctccagtcacctggatgagaa

SEQ ID NO: 8262239 - DNA, 22 bp, Homo sapiens
cctccagtactccagtccagcg

SEQ ID NO: 8262240 - DNA, 22 bp, Homo sapiens
tggggagagattgaggagtttt

SEQ ID NO: 8262241 - DNA, 23 bp, Homo sapiens
cctgcagctgctggggctccacc

SEQ ID NO: 8262242 - DNA, 22 bp, Homo sapiens
tgggcctggccctgtggaggag

SEQ ID NO: 8262243 - DNA, 22 bp, Homo sapiens
tgggcaggcaagtgaatacctt

SEQ ID NO: 8262244 - DNA, 22 bp, Homo sapiens
tgggcaggatgcgttgattctt

SEQ ID NO: 8262245 - DNA, 22 bp, Homo sapiens
tgggcaggataatatctcatgt

SEQ ID NO: 8262246 - DNA, 22 bp, Homo sapiens
tgggcaggataatatctcatgt

SEQ ID NO: 8262247 - DNA, 22 bp, Homo sapiens
tgggcaggagagaagctaaaga

SEQ ID NO: 8262248 - DNA, 22 bp, Homo sapiens
tgggtggcagcttcagcatgtt

SEQ ID NO: 8262249 - DNA, 22 bp, Homo sapiens
cctgcctgcagaaagtatctcc

SEQ ID NO: 8262250 - DNA, 22 bp, Homo sapiens
tcttgcattgctcattgtgcca

SEQ ID NO: 8262251 - DNA, 22 bp, Homo sapiens
tcttgcatttaaggagctcata

SEQ ID NO: 8262252 - DNA, 22 bp, Homo sapiens
tcttgcatttcagagttcagag

SEQ ID NO: 8262253 - DNA, 22 bp, Homo sapiens
tcttgcatacactatatgtaca

SEQ ID NO: 8262254 - DNA, 22 bp, Homo sapiens
tcttgcataggtcttttatcag

SEQ ID NO: 8262255 - DNA, 22 bp, Homo sapiens
tcttgcatgatattctgtattt

SEQ ID NO: 8262256 - DNA, 22 bp, Homo sapiens
tcttgcattccattctcgtgcc

SEQ ID NO: 8262257 - DNA, 22 bp, Homo sapiens
ccaggctgtaagagtgatgttg

SEQ ID NO: 8262258 - DNA, 22 bp, Homo sapiens
ccagggctccattgctcatcct

SEQ ID NO: 8262259 - DNA, 22 bp, Homo sapiens
ccaggcagagggaatagcaagt

SEQ ID NO: 8262260 - DNA, 22 bp, Homo sapiens
ccaggcagagggatccccatcc

SEQ ID NO: 8262261 - DNA, 22 bp, Homo sapiens
tcttaattctgtgtcttcacta

SEQ ID NO: 8262262 - DNA, 22 bp, Homo sapiens
ccaggaggcttcgtccgtggag

SEQ ID NO: 8262263 - DNA, 22 bp, Homo sapiens
ccaggaggcggaggttgcagtg

SEQ ID NO: 8262264 - DNA, 22 bp, Homo sapiens
ccaggcccccgagcagaagaca

SEQ ID NO: 8262265 - DNA, 22 bp, Homo sapiens
ccaggcccccgagcagaagaca

SEQ ID NO: 8262266 - DNA, 22 bp, Homo sapiens
ccaggcaggcgatggtgcagtg

SEQ ID NO: 8262267 - DNA, 22 bp, Homo sapiens
ccaggagcaccaggcctgtgcc

SEQ ID NO: 8262268 - DNA, 22 bp, Homo sapiens
ccaggagcagagtaggtgttca

SEQ ID NO: 8262269 - DNA, 19 bp, Homo sapiens
ccaggagcagtggtgagct

SEQ ID NO: 8262270 - DNA, 22 bp, Homo sapiens
ccaggagcagggctggctgcac

SEQ ID NO: 8262271 - DNA, 22 bp, Homo sapiens
ccaggagccactcaggcccaca

SEQ ID NO: 8262272 - DNA, 22 bp, Homo sapiens
tctgttcttctccactgtatgt

SEQ ID NO: 8262273 - DNA, 22 bp, Homo sapiens
ccaggaggcggaggttgcagcg

SEQ ID NO: 8262274 - DNA, 22 bp, Homo sapiens
ccaggagcctgggccaggctgg

SEQ ID NO: 8262275 - DNA, 22 bp, Homo sapiens
tgcaggcctcacacctggcacc

SEQ ID NO: 8262276 - DNA, 22 bp, Homo sapiens
tgcaggccggccctaggcctca

SEQ ID NO: 8262277 - DNA, 22 bp, Homo sapiens
tgcaggccagggtagggactag

SEQ ID NO: 8262278 - DNA, 22 bp, Homo sapiens
cccagcagcttgcacagtgctg

SEQ ID NO: 8262279 - DNA, 22 bp, Homo sapiens
cccagcagcctggatgttcttt

SEQ ID NO: 8262280 - DNA, 22 bp, Homo sapiens
cccagcagccttgtcccttctc

SEQ ID NO: 8262281 - DNA, 22 bp, Homo sapiens
cccagcaggcatgttgggagga

SEQ ID NO: 8262282 - DNA, 22 bp, Homo sapiens
cccagcaggaggaggttgcagt

SEQ ID NO: 8262283 - DNA, 22 bp, Homo sapiens
cccagcaggtcggtgctgcctg

SEQ ID NO: 8262284 - DNA, 22 bp, Homo sapiens
cccagcagggtctctgtgtcta

SEQ ID NO: 8262285 - DNA, 22 bp, Homo sapiens
cccagaggctgagttgggagca

SEQ ID NO: 8262286 - DNA, 22 bp, Homo sapiens
tgcacagatgctaggaggtgaa

SEQ ID NO: 8262287 - DNA, 22 bp, Homo sapiens
tgataactttaatttgatctga

SEQ ID NO: 8262288 - DNA, 22 bp, Homo sapiens
tgataactctcagtttctcatg

SEQ ID NO: 8262289 - DNA, 22 bp, Homo sapiens
tgcaatcagaaagttcagcggt

SEQ ID NO: 8262290 - DNA, 17 bp, Homo sapiens
cccagagatgctgcctt

SEQ ID NO: 8262291 - DNA, 22 bp, Homo sapiens
tgcacttcaaaaatgtcactga

SEQ ID NO: 8262292 - DNA, 22 bp, Homo sapiens
ccatccctcctccaccagctag

SEQ ID NO: 8262293 - DNA, 22 bp, Homo sapiens
tgaggctgaaactggcgataga

SEQ ID NO: 8262294 - DNA, 22 bp, Homo sapiens
tgaggcagtgtgagataataaa

SEQ ID NO: 8262295 - DNA, 22 bp, Homo sapiens
ccatccagaaacttccatcccc

SEQ ID NO: 8262296 - DNA, 22 bp, Homo sapiens
tgaggcagtgctgggaagcctg

SEQ ID NO: 8262297 - DNA, 22 bp, Homo sapiens
ccagtgcattgccgtgtctagg

SEQ ID NO: 8262298 - DNA, 22 bp, Homo sapiens
ccagtgcagtccccctgaactg

SEQ ID NO: 8262299 - DNA, 19 bp, Homo sapiens
ccagtcccatacaggagat

SEQ ID NO: 8262300 - DNA, 18 bp, Homo sapiens
tgagcaggggctgacctt

SEQ ID NO: 8262301 - DNA, 22 bp, Homo sapiens
ctttaaataatacaaggtccag

SEQ ID NO: 8262302 - DNA, 22 bp, Homo sapiens
ctttaattcagatttgaaggga

SEQ ID NO: 8262303 - DNA, 22 bp, Homo sapiens
ctttaattctcaggtgcacata

SEQ ID NO: 8262304 - DNA, 22 bp, Homo sapiens
ctttaattaggaagtataatga

SEQ ID NO: 8262305 - DNA, 22 bp, Homo sapiens
ctttaattgtagctcccataat

SEQ ID NO: 8262306 - DNA, 22 bp, Homo sapiens
ctttaattctcaggtgcacata

SEQ ID NO: 8262307 - DNA, 22 bp, Homo sapiens
cttctgggcattcagctgcaca

SEQ ID NO: 8262308 - DNA, 22 bp, Homo sapiens
cttctggaggctccagggaggt

SEQ ID NO: 8262309 - DNA, 22 bp, Homo sapiens
cttctggatttattcattcctt

SEQ ID NO: 8262310 - DNA, 22 bp, Homo sapiens
cttaggcaagcagagcccatcc

SEQ ID NO: 8262311 - DNA, 22 bp, Homo sapiens
cttatacaccctcttcccaggc

SEQ ID NO: 8262312 - DNA, 22 bp, Homo sapiens
cttaaattttcatctacaagaa

SEQ ID NO: 8262313 - DNA, 22 bp, Homo sapiens
ctgtggaaagagcctttggagg

SEQ ID NO: 8262314 - DNA, 22 bp, Homo sapiens
ctgggacagagcagcagtgggg

SEQ ID NO: 8262315 - DNA, 22 bp, Homo sapiens
ctgggagaggtggtgggaagta

SEQ ID NO: 8262316 - DNA, 22 bp, Homo sapiens
ctgggagatctgttgggactgg

SEQ ID NO: 8262317 - DNA, 22 bp, Homo sapiens
ctgggagcgcagcaggcacaac

SEQ ID NO: 8262318 - DNA, 22 bp, Homo sapiens
ctgggcagctgtatcagggagt

SEQ ID NO: 8262319 - DNA, 22 bp, Homo sapiens
ctgggcagctaccaccactgct

SEQ ID NO: 8262320 - DNA, 22 bp, Homo sapiens
ctgggcagaattttaggatggc

SEQ ID NO: 8262321 - DNA, 22 bp, Homo sapiens
ctgggcagagctaacacctgag

SEQ ID NO: 8262322 - DNA, 22 bp, Homo sapiens
ctgggctagaaggaccaggatg

SEQ ID NO: 8262323 - DNA, 22 bp, Homo sapiens
ctggtcactcctccacctgctt

SEQ ID NO: 8262324 - DNA, 20 bp, Homo sapiens
ctggggagctgctcccacga

SEQ ID NO: 8262325 - DNA, 20 bp, Homo sapiens
ctggggagcctcgcggtggc

SEQ ID NO: 8262326 - DNA, 21 bp, Homo sapiens
ctggtctggccaataaggtcc

SEQ ID NO: 8262327 - DNA, 22 bp, Homo sapiens
ctgtctggaatgcagtacatag

SEQ ID NO: 8262328 - DNA, 21 bp, Homo sapiens
ctgtctggccgcgggctccgc

SEQ ID NO: 8262329 - DNA, 22 bp, Homo sapiens
ctgtctggatgtgagtcaccta

SEQ ID NO: 8262330 - DNA, 22 bp, Homo sapiens
ctgtctgggtctacatcctctg

SEQ ID NO: 8262331 - DNA, 19 bp, Homo sapiens
ctgtctgtgcagagatgtg

SEQ ID NO: 8262332 - DNA, 17 bp, Homo sapiens
ctgtgctcgagtgatgg

SEQ ID NO: 8262333 - DNA, 22 bp, Homo sapiens
ctgtgctgcagacgcagtagct

SEQ ID NO: 8262334 - DNA, 22 bp, Homo sapiens
ctgtgctggagatgggccagag

SEQ ID NO: 8262335 - DNA, 22 bp, Homo sapiens
ctgtgctgtcttgggagcctta

SEQ ID NO: 8262336 - DNA, 20 bp, Homo sapiens
ctgtagggtgcagcaggctc

SEQ ID NO: 8262337 - DNA, 20 bp, Homo sapiens
ctgtagggtgcagcaggctc

SEQ ID NO: 8262338 - DNA, 22 bp, Homo sapiens
ctgtatatcatggttttgcagt

SEQ ID NO: 8262339 - DNA, 22 bp, Homo sapiens
ctgtatttgaaagaaaagattt

SEQ ID NO: 8262340 - DNA, 23 bp, Homo sapiens
ctgtatttgacttgagcggaaat

SEQ ID NO: 8262341 - DNA, 22 bp, Homo sapiens
ctgtatttgtcctctatttatt

SEQ ID NO: 8262342 - DNA, 22 bp, Homo sapiens
ctgtattttcatgcctacgtac

SEQ ID NO: 8262343 - DNA, 22 bp, Homo sapiens
ctgtattttttaagaatatctc

SEQ ID NO: 8262344 - DNA, 22 bp, Homo sapiens
ctgtattttttaagtgatctgg

SEQ ID NO: 8262345 - DNA, 18 bp, Homo sapiens
gagggagtagctgaggtt

SEQ ID NO: 8262346 - DNA, 22 bp, Homo sapiens
gagggagtaacgtactacagtg

SEQ ID NO: 8262347 - DNA, 22 bp, Homo sapiens
gagggaggtgatactgaacgta

SEQ ID NO: 8262348 - DNA, 22 bp, Homo sapiens
gagggagtgctttctgatagtt

SEQ ID NO: 8262349 - DNA, 22 bp, Homo sapiens
gagggagtgccagagggccagc

SEQ ID NO: 8262350 - DNA, 22 bp, Homo sapiens
gagggagtgagacacaaaagaa

SEQ ID NO: 8262351 - DNA, 22 bp, Homo sapiens
gaggggctgggcagtccctgga

SEQ ID NO: 8262352 - DNA, 22 bp, Homo sapiens
gaggggctggctgtggtcccat

SEQ ID NO: 8262353 - DNA, 22 bp, Homo sapiens
gagggagaattgcagccagcgt

SEQ ID NO: 8262354 - DNA, 22 bp, Homo sapiens
gagggagctggagcagacgccg

SEQ ID NO: 8262355 - DNA, 22 bp, Homo sapiens
gagggaggcatcatgaatccag

SEQ ID NO: 8262356 - DNA, 22 bp, Homo sapiens
gagggagggccaggtcccaacc

SEQ ID NO: 8262357 - DNA, 22 bp, Homo sapiens
gagggaggggagctccaccctc

SEQ ID NO: 8262358 - DNA, 22 bp, Homo sapiens
gagggagggaaagtttaacact

SEQ ID NO: 8262359 - DNA, 22 bp, Homo sapiens
gagggagggactagcattctct

SEQ ID NO: 8262360 - DNA, 22 bp, Homo sapiens
gaggcagtgtcggtggcaggat

SEQ ID NO: 8262361 - DNA, 22 bp, Homo sapiens
gaggctcagagaagtcatggta

SEQ ID NO: 8262362 - DNA, 20 bp, Homo sapiens
gaggagccaccttgagctgg

SEQ ID NO: 8262363 - DNA, 22 bp, Homo sapiens
gaggagagcctgcactttgacc

SEQ ID NO: 8262364 - DNA, 22 bp, Homo sapiens
gaggagagatggtagattgggt

SEQ ID NO: 8262365 - DNA, 22 bp, Homo sapiens
gaggcaggcactgttatcagca

SEQ ID NO: 8262366 - DNA, 22 bp, Homo sapiens
gaggagcccccactgggctcac

SEQ ID NO: 8262367 - DNA, 22 bp, Homo sapiens
gaggcagctgggtccggtcggg

SEQ ID NO: 8262368 - DNA, 22 bp, Homo sapiens
gaggagccatagatagtgctgc

SEQ ID NO: 8262369 - DNA, 22 bp, Homo sapiens
gaggagccaggaggtctccctg

SEQ ID NO: 8262370 - DNA, 22 bp, Homo sapiens
gaggagcccagcaccatcactt

SEQ ID NO: 8262371 - DNA, 22 bp, Homo sapiens
gaggcagcttggggctgtgggt

SEQ ID NO: 8262372 - DNA, 22 bp, Homo sapiens
gagcatggatcatgtgctgggt

SEQ ID NO: 8262373 - DNA, 22 bp, Homo sapiens
gagaggggcccaagccacatag

SEQ ID NO: 8262374 - DNA, 22 bp, Homo sapiens
gagcccagggcaggcaaggcag

SEQ ID NO: 8262375 - DNA, 22 bp, Homo sapiens
gagcccaggctggggttcagag

SEQ ID NO: 8262376 - DNA, 21 bp, Homo sapiens
gagcccaggcatctcattaat

SEQ ID NO: 8262377 - DNA, 22 bp, Homo sapiens
gagcccaggatggtgtatggct

SEQ ID NO: 8262378 - DNA, 22 bp, Homo sapiens
gagcccaggttctgcttccagc

SEQ ID NO: 8262379 - DNA, 22 bp, Homo sapiens
gagccctgaacaacagcaggaa

SEQ ID NO: 8262380 - DNA, 22 bp, Homo sapiens
gagcccagctgtccttggcaaa

SEQ ID NO: 8262381 - DNA, 22 bp, Homo sapiens
gagcccaggaagtggaggctga

SEQ ID NO: 8262382 - DNA, 22 bp, Homo sapiens
gagcccaggagtttgatgctgc

SEQ ID NO: 8262383 - DNA, 22 bp, Homo sapiens
gagcccagctctacctcagact

SEQ ID NO: 8262384 - DNA, 22 bp, Homo sapiens
gagcccagctgcggccctcagc

SEQ ID NO: 8262385 - DNA, 22 bp, Homo sapiens
gagccattgtccaagcctgttt

SEQ ID NO: 8262386 - DNA, 22 bp, Homo sapiens
gagccctgtagcaagtcatgtc

SEQ ID NO: 8262387 - DNA, 22 bp, Homo sapiens
gaggagagagggactgtctgca

SEQ ID NO: 8262388 - DNA, 22 bp, Homo sapiens
gaggagagagggactgtctgca

SEQ ID NO: 8262389 - DNA, 18 bp, Homo sapiens
gaaaggagagacagtagg

SEQ ID NO: 8262390 - DNA, 20 bp, Homo sapiens
gaaaggagtgtccctgtgag

SEQ ID NO: 8262391 - DNA, 22 bp, Homo sapiens
gaaggccagttttgagataggt

SEQ ID NO: 8262392 - DNA, 22 bp, Homo sapiens
gaaggccatttttaggtagaat

SEQ ID NO: 8262393 - DNA, 22 bp, Homo sapiens
gaaggcagggaatgtggtgcta

SEQ ID NO: 8262394 - DNA, 22 bp, Homo sapiens
gaaggagctaaagggagccctg

SEQ ID NO: 8262395 - DNA, 16 bp, Homo sapiens
gaaggagattcagaaa

SEQ ID NO: 8262396 - DNA, 22 bp, Homo sapiens
gacacagttctgttctagtagg

SEQ ID NO: 8262397 - DNA, 22 bp, Homo sapiens
gactctagattcatggtggagt

SEQ ID NO: 8262398 - DNA, 22 bp, Homo sapiens
gactctggtgtcagaagtgccc

SEQ ID NO: 8262399 - DNA, 22 bp, Homo sapiens
gactctttccctgtgacagagt

SEQ ID NO: 8262400 - DNA, 22 bp, Homo sapiens
gactgagggatagaggtgcttc

SEQ ID NO: 8262401 - DNA, 22 bp, Homo sapiens
gacagagattgaatcaggaaat

SEQ ID NO: 8262402 - DNA, 22 bp, Homo sapiens
gacagagcagcacccagcccct

SEQ ID NO: 8262403 - DNA, 20 bp, Homo sapiens
gagactggatctggagagac

SEQ ID NO: 8262404 - DNA, 22 bp, Homo sapiens
gagactggtgtttgctgggctg

SEQ ID NO: 8262405 - DNA, 22 bp, Homo sapiens
gagagggccgggggccagctcc

SEQ ID NO: 8262406 - DNA, 22 bp, Homo sapiens
gagacagatgctgctggagcat

SEQ ID NO: 8262407 - DNA, 18 bp, Homo sapiens
gagaaagcagggaatgtt

SEQ ID NO: 8262408 - DNA, 22 bp, Homo sapiens
gagaaagctaataggaatccta

SEQ ID NO: 8262409 - DNA, 22 bp, Homo sapiens
gactgaggtgcccagaggtgac

SEQ ID NO: 8262410 - DNA, 22 bp, Homo sapiens
gagaaacctgtaaggaaggaag

SEQ ID NO: 8262411 - DNA, 22 bp, Homo sapiens
ctgcagtgcctgccactgagcc

SEQ ID NO: 8262412 - DNA, 22 bp, Homo sapiens
ctgctgagcatttgcagggaca

SEQ ID NO: 8262413 - DNA, 22 bp, Homo sapiens
ctgctgagccctggcacaggtg

SEQ ID NO: 8262414 - DNA, 22 bp, Homo sapiens
ctgctgagccctggcacaggtg

SEQ ID NO: 8262415 - DNA, 22 bp, Homo sapiens
ctgctggaagtttgctgtggat

SEQ ID NO: 8262416 - DNA, 22 bp, Homo sapiens
ctgctgtgagtttggaggtcta

SEQ ID NO: 8262417 - DNA, 22 bp, Homo sapiens
ctgctggcttctagtcattcaa

SEQ ID NO: 8262418 - DNA, 22 bp, Homo sapiens
ctgctgctcagtgtcatcatgt

SEQ ID NO: 8262419 - DNA, 22 bp, Homo sapiens
ctgcggtgggctgggctgtccc

SEQ ID NO: 8262420 - DNA, 22 bp, Homo sapiens
ctgagggagaagtcacgggcag

SEQ ID NO: 8262421 - DNA, 22 bp, Homo sapiens
ctgagcaatttcagctctcact

SEQ ID NO: 8262422 - DNA, 22 bp, Homo sapiens
ctgagagatcaagccacaggat

SEQ ID NO: 8262423 - DNA, 22 bp, Homo sapiens
ctgaataatgttctcttgtatg

SEQ ID NO: 8262424 - DNA, 22 bp, Homo sapiens
ctctggagtgcagcctggtggc

SEQ ID NO: 8262425 - DNA, 22 bp, Homo sapiens
ctccctcacacccttgcccaga

SEQ ID NO: 8262426 - DNA, 22 bp, Homo sapiens
ctccctggtctttcccatcatt

SEQ ID NO: 8262427 - DNA, 22 bp, Homo sapiens
ctccctggtgtcccctccagga

SEQ ID NO: 8262428 - DNA, 22 bp, Homo sapiens
ctcccatgctctctctgagaag

SEQ ID NO: 8262429 - DNA, 22 bp, Homo sapiens
ctcaggcttgggaggaggccca

SEQ ID NO: 8262430 - DNA, 22 bp, Homo sapiens
ctcctgggctgtcggcgctctg

SEQ ID NO: 8262431 - DNA, 22 bp, Homo sapiens
tttcaaataccataaacctaat

SEQ ID NO: 8262432 - DNA, 20 bp, Homo sapiens
ctctctggaaggtgggagcc

SEQ ID NO: 8262433 - DNA, 22 bp, Homo sapiens
ctctctggacttgagtatcagc

SEQ ID NO: 8262434 - DNA, 22 bp, Homo sapiens
ctctagcttttgataccagtgt

SEQ ID NO: 8262435 - DNA, 22 bp, Homo sapiens
ctctgagctgtgggaaatgaga

SEQ ID NO: 8262436 - DNA, 22 bp, Homo sapiens
ctctgagctgccttttgagctt

SEQ ID NO: 8262437 - DNA, 22 bp, Homo sapiens
ctctgagcttagtgaaatgata

SEQ ID NO: 8262438 - DNA, 22 bp, Homo sapiens
ctctgagctttgcagcccctgg

SEQ ID NO: 8262439 - DNA, 22 bp, Homo sapiens
ctctgagggctcgagggacgcg

SEQ ID NO: 8262440 - DNA, 22 bp, Homo sapiens
ctctctggcacttcattgctgt

SEQ ID NO: 8262441 - DNA, 22 bp, Homo sapiens
ctctgagctcctaggtaaaact

SEQ ID NO: 8262442 - DNA, 22 bp, Homo sapiens
ctctgagctccaaaagtcagca

SEQ ID NO: 8262443 - DNA, 22 bp, Homo sapiens
ctctgagctcctggaagcgtgc

SEQ ID NO: 8262444 - DNA, 22 bp, Homo sapiens
ctctgagctcgtgcagtacttc

SEQ ID NO: 8262445 - DNA, 22 bp, Homo sapiens
ctctgagctgaaacatgagcat

SEQ ID NO: 8262446 - DNA, 22 bp, Homo sapiens
ctctgaggtccttcccagctct

SEQ ID NO: 8262447 - DNA, 22 bp, Homo sapiens
ctctggaggcagcaccagccag

SEQ ID NO: 8262448 - DNA, 22 bp, Homo sapiens
ctctggaggccgttggccctta

SEQ ID NO: 8262449 - DNA, 22 bp, Homo sapiens
ctctggaggttgagcccagcaa

SEQ ID NO: 8262450 - DNA, 22 bp, Homo sapiens
ctctggaggtcaggtgtggtgg

SEQ ID NO: 8262451 - DNA, 22 bp, Homo sapiens
ctctggagtcctgtatcactcc

SEQ ID NO: 8262452 - DNA, 22 bp, Homo sapiens
ctctggagtcaggcagccctgg

SEQ ID NO: 8262453 - DNA, 22 bp, Homo sapiens
ctctggagcgctgcttcccgcg

SEQ ID NO: 8262454 - DNA, 22 bp, Homo sapiens
ctctgctgctttgccagtggaa

SEQ ID NO: 8262455 - DNA, 21 bp, Homo sapiens
ctctgctgtctaccagctgtt

SEQ ID NO: 8262456 - DNA, 22 bp, Homo sapiens
ctctgctgtctcagatgggcca

SEQ ID NO: 8262457 - DNA, 22 bp, Homo sapiens
ctctgctgtgccgccagggcct

SEQ ID NO: 8262458 - DNA, 22 bp, Homo sapiens
ccttggtttccaggatgaggct

SEQ ID NO: 8262459 - DNA, 22 bp, Homo sapiens
cctttacagtatggttgtatca

SEQ ID NO: 8262460 - DNA, 21 bp, Homo sapiens
cctttacaattttgcattcct

SEQ ID NO: 8262461 - DNA, 22 bp, Homo sapiens
cctttaatttacaatgttaatt

SEQ ID NO: 8262462 - DNA, 22 bp, Homo sapiens
ccttctggatgtgctaaggaag

SEQ ID NO: 8262463 - DNA, 22 bp, Homo sapiens
ttattcacctctattagactca

SEQ ID NO: 8262464 - DNA, 23 bp, Homo sapiens
cctgtggcaagtagatgagatga

SEQ ID NO: 8262465 - DNA, 22 bp, Homo sapiens
cctggggagagaaagcccagcc

SEQ ID NO: 8262466 - DNA, 22 bp, Homo sapiens
cgcagccccaacaaatgggaca

SEQ ID NO: 8262467 - DNA, 22 bp, Homo sapiens
cgcagctctggccgagggcggc

SEQ ID NO: 8262468 - DNA, 22 bp, Homo sapiens
cgcagctcttaccctcccctta

SEQ ID NO: 8262469 - DNA, 20 bp, Homo sapiens
cgcagcagtggaagtggaat

SEQ ID NO: 8262470 - DNA, 22 bp, Homo sapiens
cgcagcagccccgtggtaggtg

SEQ ID NO: 8262471 - DNA, 22 bp, Homo sapiens
ttcagtttgaattctgtagaac

SEQ ID NO: 8262472 - DNA, 22 bp, Homo sapiens
cgggaaggtggaggttgcagtg

SEQ ID NO: 8262473 - DNA, 22 bp, Homo sapiens
cgggaaggtggaggttgcagtg

SEQ ID NO: 8262474 - DNA, 22 bp, Homo sapiens
cggctggtgtcgggcacagcaa

SEQ ID NO: 8262475 - DNA, 22 bp, Homo sapiens
cggctgggttcggctgcaggcc

SEQ ID NO: 8262476 - DNA, 22 bp, Homo sapiens
cggctgggtagaggtgccgggt

SEQ ID NO: 8262477 - DNA, 22 bp, Homo sapiens
cgtgacagggtctggctggtca

SEQ ID NO: 8262478 - DNA, 22 bp, Homo sapiens
ttctccttcctggttttcaggc

SEQ ID NO: 8262479 - DNA, 22 bp, Homo sapiens
ttctcaggtcaccagggtgcca

SEQ ID NO: 8262480 - DNA, 22 bp, Homo sapiens
ttctcaggtgaggctgaggctg

SEQ ID NO: 8262481 - DNA, 22 bp, Homo sapiens
ctaactgtcatgcacatgtgtt

SEQ ID NO: 8262482 - DNA, 22 bp, Homo sapiens
ttctgaaagccaattcattgaa

SEQ ID NO: 8262483 - DNA, 21 bp, Homo sapiens
ttcttcagtttaatataaaat

SEQ ID NO: 8262484 - DNA, 22 bp, Homo sapiens
ttcttcagtttggtaaatgtaa

SEQ ID NO: 8262485 - DNA, 22 bp, Homo sapiens
ctcagccatgcaacatgctggg

SEQ ID NO: 8262486 - DNA, 22 bp, Homo sapiens
ctcagcagtgacaagagagtat

SEQ ID NO: 8262487 - DNA, 22 bp, Homo sapiens
ggagatggcaagaagttattag

SEQ ID NO: 8262488 - DNA, 22 bp, Homo sapiens
ggagatggctggcaggtagatg

SEQ ID NO: 8262489 - DNA, 21 bp, Homo sapiens
ggagatgggtatcgcctgggc

SEQ ID NO: 8262490 - DNA, 22 bp, Homo sapiens
ggagatggtggaagctggtgca

SEQ ID NO: 8262491 - DNA, 22 bp, Homo sapiens
ggagcaaatgccaagtgggagg

SEQ ID NO: 8262492 - DNA, 22 bp, Homo sapiens
ggagcacagccttgccagtacc

SEQ ID NO: 8262493 - DNA, 22 bp, Homo sapiens
ggatctggggtagagcagtggg

SEQ ID NO: 8262494 - DNA, 22 bp, Homo sapiens
ggatgaggaaaccacagtgtcc

SEQ ID NO: 8262495 - DNA, 19 bp, Homo sapiens
ggatgagggtcaggcatag

SEQ ID NO: 8262496 - DNA, 22 bp, Homo sapiens
ggatggcagtctgcatgagaaa

SEQ ID NO: 8262497 - DNA, 22 bp, Homo sapiens
ggatggaggttctcagatgctc

SEQ ID NO: 8262498 - DNA, 22 bp, Homo sapiens
ggatggagatgaccatggtgac

SEQ ID NO: 8262499 - DNA, 22 bp, Homo sapiens
ggatgaggtagatgaacaaggg

SEQ ID NO: 8262500 - DNA, 23 bp, Homo sapiens
ggatggacgtgatgccttagcca

SEQ ID NO: 8262501 - DNA, 22 bp, Homo sapiens
ggcagaaggcctcccagctcct

SEQ ID NO: 8262502 - DNA, 22 bp, Homo sapiens
ggcagcaggagccatctggtag

SEQ ID NO: 8262503 - DNA, 22 bp, Homo sapiens
ggcagcagcaaggttggagctg

SEQ ID NO: 8262504 - DNA, 22 bp, Homo sapiens
ggcagcagggtctagattgatg

SEQ ID NO: 8262505 - DNA, 22 bp, Homo sapiens
ggcctggagcagagactaggga

SEQ ID NO: 8262506 - DNA, 22 bp, Homo sapiens
ggccaggaggcaggggctcaat

SEQ ID NO: 8262507 - DNA, 22 bp, Homo sapiens
ggccaggagctgcacagggctc

SEQ ID NO: 8262508 - DNA, 22 bp, Homo sapiens
ggccaggagcaagccaggctct

SEQ ID NO: 8262509 - DNA, 22 bp, Homo sapiens
ggccaggcactgtgtgagatat

SEQ ID NO: 8262510 - DNA, 22 bp, Homo sapiens
ggccaggaggcaggggctcaat

SEQ ID NO: 8262511 - DNA, 22 bp, Homo sapiens
ggcctagcctctcctgagagag

SEQ ID NO: 8262512 - DNA, 22 bp, Homo sapiens
ggccagctgtaagctgctgaat

SEQ ID NO: 8262513 - DNA, 22 bp, Homo sapiens
ggcatgagtggcagtgggcagt

SEQ ID NO: 8262514 - DNA, 22 bp, Homo sapiens
ggccagctttgagctgcaggaa

SEQ ID NO: 8262515 - DNA, 22 bp, Homo sapiens
ggccagcttattagctcagagg

SEQ ID NO: 8262516 - DNA, 22 bp, Homo sapiens
ggcagtggtgggaggctcgctc

SEQ ID NO: 8262517 - DNA, 22 bp, Homo sapiens
ggcaggagctcaggttggttcc

SEQ ID NO: 8262518 - DNA, 18 bp, Homo sapiens
ggcaggggtgaaccacag

SEQ ID NO: 8262519 - DNA, 22 bp, Homo sapiens
ggcaggggtgaggccactctga

SEQ ID NO: 8262520 - DNA, 22 bp, Homo sapiens
ggcagtgggttccccaaggcac

SEQ ID NO: 8262521 - DNA, 22 bp, Homo sapiens
ggcagtgggtggatctcaggga

SEQ ID NO: 8262522 - DNA, 17 bp, Homo sapiens
ggcagggtgctgggtat

SEQ ID NO: 8262523 - DNA, 22 bp, Homo sapiens
ggcagggtgtggagttgggaca

SEQ ID NO: 8262524 - DNA, 20 bp, Homo sapiens
ggctgctgtgggcagagagg

SEQ ID NO: 8262525 - DNA, 22 bp, Homo sapiens
ggctgtgattggtggatgtgaa

SEQ ID NO: 8262526 - DNA, 23 bp, Homo sapiens
ggctggtgcccttggccagtcgg

SEQ ID NO: 8262527 - DNA, 22 bp, Homo sapiens
ggctgggtacagggcagtgtgc

SEQ ID NO: 8262528 - DNA, 21 bp, Homo sapiens
ggctgggtcatgcagctggcc

SEQ ID NO: 8262529 - DNA, 22 bp, Homo sapiens
ggctgggtcccagctgggagga

SEQ ID NO: 8262530 - DNA, 19 bp, Homo sapiens
ggctgggtctggcaggttc

SEQ ID NO: 8262531 - DNA, 22 bp, Homo sapiens
ggctctgggtctgtggggagcg

SEQ ID NO: 8262532 - DNA, 22 bp, Homo sapiens
ggctctggttgaccatgatggc

SEQ ID NO: 8262533 - DNA, 22 bp, Homo sapiens
ggctcctgataggagaatgcgg

SEQ ID NO: 8262534 - DNA, 22 bp, Homo sapiens
ggcggtggcgtgaaggtggctg

SEQ ID NO: 8262535 - DNA, 22 bp, Homo sapiens
gggcagtgaatattggtgggaa

SEQ ID NO: 8262536 - DNA, 22 bp, Homo sapiens
gggcaggttattggagtaggga

SEQ ID NO: 8262537 - DNA, 22 bp, Homo sapiens
gggagggattagttctgcctgg

SEQ ID NO: 8262538 - DNA, 22 bp, Homo sapiens
gggagggccaggctcacccagg

SEQ ID NO: 8262539 - DNA, 22 bp, Homo sapiens
gggaggtgattaggaccatgta

SEQ ID NO: 8262540 - DNA, 22 bp, Homo sapiens
gggaggtgttctgccaacgcgg

SEQ ID NO: 8262541 - DNA, 22 bp, Homo sapiens
gggagggaggtgatgcttggct

SEQ ID NO: 8262542 - DNA, 22 bp, Homo sapiens
gggagggagaggacagttctat

SEQ ID NO: 8262543 - DNA, 22 bp, Homo sapiens
gggagggaggtgctggttcacg

SEQ ID NO: 8262544 - DNA, 22 bp, Homo sapiens
gggagggatctgctaggcaatg

SEQ ID NO: 8262545 - DNA, 22 bp, Homo sapiens
gggagctggcggattccccagg

SEQ ID NO: 8262546 - DNA, 22 bp, Homo sapiens
gggagctggatcgcgcgcccgg

SEQ ID NO: 8262547 - DNA, 22 bp, Homo sapiens
ggctttgcagtcatgttttgct

SEQ ID NO: 8262548 - DNA, 22 bp, Homo sapiens
gggaagggagggacctcagtct

SEQ ID NO: 8262549 - DNA, 22 bp, Homo sapiens
gggaagggagggcctccagtca

SEQ ID NO: 8262550 - DNA, 22 bp, Homo sapiens
gggaagggagggacctcagtct

SEQ ID NO: 8262551 - DNA, 22 bp, Homo sapiens
gggaagggacttgtttaaggtc

SEQ ID NO: 8262552 - DNA, 22 bp, Homo sapiens
gggaagggagctgggtatttag

SEQ ID NO: 8262553 - DNA, 22 bp, Homo sapiens
gggaagggacttgtttaaggtc

SEQ ID NO: 8262554 - DNA, 22 bp, Homo sapiens
gggaaggctgcctgagggatgg

SEQ ID NO: 8262555 - DNA, 22 bp, Homo sapiens
gggaaggccttgtcagcggatt

SEQ ID NO: 8262556 - DNA, 22 bp, Homo sapiens
gggagctgacctgcaggttccc

SEQ ID NO: 8262557 - DNA, 22 bp, Homo sapiens
gggagctgagctctgagccacg

SEQ ID NO: 8262558 - DNA, 22 bp, Homo sapiens
gggagctgaggagccccgtcgg

SEQ ID NO: 8262559 - DNA, 23 bp, Homo sapiens
gggaagtgaggagcccctcagcc

SEQ ID NO: 8262560 - DNA, 22 bp, Homo sapiens
gggaagtgaggagcccctctgc

SEQ ID NO: 8262561 - DNA, 22 bp, Homo sapiens
gggaagtgatggagccaggatt

SEQ ID NO: 8262562 - DNA, 22 bp, Homo sapiens
gggaagtgatggagccaggatt

SEQ ID NO: 8262563 - DNA, 23 bp, Homo sapiens
gggaagtgaggagcccctctgcc

SEQ ID NO: 8262564 - DNA, 22 bp, Homo sapiens
gggaagggagggcctccagtca

SEQ ID NO: 8262565 - DNA, 22 bp, Homo sapiens
gggaagggctccttttattgca

SEQ ID NO: 8262566 - DNA, 22 bp, Homo sapiens
gggaagggtgttgtcttatctt

SEQ ID NO: 8262567 - DNA, 22 bp, Homo sapiens
gggaagtgtgcagagttctctt

SEQ ID NO: 8262568 - DNA, 20 bp, Homo sapiens
gtctcctctttgcattccta

SEQ ID NO: 8262569 - DNA, 22 bp, Homo sapiens
gtgcccaggggccagctgccgg

SEQ ID NO: 8262570 - DNA, 22 bp, Homo sapiens
gtgctgggggtttctgtaggtc

SEQ ID NO: 8262571 - DNA, 22 bp, Homo sapiens
gtgctgggtgctgcagacaggt

SEQ ID NO: 8262572 - DNA, 22 bp, Homo sapiens
gtgctggggagataggaagaga

SEQ ID NO: 8262573 - DNA, 22 bp, Homo sapiens
gtgctgggattacaggtgtgag

SEQ ID NO: 8262574 - DNA, 22 bp, Homo sapiens
gtcctcagggagtcccagtcat

SEQ ID NO: 8262575 - DNA, 22 bp, Homo sapiens
gtcctcagcaccagaactaggg

SEQ ID NO: 8262576 - DNA, 22 bp, Homo sapiens
gtcctcagagtgggcaggtcct

SEQ ID NO: 8262577 - DNA, 22 bp, Homo sapiens
gtcctctgcttcatgccctgat

SEQ ID NO: 8262578 - DNA, 22 bp, Homo sapiens
gtctcctcttcatatacctgtt

SEQ ID NO: 8262579 - DNA, 22 bp, Homo sapiens
gtcctctgactcagccttggga

SEQ ID NO: 8262580 - DNA, 22 bp, Homo sapiens
ggtgggcacattcagtctctgt

SEQ ID NO: 8262581 - DNA, 22 bp, Homo sapiens
ggtgggcacccgagactggatc

SEQ ID NO: 8262582 - DNA, 22 bp, Homo sapiens
gtaggaagctctgaggctagtt

SEQ ID NO: 8262583 - DNA, 22 bp, Homo sapiens
gtagatattaaaaatggcagtg

SEQ ID NO: 8262584 - DNA, 22 bp, Homo sapiens
gggggaagactgggctagtgat

SEQ ID NO: 8262585 - DNA, 22 bp, Homo sapiens
gggggaagactgggctagtgat

SEQ ID NO: 8262586 - DNA, 22 bp, Homo sapiens
gggggaagactgggctagtgat

SEQ ID NO: 8262587 - DNA, 22 bp, Homo sapiens
ggggcaggagcccttcttcagc

SEQ ID NO: 8262588 - DNA, 22 bp, Homo sapiens
ggggcagctcccgagggcagga

SEQ ID NO: 8262589 - DNA, 22 bp, Homo sapiens
gggggcggagcacgtgaccacg

SEQ ID NO: 8262590 - DNA, 22 bp, Homo sapiens
gggggcgggagacagcagtgac

SEQ ID NO: 8262591 - DNA, 22 bp, Homo sapiens
gggggccttattcatctgccag

SEQ ID NO: 8262592 - DNA, 22 bp, Homo sapiens
ggggcacttggcacctctgcag

SEQ ID NO: 8262593 - DNA, 22 bp, Homo sapiens
ggggcactttactgcctcatct

SEQ ID NO: 8262594 - DNA, 22 bp, Homo sapiens
ggggatggaatgtagtagtgat

SEQ ID NO: 8262595 - DNA, 22 bp, Homo sapiens
ggggatggaggcgtgtggtcct

SEQ ID NO: 8262596 - DNA, 22 bp, Homo sapiens
gggctgggaatggctaagtatg

SEQ ID NO: 8262597 - DNA, 22 bp, Homo sapiens
gggctgggatggcttgaagatt

SEQ ID NO: 8262598 - DNA, 22 bp, Homo sapiens
gggctgggattgcttgctgtga

SEQ ID NO: 8262599 - DNA, 22 bp, Homo sapiens
gggctggggctcaataatttgt

SEQ ID NO: 8262600 - DNA, 22 bp, Homo sapiens
gggctgggcatggtgttccctc

SEQ ID NO: 8262601 - DNA, 22 bp, Homo sapiens
gggctcggcatctgtggactct

SEQ ID NO: 8262602 - DNA, 22 bp, Homo sapiens
gggcctcaggccttgctctgtg

SEQ ID NO: 8262603 - DNA, 20 bp, Homo sapiens
gggcagttcaatgccactct

SEQ ID NO: 8262604 - DNA, 22 bp, Homo sapiens
gggcatgacttttggagtggga

SEQ ID NO: 8262605 - DNA, 22 bp, Homo sapiens
ggtagacaatggaatgtggcct

SEQ ID NO: 8262606 - DNA, 22 bp, Homo sapiens
ggtacaaagttagatttaactt

SEQ ID NO: 8262607 - DNA, 22 bp, Homo sapiens
gggtcagggaggccccaccatg

SEQ ID NO: 8262608 - DNA, 22 bp, Homo sapiens
gggtccagacactccagaggaa

SEQ ID NO: 8262609 - DNA, 22 bp, Homo sapiens
gggtcagggctggctgtcgtca

SEQ ID NO: 8262610 - DNA, 23 bp, Homo sapiens
gggtccagagaagccattagggc

SEQ ID NO: 8262611 - DNA, 23 bp, Homo sapiens
gggtccagagacaggcatgggtg

SEQ ID NO: 8262612 - DNA, 22 bp, Homo sapiens
gggtccagagttgaagaggtta

SEQ ID NO: 8262613 - DNA, 22 bp, Homo sapiens
gggtccagagttttcccgccct

SEQ ID NO: 8262614 - DNA, 22 bp, Homo sapiens
gggtccagagcctcagcccaga

SEQ ID NO: 8262615 - DNA, 22 bp, Homo sapiens
ggtccagtcctgctcaccactt

SEQ ID NO: 8262616 - DNA, 23 bp, Homo sapiens
ggtccaggaaaggcagcagcacc

SEQ ID NO: 8262617 - DNA, 22 bp, Homo sapiens
ggtcagggctcttccagtggct

SEQ ID NO: 8262618 - DNA, 22 bp, Homo sapiens
ggtcaggggctgctctacagag

SEQ ID NO: 8262619 - DNA, 22 bp, Homo sapiens
ggtcaggaaaagactccccaga

SEQ ID NO: 8262620 - DNA, 21 bp, Homo sapiens
ggtagggaaggttcgctggtg

SEQ ID NO: 8262621 - DNA, 22 bp, Homo sapiens
ggtagggatgggatttggaagt

SEQ ID NO: 8262622 - DNA, 22 bp, Homo sapiens
ggtagggaaggtctcccacatt

SEQ ID NO: 8262623 - DNA, 22 bp, Homo sapiens
ggtagggaaggctctgcgggga

SEQ ID NO: 8262624 - DNA, 22 bp, Homo sapiens
ggtaggagtattttgcagcagt

SEQ ID NO: 8262625 - DNA, 22 bp, Homo sapiens
ggtctgtgctctggagcctctg

SEQ ID NO: 8262626 - DNA, 22 bp, Homo sapiens
ggtctgtgtcataggctgagtt

SEQ ID NO: 8262627 - DNA, 22 bp, Homo sapiens
ggtgaagggccttaggagacag

SEQ ID NO: 8262628 - DNA, 22 bp, Homo sapiens
ggtgaagcgtatttgtggagct

SEQ ID NO: 8262629 - DNA, 22 bp, Homo sapiens
ggtgaaggaggaagctgatgga

SEQ ID NO: 8262630 - DNA, 22 bp, Homo sapiens
ggtgaaggcacaagagggcaag

SEQ ID NO: 8262631 - DNA, 22 bp, Homo sapiens
ggtgaagggtgtcatggcattt

SEQ ID NO: 8262632 - DNA, 22 bp, Homo sapiens
ggtgaagtaataccaggtgtac

SEQ ID NO: 8262633 - DNA, 22 bp, Homo sapiens
ggtgaaggtctactgtgtgcca

SEQ ID NO: 8262634 - DNA, 22 bp, Homo sapiens
ggtgggagagcttgctttgatg

SEQ ID NO: 8262635 - DNA, 22 bp, Homo sapiens
ggtgggaggactgtttgaggca

SEQ ID NO: 8262636 - DNA, 22 bp, Homo sapiens
ggtgggagccaacacccttctg

SEQ ID NO: 8262637 - DNA, 22 bp, Homo sapiens
ggtgggaggcaggctgctccca

SEQ ID NO: 8262638 - DNA, 16 bp, Homo sapiens
ggtgggaggtgaggtg

SEQ ID NO: 8262639 - DNA, 22 bp, Homo sapiens
ggtgggagggctgcgttcctct

SEQ ID NO: 8262640 - DNA, 22 bp, Homo sapiens
ggtgggagtggaacgtggaaga

SEQ ID NO: 8262641 - DNA, 21 bp, Homo sapiens
ggtgggcacaggagagcagag

SEQ ID NO: 8262642 - DNA, 22 bp, Homo sapiens
ggtgggagtgggcacagttacg

SEQ ID NO: 8262643 - DNA, 22 bp, Homo sapiens
gcatccagaggtagccactgtg

SEQ ID NO: 8262644 - DNA, 22 bp, Homo sapiens
gcatccagtcttggctcctgga

SEQ ID NO: 8262645 - DNA, 22 bp, Homo sapiens
gcatttctgtgcatacacatga

SEQ ID NO: 8262646 - DNA, 22 bp, Homo sapiens
gcagtctatcttgtgatttaac

SEQ ID NO: 8262647 - DNA, 22 bp, Homo sapiens
gcagtctataaatcagctttgc

SEQ ID NO: 8262648 - DNA, 22 bp, Homo sapiens
gccagcaggtggagagatcaag

SEQ ID NO: 8262649 - DNA, 22 bp, Homo sapiens
gccagcaggttgtcaaggagct

SEQ ID NO: 8262650 - DNA, 22 bp, Homo sapiens
gccagcagggcggagccatcta

SEQ ID NO: 8262651 - DNA, 22 bp, Homo sapiens
gccagcagggcccaaatgctgg

SEQ ID NO: 8262652 - DNA, 22 bp, Homo sapiens
gccagcagtatgtcctggcagt

SEQ ID NO: 8262653 - DNA, 22 bp, Homo sapiens
gccagcagtccagtccttagtg

SEQ ID NO: 8262654 - DNA, 22 bp, Homo sapiens
gccagcagtcctgctgtgtgcc

SEQ ID NO: 8262655 - DNA, 22 bp, Homo sapiens
gccagcagtggccaccaccagg

SEQ ID NO: 8262656 - DNA, 22 bp, Homo sapiens
gccagagcacaggctggtagta

SEQ ID NO: 8262657 - DNA, 22 bp, Homo sapiens
gcccagtgtctaggaggtgaac

SEQ ID NO: 8262658 - DNA, 22 bp, Homo sapiens
gcccatccatggggtcatggcc

SEQ ID NO: 8262659 - DNA, 18 bp, Homo sapiens
gccctctggctgctgatg

SEQ ID NO: 8262660 - DNA, 22 bp, Homo sapiens
gccctctggggcacacagagga

SEQ ID NO: 8262661 - DNA, 22 bp, Homo sapiens
gcccagcaactgcacccttctt

SEQ ID NO: 8262662 - DNA, 22 bp, Homo sapiens
gcccagcaaggaccaagggccg

SEQ ID NO: 8262663 - DNA, 22 bp, Homo sapiens
gcccaggctggagtgcagtggt

SEQ ID NO: 8262664 - DNA, 22 bp, Homo sapiens
gcctcagctcccagcccaggct

SEQ ID NO: 8262665 - DNA, 22 bp, Homo sapiens
gcctcaggactggcatactcat

SEQ ID NO: 8262666 - DNA, 20 bp, Homo sapiens
gcctcagccaacccatgggg

SEQ ID NO: 8262667 - DNA, 22 bp, Homo sapiens
gcctcagccggcggacgccagg

SEQ ID NO: 8262668 - DNA, 22 bp, Homo sapiens
gccaggagaatgctagcagagg

SEQ ID NO: 8262669 - DNA, 22 bp, Homo sapiens
gccaggagcatgtcattgttga

SEQ ID NO: 8262670 - DNA, 22 bp, Homo sapiens
gccaggaggctgctgtgtaggc

SEQ ID NO: 8262671 - DNA, 21 bp, Homo sapiens
gccaggaccagcagaccactt

SEQ ID NO: 8262672 - DNA, 22 bp, Homo sapiens
gcccagagtgagtcctgggccc

SEQ ID NO: 8262673 - DNA, 22 bp, Homo sapiens
gcccacagtacgaggctcaggc

SEQ ID NO: 8262674 - DNA, 22 bp, Homo sapiens
gcccacagtacgaggctcaggc

SEQ ID NO: 8262675 - DNA, 20 bp, Homo sapiens
gcagcagtgcaagtcctctt

SEQ ID NO: 8262676 - DNA, 22 bp, Homo sapiens
gcagcagtggctgcaggtccca

SEQ ID NO: 8262677 - DNA, 22 bp, Homo sapiens
gcagctgcagaccctcagtgct

SEQ ID NO: 8262678 - DNA, 22 bp, Homo sapiens
gcagctgcagagaccgggtggg

SEQ ID NO: 8262679 - DNA, 22 bp, Homo sapiens
gcagctgcaataggcatcaagc

SEQ ID NO: 8262680 - DNA, 22 bp, Homo sapiens
gcagctgcaagcacttctggca

SEQ ID NO: 8262681 - DNA, 20 bp, Homo sapiens
gcagctgcccccagtccctg

SEQ ID NO: 8262682 - DNA, 22 bp, Homo sapiens
gcagctgccccgactgtgagtc

SEQ ID NO: 8262683 - DNA, 22 bp, Homo sapiens
gcagctgccgtgagctcacgcc

SEQ ID NO: 8262684 - DNA, 22 bp, Homo sapiens
gcagctgcctaaagtgctaaga

SEQ ID NO: 8262685 - DNA, 22 bp, Homo sapiens
gcagctgcaggtggtcccatgc

SEQ ID NO: 8262686 - DNA, 18 bp, Homo sapiens
gcagctgcagttgtagct

SEQ ID NO: 8262687 - DNA, 22 bp, Homo sapiens
gcagctgcaggcaggcttgctg

SEQ ID NO: 8262688 - DNA, 22 bp, Homo sapiens
gcagcagctccctatccaggct

SEQ ID NO: 8262689 - DNA, 22 bp, Homo sapiens
gcagcagctgacagtgggtgcc

SEQ ID NO: 8262690 - DNA, 22 bp, Homo sapiens
gcagcagctctgaatgggcccc

SEQ ID NO: 8262691 - DNA, 22 bp, Homo sapiens
gcagcagctcagttctgggagg

SEQ ID NO: 8262692 - DNA, 22 bp, Homo sapiens
gcagcagccgacatggattgca

SEQ ID NO: 8262693 - DNA, 22 bp, Homo sapiens
gcagcagcggggcccctgcgcg

SEQ ID NO: 8262694 - DNA, 22 bp, Homo sapiens
gcaggctccaactggaggagtt

SEQ ID NO: 8262695 - DNA, 22 bp, Homo sapiens
gcagggccttagcagcggctgc

SEQ ID NO: 8262696 - DNA, 22 bp, Homo sapiens
gcaggagtgtggtgggacatcc

SEQ ID NO: 8262697 - DNA, 22 bp, Homo sapiens
gcaggagtgtatttgcatgtaa

SEQ ID NO: 8262698 - DNA, 22 bp, Homo sapiens
gcaggagtgacatggatgtgga

SEQ ID NO: 8262699 - DNA, 22 bp, Homo sapiens
gcaggagtgacatggatgtgga

SEQ ID NO: 8262700 - DNA, 22 bp, Homo sapiens
gcaggagtggagaccatgggga

SEQ ID NO: 8262701 - DNA, 22 bp, Homo sapiens
gcaggagttaaaatatgtaatg

SEQ ID NO: 8262702 - DNA, 22 bp, Homo sapiens
gcaggagtgtgtctaatactca

SEQ ID NO: 8262703 - DNA, 22 bp, Homo sapiens
gcaggagttagaggtttaatct

SEQ ID NO: 8262704 - DNA, 22 bp, Homo sapiens
gcaggagtatctatacattaaa

SEQ ID NO: 8262705 - DNA, 22 bp, Homo sapiens
gcaggagtatgcagctatggtt

SEQ ID NO: 8262706 - DNA, 22 bp, Homo sapiens
gcaggagtcactgacttggtcc

SEQ ID NO: 8262707 - DNA, 22 bp, Homo sapiens
gcaggagtcagccctaccttga

SEQ ID NO: 8262708 - DNA, 22 bp, Homo sapiens
gcaggagtcccagaaggttttg

SEQ ID NO: 8262709 - DNA, 16 bp, Homo sapiens
gcaggagtaccacttg

SEQ ID NO: 8262710 - DNA, 22 bp, Homo sapiens
gcaggagctgctctcctgacga

SEQ ID NO: 8262711 - DNA, 22 bp, Homo sapiens
gcaggagctggaaagtgatgtt

SEQ ID NO: 8262712 - DNA, 22 bp, Homo sapiens
gcaggaggatcacttgagccca

SEQ ID NO: 8262713 - DNA, 22 bp, Homo sapiens
gcagaggacacaggagggcaag

SEQ ID NO: 8262714 - DNA, 22 bp, Homo sapiens
gcactgggagtctgtgggggtt

SEQ ID NO: 8262715 - DNA, 22 bp, Homo sapiens
gcactggagatacagagatgaa

SEQ ID NO: 8262716 - DNA, 18 bp, Homo sapiens
gcacagctaggagggtcc

SEQ ID NO: 8262717 - DNA, 22 bp, Homo sapiens
gcacagctcagcatgggaggac

SEQ ID NO: 8262718 - DNA, 22 bp, Homo sapiens
gagggggacgtatcctggtatg

SEQ ID NO: 8262719 - DNA, 19 bp, Homo sapiens
gcaagagcttaggaggggt

SEQ ID NO: 8262720 - DNA, 19 bp, Homo sapiens
gcctggctgggatgagccc

SEQ ID NO: 8262721 - DNA, 22 bp, Homo sapiens
gcctggctgggctgaatgctta

SEQ ID NO: 8262722 - DNA, 22 bp, Homo sapiens
gccttaggggtcagacagagct

SEQ ID NO: 8262723 - DNA, 22 bp, Homo sapiens
gcctggtgaaaggcagagagcg

SEQ ID NO: 8262724 - DNA, 22 bp, Homo sapiens
gcctggggtcccttgttggcac

SEQ ID NO: 8262725 - DNA, 22 bp, Homo sapiens
gcctggggccagcttgggctga

SEQ ID NO: 8262726 - DNA, 22 bp, Homo sapiens
gcctggggaacttgatcctgtc

SEQ ID NO: 8262727 - DNA, 22 bp, Homo sapiens
gcggaggacaggaatgcgggcg

SEQ ID NO: 8262728 - DNA, 22 bp, Homo sapiens
gcggcagaggtgttgcgagcga

SEQ ID NO: 8262729 - DNA, 22 bp, Homo sapiens
gcggcaggaagagcgcagcccc

SEQ ID NO: 8262730 - DNA, 22 bp, Homo sapiens
gccttgcaggaaggagggacag

SEQ ID NO: 8262731 - DNA, 22 bp, Homo sapiens
gcggggctttgccatgctgttt

SEQ ID NO: 8262732 - DNA, 22 bp, Homo sapiens
gctcagcttgggagcgcccggt

SEQ ID NO: 8262733 - DNA, 22 bp, Homo sapiens
gctcagctgggaccaatgtgtt

SEQ ID NO: 8262734 - DNA, 22 bp, Homo sapiens
gctcagctggaccatcgtgttt

SEQ ID NO: 8262735 - DNA, 21 bp, Homo sapiens
gctcagctgcttggttcctgt

SEQ ID NO: 8262736 - DNA, 22 bp, Homo sapiens
gctcaggcccagcggctggtgt

SEQ ID NO: 8262737 - DNA, 22 bp, Homo sapiens
gctcaggcatgtatgtggttgc

SEQ ID NO: 8262738 - DNA, 22 bp, Homo sapiens
gctctcagatgctccagcagcc

SEQ ID NO: 8262739 - DNA, 19 bp, Homo sapiens
gctcaggctgtgtgtgggg

SEQ ID NO: 8262740 - DNA, 22 bp, Homo sapiens
gctcaggcttcttctataaaga

SEQ ID NO: 8262741 - DNA, 22 bp, Homo sapiens
gctcaggctggattgcagtggc

SEQ ID NO: 8262742 - DNA, 21 bp, Homo sapiens
gctcaggctcttgacagagca

SEQ ID NO: 8262743 - DNA, 22 bp, Homo sapiens
gctcaggcctggcccatgggac

SEQ ID NO: 8262744 - DNA, 22 bp, Homo sapiens
gctcaggcctcggacacacaat

SEQ ID NO: 8262745 - DNA, 22 bp, Homo sapiens
gctcaggcctccagaggggcaa

SEQ ID NO: 8262746 - DNA, 18 bp, Homo sapiens
gctcaggccctagtcagt

SEQ ID NO: 8262747 - DNA, 22 bp, Homo sapiens
gctcaggcctcactccatttgg

SEQ ID NO: 8262748 - DNA, 21 bp, Homo sapiens
gctcaggctcaggttcaggtt

SEQ ID NO: 8262749 - DNA, 22 bp, Homo sapiens
gctcaggcctggctatccattg

SEQ ID NO: 8262750 - DNA, 22 bp, Homo sapiens
gctcaggctctcccaggggaat

SEQ ID NO: 8262751 - DNA, 22 bp, Homo sapiens
gctgccatcccctgctgggctg

SEQ ID NO: 8262752 - DNA, 22 bp, Homo sapiens
gctgcagggggtgggcgtctcc

SEQ ID NO: 8262753 - DNA, 22 bp, Homo sapiens
gctgcaggagattttgagagtc

SEQ ID NO: 8262754 - DNA, 22 bp, Homo sapiens
gctgcaggagctggagctgtgg

SEQ ID NO: 8262755 - DNA, 22 bp, Homo sapiens
gctgcacttgagcctgggagaa

SEQ ID NO: 8262756 - DNA, 22 bp, Homo sapiens
gctgaataatgtgtaatgtctc

SEQ ID NO: 8262757 - DNA, 22 bp, Homo sapiens
gctgaataattctttgttgtgg

SEQ ID NO: 8262758 - DNA, 22 bp, Homo sapiens
gctgaatacagcatgccttatg

SEQ ID NO: 8262759 - DNA, 22 bp, Homo sapiens
gctgaatagaagtcttcaaagg

SEQ ID NO: 8262760 - DNA, 22 bp, Homo sapiens
gctgaataggactgtcatctct

SEQ ID NO: 8262761 - DNA, 22 bp, Homo sapiens
gctgatccatacataaatgtgt

SEQ ID NO: 8262762 - DNA, 22 bp, Homo sapiens
gctgatccttttatgtctagct

SEQ ID NO: 8262763 - DNA, 22 bp, Homo sapiens
gctgaataagagtctactttgc

SEQ ID NO: 8262764 - DNA, 22 bp, Homo sapiens
gctggctgagttctgtcgtctg

SEQ ID NO: 8262765 - DNA, 22 bp, Homo sapiens
gctggctgcacaggggctcact

SEQ ID NO: 8262766 - DNA, 22 bp, Homo sapiens
gctggctgccaatttcagagct

SEQ ID NO: 8262767 - DNA, 22 bp, Homo sapiens
gctggctgcagattttagaggt

SEQ ID NO: 8262768 - DNA, 22 bp, Homo sapiens
gctggcagctggaagttgggct

SEQ ID NO: 8262769 - DNA, 22 bp, Homo sapiens
gctggcagagacaagaagacta

SEQ ID NO: 8262770 - DNA, 22 bp, Homo sapiens
gctggcagggacagctgcgtgt

SEQ ID NO: 8262771 - DNA, 22 bp, Homo sapiens
gctggcagactgggggcagaac

SEQ ID NO: 8262772 - DNA, 22 bp, Homo sapiens
gctgtgagaaacagggagtgtc

SEQ ID NO: 8262773 - DNA, 22 bp, Homo sapiens
gctgtgagctgcctgtgtcaca

SEQ ID NO: 8262774 - DNA, 22 bp, Homo sapiens
gctgtgagcactgctgggtgga

SEQ ID NO: 8262775 - DNA, 22 bp, Homo sapiens
gctgtgagtgagctgcctaggc

SEQ ID NO: 8262776 - DNA, 22 bp, Homo sapiens
gctgtgagggtctagtgaggtg

SEQ ID NO: 8262777 - DNA, 22 bp, Homo sapiens
gctgtgagtacaaggccctggg

SEQ ID NO: 8262778 - DNA, 22 bp, Homo sapiens
gctgtgagtggaggaggctgag

SEQ ID NO: 8262779 - DNA, 22 bp, Homo sapiens
gctgggagtcgcgtctgtggcc

SEQ ID NO: 8262780 - DNA, 20 bp, Homo sapiens
gctgggggtgtgctgagtga

SEQ ID NO: 8262781 - DNA, 22 bp, Homo sapiens
gctggggtctgtgaggagggct

SEQ ID NO: 8262782 - DNA, 22 bp, Homo sapiens
gctggtagacctcactgcactc

SEQ ID NO: 8262783 - DNA, 22 bp, Homo sapiens
ggaagcaggaggctggggtaaa

SEQ ID NO: 8262784 - DNA, 22 bp, Homo sapiens
ggaaccttgataataagttgtt

SEQ ID NO: 8262785 - DNA, 22 bp, Homo sapiens
ggaacagggatttggcctggtt

SEQ ID NO: 8262786 - DNA, 22 bp, Homo sapiens
gcttcctccagggaggggcctg

SEQ ID NO: 8262787 - DNA, 22 bp, Homo sapiens
ggaaaggctaacagtcatggaa

SEQ ID NO: 8262788 - DNA, 22 bp, Homo sapiens
ggacccaggtagggaggaagat

SEQ ID NO: 8262789 - DNA, 22 bp, Homo sapiens
ggacagagccctggtggcctaa

SEQ ID NO: 8262790 - DNA, 22 bp, Homo sapiens
ggacagagcagacgagcagcgg

SEQ ID NO: 8262791 - DNA, 22 bp, Homo sapiens
ggacagagcagacgagcagcgg

SEQ ID NO: 8262792 - DNA, 22 bp, Homo sapiens
ggacagacaaaaatagtaagca

SEQ ID NO: 8262793 - DNA, 22 bp, Homo sapiens
ggagaggagattgtggcatttt

SEQ ID NO: 8262794 - DNA, 22 bp, Homo sapiens
ggagaggaaatgccagcacttc

SEQ ID NO: 8262795 - DNA, 22 bp, Homo sapiens
ggagaggacatggctcccacag

SEQ ID NO: 8262796 - DNA, 22 bp, Homo sapiens
ggagaggagctattgggggctc

SEQ ID NO: 8262797 - DNA, 19 bp, Homo sapiens
ggagaggctggagggatgc

SEQ ID NO: 8262798 - DNA, 22 bp, Homo sapiens
ggagaggcttccagagtcgtgc

SEQ ID NO: 8262799 - DNA, 22 bp, Homo sapiens
ggagaggcttccagagtcgtgc

SEQ ID NO: 8262800 - DNA, 19 bp, Homo sapiens
ggagaggctggagggatgc

SEQ ID NO: 8262801 - DNA, 22 bp, Homo sapiens
ggacggggagctggaaagggga

SEQ ID NO: 8262802 - DNA, 22 bp, Homo sapiens
ggacctttgagggggaattggt

SEQ ID NO: 8262803 - DNA, 22 bp, Homo sapiens
tatatgatgccaaataacctgt

SEQ ID NO: 8262804 - DNA, 22 bp, Homo sapiens
tatagatagtcacttgttgcta

SEQ ID NO: 8262805 - DNA, 22 bp, Homo sapiens
tatagatagactgacgatacag

SEQ ID NO: 8262806 - DNA, 22 bp, Homo sapiens
tatattaaatgaccagttttaa

SEQ ID NO: 8262807 - DNA, 22 bp, Homo sapiens
tatattaacacccacttgcctc

SEQ ID NO: 8262808 - DNA, 20 bp, Homo sapiens
tatactaacatatatctgtt

SEQ ID NO: 8262809 - DNA, 22 bp, Homo sapiens
tatactttcctgcaactttgat

SEQ ID NO: 8262810 - DNA, 22 bp, Homo sapiens
tatacttatgctaaaaaatgtt

SEQ ID NO: 8262811 - DNA, 22 bp, Homo sapiens
tatctgtcacctgtagggtagg

SEQ ID NO: 8262812 - DNA, 22 bp, Homo sapiens
tatctataatgttttacttcct

SEQ ID NO: 8262813 - DNA, 23 bp, Homo sapiens
tatcttacctcccttctttcctg

SEQ ID NO: 8262814 - DNA, 22 bp, Homo sapiens
tatgcatacaatgagatattcc

SEQ ID NO: 8262815 - DNA, 22 bp, Homo sapiens
tattcacattctcaggcctggt

SEQ ID NO: 8262816 - DNA, 22 bp, Homo sapiens
tattcacaggttctggggatca

SEQ ID NO: 8262817 - DNA, 22 bp, Homo sapiens
tattcacagttgatttacagtt

SEQ ID NO: 8262818 - DNA, 22 bp, Homo sapiens
tattcacaggctggagtgatgt

SEQ ID NO: 8262819 - DNA, 22 bp, Homo sapiens
tattcacaggttccggagatta

SEQ ID NO: 8262820 - DNA, 22 bp, Homo sapiens
tattcacatgaaaacaaatttt

SEQ ID NO: 8262821 - DNA, 22 bp, Homo sapiens
tattcacatgtacatatgctca

SEQ ID NO: 8262822 - DNA, 22 bp, Homo sapiens
tattcacattaataagtcttca

SEQ ID NO: 8262823 - DNA, 22 bp, Homo sapiens
tattcacaggcacgaaatattg

SEQ ID NO: 8262824 - DNA, 22 bp, Homo sapiens
tattcacaaaatgaggtcctca

SEQ ID NO: 8262825 - DNA, 22 bp, Homo sapiens
tattcacagctgccgcactcag

SEQ ID NO: 8262826 - DNA, 22 bp, Homo sapiens
tattgtatcttaccacatgtat

SEQ ID NO: 8262827 - DNA, 22 bp, Homo sapiens
tattggtgatgacttgaggcca

SEQ ID NO: 8262828 - DNA, 22 bp, Homo sapiens
tattgtacatttcaaagtagct

SEQ ID NO: 8262829 - DNA, 22 bp, Homo sapiens
tatttgttgaatacccctgtct

SEQ ID NO: 8262830 - DNA, 22 bp, Homo sapiens
tatttgttgagttgttatgtct

SEQ ID NO: 8262831 - DNA, 22 bp, Homo sapiens
tatttgttccagagataaaaat

SEQ ID NO: 8262832 - DNA, 22 bp, Homo sapiens
tatttgttgcgggaattgctat

SEQ ID NO: 8262833 - DNA, 22 bp, Homo sapiens
tagaggcaccctggaggagact

SEQ ID NO: 8262834 - DNA, 22 bp, Homo sapiens
tagaggagcggcgagctgagct

SEQ ID NO: 8262835 - DNA, 23 bp, Homo sapiens
tagaggaggatgtgatgcatatt

SEQ ID NO: 8262836 - DNA, 22 bp, Homo sapiens
tagaatcagaagatttgactgt

SEQ ID NO: 8262837 - DNA, 22 bp, Homo sapiens
tagaaggcccattcatttgttc

SEQ ID NO: 8262838 - DNA, 22 bp, Homo sapiens
tactttctaagacatacaactt

SEQ ID NO: 8262839 - DNA, 19 bp, Homo sapiens
taggccctagctctgcagt

SEQ ID NO: 8262840 - DNA, 22 bp, Homo sapiens
taggcccagttccgcctcccgg

SEQ ID NO: 8262841 - DNA, 22 bp, Homo sapiens
taggaaggaagagcctcagatt

SEQ ID NO: 8262842 - DNA, 22 bp, Homo sapiens
tagtatatctttagtacatagt

SEQ ID NO: 8262843 - DNA, 22 bp, Homo sapiens
tagtctaagaaatctttacttt

SEQ ID NO: 8262844 - DNA, 22 bp, Homo sapiens
tagtgggtgatttgatgaggaa

SEQ ID NO: 8262845 - DNA, 23 bp, Homo sapiens
tagtgtatatcaacatttgtccc

SEQ ID NO: 8262846 - DNA, 22 bp, Homo sapiens
taacttagaagtttaattgtat

SEQ ID NO: 8262847 - DNA, 22 bp, Homo sapiens
gttagtgtatattgccttcaaa

SEQ ID NO: 8262848 - DNA, 22 bp, Homo sapiens
gttagtgtgactgaggaatgca

SEQ ID NO: 8262849 - DNA, 20 bp, Homo sapiens
gttaggaggttggacatgga

SEQ ID NO: 8262850 - DNA, 22 bp, Homo sapiens
tacaagcttttgtgtataaatg

SEQ ID NO: 8262851 - DNA, 22 bp, Homo sapiens
tacaatatgtggccttttgtga

SEQ ID NO: 8262852 - DNA, 22 bp, Homo sapiens
tacaagctgaccctgaagatga

SEQ ID NO: 8262853 - DNA, 22 bp, Homo sapiens
tacaagctcgggcagctcatta

SEQ ID NO: 8262854 - DNA, 22 bp, Homo sapiens
tacaagctggcgcagttaagat

SEQ ID NO: 8262855 - DNA, 19 bp, Homo sapiens
tacaagcttaaagtaatgt

SEQ ID NO: 8262856 - DNA, 22 bp, Homo sapiens
taataaactgctacgcttagtt

SEQ ID NO: 8262857 - DNA, 23 bp, Homo sapiens
taatgagaagctttgtttcctga

SEQ ID NO: 8262858 - DNA, 22 bp, Homo sapiens
tacctttaaggagatttgacaa

SEQ ID NO: 8262859 - DNA, 22 bp, Homo sapiens
tacgggagagggcgcctgagtg

SEQ ID NO: 8262860 - DNA, 22 bp, Homo sapiens
tacaggagagatttagtaatca

SEQ ID NO: 8262861 - DNA, 22 bp, Homo sapiens
tacattatcttgttatctttca

SEQ ID NO: 8262862 - DNA, 22 bp, Homo sapiens
tccagtgcattcagacacttgg

SEQ ID NO: 8262863 - DNA, 22 bp, Homo sapiens
tccagtctggagccttctggtt

SEQ ID NO: 8262864 - DNA, 22 bp, Homo sapiens
tccagtcctagaaactggagag

SEQ ID NO: 8262865 - DNA, 22 bp, Homo sapiens
tccagtgctggaccagagcacc

SEQ ID NO: 8262866 - DNA, 21 bp, Homo sapiens
tccaggcctcaggaagggatg

SEQ ID NO: 8262867 - DNA, 22 bp, Homo sapiens
tccaggccgcaggggcagcccc

SEQ ID NO: 8262868 - DNA, 22 bp, Homo sapiens
tccaggccgcatagttactctg

SEQ ID NO: 8262869 - DNA, 22 bp, Homo sapiens
tccaggcctaggccaagtgatt

SEQ ID NO: 8262870 - DNA, 22 bp, Homo sapiens
tccaggccctgggatgggagca

SEQ ID NO: 8262871 - DNA, 22 bp, Homo sapiens
tccaggccagggtaagaggaga

SEQ ID NO: 8262872 - DNA, 21 bp, Homo sapiens
tccaggccatggtggggaggc

SEQ ID NO: 8262873 - DNA, 19 bp, Homo sapiens
tccaggccattcccagagc

SEQ ID NO: 8262874 - DNA, 22 bp, Homo sapiens
tccaggccattgactgcatcct

SEQ ID NO: 8262875 - DNA, 20 bp, Homo sapiens
tccaggcccactcagctgaa

SEQ ID NO: 8262876 - DNA, 22 bp, Homo sapiens
tccaggcccagacggggtgagg

SEQ ID NO: 8262877 - DNA, 22 bp, Homo sapiens
tccaggcccactcggtggggct

SEQ ID NO: 8262878 - DNA, 22 bp, Homo sapiens
tccaggcccactcagctgaaat

SEQ ID NO: 8262879 - DNA, 22 bp, Homo sapiens
tcccagcagtcagagctatgtg

SEQ ID NO: 8262880 - DNA, 22 bp, Homo sapiens
tcccagcagggccgaccagcct

SEQ ID NO: 8262881 - DNA, 22 bp, Homo sapiens
tcccagcagcatagctcagaat

SEQ ID NO: 8262882 - DNA, 22 bp, Homo sapiens
tcccagcaggagtccagttccc

SEQ ID NO: 8262883 - DNA, 22 bp, Homo sapiens
tcccagcagatgagctgaccta

SEQ ID NO: 8262884 - DNA, 22 bp, Homo sapiens
tcccagcactgtaattctttgg

SEQ ID NO: 8262885 - DNA, 22 bp, Homo sapiens
tcccagcagagccagcaagccg

SEQ ID NO: 8262886 - DNA, 22 bp, Homo sapiens
tcccagcacgtctgctgtttct

SEQ ID NO: 8262887 - DNA, 22 bp, Homo sapiens
tcccagcaagaaagggggtggc

SEQ ID NO: 8262888 - DNA, 22 bp, Homo sapiens
tcccagcacagggcagatgtga

SEQ ID NO: 8262889 - DNA, 21 bp, Homo sapiens
tcccactgccacagcttcagg

SEQ ID NO: 8262890 - DNA, 22 bp, Homo sapiens
tccagtgtttttcttcacaggt

SEQ ID NO: 8262891 - DNA, 22 bp, Homo sapiens
tccagtgttgtcagatcatctg

SEQ ID NO: 8262892 - DNA, 19 bp, Homo sapiens
tccagtgtagctggtcatt

SEQ ID NO: 8262893 - DNA, 22 bp, Homo sapiens
tccagccccgaggccggcgacg

SEQ ID NO: 8262894 - DNA, 22 bp, Homo sapiens
tccagcccatccctagcctggg

SEQ ID NO: 8262895 - DNA, 22 bp, Homo sapiens
tccagcccctcctgagccaagc

SEQ ID NO: 8262896 - DNA, 22 bp, Homo sapiens
tccagccacgtattatctcact

SEQ ID NO: 8262897 - DNA, 22 bp, Homo sapiens
tccagccactcagcagggattg

SEQ ID NO: 8262898 - DNA, 22 bp, Homo sapiens
tccagccactcagcagggattg

SEQ ID NO: 8262899 - DNA, 22 bp, Homo sapiens
tccagcccaggctggagtgtag

SEQ ID NO: 8262900 - DNA, 19 bp, Homo sapiens
tccagcccctctgtgtgtg

SEQ ID NO: 8262901 - DNA, 22 bp, Homo sapiens
tccagcccgggggcaggtgacc

SEQ ID NO: 8262902 - DNA, 22 bp, Homo sapiens
tccagccctcagccaagtggaa

SEQ ID NO: 8262903 - DNA, 22 bp, Homo sapiens
tccagccctgcactgattagat

SEQ ID NO: 8262904 - DNA, 22 bp, Homo sapiens
tccagccctcctgggatcacag

SEQ ID NO: 8262905 - DNA, 22 bp, Homo sapiens
tccagccctgcccattctctcg

SEQ ID NO: 8262906 - DNA, 22 bp, Homo sapiens
tccagccttctcaaggctggct

SEQ ID NO: 8262907 - DNA, 22 bp, Homo sapiens
tccaccctgctttcttatctcc

SEQ ID NO: 8262908 - DNA, 23 bp, Homo sapiens
tccaccccagctgaggcttagcc

SEQ ID NO: 8262909 - DNA, 23 bp, Homo sapiens
tcctcctgacacagcctgagtga

SEQ ID NO: 8262910 - DNA, 22 bp, Homo sapiens
tccgggaggcagaggttgcagt

SEQ ID NO: 8262911 - DNA, 22 bp, Homo sapiens
tccctgccagtcctggtctgaa

SEQ ID NO: 8262912 - DNA, 23 bp, Homo sapiens
tccctgggcccgtgccagcggtg

SEQ ID NO: 8262913 - DNA, 22 bp, Homo sapiens
tcaggagggtgacaggccctgg

SEQ ID NO: 8262914 - DNA, 22 bp, Homo sapiens
tcaggaggcaagtaggtattga

SEQ ID NO: 8262915 - DNA, 22 bp, Homo sapiens
tcaggaggatgtcggcaaattt

SEQ ID NO: 8262916 - DNA, 22 bp, Homo sapiens
tcaggagggctaagactgtagc

SEQ ID NO: 8262917 - DNA, 20 bp, Homo sapiens
tcaggagcctaggacatgat

SEQ ID NO: 8262918 - DNA, 22 bp, Homo sapiens
tcaggcgaggcttaatccaagg

SEQ ID NO: 8262919 - DNA, 22 bp, Homo sapiens
tcagggcaatgtccctcagaag

SEQ ID NO: 8262920 - DNA, 22 bp, Homo sapiens
tcagggcaaaagggaaaccatt

SEQ ID NO: 8262921 - DNA, 22 bp, Homo sapiens
tcagggcaccaaaaaagatgcc

SEQ ID NO: 8262922 - DNA, 22 bp, Homo sapiens
tcagggcagaatccaaagaatt

SEQ ID NO: 8262923 - DNA, 22 bp, Homo sapiens
tcagggcagcctaaggcacctc

SEQ ID NO: 8262924 - DNA, 22 bp, Homo sapiens
tcaggggctgtgcatttcccag

SEQ ID NO: 8262925 - DNA, 21 bp, Homo sapiens
tcaggggctgtgttttccatc

SEQ ID NO: 8262926 - DNA, 22 bp, Homo sapiens
tcaggtaagtgtaatatataga

SEQ ID NO: 8262927 - DNA, 22 bp, Homo sapiens
tcagtggtatgcgtgggagctg

SEQ ID NO: 8262928 - DNA, 22 bp, Homo sapiens
tcagtggtatgcgtgggagctg

SEQ ID NO: 8262929 - DNA, 22 bp, Homo sapiens
tcagtgcttttgagaagctcct

SEQ ID NO: 8262930 - DNA, 22 bp, Homo sapiens
tcagtgcttcctggaggaagcc

SEQ ID NO: 8262931 - DNA, 22 bp, Homo sapiens
tcagtgcttcggcgagcaccta

SEQ ID NO: 8262932 - DNA, 22 bp, Homo sapiens
tcagtgcttgcctctggaggag

SEQ ID NO: 8262933 - DNA, 22 bp, Homo sapiens
tcagagagctggtgggcagagg

SEQ ID NO: 8262934 - DNA, 21 bp, Homo sapiens
tcacagagccacagaattggt

SEQ ID NO: 8262935 - DNA, 23 bp, Homo sapiens
tcacagagcatactgcattttgc

SEQ ID NO: 8262936 - DNA, 22 bp, Homo sapiens
tcacagagcacgtatcatgcct

SEQ ID NO: 8262937 - DNA, 22 bp, Homo sapiens
tcacagagcacacaagaattgc

SEQ ID NO: 8262938 - DNA, 20 bp, Homo sapiens
tcacagagtagccttgtctg

SEQ ID NO: 8262939 - DNA, 22 bp, Homo sapiens
tcacagagctcacagtttagca

SEQ ID NO: 8262940 - DNA, 22 bp, Homo sapiens
tcacagagttaaaagtttcttt

SEQ ID NO: 8262941 - DNA, 19 bp, Homo sapiens
tcacagagttcttacggga

SEQ ID NO: 8262942 - DNA, 22 bp, Homo sapiens
tcacagagagaatattgtgttt

SEQ ID NO: 8262943 - DNA, 22 bp, Homo sapiens
tcacagagagtgacttgttgct

SEQ ID NO: 8262944 - DNA, 22 bp, Homo sapiens
tcacagagaggttaagcagttg

SEQ ID NO: 8262945 - DNA, 22 bp, Homo sapiens
tcacagagatgaacttttgata

SEQ ID NO: 8262946 - DNA, 22 bp, Homo sapiens
tttgaaatgtatcagtataggt

SEQ ID NO: 8262947 - DNA, 22 bp, Homo sapiens
tttgcatggagtgaatggcgtg

SEQ ID NO: 8262948 - DNA, 18 bp, Homo sapiens
tttgcatggtaacattga

SEQ ID NO: 8262949 - DNA, 22 bp, Homo sapiens
tttgcatgggaggtagtaatca

SEQ ID NO: 8262950 - DNA, 22 bp, Homo sapiens
tttggggaaccactgaggtagg

SEQ ID NO: 8262951 - DNA, 22 bp, Homo sapiens
tttggggatgtctgagttgttg

SEQ ID NO: 8262952 - DNA, 22 bp, Homo sapiens
tttggggccagccccatgtctg

SEQ ID NO: 8262953 - DNA, 22 bp, Homo sapiens
ttttggggagaacggttgctat

SEQ ID NO: 8262954 - DNA, 16 bp, Homo sapiens
ttttattgtgacagcc

SEQ ID NO: 8262955 - DNA, 22 bp, Homo sapiens
ttctggagtattcctggcacct

SEQ ID NO: 8262956 - DNA, 22 bp, Homo sapiens
ttctggagggcatgctgctgcc

SEQ ID NO: 8262957 - DNA, 22 bp, Homo sapiens
ttctggaggctctaagggacaa

SEQ ID NO: 8262958 - DNA, 22 bp, Homo sapiens
ttctggagtcccacagccaggg

SEQ ID NO: 8262959 - DNA, 22 bp, Homo sapiens
ttctggagtattcctggcagcc

SEQ ID NO: 8262960 - DNA, 22 bp, Homo sapiens
ttctggagtgataaaacaccac

SEQ ID NO: 8262961 - DNA, 22 bp, Homo sapiens
ttctcaactctcaagagaagct

SEQ ID NO: 8262962 - DNA, 22 bp, Homo sapiens
ttctcagaattgactgggagca

SEQ ID NO: 8262963 - DNA, 22 bp, Homo sapiens
ttccctccctggctgccatttc

SEQ ID NO: 8262964 - DNA, 22 bp, Homo sapiens
ttccctccgaacctcagtgctg

SEQ ID NO: 8262965 - DNA, 22 bp, Homo sapiens
ttccctcctatgcccactgaaa

SEQ ID NO: 8262966 - DNA, 22 bp, Homo sapiens
ttccctcccccagcctggcagg

SEQ ID NO: 8262967 - DNA, 22 bp, Homo sapiens
ttccctccatttcattttataa

SEQ ID NO: 8262968 - DNA, 22 bp, Homo sapiens
ttccctcctatgcccactgaaa

SEQ ID NO: 8262969 - DNA, 22 bp, Homo sapiens
ttcgggaggcggagcttgcagt

SEQ ID NO: 8262970 - DNA, 22 bp, Homo sapiens
ttctaaaataagtttatctggt

SEQ ID NO: 8262971 - DNA, 22 bp, Homo sapiens
ttctgccagtgaaaataatgat

SEQ ID NO: 8262972 - DNA, 22 bp, Homo sapiens
ttctggaggctccagggaagaa

SEQ ID NO: 8262973 - DNA, 22 bp, Homo sapiens
ttctggaggcgggcgacctcgc

SEQ ID NO: 8262974 - DNA, 22 bp, Homo sapiens
ttctgccatttacaaatttcat

SEQ ID NO: 8262975 - DNA, 22 bp, Homo sapiens
ttctgccagtgatcaataattg

SEQ ID NO: 8262976 - DNA, 22 bp, Homo sapiens
ttcccccacctggggtacagga

SEQ ID NO: 8262977 - DNA, 22 bp, Homo sapiens
ttatgtcttaagtatgctaatt

SEQ ID NO: 8262978 - DNA, 22 bp, Homo sapiens
ttagtgtctggctatatttaaa

SEQ ID NO: 8262979 - DNA, 22 bp, Homo sapiens
ttagtgtgcatggatctgtgga

SEQ ID NO: 8262980 - DNA, 22 bp, Homo sapiens
ttagtgtgtccagttctgaaaa

SEQ ID NO: 8262981 - DNA, 22 bp, Homo sapiens
tcctcctgtctaccagttcctg

SEQ ID NO: 8262982 - DNA, 22 bp, Homo sapiens
ttatttgtggcatatgagacga

SEQ ID NO: 8262983 - DNA, 22 bp, Homo sapiens
ttattttctcctcagaaagtgg

SEQ ID NO: 8262984 - DNA, 22 bp, Homo sapiens
tttattgtcttcgtggtgccta

SEQ ID NO: 8262985 - DNA, 22 bp, Homo sapiens
tttattgtgttgaaactgaatt

SEQ ID NO: 8262986 - DNA, 22 bp, Homo sapiens
tttattgtctatgaactgcttg

SEQ ID NO: 8262987 - DNA, 22 bp, Homo sapiens
tttattgtcaatctattcccag

SEQ ID NO: 8262988 - DNA, 22 bp, Homo sapiens
tttagtgtttgcgtgtactcct

SEQ ID NO: 8262989 - DNA, 22 bp, Homo sapiens
tttagtgtggcactgatgttca

SEQ ID NO: 8262990 - DNA, 22 bp, Homo sapiens
tttagtgtgacagtccccagta

SEQ ID NO: 8262991 - DNA, 22 bp, Homo sapiens
tttagtgtagcctaagcagaat

SEQ ID NO: 8262992 - DNA, 22 bp, Homo sapiens
tttagtgtaattctgccttttg

SEQ ID NO: 8262993 - DNA, 22 bp, Homo sapiens
tttagtgtagcattcagagtca

SEQ ID NO: 8262994 - DNA, 22 bp, Homo sapiens
tttagtgtaagcataaagaaca

SEQ ID NO: 8262995 - DNA, 19 bp, Homo sapiens
tttacaagttctttgtatg

SEQ ID NO: 8262996 - DNA, 22 bp, Homo sapiens
tttaacatgtaattgctgcttt

SEQ ID NO: 8262997 - DNA, 21 bp, Homo sapiens
ttgttcttccagaagcaaagt

SEQ ID NO: 8262998 - DNA, 22 bp, Homo sapiens
ttgttcttggagcaggcagaga

SEQ ID NO: 8262999 - DNA, 22 bp, Homo sapiens
ttgttgggcatgcagtggctgt

SEQ ID NO: 8263000 - DNA, 22 bp, Homo sapiens
tttcaagtactgtaaacatgct

SEQ ID NO: 8263001 - DNA, 22 bp, Homo sapiens
tttcaagttctgttcctaaact

SEQ ID NO: 8263002 - DNA, 22 bp, Homo sapiens
tttcaagtggcgagataaggaa

SEQ ID NO: 8263003 - DNA, 22 bp, Homo sapiens
tttcgtcaattgtaacaaatgt

SEQ ID NO: 8263004 - DNA, 22 bp, Homo sapiens
tttcatatgggcattggcaata

SEQ ID NO: 8263005 - DNA, 22 bp, Homo sapiens
ttgccatgcagccaggaaggag

SEQ ID NO: 8263006 - DNA, 22 bp, Homo sapiens
ttgcctggattctaccacagaa

SEQ ID NO: 8263007 - DNA, 22 bp, Homo sapiens
ttgcctggcttgtagatggggg

SEQ ID NO: 8263008 - DNA, 22 bp, Homo sapiens
ttgcctggactctgctggtatt

SEQ ID NO: 8263009 - DNA, 22 bp, Homo sapiens
ttgcttcttagatattcctctc

SEQ ID NO: 8263010 - DNA, 22 bp, Homo sapiens
ttggccctagactctaagtccg

SEQ ID NO: 8263011 - DNA, 22 bp, Homo sapiens
ttggccctggggccagcttcga

SEQ ID NO: 8263012 - DNA, 22 bp, Homo sapiens
ttggccctgaggttatcatcta

SEQ ID NO: 8263013 - DNA, 22 bp, Homo sapiens
ttggccctggcacacccccacg

SEQ ID NO: 8263014 - DNA, 22 bp, Homo sapiens
ttggccctagatgattaagttg

SEQ ID NO: 8263015 - DNA, 22 bp, Homo sapiens
ttggccctccacctggctgtgc

SEQ ID NO: 8263016 - DNA, 22 bp, Homo sapiens
ttggccctgaggaggcagctgc

SEQ ID NO: 8263017 - DNA, 22 bp, Homo sapiens
ttggccctttatgggatgggca

SEQ ID NO: 8263018 - DNA, 22 bp, Homo sapiens
ttgggctggcagaggtggtctt

SEQ ID NO: 8263019 - DNA, 22 bp, Homo sapiens
ttggggaggttgccacattcca

SEQ ID NO: 8263020 - DNA, 22 bp, Homo sapiens
ttgggctgaggagggcgtggcc

SEQ ID NO: 8263021 - DNA, 22 bp, Homo sapiens
ttgttcttacttaagagtgaat

SEQ ID NO: 8263022 - DNA, 22 bp, Homo sapiens
ttgtggcagaccatgagtctaa

SEQ ID NO: 8263023 - DNA, 22 bp, Homo sapiens
ttgtatttatattgaatagctt

SEQ ID NO: 8263024 - DNA, 22 bp, Homo sapiens
ttgtattcttccttagcagtac

SEQ ID NO: 8263025 - DNA, 22 bp, Homo sapiens
ttgtattctttatgacttccct

SEQ ID NO: 8263026 - DNA, 22 bp, Homo sapiens
ttgtattcctgggtcaaggaga

SEQ ID NO: 8263027 - DNA, 20 bp, Homo sapiens
ttgtattccttgaatcaggt

SEQ ID NO: 8263028 - DNA, 22 bp, Homo sapiens
ttgtattctgttacagcaacat

SEQ ID NO: 8263029 - DNA, 22 bp, Homo sapiens
ttgtattccagccaccacaggc

SEQ ID NO: 8263030 - DNA, 22 bp, Homo sapiens
ttgtattcatttggccatactg

SEQ ID NO: 8263031 - DNA, 22 bp, Homo sapiens
ttgtattcattgcttacccaat

SEQ ID NO: 8263032 - DNA, 22 bp, Homo sapiens
ttggggtacgcaggtctgggag

SEQ ID NO: 8263033 - DNA, 22 bp, Homo sapiens
aactaacagtcattaaaagaac

SEQ ID NO: 8263034 - DNA, 22 bp, Homo sapiens
aaagctcttttccaagtattga

SEQ ID NO: 8263035 - DNA, 22 bp, Homo sapiens
aaagctcttgggagggttaatt

SEQ ID NO: 8263036 - DNA, 22 bp, Homo sapiens
aaagctctttcacttccgttct

SEQ ID NO: 8263037 - DNA, 22 bp, Homo sapiens
aaagctctttcttctttggcat

SEQ ID NO: 8263038 - DNA, 22 bp, Homo sapiens
aaagctctttgtatagtggaat

SEQ ID NO: 8263039 - DNA, 22 bp, Homo sapiens
aaagctggcttttacaggggct

SEQ ID NO: 8263040 - DNA, 22 bp, Homo sapiens
aaagctcttatgtaaacagaaa

SEQ ID NO: 8263041 - DNA, 22 bp, Homo sapiens
aaagctcttggattttagactc

SEQ ID NO: 8263042 - DNA, 22 bp, Homo sapiens
aaagctcttatagcagagtgtg

SEQ ID NO: 8263043 - DNA, 22 bp, Homo sapiens
aacagcagcaagtaagcaggtc

SEQ ID NO: 8263044 - DNA, 20 bp, Homo sapiens
aacagcacacattcgcatta

SEQ ID NO: 8263045 - DNA, 22 bp, Homo sapiens
aaagccagggtccaggcctgcc

SEQ ID NO: 8263046 - DNA, 22 bp, Homo sapiens
aaatgcacaggttttaaatcct

SEQ ID NO: 8263047 - DNA, 22 bp, Homo sapiens
aaatgtagtatgttgcatgtat

SEQ ID NO: 8263048 - DNA, 22 bp, Homo sapiens
aaaatcctgctgactcgagatg

SEQ ID NO: 8263049 - DNA, 22 bp, Homo sapiens
aaaatcctctaattctagaata

SEQ ID NO: 8263050 - DNA, 22 bp, Homo sapiens
aaaatcagtacactttattttg

SEQ ID NO: 8263051 - DNA, 22 bp, Homo sapiens
aaaggtagtacttctagaaggg

SEQ ID NO: 8263052 - DNA, 22 bp, Homo sapiens
aaacagtggccaattctggaga

SEQ ID NO: 8263053 - DNA, 22 bp, Homo sapiens
aaacctggtggaacggtgaata

SEQ ID NO: 8263054 - DNA, 22 bp, Homo sapiens
aaacccagggttttgtcttccc

SEQ ID NO: 8263055 - DNA, 22 bp, Homo sapiens
aaaggtgttctcactgggggtc

SEQ ID NO: 8263056 - DNA, 22 bp, Homo sapiens
aaactgataaaataagtacatt

SEQ ID NO: 8263057 - DNA, 22 bp, Homo sapiens
aaagacacaaatgtagaccaaa

SEQ ID NO: 8263058 - DNA, 22 bp, Homo sapiens
aaactgacaatctcagtcctat

SEQ ID NO: 8263059 - DNA, 20 bp, Homo sapiens
aaattactgccacacatttc

SEQ ID NO: 8263060 - DNA, 22 bp, Homo sapiens
acaaagccagattctggagcac

SEQ ID NO: 8263061 - DNA, 22 bp, Homo sapiens
acaaagctagagaagagaattg

SEQ ID NO: 8263062 - DNA, 22 bp, Homo sapiens
aagagagaacacagcttgggca

SEQ ID NO: 8263063 - DNA, 22 bp, Homo sapiens
aacttcacctttttgccacact

SEQ ID NO: 8263064 - DNA, 22 bp, Homo sapiens
aacttagtttagggtattgatt

SEQ ID NO: 8263065 - DNA, 22 bp, Homo sapiens
acactgctcacttcttcccttg

SEQ ID NO: 8263066 - DNA, 22 bp, Homo sapiens
aagattgacggctttgagtgct

SEQ ID NO: 8263067 - DNA, 22 bp, Homo sapiens
aagaggcctggaggcagaggtg

SEQ ID NO: 8263068 - DNA, 22 bp, Homo sapiens
aagaggccccccagcaggtgaa

SEQ ID NO: 8263069 - DNA, 22 bp, Homo sapiens
acagcagcttgtctgttcttta

SEQ ID NO: 8263070 - DNA, 22 bp, Homo sapiens
acagcagcttgcgtgtctggtc

SEQ ID NO: 8263071 - DNA, 22 bp, Homo sapiens
acagcagcttcctgactgtact

SEQ ID NO: 8263072 - DNA, 22 bp, Homo sapiens
acagcagctgccttcaggctct

SEQ ID NO: 8263073 - DNA, 22 bp, Homo sapiens
acagcagctaacccctgggcca

SEQ ID NO: 8263074 - DNA, 22 bp, Homo sapiens
acagcagctaaaggtgtctcct

SEQ ID NO: 8263075 - DNA, 22 bp, Homo sapiens
aactgctcatttgagagtatgc

SEQ ID NO: 8263076 - DNA, 20 bp, Homo sapiens
aatataattctctgaattta

SEQ ID NO: 8263077 - DNA, 22 bp, Homo sapiens
aatataatgctgttttatgcca

SEQ ID NO: 8263078 - DNA, 22 bp, Homo sapiens
aactacattgtcctttctgaag

SEQ ID NO: 8263079 - DNA, 22 bp, Homo sapiens
aaccagagaagaattatattgt

SEQ ID NO: 8263080 - DNA, 22 bp, Homo sapiens
aaccagagaaatggagtgataa

SEQ ID NO: 8263081 - DNA, 22 bp, Homo sapiens
aaccagagagtcttcttcattg

SEQ ID NO: 8263082 - DNA, 21 bp, Homo sapiens
aaccagagccaggctctcagc

SEQ ID NO: 8263083 - DNA, 22 bp, Homo sapiens
aaccagagctttaaaaatctgt

SEQ ID NO: 8263084 - DNA, 21 bp, Homo sapiens
aaccagaggcagaaaggggaa

SEQ ID NO: 8263085 - DNA, 22 bp, Homo sapiens
aaccagaggcagcagtacctga

SEQ ID NO: 8263086 - DNA, 22 bp, Homo sapiens
aataacttcagttcttacatta

SEQ ID NO: 8263087 - DNA, 22 bp, Homo sapiens
aataacttgaagatctcttcca

SEQ ID NO: 8263088 - DNA, 22 bp, Homo sapiens
aacaggagtcattgtcattatt

SEQ ID NO: 8263089 - DNA, 22 bp, Homo sapiens
aacaggcaatttaggactcttt

SEQ ID NO: 8263090 - DNA, 22 bp, Homo sapiens
aacaggcaacagttgactctga

SEQ ID NO: 8263091 - DNA, 22 bp, Homo sapiens
aacaggagagtaaatatatgat

SEQ ID NO: 8263092 - DNA, 22 bp, Homo sapiens
aacaggagaggggaatgtagag

SEQ ID NO: 8263093 - DNA, 22 bp, Homo sapiens
aacaggaggccttccagtccag

SEQ ID NO: 8263094 - DNA, 22 bp, Homo sapiens
aacaggccttgtttttgttcat

SEQ ID NO: 8263095 - DNA, 22 bp, Homo sapiens
aacaggcagcagactgaatctg

SEQ ID NO: 8263096 - DNA, 20 bp, Homo sapiens
aacagggcagaagcggagac

SEQ ID NO: 8263097 - DNA, 22 bp, Homo sapiens
aacagggctttggaagtctccg

SEQ ID NO: 8263098 - DNA, 22 bp, Homo sapiens
aacatgaaacccaaacagaata

SEQ ID NO: 8263099 - DNA, 22 bp, Homo sapiens
aaggtcaaagacagtaactttt

SEQ ID NO: 8263100 - DNA, 22 bp, Homo sapiens
aagtcatgagtcctcttctgtg

SEQ ID NO: 8263101 - DNA, 22 bp, Homo sapiens
aacagcagggatgacatggcca

SEQ ID NO: 8263102 - DNA, 22 bp, Homo sapiens
aacagcagggaaattccaagtc

SEQ ID NO: 8263103 - DNA, 23 bp, Homo sapiens
aacagcaggatgatagaggaggt

SEQ ID NO: 8263104 - DNA, 21 bp, Homo sapiens
actcccatcataactggtggg

SEQ ID NO: 8263105 - DNA, 22 bp, Homo sapiens
actaacttgctgagtgaccatg

SEQ ID NO: 8263106 - DNA, 22 bp, Homo sapiens
aagttacattttggtctaattg

SEQ ID NO: 8263107 - DNA, 22 bp, Homo sapiens
aagtgcataataactcccaagt

SEQ ID NO: 8263108 - DNA, 22 bp, Homo sapiens
aagtcactggcaaaagctgcag

SEQ ID NO: 8263109 - DNA, 22 bp, Homo sapiens
acttgaaaccttggcaaacaat

SEQ ID NO: 8263110 - DNA, 22 bp, Homo sapiens
aatatatagaagtacccgttgt

SEQ ID NO: 8263111 - DNA, 22 bp, Homo sapiens
aatattctaataaatgcccatc

SEQ ID NO: 8263112 - DNA, 22 bp, Homo sapiens
aatcctggaatacaagagtgaa

SEQ ID NO: 8263113 - DNA, 22 bp, Homo sapiens
aatcaaagaatgggctagttgg

SEQ ID NO: 8263114 - DNA, 23 bp, Homo sapiens
aatgaactgagaatctgtacagt

SEQ ID NO: 8263115 - DNA, 22 bp, Homo sapiens
aatgagttattaggtgtaagtg

SEQ ID NO: 8263116 - DNA, 22 bp, Homo sapiens
aatgagttctgacacttcacga

SEQ ID NO: 8263117 - DNA, 22 bp, Homo sapiens
aatgagctgctgctgttccacc

SEQ ID NO: 8263118 - DNA, 22 bp, Homo sapiens
aatgagatcagagataactcaa

SEQ ID NO: 8263119 - DNA, 22 bp, Homo sapiens
aatgagatggaggactcttaat

SEQ ID NO: 8263120 - DNA, 22 bp, Homo sapiens
aaggcagaaagggatgtgagtg

SEQ ID NO: 8263121 - DNA, 22 bp, Homo sapiens
aaggaagaaatgaataggtgga

SEQ ID NO: 8263122 - DNA, 22 bp, Homo sapiens
aaggcaggtattgatgccacag

SEQ ID NO: 8263123 - DNA, 22 bp, Homo sapiens
aaggcaggatgcggacccatct

SEQ ID NO: 8263124 - DNA, 22 bp, Homo sapiens
aaggcagctcagctcatggcag

SEQ ID NO: 8263125 - DNA, 22 bp, Homo sapiens
aaggcagggaaagtggattagg

SEQ ID NO: 8263126 - DNA, 22 bp, Homo sapiens
aaggcaggatgggaaaagattt

SEQ ID NO: 8263127 - DNA, 22 bp, Homo sapiens
acagttgatttcattagaatcg

SEQ ID NO: 8263128 - DNA, 18 bp, Homo sapiens
aagccaggtcaagataag

SEQ ID NO: 8263129 - DNA, 22 bp, Homo sapiens
accatgattcacccaccactgt

SEQ ID NO: 8263130 - DNA, 22 bp, Homo sapiens
accatgtcatttattggccaaa

SEQ ID NO: 8263131 - DNA, 22 bp, Homo sapiens
accatgttagttactgggaatg

SEQ ID NO: 8263132 - DNA, 22 bp, Homo sapiens
acaagctttgtgatagtagaga

SEQ ID NO: 8263133 - DNA, 22 bp, Homo sapiens
acaagtctttttcatgtcttct

SEQ ID NO: 8263134 - DNA, 22 bp, Homo sapiens
acaagtgtgtgcagtttgtaaa

SEQ ID NO: 8263135 - DNA, 22 bp, Homo sapiens
acaagtgtgtgcagtttgtaaa

SEQ ID NO: 8263136 - DNA, 22 bp, Homo sapiens
acaagtgttgcattttgccatt

SEQ ID NO: 8263137 - DNA, 22 bp, Homo sapiens
agatggggctcagtgtggaggc

SEQ ID NO: 8263138 - DNA, 22 bp, Homo sapiens
acaatgcttggtttttctagaa

SEQ ID NO: 8263139 - DNA, 22 bp, Homo sapiens
acaattctctcatatcttatta

SEQ ID NO: 8263140 - DNA, 22 bp, Homo sapiens
agaggccccaggtgagcatgcc

SEQ ID NO: 8263141 - DNA, 22 bp, Homo sapiens
aatttgttaaaagtgagtgaca

SEQ ID NO: 8263142 - DNA, 22 bp, Homo sapiens
agagctgggtggtggtgactca

SEQ ID NO: 8263143 - DNA, 22 bp, Homo sapiens
agacagcaatatgggagacgga

SEQ ID NO: 8263144 - DNA, 23 bp, Homo sapiens
agacagaggctgaggctggccgc

SEQ ID NO: 8263145 - DNA, 22 bp, Homo sapiens
aatgtcagtgttactgctattg

SEQ ID NO: 8263146 - DNA, 22 bp, Homo sapiens
aatgtcacatacaatggcaagt

SEQ ID NO: 8263147 - DNA, 22 bp, Homo sapiens
aatgtcacagaagaactcccca

SEQ ID NO: 8263148 - DNA, 22 bp, Homo sapiens
aattatacatgaaggcattata

SEQ ID NO: 8263149 - DNA, 22 bp, Homo sapiens
aattatacattgaacaatctag

SEQ ID NO: 8263150 - DNA, 22 bp, Homo sapiens
aattatatgttaatcttcaatt

SEQ ID NO: 8263151 - DNA, 22 bp, Homo sapiens
agcagggcccactaggggagat

SEQ ID NO: 8263152 - DNA, 22 bp, Homo sapiens
agcagggcagttaaagggtcct

SEQ ID NO: 8263153 - DNA, 22 bp, Homo sapiens
agcagggcatgaataagggttt

SEQ ID NO: 8263154 - DNA, 23 bp, Homo sapiens
acactgtctcatggatagactgc

SEQ ID NO: 8263155 - DNA, 22 bp, Homo sapiens
agccacagggggtgagggacaa

SEQ ID NO: 8263156 - DNA, 22 bp, Homo sapiens
agcagcagtcctttgtgtaatt

SEQ ID NO: 8263157 - DNA, 22 bp, Homo sapiens
agcagcagtgtgtggtcatgtt

SEQ ID NO: 8263158 - DNA, 22 bp, Homo sapiens
agcagcaggtgcttctggatct

SEQ ID NO: 8263159 - DNA, 22 bp, Homo sapiens
agcagcagtcatgcctatgctc

SEQ ID NO: 8263160 - DNA, 22 bp, Homo sapiens
agcagcagtacatataagacta

SEQ ID NO: 8263161 - DNA, 22 bp, Homo sapiens
acacatatctaagatagatgac

SEQ ID NO: 8263162 - DNA, 23 bp, Homo sapiens
acacatatattcagatacagatg

SEQ ID NO: 8263163 - DNA, 22 bp, Homo sapiens
acacatatatttgcatatacac

SEQ ID NO: 8263164 - DNA, 22 bp, Homo sapiens
agcacctgcacagtggaggaaa

SEQ ID NO: 8263165 - DNA, 22 bp, Homo sapiens
acacaggaggaggatggtggtc

SEQ ID NO: 8263166 - DNA, 22 bp, Homo sapiens
acaatttctgatcagtgaattt

SEQ ID NO: 8263167 - DNA, 22 bp, Homo sapiens
acacaggaactctgagaggtgg

SEQ ID NO: 8263168 - DNA, 22 bp, Homo sapiens
agccatggcgccactagaggga

SEQ ID NO: 8263169 - DNA, 22 bp, Homo sapiens
agccatggtctcagggccataa

SEQ ID NO: 8263170 - DNA, 22 bp, Homo sapiens
agccacaggtgttggccagtgt

SEQ ID NO: 8263171 - DNA, 22 bp, Homo sapiens
agccacagtcaacctgtccata

SEQ ID NO: 8263172 - DNA, 22 bp, Homo sapiens
agcccagctcctccacagaata

SEQ ID NO: 8263173 - DNA, 18 bp, Homo sapiens
agcccagcggagtgaatc

SEQ ID NO: 8263174 - DNA, 22 bp, Homo sapiens
agcccagctgcctgcctgctgt

SEQ ID NO: 8263175 - DNA, 22 bp, Homo sapiens
agcccagcctgattctacaccc

SEQ ID NO: 8263176 - DNA, 22 bp, Homo sapiens
agcccagctttcacccctctgg

SEQ ID NO: 8263177 - DNA, 22 bp, Homo sapiens
agcccagcttccttctgtctct

SEQ ID NO: 8263178 - DNA, 19 bp, Homo sapiens
agcccagcttatttgtcag

SEQ ID NO: 8263179 - DNA, 17 bp, Homo sapiens
acagagcacatcaagat

SEQ ID NO: 8263180 - DNA, 22 bp, Homo sapiens
acagagcaggtccagaagtgcc

SEQ ID NO: 8263181 - DNA, 21 bp, Homo sapiens
acagagcataatggtgtggca

SEQ ID NO: 8263182 - DNA, 22 bp, Homo sapiens
acagagcataatgtctagcaca

SEQ ID NO: 8263183 - DNA, 22 bp, Homo sapiens
acagagcagttctggagctggc

SEQ ID NO: 8263184 - DNA, 22 bp, Homo sapiens
agcccctctgtggctctgcctc

SEQ ID NO: 8263185 - DNA, 22 bp, Homo sapiens
acagagttgtgtttgtacaacg

SEQ ID NO: 8263186 - DNA, 22 bp, Homo sapiens
acagagtttatgtgtgtacaaa

SEQ ID NO: 8263187 - DNA, 22 bp, Homo sapiens
agctcctgttctgagagcagga

SEQ ID NO: 8263188 - DNA, 18 bp, Homo sapiens
agctctggggagatgggc

SEQ ID NO: 8263189 - DNA, 22 bp, Homo sapiens
agctctcccaccttcttcttac

SEQ ID NO: 8263190 - DNA, 21 bp, Homo sapiens
caaaaggataggaaattaggg

SEQ ID NO: 8263191 - DNA, 22 bp, Homo sapiens
atttgttaattatgaggcatac

SEQ ID NO: 8263192 - DNA, 22 bp, Homo sapiens
atttgttcacaatcagggcagg

SEQ ID NO: 8263193 - DNA, 22 bp, Homo sapiens
atttgttcacaatcagggcagg

SEQ ID NO: 8263194 - DNA, 22 bp, Homo sapiens
atttgttccatgagtaaggcta

SEQ ID NO: 8263195 - DNA, 22 bp, Homo sapiens
atttgttccatgagtaaggcta

SEQ ID NO: 8263196 - DNA, 22 bp, Homo sapiens
agagttggcccacgtgtaggcg

SEQ ID NO: 8263197 - DNA, 22 bp, Homo sapiens
attgcatgacatatccacttgt

SEQ ID NO: 8263198 - DNA, 22 bp, Homo sapiens
attgcatgccacttgtgttggt

SEQ ID NO: 8263199 - DNA, 22 bp, Homo sapiens
agagggaaatccaggagtgctt

SEQ ID NO: 8263200 - DNA, 22 bp, Homo sapiens
attccagagaggttctggaggt

SEQ ID NO: 8263201 - DNA, 22 bp, Homo sapiens
agaggcctttctgttgagtgaa

SEQ ID NO: 8263202 - DNA, 17 bp, Homo sapiens
agaggcagatacttgga

SEQ ID NO: 8263203 - DNA, 22 bp, Homo sapiens
agaggcagaagtgttcaaaccc

SEQ ID NO: 8263204 - DNA, 22 bp, Homo sapiens
agaggcagcagtcatactacag

SEQ ID NO: 8263205 - DNA, 22 bp, Homo sapiens
agaggcaggaagagctgatttt

SEQ ID NO: 8263206 - DNA, 22 bp, Homo sapiens
agaggcagccgtatttcaaagg

SEQ ID NO: 8263207 - DNA, 22 bp, Homo sapiens
agaggcaggaggttgacttgag

SEQ ID NO: 8263208 - DNA, 22 bp, Homo sapiens
agaggaggctctgggatcgtcc

SEQ ID NO: 8263209 - DNA, 22 bp, Homo sapiens
agaggaggccaggcccacacct

SEQ ID NO: 8263210 - DNA, 22 bp, Homo sapiens
agaggaggcagcttaactcagt

SEQ ID NO: 8263211 - DNA, 22 bp, Homo sapiens
agaggaggaagagctttaaaat

SEQ ID NO: 8263212 - DNA, 22 bp, Homo sapiens
agaggaggatttgtaaaggtct

SEQ ID NO: 8263213 - DNA, 20 bp, Homo sapiens
agaggaggattattttattc

SEQ ID NO: 8263214 - DNA, 22 bp, Homo sapiens
agaggagcctcagtttgcagcc

SEQ ID NO: 8263215 - DNA, 22 bp, Homo sapiens
agaggagctgggaggccctcgt

SEQ ID NO: 8263216 - DNA, 21 bp, Homo sapiens
agagctggtaggtaggtaggt

SEQ ID NO: 8263217 - DNA, 22 bp, Homo sapiens
agacagcagaaactagagcact

SEQ ID NO: 8263218 - DNA, 22 bp, Homo sapiens
agacagctaataaatgagtgtg

SEQ ID NO: 8263219 - DNA, 22 bp, Homo sapiens
agacaaagaaaccgtagaagca

SEQ ID NO: 8263220 - DNA, 22 bp, Homo sapiens
agaagtggtgtgtggccgagct

SEQ ID NO: 8263221 - DNA, 22 bp, Homo sapiens
atctcaggaggaccctgatgct

SEQ ID NO: 8263222 - DNA, 23 bp, Homo sapiens
agaagtggaatggccgtggggtc

SEQ ID NO: 8263223 - DNA, 22 bp, Homo sapiens
agagccacggcaggcctaggaa

SEQ ID NO: 8263224 - DNA, 22 bp, Homo sapiens
agagccactgggagacagagca

SEQ ID NO: 8263225 - DNA, 22 bp, Homo sapiens
atgggtggagggtgacacggat

SEQ ID NO: 8263226 - DNA, 22 bp, Homo sapiens
agagatggagagcactggggct

SEQ ID NO: 8263227 - DNA, 22 bp, Homo sapiens
atgggggcggctgaagcccagg

SEQ ID NO: 8263228 - DNA, 22 bp, Homo sapiens
agagatggccttaggtgggaat

SEQ ID NO: 8263229 - DNA, 22 bp, Homo sapiens
agagcctggtctgagataggac

SEQ ID NO: 8263230 - DNA, 22 bp, Homo sapiens
atgtatttgcgtatggacatac

SEQ ID NO: 8263231 - DNA, 22 bp, Homo sapiens
atgtatttgcttgttatggatt

SEQ ID NO: 8263232 - DNA, 22 bp, Homo sapiens
atgtatttgcgaggttaggaaa

SEQ ID NO: 8263233 - DNA, 22 bp, Homo sapiens
atgtatttgaaatttgagacat

SEQ ID NO: 8263234 - DNA, 22 bp, Homo sapiens
agagcctgcagtggagaccttg

SEQ ID NO: 8263235 - DNA, 22 bp, Homo sapiens
atgtattttaagatttgcctca

SEQ ID NO: 8263236 - DNA, 22 bp, Homo sapiens
atgtattttgccagactgtctc

SEQ ID NO: 8263237 - DNA, 23 bp, Homo sapiens
agacccagagactggctctgctc

SEQ ID NO: 8263238 - DNA, 22 bp, Homo sapiens
cagagggagccctccaggagca

SEQ ID NO: 8263239 - DNA, 22 bp, Homo sapiens
cagacttttgacattaatacag

SEQ ID NO: 8263240 - DNA, 22 bp, Homo sapiens
agcccagcagaaagtccagcct

SEQ ID NO: 8263241 - DNA, 22 bp, Homo sapiens
agcccagcaaagggaggttcag

SEQ ID NO: 8263242 - DNA, 22 bp, Homo sapiens
agcccagcactgggggcccagc

SEQ ID NO: 8263243 - DNA, 22 bp, Homo sapiens
agcccagcaaaggggtttgaga

SEQ ID NO: 8263244 - DNA, 22 bp, Homo sapiens
agcccagcccgggctgcgcttt

SEQ ID NO: 8263245 - DNA, 22 bp, Homo sapiens
agcccagcagtaagattagaga

SEQ ID NO: 8263246 - DNA, 22 bp, Homo sapiens
agcccagccactattaaatgtt

SEQ ID NO: 8263247 - DNA, 22 bp, Homo sapiens
agccactgtgtgaccagctgtc

SEQ ID NO: 8263248 - DNA, 22 bp, Homo sapiens
agccagagaacagcaggaaatg

SEQ ID NO: 8263249 - DNA, 22 bp, Homo sapiens
agccagagactttacctgtgca

SEQ ID NO: 8263250 - DNA, 22 bp, Homo sapiens
agccagagagccccaggttcta

SEQ ID NO: 8263251 - DNA, 22 bp, Homo sapiens
agccacaggaaacagagacagc

SEQ ID NO: 8263252 - DNA, 22 bp, Homo sapiens
agccacagtctgtagccagctt

SEQ ID NO: 8263253 - DNA, 22 bp, Homo sapiens
agcatataaatggacatatttg

SEQ ID NO: 8263254 - DNA, 22 bp, Homo sapiens
agcatatacaaactcatataca

SEQ ID NO: 8263255 - DNA, 22 bp, Homo sapiens
agccactggtaaactggtagga

SEQ ID NO: 8263256 - DNA, 22 bp, Homo sapiens
cagcagttatgagtagaatagt

SEQ ID NO: 8263257 - DNA, 22 bp, Homo sapiens
cagcagtgtgcaggtgtgctgg

SEQ ID NO: 8263258 - DNA, 22 bp, Homo sapiens
cagcagttttgaagtgtggaga

SEQ ID NO: 8263259 - DNA, 22 bp, Homo sapiens
cagcagttgtttcggattggga

SEQ ID NO: 8263260 - DNA, 16 bp, Homo sapiens
cagccctgaggaagaa

SEQ ID NO: 8263261 - DNA, 22 bp, Homo sapiens
cagccctgagaaggaggatctc

SEQ ID NO: 8263262 - DNA, 23 bp, Homo sapiens
cagccctgaaatcgaggtgacac

SEQ ID NO: 8263263 - DNA, 22 bp, Homo sapiens
cagccccagcacttagctgagt

SEQ ID NO: 8263264 - DNA, 22 bp, Homo sapiens
cagctctgagactgaggctatg

SEQ ID NO: 8263265 - DNA, 22 bp, Homo sapiens
agctcctgatacatgcaggaat

SEQ ID NO: 8263266 - DNA, 22 bp, Homo sapiens
agctcctgatacatgcaggaat

SEQ ID NO: 8263267 - DNA, 22 bp, Homo sapiens
cagctcagtcttgaagcactgg

SEQ ID NO: 8263268 - DNA, 22 bp, Homo sapiens
cagctcattcctcaatctagga

SEQ ID NO: 8263269 - DNA, 22 bp, Homo sapiens
cagctccaaagccccactgtcc

SEQ ID NO: 8263270 - DNA, 22 bp, Homo sapiens
agctcagagggaggtgaagtgg

SEQ ID NO: 8263271 - DNA, 19 bp, Homo sapiens
cagctcaggactcagcccc

SEQ ID NO: 8263272 - DNA, 22 bp, Homo sapiens
cagctcagtctggagagatgca

SEQ ID NO: 8263273 - DNA, 22 bp, Homo sapiens
agcctctgtgactcacaggtca

SEQ ID NO: 8263274 - DNA, 22 bp, Homo sapiens
agcctctgtagaaagcagtgtg

SEQ ID NO: 8263275 - DNA, 22 bp, Homo sapiens
agcctctgggggagctgggagc

SEQ ID NO: 8263276 - DNA, 22 bp, Homo sapiens
cagaggtccctatttctttgtt

SEQ ID NO: 8263277 - DNA, 22 bp, Homo sapiens
cagcagctgactccaagagagc

SEQ ID NO: 8263278 - DNA, 22 bp, Homo sapiens
cagcagctcagtctctcagtag

SEQ ID NO: 8263279 - DNA, 22 bp, Homo sapiens
cagcagctcactcaggtggctc

SEQ ID NO: 8263280 - DNA, 22 bp, Homo sapiens
agcctgagagccaagctgtgca

SEQ ID NO: 8263281 - DNA, 22 bp, Homo sapiens
cagcagctgaggcgctggcgtg

SEQ ID NO: 8263282 - DNA, 22 bp, Homo sapiens
cagcagggcccccgggtgcgcc

SEQ ID NO: 8263283 - DNA, 23 bp, Homo sapiens
agcagcaggaggtattgataagg

SEQ ID NO: 8263284 - DNA, 22 bp, Homo sapiens
agcagcaggattttcgttggga

SEQ ID NO: 8263285 - DNA, 22 bp, Homo sapiens
agcagcaggctagggaactgct

SEQ ID NO: 8263286 - DNA, 22 bp, Homo sapiens
agcagcaggctgtgtggactga

SEQ ID NO: 8263287 - DNA, 22 bp, Homo sapiens
agcagcaggctgggatgagtct

SEQ ID NO: 8263288 - DNA, 20 bp, Homo sapiens
agcagcagatgttggaggtg

SEQ ID NO: 8263289 - DNA, 22 bp, Homo sapiens
agcagcaggagccgtggggtga

SEQ ID NO: 8263290 - DNA, 22 bp, Homo sapiens
caagagctaccctgtgccatat

SEQ ID NO: 8263291 - DNA, 22 bp, Homo sapiens
agcagcagggacaaaggaacag

SEQ ID NO: 8263292 - DNA, 21 bp, Homo sapiens
agcagcagggaagcctcatcc

SEQ ID NO: 8263293 - DNA, 22 bp, Homo sapiens
cacaagagagtgcgcgttgcaa

SEQ ID NO: 8263294 - DNA, 22 bp, Homo sapiens
agcagccaattggaggatgaag

SEQ ID NO: 8263295 - DNA, 22 bp, Homo sapiens
agcagctcctctaggaacggat

SEQ ID NO: 8263296 - DNA, 22 bp, Homo sapiens
agcagctccctcctcagccacc

SEQ ID NO: 8263297 - DNA, 22 bp, Homo sapiens
cacaagctgggcaagtgtatat

SEQ ID NO: 8263298 - DNA, 22 bp, Homo sapiens
cacaagctccttatgtggagaa

SEQ ID NO: 8263299 - DNA, 22 bp, Homo sapiens
cacaagatggtcacataagtgc

SEQ ID NO: 8263300 - DNA, 22 bp, Homo sapiens
caacagaaggtgtactactgaa

SEQ ID NO: 8263301 - DNA, 22 bp, Homo sapiens
caaatagattgttcaatcctga

SEQ ID NO: 8263302 - DNA, 22 bp, Homo sapiens
agcagggctggggcacgagcca

SEQ ID NO: 8263303 - DNA, 22 bp, Homo sapiens
cacctctgctgtccacaggatg

SEQ ID NO: 8263304 - DNA, 22 bp, Homo sapiens
agcaggagtgtcccctggctgt

SEQ ID NO: 8263305 - DNA, 22 bp, Homo sapiens
agcaggagtgtcccctggctgt

SEQ ID NO: 8263306 - DNA, 22 bp, Homo sapiens
agcaggagcatttccatgattc

SEQ ID NO: 8263307 - DNA, 22 bp, Homo sapiens
agcaggcacaagaaagggaggt

SEQ ID NO: 8263308 - DNA, 22 bp, Homo sapiens
agcaggcaggaaggcagcactg

SEQ ID NO: 8263309 - DNA, 17 bp, Homo sapiens
agcaggctgcagaggcc

SEQ ID NO: 8263310 - DNA, 22 bp, Homo sapiens
actttcacatgtgtgcagacag

SEQ ID NO: 8263311 - DNA, 22 bp, Homo sapiens
actttcaattcccttagcaact

SEQ ID NO: 8263312 - DNA, 22 bp, Homo sapiens
actttcaagcaagaacactttg

SEQ ID NO: 8263313 - DNA, 22 bp, Homo sapiens
atatggaatggtaatctacaat

SEQ ID NO: 8263314 - DNA, 22 bp, Homo sapiens
atattcttccaaaacatcattt

SEQ ID NO: 8263315 - DNA, 22 bp, Homo sapiens
actgtgcatttgtcatggggtt

SEQ ID NO: 8263316 - DNA, 22 bp, Homo sapiens
actgtgcatttgaagggatcat

SEQ ID NO: 8263317 - DNA, 22 bp, Homo sapiens
actgtgcaggggaagagagaaa

SEQ ID NO: 8263318 - DNA, 21 bp, Homo sapiens
actgtgcagcctgaggatgtg

SEQ ID NO: 8263319 - DNA, 22 bp, Homo sapiens
ataatgagcttttgaatactga

SEQ ID NO: 8263320 - DNA, 22 bp, Homo sapiens
ataatctggtctttgtatgagt

SEQ ID NO: 8263321 - DNA, 22 bp, Homo sapiens
actgtcactccaactgagtcgt

SEQ ID NO: 8263322 - DNA, 22 bp, Homo sapiens
actgtcaagagattcaaattca

SEQ ID NO: 8263323 - DNA, 22 bp, Homo sapiens
actgtcacttgcaactgtgagg

SEQ ID NO: 8263324 - DNA, 22 bp, Homo sapiens
actgtcaaatgcaatgaactca

SEQ ID NO: 8263325 - DNA, 22 bp, Homo sapiens
atacattagctcatatgattaa

SEQ ID NO: 8263326 - DNA, 22 bp, Homo sapiens
atacatctatgcctttctgaca

SEQ ID NO: 8263327 - DNA, 22 bp, Homo sapiens
agtctgtcagtcattctaacaa

SEQ ID NO: 8263328 - DNA, 22 bp, Homo sapiens
actctgtgtgagtagagcctgt

SEQ ID NO: 8263329 - DNA, 22 bp, Homo sapiens
agtgcaggttaaggaactggcc

SEQ ID NO: 8263330 - DNA, 22 bp, Homo sapiens
agtgcagggggaaagggtgtct

SEQ ID NO: 8263331 - DNA, 22 bp, Homo sapiens
agtggcagggctggctgctgca

SEQ ID NO: 8263332 - DNA, 22 bp, Homo sapiens
agtggcagtagatgagctggtt

SEQ ID NO: 8263333 - DNA, 22 bp, Homo sapiens
aggtctcaattcctgctcctgt

SEQ ID NO: 8263334 - DNA, 22 bp, Homo sapiens
aggtctcaaactggcaccctgt

SEQ ID NO: 8263335 - DNA, 22 bp, Homo sapiens
aggtccagttgccagaatggcc

SEQ ID NO: 8263336 - DNA, 19 bp, Homo sapiens
aggtggccatgtccagcct

SEQ ID NO: 8263337 - DNA, 22 bp, Homo sapiens
aggtggcatgcctgagacataa

SEQ ID NO: 8263338 - DNA, 22 bp, Homo sapiens
aggtggccggtgccagccgggc

SEQ ID NO: 8263339 - DNA, 22 bp, Homo sapiens
aggtccagttgccagaatggcc

SEQ ID NO: 8263340 - DNA, 19 bp, Homo sapiens
actcaggcaatgagaaaca

SEQ ID NO: 8263341 - DNA, 21 bp, Homo sapiens
actcaggcaccaggggatggc

SEQ ID NO: 8263342 - DNA, 22 bp, Homo sapiens
actcaggcactcagccctcgcc

SEQ ID NO: 8263343 - DNA, 22 bp, Homo sapiens
actcaggctacaggggcagaag

SEQ ID NO: 8263344 - DNA, 22 bp, Homo sapiens
actcaggctagggaaaaagtgg

SEQ ID NO: 8263345 - DNA, 22 bp, Homo sapiens
actcaggctacaacgcgtggct

SEQ ID NO: 8263346 - DNA, 22 bp, Homo sapiens
actcaggccccatcgcccatct

SEQ ID NO: 8263347 - DNA, 22 bp, Homo sapiens
actcaggcctccttctgtcctt

SEQ ID NO: 8263348 - DNA, 22 bp, Homo sapiens
actcaggctgttttttccttgt

SEQ ID NO: 8263349 - DNA, 22 bp, Homo sapiens
actcaggcttcaggcacagctg

SEQ ID NO: 8263350 - DNA, 22 bp, Homo sapiens
accctcagtaatcgtgcagttt

SEQ ID NO: 8263351 - DNA, 22 bp, Homo sapiens
agggggctcagcatggatggag

SEQ ID NO: 8263352 - DNA, 22 bp, Homo sapiens
agggggcatcaggtcctggctc

SEQ ID NO: 8263353 - DNA, 22 bp, Homo sapiens
agggggcatcaggtcctggctc

SEQ ID NO: 8263354 - DNA, 22 bp, Homo sapiens
agggggcaggagagacctgctg

SEQ ID NO: 8263355 - DNA, 22 bp, Homo sapiens
agggggaggctgtgctgcgtct

SEQ ID NO: 8263356 - DNA, 22 bp, Homo sapiens
acccagcatgacacctgcacat

SEQ ID NO: 8263357 - DNA, 22 bp, Homo sapiens
acccagcaaagataaacttatg

SEQ ID NO: 8263358 - DNA, 22 bp, Homo sapiens
acccagccatgttcagttctct

SEQ ID NO: 8263359 - DNA, 22 bp, Homo sapiens
accaggcctggctgggcagcca

SEQ ID NO: 8263360 - DNA, 18 bp, Homo sapiens
agggagagaccgcgggtc

SEQ ID NO: 8263361 - DNA, 22 bp, Homo sapiens
agggcagcagcccatggctctg

SEQ ID NO: 8263362 - DNA, 19 bp, Homo sapiens
accaggcctcagaggccct

SEQ ID NO: 8263363 - DNA, 22 bp, Homo sapiens
agggcagcaatgcagctgctgc

SEQ ID NO: 8263364 - DNA, 22 bp, Homo sapiens
accagcagagttgaggaggaca

SEQ ID NO: 8263365 - DNA, 22 bp, Homo sapiens
accagcagcctagagcgttctt

SEQ ID NO: 8263366 - DNA, 22 bp, Homo sapiens
accagcagctgccagagtggag

SEQ ID NO: 8263367 - DNA, 21 bp, Homo sapiens
accagcaggagatcagaagga

SEQ ID NO: 8263368 - DNA, 22 bp, Homo sapiens
accagcagctgcgggccactgc

SEQ ID NO: 8263369 - DNA, 22 bp, Homo sapiens
accagcagttatgaggccagga

SEQ ID NO: 8263370 - DNA, 22 bp, Homo sapiens
accagcaggtggcagtatgtat

SEQ ID NO: 8263371 - DNA, 22 bp, Homo sapiens
accagcagggctgggccaatgg

SEQ ID NO: 8263372 - DNA, 22 bp, Homo sapiens
accagcaggccaggggcactgc

SEQ ID NO: 8263373 - DNA, 22 bp, Homo sapiens
accagccagccacagtggctcc

SEQ ID NO: 8263374 - DNA, 22 bp, Homo sapiens
accagccaccaccaggagatcg

SEQ ID NO: 8263375 - DNA, 22 bp, Homo sapiens
acatttctttgctagacagcag

SEQ ID NO: 8263376 - DNA, 22 bp, Homo sapiens
aggcctgcccgtgggacctgtg

SEQ ID NO: 8263377 - DNA, 22 bp, Homo sapiens
aggctctgttattctagagggc

SEQ ID NO: 8263378 - DNA, 22 bp, Homo sapiens
acatttcctaacgtatacactg

SEQ ID NO: 8263379 - DNA, 17 bp, Homo sapiens
acatttcctaactgaag

SEQ ID NO: 8263380 - DNA, 22 bp, Homo sapiens
acatttctatagtgcatctgtt

SEQ ID NO: 8263381 - DNA, 22 bp, Homo sapiens
acatccagatctcagcatggct

SEQ ID NO: 8263382 - DNA, 22 bp, Homo sapiens
aggcctgaggaccttctggagg

SEQ ID NO: 8263383 - DNA, 22 bp, Homo sapiens
aggcctctgttccccatgtttt

SEQ ID NO: 8263384 - DNA, 22 bp, Homo sapiens
acaggagttaaccatgggaagt

SEQ ID NO: 8263385 - DNA, 22 bp, Homo sapiens
acaggagttaaggctgagttga

SEQ ID NO: 8263386 - DNA, 22 bp, Homo sapiens
acaggagttcagaggacacccc

SEQ ID NO: 8263387 - DNA, 22 bp, Homo sapiens
acaggagtttaagaaatatttc

SEQ ID NO: 8263388 - DNA, 22 bp, Homo sapiens
acaggagtttctgacagagaca

SEQ ID NO: 8263389 - DNA, 22 bp, Homo sapiens
acaggagtggagaggtgcctct

SEQ ID NO: 8263390 - DNA, 22 bp, Homo sapiens
acaggagtggctctaccagacc

SEQ ID NO: 8263391 - DNA, 22 bp, Homo sapiens
acaggagtagggctggtggaga

SEQ ID NO: 8263392 - DNA, 22 bp, Homo sapiens
acaggagtgaatctggcactta

SEQ ID NO: 8263393 - DNA, 22 bp, Homo sapiens
acaggaggggcatgaaagacgg

SEQ ID NO: 8263394 - DNA, 22 bp, Homo sapiens
acaggagaattatctggaacaa

SEQ ID NO: 8263395 - DNA, 22 bp, Homo sapiens
agctctggttattgaagcaggg

SEQ ID NO: 8263396 - DNA, 22 bp, Homo sapiens
acagctgccaagacagagcagg

SEQ ID NO: 8263397 - DNA, 22 bp, Homo sapiens
acagctgtatccccagagctca

SEQ ID NO: 8263398 - DNA, 22 bp, Homo sapiens
acagggagccccagcatttcca

SEQ ID NO: 8263399 - DNA, 22 bp, Homo sapiens
acaggggcaagggctcacggcc

SEQ ID NO: 8263400 - DNA, 22 bp, Homo sapiens
acaggggcaggcaggacccttt

SEQ ID NO: 8263401 - DNA, 19 bp, Homo sapiens
acaggggcctttccagggt

SEQ ID NO: 8263402 - DNA, 22 bp, Homo sapiens
acaggggacctaggaccctcgg

SEQ ID NO: 8263403 - DNA, 19 bp, Homo sapiens
acaggggctagcggaagca

SEQ ID NO: 8263404 - DNA, 22 bp, Homo sapiens
acaggcagattaagggtaggca

SEQ ID NO: 8263405 - DNA, 22 bp, Homo sapiens
acaggcaggcttcggccagagc

SEQ ID NO: 8263406 - DNA, 22 bp, Homo sapiens
acagggaaggatttagtgggaa

SEQ ID NO: 8263407 - DNA, 19 bp, Homo sapiens
acagtgtctgtatataaat

SEQ ID NO: 8263408 - DNA, 22 bp, Homo sapiens
acagtgtctgacacattgtagc

SEQ ID NO: 8263409 - DNA, 22 bp, Homo sapiens
acagtgtctcctggtacccagt

SEQ ID NO: 8263410 - DNA, 23 bp, Homo sapiens
acagtgtctgctgcaagatatct

SEQ ID NO: 8263411 - DNA, 22 bp, Homo sapiens
acagtgtctgacacgtaggaag

SEQ ID NO: 8263412 - DNA, 22 bp, Homo sapiens
acagtgtctcactgctgaaatc

SEQ ID NO: 8263413 - DNA, 22 bp, Homo sapiens
acagtctaggcctaggtcaaaa

SEQ ID NO: 8263414 - DNA, 22 bp, Homo sapiens
acagtctacttgagcttgtata

SEQ ID NO: 8263415 - DNA, 22 bp, Homo sapiens
acagtctctccacactgcaggg

SEQ ID NO: 8263416 - DNA, 22 bp, Homo sapiens
acagtctactaaacatcatcag

SEQ ID NO: 8263417 - DNA, 22 bp, Homo sapiens
acagtctacaaagtgatgtgtg

SEQ ID NO: 8263418 - DNA, 22 bp, Homo sapiens
acagtctaatcttgtgttctgt

SEQ ID NO: 8263419 - DNA, 22 bp, Homo sapiens
acagtatttgcgatactgatga

SEQ ID NO: 8263420 - DNA, 22 bp, Homo sapiens
aggagatggagctcagtgggca

SEQ ID NO: 8263421 - DNA, 22 bp, Homo sapiens
aggagatggagctcagtgggca

SEQ ID NO: 8263422 - DNA, 22 bp, Homo sapiens
aggagcaccattgtgctggtgt

SEQ ID NO: 8263423 - DNA, 22 bp, Homo sapiens
aggagcactaattcctgcagag

SEQ ID NO: 8263424 - DNA, 22 bp, Homo sapiens
aggcactgggggatgagcaagg

SEQ ID NO: 8263425 - DNA, 22 bp, Homo sapiens
aggatgaggctggacacttctt

SEQ ID NO: 8263426 - DNA, 22 bp, Homo sapiens
aggatgagattccagggtcaat

SEQ ID NO: 8263427 - DNA, 19 bp, Homo sapiens
aggatggagcaggcggtga

SEQ ID NO: 8263428 - DNA, 22 bp, Homo sapiens
aggatggattctgtatgtggga

SEQ ID NO: 8263429 - DNA, 21 bp, Homo sapiens
aggcagctcaggcccagagag

SEQ ID NO: 8263430 - DNA, 22 bp, Homo sapiens
aggcagctgaggtctggcgccc

SEQ ID NO: 8263431 - DNA, 21 bp, Homo sapiens
aggcagctggaaggcctggct

SEQ ID NO: 8263432 - DNA, 22 bp, Homo sapiens
aggcagcagggccactggctga

SEQ ID NO: 8263433 - DNA, 22 bp, Homo sapiens
ccaaaggccaggcactgaggtt

SEQ ID NO: 8263434 - DNA, 16 bp, Homo sapiens
ccaagcagcagcagct

SEQ ID NO: 8263435 - DNA, 22 bp, Homo sapiens
ccaagggctgctgaggtgtcca

SEQ ID NO: 8263436 - DNA, 22 bp, Homo sapiens
catttgttgggacaatgaaaag

SEQ ID NO: 8263437 - DNA, 22 bp, Homo sapiens
catttgttgggacaatgaaaag

SEQ ID NO: 8263438 - DNA, 17 bp, Homo sapiens
catttgttgatcagttg

SEQ ID NO: 8263439 - DNA, 17 bp, Homo sapiens
catttgttgatcagttg

SEQ ID NO: 8263440 - DNA, 22 bp, Homo sapiens
catttgttggttgctgtcttat

SEQ ID NO: 8263441 - DNA, 22 bp, Homo sapiens
catttgttggtcagattgtagt

SEQ ID NO: 8263442 - DNA, 22 bp, Homo sapiens
catttgtttagaagtctttata

SEQ ID NO: 8263443 - DNA, 22 bp, Homo sapiens
catttgtttataagttccccag

SEQ ID NO: 8263444 - DNA, 22 bp, Homo sapiens
catttgttaagaaggaaaaagg

SEQ ID NO: 8263445 - DNA, 22 bp, Homo sapiens
catttgttaaccagtgtggatt

SEQ ID NO: 8263446 - DNA, 22 bp, Homo sapiens
catttgttaatgctgcttttaa

SEQ ID NO: 8263447 - DNA, 20 bp, Homo sapiens
catttgttagctttctactg

SEQ ID NO: 8263448 - DNA, 22 bp, Homo sapiens
catttgttaattactattatct

SEQ ID NO: 8263449 - DNA, 18 bp, Homo sapiens
catttgttattgtgtgtg

SEQ ID NO: 8263450 - DNA, 22 bp, Homo sapiens
catttgttcaaccattctcgct

SEQ ID NO: 8263451 - DNA, 22 bp, Homo sapiens
catttgttctgatttcaaaagg

SEQ ID NO: 8263452 - DNA, 22 bp, Homo sapiens
aggaggggcaatgatagtctgg

SEQ ID NO: 8263453 - DNA, 20 bp, Homo sapiens
aggaggggatagaatcaaag

SEQ ID NO: 8263454 - DNA, 16 bp, Homo sapiens
aggaggggaattagga

SEQ ID NO: 8263455 - DNA, 22 bp, Homo sapiens
catggacagtgggacagtgtgt

SEQ ID NO: 8263456 - DNA, 22 bp, Homo sapiens
catggggcccatgtgctccaag

SEQ ID NO: 8263457 - DNA, 22 bp, Homo sapiens
aggaccagcctccaggtctctt

SEQ ID NO: 8263458 - DNA, 22 bp, Homo sapiens
caggtgggagcgaggagctact

SEQ ID NO: 8263459 - DNA, 22 bp, Homo sapiens
aggacaggattgagctgaactg

SEQ ID NO: 8263460 - DNA, 22 bp, Homo sapiens
aggagaagtaaggctagatgat

SEQ ID NO: 8263461 - DNA, 20 bp, Homo sapiens
cagtgcccgtggaaaagatg

SEQ ID NO: 8263462 - DNA, 19 bp, Homo sapiens
cagtgcccgacgcaggtct

SEQ ID NO: 8263463 - DNA, 22 bp, Homo sapiens
cagtttctctcaataagcatcg

SEQ ID NO: 8263464 - DNA, 22 bp, Homo sapiens
cagtggttatacttactgtttc

SEQ ID NO: 8263465 - DNA, 18 bp, Homo sapiens
cagtggtgctgggatgtg

SEQ ID NO: 8263466 - DNA, 22 bp, Homo sapiens
cagtggtacttatatgaagcat

SEQ ID NO: 8263467 - DNA, 22 bp, Homo sapiens
cagtggtactctcagatgttta

SEQ ID NO: 8263468 - DNA, 22 bp, Homo sapiens
cagtggtagaagccaagtagat

SEQ ID NO: 8263469 - DNA, 22 bp, Homo sapiens
cagtggtatttgagagaatgga

SEQ ID NO: 8263470 - DNA, 23 bp, Homo sapiens
cagtggtcagaacgtgggagggt

SEQ ID NO: 8263471 - DNA, 23 bp, Homo sapiens
cagtggtcagaacgtgggagggt

SEQ ID NO: 8263472 - DNA, 22 bp, Homo sapiens
aggagggagcttaagccaggca

SEQ ID NO: 8263473 - DNA, 22 bp, Homo sapiens
aggagggagcactatatgggga

SEQ ID NO: 8263474 - DNA, 22 bp, Homo sapiens
catattctgttggtcacataga

SEQ ID NO: 8263475 - DNA, 22 bp, Homo sapiens
cataggtcactgtacaggttaa

SEQ ID NO: 8263476 - DNA, 22 bp, Homo sapiens
caggggctgtgggcggagcctc

SEQ ID NO: 8263477 - DNA, 23 bp, Homo sapiens
cagggccaggcagcagctgtcac

SEQ ID NO: 8263478 - DNA, 22 bp, Homo sapiens
cagggcctctcctccaggaact

SEQ ID NO: 8263479 - DNA, 22 bp, Homo sapiens
caggctcactgtaaggtcagct

SEQ ID NO: 8263480 - DNA, 22 bp, Homo sapiens
agctggggcatttatccactaa

SEQ ID NO: 8263481 - DNA, 22 bp, Homo sapiens
agctgtggaaatcaggcaatga

SEQ ID NO: 8263482 - DNA, 19 bp, Homo sapiens
agctgtggatgtgggattt

SEQ ID NO: 8263483 - DNA, 22 bp, Homo sapiens
agctgtggagtagggggttgga

SEQ ID NO: 8263484 - DNA, 22 bp, Homo sapiens
caggctggacattagatacata

SEQ ID NO: 8263485 - DNA, 22 bp, Homo sapiens
caggagccccaggctgacaata

SEQ ID NO: 8263486 - DNA, 22 bp, Homo sapiens
caggaggagcattagcgtctca

SEQ ID NO: 8263487 - DNA, 22 bp, Homo sapiens
caggaggagcattagcgtctca

SEQ ID NO: 8263488 - DNA, 22 bp, Homo sapiens
caggaggacatactggctcaca

SEQ ID NO: 8263489 - DNA, 22 bp, Homo sapiens
caggaggattgcttgaggccag

SEQ ID NO: 8263490 - DNA, 22 bp, Homo sapiens
agctgctgagccatgtcctgct

SEQ ID NO: 8263491 - DNA, 22 bp, Homo sapiens
caggaggagggcagccgcctcc

SEQ ID NO: 8263492 - DNA, 19 bp, Homo sapiens
agctgctggcccagggacc

SEQ ID NO: 8263493 - DNA, 22 bp, Homo sapiens
agctgctgcccataggtgacat

SEQ ID NO: 8263494 - DNA, 22 bp, Homo sapiens
agctgctgcctcactggtctgt

SEQ ID NO: 8263495 - DNA, 22 bp, Homo sapiens
caggcacactgtctacactgag

SEQ ID NO: 8263496 - DNA, 22 bp, Homo sapiens
agctggcccactgtgtggtcca

SEQ ID NO: 8263497 - DNA, 22 bp, Homo sapiens
agctggcccactgtgtggtcca

SEQ ID NO: 8263498 - DNA, 20 bp, Homo sapiens
agctggcccacaggtgtggg

SEQ ID NO: 8263499 - DNA, 22 bp, Homo sapiens
agctggccggcctccaggtgga

SEQ ID NO: 8263500 - DNA, 18 bp, Homo sapiens
agctggccctggctgccg

SEQ ID NO: 8263501 - DNA, 22 bp, Homo sapiens
caggcatagaagggcaagaata

SEQ ID NO: 8263502 - DNA, 22 bp, Homo sapiens
caggccagcagggcctccgtgg

SEQ ID NO: 8263503 - DNA, 22 bp, Homo sapiens
caggccagcttcctgacatcct

SEQ ID NO: 8263504 - DNA, 22 bp, Homo sapiens
caggccagcgtccagaacaagc

SEQ ID NO: 8263505 - DNA, 22 bp, Homo sapiens
agctgggctggagctccaagcg

SEQ ID NO: 8263506 - DNA, 19 bp, Homo sapiens
agctgggcttactcactcg

SEQ ID NO: 8263507 - DNA, 22 bp, Homo sapiens
cagctctggggcagagtgacta

SEQ ID NO: 8263508 - DNA, 22 bp, Homo sapiens
cagctctgggtaggaggaatct

SEQ ID NO: 8263509 - DNA, 20 bp, Homo sapiens
cagctctgggcaggtcgagg

SEQ ID NO: 8263510 - DNA, 22 bp, Homo sapiens
cagctctgggtgacaggagggc

SEQ ID NO: 8263511 - DNA, 22 bp, Homo sapiens
cagctctggttcctgggcccag

SEQ ID NO: 8263512 - DNA, 22 bp, Homo sapiens
cagctctggtccagggagggca

SEQ ID NO: 8263513 - DNA, 22 bp, Homo sapiens
cagctctgtaaattccttcatc

SEQ ID NO: 8263514 - DNA, 22 bp, Homo sapiens
agggcagagatctgagtgggca

SEQ ID NO: 8263515 - DNA, 19 bp, Homo sapiens
ccctcttgcacaaagcaaa

SEQ ID NO: 8263516 - DNA, 22 bp, Homo sapiens
ccctctctctatcgggccccag

SEQ ID NO: 8263517 - DNA, 22 bp, Homo sapiens
agggatgggtctaacccagaac

SEQ ID NO: 8263518 - DNA, 22 bp, Homo sapiens
agggatggcaagttaacctgag

SEQ ID NO: 8263519 - DNA, 22 bp, Homo sapiens
agggatgggaactcctccagca

SEQ ID NO: 8263520 - DNA, 22 bp, Homo sapiens
ccctctgctcaggtgcataggc

SEQ ID NO: 8263521 - DNA, 18 bp, Homo sapiens
ccctcttgcacaaagcaa

SEQ ID NO: 8263522 - DNA, 22 bp, Homo sapiens
agggagaaggtttagctgtgag

SEQ ID NO: 8263523 - DNA, 22 bp, Homo sapiens
agggaggagtcctcaaagtcat

SEQ ID NO: 8263524 - DNA, 22 bp, Homo sapiens
agggagtggttaagaaggtgca

SEQ ID NO: 8263525 - DNA, 22 bp, Homo sapiens
agggagttccgatctgtgcacc

SEQ ID NO: 8263526 - DNA, 22 bp, Homo sapiens
agggagttagtgatgtggtctc

SEQ ID NO: 8263527 - DNA, 22 bp, Homo sapiens
agggagtgttatattccatcag

SEQ ID NO: 8263528 - DNA, 22 bp, Homo sapiens
agggagtgttacataatgggtt

SEQ ID NO: 8263529 - DNA, 22 bp, Homo sapiens
agggatggaagctcgtctgcaa

SEQ ID NO: 8263530 - DNA, 22 bp, Homo sapiens
agggatggaagacttgaagacc

SEQ ID NO: 8263531 - DNA, 22 bp, Homo sapiens
agggatggatcttggccctgga

SEQ ID NO: 8263532 - DNA, 22 bp, Homo sapiens
agggatggatcttggccctgga

SEQ ID NO: 8263533 - DNA, 22 bp, Homo sapiens
agggatggagtgcggcccggac

SEQ ID NO: 8263534 - DNA, 22 bp, Homo sapiens
agggatggagtgcggcccggac

SEQ ID NO: 8263535 - DNA, 22 bp, Homo sapiens
agggatggagcccagctgttct

SEQ ID NO: 8263536 - DNA, 22 bp, Homo sapiens
cccaggggtaaggcgcagcgtg

SEQ ID NO: 8263537 - DNA, 19 bp, Homo sapiens
cccaggggacccagcccta

SEQ ID NO: 8263538 - DNA, 23 bp, Homo sapiens
cccaggagtttcactgcaaaggt

SEQ ID NO: 8263539 - DNA, 17 bp, Homo sapiens
aggggagagtgggaaga

SEQ ID NO: 8263540 - DNA, 22 bp, Homo sapiens
cctgaggacacacgctgcagga

SEQ ID NO: 8263541 - DNA, 21 bp, Homo sapiens
aggggacagagtagctccagg

SEQ ID NO: 8263542 - DNA, 22 bp, Homo sapiens
aggggacacggcttctccaggg

SEQ ID NO: 8263543 - DNA, 22 bp, Homo sapiens
aggggagagaacataaggaagt

SEQ ID NO: 8263544 - DNA, 22 bp, Homo sapiens
cctgaggagattgtggctgggg

SEQ ID NO: 8263545 - DNA, 22 bp, Homo sapiens
cctgaggatgccagcatgggtg

SEQ ID NO: 8263546 - DNA, 22 bp, Homo sapiens
aggggctgggacagagccaagc

SEQ ID NO: 8263547 - DNA, 22 bp, Homo sapiens
aggggctggcttatctgagagt

SEQ ID NO: 8263548 - DNA, 22 bp, Homo sapiens
aggggctgctgggtccgcccct

SEQ ID NO: 8263549 - DNA, 22 bp, Homo sapiens
aggggctgcctggcttggcact

SEQ ID NO: 8263550 - DNA, 22 bp, Homo sapiens
aggggctgcctggcttggcact

SEQ ID NO: 8263551 - DNA, 22 bp, Homo sapiens
aggggctggagttcgaggttac

SEQ ID NO: 8263552 - DNA, 22 bp, Homo sapiens
agggctgatgcaccatgtagcc

SEQ ID NO: 8263553 - DNA, 22 bp, Homo sapiens
aggcagggtgatgataatgatt

SEQ ID NO: 8263554 - DNA, 22 bp, Homo sapiens
aggcaggggagctggaagggta

SEQ ID NO: 8263555 - DNA, 22 bp, Homo sapiens
aggcaggggagctggaagggta

SEQ ID NO: 8263556 - DNA, 22 bp, Homo sapiens
aggcagggtcttgctatgttgc

SEQ ID NO: 8263557 - DNA, 22 bp, Homo sapiens
ccagagagtatcatggagagta

SEQ ID NO: 8263558 - DNA, 23 bp, Homo sapiens
aggcatggcatggatggtggctc

SEQ ID NO: 8263559 - DNA, 22 bp, Homo sapiens
aggcatggatgtagcagtgacc

SEQ ID NO: 8263560 - DNA, 22 bp, Homo sapiens
ccagcagacacacaggcgtggg

SEQ ID NO: 8263561 - DNA, 22 bp, Homo sapiens
ccagcagaagctcccgctgggt

SEQ ID NO: 8263562 - DNA, 19 bp, Homo sapiens
ccagcagaagccactcctg

SEQ ID NO: 8263563 - DNA, 22 bp, Homo sapiens
ccagcagagcatggggaggaag

SEQ ID NO: 8263564 - DNA, 19 bp, Homo sapiens
ccagcagacacagctgccc

SEQ ID NO: 8263565 - DNA, 22 bp, Homo sapiens
ccagcagaggggcggagtgcag

SEQ ID NO: 8263566 - DNA, 22 bp, Homo sapiens
ccagcagagctggaagtgtgct

SEQ ID NO: 8263567 - DNA, 22 bp, Homo sapiens
ccagcagagggcgcttcacacc

SEQ ID NO: 8263568 - DNA, 22 bp, Homo sapiens
aggccagaaatttggagtatgt

SEQ ID NO: 8263569 - DNA, 22 bp, Homo sapiens
ccaggagagcagaagcccaggc

SEQ ID NO: 8263570 - DNA, 22 bp, Homo sapiens
aggccagagaggggaccagcct

SEQ ID NO: 8263571 - DNA, 17 bp, Homo sapiens
aggccagatgaggcaag

SEQ ID NO: 8263572 - DNA, 22 bp, Homo sapiens
aggccagagttaaggagaacag

SEQ ID NO: 8263573 - DNA, 22 bp, Homo sapiens
ccagcctccatgtagatagctg

SEQ ID NO: 8263574 - DNA, 22 bp, Homo sapiens
aggcccagagagccagttagtg

SEQ ID NO: 8263575 - DNA, 21 bp, Homo sapiens
aggcccagagtcttgggggga

SEQ ID NO: 8263576 - DNA, 22 bp, Homo sapiens
aggcccagagcaggaaagggtt

SEQ ID NO: 8263577 - DNA, 19 bp, Homo sapiens
aggcccagcgctgggggct

SEQ ID NO: 8263578 - DNA, 22 bp, Homo sapiens
aggcccagcccgtcctcgtgct

SEQ ID NO: 8263579 - DNA, 22 bp, Homo sapiens
aggcccagctggacaaactgct

SEQ ID NO: 8263580 - DNA, 22 bp, Homo sapiens
ccatgggcactgggtggaggta

SEQ ID NO: 8263581 - DNA, 22 bp, Homo sapiens
ccatgggcgcacaggcctggag

SEQ ID NO: 8263582 - DNA, 22 bp, Homo sapiens
ccatgtgcttgctctggcacct

SEQ ID NO: 8263583 - DNA, 22 bp, Homo sapiens
ccagggagcggggctgggtctc

SEQ ID NO: 8263584 - DNA, 22 bp, Homo sapiens
aggctcagttctgtggtgagcc

SEQ ID NO: 8263585 - DNA, 22 bp, Homo sapiens
aggctcagttctgtggtgagcc

SEQ ID NO: 8263586 - DNA, 22 bp, Homo sapiens
ccaggaggaaattctaaaggta

SEQ ID NO: 8263587 - DNA, 22 bp, Homo sapiens
ccaggaggaaagaccagcccat

SEQ ID NO: 8263588 - DNA, 22 bp, Homo sapiens
ccaggagctggcatgtggagag

SEQ ID NO: 8263589 - DNA, 22 bp, Homo sapiens
ccaggagctggagggtgcagtg

SEQ ID NO: 8263590 - DNA, 22 bp, Homo sapiens
aggctcaggtgcctcattcaca

SEQ ID NO: 8263591 - DNA, 22 bp, Homo sapiens
aggctcagtcccggcccgcgcc

SEQ ID NO: 8263592 - DNA, 22 bp, Homo sapiens
aggctcagtatagctggcaagt

SEQ ID NO: 8263593 - DNA, 22 bp, Homo sapiens
aggctcagtctgttcatgcact

SEQ ID NO: 8263594 - DNA, 20 bp, Homo sapiens
atacacattcatagaaaaat

SEQ ID NO: 8263595 - DNA, 22 bp, Homo sapiens
ctggaacccaggcctggaagcc

SEQ ID NO: 8263596 - DNA, 22 bp, Homo sapiens
ctggagctggtatagggacaaa

SEQ ID NO: 8263597 - DNA, 22 bp, Homo sapiens
ctggagctgtcttcacaggcct

SEQ ID NO: 8263598 - DNA, 22 bp, Homo sapiens
ctggagctgggctagggtagga

SEQ ID NO: 8263599 - DNA, 22 bp, Homo sapiens
ctggagctgccagacgggcaca

SEQ ID NO: 8263600 - DNA, 22 bp, Homo sapiens
atacatcttccttttaaaatgc

SEQ ID NO: 8263601 - DNA, 22 bp, Homo sapiens
atacatcttgtcagattcatgt

SEQ ID NO: 8263602 - DNA, 22 bp, Homo sapiens
atacatctcatgtaagagataa

SEQ ID NO: 8263603 - DNA, 22 bp, Homo sapiens
atagggcctaaaaagtattgct

SEQ ID NO: 8263604 - DNA, 22 bp, Homo sapiens
ctggagcttattgggagcagaa

SEQ ID NO: 8263605 - DNA, 22 bp, Homo sapiens
atagaatatgacttttagatcc

SEQ ID NO: 8263606 - DNA, 22 bp, Homo sapiens
ctgcctgctgccctccagagcc

SEQ ID NO: 8263607 - DNA, 22 bp, Homo sapiens
ataataaaccaggatgggtctg

SEQ ID NO: 8263608 - DNA, 21 bp, Homo sapiens
agttttgagagtgggtagtgt

SEQ ID NO: 8263609 - DNA, 17 bp, Homo sapiens
agttttgatataatggc

SEQ ID NO: 8263610 - DNA, 22 bp, Homo sapiens
agtttatgttgtttataagcca

SEQ ID NO: 8263611 - DNA, 22 bp, Homo sapiens
agtgttagtggctgcagctggt

SEQ ID NO: 8263612 - DNA, 22 bp, Homo sapiens
agtttctgcaaatcatttttat

SEQ ID NO: 8263613 - DNA, 22 bp, Homo sapiens
agtttctgttaccatatttgac

SEQ ID NO: 8263614 - DNA, 22 bp, Homo sapiens
ctggtgctggcaacagagtagg

SEQ ID NO: 8263615 - DNA, 22 bp, Homo sapiens
ctggtggcatcttgagatggtt

SEQ ID NO: 8263616 - DNA, 22 bp, Homo sapiens
ctggtgggaggcaaggtggaag

SEQ ID NO: 8263617 - DNA, 22 bp, Homo sapiens
ctggtgggaggcaaggtggaag

SEQ ID NO: 8263618 - DNA, 22 bp, Homo sapiens
ctggtgggagcagcaggcagct

SEQ ID NO: 8263619 - DNA, 22 bp, Homo sapiens
ctggggaggcagggctgcccct

SEQ ID NO: 8263620 - DNA, 21 bp, Homo sapiens
ctgtccaaatttcataacttt

SEQ ID NO: 8263621 - DNA, 22 bp, Homo sapiens
ctgtatttcccacattctctat

SEQ ID NO: 8263622 - DNA, 22 bp, Homo sapiens
ctgtatttcttggacagttgct

SEQ ID NO: 8263623 - DNA, 22 bp, Homo sapiens
ctgtatttagttaaaatgctaa

SEQ ID NO: 8263624 - DNA, 22 bp, Homo sapiens
ctgtattctgggcagggaagga

SEQ ID NO: 8263625 - DNA, 22 bp, Homo sapiens
ctgtattcaaagtgaggatgta

SEQ ID NO: 8263626 - DNA, 22 bp, Homo sapiens
ctgtattaaaggcagtgatctt

SEQ ID NO: 8263627 - DNA, 22 bp, Homo sapiens
ctgtattagccaggtgcacaag

SEQ ID NO: 8263628 - DNA, 22 bp, Homo sapiens
atagtcttcagcactttgatca

SEQ ID NO: 8263629 - DNA, 22 bp, Homo sapiens
ctgtccagtcagaacgtcatta

SEQ ID NO: 8263630 - DNA, 22 bp, Homo sapiens
ctgtgtccaatggccttagcag

SEQ ID NO: 8263631 - DNA, 22 bp, Homo sapiens
ctgtgtcccagtaccttgggta

SEQ ID NO: 8263632 - DNA, 22 bp, Homo sapiens
ctgtgtccccctcagccaggtg

SEQ ID NO: 8263633 - DNA, 18 bp, Homo sapiens
atccttggggctgctgct

SEQ ID NO: 8263634 - DNA, 22 bp, Homo sapiens
agtggctggcataggaacagac

SEQ ID NO: 8263635 - DNA, 22 bp, Homo sapiens
agtggcaggcagaagcttctca

SEQ ID NO: 8263636 - DNA, 22 bp, Homo sapiens
ctctctgggcccagttggcacc

SEQ ID NO: 8263637 - DNA, 22 bp, Homo sapiens
ctctctggcttggcacggagat

SEQ ID NO: 8263638 - DNA, 19 bp, Homo sapiens
agtgcagggagcaccctca

SEQ ID NO: 8263639 - DNA, 22 bp, Homo sapiens
agtgcaggccccaggccaggcc

SEQ ID NO: 8263640 - DNA, 22 bp, Homo sapiens
ctctgagcagaggccgtggcta

SEQ ID NO: 8263641 - DNA, 22 bp, Homo sapiens
agtgggagggccatatggtgaa

SEQ ID NO: 8263642 - DNA, 22 bp, Homo sapiens
agtgggagagaagcaagtagta

SEQ ID NO: 8263643 - DNA, 22 bp, Homo sapiens
agtgggcagcccaggaggtctt

SEQ ID NO: 8263644 - DNA, 22 bp, Homo sapiens
agtgggcagtgcgctcggatgc

SEQ ID NO: 8263645 - DNA, 22 bp, Homo sapiens
agtgggcccttgtcacactgat

SEQ ID NO: 8263646 - DNA, 22 bp, Homo sapiens
agtgggccggacagcccaggcc

SEQ ID NO: 8263647 - DNA, 22 bp, Homo sapiens
agtgggcaggcagggtgcgcag

SEQ ID NO: 8263648 - DNA, 22 bp, Homo sapiens
agtgggcatgatctggtgtctg

SEQ ID NO: 8263649 - DNA, 22 bp, Homo sapiens
agtgggcccgagccagtggtct

SEQ ID NO: 8263650 - DNA, 22 bp, Homo sapiens
ctctgagacttttcacctccca

SEQ ID NO: 8263651 - DNA, 22 bp, Homo sapiens
agtgtcctctattatgacttta

SEQ ID NO: 8263652 - DNA, 22 bp, Homo sapiens
agtgtctgatcagttgactaga

SEQ ID NO: 8263653 - DNA, 22 bp, Homo sapiens
agtgtctgatcagttgactaga

SEQ ID NO: 8263654 - DNA, 22 bp, Homo sapiens
agtggggaagagcatgggccct

SEQ ID NO: 8263655 - DNA, 22 bp, Homo sapiens
ctcttaatgaccttaattcaag

SEQ ID NO: 8263656 - DNA, 22 bp, Homo sapiens
agtgtctgcaaaatgaaagagc

SEQ ID NO: 8263657 - DNA, 22 bp, Homo sapiens
agtctgaagactcatgtctgaa

SEQ ID NO: 8263658 - DNA, 22 bp, Homo sapiens
agtctgaagactcatgtctgaa

SEQ ID NO: 8263659 - DNA, 22 bp, Homo sapiens
agtctgaagatattcttgcagg

SEQ ID NO: 8263660 - DNA, 22 bp, Homo sapiens
agtctgaaggcaatctgctgac

SEQ ID NO: 8263661 - DNA, 22 bp, Homo sapiens
agtctggagtgcggcggcagga

SEQ ID NO: 8263662 - DNA, 23 bp, Homo sapiens
agtctggaagtgcagtggctgga

SEQ ID NO: 8263663 - DNA, 22 bp, Homo sapiens
ctcaggcaaggcccgcattctc

SEQ ID NO: 8263664 - DNA, 20 bp, Homo sapiens
ctcaggattgtctagcccct

SEQ ID NO: 8263665 - DNA, 18 bp, Homo sapiens
ctcaggcagagaagcttt

SEQ ID NO: 8263666 - DNA, 22 bp, Homo sapiens
ctcctcccacggtctcaggaag

SEQ ID NO: 8263667 - DNA, 22 bp, Homo sapiens
agtgcaggagcctggccagagc

SEQ ID NO: 8263668 - DNA, 22 bp, Homo sapiens
ctccagtgtctcagagcagatg

SEQ ID NO: 8263669 - DNA, 20 bp, Homo sapiens
ctccagtgttcaggggagtg

SEQ ID NO: 8263670 - DNA, 22 bp, Homo sapiens
ctccagtgggggtgagcctaga

SEQ ID NO: 8263671 - DNA, 22 bp, Homo sapiens
ctccatggaaaaggctgttgtt

SEQ ID NO: 8263672 - DNA, 22 bp, Homo sapiens
agtgaccaacaatgctgagaag

SEQ ID NO: 8263673 - DNA, 22 bp, Homo sapiens
agtgaccacaccctgcagacct

SEQ ID NO: 8263674 - DNA, 22 bp, Homo sapiens
agtgaccattttcagctagagg

SEQ ID NO: 8263675 - DNA, 22 bp, Homo sapiens
agtgactgggcagggcagggcc

SEQ ID NO: 8263676 - DNA, 22 bp, Homo sapiens
cgcggggcttcagccgcccagt

SEQ ID NO: 8263677 - DNA, 22 bp, Homo sapiens
cgtgccactgcactccagtctg

SEQ ID NO: 8263678 - DNA, 22 bp, Homo sapiens
cctttatgtttctgcagccccc

SEQ ID NO: 8263679 - DNA, 22 bp, Homo sapiens
cctttatgatagatgctttcag

SEQ ID NO: 8263680 - DNA, 22 bp, Homo sapiens
cctttatgtcactctggagagc

SEQ ID NO: 8263681 - DNA, 21 bp, Homo sapiens
cctttatgcaaggactggcat

SEQ ID NO: 8263682 - DNA, 19 bp, Homo sapiens
cctttagttgctcagagaa

SEQ ID NO: 8263683 - DNA, 22 bp, Homo sapiens
cctttatgagatcctggggtga

SEQ ID NO: 8263684 - DNA, 19 bp, Homo sapiens
aggtgtgggggctgcagac

SEQ ID NO: 8263685 - DNA, 22 bp, Homo sapiens
aggtggggttcagtctcagccg

SEQ ID NO: 8263686 - DNA, 22 bp, Homo sapiens
aggttcaggcacttgcccaaca

SEQ ID NO: 8263687 - DNA, 22 bp, Homo sapiens
aggttgggatgagtgggtgagc

SEQ ID NO: 8263688 - DNA, 22 bp, Homo sapiens
aggttccaagaaatcatcagtg

SEQ ID NO: 8263689 - DNA, 22 bp, Homo sapiens
aggggctgtggaaaccaactct

SEQ ID NO: 8263690 - DNA, 22 bp, Homo sapiens
cctgcctggcacatagtactct

SEQ ID NO: 8263691 - DNA, 22 bp, Homo sapiens
cctgcctgctttctgctttgca

SEQ ID NO: 8263692 - DNA, 22 bp, Homo sapiens
aggtgcttggctcgtgcacaca

SEQ ID NO: 8263693 - DNA, 20 bp, Homo sapiens
aggtgcaagcagtaaattgc

SEQ ID NO: 8263694 - DNA, 22 bp, Homo sapiens
aggtctggaaacagcagggaga

SEQ ID NO: 8263695 - DNA, 22 bp, Homo sapiens
aggtctgggattgaagacatca

SEQ ID NO: 8263696 - DNA, 22 bp, Homo sapiens
aggtctggaggcggagtcagga

SEQ ID NO: 8263697 - DNA, 22 bp, Homo sapiens
attagttggggtggagaaggat

SEQ ID NO: 8263698 - DNA, 22 bp, Homo sapiens
gcagagatctgagaaggctgcc

SEQ ID NO: 8263699 - DNA, 22 bp, Homo sapiens
gcagagatgggccagtgacgca

SEQ ID NO: 8263700 - DNA, 22 bp, Homo sapiens
gcagagaggaatgaagccatcc

SEQ ID NO: 8263701 - DNA, 22 bp, Homo sapiens
gcagagactccactgtcttgtg

SEQ ID NO: 8263702 - DNA, 22 bp, Homo sapiens
gcagagaccccgcagtgaggcc

SEQ ID NO: 8263703 - DNA, 22 bp, Homo sapiens
gcagagactagtagtgcagact

SEQ ID NO: 8263704 - DNA, 22 bp, Homo sapiens
gcagagacaggataatgggttc

SEQ ID NO: 8263705 - DNA, 22 bp, Homo sapiens
gagtggggaaagccaggacaga

SEQ ID NO: 8263706 - DNA, 22 bp, Homo sapiens
gagtggggcgtggatccagcgt

SEQ ID NO: 8263707 - DNA, 22 bp, Homo sapiens
gatggcagtcaaccaggtgagg

SEQ ID NO: 8263708 - DNA, 22 bp, Homo sapiens
gatggcaggtgatagccgagtc

SEQ ID NO: 8263709 - DNA, 22 bp, Homo sapiens
gatggcaaactgggaccagagg

SEQ ID NO: 8263710 - DNA, 22 bp, Homo sapiens
gatgtggcataagagtgaacac

SEQ ID NO: 8263711 - DNA, 22 bp, Homo sapiens
gatgtggcatctgggtgacagc

SEQ ID NO: 8263712 - DNA, 22 bp, Homo sapiens
attaaattttcactaggctccc

SEQ ID NO: 8263713 - DNA, 22 bp, Homo sapiens
gcagcttgaagctcggaggagc

SEQ ID NO: 8263714 - DNA, 22 bp, Homo sapiens
gcagcttcctgagtgtggacag

SEQ ID NO: 8263715 - DNA, 22 bp, Homo sapiens
gcaggcaattttggaaggtcag

SEQ ID NO: 8263716 - DNA, 22 bp, Homo sapiens
gcaggcaaggaacagagactgt

SEQ ID NO: 8263717 - DNA, 22 bp, Homo sapiens
attctgaggacagagtctagca

SEQ ID NO: 8263718 - DNA, 21 bp, Homo sapiens
attctgagttgtcagtcttca

SEQ ID NO: 8263719 - DNA, 22 bp, Homo sapiens
attccactccaataagtgtcaa

SEQ ID NO: 8263720 - DNA, 22 bp, Homo sapiens
attcacaagttgatggatattt

SEQ ID NO: 8263721 - DNA, 22 bp, Homo sapiens
attctggaaagctattctctct

SEQ ID NO: 8263722 - DNA, 22 bp, Homo sapiens
gcatggcaagatcaggagacca

SEQ ID NO: 8263723 - DNA, 22 bp, Homo sapiens
gcatggatgggagtggacagat

SEQ ID NO: 8263724 - DNA, 22 bp, Homo sapiens
gcatggagaagtgggaacaggt

SEQ ID NO: 8263725 - DNA, 22 bp, Homo sapiens
attgcactccagcctgggggac

SEQ ID NO: 8263726 - DNA, 22 bp, Homo sapiens
gctctgagattgagcctttggt

SEQ ID NO: 8263727 - DNA, 22 bp, Homo sapiens
gctctgagatcattcactgtaa

SEQ ID NO: 8263728 - DNA, 22 bp, Homo sapiens
gctctgagagtgggtgattctg

SEQ ID NO: 8263729 - DNA, 22 bp, Homo sapiens
gctctgagagtgggtgattctg

SEQ ID NO: 8263730 - DNA, 22 bp, Homo sapiens
gctctgagataaacgttgccct

SEQ ID NO: 8263731 - DNA, 22 bp, Homo sapiens
gctcagagaaattataggaatt

SEQ ID NO: 8263732 - DNA, 22 bp, Homo sapiens
gctcagagaatcagcagacacc

SEQ ID NO: 8263733 - DNA, 22 bp, Homo sapiens
gctcagagaatttactgctgcc

SEQ ID NO: 8263734 - DNA, 22 bp, Homo sapiens
gctcagagaagttgtgcctggc

SEQ ID NO: 8263735 - DNA, 22 bp, Homo sapiens
gctcagagaagttaaggaattt

SEQ ID NO: 8263736 - DNA, 22 bp, Homo sapiens
gcccagggtgcttagaacccat

SEQ ID NO: 8263737 - DNA, 22 bp, Homo sapiens
gcccagtctcttctggccctgt

SEQ ID NO: 8263738 - DNA, 22 bp, Homo sapiens
gccagccacttcccagactggc

SEQ ID NO: 8263739 - DNA, 22 bp, Homo sapiens
gccagccacgttagactggccc

SEQ ID NO: 8263740 - DNA, 22 bp, Homo sapiens
gccagccagggaagggagagac

SEQ ID NO: 8263741 - DNA, 22 bp, Homo sapiens
gccagccagagaggcatggtta

SEQ ID NO: 8263742 - DNA, 22 bp, Homo sapiens
gccagctgctcgcgtagggtag

SEQ ID NO: 8263743 - DNA, 22 bp, Homo sapiens
gccagctgccctctgctggtcc

SEQ ID NO: 8263744 - DNA, 22 bp, Homo sapiens
gccagccagtttgctgatggct

SEQ ID NO: 8263745 - DNA, 22 bp, Homo sapiens
gcatggcatttgaaggtagaag

SEQ ID NO: 8263746 - DNA, 22 bp, Homo sapiens
gcatggcagtgaggatggtgct

SEQ ID NO: 8263747 - DNA, 20 bp, Homo sapiens
gcatggcatgtagtgaagtg

SEQ ID NO: 8263748 - DNA, 22 bp, Homo sapiens
gccagccacaagggaggcttgt

SEQ ID NO: 8263749 - DNA, 22 bp, Homo sapiens
gccagccaagattgagaaggta

SEQ ID NO: 8263750 - DNA, 22 bp, Homo sapiens
gccagctggagactggcagggg

SEQ ID NO: 8263751 - DNA, 22 bp, Homo sapiens
atgggagggtggaaaggctctg

SEQ ID NO: 8263752 - DNA, 22 bp, Homo sapiens
gagcacagcagggctctgggtg

SEQ ID NO: 8263753 - DNA, 22 bp, Homo sapiens
gagcacagctggaggtagcatt

SEQ ID NO: 8263754 - DNA, 22 bp, Homo sapiens
atggccctgtttatggtaaggc

SEQ ID NO: 8263755 - DNA, 22 bp, Homo sapiens
atggccctttattccttcttcc

SEQ ID NO: 8263756 - DNA, 22 bp, Homo sapiens
atggcagacctgggctggagaa

SEQ ID NO: 8263757 - DNA, 17 bp, Homo sapiens
gagctctgtggcacaag

SEQ ID NO: 8263758 - DNA, 22 bp, Homo sapiens
gagccctcgggcgagcccgcgc

SEQ ID NO: 8263759 - DNA, 22 bp, Homo sapiens
gagccccaggacagctctagtt

SEQ ID NO: 8263760 - DNA, 22 bp, Homo sapiens
atgggcaacagcagtcacaatg

SEQ ID NO: 8263761 - DNA, 22 bp, Homo sapiens
atgggcagacagggagctcacg

SEQ ID NO: 8263762 - DNA, 22 bp, Homo sapiens
atgggcagagctggtgggaggc

SEQ ID NO: 8263763 - DNA, 22 bp, Homo sapiens
gagcccagtctgctcctgcgcc

SEQ ID NO: 8263764 - DNA, 22 bp, Homo sapiens
atgctgggaagacaaggtggag

SEQ ID NO: 8263765 - DNA, 22 bp, Homo sapiens
atgctgggaaactgaaaggaat

SEQ ID NO: 8263766 - DNA, 22 bp, Homo sapiens
atgctggggcctcagaccagaa

SEQ ID NO: 8263767 - DNA, 22 bp, Homo sapiens
atggcagaagtcaagatgagtt

SEQ ID NO: 8263768 - DNA, 20 bp, Homo sapiens
atggatgaccttggccaggg

SEQ ID NO: 8263769 - DNA, 22 bp, Homo sapiens
atggatctgctaatgggaagca

SEQ ID NO: 8263770 - DNA, 22 bp, Homo sapiens
atggatcttccctcatttctga

SEQ ID NO: 8263771 - DNA, 22 bp, Homo sapiens
atggatctaccttcaggctctg

SEQ ID NO: 8263772 - DNA, 21 bp, Homo sapiens
gagaatagaggggaagctgaa

SEQ ID NO: 8263773 - DNA, 22 bp, Homo sapiens
atgggcagcagctgtcattttc

SEQ ID NO: 8263774 - DNA, 22 bp, Homo sapiens
atgggcagcagctgccattcat

SEQ ID NO: 8263775 - DNA, 22 bp, Homo sapiens
atgggcagagtggggacaggaa

SEQ ID NO: 8263776 - DNA, 22 bp, Homo sapiens
atgggcagagtggggacaggaa

SEQ ID NO: 8263777 - DNA, 22 bp, Homo sapiens
gaggagctgggtcagggagaca

SEQ ID NO: 8263778 - DNA, 22 bp, Homo sapiens
atgggcaggcactggctctcag

SEQ ID NO: 8263779 - DNA, 22 bp, Homo sapiens
atgggcagctgcagcagtggtg

SEQ ID NO: 8263780 - DNA, 22 bp, Homo sapiens
atgtattcaagccacatacatt

SEQ ID NO: 8263781 - DNA, 22 bp, Homo sapiens
gaggctccctcaactctgggtg

SEQ ID NO: 8263782 - DNA, 22 bp, Homo sapiens
atgtatttactgagaaggaaac

SEQ ID NO: 8263783 - DNA, 23 bp, Homo sapiens
atgtatttaaatttcagtgatga

SEQ ID NO: 8263784 - DNA, 22 bp, Homo sapiens
atgtggcaatggttagcactgt

SEQ ID NO: 8263785 - DNA, 22 bp, Homo sapiens
atgtggcacagcacagtaagag

SEQ ID NO: 8263786 - DNA, 22 bp, Homo sapiens
atgtggcagtgggaggtgaatt

SEQ ID NO: 8263787 - DNA, 22 bp, Homo sapiens
atgtggcaccgatctttagcca

SEQ ID NO: 8263788 - DNA, 22 bp, Homo sapiens
atgtggcattcttggtcatttc

SEQ ID NO: 8263789 - DNA, 22 bp, Homo sapiens
atgtcactgttgttattgttat

SEQ ID NO: 8263790 - DNA, 22 bp, Homo sapiens
atgtcactgtttaccagctcca

SEQ ID NO: 8263791 - DNA, 19 bp, Homo sapiens
atgtcactcatgttccctg

SEQ ID NO: 8263792 - DNA, 22 bp, Homo sapiens
atgtcactccagggacacaggt

SEQ ID NO: 8263793 - DNA, 22 bp, Homo sapiens
gaagagatgacaaaggagcatg

SEQ ID NO: 8263794 - DNA, 22 bp, Homo sapiens
gaaggaggtgtcagttggactg

SEQ ID NO: 8263795 - DNA, 22 bp, Homo sapiens
atgcaggagccctcttgagggc

SEQ ID NO: 8263796 - DNA, 22 bp, Homo sapiens
gaaggagggtgcggatctgagc

SEQ ID NO: 8263797 - DNA, 22 bp, Homo sapiens
gaagcctggtccagagctccca

SEQ ID NO: 8263798 - DNA, 22 bp, Homo sapiens
atgcctggactgtatcccagat

SEQ ID NO: 8263799 - DNA, 22 bp, Homo sapiens
atgctataaactctaggtcatt

SEQ ID NO: 8263800 - DNA, 22 bp, Homo sapiens
atgcatttgacgggatatattt

SEQ ID NO: 8263801 - DNA, 22 bp, Homo sapiens
atgacatgattgccatttgata

SEQ ID NO: 8263802 - DNA, 22 bp, Homo sapiens
atgagataggaacaaacttaca

SEQ ID NO: 8263803 - DNA, 22 bp, Homo sapiens
atgagattttaaaacttcactt

SEQ ID NO: 8263804 - DNA, 22 bp, Homo sapiens
atgacacttggtgatactttgt

SEQ ID NO: 8263805 - DNA, 22 bp, Homo sapiens
ctttattctgcaaattgccttg

SEQ ID NO: 8263806 - DNA, 22 bp, Homo sapiens
ctttattcctacaagattttct

SEQ ID NO: 8263807 - DNA, 22 bp, Homo sapiens
ctttattgtccttcttaggtgg

SEQ ID NO: 8263808 - DNA, 22 bp, Homo sapiens
atctggagaaaccgccaaggga

SEQ ID NO: 8263809 - DNA, 22 bp, Homo sapiens
gtgagcagagatcgcgtgattg

SEQ ID NO: 8263810 - DNA, 22 bp, Homo sapiens
cagccctcatcccgcctgcgtt

SEQ ID NO: 8263811 - DNA, 22 bp, Homo sapiens
cagccctcctaccctgccaggc

SEQ ID NO: 8263812 - DNA, 22 bp, Homo sapiens
cagccctgtccctgagggacct

SEQ ID NO: 8263813 - DNA, 22 bp, Homo sapiens
cagccctgtctatgactgatga

SEQ ID NO: 8263814 - DNA, 22 bp, Homo sapiens
gtcacactcttccctccacatg

SEQ ID NO: 8263815 - DNA, 22 bp, Homo sapiens
cagcatctcctgtgcagaggga

SEQ ID NO: 8263816 - DNA, 22 bp, Homo sapiens
cagcatctcccaggcatttgcc

SEQ ID NO: 8263817 - DNA, 22 bp, Homo sapiens
cagcatctccatggctttggag

SEQ ID NO: 8263818 - DNA, 22 bp, Homo sapiens
cagcatctgtatcctaggctga

SEQ ID NO: 8263819 - DNA, 22 bp, Homo sapiens
cagcatctgttggatggataag

SEQ ID NO: 8263820 - DNA, 22 bp, Homo sapiens
gtacacagatgcttgagaatct

SEQ ID NO: 8263821 - DNA, 22 bp, Homo sapiens
gtactttagagtaaaatagacc

SEQ ID NO: 8263822 - DNA, 22 bp, Homo sapiens
gtactttaagactccagtagca

SEQ ID NO: 8263823 - DNA, 22 bp, Homo sapiens
gtactttaaatcaatgtagatt

SEQ ID NO: 8263824 - DNA, 22 bp, Homo sapiens
gtaggcagtggttggaagagaa

SEQ ID NO: 8263825 - DNA, 22 bp, Homo sapiens
gtaggcagtctctcaggtgatc

SEQ ID NO: 8263826 - DNA, 22 bp, Homo sapiens
gtaggcagataggagtgcagcc

SEQ ID NO: 8263827 - DNA, 22 bp, Homo sapiens
gtaggcagggctgtggggagaa

SEQ ID NO: 8263828 - DNA, 22 bp, Homo sapiens
cagatttactccctgctgctgc

SEQ ID NO: 8263829 - DNA, 22 bp, Homo sapiens
cagatttaggtcactagaattt

SEQ ID NO: 8263830 - DNA, 22 bp, Homo sapiens
cagcagccgagagggggctctg

SEQ ID NO: 8263831 - DNA, 22 bp, Homo sapiens
cagcagcctacaatgcacagaa

SEQ ID NO: 8263832 - DNA, 22 bp, Homo sapiens
cagcagccagacaagatacatc

SEQ ID NO: 8263833 - DNA, 20 bp, Homo sapiens
cagcagccattctagtagta

SEQ ID NO: 8263834 - DNA, 22 bp, Homo sapiens
cagcagccactagagggctcac

SEQ ID NO: 8263835 - DNA, 22 bp, Homo sapiens
cagagcagtggagagtaggtct

SEQ ID NO: 8263836 - DNA, 22 bp, Homo sapiens
cagagcagacgttgagattaag

SEQ ID NO: 8263837 - DNA, 22 bp, Homo sapiens
gggcaggggtagcattccaagt

SEQ ID NO: 8263838 - DNA, 22 bp, Homo sapiens
gggcaggggtagcattccaagt

SEQ ID NO: 8263839 - DNA, 22 bp, Homo sapiens
gggcaggggtcagtggccccaa

SEQ ID NO: 8263840 - DNA, 22 bp, Homo sapiens
gggcaggggtcagtggccccaa

SEQ ID NO: 8263841 - DNA, 20 bp, Homo sapiens
gggaggcattggtccctcac

SEQ ID NO: 8263842 - DNA, 20 bp, Homo sapiens
gggaggcattggtccctcac

SEQ ID NO: 8263843 - DNA, 22 bp, Homo sapiens
cagagacaacctggtagagaaa

SEQ ID NO: 8263844 - DNA, 22 bp, Homo sapiens
gggaggagggtgctggctaaac

SEQ ID NO: 8263845 - DNA, 22 bp, Homo sapiens
gggaggcacgaggcgcgcagtg

SEQ ID NO: 8263846 - DNA, 22 bp, Homo sapiens
gggaggcacgaggcgcgcagtg

SEQ ID NO: 8263847 - DNA, 22 bp, Homo sapiens
gggaggcagtgctggaggctgg

SEQ ID NO: 8263848 - DNA, 22 bp, Homo sapiens
gggaggcagtgctggaggctgg

SEQ ID NO: 8263849 - DNA, 22 bp, Homo sapiens
gggaggcatgtgttatccactt

SEQ ID NO: 8263850 - DNA, 22 bp, Homo sapiens
gggaggcatgtgttatccactt

SEQ ID NO: 8263851 - DNA, 21 bp, Homo sapiens
gggagctggaaactgggtgac

SEQ ID NO: 8263852 - DNA, 22 bp, Homo sapiens
gggagccaaggagagaggcctt

SEQ ID NO: 8263853 - DNA, 22 bp, Homo sapiens
ggctggcactgaggagagctct

SEQ ID NO: 8263854 - DNA, 22 bp, Homo sapiens
cagacaaggccatctttcattt

SEQ ID NO: 8263855 - DNA, 22 bp, Homo sapiens
cagatatgtggattctattagc

SEQ ID NO: 8263856 - DNA, 22 bp, Homo sapiens
ggtatttactgagagccactct

SEQ ID NO: 8263857 - DNA, 22 bp, Homo sapiens
ggtatttatatgtctgaagctg

SEQ ID NO: 8263858 - DNA, 22 bp, Homo sapiens
ggtatttatagtggtgcttagt

SEQ ID NO: 8263859 - DNA, 19 bp, Homo sapiens
ggtcctcagcagagcatgc

SEQ ID NO: 8263860 - DNA, 22 bp, Homo sapiens
ggtcctcaatcccaacaaggca

SEQ ID NO: 8263861 - DNA, 22 bp, Homo sapiens
gggtgtggctgcgtgccaataa

SEQ ID NO: 8263862 - DNA, 22 bp, Homo sapiens
gggttccaatgatgagcaagag

SEQ ID NO: 8263863 - DNA, 22 bp, Homo sapiens
gggtaggaaatccagaggtggc

SEQ ID NO: 8263864 - DNA, 22 bp, Homo sapiens
gggctgtggagccgcgagggct

SEQ ID NO: 8263865 - DNA, 22 bp, Homo sapiens
gggctgtgctgagtaggaggtg

SEQ ID NO: 8263866 - DNA, 22 bp, Homo sapiens
gggctgtgcctcaggtggggtc

SEQ ID NO: 8263867 - DNA, 22 bp, Homo sapiens
gggctggagttgggaagacaaa

SEQ ID NO: 8263868 - DNA, 22 bp, Homo sapiens
gggctgtgagagtggggctgct

SEQ ID NO: 8263869 - DNA, 22 bp, Homo sapiens
gggctggaggtgagcaggacag

SEQ ID NO: 8263870 - DNA, 22 bp, Homo sapiens
cagagccactgtctgccaggca

SEQ ID NO: 8263871 - DNA, 21 bp, Homo sapiens
ggggcagagctaggccctgca

SEQ ID NO: 8263872 - DNA, 22 bp, Homo sapiens
ggggcagaagtagtgcccctga

SEQ ID NO: 8263873 - DNA, 20 bp, Homo sapiens
ggggttggctggcacaggga

SEQ ID NO: 8263874 - DNA, 22 bp, Homo sapiens
gctgccctgcatctgtgccttc

SEQ ID NO: 8263875 - DNA, 22 bp, Homo sapiens
gctctgctttctggggggatcc

SEQ ID NO: 8263876 - DNA, 22 bp, Homo sapiens
gctctggaccctggagtggctg

SEQ ID NO: 8263877 - DNA, 22 bp, Homo sapiens
gctgccctgtccggctctcctg

SEQ ID NO: 8263878 - DNA, 22 bp, Homo sapiens
gctgcctgatgtccagcaggac

SEQ ID NO: 8263879 - DNA, 22 bp, Homo sapiens
gctggctgaggtctagctcttt

SEQ ID NO: 8263880 - DNA, 22 bp, Homo sapiens
caagctgaacactgtcttcaag

SEQ ID NO: 8263881 - DNA, 22 bp, Homo sapiens
gctgctggccgcccagcttctc

SEQ ID NO: 8263882 - DNA, 22 bp, Homo sapiens
ggagaagggccaattccatgta

SEQ ID NO: 8263883 - DNA, 22 bp, Homo sapiens
ggagaagggacagactcagctt

SEQ ID NO: 8263884 - DNA, 22 bp, Homo sapiens
ggagagaggctggccgtgatga

SEQ ID NO: 8263885 - DNA, 22 bp, Homo sapiens
ggaccagagaagtgagcacctg

SEQ ID NO: 8263886 - DNA, 22 bp, Homo sapiens
ggaccagctatcaatgccaggg

SEQ ID NO: 8263887 - DNA, 22 bp, Homo sapiens
ggactgggtaggagcccagggc

SEQ ID NO: 8263888 - DNA, 22 bp, Homo sapiens
cacaaataccagtttcctaaca

SEQ ID NO: 8263889 - DNA, 22 bp, Homo sapiens
ggaagagcctggggtgtcaggc

SEQ ID NO: 8263890 - DNA, 22 bp, Homo sapiens
cacagggctttgatggctgagt

SEQ ID NO: 8263891 - DNA, 20 bp, Homo sapiens
cacaggccttgtgagcagac

SEQ ID NO: 8263892 - DNA, 22 bp, Homo sapiens
cacaggagattgatctattggt

SEQ ID NO: 8263893 - DNA, 22 bp, Homo sapiens
cacaggaggttaggaagtggtc

SEQ ID NO: 8263894 - DNA, 22 bp, Homo sapiens
cacaggaggttaggaagtggtc

SEQ ID NO: 8263895 - DNA, 18 bp, Homo sapiens
cacaggagccacactcac

SEQ ID NO: 8263896 - DNA, 22 bp, Homo sapiens
cacaggagtgctgctattgttg

SEQ ID NO: 8263897 - DNA, 22 bp, Homo sapiens
cacaggagttaacataattaag

SEQ ID NO: 8263898 - DNA, 22 bp, Homo sapiens
ggcaagtggaggtgttcatcag

SEQ ID NO: 8263899 - DNA, 22 bp, Homo sapiens
ggcaagtggtagaacatctgag

SEQ ID NO: 8263900 - DNA, 22 bp, Homo sapiens
ggcaagtgcttccccaaccaca

SEQ ID NO: 8263901 - DNA, 22 bp, Homo sapiens
ggcaagtgatcctggagcaccg

SEQ ID NO: 8263902 - DNA, 22 bp, Homo sapiens
ggcaaggggtcaggctgagaca

SEQ ID NO: 8263903 - DNA, 22 bp, Homo sapiens
cacatgaataaggctttattgt

SEQ ID NO: 8263904 - DNA, 16 bp, Homo sapiens
cacatatatttatatg

SEQ ID NO: 8263905 - DNA, 22 bp, Homo sapiens
ggcaagtgtgagaagggactgg

SEQ ID NO: 8263906 - DNA, 18 bp, Homo sapiens
ggcagatgacaggagaga

SEQ ID NO: 8263907 - DNA, 20 bp, Homo sapiens
ggcagatgcagagctatgca

SEQ ID NO: 8263908 - DNA, 22 bp, Homo sapiens
ggcagagttggtggagtcagtt

SEQ ID NO: 8263909 - DNA, 22 bp, Homo sapiens
ggcagagtgctctgggcagggg

SEQ ID NO: 8263910 - DNA, 22 bp, Homo sapiens
caccagctccaccagggcaggt

SEQ ID NO: 8263911 - DNA, 22 bp, Homo sapiens
cacttgcagactttgcctggtt

SEQ ID NO: 8263912 - DNA, 22 bp, Homo sapiens
cactgtggcttaccaaagctaa

SEQ ID NO: 8263913 - DNA, 22 bp, Homo sapiens
cactgtcacgttctgaaactgt

SEQ ID NO: 8263914 - DNA, 22 bp, Homo sapiens
cactcagctgagccctcagccc

SEQ ID NO: 8263915 - DNA, 21 bp, Homo sapiens
cactccacttagaacagggtt

SEQ ID NO: 8263916 - DNA, 22 bp, Homo sapiens
caggctggagtgcaatggcaca

SEQ ID NO: 8263917 - DNA, 22 bp, Homo sapiens
tagaatatacactacagcttaa

SEQ ID NO: 8263918 - DNA, 22 bp, Homo sapiens
tactcagtttatgatttcaagt

SEQ ID NO: 8263919 - DNA, 22 bp, Homo sapiens
gtgaggggtctggacgcacagt

SEQ ID NO: 8263920 - DNA, 22 bp, Homo sapiens
gtgaggggagtaaagccatgtt

SEQ ID NO: 8263921 - DNA, 22 bp, Homo sapiens
tagaatatgtggtgtatacttt

SEQ ID NO: 8263922 - DNA, 18 bp, Homo sapiens
tagaatcaaatattttac

SEQ ID NO: 8263923 - DNA, 19 bp, Homo sapiens
tagaggagaagggaagtgg

SEQ ID NO: 8263924 - DNA, 22 bp, Homo sapiens
tagagtgtcataacagtgccca

SEQ ID NO: 8263925 - DNA, 22 bp, Homo sapiens
tagagtgtccaacacataggag

SEQ ID NO: 8263926 - DNA, 21 bp, Homo sapiens
tagggcaggcattggaagaga

SEQ ID NO: 8263927 - DNA, 22 bp, Homo sapiens
taggggttacctttagcatctc

SEQ ID NO: 8263928 - DNA, 22 bp, Homo sapiens
caggggacattaaagctccata

SEQ ID NO: 8263929 - DNA, 22 bp, Homo sapiens
caggggagttttatgcaacaga

SEQ ID NO: 8263930 - DNA, 22 bp, Homo sapiens
caggggagtgagtccctctctg

SEQ ID NO: 8263931 - DNA, 22 bp, Homo sapiens
tagtgataatgtttatgctttt

SEQ ID NO: 8263932 - DNA, 22 bp, Homo sapiens
tagtgacaggaactgaatctct

SEQ ID NO: 8263933 - DNA, 22 bp, Homo sapiens
tagtgacatctagtggactgtt

SEQ ID NO: 8263934 - DNA, 22 bp, Homo sapiens
taggagaagagtcagggcctaa

SEQ ID NO: 8263935 - DNA, 17 bp, Homo sapiens
taggagactggctgtcc

SEQ ID NO: 8263936 - DNA, 22 bp, Homo sapiens
cagggcctgtacaagtcccacc

SEQ ID NO: 8263937 - DNA, 22 bp, Homo sapiens
tagctttaagatgagatgtgga

SEQ ID NO: 8263938 - DNA, 22 bp, Homo sapiens
tcagcagaatcttcctacacct

SEQ ID NO: 8263939 - DNA, 22 bp, Homo sapiens
tcagcagccgcagctgactcag

SEQ ID NO: 8263940 - DNA, 23 bp, Homo sapiens
tcagcagcagaagtgctgggatg

SEQ ID NO: 8263941 - DNA, 21 bp, Homo sapiens
tcagcagcatctgcctagagt

SEQ ID NO: 8263942 - DNA, 22 bp, Homo sapiens
tcagcagcagctcagcatgttt

SEQ ID NO: 8263943 - DNA, 21 bp, Homo sapiens
cagtgccagccacaggacgcc

SEQ ID NO: 8263944 - DNA, 22 bp, Homo sapiens
cagtgccaaggagaaggacagc

SEQ ID NO: 8263945 - DNA, 22 bp, Homo sapiens
cagtgcccaaaggaacagaaag

SEQ ID NO: 8263946 - DNA, 22 bp, Homo sapiens
cagtgccatgatgcagagcaat

SEQ ID NO: 8263947 - DNA, 22 bp, Homo sapiens
cagtgggaatgaagtggaggcc

SEQ ID NO: 8263948 - DNA, 22 bp, Homo sapiens
cagtgggaagaatgcagcctcc

SEQ ID NO: 8263949 - DNA, 22 bp, Homo sapiens
cagtgggaagggcagaggcttt

SEQ ID NO: 8263950 - DNA, 22 bp, Homo sapiens
cagtgggatatgggggcagcat

SEQ ID NO: 8263951 - DNA, 22 bp, Homo sapiens
cagtgggacatgggcactgggc

SEQ ID NO: 8263952 - DNA, 22 bp, Homo sapiens
cagtgtctcagtttcacttgaa

SEQ ID NO: 8263953 - DNA, 22 bp, Homo sapiens
cagtgtctttcagactcagaaa

SEQ ID NO: 8263954 - DNA, 22 bp, Homo sapiens
cagtgtcttatttgtagctcag

SEQ ID NO: 8263955 - DNA, 18 bp, Homo sapiens
cagtgtcttggtaaaata

SEQ ID NO: 8263956 - DNA, 22 bp, Homo sapiens
cagtgtctggttggctctacgt

SEQ ID NO: 8263957 - DNA, 22 bp, Homo sapiens
cagtgtctgggacagaaagtca

SEQ ID NO: 8263958 - DNA, 22 bp, Homo sapiens
cagtgtctgggacagaaagtca

SEQ ID NO: 8263959 - DNA, 22 bp, Homo sapiens
cagtgtctgcctttctgtttgg

SEQ ID NO: 8263960 - DNA, 22 bp, Homo sapiens
cagtgtctccagatgctccaat

SEQ ID NO: 8263961 - DNA, 22 bp, Homo sapiens
cagtgtctcccccaggttctgt

SEQ ID NO: 8263962 - DNA, 22 bp, Homo sapiens
cagtgtctgaaataacaccgga

SEQ ID NO: 8263963 - DNA, 22 bp, Homo sapiens
cagtgtctttcagactcagaaa

SEQ ID NO: 8263964 - DNA, 22 bp, Homo sapiens
tcacagagaactataatccatc

SEQ ID NO: 8263965 - DNA, 22 bp, Homo sapiens
tcacagagaaatgtggcacaaa

SEQ ID NO: 8263966 - DNA, 22 bp, Homo sapiens
tcacagagaaaagctatcacaa

SEQ ID NO: 8263967 - DNA, 22 bp, Homo sapiens
tcacagacctggtgggaggtgg

SEQ ID NO: 8263968 - DNA, 22 bp, Homo sapiens
cagtgacacccagtctggccca

SEQ ID NO: 8263969 - DNA, 22 bp, Homo sapiens
cagtgacacgggctggcccacg

SEQ ID NO: 8263970 - DNA, 22 bp, Homo sapiens
cattcacagagggggaagcatc

SEQ ID NO: 8263971 - DNA, 22 bp, Homo sapiens
catgttctaacaatgagaaacc

SEQ ID NO: 8263972 - DNA, 22 bp, Homo sapiens
catgttctaatattgtgacata

SEQ ID NO: 8263973 - DNA, 22 bp, Homo sapiens
catgttggcaaggatacagcag

SEQ ID NO: 8263974 - DNA, 22 bp, Homo sapiens
catgttggcactgtctctgcct

SEQ ID NO: 8263975 - DNA, 22 bp, Homo sapiens
catgttggctgaggctgtattt

SEQ ID NO: 8263976 - DNA, 22 bp, Homo sapiens
catgttgggaatcagctgagag

SEQ ID NO: 8263977 - DNA, 22 bp, Homo sapiens
catgttgggcatgcatatgtgt

SEQ ID NO: 8263978 - DNA, 22 bp, Homo sapiens
catgttggtgtgctgcacccat

SEQ ID NO: 8263979 - DNA, 22 bp, Homo sapiens
catgttggcttgtcacaatgaa

SEQ ID NO: 8263980 - DNA, 22 bp, Homo sapiens
catgttggtgtgctgcacccgt

SEQ ID NO: 8263981 - DNA, 22 bp, Homo sapiens
tccccagcttgctacttctgct

SEQ ID NO: 8263982 - DNA, 22 bp, Homo sapiens
tccccagctctgtgcttccact

SEQ ID NO: 8263983 - DNA, 22 bp, Homo sapiens
tccccagccgtgaaggagagga

SEQ ID NO: 8263984 - DNA, 22 bp, Homo sapiens
tccccagcattgagggtctctc

SEQ ID NO: 8263985 - DNA, 19 bp, Homo sapiens
tccccagcacctctgagtc

SEQ ID NO: 8263986 - DNA, 22 bp, Homo sapiens
tcctcaggatgtggagtagaat

SEQ ID NO: 8263987 - DNA, 22 bp, Homo sapiens
tcctcagctttggtttactcat

SEQ ID NO: 8263988 - DNA, 22 bp, Homo sapiens
tcctcaggctgcctggaagact

SEQ ID NO: 8263989 - DNA, 20 bp, Homo sapiens
catttgggatcatgaggttt

SEQ ID NO: 8263990 - DNA, 22 bp, Homo sapiens
tccagagagccacggacagggg

SEQ ID NO: 8263991 - DNA, 22 bp, Homo sapiens
tccagccctgtgtctgggagag

SEQ ID NO: 8263992 - DNA, 22 bp, Homo sapiens
tccagccctgtgtctgggagag

SEQ ID NO: 8263993 - DNA, 22 bp, Homo sapiens
tccagctgacatctcctgaggg

SEQ ID NO: 8263994 - DNA, 22 bp, Homo sapiens
tccaggcccgagatgggctgga

SEQ ID NO: 8263995 - DNA, 22 bp, Homo sapiens
tccaggcccctgcctgggcctg

SEQ ID NO: 8263996 - DNA, 22 bp, Homo sapiens
tccaggccccagcaccttggga

SEQ ID NO: 8263997 - DNA, 22 bp, Homo sapiens
tccaggccccccacgctaatgg

SEQ ID NO: 8263998 - DNA, 22 bp, Homo sapiens
tccaggccccagaccgtactgc

SEQ ID NO: 8263999 - DNA, 22 bp, Homo sapiens
tccaggcccatagacacttctc

SEQ ID NO: 8264000 - DNA, 22 bp, Homo sapiens
tccaggccccactgaagcccct

SEQ ID NO: 8264001 - DNA, 22 bp, Homo sapiens
tccaggcccatggagcagagct

SEQ ID NO: 8264002 - DNA, 22 bp, Homo sapiens
tcatgagtttaaggtttaggct

SEQ ID NO: 8264003 - DNA, 22 bp, Homo sapiens
tccagaccaaggaaggctgggc

SEQ ID NO: 8264004 - DNA, 22 bp, Homo sapiens
tccacatgaccattgtgctcct

SEQ ID NO: 8264005 - DNA, 22 bp, Homo sapiens
tctcaactttgagaaacattgt

SEQ ID NO: 8264006 - DNA, 22 bp, Homo sapiens
tcctgaattgttgagaagcagc

SEQ ID NO: 8264007 - DNA, 22 bp, Homo sapiens
tcctgaatttcccagcatgaac

SEQ ID NO: 8264008 - DNA, 22 bp, Homo sapiens
tcctgaatgagttgatcacaat

SEQ ID NO: 8264009 - DNA, 22 bp, Homo sapiens
tcctgaatccaggagagtaggg

SEQ ID NO: 8264010 - DNA, 22 bp, Homo sapiens
tcctgaataaattagctgtcac

SEQ ID NO: 8264011 - DNA, 20 bp, Homo sapiens
tcctgaatttcctttctgct

SEQ ID NO: 8264012 - DNA, 22 bp, Homo sapiens
tctgaattctgacaatttgaat

SEQ ID NO: 8264013 - DNA, 22 bp, Homo sapiens
ccagcatgagacgatgatgaag

SEQ ID NO: 8264014 - DNA, 18 bp, Homo sapiens
ccagcatgccagaggctg

SEQ ID NO: 8264015 - DNA, 18 bp, Homo sapiens
tctgaatattatgcagtg

SEQ ID NO: 8264016 - DNA, 22 bp, Homo sapiens
tctgaatagagagaggtccttt

SEQ ID NO: 8264017 - DNA, 22 bp, Homo sapiens
tctgaatagtatattgaaagca

SEQ ID NO: 8264018 - DNA, 22 bp, Homo sapiens
tctgaatagttctattttaaag

SEQ ID NO: 8264019 - DNA, 22 bp, Homo sapiens
tctgaatatgtttatcatctct

SEQ ID NO: 8264020 - DNA, 22 bp, Homo sapiens
tctgaataatgtccttgtatca

SEQ ID NO: 8264021 - DNA, 22 bp, Homo sapiens
ccagccctcactgaggcctctc

SEQ ID NO: 8264022 - DNA, 22 bp, Homo sapiens
ccagccctgcctctcagggccc

SEQ ID NO: 8264023 - DNA, 20 bp, Homo sapiens
ccagcatgtacacatgtgga

SEQ ID NO: 8264024 - DNA, 22 bp, Homo sapiens
ccagccctgtcaccaactggag

SEQ ID NO: 8264025 - DNA, 22 bp, Homo sapiens
ccagcagagtctaggaaggagg

SEQ ID NO: 8264026 - DNA, 22 bp, Homo sapiens
ccagcagagggtcttggccatt

SEQ ID NO: 8264027 - DNA, 22 bp, Homo sapiens
ccagcagagttggtttctggta

SEQ ID NO: 8264028 - DNA, 22 bp, Homo sapiens
ccagcagcagcgtccaaggaga

SEQ ID NO: 8264029 - DNA, 22 bp, Homo sapiens
ccagcagccagagaaggacctc

SEQ ID NO: 8264030 - DNA, 22 bp, Homo sapiens
ccagcagccaccttctcgaaat

SEQ ID NO: 8264031 - DNA, 22 bp, Homo sapiens
ccagcagcaggccaggccctcc

SEQ ID NO: 8264032 - DNA, 22 bp, Homo sapiens
ccagcagcatcctgcagcactt

SEQ ID NO: 8264033 - DNA, 22 bp, Homo sapiens
ccagcagccctcttccaagact

SEQ ID NO: 8264034 - DNA, 22 bp, Homo sapiens
ccagcagcgatagggtgagtgc

SEQ ID NO: 8264035 - DNA, 22 bp, Homo sapiens
ccagcagcccacaggcgtccct

SEQ ID NO: 8264036 - DNA, 22 bp, Homo sapiens
ccagcagcccctcaatgatctg

SEQ ID NO: 8264037 - DNA, 22 bp, Homo sapiens
ccagcagctgctatgtggtttt

SEQ ID NO: 8264038 - DNA, 22 bp, Homo sapiens
ccagcagctgcaaagcctgggt

SEQ ID NO: 8264039 - DNA, 22 bp, Homo sapiens
ccagcagctgacaccagtccca

SEQ ID NO: 8264040 - DNA, 22 bp, Homo sapiens
ccagcagctcagctactggtca

SEQ ID NO: 8264041 - DNA, 21 bp, Homo sapiens
ccagcagctcaaggatctctt

SEQ ID NO: 8264042 - DNA, 22 bp, Homo sapiens
ccagcagctccctcagggtccg

SEQ ID NO: 8264043 - DNA, 22 bp, Homo sapiens
ccagcagctgtggctttgcctc

SEQ ID NO: 8264044 - DNA, 22 bp, Homo sapiens
ccagcagctttattggctctcc

SEQ ID NO: 8264045 - DNA, 22 bp, Homo sapiens
ccagcactctgtcccagcttcc

SEQ ID NO: 8264046 - DNA, 23 bp, Homo sapiens
tctcctggctgcactgtggccac

SEQ ID NO: 8264047 - DNA, 22 bp, Homo sapiens
tctttattttatgcttgtgcaa

SEQ ID NO: 8264048 - DNA, 22 bp, Homo sapiens
tctttatttctgaatcccccat

SEQ ID NO: 8264049 - DNA, 22 bp, Homo sapiens
tctttaatatctgccccagagc

SEQ ID NO: 8264050 - DNA, 22 bp, Homo sapiens
tctttaaagttggagcttgcaa

SEQ ID NO: 8264051 - DNA, 22 bp, Homo sapiens
ccagcccttgagatggaaggga

SEQ ID NO: 8264052 - DNA, 22 bp, Homo sapiens
ccagggtgtgggcgtcggcacg

SEQ ID NO: 8264053 - DNA, 22 bp, Homo sapiens
tgagcccaggagttggaggctg

SEQ ID NO: 8264054 - DNA, 22 bp, Homo sapiens
tgaccagtgatctactgggatt

SEQ ID NO: 8264055 - DNA, 21 bp, Homo sapiens
tgaccagtgccccatcctgtc

SEQ ID NO: 8264056 - DNA, 22 bp, Homo sapiens
tgaccagttaagtcatcctgtc

SEQ ID NO: 8264057 - DNA, 22 bp, Homo sapiens
tgactttacagatatgtttcct

SEQ ID NO: 8264058 - DNA, 22 bp, Homo sapiens
tgacagagcaagatcttatctc

SEQ ID NO: 8264059 - DNA, 22 bp, Homo sapiens
tgacagagcaagatctagataa

SEQ ID NO: 8264060 - DNA, 21 bp, Homo sapiens
ccagggaagaaatgagggcag

SEQ ID NO: 8264061 - DNA, 22 bp, Homo sapiens
cccaggagacagaaacagaggt

SEQ ID NO: 8264062 - DNA, 22 bp, Homo sapiens
cccaggaggacattccataccc

SEQ ID NO: 8264063 - DNA, 22 bp, Homo sapiens
cccaggagataacgttcccaag

SEQ ID NO: 8264064 - DNA, 22 bp, Homo sapiens
cccaggaggcagagatagcagt

SEQ ID NO: 8264065 - DNA, 22 bp, Homo sapiens
cccaggaggcctgcctggccgg

SEQ ID NO: 8264066 - DNA, 22 bp, Homo sapiens
cccaggaggcagaggttggagc

SEQ ID NO: 8264067 - DNA, 19 bp, Homo sapiens
cccaggagtctggctggtt

SEQ ID NO: 8264068 - DNA, 19 bp, Homo sapiens
cccaggaggcggaggttgc

SEQ ID NO: 8264069 - DNA, 21 bp, Homo sapiens
cccaggaggctgagaagagca

SEQ ID NO: 8264070 - DNA, 22 bp, Homo sapiens
tgccctcagcagcagctcctgc

SEQ ID NO: 8264071 - DNA, 21 bp, Homo sapiens
cccaggagaagaaaagatgca

SEQ ID NO: 8264072 - DNA, 22 bp, Homo sapiens
cccagctccaagggacagcgaa

SEQ ID NO: 8264073 - DNA, 22 bp, Homo sapiens
cccagctcaagcagagagctaa

SEQ ID NO: 8264074 - DNA, 22 bp, Homo sapiens
cccagcccccgagtgtctggaa

SEQ ID NO: 8264075 - DNA, 20 bp, Homo sapiens
cccagcccgggccgcgctcg

SEQ ID NO: 8264076 - DNA, 20 bp, Homo sapiens
cccagcccctacctgttgcc

SEQ ID NO: 8264077 - DNA, 22 bp, Homo sapiens
cccagcccacggtcctgggtgg

SEQ ID NO: 8264078 - DNA, 22 bp, Homo sapiens
cccagcatggagtgaggactca

SEQ ID NO: 8264079 - DNA, 22 bp, Homo sapiens
cccagcagtaaccagtggaaat

SEQ ID NO: 8264080 - DNA, 22 bp, Homo sapiens
cccagcaggtgccatcactctg

SEQ ID NO: 8264081 - DNA, 22 bp, Homo sapiens
cccagccagcctcttcccatat

SEQ ID NO: 8264082 - DNA, 22 bp, Homo sapiens
cccagccaagtgatctgaccgc

SEQ ID NO: 8264083 - DNA, 22 bp, Homo sapiens
cccagccaagtgatctgaccgc

SEQ ID NO: 8264084 - DNA, 22 bp, Homo sapiens
cccagccaaggtgctggtgttg

SEQ ID NO: 8264085 - DNA, 23 bp, Homo sapiens
cccagcagattgtaaagtgtcca

SEQ ID NO: 8264086 - DNA, 22 bp, Homo sapiens
cccagcagccagaatgaggagc

SEQ ID NO: 8264087 - DNA, 22 bp, Homo sapiens
tgcagcagtgttccttggcttg

SEQ ID NO: 8264088 - DNA, 22 bp, Homo sapiens
cccagcagaatctgatgagggc

SEQ ID NO: 8264089 - DNA, 22 bp, Homo sapiens
cccagcagaccgctgtgatggc

SEQ ID NO: 8264090 - DNA, 23 bp, Homo sapiens
cccagcagagatgaggaggggtc

SEQ ID NO: 8264091 - DNA, 22 bp, Homo sapiens
cccagcagatggctatgtgcta

SEQ ID NO: 8264092 - DNA, 22 bp, Homo sapiens
cccagagatctactgagcccag

SEQ ID NO: 8264093 - DNA, 22 bp, Homo sapiens
tgaggcagtcaccccctcctgc

SEQ ID NO: 8264094 - DNA, 22 bp, Homo sapiens
tgaggcagtattttagtgactt

SEQ ID NO: 8264095 - DNA, 22 bp, Homo sapiens
tgaggcaggtggattacaaggt

SEQ ID NO: 8264096 - DNA, 22 bp, Homo sapiens
tgaggcagtattctccattcca

SEQ ID NO: 8264097 - DNA, 22 bp, Homo sapiens
tgaggcaggtaagcaagttttg

SEQ ID NO: 8264098 - DNA, 21 bp, Homo sapiens
tgaggcaggggtgcttttgtc

SEQ ID NO: 8264099 - DNA, 18 bp, Homo sapiens
tgaggcagtcagtgatgg

SEQ ID NO: 8264100 - DNA, 22 bp, Homo sapiens
tgaggcagtgatgtttaagcac

SEQ ID NO: 8264101 - DNA, 22 bp, Homo sapiens
tgatacataaaccatcattttg

SEQ ID NO: 8264102 - DNA, 22 bp, Homo sapiens
ccatggccaattgcaccttgct

SEQ ID NO: 8264103 - DNA, 22 bp, Homo sapiens
cccaagcagggtgcagaggcat

SEQ ID NO: 8264104 - DNA, 22 bp, Homo sapiens
ccctggtgccctgggtcagcct

SEQ ID NO: 8264105 - DNA, 22 bp, Homo sapiens
cctcagctgtcttttccgaggt

SEQ ID NO: 8264106 - DNA, 22 bp, Homo sapiens
cctcagctgcttccctggagcc

SEQ ID NO: 8264107 - DNA, 22 bp, Homo sapiens
cctcagctgcttccctggagcc

SEQ ID NO: 8264108 - DNA, 22 bp, Homo sapiens
cctcagctcttccctgtgcaca

SEQ ID NO: 8264109 - DNA, 22 bp, Homo sapiens
cctcagcatcctggtgaagtag

SEQ ID NO: 8264110 - DNA, 22 bp, Homo sapiens
cctcagccttggccccaggcag

SEQ ID NO: 8264111 - DNA, 22 bp, Homo sapiens
cctcactgaagaggtgacattt

SEQ ID NO: 8264112 - DNA, 22 bp, Homo sapiens
tggcctcaatctgtcctccagc

SEQ ID NO: 8264113 - DNA, 19 bp, Homo sapiens
tggaggggtttgaatgtgg

SEQ ID NO: 8264114 - DNA, 22 bp, Homo sapiens
ccctgccttgttggagcctatg

SEQ ID NO: 8264115 - DNA, 22 bp, Homo sapiens
tggaggggcaatggagcgcgga

SEQ ID NO: 8264116 - DNA, 22 bp, Homo sapiens
ccctgcagaccaatgccataga

SEQ ID NO: 8264117 - DNA, 22 bp, Homo sapiens
ccctgcagagccagccctgacc

SEQ ID NO: 8264118 - DNA, 22 bp, Homo sapiens
tggacaggtgcacacagcagcc

SEQ ID NO: 8264119 - DNA, 22 bp, Homo sapiens
ccctgcagccggccagctcatt

SEQ ID NO: 8264120 - DNA, 23 bp, Homo sapiens
ccctgcagtcagggtgagatggt

SEQ ID NO: 8264121 - DNA, 22 bp, Homo sapiens
cccgggaggaggaagttgcagt

SEQ ID NO: 8264122 - DNA, 22 bp, Homo sapiens
cccgggaggtggagactgcagt

SEQ ID NO: 8264123 - DNA, 22 bp, Homo sapiens
tgcttgtctcagataaaactat

SEQ ID NO: 8264124 - DNA, 22 bp, Homo sapiens
tgcttgtctctctgtgcccact

SEQ ID NO: 8264125 - DNA, 22 bp, Homo sapiens
tgcttgtccgaggtgagtactt

SEQ ID NO: 8264126 - DNA, 22 bp, Homo sapiens
tgggagcaggtgtgctagggaa

SEQ ID NO: 8264127 - DNA, 22 bp, Homo sapiens
tgggagcaggtgtgctagggaa

SEQ ID NO: 8264128 - DNA, 22 bp, Homo sapiens
tggctctctacaggtcaagacc

SEQ ID NO: 8264129 - DNA, 22 bp, Homo sapiens
tggctctcttgtaaggtagtag

SEQ ID NO: 8264130 - DNA, 22 bp, Homo sapiens
cctgaataggctctgctcaaaa

SEQ ID NO: 8264131 - DNA, 22 bp, Homo sapiens
cctgaataatttgtgaaaagat

SEQ ID NO: 8264132 - DNA, 22 bp, Homo sapiens
cctgaatactggtgctgaaagt

SEQ ID NO: 8264133 - DNA, 22 bp, Homo sapiens
cctgcacttctcacagctgctg

SEQ ID NO: 8264134 - DNA, 22 bp, Homo sapiens
tgggggagagaggcattctttc

SEQ ID NO: 8264135 - DNA, 22 bp, Homo sapiens
tggggtagggaaaagaagtcga

SEQ ID NO: 8264136 - DNA, 22 bp, Homo sapiens
tggggtaggtatgaaaactagg

SEQ ID NO: 8264137 - DNA, 22 bp, Homo sapiens
tggggtaggagtcagcgagaga

SEQ ID NO: 8264138 - DNA, 22 bp, Homo sapiens
tgtcaagtctctgaatgaaatg

SEQ ID NO: 8264139 - DNA, 22 bp, Homo sapiens
tgtcaagttgtggcatgtctaa

SEQ ID NO: 8264140 - DNA, 22 bp, Homo sapiens
tgtcaagttgttaagttctggg

SEQ ID NO: 8264141 - DNA, 22 bp, Homo sapiens
tgtcaactgtgatgtcaacact

SEQ ID NO: 8264142 - DNA, 22 bp, Homo sapiens
tgtattcagtgatttcacaata

SEQ ID NO: 8264143 - DNA, 22 bp, Homo sapiens
tgtattcagtgcctagcatatg

SEQ ID NO: 8264144 - DNA, 22 bp, Homo sapiens
tgtattcatgtgagcctaggaa

SEQ ID NO: 8264145 - DNA, 22 bp, Homo sapiens
cctggaggggaccaggaccagg

SEQ ID NO: 8264146 - DNA, 22 bp, Homo sapiens
cctggagggaccctggccctgt

SEQ ID NO: 8264147 - DNA, 22 bp, Homo sapiens
cctggaggagcgctgaccagct

SEQ ID NO: 8264148 - DNA, 22 bp, Homo sapiens
cctggagcttggtcacgctgcg

SEQ ID NO: 8264149 - DNA, 22 bp, Homo sapiens
tggtctgaaggtggatttgaga

SEQ ID NO: 8264150 - DNA, 22 bp, Homo sapiens
cctgcctgtccctcagtccaca

SEQ ID NO: 8264151 - DNA, 23 bp, Homo sapiens
cctgcctgttctaactccatttc

SEQ ID NO: 8264152 - DNA, 22 bp, Homo sapiens
ctgctgagaaaagactgaggga

SEQ ID NO: 8264153 - DNA, 22 bp, Homo sapiens
ctgctgagaaccagggagaatt

SEQ ID NO: 8264154 - DNA, 22 bp, Homo sapiens
ctgctgagactggctttgtgtc

SEQ ID NO: 8264155 - DNA, 22 bp, Homo sapiens
ctgctgagcatcagggctgccc

SEQ ID NO: 8264156 - DNA, 22 bp, Homo sapiens
ctgctgagatgccaggagctct

SEQ ID NO: 8264157 - DNA, 22 bp, Homo sapiens
ctgctgagagccacgtggcaca

SEQ ID NO: 8264158 - DNA, 22 bp, Homo sapiens
ctgctgagagccccagctgaga

SEQ ID NO: 8264159 - DNA, 20 bp, Homo sapiens
ctgctgagagcctggcttgc

SEQ ID NO: 8264160 - DNA, 22 bp, Homo sapiens
ctgctgagatgccaggagctct

SEQ ID NO: 8264161 - DNA, 22 bp, Homo sapiens
ctgctgagagctgaaggctgta

SEQ ID NO: 8264162 - DNA, 22 bp, Homo sapiens
ctgctgggtctatgcaagtgga

SEQ ID NO: 8264163 - DNA, 19 bp, Homo sapiens
ctgctgggtgctgagggag

SEQ ID NO: 8264164 - DNA, 21 bp, Homo sapiens
ctgctctgacagtgaggccag

SEQ ID NO: 8264165 - DNA, 22 bp, Homo sapiens
ctgcctgttttctgatagattt

SEQ ID NO: 8264166 - DNA, 22 bp, Homo sapiens
ctgcctggggaatgtgaggatt

SEQ ID NO: 8264167 - DNA, 22 bp, Homo sapiens
ctgcctggggaatgtgaggatt

SEQ ID NO: 8264168 - DNA, 22 bp, Homo sapiens
ctggagaggctgggaacaggtt

SEQ ID NO: 8264169 - DNA, 22 bp, Homo sapiens
ctggagaggccccaagatattt

SEQ ID NO: 8264170 - DNA, 22 bp, Homo sapiens
ctggagagggagctgttggaag

SEQ ID NO: 8264171 - DNA, 22 bp, Homo sapiens
ctggagagttggaagatggact

SEQ ID NO: 8264172 - DNA, 22 bp, Homo sapiens
ctggagcaggcttgtcccagct

SEQ ID NO: 8264173 - DNA, 22 bp, Homo sapiens
ctggagcaggtttaggagtccc

SEQ ID NO: 8264174 - DNA, 22 bp, Homo sapiens
ctggagccccaggctgtgcaga

SEQ ID NO: 8264175 - DNA, 22 bp, Homo sapiens
ctggagccggaccagggacggt

SEQ ID NO: 8264176 - DNA, 22 bp, Homo sapiens
ctggagccctgaatgggcagga

SEQ ID NO: 8264177 - DNA, 22 bp, Homo sapiens
ctggagccgcatggagcaggga

SEQ ID NO: 8264178 - DNA, 22 bp, Homo sapiens
ctggagcctaggttgacctggg

SEQ ID NO: 8264179 - DNA, 17 bp, Homo sapiens
ctggagcctccaactcc

SEQ ID NO: 8264180 - DNA, 22 bp, Homo sapiens
ctggagcctgcagttttcactt

SEQ ID NO: 8264181 - DNA, 22 bp, Homo sapiens
ctggagccggcgagccccagcc

SEQ ID NO: 8264182 - DNA, 22 bp, Homo sapiens
ctggagagaccgaaagaggctg

SEQ ID NO: 8264183 - DNA, 18 bp, Homo sapiens
ctgccatgtcctactgtc

SEQ ID NO: 8264184 - DNA, 22 bp, Homo sapiens
ctgccatgtgtgaaaggggagg

SEQ ID NO: 8264185 - DNA, 22 bp, Homo sapiens
ctgcccagattttaccacctgc

SEQ ID NO: 8264186 - DNA, 22 bp, Homo sapiens
ctgccccaggcctcgggaggag

SEQ ID NO: 8264187 - DNA, 17 bp, Homo sapiens
ctgaggggagtgctgtg

SEQ ID NO: 8264188 - DNA, 22 bp, Homo sapiens
ctgagcagtggttcttgagcgc

SEQ ID NO: 8264189 - DNA, 22 bp, Homo sapiens
ctccaggccagggaagtggaca

SEQ ID NO: 8264190 - DNA, 22 bp, Homo sapiens
tttatgattattttaaagcagc

SEQ ID NO: 8264191 - DNA, 22 bp, Homo sapiens
ctctctggtttcagcgaagggg

SEQ ID NO: 8264192 - DNA, 22 bp, Homo sapiens
ctctgggtgtcttaggagctca

SEQ ID NO: 8264193 - DNA, 22 bp, Homo sapiens
ctctgggtggtctcactgagtg

SEQ ID NO: 8264194 - DNA, 23 bp, Homo sapiens
tttgttcatcattagagtctagc

SEQ ID NO: 8264195 - DNA, 21 bp, Homo sapiens
tttgttcatagctcactcttt

SEQ ID NO: 8264196 - DNA, 22 bp, Homo sapiens
ctctgagtagatagggaacctg

SEQ ID NO: 8264197 - DNA, 22 bp, Homo sapiens
ctctgagttgaggcaggagagt

SEQ ID NO: 8264198 - DNA, 22 bp, Homo sapiens
ctctgaggtctaggaccatggc

SEQ ID NO: 8264199 - DNA, 22 bp, Homo sapiens
ctctgaggttccctgggtccca

SEQ ID NO: 8264200 - DNA, 22 bp, Homo sapiens
ctctgcagagcctccagcccag

SEQ ID NO: 8264201 - DNA, 22 bp, Homo sapiens
tttgaaaatttaagtgctacac

SEQ ID NO: 8264202 - DNA, 21 bp, Homo sapiens
ctctgaatcctgcttctcagt

SEQ ID NO: 8264203 - DNA, 22 bp, Homo sapiens
cggcagcaaaggaagccaggtc

SEQ ID NO: 8264204 - DNA, 22 bp, Homo sapiens
cggcagggctccatgcatttct

SEQ ID NO: 8264205 - DNA, 22 bp, Homo sapiens
cggcagggttggttttctctga

SEQ ID NO: 8264206 - DNA, 18 bp, Homo sapiens
cggcagagtgcttctagc

SEQ ID NO: 8264207 - DNA, 22 bp, Homo sapiens
cggcagagtgtgtgcgtgcatg

SEQ ID NO: 8264208 - DNA, 22 bp, Homo sapiens
cggcagagcttcctgctcagcg

SEQ ID NO: 8264209 - DNA, 22 bp, Homo sapiens
cggcagagcggcgagcccctcc

SEQ ID NO: 8264210 - DNA, 22 bp, Homo sapiens
cggcagagacggcgctttgaac

SEQ ID NO: 8264211 - DNA, 22 bp, Homo sapiens
cggcagagccctgagtcagcct

SEQ ID NO: 8264212 - DNA, 22 bp, Homo sapiens
cggggcaggagtccctgtagag

SEQ ID NO: 8264213 - DNA, 22 bp, Homo sapiens
cgggctggctgcagctgctgga

SEQ ID NO: 8264214 - DNA, 22 bp, Homo sapiens
cggggaggcttcggattaaagc

SEQ ID NO: 8264215 - DNA, 22 bp, Homo sapiens
cggggagggcagaggctccctc

SEQ ID NO: 8264216 - DNA, 22 bp, Homo sapiens
cggggctgcgctcttcctgccg

SEQ ID NO: 8264217 - DNA, 22 bp, Homo sapiens
cggggctgctcgtcctcctgtg

SEQ ID NO: 8264218 - DNA, 22 bp, Homo sapiens
cggggctgacagcaggtgtgct

SEQ ID NO: 8264219 - DNA, 22 bp, Homo sapiens
cggggctgacagcaggtgtgct

SEQ ID NO: 8264220 - DNA, 22 bp, Homo sapiens
cggggctgaggcaacgcggaga

SEQ ID NO: 8264221 - DNA, 22 bp, Homo sapiens
cggggctggcacaggtgaccac

SEQ ID NO: 8264222 - DNA, 22 bp, Homo sapiens
cgtggtctcccacagaaagaag

SEQ ID NO: 8264223 - DNA, 22 bp, Homo sapiens
cgtgggagtggtgggtgctcag

SEQ ID NO: 8264224 - DNA, 22 bp, Homo sapiens
cgtgggaggaaaaatgggcttc

SEQ ID NO: 8264225 - DNA, 22 bp, Homo sapiens
cgagatccttcagagcgcggac

SEQ ID NO: 8264226 - DNA, 22 bp, Homo sapiens
ccttgcatctcatttcattctt

SEQ ID NO: 8264227 - DNA, 22 bp, Homo sapiens
ccttgcatatattatatctttg

SEQ ID NO: 8264228 - DNA, 22 bp, Homo sapiens
ccttgcatgtgctaacgacaag

SEQ ID NO: 8264229 - DNA, 22 bp, Homo sapiens
ccttgcatttaaaggcgtaggg

SEQ ID NO: 8264230 - DNA, 22 bp, Homo sapiens
ccttagtgaaacagaggcaatt

SEQ ID NO: 8264231 - DNA, 22 bp, Homo sapiens
ccttagtgtgaggggatacccc

SEQ ID NO: 8264232 - DNA, 22 bp, Homo sapiens
ccttagtgtgcctgaggcagat

SEQ ID NO: 8264233 - DNA, 22 bp, Homo sapiens
ctcagtctcttgggctgtgaag

SEQ ID NO: 8264234 - DNA, 22 bp, Homo sapiens
ctcagtctgtcttgtctgtgtt

SEQ ID NO: 8264235 - DNA, 19 bp, Homo sapiens
ctcagtctggctctgcctg

SEQ ID NO: 8264236 - DNA, 22 bp, Homo sapiens
ctcagtgcaaccaaagtgatct

SEQ ID NO: 8264237 - DNA, 22 bp, Homo sapiens
ctccagcctcatctcctggctg

SEQ ID NO: 8264238 - DNA, 23 bp, Homo sapiens
ttgcatggagcctgggattcctc

SEQ ID NO: 8264239 - DNA, 22 bp, Homo sapiens
ctcaggtagagtctgcatgggg

SEQ ID NO: 8264240 - DNA, 22 bp, Homo sapiens
ctcagggggaatcaggtcacag

SEQ ID NO: 8264241 - DNA, 22 bp, Homo sapiens
ctcaggagcttcctcagcccat

SEQ ID NO: 8264242 - DNA, 19 bp, Homo sapiens
ctcagctgtagctcatgtg

SEQ ID NO: 8264243 - DNA, 22 bp, Homo sapiens
ctcaggactttcaaatagaaat

SEQ ID NO: 8264244 - DNA, 22 bp, Homo sapiens
ttctggaaccagcctgcctggg

SEQ ID NO: 8264245 - DNA, 21 bp, Homo sapiens
ctcagagacaaatgccatccc

SEQ ID NO: 8264246 - DNA, 18 bp, Homo sapiens
ctcagagatgcccttatt

SEQ ID NO: 8264247 - DNA, 22 bp, Homo sapiens
ttctggctaccctcctaatgtt

SEQ ID NO: 8264248 - DNA, 18 bp, Homo sapiens
ttctggctcactcatgct

SEQ ID NO: 8264249 - DNA, 22 bp, Homo sapiens
ttctggctcgattctctgaccg

SEQ ID NO: 8264250 - DNA, 22 bp, Homo sapiens
ctataaatctacccagcattgg

SEQ ID NO: 8264251 - DNA, 22 bp, Homo sapiens
ctatactactatacagatgtaa

SEQ ID NO: 8264252 - DNA, 21 bp, Homo sapiens
ctgtggtacagctgggacgga

SEQ ID NO: 8264253 - DNA, 18 bp, Homo sapiens
ctgtgggctggtgcatga

SEQ ID NO: 8264254 - DNA, 22 bp, Homo sapiens
ctgtgggcttgaggttagacag

SEQ ID NO: 8264255 - DNA, 22 bp, Homo sapiens
ctgtggggaaagggtcctgctc

SEQ ID NO: 8264256 - DNA, 22 bp, Homo sapiens
ctgtgggctgaaagtgctcccg

SEQ ID NO: 8264257 - DNA, 22 bp, Homo sapiens
ctgtgggctcctgcagctcagg

SEQ ID NO: 8264258 - DNA, 22 bp, Homo sapiens
ctgtgggctcccagcttctctc

SEQ ID NO: 8264259 - DNA, 19 bp, Homo sapiens
ctgtgggcggaggaggggc

SEQ ID NO: 8264260 - DNA, 20 bp, Homo sapiens
ctgtgggcctcacttggggt

SEQ ID NO: 8264261 - DNA, 22 bp, Homo sapiens
ctgtgggcctgatgttcttctc

SEQ ID NO: 8264262 - DNA, 22 bp, Homo sapiens
ctgtgggcagctcctcctgtca

SEQ ID NO: 8264263 - DNA, 22 bp, Homo sapiens
ctgtgggcctagtctggcctag

SEQ ID NO: 8264264 - DNA, 22 bp, Homo sapiens
ctgtggagtttgtggcgctgac

SEQ ID NO: 8264265 - DNA, 22 bp, Homo sapiens
ctgtgaggcggaaaggactctc

SEQ ID NO: 8264266 - DNA, 22 bp, Homo sapiens
ctgtgaggcgggtggagtggag

SEQ ID NO: 8264267 - DNA, 22 bp, Homo sapiens
ctgtgagctgggtggccaggac

SEQ ID NO: 8264268 - DNA, 22 bp, Homo sapiens
ctgtccagtgcagagaacagag

SEQ ID NO: 8264269 - DNA, 22 bp, Homo sapiens
ctgtccagtgcagagaacagag

SEQ ID NO: 8264270 - DNA, 22 bp, Homo sapiens
ctgggagtgttctaggtcacat

SEQ ID NO: 8264271 - DNA, 22 bp, Homo sapiens
ctggagccttcaccaggggaaa

SEQ ID NO: 8264272 - DNA, 22 bp, Homo sapiens
ctggggtggatgggtccaagtt

SEQ ID NO: 8264273 - DNA, 22 bp, Homo sapiens
ctggggtatctgccacaactct

SEQ ID NO: 8264274 - DNA, 22 bp, Homo sapiens
ctggggtaggaggcagctgtgc

SEQ ID NO: 8264275 - DNA, 22 bp, Homo sapiens
ctggggggctactgacagagga

SEQ ID NO: 8264276 - DNA, 22 bp, Homo sapiens
ctggggggagctgcgtccagca

SEQ ID NO: 8264277 - DNA, 18 bp, Homo sapiens
ctgggctcgagagatcct

SEQ ID NO: 8264278 - DNA, 22 bp, Homo sapiens
ctggtcacctccttcccagcta

SEQ ID NO: 8264279 - DNA, 22 bp, Homo sapiens
ctggtgggtagagggcatcagg

SEQ ID NO: 8264280 - DNA, 22 bp, Homo sapiens
gaaacagcacgtttggagagat

SEQ ID NO: 8264281 - DNA, 22 bp, Homo sapiens
gaaacccaaactaagacagtag

SEQ ID NO: 8264282 - DNA, 20 bp, Homo sapiens
ctttggcaatgagaacaggg

SEQ ID NO: 8264283 - DNA, 22 bp, Homo sapiens
ctttggaggtcatagccaagag

SEQ ID NO: 8264284 - DNA, 22 bp, Homo sapiens
ctttggaggacctatgtgcaat

SEQ ID NO: 8264285 - DNA, 20 bp, Homo sapiens
ctttggagaaagatgcaata

SEQ ID NO: 8264286 - DNA, 22 bp, Homo sapiens
ctttggagaagaatgcatcctt

SEQ ID NO: 8264287 - DNA, 22 bp, Homo sapiens
cttggagcccagcaggcctgga

SEQ ID NO: 8264288 - DNA, 16 bp, Homo sapiens
cttcacagaggagagt

SEQ ID NO: 8264289 - DNA, 22 bp, Homo sapiens
cttcacagatgctgagagggct

SEQ ID NO: 8264290 - DNA, 22 bp, Homo sapiens
cttcccagcacctcagtctggc

SEQ ID NO: 8264291 - DNA, 22 bp, Homo sapiens
gagggtggggaatagactgcta

SEQ ID NO: 8264292 - DNA, 22 bp, Homo sapiens
gagggtggcctttagagcccat

SEQ ID NO: 8264293 - DNA, 22 bp, Homo sapiens
gagggtggagctccagaatctg

SEQ ID NO: 8264294 - DNA, 22 bp, Homo sapiens
gagggtggaagagctgctgaga

SEQ ID NO: 8264295 - DNA, 22 bp, Homo sapiens
gagtaatggccgtaggttggga

SEQ ID NO: 8264296 - DNA, 22 bp, Homo sapiens
gaggtgagaagggggtcagatg

SEQ ID NO: 8264297 - DNA, 22 bp, Homo sapiens
gaggtgagtggatcacgaggtc

SEQ ID NO: 8264298 - DNA, 22 bp, Homo sapiens
gaggtggctggctcagagccag

SEQ ID NO: 8264299 - DNA, 22 bp, Homo sapiens
gaggcctgtagtcatggatgta

SEQ ID NO: 8264300 - DNA, 19 bp, Homo sapiens
gaggcgaggcgtgcaggag

SEQ ID NO: 8264301 - DNA, 22 bp, Homo sapiens
gaggcgagaagctggagatggt

SEQ ID NO: 8264302 - DNA, 22 bp, Homo sapiens
gaggcctggtttgcatgagaat

SEQ ID NO: 8264303 - DNA, 22 bp, Homo sapiens
gaggcctggtctatgagatgtt

SEQ ID NO: 8264304 - DNA, 22 bp, Homo sapiens
gaggcggcggccgagcctggct

SEQ ID NO: 8264305 - DNA, 22 bp, Homo sapiens
gaggctgtaacttgggcactgg

SEQ ID NO: 8264306 - DNA, 22 bp, Homo sapiens
gagggaccccaggctggccctt

SEQ ID NO: 8264307 - DNA, 22 bp, Homo sapiens
gagggcctctgctgctccacat

SEQ ID NO: 8264308 - DNA, 22 bp, Homo sapiens
gagggccctggctggctccagc

SEQ ID NO: 8264309 - DNA, 22 bp, Homo sapiens
gaggagactgacagcagattct

SEQ ID NO: 8264310 - DNA, 22 bp, Homo sapiens
gaggacagtgtgatctgccagc

SEQ ID NO: 8264311 - DNA, 22 bp, Homo sapiens
gaggaccacagatgagcctgca

SEQ ID NO: 8264312 - DNA, 20 bp, Homo sapiens
gaggatgcagacagagggca

SEQ ID NO: 8264313 - DNA, 19 bp, Homo sapiens
gaggatgctcggtcccagg

SEQ ID NO: 8264314 - DNA, 22 bp, Homo sapiens
gaggagtggagttgctgggttg

SEQ ID NO: 8264315 - DNA, 22 bp, Homo sapiens
gaggatgctgcagtgcaggaca

SEQ ID NO: 8264316 - DNA, 18 bp, Homo sapiens
gaggatggaaggagatgc

SEQ ID NO: 8264317 - DNA, 22 bp, Homo sapiens
gaggatggaggcagttagggcc

SEQ ID NO: 8264318 - DNA, 22 bp, Homo sapiens
gaggatggaggcagttagggcc

SEQ ID NO: 8264319 - DNA, 22 bp, Homo sapiens
gaggagtctttttagggcctga

SEQ ID NO: 8264320 - DNA, 22 bp, Homo sapiens
gaggagtgccagccgtggagtc

SEQ ID NO: 8264321 - DNA, 22 bp, Homo sapiens
gaggcaacaatgatggtgtgta

SEQ ID NO: 8264322 - DNA, 22 bp, Homo sapiens
gaggcaactggaacactggtca

SEQ ID NO: 8264323 - DNA, 22 bp, Homo sapiens
gaggcaacttcctgtcctctcc

SEQ ID NO: 8264324 - DNA, 22 bp, Homo sapiens
gaggcaacattgagcttctgta

SEQ ID NO: 8264325 - DNA, 22 bp, Homo sapiens
gaggcaacacatttggaaagca

SEQ ID NO: 8264326 - DNA, 22 bp, Homo sapiens
gaggcaactgcttttcctcctt

SEQ ID NO: 8264327 - DNA, 22 bp, Homo sapiens
gaggatggtgagcaggacccag

SEQ ID NO: 8264328 - DNA, 22 bp, Homo sapiens
gaggatggtatgaggcaagcaa

SEQ ID NO: 8264329 - DNA, 22 bp, Homo sapiens
gaggcctgggttggaggtgcat

SEQ ID NO: 8264330 - DNA, 22 bp, Homo sapiens
gagctcagcccaaagagcagtg

SEQ ID NO: 8264331 - DNA, 22 bp, Homo sapiens
gagcaggcattctagtggctga

SEQ ID NO: 8264332 - DNA, 22 bp, Homo sapiens
gagcaggcaactctgcagtgcc

SEQ ID NO: 8264333 - DNA, 22 bp, Homo sapiens
gagcaggctctgcctgtgtgtc

SEQ ID NO: 8264334 - DNA, 22 bp, Homo sapiens
gagcaggctctgcctgtgtgtc

SEQ ID NO: 8264335 - DNA, 22 bp, Homo sapiens
gagcaggcctggggtgaggcct

SEQ ID NO: 8264336 - DNA, 22 bp, Homo sapiens
gagctgtgaaaagtgcctgggg

SEQ ID NO: 8264337 - DNA, 22 bp, Homo sapiens
gagctgtgagggacacattgct

SEQ ID NO: 8264338 - DNA, 22 bp, Homo sapiens
gagctgtgacacgcagcccagg

SEQ ID NO: 8264339 - DNA, 22 bp, Homo sapiens
gagctgtgccaatctgtctggg

SEQ ID NO: 8264340 - DNA, 22 bp, Homo sapiens
gagctgtggaaggcagggacca

SEQ ID NO: 8264341 - DNA, 22 bp, Homo sapiens
gagaggagtagacactttggtt

SEQ ID NO: 8264342 - DNA, 22 bp, Homo sapiens
gagaggagtaggctgatggtgc

SEQ ID NO: 8264343 - DNA, 22 bp, Homo sapiens
gagagacagcacacagtgtggg

SEQ ID NO: 8264344 - DNA, 22 bp, Homo sapiens
gagagactgatgtggctatgta

SEQ ID NO: 8264345 - DNA, 22 bp, Homo sapiens
gagagactgatgtggctatgta

SEQ ID NO: 8264346 - DNA, 22 bp, Homo sapiens
gagagactggaatgggctgtgg

SEQ ID NO: 8264347 - DNA, 22 bp, Homo sapiens
gagagactgggcagggccggca

SEQ ID NO: 8264348 - DNA, 18 bp, Homo sapiens
gagagcccagcaggtggt

SEQ ID NO: 8264349 - DNA, 22 bp, Homo sapiens
gagagccatggtggagatgggg

SEQ ID NO: 8264350 - DNA, 22 bp, Homo sapiens
gactcagtgatttgacatgcct

SEQ ID NO: 8264351 - DNA, 22 bp, Homo sapiens
gagcaggacagcagcttcctgg

SEQ ID NO: 8264352 - DNA, 22 bp, Homo sapiens
gagcaggaaggccagaagggtc

SEQ ID NO: 8264353 - DNA, 22 bp, Homo sapiens
gagcagagaatccagctaagtg

SEQ ID NO: 8264354 - DNA, 22 bp, Homo sapiens
gagcagagacagtacaactggc

SEQ ID NO: 8264355 - DNA, 22 bp, Homo sapiens
gagcacagtaaagcagtgtcac

SEQ ID NO: 8264356 - DNA, 22 bp, Homo sapiens
gagcagacgctgcagtcttggg

SEQ ID NO: 8264357 - DNA, 22 bp, Homo sapiens
gagcacagatcctggagccaca

SEQ ID NO: 8264358 - DNA, 22 bp, Homo sapiens
gagaggcaggaatcctgggtga

SEQ ID NO: 8264359 - DNA, 22 bp, Homo sapiens
gagcaacactccacattgctag

SEQ ID NO: 8264360 - DNA, 22 bp, Homo sapiens
gacagctcctttctgaggatga

SEQ ID NO: 8264361 - DNA, 22 bp, Homo sapiens
gacatcatggagaggacaaaca

SEQ ID NO: 8264362 - DNA, 22 bp, Homo sapiens
gacatgaatgttatactttatt

SEQ ID NO: 8264363 - DNA, 23 bp, Homo sapiens
gacaaagcacttgaaatgtgtac

SEQ ID NO: 8264364 - DNA, 22 bp, Homo sapiens
gacaaagcagacaagataattc

SEQ ID NO: 8264365 - DNA, 22 bp, Homo sapiens
gacaaagcctaagaagtattta

SEQ ID NO: 8264366 - DNA, 22 bp, Homo sapiens
gacaaagcgcctgctcgcgggc

SEQ ID NO: 8264367 - DNA, 22 bp, Homo sapiens
gacaaagctttggcatccttac

SEQ ID NO: 8264368 - DNA, 19 bp, Homo sapiens
gaatgggaatgggaaagct

SEQ ID NO: 8264369 - DNA, 22 bp, Homo sapiens
tataaactcctcttgcattcct

SEQ ID NO: 8264370 - DNA, 22 bp, Homo sapiens
tatcacagccttttggtgaggg

SEQ ID NO: 8264371 - DNA, 19 bp, Homo sapiens
tcaaaggcttttaggagac

SEQ ID NO: 8264372 - DNA, 22 bp, Homo sapiens
tcaaataccagcaatttcatgt

SEQ ID NO: 8264373 - DNA, 20 bp, Homo sapiens
tattgtgataggtgttaatc

SEQ ID NO: 8264374 - DNA, 22 bp, Homo sapiens
tattgtgatgaacacaaggctt

SEQ ID NO: 8264375 - DNA, 22 bp, Homo sapiens
tattgtgagttcagactaaaaa

SEQ ID NO: 8264376 - DNA, 22 bp, Homo sapiens
tattgtgaagggaaaaatagtg

SEQ ID NO: 8264377 - DNA, 22 bp, Homo sapiens
tattgtgaataatgccgcaata

SEQ ID NO: 8264378 - DNA, 22 bp, Homo sapiens
tattgtgagtataactgcattt

SEQ ID NO: 8264379 - DNA, 22 bp, Homo sapiens
tattgtgagggcaaagtttcta

SEQ ID NO: 8264380 - DNA, 22 bp, Homo sapiens
tattgtgacttttactgagtaa

SEQ ID NO: 8264381 - DNA, 22 bp, Homo sapiens
tattgtgaatagtgccgcaata

SEQ ID NO: 8264382 - DNA, 22 bp, Homo sapiens
tattgtgaatttggaagcaatg

SEQ ID NO: 8264383 - DNA, 22 bp, Homo sapiens
tagctgcctttgggctcctgct

SEQ ID NO: 8264384 - DNA, 22 bp, Homo sapiens
tagcaggggtagatagagtgtg

SEQ ID NO: 8264385 - DNA, 22 bp, Homo sapiens
tagcaaactcatacatgtgggt

SEQ ID NO: 8264386 - DNA, 20 bp, Homo sapiens
tagacttttcatcaacctta

SEQ ID NO: 8264387 - DNA, 22 bp, Homo sapiens
tagagtatagctaactgtatta

SEQ ID NO: 8264388 - DNA, 22 bp, Homo sapiens
tagagagagctgtggtggctct

SEQ ID NO: 8264389 - DNA, 22 bp, Homo sapiens
tagatataggacagtactgtat

SEQ ID NO: 8264390 - DNA, 22 bp, Homo sapiens
tagatataaggtccttagaaca

SEQ ID NO: 8264391 - DNA, 21 bp, Homo sapiens
tagatactgtattaaacctag

SEQ ID NO: 8264392 - DNA, 22 bp, Homo sapiens
tagggctgtggtcagtcctcta

SEQ ID NO: 8264393 - DNA, 22 bp, Homo sapiens
tagggctggcgtgctcagggaa

SEQ ID NO: 8264394 - DNA, 23 bp, Homo sapiens
tagggcagctgggagggacatgc

SEQ ID NO: 8264395 - DNA, 22 bp, Homo sapiens
tagggcagagtccaggatgggc

SEQ ID NO: 8264396 - DNA, 22 bp, Homo sapiens
tagggcagattcggtggagttt

SEQ ID NO: 8264397 - DNA, 21 bp, Homo sapiens
taggcagaggagcaggtatct

SEQ ID NO: 8264398 - DNA, 22 bp, Homo sapiens
tagctgtccagtgagtcccttt

SEQ ID NO: 8264399 - DNA, 22 bp, Homo sapiens
tagctgtgaaacagcagaagag

SEQ ID NO: 8264400 - DNA, 23 bp, Homo sapiens
taggggctggcgtggagcctgcg

SEQ ID NO: 8264401 - DNA, 22 bp, Homo sapiens
taggggagctcgggtgcaatcg

SEQ ID NO: 8264402 - DNA, 22 bp, Homo sapiens
taggggaggggatcatgtgctg

SEQ ID NO: 8264403 - DNA, 22 bp, Homo sapiens
taggggaggccaggaagtttta

SEQ ID NO: 8264404 - DNA, 22 bp, Homo sapiens
tactagaagctgtaatttttca

SEQ ID NO: 8264405 - DNA, 22 bp, Homo sapiens
taccatgaggacccctgtgtca

SEQ ID NO: 8264406 - DNA, 22 bp, Homo sapiens
taccatgagaatactaagagag

SEQ ID NO: 8264407 - DNA, 19 bp, Homo sapiens
taccatgaccctctttccc

SEQ ID NO: 8264408 - DNA, 22 bp, Homo sapiens
taccatgatcaggctcatcctt

SEQ ID NO: 8264409 - DNA, 22 bp, Homo sapiens
taccatgatgtttgagttacta

SEQ ID NO: 8264410 - DNA, 22 bp, Homo sapiens
taccatgtcaagcgagacatgt

SEQ ID NO: 8264411 - DNA, 22 bp, Homo sapiens
tacagtctctttgagtgattgt

SEQ ID NO: 8264412 - DNA, 22 bp, Homo sapiens
tacagtgcttggtatctagtaa

SEQ ID NO: 8264413 - DNA, 22 bp, Homo sapiens
tacagtggggagctcaggagag

SEQ ID NO: 8264414 - DNA, 22 bp, Homo sapiens
tacagtggtgacaatatggaca

SEQ ID NO: 8264415 - DNA, 22 bp, Homo sapiens
taaggagagaatttagaggttt

SEQ ID NO: 8264416 - DNA, 22 bp, Homo sapiens
taatataccaaactgtaatttt

SEQ ID NO: 8264417 - DNA, 22 bp, Homo sapiens
taatatacttcccatagtttga

SEQ ID NO: 8264418 - DNA, 22 bp, Homo sapiens
taatatatacctttgttaggaa

SEQ ID NO: 8264419 - DNA, 22 bp, Homo sapiens
taagcctgcatgaaccatgaga

SEQ ID NO: 8264420 - DNA, 22 bp, Homo sapiens
taattgctccaaggagaactaa

SEQ ID NO: 8264421 - DNA, 22 bp, Homo sapiens
taattgcagggagcctgggggc

SEQ ID NO: 8264422 - DNA, 21 bp, Homo sapiens
taatttattcagcacagtgtt

SEQ ID NO: 8264423 - DNA, 22 bp, Homo sapiens
tacaagctcacaaatttttaag

SEQ ID NO: 8264424 - DNA, 22 bp, Homo sapiens
taagacatgtccaggctgtgag

SEQ ID NO: 8264425 - DNA, 22 bp, Homo sapiens
taaatgtggagactcaggagtc

SEQ ID NO: 8264426 - DNA, 20 bp, Homo sapiens
taaagcagccgtggagggta

SEQ ID NO: 8264427 - DNA, 22 bp, Homo sapiens
taaagcagcgtgggtggggcag

SEQ ID NO: 8264428 - DNA, 22 bp, Homo sapiens
taaaacttctcatttttatggt

SEQ ID NO: 8264429 - DNA, 22 bp, Homo sapiens
taaaaggaggttgaagctgtca

SEQ ID NO: 8264430 - DNA, 22 bp, Homo sapiens
taaaaggattagcaggatgggc

SEQ ID NO: 8264431 - DNA, 22 bp, Homo sapiens
gtgttctgggatgattgtagtg

SEQ ID NO: 8264432 - DNA, 22 bp, Homo sapiens
gtgctggctgccaggaggctgc

SEQ ID NO: 8264433 - DNA, 22 bp, Homo sapiens
gtgctggcctcagagggtcatg

SEQ ID NO: 8264434 - DNA, 17 bp, Homo sapiens
gtgctggcctggggctc

SEQ ID NO: 8264435 - DNA, 22 bp, Homo sapiens
gttctggagtggtgccaggcct

SEQ ID NO: 8264436 - DNA, 22 bp, Homo sapiens
gtttatgaatgttactatagag

SEQ ID NO: 8264437 - DNA, 22 bp, Homo sapiens
gtttatgaatgtgtcagacata

SEQ ID NO: 8264438 - DNA, 22 bp, Homo sapiens
gtttatgaggaaaagttatgat

SEQ ID NO: 8264439 - DNA, 21 bp, Homo sapiens
gttcttgcaggatttccttcc

SEQ ID NO: 8264440 - DNA, 22 bp, Homo sapiens
tcattgctctaggttccttgga

SEQ ID NO: 8264441 - DNA, 22 bp, Homo sapiens
tcatttgtgcaatgtagatgaa

SEQ ID NO: 8264442 - DNA, 22 bp, Homo sapiens
tcatttgtctggcacagggaat

SEQ ID NO: 8264443 - DNA, 22 bp, Homo sapiens
tcagggcatcatcatgaatata

SEQ ID NO: 8264444 - DNA, 22 bp, Homo sapiens
tcagggcatactcttcaaggtc

SEQ ID NO: 8264445 - DNA, 22 bp, Homo sapiens
tcagtaaatgagcaaaaatttc

SEQ ID NO: 8264446 - DNA, 19 bp, Homo sapiens
tcagtctaggaatgagcta

SEQ ID NO: 8264447 - DNA, 22 bp, Homo sapiens
tcacagtgctctgggtggcaga

SEQ ID NO: 8264448 - DNA, 22 bp, Homo sapiens
tcaacgtttgttaaatgagtat

SEQ ID NO: 8264449 - DNA, 22 bp, Homo sapiens
tcacagtgacttacagagattg

SEQ ID NO: 8264450 - DNA, 22 bp, Homo sapiens
tcacatttgtgttttattagag

SEQ ID NO: 8264451 - DNA, 22 bp, Homo sapiens
tcacatttgcaattgcattgtt

SEQ ID NO: 8264452 - DNA, 23 bp, Homo sapiens
tcagaataataacctagtaactg

SEQ ID NO: 8264453 - DNA, 22 bp, Homo sapiens
tcagctgctctgttgagctgaa

SEQ ID NO: 8264454 - DNA, 22 bp, Homo sapiens
tcagctgcgacaggggcctgag

SEQ ID NO: 8264455 - DNA, 22 bp, Homo sapiens
tcagctgcctttcccatgctag

SEQ ID NO: 8264456 - DNA, 22 bp, Homo sapiens
tcagctgcctctccctggaaga

SEQ ID NO: 8264457 - DNA, 23 bp, Homo sapiens
tcagctgcttcctcctgcctgcc

SEQ ID NO: 8264458 - DNA, 20 bp, Homo sapiens
tcagattaaatgttctgtct

SEQ ID NO: 8264459 - DNA, 22 bp, Homo sapiens
tcctgagccctggggtcagtgt

SEQ ID NO: 8264460 - DNA, 22 bp, Homo sapiens
tcctgagcacctatgccatggc

SEQ ID NO: 8264461 - DNA, 22 bp, Homo sapiens
tcctgagattctgcatttctaa

SEQ ID NO: 8264462 - DNA, 22 bp, Homo sapiens
tcctgagatccttttagggatc

SEQ ID NO: 8264463 - DNA, 22 bp, Homo sapiens
tcctgagatgagacagtgctgc

SEQ ID NO: 8264464 - DNA, 23 bp, Homo sapiens
tcctgagatgagacagtgctgcc

SEQ ID NO: 8264465 - DNA, 22 bp, Homo sapiens
tcctgaggagaagagtgctagg

SEQ ID NO: 8264466 - DNA, 22 bp, Homo sapiens
tcctgaggaccctgtcaggggc

SEQ ID NO: 8264467 - DNA, 20 bp, Homo sapiens
tcctgagaggctcttggaga

SEQ ID NO: 8264468 - DNA, 22 bp, Homo sapiens
tcctgagagcagctgctttgga

SEQ ID NO: 8264469 - DNA, 22 bp, Homo sapiens
tcctgagacatctctgctggtc

SEQ ID NO: 8264470 - DNA, 19 bp, Homo sapiens
tcctgaaaacttctggaat

SEQ ID NO: 8264471 - DNA, 22 bp, Homo sapiens
tcctgcagagacagaggcctca

SEQ ID NO: 8264472 - DNA, 22 bp, Homo sapiens
tcctgcaggcttgagtcctcag

SEQ ID NO: 8264473 - DNA, 20 bp, Homo sapiens
tccctcaggtcattgggctg

SEQ ID NO: 8264474 - DNA, 22 bp, Homo sapiens
tccctcagggtgcagttgcttt

SEQ ID NO: 8264475 - DNA, 22 bp, Homo sapiens
tccctcaggtggttcttgtttc

SEQ ID NO: 8264476 - DNA, 22 bp, Homo sapiens
tccctcagtccctggacaggca

SEQ ID NO: 8264477 - DNA, 15 bp, Homo sapiens
tccctcagctaaaga

SEQ ID NO: 8264478 - DNA, 22 bp, Homo sapiens
tccctcagctcatatttatgcc

SEQ ID NO: 8264479 - DNA, 22 bp, Homo sapiens
tccctcagcttgtctccatgca

SEQ ID NO: 8264480 - DNA, 22 bp, Homo sapiens
tccctcaggacccaacttgtaa

SEQ ID NO: 8264481 - DNA, 23 bp, Homo sapiens
tccctcaggccttatctccatct

SEQ ID NO: 8264482 - DNA, 20 bp, Homo sapiens
tccctccctccagctctggg

SEQ ID NO: 8264483 - DNA, 22 bp, Homo sapiens
tccctccccacttctgagcttt

SEQ ID NO: 8264484 - DNA, 20 bp, Homo sapiens
tccctcagtcctggctttgt

SEQ ID NO: 8264485 - DNA, 19 bp, Homo sapiens
tccctcagtctgccaggcc

SEQ ID NO: 8264486 - DNA, 20 bp, Homo sapiens
tccctcagtttccagccctg

SEQ ID NO: 8264487 - DNA, 18 bp, Homo sapiens
tccctccctgctgtggcc

SEQ ID NO: 8264488 - DNA, 19 bp, Homo sapiens
tccctccctgtaatctcac

SEQ ID NO: 8264489 - DNA, 18 bp, Homo sapiens
tccctccctgctgtggcc

SEQ ID NO: 8264490 - DNA, 21 bp, Homo sapiens
tccctcagaagctcttggtca

SEQ ID NO: 8264491 - DNA, 21 bp, Homo sapiens
tccctcagaaggtagccaagc

SEQ ID NO: 8264492 - DNA, 22 bp, Homo sapiens
tccctcagacagatgtgttcct

SEQ ID NO: 8264493 - DNA, 18 bp, Homo sapiens
tccctcagaattatagaa

SEQ ID NO: 8264494 - DNA, 22 bp, Homo sapiens
tccctcagcaggaactggcctg

SEQ ID NO: 8264495 - DNA, 22 bp, Homo sapiens
tccctcagcaggaatgtggcag

SEQ ID NO: 8264496 - DNA, 20 bp, Homo sapiens
tccctcagcacttctacctc

SEQ ID NO: 8264497 - DNA, 22 bp, Homo sapiens
tccctcagattggcaattagat

SEQ ID NO: 8264498 - DNA, 21 bp, Homo sapiens
tccctcagacagggtgcctat

SEQ ID NO: 8264499 - DNA, 22 bp, Homo sapiens
tccctcagagaccgtggtgcag

SEQ ID NO: 8264500 - DNA, 22 bp, Homo sapiens
tccctcagagggcaagcgcaga

SEQ ID NO: 8264501 - DNA, 22 bp, Homo sapiens
tccctcagatgagctcctagca

SEQ ID NO: 8264502 - DNA, 22 bp, Homo sapiens
tcctcagcaaacacttcactct

SEQ ID NO: 8264503 - DNA, 22 bp, Homo sapiens
tcctcagcaggtctgtgtacca

SEQ ID NO: 8264504 - DNA, 22 bp, Homo sapiens
tccctgggaacaaaggatgaga

SEQ ID NO: 8264505 - DNA, 22 bp, Homo sapiens
tccaggcctgcctggtgtttgc

SEQ ID NO: 8264506 - DNA, 22 bp, Homo sapiens
tccaggcctggctccattcagt

SEQ ID NO: 8264507 - DNA, 22 bp, Homo sapiens
tccaggccttgacaggtcagtt

SEQ ID NO: 8264508 - DNA, 20 bp, Homo sapiens
tccaggccttgttctcagat

SEQ ID NO: 8264509 - DNA, 22 bp, Homo sapiens
tccaggcctttgcacatgttgt

SEQ ID NO: 8264510 - DNA, 22 bp, Homo sapiens
tccaggcctctagccctctctt

SEQ ID NO: 8264511 - DNA, 22 bp, Homo sapiens
tccaggcctctagcccctatct

SEQ ID NO: 8264512 - DNA, 22 bp, Homo sapiens
tccaggcctgcaatgacaaagc

SEQ ID NO: 8264513 - DNA, 22 bp, Homo sapiens
tccaggcctgactataaatgta

SEQ ID NO: 8264514 - DNA, 18 bp, Homo sapiens
tccaggcctgaagtgtcc

SEQ ID NO: 8264515 - DNA, 22 bp, Homo sapiens
tcccagcctggaccctgccagt

SEQ ID NO: 8264516 - DNA, 22 bp, Homo sapiens
tcccagcattaatgcctgtcag

SEQ ID NO: 8264517 - DNA, 22 bp, Homo sapiens
tcccagcataacaaactgcccg

SEQ ID NO: 8264518 - DNA, 22 bp, Homo sapiens
tcccaagatgacacagtggacg

SEQ ID NO: 8264519 - DNA, 21 bp, Homo sapiens
tcccaagaatatgcataagtt

SEQ ID NO: 8264520 - DNA, 22 bp, Homo sapiens
tccatgttaggtaaaggcactg

SEQ ID NO: 8264521 - DNA, 22 bp, Homo sapiens
tccatgttttctctgacaccta

SEQ ID NO: 8264522 - DNA, 22 bp, Homo sapiens
gccagctgaggccgtgcaggct

SEQ ID NO: 8264523 - DNA, 22 bp, Homo sapiens
gccagctgtaagctggggtgat

SEQ ID NO: 8264524 - DNA, 22 bp, Homo sapiens
gccagctgtaggtggtgggttg

SEQ ID NO: 8264525 - DNA, 22 bp, Homo sapiens
gcccaagccggagctgggagag

SEQ ID NO: 8264526 - DNA, 22 bp, Homo sapiens
gcccaagctggactgcagtggc

SEQ ID NO: 8264527 - DNA, 21 bp, Homo sapiens
gcctgcacacagtaggtgcac

SEQ ID NO: 8264528 - DNA, 22 bp, Homo sapiens
gcctggagaaaggaaggtggga

SEQ ID NO: 8264529 - DNA, 22 bp, Homo sapiens
gcctggagagcactgtgcgctt

SEQ ID NO: 8264530 - DNA, 22 bp, Homo sapiens
gcctggagtagcatggcaagcc

SEQ ID NO: 8264531 - DNA, 22 bp, Homo sapiens
gcctggagcccagtgtggggct

SEQ ID NO: 8264532 - DNA, 22 bp, Homo sapiens
gccctagcccgggccacctgtt

SEQ ID NO: 8264533 - DNA, 22 bp, Homo sapiens
gccctcagaggacagctgactt

SEQ ID NO: 8264534 - DNA, 22 bp, Homo sapiens
gccctcagaatgggctctaatc

SEQ ID NO: 8264535 - DNA, 22 bp, Homo sapiens
gccctcagaatgggctctaatc

SEQ ID NO: 8264536 - DNA, 22 bp, Homo sapiens
gcccacagaggcaccaccaggc

SEQ ID NO: 8264537 - DNA, 22 bp, Homo sapiens
gcccacaggggacctggtggct

SEQ ID NO: 8264538 - DNA, 23 bp, Homo sapiens
gccctgctcctggctgggaggga

SEQ ID NO: 8264539 - DNA, 22 bp, Homo sapiens
gccctgctgctggcagaggcgc

SEQ ID NO: 8264540 - DNA, 22 bp, Homo sapiens
gccctgctgtttagagagctac

SEQ ID NO: 8264541 - DNA, 22 bp, Homo sapiens
gccctgctgtcttcagagtata

SEQ ID NO: 8264542 - DNA, 22 bp, Homo sapiens
gccctgcttctggcatgcagaa

SEQ ID NO: 8264543 - DNA, 22 bp, Homo sapiens
gcctcagggggagaggccagct

SEQ ID NO: 8264544 - DNA, 22 bp, Homo sapiens
gcagaggtgtgggaggggccac

SEQ ID NO: 8264545 - DNA, 19 bp, Homo sapiens
gcagagtggggtggagggt

SEQ ID NO: 8264546 - DNA, 22 bp, Homo sapiens
gcagagtgatggaatgtgggtg

SEQ ID NO: 8264547 - DNA, 22 bp, Homo sapiens
gcagagtgaagggagaggtgtg

SEQ ID NO: 8264548 - DNA, 22 bp, Homo sapiens
gcaccagctgcagggtggctga

SEQ ID NO: 8264549 - DNA, 21 bp, Homo sapiens
gcacccagccggttctcccag

SEQ ID NO: 8264550 - DNA, 22 bp, Homo sapiens
gcagacagcatgttgggctatt

SEQ ID NO: 8264551 - DNA, 22 bp, Homo sapiens
gcaaggaggctggtggaggaag

SEQ ID NO: 8264552 - DNA, 22 bp, Homo sapiens
gcacagagagcagtgggggaca

SEQ ID NO: 8264553 - DNA, 22 bp, Homo sapiens
gcacatgcactgtgggggcaat

SEQ ID NO: 8264554 - DNA, 22 bp, Homo sapiens
gcacagagtgggtgagatgtgg

SEQ ID NO: 8264555 - DNA, 19 bp, Homo sapiens
gcaggccaggaggcggagg

SEQ ID NO: 8264556 - DNA, 22 bp, Homo sapiens
gcaggcccagagtcgctggcct

SEQ ID NO: 8264557 - DNA, 22 bp, Homo sapiens
gcaggccattcaggagatgtgc

SEQ ID NO: 8264558 - DNA, 22 bp, Homo sapiens
gcaggccagctgtgcagatggg

SEQ ID NO: 8264559 - DNA, 20 bp, Homo sapiens
gcaggccctctctctagtct

SEQ ID NO: 8264560 - DNA, 22 bp, Homo sapiens
gcaggccctcctctagcaaggc

SEQ ID NO: 8264561 - DNA, 19 bp, Homo sapiens
gcaggcccagtcgggctgg

SEQ ID NO: 8264562 - DNA, 19 bp, Homo sapiens
gcaggcccagtcgggctgg

SEQ ID NO: 8264563 - DNA, 22 bp, Homo sapiens
gcaggcccttagccttggtggg

SEQ ID NO: 8264564 - DNA, 22 bp, Homo sapiens
gcaggcccttagccttggtggg

SEQ ID NO: 8264565 - DNA, 22 bp, Homo sapiens
gcagggccagggctcaggctgt

SEQ ID NO: 8264566 - DNA, 22 bp, Homo sapiens
gcagggccagtgcagagaggaa

SEQ ID NO: 8264567 - DNA, 22 bp, Homo sapiens
gcagggccaggtacaagaagca

SEQ ID NO: 8264568 - DNA, 19 bp, Homo sapiens
gcaggtcattaggctaggt

SEQ ID NO: 8264569 - DNA, 22 bp, Homo sapiens
gcaggtagtgatcgagggtgac

SEQ ID NO: 8264570 - DNA, 20 bp, Homo sapiens
gcaggtccctggcatgcaga

SEQ ID NO: 8264571 - DNA, 22 bp, Homo sapiens
gcagcccaagcctgagcatcct

SEQ ID NO: 8264572 - DNA, 22 bp, Homo sapiens
gcagcccaaaaaagaggtagat

SEQ ID NO: 8264573 - DNA, 22 bp, Homo sapiens
gcagcccacagctggaggccta

SEQ ID NO: 8264574 - DNA, 22 bp, Homo sapiens
gcagcagccactattctggcat

SEQ ID NO: 8264575 - DNA, 22 bp, Homo sapiens
gcagcagcccagggctctcaga

SEQ ID NO: 8264576 - DNA, 22 bp, Homo sapiens
gcagcagcaggcgctcggccgt

SEQ ID NO: 8264577 - DNA, 19 bp, Homo sapiens
gcagcagcatttggtaata

SEQ ID NO: 8264578 - DNA, 22 bp, Homo sapiens
gcagcagcagcaattttctgtc

SEQ ID NO: 8264579 - DNA, 22 bp, Homo sapiens
gcagcagcaagaaggttggact

SEQ ID NO: 8264580 - DNA, 22 bp, Homo sapiens
gcagcactgtcttgtcttagga

SEQ ID NO: 8264581 - DNA, 22 bp, Homo sapiens
gcagcagaaggccaaggggagc

SEQ ID NO: 8264582 - DNA, 20 bp, Homo sapiens
ggagctgccctgggctggag

SEQ ID NO: 8264583 - DNA, 22 bp, Homo sapiens
ggagctgtctgtagggcacagg

SEQ ID NO: 8264584 - DNA, 22 bp, Homo sapiens
ggaggaggggcgctttgtctat

SEQ ID NO: 8264585 - DNA, 18 bp, Homo sapiens
ggagcccacggcgtccca

SEQ ID NO: 8264586 - DNA, 23 bp, Homo sapiens
ggagcctggcatatgagacgcat

SEQ ID NO: 8264587 - DNA, 22 bp, Homo sapiens
ggagaaagtacagcaggcaaca

SEQ ID NO: 8264588 - DNA, 22 bp, Homo sapiens
ggaaggagcatttgccagttta

SEQ ID NO: 8264589 - DNA, 18 bp, Homo sapiens
ggaaggagtggaccccag

SEQ ID NO: 8264590 - DNA, 22 bp, Homo sapiens
ggacaggatgctgaagatgaag

SEQ ID NO: 8264591 - DNA, 22 bp, Homo sapiens
ggacagagggttgacagagtat

SEQ ID NO: 8264592 - DNA, 18 bp, Homo sapiens
ggacaggagacatgggtg

SEQ ID NO: 8264593 - DNA, 22 bp, Homo sapiens
ggacaggccctctggtcagctt

SEQ ID NO: 8264594 - DNA, 22 bp, Homo sapiens
ggacaggcccggggagcctgga

SEQ ID NO: 8264595 - DNA, 22 bp, Homo sapiens
ggacaggctgcatctgagcatg

SEQ ID NO: 8264596 - DNA, 22 bp, Homo sapiens
ggactgggtcactaagatagta

SEQ ID NO: 8264597 - DNA, 22 bp, Homo sapiens
ggactgggaatcagggagatgc

SEQ ID NO: 8264598 - DNA, 22 bp, Homo sapiens
gctgtacattctgcacaggccc

SEQ ID NO: 8264599 - DNA, 22 bp, Homo sapiens
gctgtcaccaaagcaggcactg

SEQ ID NO: 8264600 - DNA, 22 bp, Homo sapiens
gctgtaggtttttccaggagtt

SEQ ID NO: 8264601 - DNA, 22 bp, Homo sapiens
gctgtagggctgagctggaccg

SEQ ID NO: 8264602 - DNA, 22 bp, Homo sapiens
gctgtatttaacaactggctca

SEQ ID NO: 8264603 - DNA, 22 bp, Homo sapiens
gctgtctgggttgagggccctg

SEQ ID NO: 8264604 - DNA, 23 bp, Homo sapiens
gctgtcctcctgggcccagcagc

SEQ ID NO: 8264605 - DNA, 22 bp, Homo sapiens
gctttatgggccatgcggtgtc

SEQ ID NO: 8264606 - DNA, 22 bp, Homo sapiens
gctttgggggctgcagtgcgtg

SEQ ID NO: 8264607 - DNA, 22 bp, Homo sapiens
gctttatgcaaacctggtactt

SEQ ID NO: 8264608 - DNA, 22 bp, Homo sapiens
gctttatgagtgaggcaggata

SEQ ID NO: 8264609 - DNA, 22 bp, Homo sapiens
gctttatggattgtaaactgca

SEQ ID NO: 8264610 - DNA, 22 bp, Homo sapiens
gctttatgctacgatttctagt

SEQ ID NO: 8264611 - DNA, 22 bp, Homo sapiens
gcttttctataagaactttcaa

SEQ ID NO: 8264612 - DNA, 22 bp, Homo sapiens
gctttaatgcaatttcacctca

SEQ ID NO: 8264613 - DNA, 22 bp, Homo sapiens
gcttggagaagatgttctcaat

SEQ ID NO: 8264614 - DNA, 18 bp, Homo sapiens
gctgctggtggagggagc

SEQ ID NO: 8264615 - DNA, 18 bp, Homo sapiens
gctgctggtggagggagc

SEQ ID NO: 8264616 - DNA, 18 bp, Homo sapiens
gctgctggtggagggagc

SEQ ID NO: 8264617 - DNA, 22 bp, Homo sapiens
gctgctggtcctcagagctcat

SEQ ID NO: 8264618 - DNA, 22 bp, Homo sapiens
gctgctgtctcatgcgatgcgg

SEQ ID NO: 8264619 - DNA, 22 bp, Homo sapiens
gctggagctgcagcctgggcct

SEQ ID NO: 8264620 - DNA, 22 bp, Homo sapiens
gctggaggggtaataggatggg

SEQ ID NO: 8264621 - DNA, 22 bp, Homo sapiens
gctgctgggatcctgggtctca

SEQ ID NO: 8264622 - DNA, 19 bp, Homo sapiens
gctgctggctctggctgga

SEQ ID NO: 8264623 - DNA, 19 bp, Homo sapiens
gctgctggctctggctgga

SEQ ID NO: 8264624 - DNA, 22 bp, Homo sapiens
gctgctgggaatgaacagtgtt

SEQ ID NO: 8264625 - DNA, 22 bp, Homo sapiens
gctgctggcttcctgctgtttt

SEQ ID NO: 8264626 - DNA, 22 bp, Homo sapiens
gctgctggaagcatgcgatgaa

SEQ ID NO: 8264627 - DNA, 22 bp, Homo sapiens
gctgctgcttgaaggctcggag

SEQ ID NO: 8264628 - DNA, 22 bp, Homo sapiens
gctggcagtaaagggtttggca

SEQ ID NO: 8264629 - DNA, 22 bp, Homo sapiens
gctggcaggtaaagccccgggg

SEQ ID NO: 8264630 - DNA, 22 bp, Homo sapiens
gctggagtatctggggaaggag

SEQ ID NO: 8264631 - DNA, 22 bp, Homo sapiens
gctgcaggcggccgtggtggcg

SEQ ID NO: 8264632 - DNA, 22 bp, Homo sapiens
gctctgtgaccttaggcaagtt

SEQ ID NO: 8264633 - DNA, 19 bp, Homo sapiens
gctctgtgatgctgagggg

SEQ ID NO: 8264634 - DNA, 22 bp, Homo sapiens
gctagaaactgtttaatctctt

SEQ ID NO: 8264635 - DNA, 22 bp, Homo sapiens
gctagaaaatgaaagataattt

SEQ ID NO: 8264636 - DNA, 19 bp, Homo sapiens
gctagggttggtggcgtgc

SEQ ID NO: 8264637 - DNA, 22 bp, Homo sapiens
gctaggagtaaggagaccttca

SEQ ID NO: 8264638 - DNA, 22 bp, Homo sapiens
gctaggagccgctgcactaggt

SEQ ID NO: 8264639 - DNA, 22 bp, Homo sapiens
gctagcagaaagcaggctgctc

SEQ ID NO: 8264640 - DNA, 22 bp, Homo sapiens
gctagaaatcgacttcagaatt

SEQ ID NO: 8264641 - DNA, 22 bp, Homo sapiens
gctcccagactgaccagaggtg

SEQ ID NO: 8264642 - DNA, 22 bp, Homo sapiens
gctcccagcaattgaggcagcc

SEQ ID NO: 8264643 - DNA, 22 bp, Homo sapiens
gctcagggagtttcacagtgta

SEQ ID NO: 8264644 - DNA, 22 bp, Homo sapiens
gggtgcaggcagcccaggcagg

SEQ ID NO: 8264645 - DNA, 22 bp, Homo sapiens
gggtgggtggcagcaccgaggc

SEQ ID NO: 8264646 - DNA, 22 bp, Homo sapiens
gggtggtgagatgtagctgatg

SEQ ID NO: 8264647 - DNA, 22 bp, Homo sapiens
gggtggtgtattagagctgcag

SEQ ID NO: 8264648 - DNA, 22 bp, Homo sapiens
gggtggtggcggaggctccagg

SEQ ID NO: 8264649 - DNA, 22 bp, Homo sapiens
gggtggtggccagcagtgggca

SEQ ID NO: 8264650 - DNA, 22 bp, Homo sapiens
ggggcccagcacccctcctcgc

SEQ ID NO: 8264651 - DNA, 22 bp, Homo sapiens
ggggcccagggcagcagtgcag

SEQ ID NO: 8264652 - DNA, 22 bp, Homo sapiens
ggggtagggcgattgctgcttt

SEQ ID NO: 8264653 - DNA, 22 bp, Homo sapiens
ggggccaggtccagcttccaaa

SEQ ID NO: 8264654 - DNA, 20 bp, Homo sapiens
ggggcccaagccctcttgcc

SEQ ID NO: 8264655 - DNA, 22 bp, Homo sapiens
ggggccagcttcgcgtgctctt

SEQ ID NO: 8264656 - DNA, 22 bp, Homo sapiens
ggggtggctggcacctcctggt

SEQ ID NO: 8264657 - DNA, 22 bp, Homo sapiens
ggggaggaagctggaacacggg

SEQ ID NO: 8264658 - DNA, 22 bp, Homo sapiens
ggggaggacctttccaaggctt

SEQ ID NO: 8264659 - DNA, 22 bp, Homo sapiens
ggggaggacctttccaaggctt

SEQ ID NO: 8264660 - DNA, 22 bp, Homo sapiens
ggggaggcaagatgaagtgagg

SEQ ID NO: 8264661 - DNA, 22 bp, Homo sapiens
ggggaggccagtggaccgtccc

SEQ ID NO: 8264662 - DNA, 22 bp, Homo sapiens
ggggaggctgatgtgggcaaag

SEQ ID NO: 8264663 - DNA, 22 bp, Homo sapiens
ggggaggctgatgtgggcaaag

SEQ ID NO: 8264664 - DNA, 22 bp, Homo sapiens
ggggccagagaggacccaggtg

SEQ ID NO: 8264665 - DNA, 22 bp, Homo sapiens
ggggcaggaggtgttctctttt

SEQ ID NO: 8264666 - DNA, 22 bp, Homo sapiens
ggggagtgacgcagggccatag

SEQ ID NO: 8264667 - DNA, 22 bp, Homo sapiens
ggggagtggttgcctgtgatcc

SEQ ID NO: 8264668 - DNA, 22 bp, Homo sapiens
ggggagtgttttcatgggcttg

SEQ ID NO: 8264669 - DNA, 18 bp, Homo sapiens
gggctgtgttcatgccca

SEQ ID NO: 8264670 - DNA, 22 bp, Homo sapiens
gggctgtgtgcccacttcccat

SEQ ID NO: 8264671 - DNA, 16 bp, Homo sapiens
gggctgggggattctg

SEQ ID NO: 8264672 - DNA, 22 bp, Homo sapiens
ggtcccagctggtcactgtcag

SEQ ID NO: 8264673 - DNA, 22 bp, Homo sapiens
gggttggggcccagcagtctgc

SEQ ID NO: 8264674 - DNA, 22 bp, Homo sapiens
gggttgggactgtcatctggag

SEQ ID NO: 8264675 - DNA, 22 bp, Homo sapiens
ggtcccaggttgacagggagac

SEQ ID NO: 8264676 - DNA, 22 bp, Homo sapiens
ggtcccagtcctctccctgcta

SEQ ID NO: 8264677 - DNA, 22 bp, Homo sapiens
ggtgaggaaagatggtgacagt

SEQ ID NO: 8264678 - DNA, 22 bp, Homo sapiens
ggtgacagcgggtcaagaggag

SEQ ID NO: 8264679 - DNA, 21 bp, Homo sapiens
ggtgctcctccatgctgctct

SEQ ID NO: 8264680 - DNA, 19 bp, Homo sapiens
ggtggcagaacgtgggtcc

SEQ ID NO: 8264681 - DNA, 22 bp, Homo sapiens
ggtggcaagggcagccagtaac

SEQ ID NO: 8264682 - DNA, 22 bp, Homo sapiens
ggtggagcgcagggtgctggcg

SEQ ID NO: 8264683 - DNA, 22 bp, Homo sapiens
ggtggagctatacgggatggct

SEQ ID NO: 8264684 - DNA, 22 bp, Homo sapiens
ggtggggcctgctccagcggcc

SEQ ID NO: 8264685 - DNA, 22 bp, Homo sapiens
ggtggggcctgctccagcggcc

SEQ ID NO: 8264686 - DNA, 22 bp, Homo sapiens
ggtgggtgagccctgggagctg

SEQ ID NO: 8264687 - DNA, 22 bp, Homo sapiens
ggtggggccctggcactggtat

SEQ ID NO: 8264688 - DNA, 22 bp, Homo sapiens
ggtggggcccaggcatctgatg

SEQ ID NO: 8264689 - DNA, 22 bp, Homo sapiens
ggtggggccagggctccaacct

SEQ ID NO: 8264690 - DNA, 22 bp, Homo sapiens
ggtgggcaggtcactctgcctc

SEQ ID NO: 8264691 - DNA, 22 bp, Homo sapiens
ggttggggcgagctggaggccc

SEQ ID NO: 8264692 - DNA, 22 bp, Homo sapiens
gtaattgtgggcttagtagagt

SEQ ID NO: 8264693 - DNA, 22 bp, Homo sapiens
gtaattgtcttgaattcacaac

SEQ ID NO: 8264694 - DNA, 22 bp, Homo sapiens
gtgcccaggcccaaggcaccac

SEQ ID NO: 8264695 - DNA, 22 bp, Homo sapiens
gtgctgatggccacccctgttc

SEQ ID NO: 8264696 - DNA, 22 bp, Homo sapiens
gtgctggccctgtcctcgagct

SEQ ID NO: 8264697 - DNA, 22 bp, Homo sapiens
gtgctgcttgggggcagagcag

SEQ ID NO: 8264698 - DNA, 22 bp, Homo sapiens
gtgctgctgccagcaggatcct

SEQ ID NO: 8264699 - DNA, 22 bp, Homo sapiens
gtgctgctcaagggacaggaca

SEQ ID NO: 8264700 - DNA, 22 bp, Homo sapiens
gtgaggcagcaggagcctctgt

SEQ ID NO: 8264701 - DNA, 19 bp, Homo sapiens
gtgaggagtgtttacagaa

SEQ ID NO: 8264702 - DNA, 22 bp, Homo sapiens
gtgaggagctctttgactcacg

SEQ ID NO: 8264703 - DNA, 22 bp, Homo sapiens
gtgaggagtctgaagcacataa

SEQ ID NO: 8264704 - DNA, 22 bp, Homo sapiens
gtgaggagctgacactggggtg

SEQ ID NO: 8264705 - DNA, 22 bp, Homo sapiens
gtgaggagggctggtcccaggc

SEQ ID NO: 8264706 - DNA, 22 bp, Homo sapiens
gtgaggaagtctgagagccaca

SEQ ID NO: 8264707 - DNA, 22 bp, Homo sapiens
gtgaggactggtaaggactgca

SEQ ID NO: 8264708 - DNA, 22 bp, Homo sapiens
gtcctctgggcagctgccccac

SEQ ID NO: 8264709 - DNA, 22 bp, Homo sapiens
gtccaggctgacccctagagga

SEQ ID NO: 8264710 - DNA, 22 bp, Homo sapiens
gtcctctggtgaaagcattccc

SEQ ID NO: 8264711 - DNA, 22 bp, Homo sapiens
gtcctctgtccctggggcacgg

SEQ ID NO: 8264712 - DNA, 22 bp, Homo sapiens
gtccagctgcagctgggcagaa

SEQ ID NO: 8264713 - DNA, 22 bp, Homo sapiens
gtccagctctcagatggctgca

SEQ ID NO: 8264714 - DNA, 22 bp, Homo sapiens
gtacaagtgtatttggcttgat

SEQ ID NO: 8264715 - DNA, 22 bp, Homo sapiens
gtacaataactagtcttatagt

SEQ ID NO: 8264716 - DNA, 22 bp, Homo sapiens
ggctagggaaatcctgatccaa

SEQ ID NO: 8264717 - DNA, 22 bp, Homo sapiens
ggctctgaaattctcactttta

SEQ ID NO: 8264718 - DNA, 22 bp, Homo sapiens
ggctctgaacatggggaggagt

SEQ ID NO: 8264719 - DNA, 22 bp, Homo sapiens
ggctctgaaggagacagctgct

SEQ ID NO: 8264720 - DNA, 22 bp, Homo sapiens
ggctcagcacagggctggcatc

SEQ ID NO: 8264721 - DNA, 22 bp, Homo sapiens
ggctctgaattattcctgagtc

SEQ ID NO: 8264722 - DNA, 22 bp, Homo sapiens
ggctctgaagggtgacaggttt

SEQ ID NO: 8264723 - DNA, 22 bp, Homo sapiens
ggctctgacctcccaggcagtt

SEQ ID NO: 8264724 - DNA, 22 bp, Homo sapiens
ggctctgagtttagaagggtgg

SEQ ID NO: 8264725 - DNA, 22 bp, Homo sapiens
ggctctgaggctatgctttaca

SEQ ID NO: 8264726 - DNA, 22 bp, Homo sapiens
ggctctgaggcagatcgatggg

SEQ ID NO: 8264727 - DNA, 23 bp, Homo sapiens
ggctctgaggatggagctggtgg

SEQ ID NO: 8264728 - DNA, 22 bp, Homo sapiens
ggccacagcagatgcttcagat

SEQ ID NO: 8264729 - DNA, 22 bp, Homo sapiens
ggccacagggctgaacgtggac

SEQ ID NO: 8264730 - DNA, 20 bp, Homo sapiens
ggccacagggtgctggtgga

SEQ ID NO: 8264731 - DNA, 22 bp, Homo sapiens
ggccaccagtcctctggcaggg

SEQ ID NO: 8264732 - DNA, 22 bp, Homo sapiens
ggccacagtctctggaaggatg

SEQ ID NO: 8264733 - DNA, 21 bp, Homo sapiens
ggccacagttagggctcagga

SEQ ID NO: 8264734 - DNA, 22 bp, Homo sapiens
ggccagcagacctcagggactc

SEQ ID NO: 8264735 - DNA, 22 bp, Homo sapiens
ggccagaggtgtcctcagttct

SEQ ID NO: 8264736 - DNA, 22 bp, Homo sapiens
ggccagagtctatatgcagaca

SEQ ID NO: 8264737 - DNA, 22 bp, Homo sapiens
ggccagcagtcacagggtcaga

SEQ ID NO: 8264738 - DNA, 22 bp, Homo sapiens
ggcccagcgaggccacctacag

SEQ ID NO: 8264739 - DNA, 22 bp, Homo sapiens
ggccagctggatgtgggtgacg

SEQ ID NO: 8264740 - DNA, 22 bp, Homo sapiens
ggcccagctttcattccttgct

SEQ ID NO: 8264741 - DNA, 22 bp, Homo sapiens
ggcccagctgtgcttccagccc

SEQ ID NO: 8264742 - DNA, 22 bp, Homo sapiens
ggcccagctgtatattacagtt

SEQ ID NO: 8264743 - DNA, 22 bp, Homo sapiens
ggcccagctgggcggggacacg

SEQ ID NO: 8264744 - DNA, 22 bp, Homo sapiens
ggcccagtgtgggtggatgttg

SEQ ID NO: 8264745 - DNA, 22 bp, Homo sapiens
ggcccagtgtcccggtcgtggc

SEQ ID NO: 8264746 - DNA, 22 bp, Homo sapiens
ggcccagtgtaccccaggcagt

SEQ ID NO: 8264747 - DNA, 22 bp, Homo sapiens
ggcccagttgagaatgaatgat

SEQ ID NO: 8264748 - DNA, 22 bp, Homo sapiens
ggcccagtgttgccagacctga

SEQ ID NO: 8264749 - DNA, 22 bp, Homo sapiens
ggcccagtctggggccctgtga

SEQ ID NO: 8264750 - DNA, 22 bp, Homo sapiens
ggcccagtgctgttcacccagt

SEQ ID NO: 8264751 - DNA, 20 bp, Homo sapiens
ggcccagtgaaccaggacgg

SEQ ID NO: 8264752 - DNA, 22 bp, Homo sapiens
ggcccaggctggagtgcggtgg

SEQ ID NO: 8264753 - DNA, 22 bp, Homo sapiens
ggcagggaaacagctgatccca

SEQ ID NO: 8264754 - DNA, 20 bp, Homo sapiens
ggcagggcatcaacagctct

SEQ ID NO: 8264755 - DNA, 22 bp, Homo sapiens
ggcagggccctgattcctgggg

SEQ ID NO: 8264756 - DNA, 22 bp, Homo sapiens
ggcagggcttgtctctgtgatg

SEQ ID NO: 8264757 - DNA, 18 bp, Homo sapiens
ggcaggggtgaaccacag

SEQ ID NO: 8264758 - DNA, 22 bp, Homo sapiens
ggcagtgcctgatgctgcagga

SEQ ID NO: 8264759 - DNA, 22 bp, Homo sapiens
ggcagtggaggaccctgtgtct

SEQ ID NO: 8264760 - DNA, 20 bp, Homo sapiens
ggcagcgggttcgggcgcag

SEQ ID NO: 8264761 - DNA, 22 bp, Homo sapiens
ggcagctcacctctggtccagg

SEQ ID NO: 8264762 - DNA, 22 bp, Homo sapiens
ggcagctccaaaaggaaacact

SEQ ID NO: 8264763 - DNA, 22 bp, Homo sapiens
ggcagctcctcctagtctgccc

SEQ ID NO: 8264764 - DNA, 22 bp, Homo sapiens
ggcagctcactgattagcaatt

SEQ ID NO: 8264765 - DNA, 21 bp, Homo sapiens
ggcagctcagcagatggggac

SEQ ID NO: 8264766 - DNA, 22 bp, Homo sapiens
ggcagctcacgggcatggggtg

SEQ ID NO: 8264767 - DNA, 20 bp, Homo sapiens
ggcagctcactactttctgt

SEQ ID NO: 8264768 - DNA, 22 bp, Homo sapiens
ggcagctcgatgacttctgcat

SEQ ID NO: 8264769 - DNA, 22 bp, Homo sapiens
ggcaccaggctgggcataggcc

SEQ ID NO: 8264770 - DNA, 22 bp, Homo sapiens
ggaggcagaacttcccgtcagt

SEQ ID NO: 8264771 - DNA, 22 bp, Homo sapiens
ggaggcaacatgcttgtttcta

SEQ ID NO: 8264772 - DNA, 22 bp, Homo sapiens
ggaggcaaagcactttgcttgg

SEQ ID NO: 8264773 - DNA, 22 bp, Homo sapiens
ggaggcaacacagggtgtgttt

SEQ ID NO: 8264774 - DNA, 17 bp, Homo sapiens
ggaggcaacagacaggg

SEQ ID NO: 8264775 - DNA, 22 bp, Homo sapiens
ggaggaggtgggttaagttgta

SEQ ID NO: 8264776 - DNA, 22 bp, Homo sapiens
ggaggaggggtttacattggaa

SEQ ID NO: 8264777 - DNA, 22 bp, Homo sapiens
ggaggaggggtgactgaatgct

SEQ ID NO: 8264778 - DNA, 22 bp, Homo sapiens
ggcagcagaactggccctgtat

SEQ ID NO: 8264779 - DNA, 22 bp, Homo sapiens
ggcagatggagaagcagcaggt

SEQ ID NO: 8264780 - DNA, 22 bp, Homo sapiens
ggcagatggaatgagctgtcta

SEQ ID NO: 8264781 - DNA, 22 bp, Homo sapiens
ggcagaggtgaagttcacaagg

SEQ ID NO: 8264782 - DNA, 22 bp, Homo sapiens
ggctgtggccagcggggctgag

SEQ ID NO: 8264783 - DNA, 22 bp, Homo sapiens
ggctgtggggggagcctgcccg

SEQ ID NO: 8264784 - DNA, 22 bp, Homo sapiens
ggctgtggcattaggtgaggcc

SEQ ID NO: 8264785 - DNA, 22 bp, Homo sapiens
ggctgtggcattaggtgaggcc

SEQ ID NO: 8264786 - DNA, 22 bp, Homo sapiens
ggctgtggcagctggaagtggt

SEQ ID NO: 8264787 - DNA, 22 bp, Homo sapiens
ggctgtggcagctggaagtggt

SEQ ID NO: 8264788 - DNA, 22 bp, Homo sapiens
gggaagcagatcataccagacc

SEQ ID NO: 8264789 - DNA, 22 bp, Homo sapiens
gggaaggcaggattctctggtg

SEQ ID NO: 8264790 - DNA, 22 bp, Homo sapiens
gggaaggcagtgggaggaactg

SEQ ID NO: 8264791 - DNA, 22 bp, Homo sapiens
gggaaggcaggcctctgttgga

SEQ ID NO: 8264792 - DNA, 22 bp, Homo sapiens
gggaaggcatacctgagggaga

SEQ ID NO: 8264793 - DNA, 22 bp, Homo sapiens
gggagccacagtgaggtgcatg

SEQ ID NO: 8264794 - DNA, 21 bp, Homo sapiens
ggctgcagggagccctggggt

SEQ ID NO: 8264795 - DNA, 22 bp, Homo sapiens
ggctgcctcctcgagacaggat

SEQ ID NO: 8264796 - DNA, 22 bp, Homo sapiens
ggctgccaggagggaggccagt

SEQ ID NO: 8264797 - DNA, 22 bp, Homo sapiens
ggctgccaggagaagctcagtg

SEQ ID NO: 8264798 - DNA, 22 bp, Homo sapiens
ggctgcctgcctccaagccggg

SEQ ID NO: 8264799 - DNA, 22 bp, Homo sapiens
ggctgcctgctcaggtgcggcg

SEQ ID NO: 8264800 - DNA, 22 bp, Homo sapiens
ggctgcctctgatgtgcagacg

SEQ ID NO: 8264801 - DNA, 22 bp, Homo sapiens
ggctgcctctggaagctggaga

SEQ ID NO: 8264802 - DNA, 22 bp, Homo sapiens
ggctggagacaacgtcctgccc

SEQ ID NO: 8264803 - DNA, 22 bp, Homo sapiens
gggcagagagctggaactcctt

SEQ ID NO: 8264804 - DNA, 20 bp, Homo sapiens
gggcagagccagccagtccc

SEQ ID NO: 8264805 - DNA, 22 bp, Homo sapiens
gggcagagactcagaaacagaa

SEQ ID NO: 8264806 - DNA, 22 bp, Homo sapiens
gggcagagactcagaaacagaa

SEQ ID NO: 8264807 - DNA, 22 bp, Homo sapiens
gggcagaggctctggcccatcc

SEQ ID NO: 8264808 - DNA, 17 bp, Homo sapiens
gggcagggactcctggg

SEQ ID NO: 8264809 - DNA, 21 bp, Homo sapiens
gggcagaggggcctcctgggt

SEQ ID NO: 8264810 - DNA, 21 bp, Homo sapiens
gggcagaggggcctcctgggt

SEQ ID NO: 8264811 - DNA, 17 bp, Homo sapiens
gggcagggactcctggg

SEQ ID NO: 8264812 - DNA, 22 bp, Homo sapiens
gggcaggtgcccagggccagag

SEQ ID NO: 8264813 - DNA, 20 bp, Homo sapiens
gggatcaggaaaggaggcta

SEQ ID NO: 8264814 - DNA, 22 bp, Homo sapiens
gggagtgtgcagaagctggggg

SEQ ID NO: 8264815 - DNA, 22 bp, Homo sapiens
gggagtgggtttggcctaggcc

SEQ ID NO: 8264816 - DNA, 22 bp, Homo sapiens
gggagtggattatgtggaccca

SEQ ID NO: 8264817 - DNA, 22 bp, Homo sapiens
gggcctcacctctccaccgcct

SEQ ID NO: 8264818 - DNA, 22 bp, Homo sapiens
gggcccagtaccctctgccaag

SEQ ID NO: 8264819 - DNA, 22 bp, Homo sapiens
gggcccaggcctccttccttcc

SEQ ID NO: 8264820 - DNA, 21 bp, Homo sapiens
gggctcagcgctcggctcctc

SEQ ID NO: 8264821 - DNA, 22 bp, Homo sapiens
gggctcagctccttccttccta

SEQ ID NO: 8264822 - DNA, 22 bp, Homo sapiens
gggctcagagcatttgggttgg

SEQ ID NO: 8264823 - DNA, 22 bp, Homo sapiens
gggctcagcctcctcacttcga

SEQ ID NO: 8264824 - DNA, 22 bp, Homo sapiens
tttggaaacatctcagaaaata

SEQ ID NO: 8264825 - DNA, 22 bp, Homo sapiens
tttggaaaaagcctgaacatag

SEQ ID NO: 8264826 - DNA, 22 bp, Homo sapiens
tttggaaatttcatcaatagcc

SEQ ID NO: 8264827 - DNA, 22 bp, Homo sapiens
tttgatatcctatacaagtaaa

SEQ ID NO: 8264828 - DNA, 22 bp, Homo sapiens
tttgatgacctgtatctttttc

SEQ ID NO: 8264829 - DNA, 22 bp, Homo sapiens
tttgacaaatatttattggcac

SEQ ID NO: 8264830 - DNA, 22 bp, Homo sapiens
tttgacaactgtgcagtttgta

SEQ ID NO: 8264831 - DNA, 22 bp, Homo sapiens
tttgacaacgttgttgtgagga

SEQ ID NO: 8264832 - DNA, 22 bp, Homo sapiens
tttgaatatacttcaaacaaag

SEQ ID NO: 8264833 - DNA, 22 bp, Homo sapiens
ttttaattgcaattatggtccc

SEQ ID NO: 8264834 - DNA, 22 bp, Homo sapiens
ttttaagaaatgtatgactgtc

SEQ ID NO: 8264835 - DNA, 22 bp, Homo sapiens
ttttaaatctccagttgacccc

SEQ ID NO: 8264836 - DNA, 22 bp, Homo sapiens
tttgttacaaagaaagaagagc

SEQ ID NO: 8264837 - DNA, 22 bp, Homo sapiens
tttgttacattaaaaagtaggt

SEQ ID NO: 8264838 - DNA, 22 bp, Homo sapiens
ttctcaggcctttgggatggga

SEQ ID NO: 8264839 - DNA, 22 bp, Homo sapiens
ttctcagggtctggatggcctg

SEQ ID NO: 8264840 - DNA, 22 bp, Homo sapiens
ttctcaggaactcagtgtcagc

SEQ ID NO: 8264841 - DNA, 22 bp, Homo sapiens
ttctcagggtttgtgcaggctt

SEQ ID NO: 8264842 - DNA, 17 bp, Homo sapiens
ttcctggaagtcattcc

SEQ ID NO: 8264843 - DNA, 22 bp, Homo sapiens
ttctggagattgagaaggcatt

SEQ ID NO: 8264844 - DNA, 22 bp, Homo sapiens
ttctggagatagtcaggcatta

SEQ ID NO: 8264845 - DNA, 22 bp, Homo sapiens
ttctggagaggaacagaaaggt

SEQ ID NO: 8264846 - DNA, 22 bp, Homo sapiens
ttctggagacccagcaacaggg

SEQ ID NO: 8264847 - DNA, 22 bp, Homo sapiens
ttctggagaataatcagcattg

SEQ ID NO: 8264848 - DNA, 22 bp, Homo sapiens
ttctggacttgccttgctgatg

SEQ ID NO: 8264849 - DNA, 22 bp, Homo sapiens
ttctggagaaaattctgtcatt

SEQ ID NO: 8264850 - DNA, 22 bp, Homo sapiens
ttgaaatcaccactagcatttg

SEQ ID NO: 8264851 - DNA, 22 bp, Homo sapiens
ttattgtgtgcgttagcctatg

SEQ ID NO: 8264852 - DNA, 22 bp, Homo sapiens
ttattgtgtcttggtttatctt

SEQ ID NO: 8264853 - DNA, 22 bp, Homo sapiens
ttattgtgtacttcctctgtgc

SEQ ID NO: 8264854 - DNA, 22 bp, Homo sapiens
ttattgtgaggaataagtgaga

SEQ ID NO: 8264855 - DNA, 22 bp, Homo sapiens
ttattgtggactactgttctgg

SEQ ID NO: 8264856 - DNA, 22 bp, Homo sapiens
ttattgtggcagaggtatggtt

SEQ ID NO: 8264857 - DNA, 22 bp, Homo sapiens
ttattgtgggtaggttgtgaaa

SEQ ID NO: 8264858 - DNA, 18 bp, Homo sapiens
ttattgtggtcacagcac

SEQ ID NO: 8264859 - DNA, 22 bp, Homo sapiens
ttcacaattaactttatactta

SEQ ID NO: 8264860 - DNA, 22 bp, Homo sapiens
ttcacagactttccatagattg

SEQ ID NO: 8264861 - DNA, 22 bp, Homo sapiens
ttcaaagaccttacttggcaaa

SEQ ID NO: 8264862 - DNA, 22 bp, Homo sapiens
ttcacagatgcctgatgtgtgg

SEQ ID NO: 8264863 - DNA, 22 bp, Homo sapiens
ttcacagatgagaaaattgagg

SEQ ID NO: 8264864 - DNA, 18 bp, Homo sapiens
ttcacagatccacaggaa

SEQ ID NO: 8264865 - DNA, 22 bp, Homo sapiens
ttcacagataacacaggcaaat

SEQ ID NO: 8264866 - DNA, 22 bp, Homo sapiens
ttcacagagcgggatgctggga

SEQ ID NO: 8264867 - DNA, 22 bp, Homo sapiens
ttcacagagcttgttcatggcc

SEQ ID NO: 8264868 - DNA, 22 bp, Homo sapiens
ttcacagagttatttttatgct

SEQ ID NO: 8264869 - DNA, 20 bp, Homo sapiens
ttcacagaggactcaggtca

SEQ ID NO: 8264870 - DNA, 22 bp, Homo sapiens
ttcacagagagtatgcagagaa

SEQ ID NO: 8264871 - DNA, 22 bp, Homo sapiens
ttcacagagcactgccaagtac

SEQ ID NO: 8264872 - DNA, 22 bp, Homo sapiens
ttcacagagagaactcaaacca

SEQ ID NO: 8264873 - DNA, 22 bp, Homo sapiens
ttcacagattgactggattcct

SEQ ID NO: 8264874 - DNA, 22 bp, Homo sapiens
ttcacagatttccctgcacatg

SEQ ID NO: 8264875 - DNA, 21 bp, Homo sapiens
ttcacagatgggaaaactgag

SEQ ID NO: 8264876 - DNA, 22 bp, Homo sapiens
ttcacagatgtattggaactcc

SEQ ID NO: 8264877 - DNA, 23 bp, Homo sapiens
ttcacagattaaatatttcttct

SEQ ID NO: 8264878 - DNA, 22 bp, Homo sapiens
ttgacaagcgaagtaccataat

SEQ ID NO: 8264879 - DNA, 22 bp, Homo sapiens
ttgcaggaaactgagtgtgagc

SEQ ID NO: 8264880 - DNA, 22 bp, Homo sapiens
ttgcatggatggatggttcgat

SEQ ID NO: 8264881 - DNA, 22 bp, Homo sapiens
ttgcatggaggaacatggccca

SEQ ID NO: 8264882 - DNA, 22 bp, Homo sapiens
ttgcatggctgtgaaaatttgg

SEQ ID NO: 8264883 - DNA, 22 bp, Homo sapiens
ttgcatggggattggagcacag

SEQ ID NO: 8264884 - DNA, 22 bp, Homo sapiens
ttgcatgggcaacaggaggtgg

SEQ ID NO: 8264885 - DNA, 22 bp, Homo sapiens
ttgcatggtaataaaatgtgac

SEQ ID NO: 8264886 - DNA, 22 bp, Homo sapiens
ttgcatggtgtgctctgaatca

SEQ ID NO: 8264887 - DNA, 22 bp, Homo sapiens
ttggaaacgtcaccttttcctt

SEQ ID NO: 8264888 - DNA, 23 bp, Homo sapiens
ttgctttcatcatgagatgctcc

SEQ ID NO: 8264889 - DNA, 22 bp, Homo sapiens
ttgcttatttgattaaatgtct

SEQ ID NO: 8264890 - DNA, 23 bp, Homo sapiens
ttgtatttttagtagagacaggg

SEQ ID NO: 8264891 - DNA, 22 bp, Homo sapiens
ttgtattttttcctggcggtgg

SEQ ID NO: 8264892 - DNA, 22 bp, Homo sapiens
ttgtatttcgatgcacgtgtag

SEQ ID NO: 8264893 - DNA, 22 bp, Homo sapiens
ttgtatttcctataacctttct

SEQ ID NO: 8264894 - DNA, 22 bp, Homo sapiens
ttgggacagagctggggctgga

SEQ ID NO: 8264895 - DNA, 22 bp, Homo sapiens
ttggcccacagtaccatgctgt

SEQ ID NO: 8264896 - DNA, 17 bp, Homo sapiens
ttgggagagaaaggtat

SEQ ID NO: 8264897 - DNA, 22 bp, Homo sapiens
ttgggagacaaaggctctgtct

SEQ ID NO: 8264898 - DNA, 22 bp, Homo sapiens
ttgggagaaggctgggacttta

SEQ ID NO: 8264899 - DNA, 22 bp, Homo sapiens
ttgggagaaatagttgatccgc

SEQ ID NO: 8264900 - DNA, 22 bp, Homo sapiens
ttgggacatgtaagctggaagt

SEQ ID NO: 8264901 - DNA, 22 bp, Homo sapiens
ttgggagagtttacatcctttt

SEQ ID NO: 8264902 - DNA, 22 bp, Homo sapiens
ttgggagatagggtaatttagc

SEQ ID NO: 8264903 - DNA, 22 bp, Homo sapiens
ttgggagatattgttctttaca

SEQ ID NO: 8264904 - DNA, 22 bp, Homo sapiens
ttgggagatggggagataatat

SEQ ID NO: 8264905 - DNA, 22 bp, Homo sapiens
ttgggagcttggacttagtgtg

SEQ ID NO: 8264906 - DNA, 22 bp, Homo sapiens
ttgggagattcattgagccaag

SEQ ID NO: 8264907 - DNA, 22 bp, Homo sapiens
ttgggcagtgattagttcatga

SEQ ID NO: 8264908 - DNA, 22 bp, Homo sapiens
ttgggcagggaaaggacaggca

SEQ ID NO: 8264909 - DNA, 22 bp, Homo sapiens
ttgggcaggtgaagagagggct

SEQ ID NO: 8264910 - DNA, 22 bp, Homo sapiens
ttgggcagtagcctcttggtgt

SEQ ID NO: 8264911 - DNA, 22 bp, Homo sapiens
ttggagaggcagtcttgctctg

SEQ ID NO: 8264912 - DNA, 22 bp, Homo sapiens
ttggagagcagtaaaccacact

SEQ ID NO: 8264913 - DNA, 22 bp, Homo sapiens
ttggagagatttaggtctcagt

SEQ ID NO: 8264914 - DNA, 22 bp, Homo sapiens
ttggagagggcttggatcacac

SEQ ID NO: 8264915 - DNA, 22 bp, Homo sapiens
ttggagagtgatattcagatgc

SEQ ID NO: 8264916 - DNA, 22 bp, Homo sapiens
ttggagccatgcccagctctct

SEQ ID NO: 8264917 - DNA, 22 bp, Homo sapiens
ttggagccctgaggatctggat

SEQ ID NO: 8264918 - DNA, 22 bp, Homo sapiens
ttggagagaggctgctcaggct

SEQ ID NO: 8264919 - DNA, 22 bp, Homo sapiens
ttggagagattatcagaccagc

SEQ ID NO: 8264920 - DNA, 20 bp, Homo sapiens
tttacattttgaaacagtga

SEQ ID NO: 8264921 - DNA, 22 bp, Homo sapiens
tttacagggttcaagaatgaaa

SEQ ID NO: 8264922 - DNA, 19 bp, Homo sapiens
tttacagggaatggagacc

SEQ ID NO: 8264923 - DNA, 22 bp, Homo sapiens
tttaaatggcattttcccagat

SEQ ID NO: 8264924 - DNA, 22 bp, Homo sapiens
tttaaatgttcatgatactgaa

SEQ ID NO: 8264925 - DNA, 22 bp, Homo sapiens
tttaaatgtttatagagagtac

SEQ ID NO: 8264926 - DNA, 23 bp, Homo sapiens
tttcaacaatgcttagagaaaac

SEQ ID NO: 8264927 - DNA, 22 bp, Homo sapiens
tttcaacaggatgataataggc

SEQ ID NO: 8264928 - DNA, 22 bp, Homo sapiens
tttcacagaactcactaaggag

SEQ ID NO: 8264929 - DNA, 23 bp, Homo sapiens
tttcacagaaggattgtagggcc

SEQ ID NO: 8264930 - DNA, 22 bp, Homo sapiens
tttcacagctgggtggcagagt

SEQ ID NO: 8264931 - DNA, 22 bp, Homo sapiens
aagggaggccagaggttttgca

SEQ ID NO: 8264932 - DNA, 22 bp, Homo sapiens
aaggccaggtccctgcagtgca

SEQ ID NO: 8264933 - DNA, 23 bp, Homo sapiens
aaggccagagagaggctagtgtc

SEQ ID NO: 8264934 - DNA, 22 bp, Homo sapiens
aaggagtgatatatgggtgcta

SEQ ID NO: 8264935 - DNA, 22 bp, Homo sapiens
aaggagtgtgaccttccagctc

SEQ ID NO: 8264936 - DNA, 22 bp, Homo sapiens
aaggagtgctgaaaggaagcgg

SEQ ID NO: 8264937 - DNA, 22 bp, Homo sapiens
aaggagtgcatgactcagagta

SEQ ID NO: 8264938 - DNA, 22 bp, Homo sapiens
aaggataagaatggaaggaaca

SEQ ID NO: 8264939 - DNA, 18 bp, Homo sapiens
aagtcttggaatttccac

SEQ ID NO: 8264940 - DNA, 22 bp, Homo sapiens
aacagtgttttgctctttgccc

SEQ ID NO: 8264941 - DNA, 22 bp, Homo sapiens
aacagtggtctggggagtggag

SEQ ID NO: 8264942 - DNA, 22 bp, Homo sapiens
aataatgtctgctattttaaaa

SEQ ID NO: 8264943 - DNA, 22 bp, Homo sapiens
aatatctgtctctaatgcatat

SEQ ID NO: 8264944 - DNA, 22 bp, Homo sapiens
aatatctgttgttctaagccac

SEQ ID NO: 8264945 - DNA, 22 bp, Homo sapiens
aatatctgtggccatacaattt

SEQ ID NO: 8264946 - DNA, 21 bp, Homo sapiens
aatctgcttccctgtgacttg

SEQ ID NO: 8264947 - DNA, 22 bp, Homo sapiens
acacatataccactgtaaatga

SEQ ID NO: 8264948 - DNA, 22 bp, Homo sapiens
acacttctcatttgatactaac

SEQ ID NO: 8264949 - DNA, 22 bp, Homo sapiens
acacttgccatgctgcacactg

SEQ ID NO: 8264950 - DNA, 22 bp, Homo sapiens
acactttaagcatttcacactg

SEQ ID NO: 8264951 - DNA, 22 bp, Homo sapiens
acagagatcagaggcataagca

SEQ ID NO: 8264952 - DNA, 22 bp, Homo sapiens
acagagcaataacagggagagg

SEQ ID NO: 8264953 - DNA, 22 bp, Homo sapiens
acagagcaataacagggagagg

SEQ ID NO: 8264954 - DNA, 22 bp, Homo sapiens
acagagatggcacagagaaggt

SEQ ID NO: 8264955 - DNA, 22 bp, Homo sapiens
acagagatgaattagacagggt

SEQ ID NO: 8264956 - DNA, 22 bp, Homo sapiens
acagctgctgcttctcactggg

SEQ ID NO: 8264957 - DNA, 22 bp, Homo sapiens
aagcagttactatttactatta

SEQ ID NO: 8264958 - DNA, 19 bp, Homo sapiens
aagcagtttatatatttgt

SEQ ID NO: 8264959 - DNA, 22 bp, Homo sapiens
aagcagtttttcaactgtttag

SEQ ID NO: 8264960 - DNA, 22 bp, Homo sapiens
acagagcacagtcgggatggga

SEQ ID NO: 8264961 - DNA, 21 bp, Homo sapiens
aagcagggactgcccaggtcc

SEQ ID NO: 8264962 - DNA, 23 bp, Homo sapiens
aagcagggagattcttagctgag

SEQ ID NO: 8264963 - DNA, 22 bp, Homo sapiens
aagcagggagaaatttttcttc

SEQ ID NO: 8264964 - DNA, 22 bp, Homo sapiens
aagcagggctccctggggactc

SEQ ID NO: 8264965 - DNA, 22 bp, Homo sapiens
aagcagggctagaccaagaaga

SEQ ID NO: 8264966 - DNA, 22 bp, Homo sapiens
aagcagggtcttcctcagttgg

SEQ ID NO: 8264967 - DNA, 18 bp, Homo sapiens
aagcagggtccattgtgc

SEQ ID NO: 8264968 - DNA, 22 bp, Homo sapiens
aagcagggctttaagcggtttt

SEQ ID NO: 8264969 - DNA, 22 bp, Homo sapiens
aagcagggtgtcttgacccatg

SEQ ID NO: 8264970 - DNA, 22 bp, Homo sapiens
aagcagggtttttccaccgcag

SEQ ID NO: 8264971 - DNA, 22 bp, Homo sapiens
acaaaaagggagatgaggtaga

SEQ ID NO: 8264972 - DNA, 22 bp, Homo sapiens
acaaatatttactgaatccact

SEQ ID NO: 8264973 - DNA, 22 bp, Homo sapiens
acaaagctctggaaggctcgtc

SEQ ID NO: 8264974 - DNA, 22 bp, Homo sapiens
acacagcttcaaagtctaattc

SEQ ID NO: 8264975 - DNA, 22 bp, Homo sapiens
aaagccagggacagtgtgcatg

SEQ ID NO: 8264976 - DNA, 22 bp, Homo sapiens
aaaggagataaagggcccttca

SEQ ID NO: 8264977 - DNA, 22 bp, Homo sapiens
aaaggagagtaggttactccat

SEQ ID NO: 8264978 - DNA, 22 bp, Homo sapiens
aaaggagagtgagtcagatgcc

SEQ ID NO: 8264979 - DNA, 22 bp, Homo sapiens
aaaggagacagtcttacctgga

SEQ ID NO: 8264980 - DNA, 22 bp, Homo sapiens
aaaggagacttcagatctcctt

SEQ ID NO: 8264981 - DNA, 22 bp, Homo sapiens
aaaggagaaaacatacaggact

SEQ ID NO: 8264982 - DNA, 22 bp, Homo sapiens
aaagctctaagagaggtaggta

SEQ ID NO: 8264983 - DNA, 22 bp, Homo sapiens
aaagctctcccactgtatgaag

SEQ ID NO: 8264984 - DNA, 22 bp, Homo sapiens
aaagctctctgaacaccagacc

SEQ ID NO: 8264985 - DNA, 23 bp, Homo sapiens
aaagctctgctgcatgtagaata

SEQ ID NO: 8264986 - DNA, 22 bp, Homo sapiens
aaagctctgagaagcactgcaa

SEQ ID NO: 8264987 - DNA, 22 bp, Homo sapiens
aaagctctggtttggagcattt

SEQ ID NO: 8264988 - DNA, 22 bp, Homo sapiens
aaagctctgggaatgcttatct

SEQ ID NO: 8264989 - DNA, 22 bp, Homo sapiens
aaagctctggaagattaggtaa

SEQ ID NO: 8264990 - DNA, 22 bp, Homo sapiens
aaagctcttaatgagattatcc

SEQ ID NO: 8264991 - DNA, 22 bp, Homo sapiens
aaagctcttaaattgacctgct

SEQ ID NO: 8264992 - DNA, 22 bp, Homo sapiens
aaagctcttactgtactagtga

SEQ ID NO: 8264993 - DNA, 22 bp, Homo sapiens
aaatgacagttctctctgagta

SEQ ID NO: 8264994 - DNA, 22 bp, Homo sapiens
aaagacacatgtctcttagatt

SEQ ID NO: 8264995 - DNA, 22 bp, Homo sapiens
aaagacacatatgcttaaccca

SEQ ID NO: 8264996 - DNA, 22 bp, Homo sapiens
aaagacacacagtgcttcagtt

SEQ ID NO: 8264997 - DNA, 22 bp, Homo sapiens
aaagacacacagccagcaagtg

SEQ ID NO: 8264998 - DNA, 22 bp, Homo sapiens
aaaaccagacactgtttctggg

SEQ ID NO: 8264999 - DNA, 22 bp, Homo sapiens
aaaaccaggcttgctgtgctcg

SEQ ID NO: 8265000 - DNA, 22 bp, Homo sapiens
aaaatgagacacatgtgactcc

SEQ ID NO: 8265001 - DNA, 22 bp, Homo sapiens
aaaatctgcttccttttacaga

SEQ ID NO: 8265002 - DNA, 22 bp, Homo sapiens
aaagcaggcagcaggctggatt

SEQ ID NO: 8265003 - DNA, 22 bp, Homo sapiens
aaagcagggcgatgtcctcctc

SEQ ID NO: 8265004 - DNA, 22 bp, Homo sapiens
aaagcagggtccaaggagatgt

SEQ ID NO: 8265005 - DNA, 22 bp, Homo sapiens
aaagcagggatgaggctagagg

SEQ ID NO: 8265006 - DNA, 22 bp, Homo sapiens
aaagcagggaaatctatttgca

SEQ ID NO: 8265007 - DNA, 22 bp, Homo sapiens
aaagcagggtccaaggagatgt

SEQ ID NO: 8265008 - DNA, 22 bp, Homo sapiens
aaaatgaggtcaatatcctttt

SEQ ID NO: 8265009 - DNA, 22 bp, Homo sapiens
aaagggaatgtgtaggacatgt

SEQ ID NO: 8265010 - DNA, 22 bp, Homo sapiens
aaagggagcatggctgcaggga

SEQ ID NO: 8265011 - DNA, 22 bp, Homo sapiens
aaagggaggggcgataagccgg

SEQ ID NO: 8265012 - DNA, 20 bp, Homo sapiens
aaaggcacagcaacagagct

SEQ ID NO: 8265013 - DNA, 22 bp, Homo sapiens
aacatgaaagttgctaagtgca

SEQ ID NO: 8265014 - DNA, 22 bp, Homo sapiens
aaaggcagagtgctcagctggc

SEQ ID NO: 8265015 - DNA, 22 bp, Homo sapiens
aacatgaagttttctatagtga

SEQ ID NO: 8265016 - DNA, 22 bp, Homo sapiens
aacatgaaggtaggatggtttt

SEQ ID NO: 8265017 - DNA, 22 bp, Homo sapiens
aaagcaggttgcaattacagtg

SEQ ID NO: 8265018 - DNA, 22 bp, Homo sapiens
aaagcaggttatgaccatggcc

SEQ ID NO: 8265019 - DNA, 22 bp, Homo sapiens
aaattgtataatgttccagctg

SEQ ID NO: 8265020 - DNA, 22 bp, Homo sapiens
aaattgtaatgacttcacttga

SEQ ID NO: 8265021 - DNA, 22 bp, Homo sapiens
aaattgtaggatcacatgacct

SEQ ID NO: 8265022 - DNA, 22 bp, Homo sapiens
aaatatagtgacacttatagtc

SEQ ID NO: 8265023 - DNA, 22 bp, Homo sapiens
aaatatacggtccctaacagtc

SEQ ID NO: 8265024 - DNA, 22 bp, Homo sapiens
aaatatacggtccctaacagtc

SEQ ID NO: 8265025 - DNA, 22 bp, Homo sapiens
aagagagaccatgggggacagg

SEQ ID NO: 8265026 - DNA, 22 bp, Homo sapiens
aaatgagtttcctcaatgtcct

SEQ ID NO: 8265027 - DNA, 22 bp, Homo sapiens
aaatgagtagcgatgcacatta

SEQ ID NO: 8265028 - DNA, 22 bp, Homo sapiens
aaatgagtttgcctctagatag

SEQ ID NO: 8265029 - DNA, 22 bp, Homo sapiens
aatgccttggagagcctagagg

SEQ ID NO: 8265030 - DNA, 22 bp, Homo sapiens
aatgtataatatttaatgcttt

SEQ ID NO: 8265031 - DNA, 21 bp, Homo sapiens
agagaagggattccaggccct

SEQ ID NO: 8265032 - DNA, 22 bp, Homo sapiens
agagaaggggtaaagagtcctg

SEQ ID NO: 8265033 - DNA, 22 bp, Homo sapiens
aatgtgtataagggagagctaa

SEQ ID NO: 8265034 - DNA, 22 bp, Homo sapiens
aatgtgtcatttcccacaggtg

SEQ ID NO: 8265035 - DNA, 23 bp, Homo sapiens
agagcaaggaaatgaggtgtgat

SEQ ID NO: 8265036 - DNA, 22 bp, Homo sapiens
agagcctggcaaaaggtcctgc

SEQ ID NO: 8265037 - DNA, 22 bp, Homo sapiens
aattaactaatttggtacaaga

SEQ ID NO: 8265038 - DNA, 22 bp, Homo sapiens
agaggaagtaatcaggacctgc

SEQ ID NO: 8265039 - DNA, 22 bp, Homo sapiens
agaggagtttgctggtgtgtgc

SEQ ID NO: 8265040 - DNA, 22 bp, Homo sapiens
agaggaggtggtgatgctttaa

SEQ ID NO: 8265041 - DNA, 22 bp, Homo sapiens
agaggaggtccttttctgatgt

SEQ ID NO: 8265042 - DNA, 22 bp, Homo sapiens
agcaaggccgagaggatgctat

SEQ ID NO: 8265043 - DNA, 22 bp, Homo sapiens
acaacattatacatagaaagct

SEQ ID NO: 8265044 - DNA, 22 bp, Homo sapiens
aatttctctctcatgcttcatg

SEQ ID NO: 8265045 - DNA, 22 bp, Homo sapiens
agagtgtggaacttgaggagct

SEQ ID NO: 8265046 - DNA, 22 bp, Homo sapiens
agagtgtggaaatgttcagagt

SEQ ID NO: 8265047 - DNA, 22 bp, Homo sapiens
agagtgtgtctatggaaggggt

SEQ ID NO: 8265048 - DNA, 22 bp, Homo sapiens
agagtgtgtgctgagaaacgag

SEQ ID NO: 8265049 - DNA, 22 bp, Homo sapiens
agagtgtgttccccaagaaaga

SEQ ID NO: 8265050 - DNA, 22 bp, Homo sapiens
acaccagtcatttattcagtca

SEQ ID NO: 8265051 - DNA, 22 bp, Homo sapiens
agccagagatccatccctagga

SEQ ID NO: 8265052 - DNA, 22 bp, Homo sapiens
agccagagattgagatgcaggc

SEQ ID NO: 8265053 - DNA, 22 bp, Homo sapiens
agccagaggtcatgagcacagg

SEQ ID NO: 8265054 - DNA, 22 bp, Homo sapiens
agccagagggatctttctaaga

SEQ ID NO: 8265055 - DNA, 22 bp, Homo sapiens
agccagagggaatctttgggga

SEQ ID NO: 8265056 - DNA, 22 bp, Homo sapiens
agccagaggccagcctgcctca

SEQ ID NO: 8265057 - DNA, 22 bp, Homo sapiens
acacagttcaggatcaaatagc

SEQ ID NO: 8265058 - DNA, 22 bp, Homo sapiens
agcagggagaccatctcttcct

SEQ ID NO: 8265059 - DNA, 22 bp, Homo sapiens
agcagggactgagccagtggga

SEQ ID NO: 8265060 - DNA, 22 bp, Homo sapiens
agcagggactgagccagtggga

SEQ ID NO: 8265061 - DNA, 22 bp, Homo sapiens
agcagggacatggcatctctcc

SEQ ID NO: 8265062 - DNA, 22 bp, Homo sapiens
agcagggactacgtgaaagtga

SEQ ID NO: 8265063 - DNA, 19 bp, Homo sapiens
agcagggacatggaacttt

SEQ ID NO: 8265064 - DNA, 22 bp, Homo sapiens
agcagggaatagcggaaagaat

SEQ ID NO: 8265065 - DNA, 22 bp, Homo sapiens
agcagggaatagcggaaagaat

SEQ ID NO: 8265066 - DNA, 22 bp, Homo sapiens
acacagttcgttgttttctact

SEQ ID NO: 8265067 - DNA, 22 bp, Homo sapiens
acacagttcgtgcttttctatt

SEQ ID NO: 8265068 - DNA, 22 bp, Homo sapiens
acacagttcatgcatgaggtct

SEQ ID NO: 8265069 - DNA, 22 bp, Homo sapiens
acacagtttatggtattctgtt

SEQ ID NO: 8265070 - DNA, 22 bp, Homo sapiens
acacagttgattgtcactcagg

SEQ ID NO: 8265071 - DNA, 22 bp, Homo sapiens
agcagggaagcctccagaacct

SEQ ID NO: 8265072 - DNA, 19 bp, Homo sapiens
agcaggccacagggccagc

SEQ ID NO: 8265073 - DNA, 22 bp, Homo sapiens
acagcagcgtgaagtgtgttat

SEQ ID NO: 8265074 - DNA, 22 bp, Homo sapiens
acagcagccttgttggtttcga

SEQ ID NO: 8265075 - DNA, 17 bp, Homo sapiens
acagcaggcccggaggg

SEQ ID NO: 8265076 - DNA, 22 bp, Homo sapiens
acagcagcactattgacatttt

SEQ ID NO: 8265077 - DNA, 22 bp, Homo sapiens
acagcagcctgcagccctgtgt

SEQ ID NO: 8265078 - DNA, 22 bp, Homo sapiens
acagcagccagccactgtgagc

SEQ ID NO: 8265079 - DNA, 20 bp, Homo sapiens
acagcagccttgctagaaac

SEQ ID NO: 8265080 - DNA, 21 bp, Homo sapiens
acagcagcaatctgtctttcc

SEQ ID NO: 8265081 - DNA, 22 bp, Homo sapiens
acagcagcaatagcagtgacat

SEQ ID NO: 8265082 - DNA, 22 bp, Homo sapiens
acagatataaactatagtagtg

SEQ ID NO: 8265083 - DNA, 22 bp, Homo sapiens
acagatataaactatagtagtg

SEQ ID NO: 8265084 - DNA, 22 bp, Homo sapiens
acagatatatgattgtgtaaat

SEQ ID NO: 8265085 - DNA, 22 bp, Homo sapiens
acagagctgtacatgtgccatg

SEQ ID NO: 8265086 - DNA, 22 bp, Homo sapiens
acagaatactcataagaagggg

SEQ ID NO: 8265087 - DNA, 22 bp, Homo sapiens
agcggctgctccgcaggctggc

SEQ ID NO: 8265088 - DNA, 20 bp, Homo sapiens
agcggctggcggaggacacg

SEQ ID NO: 8265089 - DNA, 22 bp, Homo sapiens
acagagggtctgggcacaggac

SEQ ID NO: 8265090 - DNA, 22 bp, Homo sapiens
aagtcctgaaacttctttctga

SEQ ID NO: 8265091 - DNA, 23 bp, Homo sapiens
aagtagatagctaaagttttgtt

SEQ ID NO: 8265092 - DNA, 22 bp, Homo sapiens
acctctgagatgagtcagggga

SEQ ID NO: 8265093 - DNA, 22 bp, Homo sapiens
acccaggggcgaagctggccac

SEQ ID NO: 8265094 - DNA, 22 bp, Homo sapiens
acccaggggcagccttgctgtg

SEQ ID NO: 8265095 - DNA, 22 bp, Homo sapiens
acccagggccacagcccgcagt

SEQ ID NO: 8265096 - DNA, 22 bp, Homo sapiens
acccagggctcaagcgtaggca

SEQ ID NO: 8265097 - DNA, 22 bp, Homo sapiens
aagggaggggatgtaagcctgg

SEQ ID NO: 8265098 - DNA, 22 bp, Homo sapiens
aagggaggtaaagctatttaaa

SEQ ID NO: 8265099 - DNA, 20 bp, Homo sapiens
accagaggaaagagcagtga

SEQ ID NO: 8265100 - DNA, 22 bp, Homo sapiens
accagaggaagggaatctcaag

SEQ ID NO: 8265101 - DNA, 22 bp, Homo sapiens
accagaggaggaattaccttcc

SEQ ID NO: 8265102 - DNA, 22 bp, Homo sapiens
accagaggcagtttcggctggt

SEQ ID NO: 8265103 - DNA, 22 bp, Homo sapiens
accagaggctctgccacctcca

SEQ ID NO: 8265104 - DNA, 22 bp, Homo sapiens
accagagggagacttcctcttc

SEQ ID NO: 8265105 - DNA, 22 bp, Homo sapiens
accagagggcaaaccccagtgt

SEQ ID NO: 8265106 - DNA, 22 bp, Homo sapiens
aaggccagagcgtgtcctgcct

SEQ ID NO: 8265107 - DNA, 22 bp, Homo sapiens
aaggccagagtactagaggctg

SEQ ID NO: 8265108 - DNA, 22 bp, Homo sapiens
aaggccagagcagactggagtt

SEQ ID NO: 8265109 - DNA, 22 bp, Homo sapiens
aaggccagattctctctagggg

SEQ ID NO: 8265110 - DNA, 22 bp, Homo sapiens
aaggccagcagtttgagaccag

SEQ ID NO: 8265111 - DNA, 22 bp, Homo sapiens
aaggccagagttgaactgctcc

SEQ ID NO: 8265112 - DNA, 22 bp, Homo sapiens
aaggcacagccacttgatcatc

SEQ ID NO: 8265113 - DNA, 22 bp, Homo sapiens
aaggacaggcacagtggtggag

SEQ ID NO: 8265114 - DNA, 22 bp, Homo sapiens
aaggaagatgctggcctgggga

SEQ ID NO: 8265115 - DNA, 22 bp, Homo sapiens
aaggaagggaaatagtgatgtc

SEQ ID NO: 8265116 - DNA, 22 bp, Homo sapiens
aaggaagaagggaagttactta

SEQ ID NO: 8265117 - DNA, 22 bp, Homo sapiens
acttttatgataatcaatgttc

SEQ ID NO: 8265118 - DNA, 23 bp, Homo sapiens
aatctatacttaggctggtaata

SEQ ID NO: 8265119 - DNA, 22 bp, Homo sapiens
agaagaaactgtcggggatatt

SEQ ID NO: 8265120 - DNA, 22 bp, Homo sapiens
actgggagttctccatgtccct

SEQ ID NO: 8265121 - DNA, 22 bp, Homo sapiens
actgtcatgtgctaactgtcca

SEQ ID NO: 8265122 - DNA, 22 bp, Homo sapiens
actgtacatgcatcttgtctat

SEQ ID NO: 8265123 - DNA, 22 bp, Homo sapiens
actgtccagaagatagaaatat

SEQ ID NO: 8265124 - DNA, 22 bp, Homo sapiens
actgtccattcactcatattca

SEQ ID NO: 8265125 - DNA, 22 bp, Homo sapiens
actgtacatatggattctaaga

SEQ ID NO: 8265126 - DNA, 19 bp, Homo sapiens
aagtgtgttgagccaggat

SEQ ID NO: 8265127 - DNA, 22 bp, Homo sapiens
aagtgtgtgagcctgtcaggct

SEQ ID NO: 8265128 - DNA, 22 bp, Homo sapiens
aagtgtgtgggcaggcagtggt

SEQ ID NO: 8265129 - DNA, 22 bp, Homo sapiens
aagtgtgtatttttcttcagtg

SEQ ID NO: 8265130 - DNA, 22 bp, Homo sapiens
aagtgtgtctggcggcccagtg

SEQ ID NO: 8265131 - DNA, 22 bp, Homo sapiens
aagtgtgtcttgggaagggagg

SEQ ID NO: 8265132 - DNA, 22 bp, Homo sapiens
aagtgtgtattgtttatgctgc

SEQ ID NO: 8265133 - DNA, 22 bp, Homo sapiens
aagtgtctttatatttgagaaa

SEQ ID NO: 8265134 - DNA, 22 bp, Homo sapiens
aagtgtcttttagccactttta

SEQ ID NO: 8265135 - DNA, 22 bp, Homo sapiens
aagtgtctgctggctctaccct

SEQ ID NO: 8265136 - DNA, 22 bp, Homo sapiens
aagtgtcttaactccttttggg

SEQ ID NO: 8265137 - DNA, 22 bp, Homo sapiens
aagtgtcttctgatggggtgtg

SEQ ID NO: 8265138 - DNA, 22 bp, Homo sapiens
aagtgtctgatggagcgaaatg

SEQ ID NO: 8265139 - DNA, 22 bp, Homo sapiens
aagtgtctgcaaaatgacagag

SEQ ID NO: 8265140 - DNA, 22 bp, Homo sapiens
aagtgtctgacacaaaatatgt

SEQ ID NO: 8265141 - DNA, 22 bp, Homo sapiens
actctttaacagactttgatct

SEQ ID NO: 8265142 - DNA, 22 bp, Homo sapiens
attctctgggttccagtaaatg

SEQ ID NO: 8265143 - DNA, 19 bp, Homo sapiens
agaggcctcagcagctggc

SEQ ID NO: 8265144 - DNA, 22 bp, Homo sapiens
agaggcctccctcccagctggt

SEQ ID NO: 8265145 - DNA, 22 bp, Homo sapiens
agaggccctggctagagcagct

SEQ ID NO: 8265146 - DNA, 22 bp, Homo sapiens
agaggcctccgaaaggtgggct

SEQ ID NO: 8265147 - DNA, 22 bp, Homo sapiens
agagcttgtaattgagtcaggt

SEQ ID NO: 8265148 - DNA, 22 bp, Homo sapiens
attgtatttaggagaaaagggt

SEQ ID NO: 8265149 - DNA, 22 bp, Homo sapiens
attgtattctgcacctttgtta

SEQ ID NO: 8265150 - DNA, 22 bp, Homo sapiens
attgtattcagttacaggtctt

SEQ ID NO: 8265151 - DNA, 22 bp, Homo sapiens
attgtattataattaggccaaa

SEQ ID NO: 8265152 - DNA, 22 bp, Homo sapiens
attgtattagcacaatacaatt

SEQ ID NO: 8265153 - DNA, 22 bp, Homo sapiens
attgtatttccagcttgaatgt

SEQ ID NO: 8265154 - DNA, 22 bp, Homo sapiens
attgagcacctacagtattacc

SEQ ID NO: 8265155 - DNA, 22 bp, Homo sapiens
attgaggagcagagatggggta

SEQ ID NO: 8265156 - DNA, 22 bp, Homo sapiens
attgaggactggtggggagagc

SEQ ID NO: 8265157 - DNA, 22 bp, Homo sapiens
agcaagtgtaagaatgcagaat

SEQ ID NO: 8265158 - DNA, 22 bp, Homo sapiens
agcaaggcctacagagaggggc

SEQ ID NO: 8265159 - DNA, 22 bp, Homo sapiens
agcaaggctcggtcagggtgat

SEQ ID NO: 8265160 - DNA, 22 bp, Homo sapiens
atttacaggacagcttggcatt

SEQ ID NO: 8265161 - DNA, 21 bp, Homo sapiens
agatgaggatactgaggccta

SEQ ID NO: 8265162 - DNA, 22 bp, Homo sapiens
agattgggctctatggtgccac

SEQ ID NO: 8265163 - DNA, 22 bp, Homo sapiens
agattgtatcctcggagacttc

SEQ ID NO: 8265164 - DNA, 22 bp, Homo sapiens
agatttaaatttgctacaattc

SEQ ID NO: 8265165 - DNA, 22 bp, Homo sapiens
agatttacaaaggatttgcttt

SEQ ID NO: 8265166 - DNA, 22 bp, Homo sapiens
agagctctggcctattggggcc

SEQ ID NO: 8265167 - DNA, 22 bp, Homo sapiens
atggacaggtggataggtggat

SEQ ID NO: 8265168 - DNA, 23 bp, Homo sapiens
atggacagggtttcagggtcaca

SEQ ID NO: 8265169 - DNA, 22 bp, Homo sapiens
atggacaggtactgcagtgggt

SEQ ID NO: 8265170 - DNA, 22 bp, Homo sapiens
atggacagggcacaggcgcaga

SEQ ID NO: 8265171 - DNA, 22 bp, Homo sapiens
atgggcagtaacagtggcagtc

SEQ ID NO: 8265172 - DNA, 22 bp, Homo sapiens
atgggcagttaggaggccagga

SEQ ID NO: 8265173 - DNA, 23 bp, Homo sapiens
atgggccaagcaagacccatgac

SEQ ID NO: 8265174 - DNA, 22 bp, Homo sapiens
atggacagctcttatgtgggca

SEQ ID NO: 8265175 - DNA, 19 bp, Homo sapiens
atggacagacagtttggcc

SEQ ID NO: 8265176 - DNA, 22 bp, Homo sapiens
agagatgggaaggcagacttca

SEQ ID NO: 8265177 - DNA, 22 bp, Homo sapiens
atgtatacgtgcaggtcacagg

SEQ ID NO: 8265178 - DNA, 22 bp, Homo sapiens
atgtataatgctaattagctag

SEQ ID NO: 8265179 - DNA, 22 bp, Homo sapiens
agagactgtaatgagaggtaca

SEQ ID NO: 8265180 - DNA, 22 bp, Homo sapiens
agagactgtaatgagaggtaca

SEQ ID NO: 8265181 - DNA, 22 bp, Homo sapiens
agagactggagatgggcagtgt

SEQ ID NO: 8265182 - DNA, 22 bp, Homo sapiens
agagactgcaatgagtggtagg

SEQ ID NO: 8265183 - DNA, 22 bp, Homo sapiens
agagactgcaatgagtggtagg

SEQ ID NO: 8265184 - DNA, 22 bp, Homo sapiens
atgaggatgttagtggactgga

SEQ ID NO: 8265185 - DNA, 22 bp, Homo sapiens
atgaggagtcaaggagtcggag

SEQ ID NO: 8265186 - DNA, 22 bp, Homo sapiens
atgaggagaccaaggcctgatg

SEQ ID NO: 8265187 - DNA, 22 bp, Homo sapiens
atgaggagccctcatttaggtt

SEQ ID NO: 8265188 - DNA, 22 bp, Homo sapiens
atgaggagctgttttaactgct

SEQ ID NO: 8265189 - DNA, 22 bp, Homo sapiens
atgaggaggtcaggccttacaa

SEQ ID NO: 8265190 - DNA, 22 bp, Homo sapiens
atgaggaggccagtaagagcct

SEQ ID NO: 8265191 - DNA, 22 bp, Homo sapiens
atctgttcttgtgtcagtaatt

SEQ ID NO: 8265192 - DNA, 22 bp, Homo sapiens
atgcttccctttgctccacatg

SEQ ID NO: 8265193 - DNA, 22 bp, Homo sapiens
cacattgaaccatatattagtg

SEQ ID NO: 8265194 - DNA, 21 bp, Homo sapiens
agcaggcccaatggagggggc

SEQ ID NO: 8265195 - DNA, 22 bp, Homo sapiens
agcaggcccagggcttctcagc

SEQ ID NO: 8265196 - DNA, 22 bp, Homo sapiens
agcaggcctcatgcaccagcta

SEQ ID NO: 8265197 - DNA, 19 bp, Homo sapiens
agcaggccaggcaggtggc

SEQ ID NO: 8265198 - DNA, 22 bp, Homo sapiens
agcaggccactgcagctggagc

SEQ ID NO: 8265199 - DNA, 22 bp, Homo sapiens
agcaggcccaagctggggggaa

SEQ ID NO: 8265200 - DNA, 19 bp, Homo sapiens
agcaggccaggcaggtggc

SEQ ID NO: 8265201 - DNA, 22 bp, Homo sapiens
agcaggcctgccacctcggggt

SEQ ID NO: 8265202 - DNA, 20 bp, Homo sapiens
agcaggccttggggagagga

SEQ ID NO: 8265203 - DNA, 22 bp, Homo sapiens
cacagctggggaagctgaggcc

SEQ ID NO: 8265204 - DNA, 22 bp, Homo sapiens
cacagctgccccctctctaact

SEQ ID NO: 8265205 - DNA, 22 bp, Homo sapiens
cacagctgccctactccatgtg

SEQ ID NO: 8265206 - DNA, 22 bp, Homo sapiens
cacagctgcacagaggaggtgc

SEQ ID NO: 8265207 - DNA, 22 bp, Homo sapiens
cacagctgccatgcagtcagtg

SEQ ID NO: 8265208 - DNA, 22 bp, Homo sapiens
cacagctgaccaccctgctccc

SEQ ID NO: 8265209 - DNA, 22 bp, Homo sapiens
caatttctggaactaattctga

SEQ ID NO: 8265210 - DNA, 22 bp, Homo sapiens
caagggcagcagcctcaagcgg

SEQ ID NO: 8265211 - DNA, 22 bp, Homo sapiens
caagggacatttctcataggag

SEQ ID NO: 8265212 - DNA, 22 bp, Homo sapiens
agcagacaggctgccacagtgc

SEQ ID NO: 8265213 - DNA, 22 bp, Homo sapiens
agcagacatatctcatgtcaca

SEQ ID NO: 8265214 - DNA, 22 bp, Homo sapiens
cagagtggcagtcccaggccca

SEQ ID NO: 8265215 - DNA, 22 bp, Homo sapiens
cagagtggagatgtgtgtggaa

SEQ ID NO: 8265216 - DNA, 18 bp, Homo sapiens
cagagtgggccaagagac

SEQ ID NO: 8265217 - DNA, 22 bp, Homo sapiens
agccctgagccagcctggtcag

SEQ ID NO: 8265218 - DNA, 17 bp, Homo sapiens
cagaggagctttggggg

SEQ ID NO: 8265219 - DNA, 18 bp, Homo sapiens
cagaggagagacattcag

SEQ ID NO: 8265220 - DNA, 22 bp, Homo sapiens
agccggcaataggaaaggagag

SEQ ID NO: 8265221 - DNA, 22 bp, Homo sapiens
cagatctatctgttgatggtgc

SEQ ID NO: 8265222 - DNA, 22 bp, Homo sapiens
cagagctgtgataaatagatat

SEQ ID NO: 8265223 - DNA, 22 bp, Homo sapiens
agccagggctgcaggttccttg

SEQ ID NO: 8265224 - DNA, 22 bp, Homo sapiens
agccagggctgcgagcagacag

SEQ ID NO: 8265225 - DNA, 22 bp, Homo sapiens
cagcccagaactcacgtctcca

SEQ ID NO: 8265226 - DNA, 22 bp, Homo sapiens
cagcccagtgcacgcccgtttc

SEQ ID NO: 8265227 - DNA, 22 bp, Homo sapiens
cagccccacacggtctagctct

SEQ ID NO: 8265228 - DNA, 22 bp, Homo sapiens
cagcacttggtgccattgagtg

SEQ ID NO: 8265229 - DNA, 18 bp, Homo sapiens
cagctgccagctcatgga

SEQ ID NO: 8265230 - DNA, 18 bp, Homo sapiens
cagctgccagctcatgga

SEQ ID NO: 8265231 - DNA, 22 bp, Homo sapiens
cagctgccacttgctctcggct

SEQ ID NO: 8265232 - DNA, 22 bp, Homo sapiens
agctctggaataatgatgtgat

SEQ ID NO: 8265233 - DNA, 22 bp, Homo sapiens
agctctggagccggaggatttc

SEQ ID NO: 8265234 - DNA, 22 bp, Homo sapiens
cagctgcccatcctgggaaatg

SEQ ID NO: 8265235 - DNA, 22 bp, Homo sapiens
cagcgaggtgaagggtacaagc

SEQ ID NO: 8265236 - DNA, 22 bp, Homo sapiens
cagcgctggggtaggagcacct

SEQ ID NO: 8265237 - DNA, 22 bp, Homo sapiens
cagcggccggtgaggaagggga

SEQ ID NO: 8265238 - DNA, 22 bp, Homo sapiens
cagctgctttcagcaggaggga

SEQ ID NO: 8265239 - DNA, 23 bp, Homo sapiens
agctctggcgttggggaggtagt

SEQ ID NO: 8265240 - DNA, 22 bp, Homo sapiens
agctctggcactggcgcgggat

SEQ ID NO: 8265241 - DNA, 20 bp, Homo sapiens
agtgtctggtgcagggcctc

SEQ ID NO: 8265242 - DNA, 22 bp, Homo sapiens
agtgtctgaacctgcagtggga

SEQ ID NO: 8265243 - DNA, 22 bp, Homo sapiens
agtgtcttcatgatgtggcagc

SEQ ID NO: 8265244 - DNA, 22 bp, Homo sapiens
agtgtctttagcaagtttagtc

SEQ ID NO: 8265245 - DNA, 22 bp, Homo sapiens
agtgtgtcgagggagggtccag

SEQ ID NO: 8265246 - DNA, 22 bp, Homo sapiens
actggggtgaaattggagtgtc

SEQ ID NO: 8265247 - DNA, 22 bp, Homo sapiens
actggggcaggaaagtatgctg

SEQ ID NO: 8265248 - DNA, 22 bp, Homo sapiens
agtgagagtattaatgtgaact

SEQ ID NO: 8265249 - DNA, 21 bp, Homo sapiens
agtccttgaaactctttcttg

SEQ ID NO: 8265250 - DNA, 22 bp, Homo sapiens
agtgggagataacttaacagct

SEQ ID NO: 8265251 - DNA, 20 bp, Homo sapiens
agtgggagagggcagactgc

SEQ ID NO: 8265252 - DNA, 22 bp, Homo sapiens
agtgggagcggcagtcggggac

SEQ ID NO: 8265253 - DNA, 22 bp, Homo sapiens
agtgggagccagcagcttgggg

SEQ ID NO: 8265254 - DNA, 22 bp, Homo sapiens
agtgggaggcggctgacgggcg

SEQ ID NO: 8265255 - DNA, 16 bp, Homo sapiens
agtgggaggagaaaga

SEQ ID NO: 8265256 - DNA, 22 bp, Homo sapiens
agtgggaggaagtggtgatatt

SEQ ID NO: 8265257 - DNA, 22 bp, Homo sapiens
agtggcagaagtcactgggtag

SEQ ID NO: 8265258 - DNA, 22 bp, Homo sapiens
actctggtagacaaggagaggt

SEQ ID NO: 8265259 - DNA, 20 bp, Homo sapiens
agtaacttagcaactctagg

SEQ ID NO: 8265260 - DNA, 21 bp, Homo sapiens
aggttccagcagccagagaat

SEQ ID NO: 8265261 - DNA, 22 bp, Homo sapiens
aggtgccacctctggtgctgtc

SEQ ID NO: 8265262 - DNA, 22 bp, Homo sapiens
aggtgcatctcgtagctcttct

SEQ ID NO: 8265263 - DNA, 22 bp, Homo sapiens
atatagaaggtgctatttacat

SEQ ID NO: 8265264 - DNA, 19 bp, Homo sapiens
atatagcattattcaattt

SEQ ID NO: 8265265 - DNA, 22 bp, Homo sapiens
atcaagggcgcgtggttcggcg

SEQ ID NO: 8265266 - DNA, 22 bp, Homo sapiens
ataaattatgaatggccctttt

SEQ ID NO: 8265267 - DNA, 22 bp, Homo sapiens
atacacttccaaatattgatta

SEQ ID NO: 8265268 - DNA, 22 bp, Homo sapiens
actttacaggcacttcaagtat

SEQ ID NO: 8265269 - DNA, 22 bp, Homo sapiens
actttactcaacaaatatttat

SEQ ID NO: 8265270 - DNA, 22 bp, Homo sapiens
agaaaaggattgatggatcaga

SEQ ID NO: 8265271 - DNA, 22 bp, Homo sapiens
atagtgtgactgaggagttgaa

SEQ ID NO: 8265272 - DNA, 22 bp, Homo sapiens
atagtgtgtaaagtgcagtgat

SEQ ID NO: 8265273 - DNA, 22 bp, Homo sapiens
atagtgtctttcttcacaggca

SEQ ID NO: 8265274 - DNA, 22 bp, Homo sapiens
ataggagactgttcttggcttc

SEQ ID NO: 8265275 - DNA, 22 bp, Homo sapiens
atagtgtgttagtgacataggc

SEQ ID NO: 8265276 - DNA, 22 bp, Homo sapiens
atagtgtgtggtataggtagag

SEQ ID NO: 8265277 - DNA, 22 bp, Homo sapiens
atagctttcttaaatatataaa

SEQ ID NO: 8265278 - DNA, 22 bp, Homo sapiens
atagctgtagaatgtatacaca

SEQ ID NO: 8265279 - DNA, 22 bp, Homo sapiens
atagctttacagaagagtttag

SEQ ID NO: 8265280 - DNA, 22 bp, Homo sapiens
acaggatggccagctgatattg

SEQ ID NO: 8265281 - DNA, 22 bp, Homo sapiens
acaggacatgtaccaggtggtc

SEQ ID NO: 8265282 - DNA, 22 bp, Homo sapiens
aggacagtggtgttctggagtg

SEQ ID NO: 8265283 - DNA, 22 bp, Homo sapiens
aggactggccctgaggggaggc

SEQ ID NO: 8265284 - DNA, 22 bp, Homo sapiens
aggaaaggggtaggtgtggacg

SEQ ID NO: 8265285 - DNA, 22 bp, Homo sapiens
aggcagcaaagaaatgatgctg

SEQ ID NO: 8265286 - DNA, 22 bp, Homo sapiens
aggcagcaagattatttaatcc

SEQ ID NO: 8265287 - DNA, 20 bp, Homo sapiens
aggcagacaaggagtctgtt

SEQ ID NO: 8265288 - DNA, 18 bp, Homo sapiens
aggcagacactagaggtc

SEQ ID NO: 8265289 - DNA, 22 bp, Homo sapiens
aggcagagaaaaaccagatatg

SEQ ID NO: 8265290 - DNA, 22 bp, Homo sapiens
aggcagatcacaggagggcctg

SEQ ID NO: 8265291 - DNA, 22 bp, Homo sapiens
aggcagtggtgtttgctggtgg

SEQ ID NO: 8265292 - DNA, 22 bp, Homo sapiens
aggaggcccctcctgggttgct

SEQ ID NO: 8265293 - DNA, 19 bp, Homo sapiens
aggaggccatgccactaga

SEQ ID NO: 8265294 - DNA, 22 bp, Homo sapiens
aggaggccattctctcagtagc

SEQ ID NO: 8265295 - DNA, 20 bp, Homo sapiens
aggaggcatgaggggattta

SEQ ID NO: 8265296 - DNA, 20 bp, Homo sapiens
aggaggccaaagtaatgggg

SEQ ID NO: 8265297 - DNA, 21 bp, Homo sapiens
aggaggccagtactgctgaac

SEQ ID NO: 8265298 - DNA, 22 bp, Homo sapiens
aggaggccctagagctctagag

SEQ ID NO: 8265299 - DNA, 22 bp, Homo sapiens
aggaggccgatttcagaggtcg

SEQ ID NO: 8265300 - DNA, 22 bp, Homo sapiens
aggcacgagcaatggccgagga

SEQ ID NO: 8265301 - DNA, 22 bp, Homo sapiens
aggctgctggcaggcgtggacg

SEQ ID NO: 8265302 - DNA, 22 bp, Homo sapiens
aggctgctgccttggagagtgt

SEQ ID NO: 8265303 - DNA, 22 bp, Homo sapiens
aggctgcttcaatggataagat

SEQ ID NO: 8265304 - DNA, 21 bp, Homo sapiens
aggctgctctttcttgtggta

SEQ ID NO: 8265305 - DNA, 22 bp, Homo sapiens
aggctctggcaacagctggtgt

SEQ ID NO: 8265306 - DNA, 19 bp, Homo sapiens
aggctgtgagggaggactc

SEQ ID NO: 8265307 - DNA, 22 bp, Homo sapiens
aggctgggaaacctgaagttgt

SEQ ID NO: 8265308 - DNA, 22 bp, Homo sapiens
aggctgggaaatgtattccagc

SEQ ID NO: 8265309 - DNA, 22 bp, Homo sapiens
aggctgggaaatgtagtcttcc

SEQ ID NO: 8265310 - DNA, 22 bp, Homo sapiens
accactgtacagcagatatagt

SEQ ID NO: 8265311 - DNA, 22 bp, Homo sapiens
accactgtactatttgagtggc

SEQ ID NO: 8265312 - DNA, 22 bp, Homo sapiens
accactgtctacacattgactc

SEQ ID NO: 8265313 - DNA, 22 bp, Homo sapiens
aggctctggacagtgaggagtt

SEQ ID NO: 8265314 - DNA, 20 bp, Homo sapiens
aggctcagggtgtttaggaa

SEQ ID NO: 8265315 - DNA, 22 bp, Homo sapiens
aggctcaggtctcaggtctggc

SEQ ID NO: 8265316 - DNA, 21 bp, Homo sapiens
acatgtctctaatctcagtga

SEQ ID NO: 8265317 - DNA, 22 bp, Homo sapiens
acatgtggaggaggcgagggta

SEQ ID NO: 8265318 - DNA, 22 bp, Homo sapiens
aggctcagggactccctccctc

SEQ ID NO: 8265319 - DNA, 22 bp, Homo sapiens
aggctcaggaggagctgccgga

SEQ ID NO: 8265320 - DNA, 20 bp, Homo sapiens
aggctcagctgagctcttgg

SEQ ID NO: 8265321 - DNA, 22 bp, Homo sapiens
acatgtcaatttagtactctta

SEQ ID NO: 8265322 - DNA, 22 bp, Homo sapiens
aggggagctaacaccagagccc

SEQ ID NO: 8265323 - DNA, 22 bp, Homo sapiens
aggggagcttgaggcatggcct

SEQ ID NO: 8265324 - DNA, 22 bp, Homo sapiens
aggggcaggtgctgcacttaga

SEQ ID NO: 8265325 - DNA, 22 bp, Homo sapiens
aggggaggagcttttcttgcct

SEQ ID NO: 8265326 - DNA, 22 bp, Homo sapiens
aggggcagttccaagttttgtg

SEQ ID NO: 8265327 - DNA, 22 bp, Homo sapiens
aggggagccgaggggcatctgt

SEQ ID NO: 8265328 - DNA, 22 bp, Homo sapiens
aggggagcatctgtgatggtta

SEQ ID NO: 8265329 - DNA, 22 bp, Homo sapiens
agggctcactgggaggctataa

SEQ ID NO: 8265330 - DNA, 22 bp, Homo sapiens
agggcaagttgagtgtgcgtgg

SEQ ID NO: 8265331 - DNA, 22 bp, Homo sapiens
agggaggtctttgaggggctta

SEQ ID NO: 8265332 - DNA, 20 bp, Homo sapiens
agggaggtgctgggcctgag

SEQ ID NO: 8265333 - DNA, 22 bp, Homo sapiens
agggaggtccatccctgcagag

SEQ ID NO: 8265334 - DNA, 22 bp, Homo sapiens
agggaggtctggctgccctgag

SEQ ID NO: 8265335 - DNA, 21 bp, Homo sapiens
agggccagatcaccaaggagc

SEQ ID NO: 8265336 - DNA, 22 bp, Homo sapiens
agggccagccaggccctacaaa

SEQ ID NO: 8265337 - DNA, 22 bp, Homo sapiens
agggctcaatggtgggcatgta

SEQ ID NO: 8265338 - DNA, 22 bp, Homo sapiens
ccagccctgattagagaatgtc

SEQ ID NO: 8265339 - DNA, 22 bp, Homo sapiens
ccagccctcggtagtcccatag

SEQ ID NO: 8265340 - DNA, 22 bp, Homo sapiens
ccagaggttactttgccttgga

SEQ ID NO: 8265341 - DNA, 22 bp, Homo sapiens
aggcaggtcccctggaaggcac

SEQ ID NO: 8265342 - DNA, 22 bp, Homo sapiens
ccaggaggtctgagtgtggaca

SEQ ID NO: 8265343 - DNA, 22 bp, Homo sapiens
ccaggagggtggttactcaatc

SEQ ID NO: 8265344 - DNA, 22 bp, Homo sapiens
ccaggaggtggaggttgcggtg

SEQ ID NO: 8265345 - DNA, 22 bp, Homo sapiens
ccagctcccctcagcaggtaat

SEQ ID NO: 8265346 - DNA, 22 bp, Homo sapiens
ccagctcccattcttcacctgt

SEQ ID NO: 8265347 - DNA, 23 bp, Homo sapiens
ccagctcccaggtctgaggactg

SEQ ID NO: 8265348 - DNA, 22 bp, Homo sapiens
ccagctcccgcaggctgcacag

SEQ ID NO: 8265349 - DNA, 22 bp, Homo sapiens
ccagctccgggagttgctgctg

SEQ ID NO: 8265350 - DNA, 22 bp, Homo sapiens
ccagctccctgaagcctggtct

SEQ ID NO: 8265351 - DNA, 16 bp, Homo sapiens
aggctcagaggctgga

SEQ ID NO: 8265352 - DNA, 21 bp, Homo sapiens
aggctcagagatcaaacagta

SEQ ID NO: 8265353 - DNA, 22 bp, Homo sapiens
aggctcagagatgagtaagcac

SEQ ID NO: 8265354 - DNA, 21 bp, Homo sapiens
aggctgtgacttacactatct

SEQ ID NO: 8265355 - DNA, 22 bp, Homo sapiens
ccagtgtcttcagagtaaatct

SEQ ID NO: 8265356 - DNA, 22 bp, Homo sapiens
ccagtgtctagtcacaggtact

SEQ ID NO: 8265357 - DNA, 22 bp, Homo sapiens
ccagtgtctgtggtatagaaag

SEQ ID NO: 8265358 - DNA, 19 bp, Homo sapiens
ccagtgtctagcgcacagc

SEQ ID NO: 8265359 - DNA, 22 bp, Homo sapiens
ccagtgtcagaaagattatcct

SEQ ID NO: 8265360 - DNA, 22 bp, Homo sapiens
ccagtgtccttcctttccatgg

SEQ ID NO: 8265361 - DNA, 22 bp, Homo sapiens
ccagtgtctactgtggcatatc

SEQ ID NO: 8265362 - DNA, 22 bp, Homo sapiens
ccagtgtctagcagatgacagg

SEQ ID NO: 8265363 - DNA, 22 bp, Homo sapiens
ccagtgtattatttgagaaatt

SEQ ID NO: 8265364 - DNA, 22 bp, Homo sapiens
ccagtggtgaatccagggatgt

SEQ ID NO: 8265365 - DNA, 19 bp, Homo sapiens
aggctctgtaggagagggc

SEQ ID NO: 8265366 - DNA, 22 bp, Homo sapiens
ccagggcagaaaaagagggaat

SEQ ID NO: 8265367 - DNA, 22 bp, Homo sapiens
aggctctgggaagcagtgagtt

SEQ ID NO: 8265368 - DNA, 22 bp, Homo sapiens
aggctcagcccctgggaggaga

SEQ ID NO: 8265369 - DNA, 22 bp, Homo sapiens
aggctcagcccaaggtggagag

SEQ ID NO: 8265370 - DNA, 22 bp, Homo sapiens
cctcctggtgggcgcttctggc

SEQ ID NO: 8265371 - DNA, 18 bp, Homo sapiens
aggggcagcttgtgtgga

SEQ ID NO: 8265372 - DNA, 22 bp, Homo sapiens
aggggaatgggtagactgttga

SEQ ID NO: 8265373 - DNA, 22 bp, Homo sapiens
agggggtgatcaaggtgcggcg

SEQ ID NO: 8265374 - DNA, 22 bp, Homo sapiens
aggggtagagattgctggtgta

SEQ ID NO: 8265375 - DNA, 22 bp, Homo sapiens
cctctgtgtcagggaagagact

SEQ ID NO: 8265376 - DNA, 22 bp, Homo sapiens
cctcagggtctgaggagaccgt

SEQ ID NO: 8265377 - DNA, 22 bp, Homo sapiens
cctcagtctatttccagcaggt

SEQ ID NO: 8265378 - DNA, 18 bp, Homo sapiens
cctcagggagatccagtg

SEQ ID NO: 8265379 - DNA, 22 bp, Homo sapiens
ccctggcagaatgtctctgggc

SEQ ID NO: 8265380 - DNA, 22 bp, Homo sapiens
ccctggcagcaatcactggtgt

SEQ ID NO: 8265381 - DNA, 22 bp, Homo sapiens
agggcccatgtcgggcgctctg

SEQ ID NO: 8265382 - DNA, 22 bp, Homo sapiens
agggcccatagatcgtcagctt

SEQ ID NO: 8265383 - DNA, 22 bp, Homo sapiens
agggcccaggacagcatcaggg

SEQ ID NO: 8265384 - DNA, 22 bp, Homo sapiens
agggcccagtggagagctgagc

SEQ ID NO: 8265385 - DNA, 22 bp, Homo sapiens
agggcccatgtgggagcacttg

SEQ ID NO: 8265386 - DNA, 22 bp, Homo sapiens
agggcctgtgctgagtagacga

SEQ ID NO: 8265387 - DNA, 22 bp, Homo sapiens
agggcccaccttggtgctgagg

SEQ ID NO: 8265388 - DNA, 22 bp, Homo sapiens
agggcccagcccttgctggtct

SEQ ID NO: 8265389 - DNA, 22 bp, Homo sapiens
agggcccagcagcatttcagtg

SEQ ID NO: 8265390 - DNA, 22 bp, Homo sapiens
agggcccacagttcctatggcc

SEQ ID NO: 8265391 - DNA, 20 bp, Homo sapiens
agggcccaggaagagagtta

SEQ ID NO: 8265392 - DNA, 23 bp, Homo sapiens
agggcccaagcctggacagcagg

SEQ ID NO: 8265393 - DNA, 22 bp, Homo sapiens
agggcatgtgggagaggagcct

SEQ ID NO: 8265394 - DNA, 22 bp, Homo sapiens
agggcatgctggaggagagaca

SEQ ID NO: 8265395 - DNA, 22 bp, Homo sapiens
agggcagctgtgagccactgtg

SEQ ID NO: 8265396 - DNA, 22 bp, Homo sapiens
agggcagaagtacagacactta

SEQ ID NO: 8265397 - DNA, 22 bp, Homo sapiens
cccaggtgtttgtggcagaggt

SEQ ID NO: 8265398 - DNA, 22 bp, Homo sapiens
agggatggtggaggaatttcaa

SEQ ID NO: 8265399 - DNA, 22 bp, Homo sapiens
agggatggtggaggttgcaagt

SEQ ID NO: 8265400 - DNA, 17 bp, Homo sapiens
cccaggccgccgggagc

SEQ ID NO: 8265401 - DNA, 22 bp, Homo sapiens
cccaggccctggcagagcttgt

SEQ ID NO: 8265402 - DNA, 22 bp, Homo sapiens
cccaggccccagggcttgtcag

SEQ ID NO: 8265403 - DNA, 22 bp, Homo sapiens
cccaggcctggtctgggccagt

SEQ ID NO: 8265404 - DNA, 22 bp, Homo sapiens
agggaatggatgatggcaggtt

SEQ ID NO: 8265405 - DNA, 22 bp, Homo sapiens
agggacagtctactgttcactg

SEQ ID NO: 8265406 - DNA, 22 bp, Homo sapiens
agggaccaatcaccgacaggct

SEQ ID NO: 8265407 - DNA, 22 bp, Homo sapiens
cccaggccagaacttggttgct

SEQ ID NO: 8265408 - DNA, 22 bp, Homo sapiens
caggcccagggttattgggaaa

SEQ ID NO: 8265409 - DNA, 22 bp, Homo sapiens
caggcccataatgcaaatattt

SEQ ID NO: 8265410 - DNA, 22 bp, Homo sapiens
caggcccagtgatcagggctct

SEQ ID NO: 8265411 - DNA, 22 bp, Homo sapiens
caggcccatttgtagccacttt

SEQ ID NO: 8265412 - DNA, 22 bp, Homo sapiens
caggcccattctaggcttgcta

SEQ ID NO: 8265413 - DNA, 22 bp, Homo sapiens
caggcccatgagggcagccaca

SEQ ID NO: 8265414 - DNA, 22 bp, Homo sapiens
caggcccatctgctcccaggct

SEQ ID NO: 8265415 - DNA, 22 bp, Homo sapiens
agctgtcctgtgggagggagtg

SEQ ID NO: 8265416 - DNA, 22 bp, Homo sapiens
agctgtcaggcagaactgagct

SEQ ID NO: 8265417 - DNA, 22 bp, Homo sapiens
caggcagcctgcggtctgcaca

SEQ ID NO: 8265418 - DNA, 22 bp, Homo sapiens
caggcagggagctggaaaggat

SEQ ID NO: 8265419 - DNA, 22 bp, Homo sapiens
caggcaggtcagtgaagaagga

SEQ ID NO: 8265420 - DNA, 22 bp, Homo sapiens
caggagccagctgtcccaacca

SEQ ID NO: 8265421 - DNA, 22 bp, Homo sapiens
caggagtctgttcctcatttgt

SEQ ID NO: 8265422 - DNA, 22 bp, Homo sapiens
caggagcccagagtcctcagct

SEQ ID NO: 8265423 - DNA, 22 bp, Homo sapiens
caggatggagagtgaggggtca

SEQ ID NO: 8265424 - DNA, 22 bp, Homo sapiens
caggagccacattccaccttga

SEQ ID NO: 8265425 - DNA, 22 bp, Homo sapiens
caggagccagaggcggatggag

SEQ ID NO: 8265426 - DNA, 22 bp, Homo sapiens
caggcacacatccgtgagagat

SEQ ID NO: 8265427 - DNA, 22 bp, Homo sapiens
caggatgggtgtcggccagcac

SEQ ID NO: 8265428 - DNA, 22 bp, Homo sapiens
caggcacaattatttccctttc

SEQ ID NO: 8265429 - DNA, 22 bp, Homo sapiens
caggatgggatgtagtgggccc

SEQ ID NO: 8265430 - DNA, 22 bp, Homo sapiens
caggagaaatgtggctgctacc

SEQ ID NO: 8265431 - DNA, 22 bp, Homo sapiens
caggagaaacataattttctgg

SEQ ID NO: 8265432 - DNA, 22 bp, Homo sapiens
cagctgtccttcctggtgggcg

SEQ ID NO: 8265433 - DNA, 22 bp, Homo sapiens
cagctgtcagccggtgcaggct

SEQ ID NO: 8265434 - DNA, 22 bp, Homo sapiens
cagctgtcacttctaagttttg

SEQ ID NO: 8265435 - DNA, 22 bp, Homo sapiens
aggacaagacaaggaccagaga

SEQ ID NO: 8265436 - DNA, 22 bp, Homo sapiens
aggacagacctaggactggagc

SEQ ID NO: 8265437 - DNA, 22 bp, Homo sapiens
aggacacttaggttattcaact

SEQ ID NO: 8265438 - DNA, 22 bp, Homo sapiens
cagggctgttagctgctgctct

SEQ ID NO: 8265439 - DNA, 22 bp, Homo sapiens
aggacagagggaccagagccca

SEQ ID NO: 8265440 - DNA, 22 bp, Homo sapiens
aggacagatttttggccaccag

SEQ ID NO: 8265441 - DNA, 22 bp, Homo sapiens
aggaagagctggaccagaggac

SEQ ID NO: 8265442 - DNA, 18 bp, Homo sapiens
cagggctgtggggtcact

SEQ ID NO: 8265443 - DNA, 18 bp, Homo sapiens
cagggctgtggggtcact

SEQ ID NO: 8265444 - DNA, 22 bp, Homo sapiens
cagggctggatttcatttctag

SEQ ID NO: 8265445 - DNA, 22 bp, Homo sapiens
agctttgggcagaagaggattc

SEQ ID NO: 8265446 - DNA, 22 bp, Homo sapiens
agctttgaatcctggctctgtc

SEQ ID NO: 8265447 - DNA, 22 bp, Homo sapiens
aggcaagaacagacatgggagt

SEQ ID NO: 8265448 - DNA, 22 bp, Homo sapiens
aggcaagttattggctcagagc

SEQ ID NO: 8265449 - DNA, 22 bp, Homo sapiens
aggcaaggtgctacagacagtg

SEQ ID NO: 8265450 - DNA, 22 bp, Homo sapiens
cattgcttgatagctgaaaatt

SEQ ID NO: 8265451 - DNA, 22 bp, Homo sapiens
cattgcttatttcagctaaagt

SEQ ID NO: 8265452 - DNA, 22 bp, Homo sapiens
catttctcctgggtgataaatt

SEQ ID NO: 8265453 - DNA, 22 bp, Homo sapiens
aggcaggaggatcatggatgca

SEQ ID NO: 8265454 - DNA, 18 bp, Homo sapiens
aggcaggatcctggcctc

SEQ ID NO: 8265455 - DNA, 22 bp, Homo sapiens
aggcaggagcaagccctacaag

SEQ ID NO: 8265456 - DNA, 22 bp, Homo sapiens
aggcaggaaccctgtgtgcgcc

SEQ ID NO: 8265457 - DNA, 17 bp, Homo sapiens
aggcaggagattggaga

SEQ ID NO: 8265458 - DNA, 22 bp, Homo sapiens
aggagccatccccatgagaggt

SEQ ID NO: 8265459 - DNA, 22 bp, Homo sapiens
aggagccagttccaccccagga

SEQ ID NO: 8265460 - DNA, 23 bp, Homo sapiens
aggaggcctgaaactgaggctga

SEQ ID NO: 8265461 - DNA, 22 bp, Homo sapiens
aggaggcctctatccagagaga

SEQ ID NO: 8265462 - DNA, 22 bp, Homo sapiens
aggaggccgggattctggagat

SEQ ID NO: 8265463 - DNA, 22 bp, Homo sapiens
cagtgtgctgcagagaacattt

SEQ ID NO: 8265464 - DNA, 22 bp, Homo sapiens
cagtggttcctgttcttctggg

SEQ ID NO: 8265465 - DNA, 22 bp, Homo sapiens
cagtggttctcaatcaggaatg

SEQ ID NO: 8265466 - DNA, 23 bp, Homo sapiens
aggagccaggtgcagcccttgtg

SEQ ID NO: 8265467 - DNA, 23 bp, Homo sapiens
aggagccaggaaccagcttcccc

SEQ ID NO: 8265468 - DNA, 22 bp, Homo sapiens
aggagccaggaaacctgctctg

SEQ ID NO: 8265469 - DNA, 21 bp, Homo sapiens
aggagccagcctgtcagtcta

SEQ ID NO: 8265470 - DNA, 22 bp, Homo sapiens
aggagccagcgttcctcaggat

SEQ ID NO: 8265471 - DNA, 22 bp, Homo sapiens
catctcatagtgcagtgctgta

SEQ ID NO: 8265472 - DNA, 22 bp, Homo sapiens
catccaaactctcattatctgt

SEQ ID NO: 8265473 - DNA, 22 bp, Homo sapiens
aggaggcctgttttctcctgga

SEQ ID NO: 8265474 - DNA, 22 bp, Homo sapiens
aggaggctgaactagggtctgg

SEQ ID NO: 8265475 - DNA, 22 bp, Homo sapiens
aggatgagagatacatggagca

SEQ ID NO: 8265476 - DNA, 22 bp, Homo sapiens
aggatgggtcagctagagtcca

SEQ ID NO: 8265477 - DNA, 22 bp, Homo sapiens
catgagatttgggaggggccag

SEQ ID NO: 8265478 - DNA, 22 bp, Homo sapiens
atccaggcgaatgcagaaggcc

SEQ ID NO: 8265479 - DNA, 22 bp, Homo sapiens
ctgtgtggactggttgaggccc

SEQ ID NO: 8265480 - DNA, 22 bp, Homo sapiens
ctgtgtggcctcaagccagcct

SEQ ID NO: 8265481 - DNA, 22 bp, Homo sapiens
atcctgaaaacttacgaagtgg

SEQ ID NO: 8265482 - DNA, 22 bp, Homo sapiens
atcagacaattgttgagtactg

SEQ ID NO: 8265483 - DNA, 22 bp, Homo sapiens
atctgacaaggccacatattct

SEQ ID NO: 8265484 - DNA, 22 bp, Homo sapiens
ctggctgtgtcttggaggagct

SEQ ID NO: 8265485 - DNA, 22 bp, Homo sapiens
atattatagacagagtcttctg

SEQ ID NO: 8265486 - DNA, 22 bp, Homo sapiens
ctgggctgagcctgggctgtgt

SEQ ID NO: 8265487 - DNA, 22 bp, Homo sapiens
atattcactgagcataaagcca

SEQ ID NO: 8265488 - DNA, 22 bp, Homo sapiens
atattcttgtgattataaagta

SEQ ID NO: 8265489 - DNA, 22 bp, Homo sapiens
ctggcccatggtgagctctggg

SEQ ID NO: 8265490 - DNA, 22 bp, Homo sapiens
atactacacattgactatattt

SEQ ID NO: 8265491 - DNA, 22 bp, Homo sapiens
atactacactatgcatggatgt

SEQ ID NO: 8265492 - DNA, 22 bp, Homo sapiens
atactacactatgcatggatgt

SEQ ID NO: 8265493 - DNA, 22 bp, Homo sapiens
ctggctcccgaagccctcagtg

SEQ ID NO: 8265494 - DNA, 22 bp, Homo sapiens
ctggaataaacgatcttcagca

SEQ ID NO: 8265495 - DNA, 22 bp, Homo sapiens
ctgctgcattcctctttatgag

SEQ ID NO: 8265496 - DNA, 22 bp, Homo sapiens
ctgctgcattactcttctcaag

SEQ ID NO: 8265497 - DNA, 22 bp, Homo sapiens
ctggagagaatgtggaatgatt

SEQ ID NO: 8265498 - DNA, 22 bp, Homo sapiens
ctggagagaaatgacaaagcta

SEQ ID NO: 8265499 - DNA, 22 bp, Homo sapiens
ctggagagaatgttcattgcag

SEQ ID NO: 8265500 - DNA, 22 bp, Homo sapiens
ataccttttagacatgtagttg

SEQ ID NO: 8265501 - DNA, 20 bp, Homo sapiens
ctgcagggttagaggctcca

SEQ ID NO: 8265502 - DNA, 22 bp, Homo sapiens
ctgcatggtagggataagatgg

SEQ ID NO: 8265503 - DNA, 22 bp, Homo sapiens
ctgcatggttcaaatgagctaa

SEQ ID NO: 8265504 - DNA, 22 bp, Homo sapiens
ctgaggagcgttggtcacgtgt

SEQ ID NO: 8265505 - DNA, 22 bp, Homo sapiens
ctgaggagctgaaggccctcca

SEQ ID NO: 8265506 - DNA, 22 bp, Homo sapiens
ctgaggagcagctggcccgcta

SEQ ID NO: 8265507 - DNA, 22 bp, Homo sapiens
ctgaggagatccccccagaagt

SEQ ID NO: 8265508 - DNA, 22 bp, Homo sapiens
ctgcaatatgatgtctgagaaa

SEQ ID NO: 8265509 - DNA, 22 bp, Homo sapiens
ctgatcccattggcagtccagt

SEQ ID NO: 8265510 - DNA, 16 bp, Homo sapiens
ctgatcccacatcctt

SEQ ID NO: 8265511 - DNA, 21 bp, Homo sapiens
ctgatcccaaacctctgccct

SEQ ID NO: 8265512 - DNA, 22 bp, Homo sapiens
ctgatcccaggcactgtcgcaa

SEQ ID NO: 8265513 - DNA, 22 bp, Homo sapiens
ataaattaggatctggggttcc

SEQ ID NO: 8265514 - DNA, 22 bp, Homo sapiens
ctgctgaggtatactatgtgac

SEQ ID NO: 8265515 - DNA, 22 bp, Homo sapiens
ctgctgagcctggtgcgggatg

SEQ ID NO: 8265516 - DNA, 22 bp, Homo sapiens
ctccctccaaataagactcggg

SEQ ID NO: 8265517 - DNA, 22 bp, Homo sapiens
ctccctccctacgtgagctcac

SEQ ID NO: 8265518 - DNA, 22 bp, Homo sapiens
ctccctcctcaaatatctttgt

SEQ ID NO: 8265519 - DNA, 22 bp, Homo sapiens
ctccgtgctattttagtatcgc

SEQ ID NO: 8265520 - DNA, 22 bp, Homo sapiens
ctcctgcccacgtgctacttct

SEQ ID NO: 8265521 - DNA, 22 bp, Homo sapiens
agtggcagatctctggtctgga

SEQ ID NO: 8265522 - DNA, 22 bp, Homo sapiens
agtggcagaggttgactgcagt

SEQ ID NO: 8265523 - DNA, 22 bp, Homo sapiens
ctcctgggaatttagttgtgag

SEQ ID NO: 8265524 - DNA, 22 bp, Homo sapiens
ctcagtgttaaatataaggtat

SEQ ID NO: 8265525 - DNA, 22 bp, Homo sapiens
agtccctctgggagcaggactg

SEQ ID NO: 8265526 - DNA, 22 bp, Homo sapiens
agtcccctggcaggagggacgt

SEQ ID NO: 8265527 - DNA, 22 bp, Homo sapiens
agtcctgatgctctggcaggag

SEQ ID NO: 8265528 - DNA, 22 bp, Homo sapiens
ctccaggctggatccaagtcaa

SEQ ID NO: 8265529 - DNA, 22 bp, Homo sapiens
ctgaggagagatcacgtggtgt

SEQ ID NO: 8265530 - DNA, 22 bp, Homo sapiens
ctgaggagacagaagccaaata

SEQ ID NO: 8265531 - DNA, 22 bp, Homo sapiens
ctgaggagaggtggcctgtgtt

SEQ ID NO: 8265532 - DNA, 22 bp, Homo sapiens
ctgaggagaacaatgagatcaa

SEQ ID NO: 8265533 - DNA, 22 bp, Homo sapiens
ctgagcagcaattgctggccca

SEQ ID NO: 8265534 - DNA, 22 bp, Homo sapiens
ctgaatgagggattctgagggc

SEQ ID NO: 8265535 - DNA, 18 bp, Homo sapiens
agtgtctggatatttggg

SEQ ID NO: 8265536 - DNA, 22 bp, Homo sapiens
ctgacaaaccactgctccagct

SEQ ID NO: 8265537 - DNA, 22 bp, Homo sapiens
ctgacaaggttgaattgtccca

SEQ ID NO: 8265538 - DNA, 17 bp, Homo sapiens
ctctggggacagttcta

SEQ ID NO: 8265539 - DNA, 22 bp, Homo sapiens
ctctggggtgcttcgacacttc

SEQ ID NO: 8265540 - DNA, 22 bp, Homo sapiens
ctctgctgagccagagtcccca

SEQ ID NO: 8265541 - DNA, 22 bp, Homo sapiens
ctctggattgctgtgagatgct

SEQ ID NO: 8265542 - DNA, 22 bp, Homo sapiens
ctctgagcagcggtgccgaagt

SEQ ID NO: 8265543 - DNA, 22 bp, Homo sapiens
ctctgagctccaaaagtcagca

SEQ ID NO: 8265544 - DNA, 22 bp, Homo sapiens
ctctgagcccgctgcagcccca

SEQ ID NO: 8265545 - DNA, 21 bp, Homo sapiens
aggtggggctgcacctctgct

SEQ ID NO: 8265546 - DNA, 22 bp, Homo sapiens
aggtggggagtatatgtaattg

SEQ ID NO: 8265547 - DNA, 22 bp, Homo sapiens
cctggctctggggcggacagct

SEQ ID NO: 8265548 - DNA, 22 bp, Homo sapiens
cctgggctcaagtgatggtccc

SEQ ID NO: 8265549 - DNA, 23 bp, Homo sapiens
cctggagtactaaggggatggaa

SEQ ID NO: 8265550 - DNA, 22 bp, Homo sapiens
cctgcagagccacgtgccagcg

SEQ ID NO: 8265551 - DNA, 22 bp, Homo sapiens
aggtagggaagaaggcatgaaa

SEQ ID NO: 8265552 - DNA, 22 bp, Homo sapiens
aggtagggggtttgggaactgc

SEQ ID NO: 8265553 - DNA, 22 bp, Homo sapiens
aggtacagcaatataagaggtc

SEQ ID NO: 8265554 - DNA, 23 bp, Homo sapiens
agtatgggggatcacgtggccct

SEQ ID NO: 8265555 - DNA, 22 bp, Homo sapiens
agtatttagcatagtggttagt

SEQ ID NO: 8265556 - DNA, 22 bp, Homo sapiens
agtatttagctgactcgctaca

SEQ ID NO: 8265557 - DNA, 22 bp, Homo sapiens
agtatttagagacacaagatgg

SEQ ID NO: 8265558 - DNA, 22 bp, Homo sapiens
agtatttagagacacaagacgg

SEQ ID NO: 8265559 - DNA, 22 bp, Homo sapiens
cctgttgctctgcatgagttta

SEQ ID NO: 8265560 - DNA, 22 bp, Homo sapiens
cctgttggaaggtgtaggcccc

SEQ ID NO: 8265561 - DNA, 22 bp, Homo sapiens
cgggcagtgtggctccagagtc

SEQ ID NO: 8265562 - DNA, 19 bp, Homo sapiens
ctaaacttatgtgaccaca

SEQ ID NO: 8265563 - DNA, 22 bp, Homo sapiens
cagcagcttctgttgatcagaa

SEQ ID NO: 8265564 - DNA, 22 bp, Homo sapiens
cagcaggaaagacatctgagca

SEQ ID NO: 8265565 - DNA, 22 bp, Homo sapiens
cagcaccctttccactgccttg

SEQ ID NO: 8265566 - DNA, 22 bp, Homo sapiens
cagcagctagaggaagggcaga

SEQ ID NO: 8265567 - DNA, 22 bp, Homo sapiens
cagcagctgatggggaagtgat

SEQ ID NO: 8265568 - DNA, 22 bp, Homo sapiens
cagcagctgcaaatggaaacag

SEQ ID NO: 8265569 - DNA, 22 bp, Homo sapiens
cagcagctgggaaggaggctga

SEQ ID NO: 8265570 - DNA, 22 bp, Homo sapiens
cagcaggctgcgattgctcatt

SEQ ID NO: 8265571 - DNA, 22 bp, Homo sapiens
cagcaggctgcgattgctcatt

SEQ ID NO: 8265572 - DNA, 22 bp, Homo sapiens
cagcaggctctgagtggctgcc

SEQ ID NO: 8265573 - DNA, 22 bp, Homo sapiens
cagcaggcgttgggagaaagac

SEQ ID NO: 8265574 - DNA, 20 bp, Homo sapiens
cagcaggctatggggcaccc

SEQ ID NO: 8265575 - DNA, 22 bp, Homo sapiens
cagcaggcggcccgcgggcccg

SEQ ID NO: 8265576 - DNA, 22 bp, Homo sapiens
gtctgtggagttgcttgctgga

SEQ ID NO: 8265577 - DNA, 22 bp, Homo sapiens
cagcccccatggggaggtcaag

SEQ ID NO: 8265578 - DNA, 22 bp, Homo sapiens
cagccccatggtgtgctccagc

SEQ ID NO: 8265579 - DNA, 22 bp, Homo sapiens
gtctggaaattaagaggaggtt

SEQ ID NO: 8265580 - DNA, 22 bp, Homo sapiens
gtgctgtgtgatccatgctggc

SEQ ID NO: 8265581 - DNA, 22 bp, Homo sapiens
gtgccctcacaaagtggaaaga

SEQ ID NO: 8265582 - DNA, 22 bp, Homo sapiens
gtgccctcctgaagccatcaca

SEQ ID NO: 8265583 - DNA, 22 bp, Homo sapiens
gtgcccagttgaggccaggact

SEQ ID NO: 8265584 - DNA, 22 bp, Homo sapiens
gtgcccagtgcaggcccgcagg

SEQ ID NO: 8265585 - DNA, 20 bp, Homo sapiens
gtgcccagttggtgacagac

SEQ ID NO: 8265586 - DNA, 22 bp, Homo sapiens
gtgcccaggtgtccctgagaag

SEQ ID NO: 8265587 - DNA, 22 bp, Homo sapiens
ggggagaccatctgaaggtgat

SEQ ID NO: 8265588 - DNA, 22 bp, Homo sapiens
ggggagagtcctttccagttcc

SEQ ID NO: 8265589 - DNA, 22 bp, Homo sapiens
cagagtcatgggccgtcaggca

SEQ ID NO: 8265590 - DNA, 22 bp, Homo sapiens
ggtctggaataaggtccaggaa

SEQ ID NO: 8265591 - DNA, 22 bp, Homo sapiens
ggtctggaagcgcagtaggctg

SEQ ID NO: 8265592 - DNA, 22 bp, Homo sapiens
cagagcctctcagaggtcagac

SEQ ID NO: 8265593 - DNA, 22 bp, Homo sapiens
cagagctgcttcccagtttgtg

SEQ ID NO: 8265594 - DNA, 22 bp, Homo sapiens
gggctgagtcatctggggcctc

SEQ ID NO: 8265595 - DNA, 20 bp, Homo sapiens
cagaggcaaggagacttgga

SEQ ID NO: 8265596 - DNA, 22 bp, Homo sapiens
cagaggcaaaagaggtggaggt

SEQ ID NO: 8265597 - DNA, 22 bp, Homo sapiens
gggccagacctcttctcaggga

SEQ ID NO: 8265598 - DNA, 22 bp, Homo sapiens
gggccagcctactgctagaccc

SEQ ID NO: 8265599 - DNA, 22 bp, Homo sapiens
gggcagtgtcggggcccaggga

SEQ ID NO: 8265600 - DNA, 19 bp, Homo sapiens
cagagcctcagagctagaa

SEQ ID NO: 8265601 - DNA, 22 bp, Homo sapiens
cagactctcttccatgcatcac

SEQ ID NO: 8265602 - DNA, 22 bp, Homo sapiens
cagactggccacatctgcactg

SEQ ID NO: 8265603 - DNA, 22 bp, Homo sapiens
cagactgggagtcaggaagaag

SEQ ID NO: 8265604 - DNA, 22 bp, Homo sapiens
cagactggctgaaggccgagtg

SEQ ID NO: 8265605 - DNA, 22 bp, Homo sapiens
gggcagcagagccctgccgagt

SEQ ID NO: 8265606 - DNA, 17 bp, Homo sapiens
ggcttatctgttgggtg

SEQ ID NO: 8265607 - DNA, 22 bp, Homo sapiens
gggcagtggtccaggctacagc

SEQ ID NO: 8265608 - DNA, 22 bp, Homo sapiens
cagagacagggcagggagtgtg

SEQ ID NO: 8265609 - DNA, 22 bp, Homo sapiens
cagagacagggcagggagtgtg

SEQ ID NO: 8265610 - DNA, 22 bp, Homo sapiens
gggcagcagcaggaggtctctg

SEQ ID NO: 8265611 - DNA, 22 bp, Homo sapiens
gggcagcatcaggaggggcttt

SEQ ID NO: 8265612 - DNA, 22 bp, Homo sapiens
gggcagcataacaatcactgaa

SEQ ID NO: 8265613 - DNA, 22 bp, Homo sapiens
gggcagcattctgtgggcaggt

SEQ ID NO: 8265614 - DNA, 22 bp, Homo sapiens
gggcagcatttgaaaaacagat

SEQ ID NO: 8265615 - DNA, 22 bp, Homo sapiens
cagagacagcctgggagggaca

SEQ ID NO: 8265616 - DNA, 22 bp, Homo sapiens
cagagacagcctgggagggaca

SEQ ID NO: 8265617 - DNA, 22 bp, Homo sapiens
ggccaagatggaaggagagatg

SEQ ID NO: 8265618 - DNA, 19 bp, Homo sapiens
ggccactcctggtgactgg

SEQ ID NO: 8265619 - DNA, 22 bp, Homo sapiens
ggcagggcagcgctgattaggg

SEQ ID NO: 8265620 - DNA, 22 bp, Homo sapiens
ggcagggcagcgctgattaggg

SEQ ID NO: 8265621 - DNA, 22 bp, Homo sapiens
ggcagggcaggaaagtcaggaa

SEQ ID NO: 8265622 - DNA, 22 bp, Homo sapiens
ggcagggcaggaaagtcaggaa

SEQ ID NO: 8265623 - DNA, 22 bp, Homo sapiens
ggccccaggtagaagatataga

SEQ ID NO: 8265624 - DNA, 22 bp, Homo sapiens
cacctttaatgagcaccagccg

SEQ ID NO: 8265625 - DNA, 22 bp, Homo sapiens
ggcctctctccagtcagtgcag

SEQ ID NO: 8265626 - DNA, 22 bp, Homo sapiens
ggcaggcaggagcgtgcttggg

SEQ ID NO: 8265627 - DNA, 22 bp, Homo sapiens
ggcaggcatggggtctgccatt

SEQ ID NO: 8265628 - DNA, 22 bp, Homo sapiens
ggaggtgcagagtagggttggt

SEQ ID NO: 8265629 - DNA, 22 bp, Homo sapiens
cacagggaaccaaggctgggcc

SEQ ID NO: 8265630 - DNA, 22 bp, Homo sapiens
ggaggtgctggcggccagctct

SEQ ID NO: 8265631 - DNA, 22 bp, Homo sapiens
ggaggtgctgatcccagtcaac

SEQ ID NO: 8265632 - DNA, 22 bp, Homo sapiens
ggctccaggtgcatgccaggct

SEQ ID NO: 8265633 - DNA, 20 bp, Homo sapiens
ggcctgagcatggctggcag

SEQ ID NO: 8265634 - DNA, 22 bp, Homo sapiens
gctggctggctgtgcaaaggca

SEQ ID NO: 8265635 - DNA, 22 bp, Homo sapiens
gctggctgggtccctgagaggc

SEQ ID NO: 8265636 - DNA, 21 bp, Homo sapiens
gctggctgtcccagggaagca

SEQ ID NO: 8265637 - DNA, 22 bp, Homo sapiens
caagggaagaggacagggacct

SEQ ID NO: 8265638 - DNA, 22 bp, Homo sapiens
gctggaggctggagtgcagtgg

SEQ ID NO: 8265639 - DNA, 22 bp, Homo sapiens
caaatgtgacttttgggcttct

SEQ ID NO: 8265640 - DNA, 22 bp, Homo sapiens
gctggagcttgagaggacaggg

SEQ ID NO: 8265641 - DNA, 22 bp, Homo sapiens
gctggaggatcacttgagccca

SEQ ID NO: 8265642 - DNA, 22 bp, Homo sapiens
gctttctgtaggtagttactgt

SEQ ID NO: 8265643 - DNA, 22 bp, Homo sapiens
gctgttcattagaaatagaatg

SEQ ID NO: 8265644 - DNA, 22 bp, Homo sapiens
ggaggcaggaaagacaggttca

SEQ ID NO: 8265645 - DNA, 23 bp, Homo sapiens
ggagctgctgttgggggagctgc

SEQ ID NO: 8265646 - DNA, 22 bp, Homo sapiens
ggagctgcttcttgctgtgggt

SEQ ID NO: 8265647 - DNA, 22 bp, Homo sapiens
ggagcaggcagggccgtgtctg

SEQ ID NO: 8265648 - DNA, 22 bp, Homo sapiens
ggagcaggcagggccgtgtctg

SEQ ID NO: 8265649 - DNA, 19 bp, Homo sapiens
ggagccgccgcccttcatt

SEQ ID NO: 8265650 - DNA, 22 bp, Homo sapiens
cacagagagctacgtgcagcgt

SEQ ID NO: 8265651 - DNA, 22 bp, Homo sapiens
cacagaggaaaggcagttggta

SEQ ID NO: 8265652 - DNA, 22 bp, Homo sapiens
cacagaggactgtagcggggag

SEQ ID NO: 8265653 - DNA, 22 bp, Homo sapiens
cacagaggcaaccttctggggt

SEQ ID NO: 8265654 - DNA, 22 bp, Homo sapiens
ggactgggagaatggaggcaag

SEQ ID NO: 8265655 - DNA, 22 bp, Homo sapiens
cacagagaaaatgttggtgctt

SEQ ID NO: 8265656 - DNA, 22 bp, Homo sapiens
cacagaattttctctttacaat

SEQ ID NO: 8265657 - DNA, 22 bp, Homo sapiens
cacagaatggaccagttttaga

SEQ ID NO: 8265658 - DNA, 22 bp, Homo sapiens
ggactgggccaggggttggact

SEQ ID NO: 8265659 - DNA, 17 bp, Homo sapiens
ggactgggcggggcagg

SEQ ID NO: 8265660 - DNA, 22 bp, Homo sapiens
cacagagaccccttctggggcc

SEQ ID NO: 8265661 - DNA, 22 bp, Homo sapiens
ggaaggggagctggaaagggta

SEQ ID NO: 8265662 - DNA, 22 bp, Homo sapiens
ggaaggggagctggaaagggta

SEQ ID NO: 8265663 - DNA, 21 bp, Homo sapiens
cacagaatatacattttagtt

SEQ ID NO: 8265664 - DNA, 22 bp, Homo sapiens
gaggcagcagggctggttcctt

SEQ ID NO: 8265665 - DNA, 22 bp, Homo sapiens
gaggcagcattcgcatagacag

SEQ ID NO: 8265666 - DNA, 22 bp, Homo sapiens
gaggcagccagaggttctcatt

SEQ ID NO: 8265667 - DNA, 22 bp, Homo sapiens
gaggcagcctcagtggacctcg

SEQ ID NO: 8265668 - DNA, 22 bp, Homo sapiens
gaggagaagggcacggagaaaa

SEQ ID NO: 8265669 - DNA, 22 bp, Homo sapiens
gaggagaagctaagaaacacag

SEQ ID NO: 8265670 - DNA, 22 bp, Homo sapiens
gaggagaagctattggaaggac

SEQ ID NO: 8265671 - DNA, 22 bp, Homo sapiens
gaggagaaattatccttggtgt

SEQ ID NO: 8265672 - DNA, 22 bp, Homo sapiens
atgggctgggatctgagtgtca

SEQ ID NO: 8265673 - DNA, 22 bp, Homo sapiens
atggggagctcaccacctgttt

SEQ ID NO: 8265674 - DNA, 22 bp, Homo sapiens
atggggagagcctctgtcccca

SEQ ID NO: 8265675 - DNA, 22 bp, Homo sapiens
atggggagagaagggctgagct

SEQ ID NO: 8265676 - DNA, 22 bp, Homo sapiens
atgggctgacccagtcgtggca

SEQ ID NO: 8265677 - DNA, 22 bp, Homo sapiens
atgggagaaacatcatgaggca

SEQ ID NO: 8265678 - DNA, 22 bp, Homo sapiens
atgggagaaacatcatgaggca

SEQ ID NO: 8265679 - DNA, 22 bp, Homo sapiens
atgggcagggcagtgtataaga

SEQ ID NO: 8265680 - DNA, 22 bp, Homo sapiens
gagatggggtcagctgggacat

SEQ ID NO: 8265681 - DNA, 22 bp, Homo sapiens
gagatggccctggcatgtagct

SEQ ID NO: 8265682 - DNA, 21 bp, Homo sapiens
gagatggcccagtagcgggcc

SEQ ID NO: 8265683 - DNA, 22 bp, Homo sapiens
atggagggtggtaagacagaga

SEQ ID NO: 8265684 - DNA, 22 bp, Homo sapiens
gagatggccagtgccaggacaa

SEQ ID NO: 8265685 - DNA, 22 bp, Homo sapiens
atggaggatgtgcagcatgggc

SEQ ID NO: 8265686 - DNA, 22 bp, Homo sapiens
gactgggctccaagagggagag

SEQ ID NO: 8265687 - DNA, 22 bp, Homo sapiens
gagagagctctgtgcctgggat

SEQ ID NO: 8265688 - DNA, 22 bp, Homo sapiens
gagagcacatgaacatggagga

SEQ ID NO: 8265689 - DNA, 22 bp, Homo sapiens
gagggcctggcacagggaggct

SEQ ID NO: 8265690 - DNA, 22 bp, Homo sapiens
atgtgacagtgtttgacagatg

SEQ ID NO: 8265691 - DNA, 22 bp, Homo sapiens
atgtccttttaaaatgtgagaa

SEQ ID NO: 8265692 - DNA, 22 bp, Homo sapiens
atgtccttaatctgaatgttag

SEQ ID NO: 8265693 - DNA, 22 bp, Homo sapiens
gaggcagcgggtcaggaccgtg

SEQ ID NO: 8265694 - DNA, 22 bp, Homo sapiens
gaggtggccaagcgaggaaggg

SEQ ID NO: 8265695 - DNA, 22 bp, Homo sapiens
gaggtggcactgtgaggagcac

SEQ ID NO: 8265696 - DNA, 22 bp, Homo sapiens
atgttgggaaggccgcaggcac

SEQ ID NO: 8265697 - DNA, 22 bp, Homo sapiens
gacgcatcaggaggcgaggagc

SEQ ID NO: 8265698 - DNA, 22 bp, Homo sapiens
gacctttagtgtcatgttatat

SEQ ID NO: 8265699 - DNA, 22 bp, Homo sapiens
gacctttagtgtccaatattca

SEQ ID NO: 8265700 - DNA, 22 bp, Homo sapiens
gacggagctggttgctgcggct

SEQ ID NO: 8265701 - DNA, 21 bp, Homo sapiens
gactggagagaggaagtctgg

SEQ ID NO: 8265702 - DNA, 22 bp, Homo sapiens
gactgggcagccggtagggaag

SEQ ID NO: 8265703 - DNA, 21 bp, Homo sapiens
gacctttacatttttcactgt

SEQ ID NO: 8265704 - DNA, 22 bp, Homo sapiens
gacctttaatgtttctaccact

SEQ ID NO: 8265705 - DNA, 22 bp, Homo sapiens
gacatttctagcccataaaact

SEQ ID NO: 8265706 - DNA, 22 bp, Homo sapiens
gacatttctagcccataaaact

SEQ ID NO: 8265707 - DNA, 22 bp, Homo sapiens
gaatcagcctgagtttgcagct

SEQ ID NO: 8265708 - DNA, 22 bp, Homo sapiens
gaatcagatactgatttcagtc

SEQ ID NO: 8265709 - DNA, 22 bp, Homo sapiens
gaacaaattctcatcaacttgt

SEQ ID NO: 8265710 - DNA, 22 bp, Homo sapiens
gaacaaatcccttcctgtctcc

SEQ ID NO: 8265711 - DNA, 22 bp, Homo sapiens
gaacaaattggagaaatcagga

SEQ ID NO: 8265712 - DNA, 22 bp, Homo sapiens
gaacaactccaagggacatcat

SEQ ID NO: 8265713 - DNA, 22 bp, Homo sapiens
atgatatatgtgttgagcttgc

SEQ ID NO: 8265714 - DNA, 21 bp, Homo sapiens
atgatatgcttgtatttccaa

SEQ ID NO: 8265715 - DNA, 22 bp, Homo sapiens
atgatggaggccgtgatggacg

SEQ ID NO: 8265716 - DNA, 22 bp, Homo sapiens
atctggaggcaaaggggcgtga

SEQ ID NO: 8265717 - DNA, 22 bp, Homo sapiens
atctggaggattctgggacttg

SEQ ID NO: 8265718 - DNA, 22 bp, Homo sapiens
atctggagagctggcagcccag

SEQ ID NO: 8265719 - DNA, 22 bp, Homo sapiens
gccaggctggggggagatgtct

SEQ ID NO: 8265720 - DNA, 22 bp, Homo sapiens
gccacaggtactatgggagaga

SEQ ID NO: 8265721 - DNA, 19 bp, Homo sapiens
gccaggcctggacctgcag

SEQ ID NO: 8265722 - DNA, 22 bp, Homo sapiens
gccacagtcactgctgcagggg

SEQ ID NO: 8265723 - DNA, 21 bp, Homo sapiens
gcccacagtgaggaggatccc

SEQ ID NO: 8265724 - DNA, 22 bp, Homo sapiens
gcccacagttaatgggggctct

SEQ ID NO: 8265725 - DNA, 22 bp, Homo sapiens
gcccacagtgtagcaggtactc

SEQ ID NO: 8265726 - DNA, 22 bp, Homo sapiens
atttctgttgcttataaattac

SEQ ID NO: 8265727 - DNA, 22 bp, Homo sapiens
gcccccagctctcaagctcaaa

SEQ ID NO: 8265728 - DNA, 22 bp, Homo sapiens
gcccccaggctctggagaacct

SEQ ID NO: 8265729 - DNA, 22 bp, Homo sapiens
gcccccagaagggccacagatt

SEQ ID NO: 8265730 - DNA, 22 bp, Homo sapiens
gcccccagacctcagtgggctg

SEQ ID NO: 8265731 - DNA, 22 bp, Homo sapiens
gcccccagagaatgaggtacga

SEQ ID NO: 8265732 - DNA, 22 bp, Homo sapiens
gcctctgatggaggccagcgct

SEQ ID NO: 8265733 - DNA, 22 bp, Homo sapiens
gcctggattccttgtttctcag

SEQ ID NO: 8265734 - DNA, 22 bp, Homo sapiens
gcctgagacagtgtggtccaat

SEQ ID NO: 8265735 - DNA, 22 bp, Homo sapiens
gctgactgctcagggccagctg

SEQ ID NO: 8265736 - DNA, 22 bp, Homo sapiens
gctgactggttcaggtcccgct

SEQ ID NO: 8265737 - DNA, 22 bp, Homo sapiens
gctgactgtccgctgctcccgg

SEQ ID NO: 8265738 - DNA, 22 bp, Homo sapiens
caaatagaactcacagacaaga

SEQ ID NO: 8265739 - DNA, 22 bp, Homo sapiens
caaagctggactgctcagttca

SEQ ID NO: 8265740 - DNA, 18 bp, Homo sapiens
caaagctcacgttccatc

SEQ ID NO: 8265741 - DNA, 22 bp, Homo sapiens
caaagctcgccacctctgaggg

SEQ ID NO: 8265742 - DNA, 21 bp, Homo sapiens
caaagctcattctttggtcat

SEQ ID NO: 8265743 - DNA, 22 bp, Homo sapiens
caaagctcagccctccaatgaa

SEQ ID NO: 8265744 - DNA, 22 bp, Homo sapiens
caaagctcatgctcttagccat

SEQ ID NO: 8265745 - DNA, 22 bp, Homo sapiens
caaaggaggtgataggccctct

SEQ ID NO: 8265746 - DNA, 20 bp, Homo sapiens
caaagcagtaggataaaaat

SEQ ID NO: 8265747 - DNA, 22 bp, Homo sapiens
caaagcaggcttgtcaaattgc

SEQ ID NO: 8265748 - DNA, 22 bp, Homo sapiens
attagtgtacatctcacacgca

SEQ ID NO: 8265749 - DNA, 22 bp, Homo sapiens
attagtgtcatgttgaggactt

SEQ ID NO: 8265750 - DNA, 22 bp, Homo sapiens
attagtgtctgtgaataattct

SEQ ID NO: 8265751 - DNA, 22 bp, Homo sapiens
attagtgtggaccctaatttaa

SEQ ID NO: 8265752 - DNA, 22 bp, Homo sapiens
attagtgtgtaggctggaaaaa

SEQ ID NO: 8265753 - DNA, 22 bp, Homo sapiens
attagtgttcttatcttctagg

SEQ ID NO: 8265754 - DNA, 22 bp, Homo sapiens
attagtgttgtaagaagctgcc

SEQ ID NO: 8265755 - DNA, 22 bp, Homo sapiens
attagtgttgtggcttcatggc

SEQ ID NO: 8265756 - DNA, 22 bp, Homo sapiens
attcaactgtaaacttgttcac

SEQ ID NO: 8265757 - DNA, 22 bp, Homo sapiens
gcagcagagctttgtcctggct

SEQ ID NO: 8265758 - DNA, 17 bp, Homo sapiens
gcagcagagagaccctc

SEQ ID NO: 8265759 - DNA, 21 bp, Homo sapiens
gcagcagaggcttgacagaca

SEQ ID NO: 8265760 - DNA, 20 bp, Homo sapiens
gcagcagacagacaggggac

SEQ ID NO: 8265761 - DNA, 22 bp, Homo sapiens
gcagcagagaccccaggaagga

SEQ ID NO: 8265762 - DNA, 22 bp, Homo sapiens
gcagcagagtttgggagatggt

SEQ ID NO: 8265763 - DNA, 22 bp, Homo sapiens
gcagcagatgctttcatggaca

SEQ ID NO: 8265764 - DNA, 22 bp, Homo sapiens
gcagcagagtagacagagccct

SEQ ID NO: 8265765 - DNA, 22 bp, Homo sapiens
attcacagtttcctcatattct

SEQ ID NO: 8265766 - DNA, 19 bp, Homo sapiens
gcagctgcttgaaaagaaa

SEQ ID NO: 8265767 - DNA, 22 bp, Homo sapiens
gcagctgctggagggaggcagg

SEQ ID NO: 8265768 - DNA, 22 bp, Homo sapiens
gcagctgcgctggtgtggggca

SEQ ID NO: 8265769 - DNA, 22 bp, Homo sapiens
gcagctgctggaagttcctgcc

SEQ ID NO: 8265770 - DNA, 22 bp, Homo sapiens
gcagctgcctattcagggcttg

SEQ ID NO: 8265771 - DNA, 22 bp, Homo sapiens
gcagctgcgaagaagtctatct

SEQ ID NO: 8265772 - DNA, 22 bp, Homo sapiens
gcagctgccttcagctggatgg

SEQ ID NO: 8265773 - DNA, 22 bp, Homo sapiens
gcaggccttggcaatgagcctg

SEQ ID NO: 8265774 - DNA, 21 bp, Homo sapiens
gcagtgcttcgagactgtggt

SEQ ID NO: 8265775 - DNA, 23 bp, Homo sapiens
gcagtgcttggcacagctgggtc

SEQ ID NO: 8265776 - DNA, 22 bp, Homo sapiens
attgtatttgtacaagacatgt

SEQ ID NO: 8265777 - DNA, 22 bp, Homo sapiens
attgtgacaaatgtgccatact

SEQ ID NO: 8265778 - DNA, 21 bp, Homo sapiens
attgtgaccatcattttggaa

SEQ ID NO: 8265779 - DNA, 22 bp, Homo sapiens
attgtgacagtacctgccatgg

SEQ ID NO: 8265780 - DNA, 22 bp, Homo sapiens
attgtgactcctgatatagaaa

SEQ ID NO: 8265781 - DNA, 22 bp, Homo sapiens
attgtgactttgagctgaaagc

SEQ ID NO: 8265782 - DNA, 18 bp, Homo sapiens
attgtgactctcagttca

SEQ ID NO: 8265783 - DNA, 22 bp, Homo sapiens
attgtctttccactgagaagtt

SEQ ID NO: 8265784 - DNA, 22 bp, Homo sapiens
gccaaaggacctgtgggtgaca

SEQ ID NO: 8265785 - DNA, 23 bp, Homo sapiens
gccaaaggtctgttcagtggtga

SEQ ID NO: 8265786 - DNA, 22 bp, Homo sapiens
gccaaaggttggcctgtgagtt

SEQ ID NO: 8265787 - DNA, 22 bp, Homo sapiens
gccaacaggccttgctctgctc

SEQ ID NO: 8265788 - DNA, 22 bp, Homo sapiens
gccaacagctgggtgcatgtcc

SEQ ID NO: 8265789 - DNA, 22 bp, Homo sapiens
tggctggctgtcaaggaaagcc

SEQ ID NO: 8265790 - DNA, 22 bp, Homo sapiens
cctctgagtcctccctggttgc

SEQ ID NO: 8265791 - DNA, 22 bp, Homo sapiens
cctctgctctggtccatgtgct

SEQ ID NO: 8265792 - DNA, 22 bp, Homo sapiens
cctctgctctggtccatgtgct

SEQ ID NO: 8265793 - DNA, 19 bp, Homo sapiens
cctctgctccagtttcctt

SEQ ID NO: 8265794 - DNA, 22 bp, Homo sapiens
tgggaaggaactgcctttagct

SEQ ID NO: 8265795 - DNA, 22 bp, Homo sapiens
tgggaaggacagaacataattg

SEQ ID NO: 8265796 - DNA, 22 bp, Homo sapiens
tgggaaggacgtgtcagtggca

SEQ ID NO: 8265797 - DNA, 22 bp, Homo sapiens
tgggcccatcattgctgtgggc

SEQ ID NO: 8265798 - DNA, 22 bp, Homo sapiens
tgggcccaagtgcaatgcagtg

SEQ ID NO: 8265799 - DNA, 22 bp, Homo sapiens
tgggcccacatgcctttctgcc

SEQ ID NO: 8265800 - DNA, 21 bp, Homo sapiens
tgggcccagctctgtctgttt

SEQ ID NO: 8265801 - DNA, 22 bp, Homo sapiens
tgggcccaagagagtctccaac

SEQ ID NO: 8265802 - DNA, 21 bp, Homo sapiens
tgggcccagttcccgctgggc

SEQ ID NO: 8265803 - DNA, 22 bp, Homo sapiens
tgggcccaggtcctgggagaag

SEQ ID NO: 8265804 - DNA, 22 bp, Homo sapiens
tgggctggcccaccacacctcg

SEQ ID NO: 8265805 - DNA, 22 bp, Homo sapiens
tgggctggagcttgttgcttcc

SEQ ID NO: 8265806 - DNA, 22 bp, Homo sapiens
tgggagtgtaaattagttcaac

SEQ ID NO: 8265807 - DNA, 18 bp, Homo sapiens
tgggagtgggagtggata

SEQ ID NO: 8265808 - DNA, 22 bp, Homo sapiens
cctgagatggccagtgctggga

SEQ ID NO: 8265809 - DNA, 22 bp, Homo sapiens
cctgagatcagtgcatttggtg

SEQ ID NO: 8265810 - DNA, 22 bp, Homo sapiens
cctcaggcttaacttgtcttga

SEQ ID NO: 8265811 - DNA, 22 bp, Homo sapiens
cctcaggctgtcttccttctgg

SEQ ID NO: 8265812 - DNA, 22 bp, Homo sapiens
cctcaggcttacgggcaatgga

SEQ ID NO: 8265813 - DNA, 22 bp, Homo sapiens
cctcaggcttcgtcttccaccc

SEQ ID NO: 8265814 - DNA, 22 bp, Homo sapiens
cctcaggcttctagttcagtga

SEQ ID NO: 8265815 - DNA, 22 bp, Homo sapiens
cctcaggcttgtgagccttcag

SEQ ID NO: 8265816 - DNA, 22 bp, Homo sapiens
cctcaggctctgggtgcctacc

SEQ ID NO: 8265817 - DNA, 22 bp, Homo sapiens
cctcaggctgctcacacttgtc

SEQ ID NO: 8265818 - DNA, 22 bp, Homo sapiens
cctcaggctgggctgcccctgg

SEQ ID NO: 8265819 - DNA, 22 bp, Homo sapiens
cctcaggcctgccagagcccca

SEQ ID NO: 8265820 - DNA, 22 bp, Homo sapiens
cctcaggcctctgcctcattgg

SEQ ID NO: 8265821 - DNA, 22 bp, Homo sapiens
cctcaggctagctactgtccct

SEQ ID NO: 8265822 - DNA, 22 bp, Homo sapiens
cctcagcatcctcatgctcagt

SEQ ID NO: 8265823 - DNA, 22 bp, Homo sapiens
cctcagcagacacgcttctcac

SEQ ID NO: 8265824 - DNA, 22 bp, Homo sapiens
cctcagcatcctcctgctcagt

SEQ ID NO: 8265825 - DNA, 22 bp, Homo sapiens
cctcagagttggaatcacattt

SEQ ID NO: 8265826 - DNA, 17 bp, Homo sapiens
cctcagcttctttcctc

SEQ ID NO: 8265827 - DNA, 22 bp, Homo sapiens
tggcccagcactccaagtaggg

SEQ ID NO: 8265828 - DNA, 20 bp, Homo sapiens
tggcccagcacgacgaggac

SEQ ID NO: 8265829 - DNA, 22 bp, Homo sapiens
tggcccagagcactgctgggca

SEQ ID NO: 8265830 - DNA, 22 bp, Homo sapiens
tggcccagatctctgaccttga

SEQ ID NO: 8265831 - DNA, 19 bp, Homo sapiens
tggcccagatggtcctggg

SEQ ID NO: 8265832 - DNA, 22 bp, Homo sapiens
cctcatggccttgagctgaggg

SEQ ID NO: 8265833 - DNA, 22 bp, Homo sapiens
cctcatgctgcatctctgaggt

SEQ ID NO: 8265834 - DNA, 18 bp, Homo sapiens
cctcagggagagagacgc

SEQ ID NO: 8265835 - DNA, 22 bp, Homo sapiens
tggcagggtgggcttcagcccc

SEQ ID NO: 8265836 - DNA, 22 bp, Homo sapiens
tggcagggtgggcttcagcccc

SEQ ID NO: 8265837 - DNA, 22 bp, Homo sapiens
tggcagggttggccaccttacc

SEQ ID NO: 8265838 - DNA, 22 bp, Homo sapiens
tggcagggtggcaacttttggt

SEQ ID NO: 8265839 - DNA, 22 bp, Homo sapiens
tggcagaggagaattaagatta

SEQ ID NO: 8265840 - DNA, 22 bp, Homo sapiens
tggcagaggaggctcagattga

SEQ ID NO: 8265841 - DNA, 19 bp, Homo sapiens
tggcagaggcagtttgtac

SEQ ID NO: 8265842 - DNA, 22 bp, Homo sapiens
tggcagaggtaattcaaatccc

SEQ ID NO: 8265843 - DNA, 22 bp, Homo sapiens
tggcagaggctctgtgatgttg

SEQ ID NO: 8265844 - DNA, 22 bp, Homo sapiens
ccctgcagccttgcatgccttc

SEQ ID NO: 8265845 - DNA, 22 bp, Homo sapiens
ccctgcaggctcagactggagt

SEQ ID NO: 8265846 - DNA, 22 bp, Homo sapiens
ccctgcaggggacctgcagcct

SEQ ID NO: 8265847 - DNA, 22 bp, Homo sapiens
tggagcaggccggaagtggctt

SEQ ID NO: 8265848 - DNA, 18 bp, Homo sapiens
tggagcaggtaggcatga

SEQ ID NO: 8265849 - DNA, 19 bp, Homo sapiens
tggcagaggacaaggactt

SEQ ID NO: 8265850 - DNA, 22 bp, Homo sapiens
cccagggaagggctacctgagg

SEQ ID NO: 8265851 - DNA, 22 bp, Homo sapiens
cccagggaatgactctggcctt

SEQ ID NO: 8265852 - DNA, 23 bp, Homo sapiens
cccagggacacgatgacacctcc

SEQ ID NO: 8265853 - DNA, 22 bp, Homo sapiens
cccaggggttctgagcagcagc

SEQ ID NO: 8265854 - DNA, 22 bp, Homo sapiens
cccaggggttctagaccagctt

SEQ ID NO: 8265855 - DNA, 22 bp, Homo sapiens
cccaggggttcaaggctgcagt

SEQ ID NO: 8265856 - DNA, 22 bp, Homo sapiens
cccagggacagatgggcagcta

SEQ ID NO: 8265857 - DNA, 22 bp, Homo sapiens
cccaggagacctagatctgttt

SEQ ID NO: 8265858 - DNA, 22 bp, Homo sapiens
tgccagtgaaacgtggtctcat

SEQ ID NO: 8265859 - DNA, 23 bp, Homo sapiens
tgctgtggatggcaggtccttgc

SEQ ID NO: 8265860 - DNA, 22 bp, Homo sapiens
tgctgtgctggcggcagaggcc

SEQ ID NO: 8265861 - DNA, 22 bp, Homo sapiens
tgctgtggattcagagatgaaa

SEQ ID NO: 8265862 - DNA, 22 bp, Homo sapiens
tgctgtggttcccagagtggat

SEQ ID NO: 8265863 - DNA, 22 bp, Homo sapiens
tggagcaggacggggagtggta

SEQ ID NO: 8265864 - DNA, 22 bp, Homo sapiens
tgctggagcccaggcggccttt

SEQ ID NO: 8265865 - DNA, 22 bp, Homo sapiens
tgctggagcccaggcggccttt

SEQ ID NO: 8265866 - DNA, 21 bp, Homo sapiens
tgctggcctcaagggtgactt

SEQ ID NO: 8265867 - DNA, 22 bp, Homo sapiens
ccccttttcgcttggcctcatc

SEQ ID NO: 8265868 - DNA, 22 bp, Homo sapiens
ccaggccccagggctggctttc

SEQ ID NO: 8265869 - DNA, 22 bp, Homo sapiens
ccaggcctggacgggtggcctg

SEQ ID NO: 8265870 - DNA, 22 bp, Homo sapiens
ccaggctctgtgtgggctagag

SEQ ID NO: 8265871 - DNA, 22 bp, Homo sapiens
ccaggccagcgctggctggagg

SEQ ID NO: 8265872 - DNA, 22 bp, Homo sapiens
ccaggagacccagggaaggagc

SEQ ID NO: 8265873 - DNA, 22 bp, Homo sapiens
ccaggagacaaagatgactgct

SEQ ID NO: 8265874 - DNA, 22 bp, Homo sapiens
ccaggagggaccgcggcatccc

SEQ ID NO: 8265875 - DNA, 22 bp, Homo sapiens
ccaggagtggctggtgaccttc

SEQ ID NO: 8265876 - DNA, 19 bp, Homo sapiens
ccaggagtggtggggtgag

SEQ ID NO: 8265877 - DNA, 22 bp, Homo sapiens
ccaggagtcaataaaggaagct

SEQ ID NO: 8265878 - DNA, 22 bp, Homo sapiens
ccaggagtctggatgaggtgtc

SEQ ID NO: 8265879 - DNA, 22 bp, Homo sapiens
ccaggagtgcagggatggtatc

SEQ ID NO: 8265880 - DNA, 22 bp, Homo sapiens
ccaggaggttgaggctgcagtg

SEQ ID NO: 8265881 - DNA, 22 bp, Homo sapiens
ccaggagttggaggttgcagtg

SEQ ID NO: 8265882 - DNA, 22 bp, Homo sapiens
ccaggagtttgaggctgcagtg

SEQ ID NO: 8265883 - DNA, 22 bp, Homo sapiens
ccaggagttggaggctgcagtg

SEQ ID NO: 8265884 - DNA, 22 bp, Homo sapiens
ccaggagttggaagctgccatg

SEQ ID NO: 8265885 - DNA, 22 bp, Homo sapiens
ccaggagaagcatctgagtgta

SEQ ID NO: 8265886 - DNA, 22 bp, Homo sapiens
ccaggagaataatggcagatta

SEQ ID NO: 8265887 - DNA, 22 bp, Homo sapiens
tctgggagcagatgatggtata

SEQ ID NO: 8265888 - DNA, 19 bp, Homo sapiens
tctgggagagtgaatctga

SEQ ID NO: 8265889 - DNA, 22 bp, Homo sapiens
tctggtactagaggagtgctgg

SEQ ID NO: 8265890 - DNA, 22 bp, Homo sapiens
tctgggagccatgccttggagt

SEQ ID NO: 8265891 - DNA, 22 bp, Homo sapiens
ccagctctcagcgggagactca

SEQ ID NO: 8265892 - DNA, 22 bp, Homo sapiens
ccagagactggctgagagatct

SEQ ID NO: 8265893 - DNA, 22 bp, Homo sapiens
ccagagagaaaatggagggcca

SEQ ID NO: 8265894 - DNA, 21 bp, Homo sapiens
ccagctgcctgcactttggac

SEQ ID NO: 8265895 - DNA, 21 bp, Homo sapiens
ccagctgctccttgaggttcc

SEQ ID NO: 8265896 - DNA, 22 bp, Homo sapiens
ccagctgctatcatgccatttc

SEQ ID NO: 8265897 - DNA, 22 bp, Homo sapiens
ccagctgctgcaccgtgcatgg

SEQ ID NO: 8265898 - DNA, 22 bp, Homo sapiens
ccagctgctgtgcagggaggct

SEQ ID NO: 8265899 - DNA, 22 bp, Homo sapiens
ccagctctgcagggcctggggt

SEQ ID NO: 8265900 - DNA, 22 bp, Homo sapiens
ccagctctctgcagaaaggact

SEQ ID NO: 8265901 - DNA, 22 bp, Homo sapiens
ccagctgcatgacattaggtga

SEQ ID NO: 8265902 - DNA, 22 bp, Homo sapiens
ccagctctgccaagcgtcagct

SEQ ID NO: 8265903 - DNA, 22 bp, Homo sapiens
ccagctgcagaatgttggggaa

SEQ ID NO: 8265904 - DNA, 22 bp, Homo sapiens
tgagggctaaattgtggcaggt

SEQ ID NO: 8265905 - DNA, 22 bp, Homo sapiens
tgaggcagcccactttccttag

SEQ ID NO: 8265906 - DNA, 22 bp, Homo sapiens
tgaggcagcattcttcaagaca

SEQ ID NO: 8265907 - DNA, 22 bp, Homo sapiens
tgaggcagcaattgtattgtat

SEQ ID NO: 8265908 - DNA, 20 bp, Homo sapiens
ccagtccctgagcaccaggg

SEQ ID NO: 8265909 - DNA, 22 bp, Homo sapiens
tgaggcagcctgcattaaagag

SEQ ID NO: 8265910 - DNA, 23 bp, Homo sapiens
ccagtctcacgtatacaggattt

SEQ ID NO: 8265911 - DNA, 23 bp, Homo sapiens
ccagtctctttccaaaatcacat

SEQ ID NO: 8265912 - DNA, 22 bp, Homo sapiens
ccatgtggctgctgacaacaga

SEQ ID NO: 8265913 - DNA, 22 bp, Homo sapiens
ccatgtggtgggaaggagaatg

SEQ ID NO: 8265914 - DNA, 22 bp, Homo sapiens
cccagacataacagcagagagg

SEQ ID NO: 8265915 - DNA, 22 bp, Homo sapiens
ccattgcactccatcctgggca

SEQ ID NO: 8265916 - DNA, 22 bp, Homo sapiens
ccatgttgtcaaacttagagta

SEQ ID NO: 8265917 - DNA, 22 bp, Homo sapiens
ccatgttgtatctcttatcggc

SEQ ID NO: 8265918 - DNA, 22 bp, Homo sapiens
ccatgttggaacttcacattct

SEQ ID NO: 8265919 - DNA, 22 bp, Homo sapiens
tgaggcagcaattgattattca

SEQ ID NO: 8265920 - DNA, 22 bp, Homo sapiens
tgaggcagagtaagatacatga

SEQ ID NO: 8265921 - DNA, 22 bp, Homo sapiens
tgaggcagatatttattgggtt

SEQ ID NO: 8265922 - DNA, 22 bp, Homo sapiens
tgaggcagaaattcctgttttc

SEQ ID NO: 8265923 - DNA, 22 bp, Homo sapiens
tgaggactacctggggtgggag

SEQ ID NO: 8265924 - DNA, 22 bp, Homo sapiens
tgaggcagaaaatagcagttca

SEQ ID NO: 8265925 - DNA, 23 bp, Homo sapiens
tgaggacctctcaggggccaggc

SEQ ID NO: 8265926 - DNA, 22 bp, Homo sapiens
ccaggggctgcagatccatggt

SEQ ID NO: 8265927 - DNA, 22 bp, Homo sapiens
ccaggggctctcagggtgtgtg

SEQ ID NO: 8265928 - DNA, 22 bp, Homo sapiens
ccagggctgctgtgggactcca

SEQ ID NO: 8265929 - DNA, 22 bp, Homo sapiens
tgaatgatggtgtgttcttgcc

SEQ ID NO: 8265930 - DNA, 22 bp, Homo sapiens
taagtcgtggatgattcttcgg

SEQ ID NO: 8265931 - DNA, 22 bp, Homo sapiens
taaggcagcctcagggtagggt

SEQ ID NO: 8265932 - DNA, 22 bp, Homo sapiens
caggcagatgctgacaagagtt

SEQ ID NO: 8265933 - DNA, 22 bp, Homo sapiens
caggcaccacactaggggctga

SEQ ID NO: 8265934 - DNA, 22 bp, Homo sapiens
caggcaccagtgagaagggcct

SEQ ID NO: 8265935 - DNA, 22 bp, Homo sapiens
caggcccaagactgatgagtct

SEQ ID NO: 8265936 - DNA, 22 bp, Homo sapiens
caggcccactgcttgtctagtc

SEQ ID NO: 8265937 - DNA, 22 bp, Homo sapiens
caggccaggtggcaggcaaaac

SEQ ID NO: 8265938 - DNA, 22 bp, Homo sapiens
caggcatgtggcccaggggtga

SEQ ID NO: 8265939 - DNA, 22 bp, Homo sapiens
tacaaaaaattgatactgacga

SEQ ID NO: 8265940 - DNA, 22 bp, Homo sapiens
caggcatggagaggcagagact

SEQ ID NO: 8265941 - DNA, 22 bp, Homo sapiens
taatgtgtgtcatcagtagagt

SEQ ID NO: 8265942 - DNA, 22 bp, Homo sapiens
taatgtatttgttcagaagagt

SEQ ID NO: 8265943 - DNA, 22 bp, Homo sapiens
taatatctggcattcaaacatg

SEQ ID NO: 8265944 - DNA, 22 bp, Homo sapiens
taatcacagaaacagactgttt

SEQ ID NO: 8265945 - DNA, 22 bp, Homo sapiens
tactttatcagcgtcaaaggta

SEQ ID NO: 8265946 - DNA, 22 bp, Homo sapiens
tactttatattgtggctggcca

SEQ ID NO: 8265947 - DNA, 18 bp, Homo sapiens
tactttattccccctcca

SEQ ID NO: 8265948 - DNA, 22 bp, Homo sapiens
tactttattcaggaaggctggt

SEQ ID NO: 8265949 - DNA, 22 bp, Homo sapiens
tactttattgtaaatgctgatg

SEQ ID NO: 8265950 - DNA, 22 bp, Homo sapiens
tacattgttcatgcatgagaaa

SEQ ID NO: 8265951 - DNA, 22 bp, Homo sapiens
caggcgggcaggtgcggcccct

SEQ ID NO: 8265952 - DNA, 22 bp, Homo sapiens
caggcgggacgtgggaggatca

SEQ ID NO: 8265953 - DNA, 22 bp, Homo sapiens
caggcccaggccagtggttccc

SEQ ID NO: 8265954 - DNA, 22 bp, Homo sapiens
caggccgggcactgcgctaggt

SEQ ID NO: 8265955 - DNA, 22 bp, Homo sapiens
caggccggggcggcgccatctt

SEQ ID NO: 8265956 - DNA, 22 bp, Homo sapiens
caggcctcctatgagcactagc

SEQ ID NO: 8265957 - DNA, 22 bp, Homo sapiens
caggcccagcccttagccaggt

SEQ ID NO: 8265958 - DNA, 22 bp, Homo sapiens
caggcccagcccagcccttcga

SEQ ID NO: 8265959 - DNA, 22 bp, Homo sapiens
caggcccagcccagcccttcga

SEQ ID NO: 8265960 - DNA, 22 bp, Homo sapiens
caggcctcgaggagacagctac

SEQ ID NO: 8265961 - DNA, 22 bp, Homo sapiens
caggcctgagacatctgagata

SEQ ID NO: 8265962 - DNA, 22 bp, Homo sapiens
cagggacaatggcagagcctga

SEQ ID NO: 8265963 - DNA, 22 bp, Homo sapiens
cagggaagaatagttagcaaag

SEQ ID NO: 8265964 - DNA, 22 bp, Homo sapiens
cagggaaggctgcaaatgttaa

SEQ ID NO: 8265965 - DNA, 22 bp, Homo sapiens
cagggaagagccgatgctgcag

SEQ ID NO: 8265966 - DNA, 22 bp, Homo sapiens
caggctgccgtggggtccaggc

SEQ ID NO: 8265967 - DNA, 22 bp, Homo sapiens
cagggccattggcgtggctgtc

SEQ ID NO: 8265968 - DNA, 22 bp, Homo sapiens
cagggcctcatcctcagagatt

SEQ ID NO: 8265969 - DNA, 22 bp, Homo sapiens
cagggcctcatggccggggtgc

SEQ ID NO: 8265970 - DNA, 22 bp, Homo sapiens
tagattgtagatcatgagactt

SEQ ID NO: 8265971 - DNA, 22 bp, Homo sapiens
cagggccatgaggcacagggtc

SEQ ID NO: 8265972 - DNA, 22 bp, Homo sapiens
cagggccagttctcgcagcagt

SEQ ID NO: 8265973 - DNA, 22 bp, Homo sapiens
cagggctgtaaattagtgctga

SEQ ID NO: 8265974 - DNA, 22 bp, Homo sapiens
caggggctgtttgcctcaggcc

SEQ ID NO: 8265975 - DNA, 22 bp, Homo sapiens
cagggctgtggctttgtgctgt

SEQ ID NO: 8265976 - DNA, 22 bp, Homo sapiens
caggggcctgtcctggcttctg

SEQ ID NO: 8265977 - DNA, 22 bp, Homo sapiens
caggtagggatatgatggtgat

SEQ ID NO: 8265978 - DNA, 22 bp, Homo sapiens
caggtaggaaaagggtgtcagg

SEQ ID NO: 8265979 - DNA, 22 bp, Homo sapiens
caggtaaggtcacattctgaag

SEQ ID NO: 8265980 - DNA, 22 bp, Homo sapiens
caggtccaattgcgctaaaatc

SEQ ID NO: 8265981 - DNA, 18 bp, Homo sapiens
caggtcagcctggcctca

SEQ ID NO: 8265982 - DNA, 22 bp, Homo sapiens
caggtgccgggaatgcagcaat

SEQ ID NO: 8265983 - DNA, 22 bp, Homo sapiens
caggtgggtacatcacagagac

SEQ ID NO: 8265984 - DNA, 22 bp, Homo sapiens
tcaagctgcatcagtgcagtga

SEQ ID NO: 8265985 - DNA, 22 bp, Homo sapiens
cagtcactggaatagctgagga

SEQ ID NO: 8265986 - DNA, 22 bp, Homo sapiens
tatttgtttctagtggcagcaa

SEQ ID NO: 8265987 - DNA, 22 bp, Homo sapiens
catctgctgacttgacaagtac

SEQ ID NO: 8265988 - DNA, 22 bp, Homo sapiens
catctgttgcttcctaacaagt

SEQ ID NO: 8265989 - DNA, 22 bp, Homo sapiens
tcagtcccaaggtcctgaggtg

SEQ ID NO: 8265990 - DNA, 23 bp, Homo sapiens
tcagtcccaacagcttctcctgg

SEQ ID NO: 8265991 - DNA, 22 bp, Homo sapiens
tcagtgctcaggggagccgagg

SEQ ID NO: 8265992 - DNA, 20 bp, Homo sapiens
tcagtgctcaggcaccaggt

SEQ ID NO: 8265993 - DNA, 22 bp, Homo sapiens
tccaggagaaggccatccagcg

SEQ ID NO: 8265994 - DNA, 22 bp, Homo sapiens
catggcaggaaggacatgcact

SEQ ID NO: 8265995 - DNA, 22 bp, Homo sapiens
catggcagctttgggaggagga

SEQ ID NO: 8265996 - DNA, 22 bp, Homo sapiens
catgcaggcctatggagcagtg

SEQ ID NO: 8265997 - DNA, 22 bp, Homo sapiens
tcaggccccttgtcagctctgt

SEQ ID NO: 8265998 - DNA, 22 bp, Homo sapiens
tcaggcccttctcccaggactc

SEQ ID NO: 8265999 - DNA, 22 bp, Homo sapiens
tcaggcccagagtcacggatcc

SEQ ID NO: 8266000 - DNA, 22 bp, Homo sapiens
tcaggccctttgctgctgcccc

SEQ ID NO: 8266001 - DNA, 22 bp, Homo sapiens
tcagagattcacgtcagtccca

SEQ ID NO: 8266002 - DNA, 22 bp, Homo sapiens
tcagagagttttcactagggtg

SEQ ID NO: 8266003 - DNA, 22 bp, Homo sapiens
tcagatatgaattcatatctct

SEQ ID NO: 8266004 - DNA, 22 bp, Homo sapiens
tcagatatagtcatttaaataa

SEQ ID NO: 8266005 - DNA, 22 bp, Homo sapiens
ccaagaggttgtgaggcaggca

SEQ ID NO: 8266006 - DNA, 18 bp, Homo sapiens
ccaaggcccctgctgggg

SEQ ID NO: 8266007 - DNA, 22 bp, Homo sapiens
tccttggggtaactccagcctg

SEQ ID NO: 8266008 - DNA, 19 bp, Homo sapiens
tccttccccccagcacaga

SEQ ID NO: 8266009 - DNA, 22 bp, Homo sapiens
tcctttaaagaactgtgctttt

SEQ ID NO: 8266010 - DNA, 22 bp, Homo sapiens
tcctttaaactcctttcaagtc

SEQ ID NO: 8266011 - DNA, 23 bp, Homo sapiens
tcctttaagatatcttattcctt

SEQ ID NO: 8266012 - DNA, 22 bp, Homo sapiens
tcctttaacttgattattttca

SEQ ID NO: 8266013 - DNA, 22 bp, Homo sapiens
tccttaaagttggggtgctgca

SEQ ID NO: 8266014 - DNA, 22 bp, Homo sapiens
ccagagacaaggagctggagtc

SEQ ID NO: 8266015 - DNA, 22 bp, Homo sapiens
ccactgtctgtgacatcagaaa

SEQ ID NO: 8266016 - DNA, 22 bp, Homo sapiens
tccctggggtatcgctgaggca

SEQ ID NO: 8266017 - DNA, 23 bp, Homo sapiens
tcctaactgattctgcagtctct

SEQ ID NO: 8266018 - DNA, 22 bp, Homo sapiens
catttaatagatgctgtttcag

SEQ ID NO: 8266019 - DNA, 22 bp, Homo sapiens
catttaatgcacggatgtagcc

SEQ ID NO: 8266020 - DNA, 22 bp, Homo sapiens
tccctcagaaattctctctgaa

SEQ ID NO: 8266021 - DNA, 22 bp, Homo sapiens
cattgtctggtaggaagtgggc

SEQ ID NO: 8266022 - DNA, 22 bp, Homo sapiens
catgggccatggtgaagccagg

SEQ ID NO: 8266023 - DNA, 19 bp, Homo sapiens
tccaggagcaaagccagtt

SEQ ID NO: 8266024 - DNA, 22 bp, Homo sapiens
tcccaccaggtgaccatttcat

SEQ ID NO: 8266025 - DNA, 22 bp, Homo sapiens
cattcttctggatagttagttg

SEQ ID NO: 8266026 - DNA, 22 bp, Homo sapiens
ctccagattctggatgactggg

SEQ ID NO: 8266027 - DNA, 22 bp, Homo sapiens
ctccagatccagctgagctgca

SEQ ID NO: 8266028 - DNA, 22 bp, Homo sapiens
ttgtacaacgttttaaatttga

SEQ ID NO: 8266029 - DNA, 22 bp, Homo sapiens
ctccaccccgtgccggtgctgg

SEQ ID NO: 8266030 - DNA, 22 bp, Homo sapiens
tttaatatccagtggatacaaa

SEQ ID NO: 8266031 - DNA, 22 bp, Homo sapiens
tttaacagatgtgaaattttca

SEQ ID NO: 8266032 - DNA, 22 bp, Homo sapiens
ctcccagccttcgccagtctga

SEQ ID NO: 8266033 - DNA, 22 bp, Homo sapiens
ttgtgggccattcagctgctct

SEQ ID NO: 8266034 - DNA, 23 bp, Homo sapiens
ttgtgggcagattccatggggag

SEQ ID NO: 8266035 - DNA, 22 bp, Homo sapiens
ctccagtgcgtcttagtaaacc

SEQ ID NO: 8266036 - DNA, 22 bp, Homo sapiens
ctccagccagagtgcctctgtt

SEQ ID NO: 8266037 - DNA, 20 bp, Homo sapiens
ctccagcccctgccctggtc

SEQ ID NO: 8266038 - DNA, 20 bp, Homo sapiens
ctccagcccctgccctggtc

SEQ ID NO: 8266039 - DNA, 22 bp, Homo sapiens
ttgtattttgttatgctactgc

SEQ ID NO: 8266040 - DNA, 22 bp, Homo sapiens
ctccagcctcagatgacggtac

SEQ ID NO: 8266041 - DNA, 22 bp, Homo sapiens
ctcctggatgcaggctgtctgc

SEQ ID NO: 8266042 - DNA, 22 bp, Homo sapiens
tttattgtttagaagggggctg

SEQ ID NO: 8266043 - DNA, 22 bp, Homo sapiens
tttattgttgttagtcataagt

SEQ ID NO: 8266044 - DNA, 22 bp, Homo sapiens
tttattgttatcatgggtgagt

SEQ ID NO: 8266045 - DNA, 22 bp, Homo sapiens
tttattgttgggtcttaagctg

SEQ ID NO: 8266046 - DNA, 22 bp, Homo sapiens
tttcctactgccctatacacac

SEQ ID NO: 8266047 - DNA, 22 bp, Homo sapiens
tttcacagttagcatgaggact

SEQ ID NO: 8266048 - DNA, 22 bp, Homo sapiens
ctgagcccgggtgctctacccc

SEQ ID NO: 8266049 - DNA, 22 bp, Homo sapiens
ctgagcccctctgacctcagag

SEQ ID NO: 8266050 - DNA, 22 bp, Homo sapiens
ctgagccctcctgcttgctgag

SEQ ID NO: 8266051 - DNA, 22 bp, Homo sapiens
ctgagcccgttgtgaatattcc

SEQ ID NO: 8266052 - DNA, 20 bp, Homo sapiens
ctgagcccccagcctgcagg

SEQ ID NO: 8266053 - DNA, 17 bp, Homo sapiens
ctgagccccgggcagct

SEQ ID NO: 8266054 - DNA, 20 bp, Homo sapiens
ctgagcccagatcccaggtc

SEQ ID NO: 8266055 - DNA, 22 bp, Homo sapiens
ctgagcccaggcgggagctgag

SEQ ID NO: 8266056 - DNA, 22 bp, Homo sapiens
ctgagcccattgggtgctgtta

SEQ ID NO: 8266057 - DNA, 22 bp, Homo sapiens
ctgagccccatctgaggtgccc

SEQ ID NO: 8266058 - DNA, 22 bp, Homo sapiens
ctgagcctgtgtttctctggca

SEQ ID NO: 8266059 - DNA, 22 bp, Homo sapiens
ctgagccctgcctcttgtcact

SEQ ID NO: 8266060 - DNA, 22 bp, Homo sapiens
ctgagccctggctcgcctggag

SEQ ID NO: 8266061 - DNA, 22 bp, Homo sapiens
ctgagccctctgttttccctct

SEQ ID NO: 8266062 - DNA, 20 bp, Homo sapiens
ctgagcccttcctgtgaacc

SEQ ID NO: 8266063 - DNA, 22 bp, Homo sapiens
ctgagcccttgaacccaagtcc

SEQ ID NO: 8266064 - DNA, 22 bp, Homo sapiens
ctgagcccttgcttatgcttcc

SEQ ID NO: 8266065 - DNA, 22 bp, Homo sapiens
ctgagcccttgtcttcctggtc

SEQ ID NO: 8266066 - DNA, 22 bp, Homo sapiens
ctgagccatccataccagctta

SEQ ID NO: 8266067 - DNA, 22 bp, Homo sapiens
ctgacaggctgagatccctggt

SEQ ID NO: 8266068 - DNA, 22 bp, Homo sapiens
ctgaatatcatttatcattggc

SEQ ID NO: 8266069 - DNA, 22 bp, Homo sapiens
ctgaatattagtcatgtctgat

SEQ ID NO: 8266070 - DNA, 22 bp, Homo sapiens
tgtgtctcaagtcagagcatca

SEQ ID NO: 8266071 - DNA, 22 bp, Homo sapiens
tgtgtattaatgtttgtatatg

SEQ ID NO: 8266072 - DNA, 22 bp, Homo sapiens
tgtgtctctttgtcctagagct

SEQ ID NO: 8266073 - DNA, 22 bp, Homo sapiens
cctgggagtggcactcacagca

SEQ ID NO: 8266074 - DNA, 22 bp, Homo sapiens
cctgggagtgtgccatctctgt

SEQ ID NO: 8266075 - DNA, 22 bp, Homo sapiens
tggggcagccacatagacaaca

SEQ ID NO: 8266076 - DNA, 22 bp, Homo sapiens
tggggcagctccatctattcca

SEQ ID NO: 8266077 - DNA, 22 bp, Homo sapiens
tggggcagggatgggaaactat

SEQ ID NO: 8266078 - DNA, 22 bp, Homo sapiens
tggggcagtggcttttcaccct

SEQ ID NO: 8266079 - DNA, 22 bp, Homo sapiens
tggggccaagaaggtctcatgt

SEQ ID NO: 8266080 - DNA, 22 bp, Homo sapiens
cctgggctcaagtgatcctcct

SEQ ID NO: 8266081 - DNA, 22 bp, Homo sapiens
cctgggctctgaggagggagtc

SEQ ID NO: 8266082 - DNA, 22 bp, Homo sapiens
cctggtgggcaggagtgagacc

SEQ ID NO: 8266083 - DNA, 22 bp, Homo sapiens
cctggtggagaggggcggagcg

SEQ ID NO: 8266084 - DNA, 22 bp, Homo sapiens
cctggtggaaggtgagtgaggc

SEQ ID NO: 8266085 - DNA, 22 bp, Homo sapiens
cctggtggcttctgggtggacg

SEQ ID NO: 8266086 - DNA, 22 bp, Homo sapiens
tgttacagggataaatgaggta

SEQ ID NO: 8266087 - DNA, 23 bp, Homo sapiens
tgttccagatacgccttttcctc

SEQ ID NO: 8266088 - DNA, 22 bp, Homo sapiens
cctgtgctccctatgtatctgg

SEQ ID NO: 8266089 - DNA, 22 bp, Homo sapiens
tgtttagatgcaaagtctcaca

SEQ ID NO: 8266090 - DNA, 22 bp, Homo sapiens
ttctctggactatttgcactcc

SEQ ID NO: 8266091 - DNA, 20 bp, Homo sapiens
ctactttaggcactgagaat

SEQ ID NO: 8266092 - DNA, 22 bp, Homo sapiens
ttctctggccatagctggctag

SEQ ID NO: 8266093 - DNA, 21 bp, Homo sapiens
ttctctggcttctgtagctgg

SEQ ID NO: 8266094 - DNA, 22 bp, Homo sapiens
ctcacagagctcatactgggag

SEQ ID NO: 8266095 - DNA, 22 bp, Homo sapiens
ctattactgacttctgtattta

SEQ ID NO: 8266096 - DNA, 22 bp, Homo sapiens
cgcccagctgaaatctccaggc

SEQ ID NO: 8266097 - DNA, 22 bp, Homo sapiens
cgccccagccagttgagcggcg

SEQ ID NO: 8266098 - DNA, 22 bp, Homo sapiens
cgccccagatgcaagacaaaga

SEQ ID NO: 8266099 - DNA, 22 bp, Homo sapiens
cgccccagtctgtaggtgcccc

SEQ ID NO: 8266100 - DNA, 22 bp, Homo sapiens
ttcaagtttactttgaagttta

SEQ ID NO: 8266101 - DNA, 23 bp, Homo sapiens
cgcccagcctcagtgacctgggc

SEQ ID NO: 8266102 - DNA, 22 bp, Homo sapiens
cgtatttagaaggctgctgaaa

SEQ ID NO: 8266103 - DNA, 22 bp, Homo sapiens
cgtattcactcaggacacatag

SEQ ID NO: 8266104 - DNA, 22 bp, Homo sapiens
ctaaatactagccttcagattt

SEQ ID NO: 8266105 - DNA, 22 bp, Homo sapiens
ttcacacttgttaggatggctt

SEQ ID NO: 8266106 - DNA, 22 bp, Homo sapiens
ttcacagaatggcaagttatgg

SEQ ID NO: 8266107 - DNA, 22 bp, Homo sapiens
ttcacagaagaggtcacatttc

SEQ ID NO: 8266108 - DNA, 22 bp, Homo sapiens
ttcacactgtcccgggtggaaa

SEQ ID NO: 8266109 - DNA, 22 bp, Homo sapiens
ttcacactgtttttcatagtgg

SEQ ID NO: 8266110 - DNA, 22 bp, Homo sapiens
ttcacagaattgtcttgactgg

SEQ ID NO: 8266111 - DNA, 22 bp, Homo sapiens
cggggctgtagcacagctgagc

SEQ ID NO: 8266112 - DNA, 22 bp, Homo sapiens
ctgggaggcagaggttgcagtg

SEQ ID NO: 8266113 - DNA, 22 bp, Homo sapiens
ctgggaggcagaggttgcagtg

SEQ ID NO: 8266114 - DNA, 22 bp, Homo sapiens
ctgggaggcccacgttgggaag

SEQ ID NO: 8266115 - DNA, 22 bp, Homo sapiens
ctgggcaggagaggtggttgga

SEQ ID NO: 8266116 - DNA, 22 bp, Homo sapiens
ctgggaggcggagcttgcagtg

SEQ ID NO: 8266117 - DNA, 22 bp, Homo sapiens
ctggctgtgctgactgagaggg

SEQ ID NO: 8266118 - DNA, 22 bp, Homo sapiens
ctggggccctgggtctgccctc

SEQ ID NO: 8266119 - DNA, 23 bp, Homo sapiens
ctggggctcattgcagtagccat

SEQ ID NO: 8266120 - DNA, 22 bp, Homo sapiens
ctggggcattgggagaggcctg

SEQ ID NO: 8266121 - DNA, 22 bp, Homo sapiens
ctgggctgccaggtaggcacac

SEQ ID NO: 8266122 - DNA, 22 bp, Homo sapiens
ctgggctgcggtggtaggttgt

SEQ ID NO: 8266123 - DNA, 22 bp, Homo sapiens
ctgggctgcttgctgaaggggt

SEQ ID NO: 8266124 - DNA, 22 bp, Homo sapiens
ctgggctgcttgctgaaggggt

SEQ ID NO: 8266125 - DNA, 22 bp, Homo sapiens
ctgggctgcatcaaagaggcat

SEQ ID NO: 8266126 - DNA, 22 bp, Homo sapiens
ctgggctgcaggagtggggcaa

SEQ ID NO: 8266127 - DNA, 22 bp, Homo sapiens
ctggcagcccaacctagagtct

SEQ ID NO: 8266128 - DNA, 22 bp, Homo sapiens
ctgccaaggctggggaggacaa

SEQ ID NO: 8266129 - DNA, 22 bp, Homo sapiens
ctgccactttcacccagtgctc

SEQ ID NO: 8266130 - DNA, 22 bp, Homo sapiens
ctggcaggcggcagagcccagg

SEQ ID NO: 8266131 - DNA, 20 bp, Homo sapiens
ctggcaggagcgagtctacc

SEQ ID NO: 8266132 - DNA, 22 bp, Homo sapiens
ctggcaggagcattcacagagg

SEQ ID NO: 8266133 - DNA, 22 bp, Homo sapiens
ctggccctattccaggccttcc

SEQ ID NO: 8266134 - DNA, 22 bp, Homo sapiens
ctggccctatgagcctcctgat

SEQ ID NO: 8266135 - DNA, 22 bp, Homo sapiens
ctggccctgccagagatcaaca

SEQ ID NO: 8266136 - DNA, 22 bp, Homo sapiens
ctggccctgctccgcgccgcgg

SEQ ID NO: 8266137 - DNA, 22 bp, Homo sapiens
ctggccctgcctaatgtacttg

SEQ ID NO: 8266138 - DNA, 16 bp, Homo sapiens
ctggccctggctctgg

SEQ ID NO: 8266139 - DNA, 22 bp, Homo sapiens
ctggccctggagggctgtgcga

SEQ ID NO: 8266140 - DNA, 22 bp, Homo sapiens
ctggccctcagactcatgggca

SEQ ID NO: 8266141 - DNA, 22 bp, Homo sapiens
ctggccctcgtcagtttcactg

SEQ ID NO: 8266142 - DNA, 22 bp, Homo sapiens
ctggccctcggagtccagctgc

SEQ ID NO: 8266143 - DNA, 23 bp, Homo sapiens
ctggccctggctctgtgatcatg

SEQ ID NO: 8266144 - DNA, 22 bp, Homo sapiens
ctggccctggctggagcccagg

SEQ ID NO: 8266145 - DNA, 22 bp, Homo sapiens
ctggccctggtaaggacaccca

SEQ ID NO: 8266146 - DNA, 22 bp, Homo sapiens
ctggccctgtaggatgtgagtt

SEQ ID NO: 8266147 - DNA, 22 bp, Homo sapiens
ctggccctgtcagcacagaatc

SEQ ID NO: 8266148 - DNA, 22 bp, Homo sapiens
ctggctgtgcagtcttccagaa

SEQ ID NO: 8266149 - DNA, 22 bp, Homo sapiens
ctgtcctggagggcataggacg

SEQ ID NO: 8266150 - DNA, 22 bp, Homo sapiens
ctgtgagggccagagtcagggc

SEQ ID NO: 8266151 - DNA, 22 bp, Homo sapiens
ctgtgagggtcacagccatgcc

SEQ ID NO: 8266152 - DNA, 22 bp, Homo sapiens
ctgtgtcctgtctcctaaggtg

SEQ ID NO: 8266153 - DNA, 22 bp, Homo sapiens
ctgtgtcctccccatcacttct

SEQ ID NO: 8266154 - DNA, 22 bp, Homo sapiens
ctgttgcttcaggaaacagtaa

SEQ ID NO: 8266155 - DNA, 22 bp, Homo sapiens
ctgttgctccagggaacacaga

SEQ ID NO: 8266156 - DNA, 18 bp, Homo sapiens
ctgttgagatgtggctga

SEQ ID NO: 8266157 - DNA, 22 bp, Homo sapiens
cttgtattaagcttagagaggc

SEQ ID NO: 8266158 - DNA, 22 bp, Homo sapiens
cttgtagacccctggactcacg

SEQ ID NO: 8266159 - DNA, 22 bp, Homo sapiens
cttgcatgcatttgaagatcat

SEQ ID NO: 8266160 - DNA, 22 bp, Homo sapiens
gacctatttaagtgtagttcaa

SEQ ID NO: 8266161 - DNA, 22 bp, Homo sapiens
gaccctttggaggtagtcacca

SEQ ID NO: 8266162 - DNA, 22 bp, Homo sapiens
gacaggggtccctctgggctgt

SEQ ID NO: 8266163 - DNA, 22 bp, Homo sapiens
gacagggctgtgggaggagcag

SEQ ID NO: 8266164 - DNA, 22 bp, Homo sapiens
gacaagggttctgcagagcctg

SEQ ID NO: 8266165 - DNA, 22 bp, Homo sapiens
gacaaggcgcccagcctgccaa

SEQ ID NO: 8266166 - DNA, 22 bp, Homo sapiens
gaatagatagcttggatggttg

SEQ ID NO: 8266167 - DNA, 22 bp, Homo sapiens
gaatagatatccttgagggtct

SEQ ID NO: 8266168 - DNA, 22 bp, Homo sapiens
gaatagattatacttgaagcat

SEQ ID NO: 8266169 - DNA, 22 bp, Homo sapiens
gaatacatgtgtgtatagaggt

SEQ ID NO: 8266170 - DNA, 22 bp, Homo sapiens
gacaagctcgcctgccccggaa

SEQ ID NO: 8266171 - DNA, 22 bp, Homo sapiens
gacaagctcccggtggccctcc

SEQ ID NO: 8266172 - DNA, 22 bp, Homo sapiens
gacaagctcttgtttcatggtt

SEQ ID NO: 8266173 - DNA, 23 bp, Homo sapiens
ctttcattgtggtttcacagagc

SEQ ID NO: 8266174 - DNA, 22 bp, Homo sapiens
gaaatcaaacccttttctgata

SEQ ID NO: 8266175 - DNA, 22 bp, Homo sapiens
gaaatcaatttcttggttgata

SEQ ID NO: 8266176 - DNA, 22 bp, Homo sapiens
gaaatcaaggctacattcaggt

SEQ ID NO: 8266177 - DNA, 22 bp, Homo sapiens
gaagagaagcatcaataggtaa

SEQ ID NO: 8266178 - DNA, 22 bp, Homo sapiens
gaagacactctgcagagttatc

SEQ ID NO: 8266179 - DNA, 22 bp, Homo sapiens
gaagacactaaggcccagggag

SEQ ID NO: 8266180 - DNA, 22 bp, Homo sapiens
gaagacacctactgtcatttct

SEQ ID NO: 8266181 - DNA, 22 bp, Homo sapiens
gaagacactaaactggggcttc

SEQ ID NO: 8266182 - DNA, 22 bp, Homo sapiens
gaagacatgtggattctagttt

SEQ ID NO: 8266183 - DNA, 22 bp, Homo sapiens
gaagacatgtttttaatatgta

SEQ ID NO: 8266184 - DNA, 22 bp, Homo sapiens
gaagacacaattggtgggtcca

SEQ ID NO: 8266185 - DNA, 21 bp, Homo sapiens
gaagacacataacctctctcc

SEQ ID NO: 8266186 - DNA, 20 bp, Homo sapiens
gaagacacagagttcatctc

SEQ ID NO: 8266187 - DNA, 22 bp, Homo sapiens
gaggaggaagttctctgtaggc

SEQ ID NO: 8266188 - DNA, 19 bp, Homo sapiens
gaggaggaaaactagtgta

SEQ ID NO: 8266189 - DNA, 22 bp, Homo sapiens
gaggaggcacttgagcagatgt

SEQ ID NO: 8266190 - DNA, 22 bp, Homo sapiens
gaggaggccagtggaaggaagc

SEQ ID NO: 8266191 - DNA, 22 bp, Homo sapiens
gaggaggctaagtgggctctgg

SEQ ID NO: 8266192 - DNA, 22 bp, Homo sapiens
gaggagcttgaggctaggagcc

SEQ ID NO: 8266193 - DNA, 22 bp, Homo sapiens
gaggagccctgttccccaggcc

SEQ ID NO: 8266194 - DNA, 18 bp, Homo sapiens
gaggagccgtccctacta

SEQ ID NO: 8266195 - DNA, 22 bp, Homo sapiens
gaggagcctggccccacatcca

SEQ ID NO: 8266196 - DNA, 22 bp, Homo sapiens
gaggccagcgcgcagcactttt

SEQ ID NO: 8266197 - DNA, 22 bp, Homo sapiens
gaggcagaggaaggtggtctct

SEQ ID NO: 8266198 - DNA, 22 bp, Homo sapiens
gaggcagagaccttcaggacct

SEQ ID NO: 8266199 - DNA, 22 bp, Homo sapiens
gaggcagaagttgcagtgagca

SEQ ID NO: 8266200 - DNA, 22 bp, Homo sapiens
gagcctggattgaagtgggtgg

SEQ ID NO: 8266201 - DNA, 22 bp, Homo sapiens
gagcctgaatttgacctgctta

SEQ ID NO: 8266202 - DNA, 22 bp, Homo sapiens
gagctctgactgctgggtgaca

SEQ ID NO: 8266203 - DNA, 22 bp, Homo sapiens
gagctctgatgtttagtggaga

SEQ ID NO: 8266204 - DNA, 22 bp, Homo sapiens
gagctctgaaaaagcttgcctt

SEQ ID NO: 8266205 - DNA, 22 bp, Homo sapiens
gagctctgtgtggcttgggtgg

SEQ ID NO: 8266206 - DNA, 22 bp, Homo sapiens
gagctctgtgtagcctgagggt

SEQ ID NO: 8266207 - DNA, 22 bp, Homo sapiens
gagctctgttctcgtcctgctg

SEQ ID NO: 8266208 - DNA, 22 bp, Homo sapiens
gagaagggggctcgagtgtcct

SEQ ID NO: 8266209 - DNA, 22 bp, Homo sapiens
gagaatgttaatgttgaagtat

SEQ ID NO: 8266210 - DNA, 22 bp, Homo sapiens
gagatcctgtaggcagctaaga

SEQ ID NO: 8266211 - DNA, 22 bp, Homo sapiens
gagaggcctgagaggctgcgga

SEQ ID NO: 8266212 - DNA, 21 bp, Homo sapiens
gagaggcctgggcccgtgagc

SEQ ID NO: 8266213 - DNA, 22 bp, Homo sapiens
gagaggcctgggcccgtgagct

SEQ ID NO: 8266214 - DNA, 22 bp, Homo sapiens
gagaggcctgggcccgtgagct

SEQ ID NO: 8266215 - DNA, 22 bp, Homo sapiens
gagaggccctgtggtcccagct

SEQ ID NO: 8266216 - DNA, 22 bp, Homo sapiens
gagaggccctgaagcccacaga

SEQ ID NO: 8266217 - DNA, 22 bp, Homo sapiens
gagaggccggcgtcgctgcggc

SEQ ID NO: 8266218 - DNA, 22 bp, Homo sapiens
gagaggccatggggtgggatgc

SEQ ID NO: 8266219 - DNA, 22 bp, Homo sapiens
gagaggccatggggtgggatgc

SEQ ID NO: 8266220 - DNA, 22 bp, Homo sapiens
gagaggccatggctgtgcagtg

SEQ ID NO: 8266221 - DNA, 22 bp, Homo sapiens
gagaggccaaaatccctgcccc

SEQ ID NO: 8266222 - DNA, 22 bp, Homo sapiens
gagcagctgtggggttgaccat

SEQ ID NO: 8266223 - DNA, 22 bp, Homo sapiens
gagcagctgcagtgcagaccct

SEQ ID NO: 8266224 - DNA, 22 bp, Homo sapiens
gagcagcctgaggagcgtgggc

SEQ ID NO: 8266225 - DNA, 22 bp, Homo sapiens
gagcagcttatgtcaagccaga

SEQ ID NO: 8266226 - DNA, 22 bp, Homo sapiens
gagccagccgcaagagctgtga

SEQ ID NO: 8266227 - DNA, 22 bp, Homo sapiens
gagccagggctgtgagctgagc

SEQ ID NO: 8266228 - DNA, 22 bp, Homo sapiens
gtctggaggaggaagaaggcac

SEQ ID NO: 8266229 - DNA, 22 bp, Homo sapiens
gtgcaggtggctggtggcaccc

SEQ ID NO: 8266230 - DNA, 22 bp, Homo sapiens
gtgcattctatcaaatggtaca

SEQ ID NO: 8266231 - DNA, 22 bp, Homo sapiens
gtgcattccaaggcactttaga

SEQ ID NO: 8266232 - DNA, 22 bp, Homo sapiens
gtgcattccaccgtgcaggttg

SEQ ID NO: 8266233 - DNA, 19 bp, Homo sapiens
gtgcattccaaagcaccat

SEQ ID NO: 8266234 - DNA, 22 bp, Homo sapiens
gtgcattctctgattttcacaa

SEQ ID NO: 8266235 - DNA, 22 bp, Homo sapiens
gtgagcagctcagggtggtctc

SEQ ID NO: 8266236 - DNA, 22 bp, Homo sapiens
gtgagcaggatttcatggtgta

SEQ ID NO: 8266237 - DNA, 22 bp, Homo sapiens
gtccctcaaggtccagtcatgg

SEQ ID NO: 8266238 - DNA, 22 bp, Homo sapiens
gtccctcacccagatgctccca

SEQ ID NO: 8266239 - DNA, 22 bp, Homo sapiens
gtcccccacacttccatgtcac

SEQ ID NO: 8266240 - DNA, 22 bp, Homo sapiens
gtcccctggcccccagcgtcgg

SEQ ID NO: 8266241 - DNA, 22 bp, Homo sapiens
gtcccctggtggctggagctgc

SEQ ID NO: 8266242 - DNA, 22 bp, Homo sapiens
gtcccctgtccagggccagcca

SEQ ID NO: 8266243 - DNA, 22 bp, Homo sapiens
gtattcacctaaatgtagtttg

SEQ ID NO: 8266244 - DNA, 22 bp, Homo sapiens
gtattcacatggtggtagattg

SEQ ID NO: 8266245 - DNA, 22 bp, Homo sapiens
gtaccatgagcatcatgttttt

SEQ ID NO: 8266246 - DNA, 22 bp, Homo sapiens
gtaccatgggatctagggccca

SEQ ID NO: 8266247 - DNA, 22 bp, Homo sapiens
gtaccatgttgtttggaaggct

SEQ ID NO: 8266248 - DNA, 22 bp, Homo sapiens
ggtctccaaagctgcattgatg

SEQ ID NO: 8266249 - DNA, 22 bp, Homo sapiens
ggtctccaaagcttaggactac

SEQ ID NO: 8266250 - DNA, 22 bp, Homo sapiens
ggtctccagctgggaccctgca

SEQ ID NO: 8266251 - DNA, 22 bp, Homo sapiens
ggtcagaggtcacaagctggca

SEQ ID NO: 8266252 - DNA, 22 bp, Homo sapiens
ggtagggcaaagtagggcacct

SEQ ID NO: 8266253 - DNA, 22 bp, Homo sapiens
ggtagtacatggaagagtacac

SEQ ID NO: 8266254 - DNA, 22 bp, Homo sapiens
ggtaggggcagggccaagctgt

SEQ ID NO: 8266255 - DNA, 22 bp, Homo sapiens
ggtcactggtctctgcttccat

SEQ ID NO: 8266256 - DNA, 22 bp, Homo sapiens
ggtcactgccctcccttttgca

SEQ ID NO: 8266257 - DNA, 22 bp, Homo sapiens
ggtcactccaccttctccacct

SEQ ID NO: 8266258 - DNA, 22 bp, Homo sapiens
ggtcactgagctgtaattctgt

SEQ ID NO: 8266259 - DNA, 18 bp, Homo sapiens
ggtcactgagatgctact

SEQ ID NO: 8266260 - DNA, 22 bp, Homo sapiens
ggtcagagccatggagcaactg

SEQ ID NO: 8266261 - DNA, 22 bp, Homo sapiens
ggtgtgggccctgatgtcagca

SEQ ID NO: 8266262 - DNA, 22 bp, Homo sapiens
ggtgttggtctacaccagcact

SEQ ID NO: 8266263 - DNA, 22 bp, Homo sapiens
ggtgtgtggttttgatacagtc

SEQ ID NO: 8266264 - DNA, 17 bp, Homo sapiens
ggtggcctgcagtggct

SEQ ID NO: 8266265 - DNA, 22 bp, Homo sapiens
ggggtgggcgtgcagggacacc

SEQ ID NO: 8266266 - DNA, 22 bp, Homo sapiens
ggggtgggcgtgcagggacacc

SEQ ID NO: 8266267 - DNA, 22 bp, Homo sapiens
ggggctgggatttgaacccagg

SEQ ID NO: 8266268 - DNA, 22 bp, Homo sapiens
ggggctggtggtggtttctcca

SEQ ID NO: 8266269 - DNA, 22 bp, Homo sapiens
ggggtggggttactcattgtgc

SEQ ID NO: 8266270 - DNA, 22 bp, Homo sapiens
gggtagtaactacacagcgaag

SEQ ID NO: 8266271 - DNA, 22 bp, Homo sapiens
gggtggaggagaacaggcccca

SEQ ID NO: 8266272 - DNA, 22 bp, Homo sapiens
gggtaggagaggtgtctgtgtg

SEQ ID NO: 8266273 - DNA, 22 bp, Homo sapiens
ggggctgatggaactcaggcct

SEQ ID NO: 8266274 - DNA, 22 bp, Homo sapiens
ggggctgagtcagtgggaagag

SEQ ID NO: 8266275 - DNA, 22 bp, Homo sapiens
ggggctggctcactaagagact

SEQ ID NO: 8266276 - DNA, 22 bp, Homo sapiens
ggggctgaacctggaggtggtc

SEQ ID NO: 8266277 - DNA, 22 bp, Homo sapiens
ggggctgacgggcatgtggctt

SEQ ID NO: 8266278 - DNA, 22 bp, Homo sapiens
ggggctgagaattcagtctcgg

SEQ ID NO: 8266279 - DNA, 22 bp, Homo sapiens
gggcttggtggagagaatgctg

SEQ ID NO: 8266280 - DNA, 22 bp, Homo sapiens
ggggccgaccgcggttcaggcc

SEQ ID NO: 8266281 - DNA, 22 bp, Homo sapiens
gggcatggtgctggtgttcatg

SEQ ID NO: 8266282 - DNA, 22 bp, Homo sapiens
gggcatggcgtgtgctggattc

SEQ ID NO: 8266283 - DNA, 22 bp, Homo sapiens
gggcatggccaggtgaggggtc

SEQ ID NO: 8266284 - DNA, 22 bp, Homo sapiens
gggcatggccaggtgaggggtc

SEQ ID NO: 8266285 - DNA, 18 bp, Homo sapiens
gggcatggatgcagcatc

SEQ ID NO: 8266286 - DNA, 22 bp, Homo sapiens
gggccaagggtgcgtggcagga

SEQ ID NO: 8266287 - DNA, 22 bp, Homo sapiens
gggccaaggggagctggaaggg

SEQ ID NO: 8266288 - DNA, 22 bp, Homo sapiens
gggctgctgcccaggaggcacc

SEQ ID NO: 8266289 - DNA, 22 bp, Homo sapiens
gggctgatgatgagcagaggtg

SEQ ID NO: 8266290 - DNA, 22 bp, Homo sapiens
gggctgatcgcttgagctcagg

SEQ ID NO: 8266291 - DNA, 22 bp, Homo sapiens
gggctgatgtgctcccaggtgg

SEQ ID NO: 8266292 - DNA, 22 bp, Homo sapiens
gggctgatgtgacagaactctc

SEQ ID NO: 8266293 - DNA, 22 bp, Homo sapiens
gggctgattcgatgggggtaga

SEQ ID NO: 8266294 - DNA, 22 bp, Homo sapiens
gggctgattcgatgggggtaga

SEQ ID NO: 8266295 - DNA, 22 bp, Homo sapiens
gggaggaaggcttgggtgagta

SEQ ID NO: 8266296 - DNA, 22 bp, Homo sapiens
gggatggggagctggaaagggg

SEQ ID NO: 8266297 - DNA, 22 bp, Homo sapiens
gggaggagctgagtgtgtgtgc

SEQ ID NO: 8266298 - DNA, 22 bp, Homo sapiens
gggatggggggaagcgtccatg

SEQ ID NO: 8266299 - DNA, 22 bp, Homo sapiens
gggatggggagctggaaagggg

SEQ ID NO: 8266300 - DNA, 22 bp, Homo sapiens
gggatggggtcaacatgtacct

SEQ ID NO: 8266301 - DNA, 22 bp, Homo sapiens
gggatggggtcgggaccctgct

SEQ ID NO: 8266302 - DNA, 22 bp, Homo sapiens
gggcaggagaaggtggatgtcc

SEQ ID NO: 8266303 - DNA, 22 bp, Homo sapiens
gggcaggagaaggtggatgtcc

SEQ ID NO: 8266304 - DNA, 22 bp, Homo sapiens
gggcaggagagggccacctgga

SEQ ID NO: 8266305 - DNA, 23 bp, Homo sapiens
gggcatggagtgtaggtggaagg

SEQ ID NO: 8266306 - DNA, 22 bp, Homo sapiens
gggagctggttcctgccctcca

SEQ ID NO: 8266307 - DNA, 22 bp, Homo sapiens
gggagacagttcagatagtttc

SEQ ID NO: 8266308 - DNA, 20 bp, Homo sapiens
gggagacagggccagtgtcc

SEQ ID NO: 8266309 - DNA, 19 bp, Homo sapiens
gggagacagctctgggctg

SEQ ID NO: 8266310 - DNA, 19 bp, Homo sapiens
gggagacagctctgggctg

SEQ ID NO: 8266311 - DNA, 22 bp, Homo sapiens
gggagacacttgctttagaggg

SEQ ID NO: 8266312 - DNA, 22 bp, Homo sapiens
gggagacaaggagaaccaaaga

SEQ ID NO: 8266313 - DNA, 22 bp, Homo sapiens
gggagacacgctgcaggcataa

SEQ ID NO: 8266314 - DNA, 22 bp, Homo sapiens
gggagacaagaagtagcctgct

SEQ ID NO: 8266315 - DNA, 22 bp, Homo sapiens
gggagacaagaagtagcctgct

SEQ ID NO: 8266316 - DNA, 22 bp, Homo sapiens
gggagagaattattgccagacc

SEQ ID NO: 8266317 - DNA, 22 bp, Homo sapiens
gggagagagaaaacgtggcgca

SEQ ID NO: 8266318 - DNA, 22 bp, Homo sapiens
gggagagcgcgctagggccgag

SEQ ID NO: 8266319 - DNA, 22 bp, Homo sapiens
ggcttgtcatgttgatgttctt

SEQ ID NO: 8266320 - DNA, 22 bp, Homo sapiens
ggcttgggagcaggcatgtgac

SEQ ID NO: 8266321 - DNA, 22 bp, Homo sapiens
ggcttgggagcaggcatgtgac

SEQ ID NO: 8266322 - DNA, 22 bp, Homo sapiens
gggaccagaggctgtgcacaat

SEQ ID NO: 8266323 - DNA, 22 bp, Homo sapiens
gggagacaaaggtgaggttctt

SEQ ID NO: 8266324 - DNA, 22 bp, Homo sapiens
gggacaggctgagacttgagct

SEQ ID NO: 8266325 - DNA, 22 bp, Homo sapiens
ggctgctgaagtgtggcaatct

SEQ ID NO: 8266326 - DNA, 22 bp, Homo sapiens
ggctgctgccctcctaagtgca

SEQ ID NO: 8266327 - DNA, 22 bp, Homo sapiens
ggctgctgctgtgtaggcctgt

SEQ ID NO: 8266328 - DNA, 22 bp, Homo sapiens
ggctgctgagttggccaggaga

SEQ ID NO: 8266329 - DNA, 22 bp, Homo sapiens
ggctgctgggaatatgccagct

SEQ ID NO: 8266330 - DNA, 22 bp, Homo sapiens
ggctgctggcattgaggtaggt

SEQ ID NO: 8266331 - DNA, 21 bp, Homo sapiens
ggctgctgggagagctgcgtg

SEQ ID NO: 8266332 - DNA, 22 bp, Homo sapiens
ggctgggctgcggctgtacctg

SEQ ID NO: 8266333 - DNA, 19 bp, Homo sapiens
ggctgggccctgtttctcc

SEQ ID NO: 8266334 - DNA, 22 bp, Homo sapiens
ggctgggccgcggctacccaga

SEQ ID NO: 8266335 - DNA, 22 bp, Homo sapiens
ggctgggcctctccctcagctg

SEQ ID NO: 8266336 - DNA, 21 bp, Homo sapiens
ggctgggcaggacccacccct

SEQ ID NO: 8266337 - DNA, 22 bp, Homo sapiens
ggctgggccagggcctgtggac

SEQ ID NO: 8266338 - DNA, 22 bp, Homo sapiens
ggcgggaggctgaggagttggt

SEQ ID NO: 8266339 - DNA, 22 bp, Homo sapiens
ggcggggcctcgcgaacggcct

SEQ ID NO: 8266340 - DNA, 22 bp, Homo sapiens
ggcgctgtcgtgagctcgcccg

SEQ ID NO: 8266341 - DNA, 22 bp, Homo sapiens
ggcgggagcagcagctctgagc

SEQ ID NO: 8266342 - DNA, 22 bp, Homo sapiens
ggcgggagatggggccgttcag

SEQ ID NO: 8266343 - DNA, 22 bp, Homo sapiens
ggctccagaaacttcagtccat

SEQ ID NO: 8266344 - DNA, 22 bp, Homo sapiens
ggctccagatgtcccctggcaa

SEQ ID NO: 8266345 - DNA, 22 bp, Homo sapiens
ggctccaggaacctcctctcct

SEQ ID NO: 8266346 - DNA, 22 bp, Homo sapiens
ggctccagatgtctcctggcaa

SEQ ID NO: 8266347 - DNA, 22 bp, Homo sapiens
ggctccaggagggccttggcca

SEQ ID NO: 8266348 - DNA, 22 bp, Homo sapiens
ggctctgggcatagaaggaagc

SEQ ID NO: 8266349 - DNA, 22 bp, Homo sapiens
ggccatgcaggtcagaggtggg

SEQ ID NO: 8266350 - DNA, 22 bp, Homo sapiens
ggccatgcaggtctggtaggtc

SEQ ID NO: 8266351 - DNA, 22 bp, Homo sapiens
ggccatgccaggctgcctggga

SEQ ID NO: 8266352 - DNA, 22 bp, Homo sapiens
ggccatgcctggtctggcacca

SEQ ID NO: 8266353 - DNA, 22 bp, Homo sapiens
ggccagggggcttcagactcca

SEQ ID NO: 8266354 - DNA, 22 bp, Homo sapiens
ggcagtgaatctgagagcctgg

SEQ ID NO: 8266355 - DNA, 22 bp, Homo sapiens
ggcaggtggcactgctgctccc

SEQ ID NO: 8266356 - DNA, 22 bp, Homo sapiens
ggcaggtggccaagtgtctaag

SEQ ID NO: 8266357 - DNA, 22 bp, Homo sapiens
ggcctcagggttgggcccatta

SEQ ID NO: 8266358 - DNA, 22 bp, Homo sapiens
ggcctcagtgggccgctgcagg

SEQ ID NO: 8266359 - DNA, 22 bp, Homo sapiens
ggcctcagtttctccatgggtt

SEQ ID NO: 8266360 - DNA, 22 bp, Homo sapiens
ggcctcagaggaggtgtgagtc

SEQ ID NO: 8266361 - DNA, 21 bp, Homo sapiens
ggcctcagccacctggctctg

SEQ ID NO: 8266362 - DNA, 22 bp, Homo sapiens
ggcctcagggtcactctgtaga

SEQ ID NO: 8266363 - DNA, 23 bp, Homo sapiens
ggcctcagcgcacagaaactgct

SEQ ID NO: 8266364 - DNA, 18 bp, Homo sapiens
ggcctcagcctggccgga

SEQ ID NO: 8266365 - DNA, 19 bp, Homo sapiens
ggccatggcgggggtcaca

SEQ ID NO: 8266366 - DNA, 22 bp, Homo sapiens
ggcctcagagaaggctgtgcgg

SEQ ID NO: 8266367 - DNA, 23 bp, Homo sapiens
ggccatggagacttagaatgggc

SEQ ID NO: 8266368 - DNA, 22 bp, Homo sapiens
ggccatgctcgtggctggactg

SEQ ID NO: 8266369 - DNA, 22 bp, Homo sapiens
ggccatgcctgtgggtgcaggc

SEQ ID NO: 8266370 - DNA, 22 bp, Homo sapiens
ggcacagcaggagctatgtgaa

SEQ ID NO: 8266371 - DNA, 22 bp, Homo sapiens
ggcacagccctctctgtggaca

SEQ ID NO: 8266372 - DNA, 22 bp, Homo sapiens
ggcaccagcacttgggatggct

SEQ ID NO: 8266373 - DNA, 22 bp, Homo sapiens
ggcagaggaagctggaagtggg

SEQ ID NO: 8266374 - DNA, 22 bp, Homo sapiens
ggcaggagggcggacaatgacc

SEQ ID NO: 8266375 - DNA, 22 bp, Homo sapiens
ggcaggaggtgagtggcgggtg

SEQ ID NO: 8266376 - DNA, 22 bp, Homo sapiens
ggcaggaggaagagttagcacc

SEQ ID NO: 8266377 - DNA, 22 bp, Homo sapiens
ggcaggaggaagagttagcacc

SEQ ID NO: 8266378 - DNA, 22 bp, Homo sapiens
ggcagaggtagctggaaccagg

SEQ ID NO: 8266379 - DNA, 20 bp, Homo sapiens
ggcagagggcctgggagaag

SEQ ID NO: 8266380 - DNA, 22 bp, Homo sapiens
ggcaggcactgtgctaggcgct

SEQ ID NO: 8266381 - DNA, 22 bp, Homo sapiens
ggcaggcaaggcagcctggtga

SEQ ID NO: 8266382 - DNA, 22 bp, Homo sapiens
ggcaggcaatgaggatgggaag

SEQ ID NO: 8266383 - DNA, 22 bp, Homo sapiens
ggcaggcaagtctgctctgtga

SEQ ID NO: 8266384 - DNA, 22 bp, Homo sapiens
ggagccagaggctgctgctgtg

SEQ ID NO: 8266385 - DNA, 22 bp, Homo sapiens
ggcaaaggaaaacgtctcagct

SEQ ID NO: 8266386 - DNA, 22 bp, Homo sapiens
ggcaaaggaaaacgtctcagct

SEQ ID NO: 8266387 - DNA, 22 bp, Homo sapiens
ggcaaaggaaccaggccacact

SEQ ID NO: 8266388 - DNA, 22 bp, Homo sapiens
ggcaagagtgaggagtgtctct

SEQ ID NO: 8266389 - DNA, 22 bp, Homo sapiens
ggcaagagttgaagctccagga

SEQ ID NO: 8266390 - DNA, 22 bp, Homo sapiens
ggcaagagtgaggagtgtctct

SEQ ID NO: 8266391 - DNA, 22 bp, Homo sapiens
ggcaagaggtccaagaggtctc

SEQ ID NO: 8266392 - DNA, 23 bp, Homo sapiens
ggagtgcaatggcgccatctcgg

SEQ ID NO: 8266393 - DNA, 22 bp, Homo sapiens
ggcaaacacacctcggtgagaa

SEQ ID NO: 8266394 - DNA, 22 bp, Homo sapiens
ggcaaacaccaggcgagggagc

SEQ ID NO: 8266395 - DNA, 22 bp, Homo sapiens
ggcaaacagacttgaccatctt

SEQ ID NO: 8266396 - DNA, 22 bp, Homo sapiens
ggcaaacaggagagtaaagaga

SEQ ID NO: 8266397 - DNA, 22 bp, Homo sapiens
gcagaggccaggccaccagcaa

SEQ ID NO: 8266398 - DNA, 22 bp, Homo sapiens
gcagagggtcctgtgccagcag

SEQ ID NO: 8266399 - DNA, 22 bp, Homo sapiens
gcagaggtcctagccaggagtc

SEQ ID NO: 8266400 - DNA, 20 bp, Homo sapiens
gcagagtgtgagagggtgaa

SEQ ID NO: 8266401 - DNA, 22 bp, Homo sapiens
gcagaggtgaccagcagcaggg

SEQ ID NO: 8266402 - DNA, 22 bp, Homo sapiens
gcagaggtgagaagggcctccc

SEQ ID NO: 8266403 - DNA, 22 bp, Homo sapiens
gcagaggatcaggctctggaaa

SEQ ID NO: 8266404 - DNA, 22 bp, Homo sapiens
gcagagcaccctgcagtggtat

SEQ ID NO: 8266405 - DNA, 22 bp, Homo sapiens
gcacaggctccggaggagagct

SEQ ID NO: 8266406 - DNA, 22 bp, Homo sapiens
gcaaaggccactggggcgatgg

SEQ ID NO: 8266407 - DNA, 22 bp, Homo sapiens
gaggcccaaggactctgtcccg

SEQ ID NO: 8266408 - DNA, 22 bp, Homo sapiens
gaggcccaatgcttccctcctt

SEQ ID NO: 8266409 - DNA, 22 bp, Homo sapiens
gaggcccacagggagtaccaag

SEQ ID NO: 8266410 - DNA, 22 bp, Homo sapiens
gaggcccagaggcccaggacgt

SEQ ID NO: 8266411 - DNA, 22 bp, Homo sapiens
gaggcccagcagcgcaggtctt

SEQ ID NO: 8266412 - DNA, 22 bp, Homo sapiens
gcaggacaaaatttccagggtg

SEQ ID NO: 8266413 - DNA, 22 bp, Homo sapiens
gcagccctaacctgtcatagtg

SEQ ID NO: 8266414 - DNA, 22 bp, Homo sapiens
gcagggctggggctgctcctga

SEQ ID NO: 8266415 - DNA, 22 bp, Homo sapiens
gcagggacatctttgtctagta

SEQ ID NO: 8266416 - DNA, 22 bp, Homo sapiens
gcaggcagaggtggaggagaca

SEQ ID NO: 8266417 - DNA, 22 bp, Homo sapiens
gcaggcagatcacctgtcagga

SEQ ID NO: 8266418 - DNA, 22 bp, Homo sapiens
gcagggaagatcttggagctgc

SEQ ID NO: 8266419 - DNA, 22 bp, Homo sapiens
gcagggaaggggacggaaccag

SEQ ID NO: 8266420 - DNA, 22 bp, Homo sapiens
gcagggaagggaaacagagacc

SEQ ID NO: 8266421 - DNA, 22 bp, Homo sapiens
gcagggaagttgtaatgtaatg

SEQ ID NO: 8266422 - DNA, 22 bp, Homo sapiens
gcagggaagtttgatctttttc

SEQ ID NO: 8266423 - DNA, 22 bp, Homo sapiens
gcagggaaggggcatgctggag

SEQ ID NO: 8266424 - DNA, 22 bp, Homo sapiens
gccccagcgtggctgtgttagg

SEQ ID NO: 8266425 - DNA, 22 bp, Homo sapiens
gccccagcctgggaactggagg

SEQ ID NO: 8266426 - DNA, 22 bp, Homo sapiens
gccccagctctgccacaactag

SEQ ID NO: 8266427 - DNA, 22 bp, Homo sapiens
gccccagcctagttttctttca

SEQ ID NO: 8266428 - DNA, 22 bp, Homo sapiens
gccccagccctgtggaccatgg

SEQ ID NO: 8266429 - DNA, 22 bp, Homo sapiens
gccccagcctcccgagtagctg

SEQ ID NO: 8266430 - DNA, 22 bp, Homo sapiens
gccccagccaaggtgacacgaa

SEQ ID NO: 8266431 - DNA, 22 bp, Homo sapiens
gccccagcagcaatgcggttga

SEQ ID NO: 8266432 - DNA, 22 bp, Homo sapiens
gccccagaaagttcaaggcaca

SEQ ID NO: 8266433 - DNA, 22 bp, Homo sapiens
gcccagctccattcttggtgag

SEQ ID NO: 8266434 - DNA, 22 bp, Homo sapiens
gcccagctgcaccctggtgggt

SEQ ID NO: 8266435 - DNA, 22 bp, Homo sapiens
gcccagcacctctctcagggtt

SEQ ID NO: 8266436 - DNA, 22 bp, Homo sapiens
gcccagcactaaaagctttgct

SEQ ID NO: 8266437 - DNA, 22 bp, Homo sapiens
gcccagcactcctctctgacat

SEQ ID NO: 8266438 - DNA, 22 bp, Homo sapiens
gcccagcagatctcagtgtctc

SEQ ID NO: 8266439 - DNA, 22 bp, Homo sapiens
gcccagcagctccacttggctt

SEQ ID NO: 8266440 - DNA, 22 bp, Homo sapiens
gcccagcagctggtggagaagg

SEQ ID NO: 8266441 - DNA, 22 bp, Homo sapiens
gcccagcacattgctgaggacc

SEQ ID NO: 8266442 - DNA, 22 bp, Homo sapiens
gcccagcacatctggccttgaa

SEQ ID NO: 8266443 - DNA, 22 bp, Homo sapiens
gcccagcacagctggaagagtc

SEQ ID NO: 8266444 - DNA, 21 bp, Homo sapiens
gcccagcaaggtgagaaggcc

SEQ ID NO: 8266445 - DNA, 22 bp, Homo sapiens
gcccaggaagttgaggctgccg

SEQ ID NO: 8266446 - DNA, 17 bp, Homo sapiens
gcccaggaaggacggcc

SEQ ID NO: 8266447 - DNA, 22 bp, Homo sapiens
gcccagctgtctggcagggatg

SEQ ID NO: 8266448 - DNA, 22 bp, Homo sapiens
gcccaggagcctggagatgtgt

SEQ ID NO: 8266449 - DNA, 22 bp, Homo sapiens
gcccaggagaggccagggctga

SEQ ID NO: 8266450 - DNA, 22 bp, Homo sapiens
gcccatgtgatttcctgggagt

SEQ ID NO: 8266451 - DNA, 22 bp, Homo sapiens
gccagctcagatgcaggaagga

SEQ ID NO: 8266452 - DNA, 22 bp, Homo sapiens
gccagctgaagccctggtggaa

SEQ ID NO: 8266453 - DNA, 22 bp, Homo sapiens
gccaccagggggtgcaaggtcc

SEQ ID NO: 8266454 - DNA, 22 bp, Homo sapiens
gccaccaggagcccagtccaaa

SEQ ID NO: 8266455 - DNA, 22 bp, Homo sapiens
gcatggccatggcactatggac

SEQ ID NO: 8266456 - DNA, 22 bp, Homo sapiens
gctggctggcgggtgcgtcctc

SEQ ID NO: 8266457 - DNA, 22 bp, Homo sapiens
gctggctggagtaaggagggag

SEQ ID NO: 8266458 - DNA, 22 bp, Homo sapiens
gctggctggagtgagctaccct

SEQ ID NO: 8266459 - DNA, 22 bp, Homo sapiens
gctggctggaggtgaggaagaa

SEQ ID NO: 8266460 - DNA, 22 bp, Homo sapiens
gctggctggaactagcagttgg

SEQ ID NO: 8266461 - DNA, 22 bp, Homo sapiens
gctggctggaatgggagaagaa

SEQ ID NO: 8266462 - DNA, 22 bp, Homo sapiens
gctggctggaggagggaggttg

SEQ ID NO: 8266463 - DNA, 19 bp, Homo sapiens
gctggctggaggagggaca

SEQ ID NO: 8266464 - DNA, 22 bp, Homo sapiens
gctggagaaacaggaggaggaa

SEQ ID NO: 8266465 - DNA, 22 bp, Homo sapiens
gctggagaacccaggaggaaga

SEQ ID NO: 8266466 - DNA, 22 bp, Homo sapiens
gctggctgctgttgagacttgt

SEQ ID NO: 8266467 - DNA, 22 bp, Homo sapiens
gctggctgcgtcatcacagggc

SEQ ID NO: 8266468 - DNA, 20 bp, Homo sapiens
gcttgctttgtctgatgggc

SEQ ID NO: 8266469 - DNA, 22 bp, Homo sapiens
gcttgctttgtaaatatctgtg

SEQ ID NO: 8266470 - DNA, 19 bp, Homo sapiens
gcttgctttatgaaggggg

SEQ ID NO: 8266471 - DNA, 22 bp, Homo sapiens
gctttatgtgagtagcactgtc

SEQ ID NO: 8266472 - DNA, 22 bp, Homo sapiens
gctttatgtaagtccaaaggca

SEQ ID NO: 8266473 - DNA, 22 bp, Homo sapiens
gcttgcatttggaatagattaa

SEQ ID NO: 8266474 - DNA, 22 bp, Homo sapiens
gcttgcattgtcagaatgacta

SEQ ID NO: 8266475 - DNA, 22 bp, Homo sapiens
gcttgcattctggatctatggt

SEQ ID NO: 8266476 - DNA, 22 bp, Homo sapiens
gcttgcattaggagttatgact

SEQ ID NO: 8266477 - DNA, 22 bp, Homo sapiens
gcttgcatgattggagtgggtg

SEQ ID NO: 8266478 - DNA, 22 bp, Homo sapiens
gcttgcatcttctagttcctag

SEQ ID NO: 8266479 - DNA, 22 bp, Homo sapiens
gcttgcatgatatggcatctgg

SEQ ID NO: 8266480 - DNA, 22 bp, Homo sapiens
gcttgcatagctctgtcctgtt

SEQ ID NO: 8266481 - DNA, 22 bp, Homo sapiens
gcttgcatattggaaagactca

SEQ ID NO: 8266482 - DNA, 22 bp, Homo sapiens
gcttgcatcatcttgagagtcc

SEQ ID NO: 8266483 - DNA, 22 bp, Homo sapiens
gctgtgtatcagatgccacggg

SEQ ID NO: 8266484 - DNA, 22 bp, Homo sapiens
gctgtggcttgcagctggggct

SEQ ID NO: 8266485 - DNA, 19 bp, Homo sapiens
gctgggcttgggtttgtag

SEQ ID NO: 8266486 - DNA, 22 bp, Homo sapiens
ggagccagaaatgctgtggttg

SEQ ID NO: 8266487 - DNA, 22 bp, Homo sapiens
ggagagaccctggagaaggtcc

SEQ ID NO: 8266488 - DNA, 22 bp, Homo sapiens
ggagagaaattgaggtagcaag

SEQ ID NO: 8266489 - DNA, 22 bp, Homo sapiens
ggagagaactgacctgaaagga

SEQ ID NO: 8266490 - DNA, 22 bp, Homo sapiens
ggagagaattccatggacatgt

SEQ ID NO: 8266491 - DNA, 22 bp, Homo sapiens
ggagactacctagcaggctgtt

SEQ ID NO: 8266492 - DNA, 19 bp, Homo sapiens
ggaccagctttcaggaggc

SEQ ID NO: 8266493 - DNA, 22 bp, Homo sapiens
ggacaggtgactgcccagagtg

SEQ ID NO: 8266494 - DNA, 22 bp, Homo sapiens
ggacaggtgcaaagggcacatg

SEQ ID NO: 8266495 - DNA, 22 bp, Homo sapiens
ggacaggtgtgaggctggcaca

SEQ ID NO: 8266496 - DNA, 22 bp, Homo sapiens
ggacatagaggccctgcatggc

SEQ ID NO: 8266497 - DNA, 22 bp, Homo sapiens
ggaagaggctctcattgagggc

SEQ ID NO: 8266498 - DNA, 22 bp, Homo sapiens
ggaatcagaattactgaatgga

SEQ ID NO: 8266499 - DNA, 22 bp, Homo sapiens
ggaatcagatgaggggcagagc

SEQ ID NO: 8266500 - DNA, 20 bp, Homo sapiens
ggaatcagggtaatgtactg

SEQ ID NO: 8266501 - DNA, 22 bp, Homo sapiens
gctgccctgtttagccagggtt

SEQ ID NO: 8266502 - DNA, 22 bp, Homo sapiens
gctgcccacaaccccgtgtcta

SEQ ID NO: 8266503 - DNA, 22 bp, Homo sapiens
gctgcccaggagaggtggggct

SEQ ID NO: 8266504 - DNA, 22 bp, Homo sapiens
gctgcccagtgtgctcatgcag

SEQ ID NO: 8266505 - DNA, 19 bp, Homo sapiens
gctgagggccacccagccc

SEQ ID NO: 8266506 - DNA, 22 bp, Homo sapiens
gctgagggctgtaacagcagag

SEQ ID NO: 8266507 - DNA, 22 bp, Homo sapiens
gctgcccaattacagggccgtg

SEQ ID NO: 8266508 - DNA, 21 bp, Homo sapiens
gctgctgtgggccagggaggc

SEQ ID NO: 8266509 - DNA, 22 bp, Homo sapiens
gctgcctgttgaagggtctgtg

SEQ ID NO: 8266510 - DNA, 22 bp, Homo sapiens
gctgcggtcactgcgggggctg

SEQ ID NO: 8266511 - DNA, 22 bp, Homo sapiens
gctgcctgtcctgaggagtccg

SEQ ID NO: 8266512 - DNA, 22 bp, Homo sapiens
gctgcctgtctgctgacccagg

SEQ ID NO: 8266513 - DNA, 22 bp, Homo sapiens
gctccctgtgctctgagtgata

SEQ ID NO: 8266514 - DNA, 22 bp, Homo sapiens
gctctgggccgggcaccagcct

SEQ ID NO: 8266515 - DNA, 22 bp, Homo sapiens
gctgaataggcacagagggcat

SEQ ID NO: 8266516 - DNA, 22 bp, Homo sapiens
gctgaataggggtcccaaagat

SEQ ID NO: 8266517 - DNA, 22 bp, Homo sapiens
gctctggggcccagggatcaca

SEQ ID NO: 8266518 - DNA, 23 bp, Homo sapiens
gctccctgtgctccaggagatgc

SEQ ID NO: 8266519 - DNA, 22 bp, Homo sapiens
gctccctgactcagttcctgag

SEQ ID NO: 8266520 - DNA, 22 bp, Homo sapiens
gctccctgcagctgagagttcc

SEQ ID NO: 8266521 - DNA, 21 bp, Homo sapiens
gctccctgctcagctcctggg

SEQ ID NO: 8266522 - DNA, 22 bp, Homo sapiens
gctcagctgagcgaaggacatg

SEQ ID NO: 8266523 - DNA, 22 bp, Homo sapiens
gctcagagttaaatatagtgct

SEQ ID NO: 8266524 - DNA, 22 bp, Homo sapiens
gctcagagttaattggatgggt

SEQ ID NO: 8266525 - DNA, 22 bp, Homo sapiens
gctcagctatcagtgttcctga

SEQ ID NO: 8266526 - DNA, 22 bp, Homo sapiens
gctcagctacttacaggtggct

SEQ ID NO: 8266527 - DNA, 22 bp, Homo sapiens
gctcagaggttgttcttgggtt

SEQ ID NO: 8266528 - DNA, 22 bp, Homo sapiens
gctcagagggaacaaggggctg

SEQ ID NO: 8266529 - DNA, 22 bp, Homo sapiens
gctcagaggccactgttggaaa

SEQ ID NO: 8266530 - DNA, 21 bp, Homo sapiens
gccttgccacatgtgccacag

SEQ ID NO: 8266531 - DNA, 22 bp, Homo sapiens
gccttgccgctcagcagtgggg

SEQ ID NO: 8266532 - DNA, 22 bp, Homo sapiens
gcgtggggcagcccagggcttc

SEQ ID NO: 8266533 - DNA, 22 bp, Homo sapiens
gcggtggggaaaggaggtgctg

SEQ ID NO: 8266534 - DNA, 22 bp, Homo sapiens
gcctttaaagccccgagagccc

SEQ ID NO: 8266535 - DNA, 22 bp, Homo sapiens
tagggatgtggtgagaactgag

SEQ ID NO: 8266536 - DNA, 22 bp, Homo sapiens
tagggatgtcctgagacttggc

SEQ ID NO: 8266537 - DNA, 22 bp, Homo sapiens
tagggatgtaaacatagtaatt

SEQ ID NO: 8266538 - DNA, 22 bp, Homo sapiens
tagggatggcagcatgtagctt

SEQ ID NO: 8266539 - DNA, 22 bp, Homo sapiens
tagggatggatgatgcctggca

SEQ ID NO: 8266540 - DNA, 22 bp, Homo sapiens
tagggatgggagattctcaaac

SEQ ID NO: 8266541 - DNA, 22 bp, Homo sapiens
tagggatgatggagcctatgta

SEQ ID NO: 8266542 - DNA, 22 bp, Homo sapiens
tagggatgatgtctaaaatcat

SEQ ID NO: 8266543 - DNA, 20 bp, Homo sapiens
tagggatgccagtacttctc

SEQ ID NO: 8266544 - DNA, 22 bp, Homo sapiens
tagggatgcttagtaggaccca

SEQ ID NO: 8266545 - DNA, 22 bp, Homo sapiens
tagggatggaaacccgttttct

SEQ ID NO: 8266546 - DNA, 22 bp, Homo sapiens
tagggatggaaactaggaatct

SEQ ID NO: 8266547 - DNA, 22 bp, Homo sapiens
tagggatgacgaaaggacagag

SEQ ID NO: 8266548 - DNA, 22 bp, Homo sapiens
tagggatgactatgattcccac

SEQ ID NO: 8266549 - DNA, 22 bp, Homo sapiens
tagggatgaagatggtatttct

SEQ ID NO: 8266550 - DNA, 22 bp, Homo sapiens
tagggagtgcgtagcagggtgg

SEQ ID NO: 8266551 - DNA, 22 bp, Homo sapiens
tagggatgaagttgctatttac

SEQ ID NO: 8266552 - DNA, 22 bp, Homo sapiens
tagggatgagccagtgggtagt

SEQ ID NO: 8266553 - DNA, 22 bp, Homo sapiens
tagggatgagcaactggtagtg

SEQ ID NO: 8266554 - DNA, 22 bp, Homo sapiens
tagggatgaggatagatttttc

SEQ ID NO: 8266555 - DNA, 22 bp, Homo sapiens
tagggaggagggttttcaaatc

SEQ ID NO: 8266556 - DNA, 22 bp, Homo sapiens
tagggaggctacttcttgtagg

SEQ ID NO: 8266557 - DNA, 22 bp, Homo sapiens
tagctttagtgaaaaatatcag

SEQ ID NO: 8266558 - DNA, 22 bp, Homo sapiens
tagctttacaaagtgctgcacc

SEQ ID NO: 8266559 - DNA, 22 bp, Homo sapiens
taggatatgcatttttatacat

SEQ ID NO: 8266560 - DNA, 22 bp, Homo sapiens
taggatatgagtaagcctttgt

SEQ ID NO: 8266561 - DNA, 22 bp, Homo sapiens
taggatatgtgaaatcatatta

SEQ ID NO: 8266562 - DNA, 22 bp, Homo sapiens
taggatatggtagaaatcattc

SEQ ID NO: 8266563 - DNA, 22 bp, Homo sapiens
tagctctgtggatctttttaag

SEQ ID NO: 8266564 - DNA, 22 bp, Homo sapiens
tagctctgtgctctggatctgt

SEQ ID NO: 8266565 - DNA, 22 bp, Homo sapiens
tagctctgtcacctggcaaagt

SEQ ID NO: 8266566 - DNA, 19 bp, Homo sapiens
tagctctgtcttattccaa

SEQ ID NO: 8266567 - DNA, 22 bp, Homo sapiens
tagctctgcaatgaagcccagg

SEQ ID NO: 8266568 - DNA, 22 bp, Homo sapiens
tagctctgcaatgaagcccagg

SEQ ID NO: 8266569 - DNA, 22 bp, Homo sapiens
tagctctgctggaaggagtcag

SEQ ID NO: 8266570 - DNA, 22 bp, Homo sapiens
tagctctgccaaatggaggctg

SEQ ID NO: 8266571 - DNA, 22 bp, Homo sapiens
tagctctgtcacatacactgca

SEQ ID NO: 8266572 - DNA, 22 bp, Homo sapiens
tagctctggagtcttctcagaa

SEQ ID NO: 8266573 - DNA, 22 bp, Homo sapiens
tagctctggcattctttccaaa

SEQ ID NO: 8266574 - DNA, 22 bp, Homo sapiens
tagctctgaccaagagactgag

SEQ ID NO: 8266575 - DNA, 22 bp, Homo sapiens
tagctctgaggccatctccggt

SEQ ID NO: 8266576 - DNA, 22 bp, Homo sapiens
tagctctgacatttgcaattac

SEQ ID NO: 8266577 - DNA, 22 bp, Homo sapiens
tagaaagctgagtaatacattt

SEQ ID NO: 8266578 - DNA, 22 bp, Homo sapiens
tagacacatcaagtatagttaa

SEQ ID NO: 8266579 - DNA, 22 bp, Homo sapiens
tactttttatgataagaactga

SEQ ID NO: 8266580 - DNA, 22 bp, Homo sapiens
tataaattattaggctgctaaa

SEQ ID NO: 8266581 - DNA, 22 bp, Homo sapiens
tatgactatagggcttagtgtt

SEQ ID NO: 8266582 - DNA, 22 bp, Homo sapiens
tatgacattgctttttagaact

SEQ ID NO: 8266583 - DNA, 22 bp, Homo sapiens
tatgacattatgtattacatgt

SEQ ID NO: 8266584 - DNA, 22 bp, Homo sapiens
tatatcttatatgtgcaggtac

SEQ ID NO: 8266585 - DNA, 22 bp, Homo sapiens
tatatcatggagattaacattc

SEQ ID NO: 8266586 - DNA, 22 bp, Homo sapiens
tatccaattcaccattgatggg

SEQ ID NO: 8266587 - DNA, 22 bp, Homo sapiens
tatgagtggcgtagaggtaggg

SEQ ID NO: 8266588 - DNA, 22 bp, Homo sapiens
tatgtctgaatcttatttaaat

SEQ ID NO: 8266589 - DNA, 22 bp, Homo sapiens
tattctcatcatcactggagct

SEQ ID NO: 8266590 - DNA, 22 bp, Homo sapiens
tatttataacagtgagaacggg

SEQ ID NO: 8266591 - DNA, 22 bp, Homo sapiens
tattgacactttttgtgtagcc

SEQ ID NO: 8266592 - DNA, 22 bp, Homo sapiens
tatttataatctgccaaagaga

SEQ ID NO: 8266593 - DNA, 22 bp, Homo sapiens
taaggtagccctaatgtgggtt

SEQ ID NO: 8266594 - DNA, 22 bp, Homo sapiens
taagtgtccctattgtgatttt

SEQ ID NO: 8266595 - DNA, 22 bp, Homo sapiens
taatggtatttcaagacttgcc

SEQ ID NO: 8266596 - DNA, 22 bp, Homo sapiens
tacaaaggcttaaagagatttc

SEQ ID NO: 8266597 - DNA, 22 bp, Homo sapiens
tacaaaggcggtttttctgggc

SEQ ID NO: 8266598 - DNA, 22 bp, Homo sapiens
tacaaaaaattgatactgacga

SEQ ID NO: 8266599 - DNA, 22 bp, Homo sapiens
tacagatatagagatttataga

SEQ ID NO: 8266600 - DNA, 22 bp, Homo sapiens
tacagatatagagatttataga

SEQ ID NO: 8266601 - DNA, 22 bp, Homo sapiens
tacagattttgtgaagaagtgt

SEQ ID NO: 8266602 - DNA, 22 bp, Homo sapiens
tacagatacagatctagataca

SEQ ID NO: 8266603 - DNA, 22 bp, Homo sapiens
tacatatactgagtgatttgct

SEQ ID NO: 8266604 - DNA, 22 bp, Homo sapiens
tacaggagcacaaaagagttga

SEQ ID NO: 8266605 - DNA, 22 bp, Homo sapiens
tacaggagctgctctgtgatac

SEQ ID NO: 8266606 - DNA, 22 bp, Homo sapiens
tacaggagcatggggaagggat

SEQ ID NO: 8266607 - DNA, 17 bp, Homo sapiens
tacaggagagcaggaac

SEQ ID NO: 8266608 - DNA, 22 bp, Homo sapiens
tacaggaggattatcaaaggat

SEQ ID NO: 8266609 - DNA, 20 bp, Homo sapiens
tacaggagtgagtgggtggg

SEQ ID NO: 8266610 - DNA, 19 bp, Homo sapiens
tacaggaggcctgcaatct

SEQ ID NO: 8266611 - DNA, 18 bp, Homo sapiens
gtgtgcagttgcaggggt

SEQ ID NO: 8266612 - DNA, 22 bp, Homo sapiens
gtgctccaggtcgctcagagag

SEQ ID NO: 8266613 - DNA, 22 bp, Homo sapiens
gtgtggccttgggagaggtctg

SEQ ID NO: 8266614 - DNA, 22 bp, Homo sapiens
gttgggagcagcagaccaagag

SEQ ID NO: 8266615 - DNA, 22 bp, Homo sapiens
gttgcaggaggatggctgcata

SEQ ID NO: 8266616 - DNA, 22 bp, Homo sapiens
gttgcagatgtggaactcgtgc

SEQ ID NO: 8266617 - DNA, 22 bp, Homo sapiens
taaattcactcctggtagacct

SEQ ID NO: 8266618 - DNA, 22 bp, Homo sapiens
taaaatgtttgcaagagaccag

SEQ ID NO: 8266619 - DNA, 22 bp, Homo sapiens
taaaatgatctctcatgttctt

SEQ ID NO: 8266620 - DNA, 22 bp, Homo sapiens
tcccagggttacagccagggca

SEQ ID NO: 8266621 - DNA, 20 bp, Homo sapiens
tcccatgtccatatcagccc

SEQ ID NO: 8266622 - DNA, 22 bp, Homo sapiens
tcccatgtaagaaggagacagg

SEQ ID NO: 8266623 - DNA, 22 bp, Homo sapiens
tcccatgtgttcctctagtcta

SEQ ID NO: 8266624 - DNA, 22 bp, Homo sapiens
tcccatgtgactcagctgcctg

SEQ ID NO: 8266625 - DNA, 22 bp, Homo sapiens
tcccatgttaccaaggagtcac

SEQ ID NO: 8266626 - DNA, 22 bp, Homo sapiens
tcccatgttgatctttgggttg

SEQ ID NO: 8266627 - DNA, 22 bp, Homo sapiens
tcccatgttaggtgtttctgtt

SEQ ID NO: 8266628 - DNA, 18 bp, Homo sapiens
tcccatgttgtttttaaa

SEQ ID NO: 8266629 - DNA, 22 bp, Homo sapiens
tcccatgttgtgcctggctgca

SEQ ID NO: 8266630 - DNA, 22 bp, Homo sapiens
tccccaggaaattctgattctt

SEQ ID NO: 8266631 - DNA, 22 bp, Homo sapiens
tccccaggggcctgggcacagt

SEQ ID NO: 8266632 - DNA, 22 bp, Homo sapiens
tccaggagtctagcctcaggcc

SEQ ID NO: 8266633 - DNA, 22 bp, Homo sapiens
tccaggagtggggcagaggtct

SEQ ID NO: 8266634 - DNA, 22 bp, Homo sapiens
tccaggccactgcagaggctct

SEQ ID NO: 8266635 - DNA, 22 bp, Homo sapiens
tccaggccacatggatggcgat

SEQ ID NO: 8266636 - DNA, 22 bp, Homo sapiens
tccaggccaatgtagcaggccc

SEQ ID NO: 8266637 - DNA, 22 bp, Homo sapiens
tccaggccacgacctcctggat

SEQ ID NO: 8266638 - DNA, 22 bp, Homo sapiens
tccagccaactgcctagggagc

SEQ ID NO: 8266639 - DNA, 23 bp, Homo sapiens
tccagccaaatctggctgacagt

SEQ ID NO: 8266640 - DNA, 22 bp, Homo sapiens
tccagccaagccttggtagctg

SEQ ID NO: 8266641 - DNA, 22 bp, Homo sapiens
tccagccaatcagagctgaggc

SEQ ID NO: 8266642 - DNA, 22 bp, Homo sapiens
tccagcagtgctctagagcgtg

SEQ ID NO: 8266643 - DNA, 19 bp, Homo sapiens
tccagcagtgcttgaaatc

SEQ ID NO: 8266644 - DNA, 22 bp, Homo sapiens
tccagcagtgctcaggactcac

SEQ ID NO: 8266645 - DNA, 16 bp, Homo sapiens
tccagcagtctctgta

SEQ ID NO: 8266646 - DNA, 22 bp, Homo sapiens
tccagcagtccatgtgagacac

SEQ ID NO: 8266647 - DNA, 20 bp, Homo sapiens
tccagcagtatgctatactt

SEQ ID NO: 8266648 - DNA, 22 bp, Homo sapiens
tccagcaggttggtcaggtgca

SEQ ID NO: 8266649 - DNA, 22 bp, Homo sapiens
tccagcagtaaggaaagtacat

SEQ ID NO: 8266650 - DNA, 18 bp, Homo sapiens
tccagcagcatagtttcc

SEQ ID NO: 8266651 - DNA, 22 bp, Homo sapiens
tccagcagaggttgataatacc

SEQ ID NO: 8266652 - DNA, 22 bp, Homo sapiens
tccagcagagtctctgaggggg

SEQ ID NO: 8266653 - DNA, 23 bp, Homo sapiens
tccagcagccaagaagggtagaa

SEQ ID NO: 8266654 - DNA, 22 bp, Homo sapiens
tccagcagaccatcaaggctca

SEQ ID NO: 8266655 - DNA, 22 bp, Homo sapiens
tccagcagactcatcagcaagg

SEQ ID NO: 8266656 - DNA, 23 bp, Homo sapiens
tccagcagagccttccaggaggg

SEQ ID NO: 8266657 - DNA, 22 bp, Homo sapiens
tccagcagcccgaaggcccatc

SEQ ID NO: 8266658 - DNA, 22 bp, Homo sapiens
tccagcagggaattagtagtct

SEQ ID NO: 8266659 - DNA, 22 bp, Homo sapiens
tccagcagcctgacttccctct

SEQ ID NO: 8266660 - DNA, 22 bp, Homo sapiens
tccagcagccacacctctggac

SEQ ID NO: 8266661 - DNA, 22 bp, Homo sapiens
tccagcaggtccgagacaagtt

SEQ ID NO: 8266662 - DNA, 18 bp, Homo sapiens
tccagcaggtctgaggtg

SEQ ID NO: 8266663 - DNA, 22 bp, Homo sapiens
tccagcaggtgtttgccaactt

SEQ ID NO: 8266664 - DNA, 22 bp, Homo sapiens
tcaagctggctgttgctatttc

SEQ ID NO: 8266665 - DNA, 22 bp, Homo sapiens
tcaagtctggagatctggaact

SEQ ID NO: 8266666 - DNA, 22 bp, Homo sapiens
tcaataaatagcttggctcagc

SEQ ID NO: 8266667 - DNA, 22 bp, Homo sapiens
tcagagcttatctcttgctgga

SEQ ID NO: 8266668 - DNA, 22 bp, Homo sapiens
tcagagcatgtgggctgcagtt

SEQ ID NO: 8266669 - DNA, 22 bp, Homo sapiens
tcagagcaccacacagttccct

SEQ ID NO: 8266670 - DNA, 22 bp, Homo sapiens
tcacttgagagatattagaagt

SEQ ID NO: 8266671 - DNA, 22 bp, Homo sapiens
tcagctctgcactccactgtgg

SEQ ID NO: 8266672 - DNA, 22 bp, Homo sapiens
tcagctctgcaaggtcacctcc

SEQ ID NO: 8266673 - DNA, 22 bp, Homo sapiens
tcaggaagctgctctgggtggt

SEQ ID NO: 8266674 - DNA, 22 bp, Homo sapiens
tcaggaggttgaccacggggca

SEQ ID NO: 8266675 - DNA, 22 bp, Homo sapiens
tcaggagtaaagacagagttcc

SEQ ID NO: 8266676 - DNA, 22 bp, Homo sapiens
tcaggagtaagggtaacccaga

SEQ ID NO: 8266677 - DNA, 22 bp, Homo sapiens
tcaggagtaaagaagacttgac

SEQ ID NO: 8266678 - DNA, 22 bp, Homo sapiens
tcaggagtctgtgcagttccac

SEQ ID NO: 8266679 - DNA, 22 bp, Homo sapiens
tcaggagtcctgcctgcagcct

SEQ ID NO: 8266680 - DNA, 22 bp, Homo sapiens
tcaggagtaagttataagtatt

SEQ ID NO: 8266681 - DNA, 22 bp, Homo sapiens
tcaggagtactggtgtctacag

SEQ ID NO: 8266682 - DNA, 21 bp, Homo sapiens
tcagcagcttttgcagtccct

SEQ ID NO: 8266683 - DNA, 21 bp, Homo sapiens
tcagcagaaggaccactaggg

SEQ ID NO: 8266684 - DNA, 22 bp, Homo sapiens
tcagctctacacacacctgtgt

SEQ ID NO: 8266685 - DNA, 22 bp, Homo sapiens
tcagctctacacacacctgtgt

SEQ ID NO: 8266686 - DNA, 22 bp, Homo sapiens
tcagctctacctgggagctgtc

SEQ ID NO: 8266687 - DNA, 21 bp, Homo sapiens
tcaggcagtgcaaatacatgg

SEQ ID NO: 8266688 - DNA, 22 bp, Homo sapiens
tcaggagtttcaggtgtaagtg

SEQ ID NO: 8266689 - DNA, 22 bp, Homo sapiens
tcaggagtttggcctacagagg

SEQ ID NO: 8266690 - DNA, 22 bp, Homo sapiens
tcaggagttgaaggggatcctg

SEQ ID NO: 8266691 - DNA, 19 bp, Homo sapiens
tcaggagttagttgtgctc

SEQ ID NO: 8266692 - DNA, 22 bp, Homo sapiens
tcaggagtgcagcagtttggag

SEQ ID NO: 8266693 - DNA, 22 bp, Homo sapiens
tcaggagtgccagtaccttttg

SEQ ID NO: 8266694 - DNA, 21 bp, Homo sapiens
tcaggagtggagagaattggt

SEQ ID NO: 8266695 - DNA, 22 bp, Homo sapiens
tcaggagtgataccatttgtca

SEQ ID NO: 8266696 - DNA, 18 bp, Homo sapiens
tcaggagtttgtggatgg

SEQ ID NO: 8266697 - DNA, 19 bp, Homo sapiens
tcaggcagttattcacaaa

SEQ ID NO: 8266698 - DNA, 22 bp, Homo sapiens
tcatatactgccttgtagatta

SEQ ID NO: 8266699 - DNA, 22 bp, Homo sapiens
tcatgctagttaagaacacaat

SEQ ID NO: 8266700 - DNA, 22 bp, Homo sapiens
tcagtgtcatcacttaatataa

SEQ ID NO: 8266701 - DNA, 22 bp, Homo sapiens
tcagtgtcatcacttaatataa

SEQ ID NO: 8266702 - DNA, 22 bp, Homo sapiens
tcagtgtcatatcaagaagatg

SEQ ID NO: 8266703 - DNA, 20 bp, Homo sapiens
tcagtgtcagtagccactac

SEQ ID NO: 8266704 - DNA, 22 bp, Homo sapiens
tcagtgtcagtcttttagatat

SEQ ID NO: 8266705 - DNA, 16 bp, Homo sapiens
tcagtgtcagctcctg

SEQ ID NO: 8266706 - DNA, 22 bp, Homo sapiens
tcagtgtcacaggatgctatgc

SEQ ID NO: 8266707 - DNA, 22 bp, Homo sapiens
tcagtgtcccgtctcttaactc

SEQ ID NO: 8266708 - DNA, 19 bp, Homo sapiens
tcagtgtccctgttaatat

SEQ ID NO: 8266709 - DNA, 22 bp, Homo sapiens
tcagtgtccggagcctgagtgc

SEQ ID NO: 8266710 - DNA, 22 bp, Homo sapiens
tcagtgtccaaaaagaggcaag

SEQ ID NO: 8266711 - DNA, 22 bp, Homo sapiens
tcagtgtccataaataaagttt

SEQ ID NO: 8266712 - DNA, 22 bp, Homo sapiens
tcagtgtctagggacagtaatc

SEQ ID NO: 8266713 - DNA, 23 bp, Homo sapiens
tcagtgtctagttgtggaattga

SEQ ID NO: 8266714 - DNA, 22 bp, Homo sapiens
tcagtgtccttcgttcttgttg

SEQ ID NO: 8266715 - DNA, 22 bp, Homo sapiens
tcagtgtcctgtgcggtgcagc

SEQ ID NO: 8266716 - DNA, 22 bp, Homo sapiens
tcagtgtctatagataaggttt

SEQ ID NO: 8266717 - DNA, 22 bp, Homo sapiens
tcagtgtctcatatgaggtttc

SEQ ID NO: 8266718 - DNA, 22 bp, Homo sapiens
tcagggaatgggcccagtccct

SEQ ID NO: 8266719 - DNA, 22 bp, Homo sapiens
tttgttttcaatgtgtcattca

SEQ ID NO: 8266720 - DNA, 22 bp, Homo sapiens
tttgtattacaaagtcacagta

SEQ ID NO: 8266721 - DNA, 22 bp, Homo sapiens
tttgtatttttcccagctagct

SEQ ID NO: 8266722 - DNA, 22 bp, Homo sapiens
tttctgtcattactttcctccc

SEQ ID NO: 8266723 - DNA, 22 bp, Homo sapiens
tttctgacctgcaacagtttac

SEQ ID NO: 8266724 - DNA, 22 bp, Homo sapiens
tttctgtacacccactattcat

SEQ ID NO: 8266725 - DNA, 17 bp, Homo sapiens
tttctccttccatctca

SEQ ID NO: 8266726 - DNA, 22 bp, Homo sapiens
tttcctcttctggcaggcaggg

SEQ ID NO: 8266727 - DNA, 22 bp, Homo sapiens
ttgtgacaatacagcatggaga

SEQ ID NO: 8266728 - DNA, 22 bp, Homo sapiens
ttgtgacacatgccgtcctgag

SEQ ID NO: 8266729 - DNA, 22 bp, Homo sapiens
ttgtgacagagatcacgtggcc

SEQ ID NO: 8266730 - DNA, 22 bp, Homo sapiens
ttgtgacattgattaaactatg

SEQ ID NO: 8266731 - DNA, 22 bp, Homo sapiens
ttgtgagaaatcttaatcccaa

SEQ ID NO: 8266732 - DNA, 22 bp, Homo sapiens
ttgttttggaagaacttactct

SEQ ID NO: 8266733 - DNA, 22 bp, Homo sapiens
ttgttttgctaaagggtcatca

SEQ ID NO: 8266734 - DNA, 22 bp, Homo sapiens
ttgttttggagatgagctaaaa

SEQ ID NO: 8266735 - DNA, 22 bp, Homo sapiens
tttaattgattcacagtctgta

SEQ ID NO: 8266736 - DNA, 22 bp, Homo sapiens
tttaattgcatttaaagatgga

SEQ ID NO: 8266737 - DNA, 22 bp, Homo sapiens
tttaattgttgtgggtacatag

SEQ ID NO: 8266738 - DNA, 22 bp, Homo sapiens
tttaattagcaagccagagagc

SEQ ID NO: 8266739 - DNA, 22 bp, Homo sapiens
ttccacaggtttcagactgttc

SEQ ID NO: 8266740 - DNA, 22 bp, Homo sapiens
ttcacaaaatggtttgttgatg

SEQ ID NO: 8266741 - DNA, 22 bp, Homo sapiens
ttcacaaaaatgctgaacagtt

SEQ ID NO: 8266742 - DNA, 22 bp, Homo sapiens
ttcacaaagctggagcatttcc

SEQ ID NO: 8266743 - DNA, 22 bp, Homo sapiens
ttagagtgtagcaggaagaggc

SEQ ID NO: 8266744 - DNA, 21 bp, Homo sapiens
ttagagtagagaacatgatcc

SEQ ID NO: 8266745 - DNA, 21 bp, Homo sapiens
ttcaacaaagggaataagttt

SEQ ID NO: 8266746 - DNA, 22 bp, Homo sapiens
ttcaacaagtagtacacacagt

SEQ ID NO: 8266747 - DNA, 22 bp, Homo sapiens
ttcaacaatgaaagctaaggaa

SEQ ID NO: 8266748 - DNA, 22 bp, Homo sapiens
ttcaacaacttggttcaaatgg

SEQ ID NO: 8266749 - DNA, 22 bp, Homo sapiens
ttcagtgcacagtactgagact

SEQ ID NO: 8266750 - DNA, 22 bp, Homo sapiens
ttcagtgcagacgccgaagccc

SEQ ID NO: 8266751 - DNA, 22 bp, Homo sapiens
ttcagtgccgtgctgggtcgct

SEQ ID NO: 8266752 - DNA, 22 bp, Homo sapiens
ttcagtgcctgtccacagcttc

SEQ ID NO: 8266753 - DNA, 22 bp, Homo sapiens
ttcagtgctaaaaagtctcaag

SEQ ID NO: 8266754 - DNA, 22 bp, Homo sapiens
ttcagtgcttacaggtttcttt

SEQ ID NO: 8266755 - DNA, 22 bp, Homo sapiens
ttctggggttatgggtgattct

SEQ ID NO: 8266756 - DNA, 22 bp, Homo sapiens
ttctgaatttctgtgtatctta

SEQ ID NO: 8266757 - DNA, 22 bp, Homo sapiens
ttctgaatgatagtcttgaact

SEQ ID NO: 8266758 - DNA, 22 bp, Homo sapiens
ttctgctgctgctgcacccaat

SEQ ID NO: 8266759 - DNA, 22 bp, Homo sapiens
ttctgagctacatagtactggg

SEQ ID NO: 8266760 - DNA, 22 bp, Homo sapiens
ttctgcttttctctgtctgagt

SEQ ID NO: 8266761 - DNA, 22 bp, Homo sapiens
ttctgctttcagttcttctggg

SEQ ID NO: 8266762 - DNA, 22 bp, Homo sapiens
ttgaggagtgtttagggtgagg

SEQ ID NO: 8266763 - DNA, 22 bp, Homo sapiens
ttgaggagttaggatgtttata

SEQ ID NO: 8266764 - DNA, 18 bp, Homo sapiens
ttgaggagttcactgtct

SEQ ID NO: 8266765 - DNA, 22 bp, Homo sapiens
ttgagcccaggaggcctgggtg

SEQ ID NO: 8266766 - DNA, 22 bp, Homo sapiens
ttgagcaaatcagaagtttaga

SEQ ID NO: 8266767 - DNA, 22 bp, Homo sapiens
ttgagcaaatcagattgtaatt

SEQ ID NO: 8266768 - DNA, 22 bp, Homo sapiens
ttgagcaaaggagtaaaatgca

SEQ ID NO: 8266769 - DNA, 20 bp, Homo sapiens
ttgagcaatcagtaaaggat

SEQ ID NO: 8266770 - DNA, 22 bp, Homo sapiens
ttgagcaatgctgcaaagagat

SEQ ID NO: 8266771 - DNA, 22 bp, Homo sapiens
ttgagcaagagtaggaactgaa

SEQ ID NO: 8266772 - DNA, 22 bp, Homo sapiens
ttgagcaattaggaaataaaga

SEQ ID NO: 8266773 - DNA, 22 bp, Homo sapiens
ttaagacatgtgagcataactt

SEQ ID NO: 8266774 - DNA, 22 bp, Homo sapiens
ttaattgttggaaatagattat

SEQ ID NO: 8266775 - DNA, 22 bp, Homo sapiens
ttaattgtctgtgagtacctga

SEQ ID NO: 8266776 - DNA, 22 bp, Homo sapiens
ttaattgtaaagtttgcctgtt

SEQ ID NO: 8266777 - DNA, 22 bp, Homo sapiens
ttactttagatcatactgtgtg

SEQ ID NO: 8266778 - DNA, 22 bp, Homo sapiens
ttacatattatccaaaactgct

SEQ ID NO: 8266779 - DNA, 22 bp, Homo sapiens
tccccatgggtggggacacata

SEQ ID NO: 8266780 - DNA, 18 bp, Homo sapiens
tgtggacatggctcttca

SEQ ID NO: 8266781 - DNA, 22 bp, Homo sapiens
tgtggagcctcaaggccatctc

SEQ ID NO: 8266782 - DNA, 22 bp, Homo sapiens
tgtggcaaagaccatttctttc

SEQ ID NO: 8266783 - DNA, 22 bp, Homo sapiens
tgtggaggattctgatgccagc

SEQ ID NO: 8266784 - DNA, 22 bp, Homo sapiens
tgtggcagatacagaagatcaa

SEQ ID NO: 8266785 - DNA, 22 bp, Homo sapiens
tgtggcagagagagcttccttg

SEQ ID NO: 8266786 - DNA, 22 bp, Homo sapiens
tgtggccaggaaaaggagatgg

SEQ ID NO: 8266787 - DNA, 22 bp, Homo sapiens
tgtggccagccacaggcatggt

SEQ ID NO: 8266788 - DNA, 22 bp, Homo sapiens
tgtggtggtaatgagccagatg

SEQ ID NO: 8266789 - DNA, 22 bp, Homo sapiens
tgtggtggctattctggtctca

SEQ ID NO: 8266790 - DNA, 22 bp, Homo sapiens
tgtggtggggtctggtattcca

SEQ ID NO: 8266791 - DNA, 18 bp, Homo sapiens
tgtggtggagctgccttc

SEQ ID NO: 8266792 - DNA, 22 bp, Homo sapiens
tgtggggactttcaaagccaat

SEQ ID NO: 8266793 - DNA, 19 bp, Homo sapiens
tgtggggagtcagggggct

SEQ ID NO: 8266794 - DNA, 22 bp, Homo sapiens
tgtggtcctggggagacatgaa

SEQ ID NO: 8266795 - DNA, 22 bp, Homo sapiens
tgtggtagagggcagatgggca

SEQ ID NO: 8266796 - DNA, 22 bp, Homo sapiens
tgtggtagagggcagatgggca

SEQ ID NO: 8266797 - DNA, 22 bp, Homo sapiens
tgtggtcccaaggcaactggaa

SEQ ID NO: 8266798 - DNA, 22 bp, Homo sapiens
tgtgtccaacccagggacaagt

SEQ ID NO: 8266799 - DNA, 20 bp, Homo sapiens
tgtgtccatcatctgggcac

SEQ ID NO: 8266800 - DNA, 22 bp, Homo sapiens
tgtgtccattcaggcactgacc

SEQ ID NO: 8266801 - DNA, 23 bp, Homo sapiens
tgtgtttacctgaggatcttgtt

SEQ ID NO: 8266802 - DNA, 22 bp, Homo sapiens
tgttctgagtgcagcttaataa

SEQ ID NO: 8266803 - DNA, 22 bp, Homo sapiens
caaaagcagttctatctgagtt

SEQ ID NO: 8266804 - DNA, 22 bp, Homo sapiens
gacatttattggattttacgag

SEQ ID NO: 8266805 - DNA, 22 bp, Homo sapiens
gacatttatgaaggagatatgc

SEQ ID NO: 8266806 - DNA, 22 bp, Homo sapiens
gacacagtttttctcacggtgg

SEQ ID NO: 8266807 - DNA, 22 bp, Homo sapiens
caagtttgtgttctatcattct

SEQ ID NO: 8266808 - DNA, 22 bp, Homo sapiens
cagaaacatgtataaagttgta

SEQ ID NO: 8266809 - DNA, 22 bp, Homo sapiens
cagaaaagggtgtttgttcagg

SEQ ID NO: 8266810 - DNA, 22 bp, Homo sapiens
cacagttttatcttatactgat

SEQ ID NO: 8266811 - DNA, 22 bp, Homo sapiens
cacagttttgtcttggtttcca

SEQ ID NO: 8266812 - DNA, 22 bp, Homo sapiens
cacagttttgcccagggcttct

SEQ ID NO: 8266813 - DNA, 22 bp, Homo sapiens
cacatttaattggtttagggtg

SEQ ID NO: 8266814 - DNA, 22 bp, Homo sapiens
ctacattttaataagctgctta

SEQ ID NO: 8266815 - DNA, 22 bp, Homo sapiens
ctacatttttcaccgagcctct

SEQ ID NO: 8266816 - DNA, 19 bp, Homo sapiens
cctgtgactatctttgtaa

SEQ ID NO: 8266817 - DNA, 22 bp, Homo sapiens
ctgcaaggtatatgttatcata

SEQ ID NO: 8266818 - DNA, 22 bp, Homo sapiens
ctgcaaggctgaattcagctga

SEQ ID NO: 8266819 - DNA, 22 bp, Homo sapiens
atactacaatcataattgtaca

SEQ ID NO: 8266820 - DNA, 22 bp, Homo sapiens
ccacagtttcttcatctataaa

SEQ ID NO: 8266821 - DNA, 22 bp, Homo sapiens
ccacagttattcatttgtgaca

SEQ ID NO: 8266822 - DNA, 22 bp, Homo sapiens
aggcacttgcattgatgaggtc

SEQ ID NO: 8266823 - DNA, 22 bp, Homo sapiens
aggcaaggtgctacagacagtg

SEQ ID NO: 8266824 - DNA, 23 bp, Homo sapiens
aggcaagggtgtaaaggaaatga

SEQ ID NO: 8266825 - DNA, 22 bp, Homo sapiens
acagtgttacttgatagtgtat

SEQ ID NO: 8266826 - DNA, 22 bp, Homo sapiens
acagtgttcactaaggttagct

SEQ ID NO: 8266827 - DNA, 22 bp, Homo sapiens
acagtgttcctttgttgtgact

SEQ ID NO: 8266828 - DNA, 22 bp, Homo sapiens
acagggcagtgtcttgaaaaat

SEQ ID NO: 8266829 - DNA, 22 bp, Homo sapiens
atacacagccattatgaattag

SEQ ID NO: 8266830 - DNA, 21 bp, Homo sapiens
caattactatgaaccagttga

SEQ ID NO: 8266831 - DNA, 22 bp, Homo sapiens
cactaattaacacgtcgtctct

SEQ ID NO: 8266832 - DNA, 22 bp, Homo sapiens
agcatttaggagaatttgagaa

SEQ ID NO: 8266833 - DNA, 22 bp, Homo sapiens
agcatttatcttttgtttgagt

SEQ ID NO: 8266834 - DNA, 22 bp, Homo sapiens
agcattttctgagagtatagat

SEQ ID NO: 8266835 - DNA, 22 bp, Homo sapiens
cagaaagacctgattggcagtt

SEQ ID NO: 8266836 - DNA, 22 bp, Homo sapiens
atgaggcaaaggtggaggtggg

SEQ ID NO: 8266837 - DNA, 22 bp, Homo sapiens
atgaggcaaggctggccgtgtt

SEQ ID NO: 8266838 - DNA, 22 bp, Homo sapiens
atgaggcaaggatcaggtaagg

SEQ ID NO: 8266839 - DNA, 22 bp, Homo sapiens
atgaggcaatcatggtccagtt

SEQ ID NO: 8266840 - DNA, 22 bp, Homo sapiens
atgaggcacagagatgttaatg

SEQ ID NO: 8266841 - DNA, 22 bp, Homo sapiens
atgaggcaatagaatattgaat

SEQ ID NO: 8266842 - DNA, 22 bp, Homo sapiens
atgaggcacatcacagccaatg

SEQ ID NO: 8266843 - DNA, 22 bp, Homo sapiens
agagaacagtgttttgaaggag

SEQ ID NO: 8266844 - DNA, 22 bp, Homo sapiens
agagaacatattttgtatgatt

SEQ ID NO: 8266845 - DNA, 22 bp, Homo sapiens
attgagaatatgatttagtata

SEQ ID NO: 8266846 - DNA, 22 bp, Homo sapiens
acacagttctttcactgttggt

SEQ ID NO: 8266847 - DNA, 22 bp, Homo sapiens
acacagtttatggtattctgtt

SEQ ID NO: 8266848 - DNA, 22 bp, Homo sapiens
acacagttcatgcatgaggtct

SEQ ID NO: 8266849 - DNA, 22 bp, Homo sapiens
acacagttcgttgttttctact

SEQ ID NO: 8266850 - DNA, 22 bp, Homo sapiens
acacagttcgtgcttttctatt

SEQ ID NO: 8266851 - DNA, 22 bp, Homo sapiens
agagcaacgaggtgatactaga

SEQ ID NO: 8266852 - DNA, 22 bp, Homo sapiens
aagaagcattctttcattggtt

SEQ ID NO: 8266853 - DNA, 22 bp, Homo sapiens
aaagcagtatgaaaggcaataa

SEQ ID NO: 8266854 - DNA, 22 bp, Homo sapiens
aaagcagtgcaccttaattgat

SEQ ID NO: 8266855 - DNA, 22 bp, Homo sapiens
aaagcagtctcagacttaagca

SEQ ID NO: 8266856 - DNA, 22 bp, Homo sapiens
aaagcagtgctgtgagaacact

SEQ ID NO: 8266857 - DNA, 22 bp, Homo sapiens
acaatgttctacatatacataa

SEQ ID NO: 8266858 - DNA, 22 bp, Homo sapiens
aagcagtttagataggcaaagg

SEQ ID NO: 8266859 - DNA, 22 bp, Homo sapiens
tcagagaagacatcattgtgaa

SEQ ID NO: 8266860 - DNA, 22 bp, Homo sapiens
tatttattctttgtactgcctt

SEQ ID NO: 8266861 - DNA, 17 bp, Homo sapiens
tatgaggcagtttgtga

SEQ ID NO: 8266862 - DNA, 22 bp, Homo sapiens
tatacacatatacgtttgtgtg

SEQ ID NO: 8266863 - DNA, 17 bp, Homo sapiens
tatacacagacagactg

SEQ ID NO: 8266864 - DNA, 22 bp, Homo sapiens
tactttggatccttacaatagc

SEQ ID NO: 8266865 - DNA, 22 bp, Homo sapiens
ggcaagaaggcttcaggtagct

SEQ ID NO: 8266866 - DNA, 22 bp, Homo sapiens
gggcaagaagctggaagcattc

SEQ ID NO: 8266867 - DNA, 22 bp, Homo sapiens
gtagaacatggtagggcaggtg

SEQ ID NO: 8266868 - DNA, 22 bp, Homo sapiens
gtagaacactggggctctgttg

SEQ ID NO: 8266869 - DNA, 22 bp, Homo sapiens
gaggcaaggccgcacgtctcag

SEQ ID NO: 8266870 - DNA, 22 bp, Homo sapiens
ctactactccaccacttaccag

SEQ ID NO: 8266871 - DNA, 22 bp, Homo sapiens
tgtttataaattttcttgccat

SEQ ID NO: 8266872 - DNA, 22 bp, Homo sapiens
ctgaggcagagggcagaccaga

SEQ ID NO: 8266873 - DNA, 21 bp, Homo sapiens
ctgaggcatgcaggcctgggc

SEQ ID NO: 8266874 - DNA, 22 bp, Homo sapiens
ctgaggcatgttacaggacata

SEQ ID NO: 8266875 - DNA, 22 bp, Homo sapiens
ctgaggcatgggaagttgggtg

SEQ ID NO: 8266876 - DNA, 22 bp, Homo sapiens
tttgcattttagatttaggcct

SEQ ID NO: 8266877 - DNA, 22 bp, Homo sapiens
tttgccacattctatacatttg

SEQ ID NO: 8266878 - DNA, 22 bp, Homo sapiens
tttatttaccttatgtcctcca

SEQ ID NO: 8266879 - DNA, 22 bp, Homo sapiens
ttgaaaggtgaacatgatgcac

SEQ ID NO: 8266880 - DNA, 22 bp, Homo sapiens
catttacacttctaaccacaag

SEQ ID NO: 8266881 - DNA, 22 bp, Homo sapiens
catttacaatgtacaggttgtg

SEQ ID NO: 8266882 - DNA, 22 bp, Homo sapiens
catttacacacagaggtgtgct

SEQ ID NO: 8266883 - DNA, 22 bp, Homo sapiens
cagttttggtgatatttgagaa

SEQ ID NO: 8266884 - DNA, 22 bp, Homo sapiens
tacatttataaggcttctctgt

SEQ ID NO: 8266885 - DNA, 22 bp, Homo sapiens
tacatttacagagccttctctg

SEQ ID NO: 8266886 - DNA, 22 bp, Homo sapiens
tgaggcagcaattgtattgtat

SEQ ID NO: 8266887 - DNA, 22 bp, Homo sapiens
tgcaaaggggacagagtccact

SEQ ID NO: 8266888 - DNA, 22 bp, Homo sapiens
tgaggtcaagcccagagcagca

SEQ ID NO: 8266889 - DNA, 22 bp, Homo sapiens
tgttctcttctcattgaacatg

SEQ ID NO: 8266890 - DNA, 22 bp, Homo sapiens
tgtttgatgacgacattgtaga

SEQ ID NO: 8266891 - DNA, 22 bp, Homo sapiens
ttacacagaaattttattgcct

SEQ ID NO: 8266892 - DNA, 22 bp, Homo sapiens
ttacacagcttctatccttgaa

SEQ ID NO: 8266893 - DNA, 22 bp, Homo sapiens
ttacacagatggttagtagagg

SEQ ID NO: 8266894 - DNA, 22 bp, Homo sapiens
ttagagaaccaatgaatagtct

SEQ ID NO: 8266895 - DNA, 22 bp, Homo sapiens
ttagagaagatgaaccatcgtt

SEQ ID NO: 8266896 - DNA, 22 bp, Homo sapiens
ttgaggcaaaatcaacgggaag

SEQ ID NO: 8266897 - DNA, 23 bp, Homo sapiens
ttgaggcaaacatgtaagtagga

SEQ ID NO: 8266898 - DNA, 23 bp, Homo sapiens
ttgaggcaaactcttttctgaaa

SEQ ID NO: 8266899 - DNA, 22 bp, Homo sapiens
ttgaggcacacacaggttgcat

SEQ ID NO: 8266900 - DNA, 22 bp, Homo sapiens
ttgaggcacagattttagtggc

SEQ ID NO: 8266901 - DNA, 20 bp, Homo sapiens
ttgaggcatgtctagaagta

SEQ ID NO: 8266902 - DNA, 22 bp, Homo sapiens
ttgaggcattactgtaatgaga

SEQ ID NO: 8266903 - DNA, 22 bp, Homo sapiens
ttgaggcagggcatggtggccc

SEQ ID NO: 8266904 - DNA, 22 bp, Homo sapiens
ttgaggcagcccttaattggga

SEQ ID NO: 8266905 - DNA, 22 bp, Homo sapiens
ttgaggcaggtccgggtccttc

SEQ ID NO: 8266906 - DNA, 22 bp, Homo sapiens
ttgatgttcataaatgatacag

SEQ ID NO: 8266907 - DNA, 22 bp, Homo sapiens
tttactttctcaagtatatagg

SEQ ID NO: 8266908 - DNA, 22 bp, Homo sapiens
ttgcaaggtgataaaagaatga

SEQ ID NO: 8266909 - DNA, 22 bp, Homo sapiens
tttctctgtgggctttatgcat

SEQ ID NO: 8266910 - DNA, 22 bp, Homo sapiens
tttgtagaataatatctttctg

SEQ ID NO: 8266911 - DNA, 22 bp, Homo sapiens
ttttatatggcacattggttgg

SEQ ID NO: 8266912 - DNA, 22 bp, Homo sapiens
ttttatgaagataattttctga

SEQ ID NO: 8266913 - DNA, 22 bp, Homo sapiens
ttttggcaaaggcattctcttt

SEQ ID NO: 8266914 - DNA, 22 bp, Homo sapiens
ttttggcactttgtctgattct

SEQ ID NO: 8266915 - DNA, 22 bp, Homo sapiens
ttttggcactgcgtctacatgg

SEQ ID NO: 8266916 - DNA, 22 bp, Homo sapiens
ttttggcagattacttaatatg

SEQ ID NO: 8266917 - DNA, 22 bp, Homo sapiens
cacaggttaggtattatactat

SEQ ID NO: 8266918 - DNA, 22 bp, Homo sapiens
gctggaaggctaggctcagttg

SEQ ID NO: 8266919 - DNA, 22 bp, Homo sapiens
cagagacaatgtctctgcttgt

SEQ ID NO: 8266920 - DNA, 22 bp, Homo sapiens
cagagacaacaagtttaactat

SEQ ID NO: 8266921 - DNA, 22 bp, Homo sapiens
ctttacacatgagacctgcaat

SEQ ID NO: 8266922 - DNA, 22 bp, Homo sapiens
ctttacacatcctaaccagtgt

SEQ ID NO: 8266923 - DNA, 22 bp, Homo sapiens
ctttacacaatgattttcttta

SEQ ID NO: 8266924 - DNA, 22 bp, Homo sapiens
ctttacacttggacccacactt

SEQ ID NO: 8266925 - DNA, 22 bp, Homo sapiens
ctttacaccaagcagatctttc

SEQ ID NO: 8266926 - DNA, 22 bp, Homo sapiens
caaaagcagcaagtttatatgt

SEQ ID NO: 8266927 - DNA, 21 bp, Homo sapiens
ctacacagctttctataggaa

SEQ ID NO: 8266928 - DNA, 22 bp, Homo sapiens
ctacacagagcctacttctgca

SEQ ID NO: 8266929 - DNA, 22 bp, Homo sapiens
ctgttactggacgcacgcagct

SEQ ID NO: 8266930 - DNA, 22 bp, Homo sapiens
ctgtgcctccctttactttgag

SEQ ID NO: 8266931 - DNA, 22 bp, Homo sapiens
atatattttttgagacagagtc

SEQ ID NO: 8266932 - DNA, 22 bp, Homo sapiens
agtttgtgcaatggtgtcacct

SEQ ID NO: 8266933 - DNA, 20 bp, Homo sapiens
acagtttattttacttggtt

SEQ ID NO: 8266934 - DNA, 17 bp, Homo sapiens
acagtttgattttagca

SEQ ID NO: 8266935 - DNA, 22 bp, Homo sapiens
acagtttgaataatttagatag

SEQ ID NO: 8266936 - DNA, 22 bp, Homo sapiens
acaggtttagctcttagtagtc

SEQ ID NO: 8266937 - DNA, 22 bp, Homo sapiens
aggaagaacctaagaaagtctc

SEQ ID NO: 8266938 - DNA, 22 bp, Homo sapiens
acatgtttggctctatgctata

SEQ ID NO: 8266939 - DNA, 22 bp, Homo sapiens
acatgttagctactattgttat

SEQ ID NO: 8266940 - DNA, 22 bp, Homo sapiens
acatttgagcatatttcttgtc

SEQ ID NO: 8266941 - DNA, 22 bp, Homo sapiens
acatttgatatggagttgtgta

SEQ ID NO: 8266942 - DNA, 22 bp, Homo sapiens
acatttgagtcatatttgctta

SEQ ID NO: 8266943 - DNA, 22 bp, Homo sapiens
cacagtttggttttgctgtaat

SEQ ID NO: 8266944 - DNA, 22 bp, Homo sapiens
cacagtttctataggtcagaat

SEQ ID NO: 8266945 - DNA, 22 bp, Homo sapiens
cacagtttcaataattattctt

SEQ ID NO: 8266946 - DNA, 22 bp, Homo sapiens
cacagtttctgaacactttgca

SEQ ID NO: 8266947 - DNA, 22 bp, Homo sapiens
agcaaagaaatggaggctcaga

SEQ ID NO: 8266948 - DNA, 22 bp, Homo sapiens
agagacagggttttgtcgtgtt

SEQ ID NO: 8266949 - DNA, 22 bp, Homo sapiens
atctttgttatctcagatcttg

SEQ ID NO: 8266950 - DNA, 22 bp, Homo sapiens
atctttgttgctctcatttctg

SEQ ID NO: 8266951 - DNA, 22 bp, Homo sapiens
atttgtgaattaagcatgtcaa

SEQ ID NO: 8266952 - DNA, 22 bp, Homo sapiens
acaattttccccataggttatc

SEQ ID NO: 8266953 - DNA, 22 bp, Homo sapiens
aatttacagttgctgatggtac

SEQ ID NO: 8266954 - DNA, 22 bp, Homo sapiens
aatttacaggtgcactcgccat

SEQ ID NO: 8266955 - DNA, 22 bp, Homo sapiens
aatttacacttcatttggaggg

SEQ ID NO: 8266956 - DNA, 22 bp, Homo sapiens
aattttattagaaggcaagggg

SEQ ID NO: 8266957 - DNA, 22 bp, Homo sapiens
aattttattaactggatgtagc

SEQ ID NO: 8266958 - DNA, 22 bp, Homo sapiens
acaattactcaactttgctgct

SEQ ID NO: 8266959 - DNA, 18 bp, Homo sapiens
agaaataccagtattgga

SEQ ID NO: 8266960 - DNA, 20 bp, Homo sapiens
agaaataccacatttggcaa

SEQ ID NO: 8266961 - DNA, 20 bp, Homo sapiens
aagtcacttaagatgggcag

SEQ ID NO: 8266962 - DNA, 19 bp, Homo sapiens
aagtcacttgagggcagga

SEQ ID NO: 8266963 - DNA, 20 bp, Homo sapiens
gtcaaactactggcagtgcc

SEQ ID NO: 8266964 - DNA, 22 bp, Homo sapiens
gtgaggcagaagttccctttta

SEQ ID NO: 8266965 - DNA, 22 bp, Homo sapiens
gtgaggcagagatgccaaaact

SEQ ID NO: 8266966 - DNA, 22 bp, Homo sapiens
gtgaggcaagggcatactaggc

SEQ ID NO: 8266967 - DNA, 22 bp, Homo sapiens
gtgaggcagcaggagcctctgt

SEQ ID NO: 8266968 - DNA, 22 bp, Homo sapiens
gtgaggcaggcattctcctttc

SEQ ID NO: 8266969 - DNA, 20 bp, Homo sapiens
gcaaggcacagtgaggaggg

SEQ ID NO: 8266970 - DNA, 22 bp, Homo sapiens
gcaaggcagcgcggagtagcta

SEQ ID NO: 8266971 - DNA, 22 bp, Homo sapiens
gcagtttgaaagtatgagtcca

SEQ ID NO: 8266972 - DNA, 22 bp, Homo sapiens
gcagtttgctggactaatgaag

SEQ ID NO: 8266973 - DNA, 22 bp, Homo sapiens
gcagtttgtttgtggacacctt

SEQ ID NO: 8266974 - DNA, 22 bp, Homo sapiens
tcatttacatgtctttctctga

SEQ ID NO: 8266975 - DNA, 22 bp, Homo sapiens
tcatttacgcgcctccttcctt

SEQ ID NO: 8266976 - DNA, 22 bp, Homo sapiens
gtttgtcaatgacttaggcgtt

SEQ ID NO: 8266977 - DNA, 22 bp, Homo sapiens
gtttgtcatttgtacttctagc

SEQ ID NO: 8266978 - DNA, 22 bp, Homo sapiens
tacacaatctgtttttccattt

SEQ ID NO: 8266979 - DNA, 22 bp, Homo sapiens
tacacagttttgctcccatgat

SEQ ID NO: 8266980 - DNA, 22 bp, Homo sapiens
tacacagtatatgggatcacag

SEQ ID NO: 8266981 - DNA, 22 bp, Homo sapiens
tacacagaacctggtgtacagt

SEQ ID NO: 8266982 - DNA, 22 bp, Homo sapiens
taccacagacagatttcagtaa

SEQ ID NO: 8266983 - DNA, 22 bp, Homo sapiens
tagagaactcagtgtgcagcct

SEQ ID NO: 8266984 - DNA, 22 bp, Homo sapiens
tagagaacaagtatggcacgga

SEQ ID NO: 8266985 - DNA, 22 bp, Homo sapiens
tcaaataccagcaatttcatgt

SEQ ID NO: 8266986 - DNA, 18 bp, Homo sapiens
tcaaatactttgggcagt

SEQ ID NO: 8266987 - DNA, 21 bp, Homo sapiens
gagaactgaaccagagcagct

SEQ ID NO: 8266988 - DNA, 22 bp, Homo sapiens
gaggcaagaaaggactttctag

SEQ ID NO: 8266989 - DNA, 22 bp, Homo sapiens
ctggtaacaatatccacaaaga

SEQ ID NO: 8266990 - DNA, 22 bp, Homo sapiens
ctcagagaggcagtggaagtca

SEQ ID NO: 8266991 - DNA, 22 bp, Homo sapiens
ttctttctgtccataatgagac

SEQ ID NO: 8266992 - DNA, 21 bp, Homo sapiens
ttctttctgaatctgaagtat

SEQ ID NO: 8266993 - DNA, 22 bp, Homo sapiens
ttctggaagggtggagtagctt

SEQ ID NO: 8266994 - DNA, 22 bp, Homo sapiens
ctagagaaaggcagtggagcaa

SEQ ID NO: 8266995 - DNA, 22 bp, Homo sapiens
ctagataaggtggcttggaatt

SEQ ID NO: 8266996 - DNA, 22 bp, Homo sapiens
ctagagagccgctgtggaaaat

SEQ ID NO: 8266997 - DNA, 22 bp, Homo sapiens
ctagagaggtggtgttgggtgg

SEQ ID NO: 8266998 - DNA, 17 bp, Homo sapiens
ctagagagaaagagcta

SEQ ID NO: 8266999 - DNA, 23 bp, Homo sapiens
tttatattcctaatgtcttgagc

SEQ ID NO: 8267000 - DNA, 22 bp, Homo sapiens
ctggaagagtgactttgcattt

SEQ ID NO: 8267001 - DNA, 23 bp, Homo sapiens
tggctactttatgaggttgagga

SEQ ID NO: 8267002 - DNA, 22 bp, Homo sapiens
tgaggcaggtaagcaagttttg

SEQ ID NO: 8267003 - DNA, 22 bp, Homo sapiens
tgaggacattggtcaggacatg

SEQ ID NO: 8267004 - DNA, 22 bp, Homo sapiens
tccacagtctatttttagtcta

SEQ ID NO: 8267005 - DNA, 22 bp, Homo sapiens
cagtttatagttgttatgtgtg

SEQ ID NO: 8267006 - DNA, 22 bp, Homo sapiens
tatatttaaatccaggttgaaa

SEQ ID NO: 8267007 - DNA, 22 bp, Homo sapiens
tttatattgggagtcgttttga

SEQ ID NO: 8267008 - DNA, 22 bp, Homo sapiens
tttatatttcccaggattggcc

SEQ ID NO: 8267009 - DNA, 22 bp, Homo sapiens
tttatattgtaaaaatggttct

SEQ ID NO: 8267010 - DNA, 22 bp, Homo sapiens
ttggaacacaatgtttctttca

SEQ ID NO: 8267011 - DNA, 21 bp, Homo sapiens
ttggaacaagcagcagtttgc

SEQ ID NO: 8267012 - DNA, 22 bp, Homo sapiens
ttcagagacatgttctagatca

SEQ ID NO: 8267013 - DNA, 22 bp, Homo sapiens
ttattatggcagttttctaggt

SEQ ID NO: 8267014 - DNA, 22 bp, Homo sapiens
ttctctgaaggttgtggaacta

SEQ ID NO: 8267015 - DNA, 22 bp, Homo sapiens
tttgaggttagctagcagatca

SEQ ID NO: 8267016 - DNA, 22 bp, Homo sapiens
gtgcaaagcttaacattctgca

SEQ ID NO: 8267017 - DNA, 22 bp, Homo sapiens
cagagtttcggtaagcatagaa

SEQ ID NO: 8267018 - DNA, 22 bp, Homo sapiens
gagcagggagacaactctggtg

SEQ ID NO: 8267019 - DNA, 22 bp, Homo sapiens
atgaggcatatcctcctatggt

SEQ ID NO: 8267020 - DNA, 22 bp, Homo sapiens
atgaggcatctaacattgcaaa

SEQ ID NO: 8267021 - DNA, 22 bp, Homo sapiens
atgaggcatgggatcaaaatga

SEQ ID NO: 8267022 - DNA, 22 bp, Homo sapiens
atgaggcatgtgaggagaaggg

SEQ ID NO: 8267023 - DNA, 22 bp, Homo sapiens
atgaggcatctgcagtcactag

SEQ ID NO: 8267024 - DNA, 21 bp, Homo sapiens
atgaggcatgagagggtttct

SEQ ID NO: 8267025 - DNA, 16 bp, Homo sapiens
atgaggcataggctgc

SEQ ID NO: 8267026 - DNA, 22 bp, Homo sapiens
atgaggcatagcagggatcgga

SEQ ID NO: 8267027 - DNA, 22 bp, Homo sapiens
atgaggcagtctggcctgaggg

SEQ ID NO: 8267028 - DNA, 15 bp, Homo sapiens
atgaggcatttgggg

SEQ ID NO: 8267029 - DNA, 22 bp, Homo sapiens
atgaggcattccactcaaactc

SEQ ID NO: 8267030 - DNA, 22 bp, Homo sapiens
atgaggcattcacagaaggcac

SEQ ID NO: 8267031 - DNA, 23 bp, Homo sapiens
atgaggcattaaacaggcttttt

SEQ ID NO: 8267032 - DNA, 22 bp, Homo sapiens
cttgagaagcattaagaggtag

SEQ ID NO: 8267033 - DNA, 22 bp, Homo sapiens
cttgagaatgtgagccacagat

SEQ ID NO: 8267034 - DNA, 22 bp, Homo sapiens
atttacataatagactttaggt

SEQ ID NO: 8267035 - DNA, 23 bp, Homo sapiens
attttacaggtcagttccttgaa

SEQ ID NO: 8267036 - DNA, 19 bp, Homo sapiens
aggctaaagagtcttgcgt

SEQ ID NO: 8267037 - DNA, 22 bp, Homo sapiens
aggacaaaggaccagatctgga

SEQ ID NO: 8267038 - DNA, 21 bp, Homo sapiens
aggcaggattcaaacacagag

SEQ ID NO: 8267039 - DNA, 22 bp, Homo sapiens
atacacaggcatgcttctgatt

SEQ ID NO: 8267040 - DNA, 22 bp, Homo sapiens
ctatatttggtgagggatgtct

SEQ ID NO: 8267041 - DNA, 22 bp, Homo sapiens
agtggcacaattttgactcccc

SEQ ID NO: 8267042 - DNA, 22 bp, Homo sapiens
accagttttttatacatcttct

SEQ ID NO: 8267043 - DNA, 22 bp, Homo sapiens
acatacacatgaatatattttt

SEQ ID NO: 8267044 - DNA, 22 bp, Homo sapiens
attggtagttttgtatttctct

SEQ ID NO: 8267045 - DNA, 22 bp, Homo sapiens
attttatgacacgattcttcca

SEQ ID NO: 8267046 - DNA, 22 bp, Homo sapiens
attacacaggctggctctttga

SEQ ID NO: 8267047 - DNA, 22 bp, Homo sapiens
attacacatagacattcgttca

SEQ ID NO: 8267048 - DNA, 22 bp, Homo sapiens
attacacagcggttactactag

SEQ ID NO: 8267049 - DNA, 22 bp, Homo sapiens
attacacaggatttgccttact

SEQ ID NO: 8267050 - DNA, 22 bp, Homo sapiens
agaggcaatgaaagcagtctct

SEQ ID NO: 8267051 - DNA, 22 bp, Homo sapiens
agagacacatcatataagtata

SEQ ID NO: 8267052 - DNA, 22 bp, Homo sapiens
atgaggcacgtgttactggcct

SEQ ID NO: 8267053 - DNA, 22 bp, Homo sapiens
atgaggcacttaaaagtgaaga

SEQ ID NO: 8267054 - DNA, 22 bp, Homo sapiens
atgaggcagaaaaaagtcggag

SEQ ID NO: 8267055 - DNA, 22 bp, Homo sapiens
caaaggcatcggcaattaggga

SEQ ID NO: 8267056 - DNA, 22 bp, Homo sapiens
agcaggttgttttgtggccagg

SEQ ID NO: 8267057 - DNA, 22 bp, Homo sapiens
cagagacatccattttatatgc

SEQ ID NO: 8267058 - DNA, 22 bp, Homo sapiens
aagtggcagaatagtggcagga

SEQ ID NO: 8267059 - DNA, 22 bp, Homo sapiens
aagtggcagccttagaaggaga

SEQ ID NO: 8267060 - DNA, 22 bp, Homo sapiens
aagtggcagttcaggaagcaga

SEQ ID NO: 8267061 - DNA, 22 bp, Homo sapiens
aagtggcatgtataagaaagaa

SEQ ID NO: 8267062 - DNA, 22 bp, Homo sapiens
aagtttgtggtcatttattata

SEQ ID NO: 8267063 - DNA, 22 bp, Homo sapiens
aagtttgttgtacatgttagta

SEQ ID NO: 8267064 - DNA, 22 bp, Homo sapiens
acattttgcccttatttgctga

SEQ ID NO: 8267065 - DNA, 22 bp, Homo sapiens
acagtttacagggatttgagct

SEQ ID NO: 8267066 - DNA, 22 bp, Homo sapiens
agcatttaattacagtttaatt

SEQ ID NO: 8267067 - DNA, 22 bp, Homo sapiens
tcagtttgaatgttagcacagt

SEQ ID NO: 8267068 - DNA, 22 bp, Homo sapiens
tacaccagattatttataacat

SEQ ID NO: 8267069 - DNA, 22 bp, Homo sapiens
tacaatttagtggtgtgtggtt

SEQ ID NO: 8267070 - DNA, 22 bp, Homo sapiens
tacacatatgtgtgtatatgtg

SEQ ID NO: 8267071 - DNA, 22 bp, Homo sapiens
taacacagttctctgttgcaca

SEQ ID NO: 8267072 - DNA, 22 bp, Homo sapiens
gttttataggctgttgctatat

SEQ ID NO: 8267073 - DNA, 22 bp, Homo sapiens
tagtggcaaaagcattttgggt

SEQ ID NO: 8267074 - DNA, 22 bp, Homo sapiens
tagcatttggacattgtcacct

SEQ ID NO: 8267075 - DNA, 22 bp, Homo sapiens
ggtagaaataatcttcaggctg

SEQ ID NO: 8267076 - DNA, 22 bp, Homo sapiens
ggtagaaagatggaacgttgaa

SEQ ID NO: 8267077 - DNA, 22 bp, Homo sapiens
gggtcagagccgtaacaggact

SEQ ID NO: 8267078 - DNA, 22 bp, Homo sapiens
gggtcagagtaagcaaggacaa

SEQ ID NO: 8267079 - DNA, 22 bp, Homo sapiens
gtgaggcagggaaagaggataa

SEQ ID NO: 8267080 - DNA, 22 bp, Homo sapiens
gtgaggcattgaagaccggaat

SEQ ID NO: 8267081 - DNA, 22 bp, Homo sapiens
tgttgctcttttttaggtgagt

SEQ ID NO: 8267082 - DNA, 22 bp, Homo sapiens
tttgaagggcacgacaatagtt

SEQ ID NO: 8267083 - DNA, 22 bp, Homo sapiens
gacatttaatagtattgtggga

SEQ ID NO: 8267084 - DNA, 22 bp, Homo sapiens
gacatttaaggcagtcacttaa

SEQ ID NO: 8267085 - DNA, 22 bp, Homo sapiens
gacatttagctgttttgcattt

SEQ ID NO: 8267086 - DNA, 19 bp, Homo sapiens
gacacagttggttcctttg

SEQ ID NO: 8267087 - DNA, 22 bp, Homo sapiens
gacacagttacttattttgcct

SEQ ID NO: 8267088 - DNA, 22 bp, Homo sapiens
gacacagtaatgtgtttcatct

SEQ ID NO: 8267089 - DNA, 22 bp, Homo sapiens
cttacacactagatggtaggtg

SEQ ID NO: 8267090 - DNA, 22 bp, Homo sapiens
tgcaggcattggtgagagaagc

SEQ ID NO: 8267091 - DNA, 22 bp, Homo sapiens
cattttatgtttatggagtgct

SEQ ID NO: 8267092 - DNA, 22 bp, Homo sapiens
cattttgtagcaatgactgttg

SEQ ID NO: 8267093 - DNA, 22 bp, Homo sapiens
tagaacagcatttggctattaa

SEQ ID NO: 8267094 - DNA, 22 bp, Homo sapiens
ttgtggcagaccatgagtctaa

SEQ ID NO: 8267095 - DNA, 22 bp, Homo sapiens
ttggaacatccaggacagatat

SEQ ID NO: 8267096 - DNA, 22 bp, Homo sapiens
ttggaacagtgtgaaaaggtta

SEQ ID NO: 8267097 - DNA, 20 bp, Homo sapiens
ttggaacagtggatcagcag

SEQ ID NO: 8267098 - DNA, 22 bp, Homo sapiens
ttggaacagaaacagacaaata

SEQ ID NO: 8267099 - DNA, 22 bp, Homo sapiens
ttggaacagagccctaaggaca

SEQ ID NO: 8267100 - DNA, 22 bp, Homo sapiens
ttggaacagaactgcgttcatt

SEQ ID NO: 8267101 - DNA, 22 bp, Homo sapiens
ttggaacaggattcaattaaag

SEQ ID NO: 8267102 - DNA, 23 bp, Homo sapiens
ttggaacacagtaaatgcacaat

SEQ ID NO: 8267103 - DNA, 19 bp, Homo sapiens
ttgcatttcatgtttgatt

SEQ ID NO: 8267104 - DNA, 22 bp, Homo sapiens
ttgcatttgctcatttgatatg

SEQ ID NO: 8267105 - DNA, 22 bp, Homo sapiens
ttgcatttcctgtactgtttga

SEQ ID NO: 8267106 - DNA, 21 bp, Homo sapiens
ttgcattttaagtttactgct

SEQ ID NO: 8267107 - DNA, 22 bp, Homo sapiens
ttgcatttttagatgcttctgt

SEQ ID NO: 8267108 - DNA, 22 bp, Homo sapiens
tttacacattattttcagtgtg

SEQ ID NO: 8267109 - DNA, 22 bp, Homo sapiens
ttatttgttttctgagaagtat

SEQ ID NO: 8267110 - DNA, 22 bp, Homo sapiens
ttctttctttgtagtcctgaac

SEQ ID NO: 8267111 - DNA, 22 bp, Homo sapiens
tttgtgcacattgcttttctat

SEQ ID NO: 8267112 - DNA, 22 bp, Homo sapiens
tttgtgcaatttatgtactata

SEQ ID NO: 8267113 - DNA, 19 bp, Homo sapiens
tttgtgcagcaacattaat

SEQ ID NO: 8267114 - DNA, 22 bp, Homo sapiens
ttttacacttcggttgtgtgca

SEQ ID NO: 8267115 - DNA, 22 bp, Homo sapiens
ttttacacctgttaactctaag

SEQ ID NO: 8267116 - DNA, 22 bp, Homo sapiens
ttttacacctcagatgagcaga

SEQ ID NO: 8267117 - DNA, 22 bp, Homo sapiens
ttttgtatcctccctttcactg

SEQ ID NO: 8267118 - DNA, 22 bp, Homo sapiens
tttgtccagatgcacagataat

SEQ ID NO: 8267119 - DNA, 20 bp, Homo sapiens
tttgtccagcgtctactctg

SEQ ID NO: 8267120 - DNA, 21 bp, Homo sapiens
tttgtccacctgtgttcacca

SEQ ID NO: 8267121 - DNA, 22 bp, Homo sapiens
tttgcattacttgactttagtt

SEQ ID NO: 8267122 - DNA, 22 bp, Homo sapiens
atttagaactttgtttgccaat

SEQ ID NO: 8267123 - DNA, 22 bp, Homo sapiens
atttacaccttcttcgattctc

SEQ ID NO: 8267124 - DNA, 22 bp, Homo sapiens
atttacactaaaggaaggagga

SEQ ID NO: 8267125 - DNA, 22 bp, Homo sapiens
atttacactggttctcagagct

SEQ ID NO: 8267126 - DNA, 22 bp, Homo sapiens
atttacacattcataagatttc

SEQ ID NO: 8267127 - DNA, 22 bp, Homo sapiens
atttacacttggtttactagag

SEQ ID NO: 8267128 - DNA, 22 bp, Homo sapiens
atgaggcagctgctggagaacg

SEQ ID NO: 8267129 - DNA, 22 bp, Homo sapiens
atgaggcagctggctttctccc

SEQ ID NO: 8267130 - DNA, 22 bp, Homo sapiens
atgaggcaggaaaggcgtatct

SEQ ID NO: 8267131 - DNA, 22 bp, Homo sapiens
atgaggcaggagcggggaccct

SEQ ID NO: 8267132 - DNA, 22 bp, Homo sapiens
atgaggcaggagtgcagtggca

SEQ ID NO: 8267133 - DNA, 22 bp, Homo sapiens
atgaggcaggtggaggctgcca

SEQ ID NO: 8267134 - DNA, 22 bp, Homo sapiens
atgaggcaggatattaactttt

SEQ ID NO: 8267135 - DNA, 22 bp, Homo sapiens
atgaggcaggattaagctatca

SEQ ID NO: 8267136 - DNA, 22 bp, Homo sapiens
atgaggcagtacacacaaagcc

SEQ ID NO: 8267137 - DNA, 22 bp, Homo sapiens
atgaggcagcccttcccttctc

SEQ ID NO: 8267138 - DNA, 22 bp, Homo sapiens
atgaggcagctgacagctgttc

SEQ ID NO: 8267139 - DNA, 22 bp, Homo sapiens
atgaggcagcacatgggattgt

SEQ ID NO: 8267140 - DNA, 22 bp, Homo sapiens
atgaggcagatgttgcatgagg

SEQ ID NO: 8267141 - DNA, 22 bp, Homo sapiens
atgaggcagagggctgtgccag

SEQ ID NO: 8267142 - DNA, 22 bp, Homo sapiens
atgcatttatgtgtgtacattg

SEQ ID NO: 8267143 - DNA, 22 bp, Homo sapiens
gagaacagatttttctgctgtc

SEQ ID NO: 8267144 - DNA, 22 bp, Homo sapiens
caaggagagtaattgaatgaga

SEQ ID NO: 8267145 - DNA, 20 bp, Homo sapiens
agtttgagaggaagtcagtg

SEQ ID NO: 8267146 - DNA, 22 bp, Homo sapiens
agtttgtaaaatgtggcctgga

SEQ ID NO: 8267147 - DNA, 22 bp, Homo sapiens
agtttgtaaacttgagctagcc

SEQ ID NO: 8267148 - DNA, 19 bp, Homo sapiens
agtttgaggaagttaagaa

SEQ ID NO: 8267149 - DNA, 22 bp, Homo sapiens
ctgaggcatgaatgtgggcttt

SEQ ID NO: 8267150 - DNA, 22 bp, Homo sapiens
ctgaggcatcatggagaacagt

SEQ ID NO: 8267151 - DNA, 22 bp, Homo sapiens
ctgaggcagtttaatttttgaa

SEQ ID NO: 8267152 - DNA, 21 bp, Homo sapiens
ctgaggcagcacagctagtca

SEQ ID NO: 8267153 - DNA, 22 bp, Homo sapiens
ctgaggcaggagagttgcttga

SEQ ID NO: 8267154 - DNA, 22 bp, Homo sapiens
ctgaggcaggagaattgctgga

SEQ ID NO: 8267155 - DNA, 22 bp, Homo sapiens
ctgaggcaggcagatcacttga

SEQ ID NO: 8267156 - DNA, 22 bp, Homo sapiens
ctgaggcaggatggcctggctg

SEQ ID NO: 8267157 - DNA, 22 bp, Homo sapiens
ctgaggcaggggcagctggaga

SEQ ID NO: 8267158 - DNA, 22 bp, Homo sapiens
agtgacacggagagacagcatg

SEQ ID NO: 8267159 - DNA, 22 bp, Homo sapiens
agtgacaaaacggaacatacag

SEQ ID NO: 8267160 - DNA, 19 bp, Homo sapiens
ctcttgggtggcagaggcc

SEQ ID NO: 8267161 - DNA, 22 bp, Homo sapiens
ccagtttgaggaagaagtagat

SEQ ID NO: 8267162 - DNA, 22 bp, Homo sapiens
catttacagtgagagtttttac

SEQ ID NO: 8267163 - DNA, 21 bp, Homo sapiens
catttacatgacagattggtt

SEQ ID NO: 8267164 - DNA, 22 bp, Homo sapiens
catttacataacagtaacgctg

SEQ ID NO: 8267165 - DNA, 22 bp, Homo sapiens
catttacatttaaggttaatat

SEQ ID NO: 8267166 - DNA, 22 bp, Homo sapiens
agacacagtttgggatgggttg

SEQ ID NO: 8267167 - DNA, 21 bp, Homo sapiens
agacacaggggttgctggggt

SEQ ID NO: 8267168 - DNA, 22 bp, Homo sapiens
agacacaggattctgcatttct

SEQ ID NO: 8267169 - DNA, 22 bp, Homo sapiens
agacacagtacttgccctcatg

SEQ ID NO: 8267170 - DNA, 22 bp, Homo sapiens
agacacagtataagcacaacaa

SEQ ID NO: 8267171 - DNA, 22 bp, Homo sapiens
agacacagaagttgctgttggg

SEQ ID NO: 8267172 - DNA, 22 bp, Homo sapiens
agacacagaagttgctgttggg

SEQ ID NO: 8267173 - DNA, 22 bp, Homo sapiens
agacacagatggtacctgagcc

SEQ ID NO: 8267174 - DNA, 22 bp, Homo sapiens
agacacagcagtgcctgcctca

SEQ ID NO: 8267175 - DNA, 22 bp, Homo sapiens
agacacagcaataactactgtt

SEQ ID NO: 8267176 - DNA, 22 bp, Homo sapiens
atctttgtgaatctcaacttgg

SEQ ID NO: 8267177 - DNA, 22 bp, Homo sapiens
atctttgtcactctactgtcta

SEQ ID NO: 8267178 - DNA, 22 bp, Homo sapiens
agaatacatcaatctattttct

SEQ ID NO: 8267179 - DNA, 22 bp, Homo sapiens
agaaacagaaccaggtgtcatt

SEQ ID NO: 8267180 - DNA, 22 bp, Homo sapiens
aggcgaagggaccagacggtag

SEQ ID NO: 8267181 - DNA, 22 bp, Homo sapiens
acatttaggatgttttgagaga

SEQ ID NO: 8267182 - DNA, 22 bp, Homo sapiens
acatttacattttctctggcct

SEQ ID NO: 8267183 - DNA, 17 bp, Homo sapiens
acagtttgtcattctaa

SEQ ID NO: 8267184 - DNA, 22 bp, Homo sapiens
acagtttggcgtgattgatagt

SEQ ID NO: 8267185 - DNA, 22 bp, Homo sapiens
acagtttggcagtttcttacta

SEQ ID NO: 8267186 - DNA, 22 bp, Homo sapiens
acagtttgccctgacattctcc

SEQ ID NO: 8267187 - DNA, 22 bp, Homo sapiens
acagtttgttccttttcattgc

SEQ ID NO: 8267188 - DNA, 22 bp, Homo sapiens
acagtttgtgttggccatgggc

SEQ ID NO: 8267189 - DNA, 22 bp, Homo sapiens
acagggcaacctctgggagact

SEQ ID NO: 8267190 - DNA, 22 bp, Homo sapiens
aagcagaatttaatagaaaggt

SEQ ID NO: 8267191 - DNA, 22 bp, Homo sapiens
aagagacatgaatactcgaagg

SEQ ID NO: 8267192 - DNA, 21 bp, Homo sapiens
aagaaagataattaaggaccc

SEQ ID NO: 8267193 - DNA, 22 bp, Homo sapiens
aacacagtttctgcattggtag

SEQ ID NO: 8267194 - DNA, 22 bp, Homo sapiens
aacacagtttctctatgagagt

SEQ ID NO: 8267195 - DNA, 22 bp, Homo sapiens
aacacagttttccaaaatagag

SEQ ID NO: 8267196 - DNA, 22 bp, Homo sapiens
aacacagtcctgctcacttatt

SEQ ID NO: 8267197 - DNA, 22 bp, Homo sapiens
aacacagtcagttcctggatca

SEQ ID NO: 8267198 - DNA, 22 bp, Homo sapiens
aacacaggccagcctgtgcagt

SEQ ID NO: 8267199 - DNA, 22 bp, Homo sapiens
aaagcactgcacatatatttgc

SEQ ID NO: 8267200 - DNA, 22 bp, Homo sapiens
aaatactagaattcagagttga

SEQ ID NO: 8267201 - DNA, 22 bp, Homo sapiens
aaagagcaagggctttgaggct

SEQ ID NO: 8267202 - DNA, 22 bp, Homo sapiens
acacagatgctatttagtctct

SEQ ID NO: 8267203 - DNA, 22 bp, Homo sapiens
acacatgtaaaacacttagcaa

SEQ ID NO: 8267204 - DNA, 22 bp, Homo sapiens
acgtagcactgagagatgcagg

SEQ ID NO: 8267205 - DNA, 22 bp, Homo sapiens
actctcactgcttggctcctgc

SEQ ID NO: 8267206 - DNA, 22 bp, Homo sapiens
actctcactagctctgtgacct

SEQ ID NO: 8267207 - DNA, 22 bp, Homo sapiens
agaaatgaagagagtcaaggtt

SEQ ID NO: 8267208 - DNA, 22 bp, Homo sapiens
actgttcttcatttagcaaaga

SEQ ID NO: 8267209 - DNA, 19 bp, Homo sapiens
actgttctgtatgttgatt

SEQ ID NO: 8267210 - DNA, 22 bp, Homo sapiens
actgttctgcatgctgtgaggg

SEQ ID NO: 8267211 - DNA, 22 bp, Homo sapiens
acattttgagaaatgacaagct

SEQ ID NO: 8267212 - DNA, 22 bp, Homo sapiens
acagtgtttggcaatgcatgca

SEQ ID NO: 8267213 - DNA, 22 bp, Homo sapiens
gttctctagggctgtagactgg

SEQ ID NO: 8267214 - DNA, 22 bp, Homo sapiens
ggaagaaaatgggcaacaggtg

SEQ ID NO: 8267215 - DNA, 22 bp, Homo sapiens
ggaagaaaggtggacaacaggt

SEQ ID NO: 8267216 - DNA, 17 bp, Homo sapiens
ggaagaaaaggatcatc

SEQ ID NO: 8267217 - DNA, 22 bp, Homo sapiens
ggaaagaaccctggatggctgg

SEQ ID NO: 8267218 - DNA, 22 bp, Homo sapiens
ggaaagaaagtgtgaacaactt

SEQ ID NO: 8267219 - DNA, 21 bp, Homo sapiens
ggaaagaaggcaaggctcagg

SEQ ID NO: 8267220 - DNA, 22 bp, Homo sapiens
gcttagctgcatgcatgttctt

SEQ ID NO: 8267221 - DNA, 22 bp, Homo sapiens
gaggcagagtcacaaagagtct

SEQ ID NO: 8267222 - DNA, 22 bp, Homo sapiens
gacacaggggggcgctagaaga

SEQ ID NO: 8267223 - DNA, 22 bp, Homo sapiens
gacacagggggatgtgtggacg

SEQ ID NO: 8267224 - DNA, 22 bp, Homo sapiens
gacacagggacgtgctctgcct

SEQ ID NO: 8267225 - DNA, 22 bp, Homo sapiens
gacacaggtagaataaagtact

SEQ ID NO: 8267226 - DNA, 23 bp, Homo sapiens
gacacaggagcacccagctgagc

SEQ ID NO: 8267227 - DNA, 22 bp, Homo sapiens
gacacaggattcctggctctgc

SEQ ID NO: 8267228 - DNA, 20 bp, Homo sapiens
gacacaggcagtcctcagag

SEQ ID NO: 8267229 - DNA, 22 bp, Homo sapiens
gacacaggaatcaccttggatg

SEQ ID NO: 8267230 - DNA, 22 bp, Homo sapiens
gacacaggaaaagctccagccc

SEQ ID NO: 8267231 - DNA, 18 bp, Homo sapiens
gacacaggagagagtccc

SEQ ID NO: 8267232 - DNA, 22 bp, Homo sapiens
gaaagggtctttgatttccctc

SEQ ID NO: 8267233 - DNA, 22 bp, Homo sapiens
cttggattcctcatatgcacag

SEQ ID NO: 8267234 - DNA, 22 bp, Homo sapiens
gatttacaaagctctctagtgt

SEQ ID NO: 8267235 - DNA, 22 bp, Homo sapiens
gatttacagatctaagggtcac

SEQ ID NO: 8267236 - DNA, 22 bp, Homo sapiens
gatttacaggttaggtcctgta

SEQ ID NO: 8267237 - DNA, 22 bp, Homo sapiens
gatttacagctatacccaatgg

SEQ ID NO: 8267238 - DNA, 22 bp, Homo sapiens
ttgtatttctccactttctgtt

SEQ ID NO: 8267239 - DNA, 22 bp, Homo sapiens
ttcttgtctttgttatgtagga

SEQ ID NO: 8267240 - DNA, 19 bp, Homo sapiens
ctgaggcaagtggtggtca

SEQ ID NO: 8267241 - DNA, 22 bp, Homo sapiens
ctgaggcacagtgaacttctcc

SEQ ID NO: 8267242 - DNA, 22 bp, Homo sapiens
ctgaggcaccggcaatgttctg

SEQ ID NO: 8267243 - DNA, 22 bp, Homo sapiens
ctgaggcacctacagtctcggg

SEQ ID NO: 8267244 - DNA, 22 bp, Homo sapiens
ctgaggcacccatcttctcctg

SEQ ID NO: 8267245 - DNA, 22 bp, Homo sapiens
ctgaggcactaacaaggacaag

SEQ ID NO: 8267246 - DNA, 22 bp, Homo sapiens
ctgaggcactgtcagctgaggc

SEQ ID NO: 8267247 - DNA, 22 bp, Homo sapiens
ctgaggcactggtaatgggcat

SEQ ID NO: 8267248 - DNA, 22 bp, Homo sapiens
ctgaggcagaaaaagcaagggt

SEQ ID NO: 8267249 - DNA, 22 bp, Homo sapiens
ctgaggcagagagaacccgggc

SEQ ID NO: 8267250 - DNA, 22 bp, Homo sapiens
ctgaggcagagaatgagtttgt

SEQ ID NO: 8267251 - DNA, 22 bp, Homo sapiens
tttgtgaataggttggcttcca

SEQ ID NO: 8267252 - DNA, 22 bp, Homo sapiens
tgtaggcatattcatagagttg

SEQ ID NO: 8267253 - DNA, 22 bp, Homo sapiens
gtttacacataactcctatcaa

SEQ ID NO: 8267254 - DNA, 22 bp, Homo sapiens
gtttacactccaggctggggtg

SEQ ID NO: 8267255 - DNA, 18 bp, Homo sapiens
gtttacacattctagaaa

SEQ ID NO: 8267256 - DNA, 22 bp, Homo sapiens
catttacagcagactgatgaaa

SEQ ID NO: 8267257 - DNA, 22 bp, Homo sapiens
tctcttggggaaagagaagaat

SEQ ID NO: 8267258 - DNA, 22 bp, Homo sapiens
tctcttgggaggaaagagagaa

SEQ ID NO: 8267259 - DNA, 22 bp, Homo sapiens
tacatgttatttcactattggt

SEQ ID NO: 8267260 - DNA, 20 bp, Homo sapiens
tatttacaacttagagcctc

SEQ ID NO: 8267261 - DNA, 22 bp, Homo sapiens
tgtttatagggtctgtcacttg

SEQ ID NO: 8267262 - DNA, 22 bp, Homo sapiens
tgtctctagggcaatgtgaact

SEQ ID NO: 8267263 - DNA, 22 bp, Homo sapiens
tgtgcacaggaagctattctct

SEQ ID NO: 8267264 - DNA, 22 bp, Homo sapiens
ttatttgaatgatggcacaatt

SEQ ID NO: 8267265 - DNA, 22 bp, Homo sapiens
ttacatttcccccttggaggct

SEQ ID NO: 8267266 - DNA, 22 bp, Homo sapiens
ttattctggaggaagcaaatgg

SEQ ID NO: 8267267 - DNA, 22 bp, Homo sapiens
ttacattttgcacagatgtccc

SEQ ID NO: 8267268 - DNA, 22 bp, Homo sapiens
tgtatttagtccagtctctcat

SEQ ID NO: 8267269 - DNA, 22 bp, Homo sapiens
tgtatttattcttctggtgttt

SEQ ID NO: 8267270 - DNA, 22 bp, Homo sapiens
tgtcacataggcaaaatgtttt

SEQ ID NO: 8267271 - DNA, 21 bp, Homo sapiens
tgtcacatgtggatggtattt

SEQ ID NO: 8267272 - DNA, 22 bp, Homo sapiens
tgtcacattgaatatgatttat

SEQ ID NO: 8267273 - DNA, 22 bp, Homo sapiens
tggtgggagtgagggcatgcca

SEQ ID NO: 8267274 - DNA, 22 bp, Homo sapiens
tggaacactttcagtagctatt

SEQ ID NO: 8267275 - DNA, 22 bp, Homo sapiens
tggaggcaactgaagatgtagt

SEQ ID NO: 8267276 - DNA, 22 bp, Homo sapiens
tggcaactcctgactctactca

SEQ ID NO: 8267277 - DNA, 22 bp, Homo sapiens
tgacatttcggtgtatgtgatg

SEQ ID NO: 8267278 - DNA, 22 bp, Homo sapiens
tgaaggcaactgagaaaaagca

SEQ ID NO: 8267279 - DNA, 20 bp, Homo sapiens
tgaaggcaggtaagaaagat

SEQ ID NO: 8267280 - DNA, 22 bp, Homo sapiens
tgagagcaacacgcagtagtat

SEQ ID NO: 8267281 - DNA, 22 bp, Homo sapiens
tgaggcaggaggttgagaactg

SEQ ID NO: 8267282 - DNA, 22 bp, Homo sapiens
tgaggcaggagttcaggctgcg

SEQ ID NO: 8267283 - DNA, 22 bp, Homo sapiens
tgaggccagcttcagcagtgga

SEQ ID NO: 8267284 - DNA, 22 bp, Homo sapiens
tgaggcactgggagagcacact

SEQ ID NO: 8267285 - DNA, 22 bp, Homo sapiens
tgaggcagaaaatagcagttca

SEQ ID NO: 8267286 - DNA, 22 bp, Homo sapiens
tgaggcaagggatggccccgtg

SEQ ID NO: 8267287 - DNA, 22 bp, Homo sapiens
tgaggcaaggctgaatgaaggc

SEQ ID NO: 8267288 - DNA, 19 bp, Homo sapiens
tgaggcaagctttttcttg

SEQ ID NO: 8267289 - DNA, 22 bp, Homo sapiens
tgaggcaagctgggcccatgga

SEQ ID NO: 8267290 - DNA, 22 bp, Homo sapiens
tgaggcaagtctcaatctttga

SEQ ID NO: 8267291 - DNA, 22 bp, Homo sapiens
tgaggcaatccctagggtaagg

SEQ ID NO: 8267292 - DNA, 21 bp, Homo sapiens
tgaggcaagtccttttatagc

SEQ ID NO: 8267293 - DNA, 22 bp, Homo sapiens
tgaggcaagtactttccctttt

SEQ ID NO: 8267294 - DNA, 19 bp, Homo sapiens
tgaggcacatgataagaac

SEQ ID NO: 8267295 - DNA, 22 bp, Homo sapiens
tgaggcaattggaaattttaac

SEQ ID NO: 8267296 - DNA, 22 bp, Homo sapiens
tgaggcaatgtccttcatcctt

SEQ ID NO: 8267297 - DNA, 22 bp, Homo sapiens
tgaggcaaagacaaagcagcat

SEQ ID NO: 8267298 - DNA, 22 bp, Homo sapiens
tgaggcaaaagttatgtggtag

SEQ ID NO: 8267299 - DNA, 22 bp, Homo sapiens
tgaggcaaagttcaagctgaaa

SEQ ID NO: 8267300 - DNA, 19 bp, Homo sapiens
tgaggcaagatggctctgg

SEQ ID NO: 8267301 - DNA, 22 bp, Homo sapiens
tgaggcaagagtttgattagag

SEQ ID NO: 8267302 - DNA, 22 bp, Homo sapiens
tgaggcaacagaaagggccaat

SEQ ID NO: 8267303 - DNA, 17 bp, Homo sapiens
tgaggcaaccatcacta

SEQ ID NO: 8267304 - DNA, 22 bp, Homo sapiens
tgaggcaaaaacactgattagg

SEQ ID NO: 8267305 - DNA, 22 bp, Homo sapiens
tgcctactagtactattttgtg

SEQ ID NO: 8267306 - DNA, 22 bp, Homo sapiens
tgatattttatgagctttcata

SEQ ID NO: 8267307 - DNA, 20 bp, Homo sapiens
tgcaaggaagcaggcaagtg

SEQ ID NO: 8267308 - DNA, 22 bp, Homo sapiens
tctagagactataatgtgtcct

SEQ ID NO: 8267309 - DNA, 22 bp, Homo sapiens
tctagagaaaaaactcaagtga

SEQ ID NO: 8267310 - DNA, 22 bp, Homo sapiens
tctagagatacattggtcattt

SEQ ID NO: 8267311 - DNA, 22 bp, Homo sapiens
tctatttgttctcaggatcatc

SEQ ID NO: 8267312 - DNA, 22 bp, Homo sapiens
tcttgaggttattaagctgtta

SEQ ID NO: 8267313 - DNA, 22 bp, Homo sapiens
aagctacttttatatgcagtag

SEQ ID NO: 8267314 - DNA, 22 bp, Homo sapiens
aagctcttatgatatttattta

SEQ ID NO: 8267315 - DNA, 18 bp, Homo sapiens
aagctcttaaatggttca

SEQ ID NO: 8267316 - DNA, 22 bp, Homo sapiens
aagctattgaatttatagcata

SEQ ID NO: 8267317 - DNA, 22 bp, Homo sapiens
acattcttcttgtgaatttact

SEQ ID NO: 8267318 - DNA, 22 bp, Homo sapiens
actttcttaggctgtataaatg

SEQ ID NO: 8267319 - DNA, 22 bp, Homo sapiens
aagtctaggacaggaagtctat

SEQ ID NO: 8267320 - DNA, 22 bp, Homo sapiens
acacattaacctttgaaattct

SEQ ID NO: 8267321 - DNA, 22 bp, Homo sapiens
acactcaccctcccactgcctg

SEQ ID NO: 8267322 - DNA, 22 bp, Homo sapiens
acactctgtaatgtcacactcc

SEQ ID NO: 8267323 - DNA, 22 bp, Homo sapiens
acacagatgcattacacatcta

SEQ ID NO: 8267324 - DNA, 22 bp, Homo sapiens
acacagagtttgacacatggga

SEQ ID NO: 8267325 - DNA, 21 bp, Homo sapiens
acacagaggcatcatcacttt

SEQ ID NO: 8267326 - DNA, 22 bp, Homo sapiens
acacttttagctatgagttaat

SEQ ID NO: 8267327 - DNA, 22 bp, Homo sapiens
acacttttgtgtatatccagtt

SEQ ID NO: 8267328 - DNA, 22 bp, Homo sapiens
acacttttgtttgaagtctcca

SEQ ID NO: 8267329 - DNA, 22 bp, Homo sapiens
acagattcactgcactggccat

SEQ ID NO: 8267330 - DNA, 22 bp, Homo sapiens
aatggcagaggcaaagatggta

SEQ ID NO: 8267331 - DNA, 19 bp, Homo sapiens
aaaaggagagatcagagtt

SEQ ID NO: 8267332 - DNA, 22 bp, Homo sapiens
aaaacctcagttctgctcttaa

SEQ ID NO: 8267333 - DNA, 22 bp, Homo sapiens
aaaactctgcagttagtttcta

SEQ ID NO: 8267334 - DNA, 22 bp, Homo sapiens
aaatacatttacagtcgtggct

SEQ ID NO: 8267335 - DNA, 22 bp, Homo sapiens
aaatactgctgctattcctttt

SEQ ID NO: 8267336 - DNA, 22 bp, Homo sapiens
aaatctcctttgatatcccatc

SEQ ID NO: 8267337 - DNA, 22 bp, Homo sapiens
aacacagatcaaaatatttcct

SEQ ID NO: 8267338 - DNA, 22 bp, Homo sapiens
aacctgagtcttttgatttgct

SEQ ID NO: 8267339 - DNA, 22 bp, Homo sapiens
aacctgagggcaggaccccata

SEQ ID NO: 8267340 - DNA, 20 bp, Homo sapiens
aacctgaggcagtgttccag

SEQ ID NO: 8267341 - DNA, 22 bp, Homo sapiens
aacctgagcgcgttgctttcta

SEQ ID NO: 8267342 - DNA, 22 bp, Homo sapiens
aacctgagatactggtctttat

SEQ ID NO: 8267343 - DNA, 22 bp, Homo sapiens
aacctgagataataggagagta

SEQ ID NO: 8267344 - DNA, 21 bp, Homo sapiens
aacctgagacccacgggacta

SEQ ID NO: 8267345 - DNA, 22 bp, Homo sapiens
aatggccattgggtcatgctag

SEQ ID NO: 8267346 - DNA, 22 bp, Homo sapiens
aatagagtcagttctacattct

SEQ ID NO: 8267347 - DNA, 22 bp, Homo sapiens
aattcccaccttctctcttttg

SEQ ID NO: 8267348 - DNA, 22 bp, Homo sapiens
aatttaagagcatagctccaac

SEQ ID NO: 8267349 - DNA, 22 bp, Homo sapiens
aagcagagaccggctaatggag

SEQ ID NO: 8267350 - DNA, 22 bp, Homo sapiens
acacatcttagactgaaatatg

SEQ ID NO: 8267351 - DNA, 22 bp, Homo sapiens
acagctctgtgtattgtcatct

SEQ ID NO: 8267352 - DNA, 22 bp, Homo sapiens
aggctgagggctcctgagggca

SEQ ID NO: 8267353 - DNA, 22 bp, Homo sapiens
acatgacttttctcttccagag

SEQ ID NO: 8267354 - DNA, 22 bp, Homo sapiens
acatgcagaattcttagagagc

SEQ ID NO: 8267355 - DNA, 22 bp, Homo sapiens
acatgcagacgggatcctggca

SEQ ID NO: 8267356 - DNA, 22 bp, Homo sapiens
acatgcagagggagggccaggc

SEQ ID NO: 8267357 - DNA, 22 bp, Homo sapiens
acatgcaggaaaatgcacagat

SEQ ID NO: 8267358 - DNA, 22 bp, Homo sapiens
acatgcagtgagtagttctcca

SEQ ID NO: 8267359 - DNA, 20 bp, Homo sapiens
acatgcagtggtcatttcag

SEQ ID NO: 8267360 - DNA, 22 bp, Homo sapiens
acatgcagtgaggatcttagaa

SEQ ID NO: 8267361 - DNA, 22 bp, Homo sapiens
acatgcaggtgatctggtcaat

SEQ ID NO: 8267362 - DNA, 22 bp, Homo sapiens
acatgcagggctttttgcctct

SEQ ID NO: 8267363 - DNA, 22 bp, Homo sapiens
acccacacctccgtatatcact

SEQ ID NO: 8267364 - DNA, 22 bp, Homo sapiens
accatttatcaagcacctgtga

SEQ ID NO: 8267365 - DNA, 22 bp, Homo sapiens
accatttagtaagtatacctgg

SEQ ID NO: 8267366 - DNA, 22 bp, Homo sapiens
accatttactcccattggaagt

SEQ ID NO: 8267367 - DNA, 22 bp, Homo sapiens
acccacacatctctaattcagt

SEQ ID NO: 8267368 - DNA, 22 bp, Homo sapiens
accatttaaggaaaatgtatca

SEQ ID NO: 8267369 - DNA, 22 bp, Homo sapiens
accatttaataagtatttccat

SEQ ID NO: 8267370 - DNA, 22 bp, Homo sapiens
accatttaaaattgatgccttc

SEQ ID NO: 8267371 - DNA, 22 bp, Homo sapiens
agaaaatttaaagagacacaca

SEQ ID NO: 8267372 - DNA, 22 bp, Homo sapiens
atcattctgatggtcaatgcta

SEQ ID NO: 8267373 - DNA, 22 bp, Homo sapiens
atcattctctgcttgagcactc

SEQ ID NO: 8267374 - DNA, 23 bp, Homo sapiens
atcattctccaatctggagcagg

SEQ ID NO: 8267375 - DNA, 22 bp, Homo sapiens
acttcaaaaataagtgagaggt

SEQ ID NO: 8267376 - DNA, 22 bp, Homo sapiens
acttgcagctaccatcattcca

SEQ ID NO: 8267377 - DNA, 22 bp, Homo sapiens
agtttacatgacgtgtatttca

SEQ ID NO: 8267378 - DNA, 22 bp, Homo sapiens
agtctcttcctcatgcatatgt

SEQ ID NO: 8267379 - DNA, 22 bp, Homo sapiens
agtctcttgcacattgtattaa

SEQ ID NO: 8267380 - DNA, 22 bp, Homo sapiens
agggtgtgttctcctatgagaa

SEQ ID NO: 8267381 - DNA, 22 bp, Homo sapiens
accttacccagaggggcatgac

SEQ ID NO: 8267382 - DNA, 22 bp, Homo sapiens
agacacataggaccacactgtg

SEQ ID NO: 8267383 - DNA, 23 bp, Homo sapiens
agacacataggagcagctattgg

SEQ ID NO: 8267384 - DNA, 22 bp, Homo sapiens
atgcaggattagaaagttgcct

SEQ ID NO: 8267385 - DNA, 22 bp, Homo sapiens
atgcaggatgtcaacgcatcct

SEQ ID NO: 8267386 - DNA, 22 bp, Homo sapiens
atggcagatggctggagcaggt

SEQ ID NO: 8267387 - DNA, 22 bp, Homo sapiens
atgggaggcagacactaagttc

SEQ ID NO: 8267388 - DNA, 22 bp, Homo sapiens
atgggaggcaggctcagaaccg

SEQ ID NO: 8267389 - DNA, 22 bp, Homo sapiens
atttgcttatctccacagttgt

SEQ ID NO: 8267390 - DNA, 22 bp, Homo sapiens
atttattgaacactgactatgt

SEQ ID NO: 8267391 - DNA, 22 bp, Homo sapiens
agccttcggccagagggtggcc

SEQ ID NO: 8267392 - DNA, 22 bp, Homo sapiens
cagacagagtcttcccatcagt

SEQ ID NO: 8267393 - DNA, 22 bp, Homo sapiens
agcccagctttgaaccatatca

SEQ ID NO: 8267394 - DNA, 22 bp, Homo sapiens
cacaggaggttaggaagtggtc

SEQ ID NO: 8267395 - DNA, 22 bp, Homo sapiens
cacatccctggagttacccagt

SEQ ID NO: 8267396 - DNA, 22 bp, Homo sapiens
cacatcaagcatccatgagttt

SEQ ID NO: 8267397 - DNA, 22 bp, Homo sapiens
cattatgatggtaattttctct

SEQ ID NO: 8267398 - DNA, 22 bp, Homo sapiens
cattcccacgtgttctttgctt

SEQ ID NO: 8267399 - DNA, 22 bp, Homo sapiens
catgcagagtttattaccatct

SEQ ID NO: 8267400 - DNA, 22 bp, Homo sapiens
catgcaggcccgcctgaatggg

SEQ ID NO: 8267401 - DNA, 22 bp, Homo sapiens
catgcaggcacccagagcccac

SEQ ID NO: 8267402 - DNA, 22 bp, Homo sapiens
aggagaggctctaactctgtgt

SEQ ID NO: 8267403 - DNA, 22 bp, Homo sapiens
aggaacaattgataaactcaca

SEQ ID NO: 8267404 - DNA, 22 bp, Homo sapiens
aggaactagtgcaacaggagcg

SEQ ID NO: 8267405 - DNA, 22 bp, Homo sapiens
agctctctgataaattgataaa

SEQ ID NO: 8267406 - DNA, 22 bp, Homo sapiens
agggagcatgggtgaagcaggc

SEQ ID NO: 8267407 - DNA, 22 bp, Homo sapiens
cctcaaatctttagagttattt

SEQ ID NO: 8267408 - DNA, 22 bp, Homo sapiens
aggctgagccacggggctggct

SEQ ID NO: 8267409 - DNA, 22 bp, Homo sapiens
aggctgagcaaagggccttacc

SEQ ID NO: 8267410 - DNA, 22 bp, Homo sapiens
cgggttttccacaggagtcttt

SEQ ID NO: 8267411 - DNA, 22 bp, Homo sapiens
ccttttataaagttgtattgaa

SEQ ID NO: 8267412 - DNA, 22 bp, Homo sapiens
ccttttatactcagtgatatca

SEQ ID NO: 8267413 - DNA, 22 bp, Homo sapiens
ccttttatactctgtcctctgg

SEQ ID NO: 8267414 - DNA, 22 bp, Homo sapiens
ccttttatatggctcatcacag

SEQ ID NO: 8267415 - DNA, 22 bp, Homo sapiens
ccttttatagatcagtgtgtta

SEQ ID NO: 8267416 - DNA, 22 bp, Homo sapiens
ccttttatgaacttgagcaggt

SEQ ID NO: 8267417 - DNA, 22 bp, Homo sapiens
ccttgctcaagctagtgacggg

SEQ ID NO: 8267418 - DNA, 22 bp, Homo sapiens
ctgagggtcaacttgattgtat

SEQ ID NO: 8267419 - DNA, 22 bp, Homo sapiens
agtttacaaagtttcactgttc

SEQ ID NO: 8267420 - DNA, 22 bp, Homo sapiens
ctgtcctccagacgacagtccc

SEQ ID NO: 8267421 - DNA, 22 bp, Homo sapiens
atcctctgtggattacacctag

SEQ ID NO: 8267422 - DNA, 22 bp, Homo sapiens
cacaatgtatatgtatatcaaa

SEQ ID NO: 8267423 - DNA, 22 bp, Homo sapiens
cacaactttaggaaccacattc

SEQ ID NO: 8267424 - DNA, 22 bp, Homo sapiens
cacacatttcagatgctacaat

SEQ ID NO: 8267425 - DNA, 22 bp, Homo sapiens
cacccacatggaaattcacagt

SEQ ID NO: 8267426 - DNA, 22 bp, Homo sapiens
cacccacattccatcactctgc

SEQ ID NO: 8267427 - DNA, 22 bp, Homo sapiens
cacactgtcaggtaaataacac

SEQ ID NO: 8267428 - DNA, 22 bp, Homo sapiens
gggacactggacccagtgtcca

SEQ ID NO: 8267429 - DNA, 22 bp, Homo sapiens
gggacacagagaaactggagaa

SEQ ID NO: 8267430 - DNA, 22 bp, Homo sapiens
gggacaatggaggcctctctcc

SEQ ID NO: 8267431 - DNA, 22 bp, Homo sapiens
cagccaagaaccacagacccag

SEQ ID NO: 8267432 - DNA, 21 bp, Homo sapiens
cagcccagcccattgacagtg

SEQ ID NO: 8267433 - DNA, 22 bp, Homo sapiens
atggcagagggattgaacagct

SEQ ID NO: 8267434 - DNA, 22 bp, Homo sapiens
atgtgtattaccctttcattcc

SEQ ID NO: 8267435 - DNA, 22 bp, Homo sapiens
atgcaggacataagcatcgaca

SEQ ID NO: 8267436 - DNA, 22 bp, Homo sapiens
atgaagatggttcaactggcct

SEQ ID NO: 8267437 - DNA, 22 bp, Homo sapiens
atgagtgtttagaaaacactgg

SEQ ID NO: 8267438 - DNA, 22 bp, Homo sapiens
atcttttacattactgcccaga

SEQ ID NO: 8267439 - DNA, 22 bp, Homo sapiens
atcttttactacaaatcaggtg

SEQ ID NO: 8267440 - DNA, 22 bp, Homo sapiens
atcttttatgagcgttctgaca

SEQ ID NO: 8267441 - DNA, 22 bp, Homo sapiens
atctttttgacatggtgatggt

SEQ ID NO: 8267442 - DNA, 22 bp, Homo sapiens
cttttattttgaattaagggct

SEQ ID NO: 8267443 - DNA, 22 bp, Homo sapiens
atttattgagacttaacaaccc

SEQ ID NO: 8267444 - DNA, 22 bp, Homo sapiens
atttattgagagggaggggaat

SEQ ID NO: 8267445 - DNA, 22 bp, Homo sapiens
atttattggatgcttacttggg

SEQ ID NO: 8267446 - DNA, 22 bp, Homo sapiens
atttattgagcctttcctatgt

SEQ ID NO: 8267447 - DNA, 22 bp, Homo sapiens
gctcaggcaaatttctggtgaa

SEQ ID NO: 8267448 - DNA, 22 bp, Homo sapiens
gcgagcctctggagtcctctgg

SEQ ID NO: 8267449 - DNA, 22 bp, Homo sapiens
atgtttttggaaatgggaacat

SEQ ID NO: 8267450 - DNA, 22 bp, Homo sapiens
gatgatgaggccatgaggcagg

SEQ ID NO: 8267451 - DNA, 22 bp, Homo sapiens
gcaagtagtgggaaagaagatg

SEQ ID NO: 8267452 - DNA, 22 bp, Homo sapiens
catcacagaaataaacatacct

SEQ ID NO: 8267453 - DNA, 22 bp, Homo sapiens
catcacaggtcctgatgacatt

SEQ ID NO: 8267454 - DNA, 22 bp, Homo sapiens
catacatttatacacatctatg

SEQ ID NO: 8267455 - DNA, 17 bp, Homo sapiens
tcatttgttgtgactag

SEQ ID NO: 8267456 - DNA, 22 bp, Homo sapiens
tcatttgttctcattctctact

SEQ ID NO: 8267457 - DNA, 22 bp, Homo sapiens
tcatgtcccgttgctggctgcc

SEQ ID NO: 8267458 - DNA, 18 bp, Homo sapiens
tcatttgttttgcatgaa

SEQ ID NO: 8267459 - DNA, 22 bp, Homo sapiens
tctgaaatcctttatcttggct

SEQ ID NO: 8267460 - DNA, 19 bp, Homo sapiens
ccagcccacagtgactttc

SEQ ID NO: 8267461 - DNA, 21 bp, Homo sapiens
ccagcccagctgtgtcccagc

SEQ ID NO: 8267462 - DNA, 22 bp, Homo sapiens
ccagccttcacctgctctggtc

SEQ ID NO: 8267463 - DNA, 22 bp, Homo sapiens
ccaaatattaacaaagtaattt

SEQ ID NO: 8267464 - DNA, 22 bp, Homo sapiens
ccacacagataagtgttttcta

SEQ ID NO: 8267465 - DNA, 23 bp, Homo sapiens
ccactgaagaatccagggagttt

SEQ ID NO: 8267466 - DNA, 22 bp, Homo sapiens
tcctggggagggttctggctcc

SEQ ID NO: 8267467 - DNA, 22 bp, Homo sapiens
caggaacacaagttcagggatg

SEQ ID NO: 8267468 - DNA, 22 bp, Homo sapiens
caggaacagagtggcattgtct

SEQ ID NO: 8267469 - DNA, 22 bp, Homo sapiens
caggaacaggctgatgggcagg

SEQ ID NO: 8267470 - DNA, 22 bp, Homo sapiens
caggaacaggggagtgaacctg

SEQ ID NO: 8267471 - DNA, 22 bp, Homo sapiens
caggaacagggtgtcctggcag

SEQ ID NO: 8267472 - DNA, 22 bp, Homo sapiens
caggaacagctgacctgacaat

SEQ ID NO: 8267473 - DNA, 21 bp, Homo sapiens
caggaacattctttacattta

SEQ ID NO: 8267474 - DNA, 22 bp, Homo sapiens
caggaacattgtagaattgaaa

SEQ ID NO: 8267475 - DNA, 22 bp, Homo sapiens
caggaacatgtctccaattaga

SEQ ID NO: 8267476 - DNA, 22 bp, Homo sapiens
caggaacatgttggaaagaaat

SEQ ID NO: 8267477 - DNA, 22 bp, Homo sapiens
gtttcctgatgtgggagatctt

SEQ ID NO: 8267478 - DNA, 22 bp, Homo sapiens
gtttattgataaaagctggaca

SEQ ID NO: 8267479 - DNA, 22 bp, Homo sapiens
gtttattgggtattgtggagcc

SEQ ID NO: 8267480 - DNA, 22 bp, Homo sapiens
caggaacaatatctgtcctggt

SEQ ID NO: 8267481 - DNA, 22 bp, Homo sapiens
caggaacaatacctcttgccag

SEQ ID NO: 8267482 - DNA, 22 bp, Homo sapiens
caggaacaatcttactactatt

SEQ ID NO: 8267483 - DNA, 22 bp, Homo sapiens
caggaacaactcccagcatctc

SEQ ID NO: 8267484 - DNA, 22 bp, Homo sapiens
cagctcttaacacagcttgtat

SEQ ID NO: 8267485 - DNA, 22 bp, Homo sapiens
cagctcttcagtgcctgagata

SEQ ID NO: 8267486 - DNA, 22 bp, Homo sapiens
cagctcttccctcttcttgtag

SEQ ID NO: 8267487 - DNA, 22 bp, Homo sapiens
cagctcttccatttccttcagc

SEQ ID NO: 8267488 - DNA, 22 bp, Homo sapiens
cagctcttattttctctcctaa

SEQ ID NO: 8267489 - DNA, 22 bp, Homo sapiens
cagctcttagagggagacagac

SEQ ID NO: 8267490 - DNA, 22 bp, Homo sapiens
cagctcttcagagtgagcaatg

SEQ ID NO: 8267491 - DNA, 18 bp, Homo sapiens
cagctcttctccagtaac

SEQ ID NO: 8267492 - DNA, 22 bp, Homo sapiens
cagctcttggagaaaccagagc

SEQ ID NO: 8267493 - DNA, 22 bp, Homo sapiens
cagctcttggagcctccagtaa

SEQ ID NO: 8267494 - DNA, 22 bp, Homo sapiens
cagctctttactctgcaatgat

SEQ ID NO: 8267495 - DNA, 22 bp, Homo sapiens
cagctctttattgaaacaaaaa

SEQ ID NO: 8267496 - DNA, 22 bp, Homo sapiens
cagctctttattgccaatattc

SEQ ID NO: 8267497 - DNA, 22 bp, Homo sapiens
cagctcttcctaccctagttgg

SEQ ID NO: 8267498 - DNA, 22 bp, Homo sapiens
cagctcttcctagccatgccac

SEQ ID NO: 8267499 - DNA, 17 bp, Homo sapiens
cagctcttcctccctct

SEQ ID NO: 8267500 - DNA, 22 bp, Homo sapiens
cagctcttcctcccaccggaca

SEQ ID NO: 8267501 - DNA, 22 bp, Homo sapiens
cagctctttgagtattccattt

SEQ ID NO: 8267502 - DNA, 22 bp, Homo sapiens
cagctctttttcacacaacatg

SEQ ID NO: 8267503 - DNA, 22 bp, Homo sapiens
cagctcttttttgcagcagctg

SEQ ID NO: 8267504 - DNA, 19 bp, Homo sapiens
gtgggacagacattacata

SEQ ID NO: 8267505 - DNA, 22 bp, Homo sapiens
cagcccagccttgtctctttat

SEQ ID NO: 8267506 - DNA, 22 bp, Homo sapiens
cagcccaggccgacagttcctc

SEQ ID NO: 8267507 - DNA, 22 bp, Homo sapiens
gtggggctaaaaactgtgcagt

SEQ ID NO: 8267508 - DNA, 22 bp, Homo sapiens
caggaggaagaactctgcaaca

SEQ ID NO: 8267509 - DNA, 22 bp, Homo sapiens
taaaccttatttgaataccaac

SEQ ID NO: 8267510 - DNA, 22 bp, Homo sapiens
caggacactaaaaagccaagct

SEQ ID NO: 8267511 - DNA, 22 bp, Homo sapiens
caggacacagaataaggcagtt

SEQ ID NO: 8267512 - DNA, 22 bp, Homo sapiens
caggacacatttcttgttcagg

SEQ ID NO: 8267513 - DNA, 22 bp, Homo sapiens
caggacaccttagctaaaattc

SEQ ID NO: 8267514 - DNA, 22 bp, Homo sapiens
caggaagtggggtcatggagta

SEQ ID NO: 8267515 - DNA, 22 bp, Homo sapiens
caggaagtgctcgctgtgggga

SEQ ID NO: 8267516 - DNA, 22 bp, Homo sapiens
caggaagtagagttggccagcc

SEQ ID NO: 8267517 - DNA, 22 bp, Homo sapiens
caggaagtgtgcctgagcacct

SEQ ID NO: 8267518 - DNA, 22 bp, Homo sapiens
tgtaaagaaagacgcagagtta

SEQ ID NO: 8267519 - DNA, 22 bp, Homo sapiens
tgtaaacatatgtatgtatgta

SEQ ID NO: 8267520 - DNA, 23 bp, Homo sapiens
tgtaaacatcaccccctggagtt

SEQ ID NO: 8267521 - DNA, 22 bp, Homo sapiens
tggtagggacactatgcagaaa

SEQ ID NO: 8267522 - DNA, 22 bp, Homo sapiens
tgtaaacagccccatggagagc

SEQ ID NO: 8267523 - DNA, 22 bp, Homo sapiens
tgtaaacataccagagccaagt

SEQ ID NO: 8267524 - DNA, 22 bp, Homo sapiens
cctggctcctgcctctgcaggg

SEQ ID NO: 8267525 - DNA, 22 bp, Homo sapiens
tggcacagggcttggtcgctca

SEQ ID NO: 8267526 - DNA, 22 bp, Homo sapiens
tggctcatctttttagacttat

SEQ ID NO: 8267527 - DNA, 22 bp, Homo sapiens
tggctcatctatcagaaagtcc

SEQ ID NO: 8267528 - DNA, 18 bp, Homo sapiens
cctctgggttttgttccc

SEQ ID NO: 8267529 - DNA, 22 bp, Homo sapiens
cccccaaagtttgcacggataa

SEQ ID NO: 8267530 - DNA, 22 bp, Homo sapiens
ttttattctaagtatgatggga

SEQ ID NO: 8267531 - DNA, 22 bp, Homo sapiens
ctcttttagagatgaaaattgg

SEQ ID NO: 8267532 - DNA, 22 bp, Homo sapiens
ctcttttatgtgacgtgtgtga

SEQ ID NO: 8267533 - DNA, 22 bp, Homo sapiens
ctcttttaattgtcataacaac

SEQ ID NO: 8267534 - DNA, 22 bp, Homo sapiens
ctcttttacaccaaaaggccta

SEQ ID NO: 8267535 - DNA, 23 bp, Homo sapiens
ttttattgatatgtagctgttgt

SEQ ID NO: 8267536 - DNA, 19 bp, Homo sapiens
tttttaatgggctggagca

SEQ ID NO: 8267537 - DNA, 22 bp, Homo sapiens
ctgctttggctcagtgacatca

SEQ ID NO: 8267538 - DNA, 22 bp, Homo sapiens
ctggcctggggggacacatccc

SEQ ID NO: 8267539 - DNA, 22 bp, Homo sapiens
ttgaggaaagagtgcaaagagg

SEQ ID NO: 8267540 - DNA, 22 bp, Homo sapiens
ttcccacagagattacattgaa

SEQ ID NO: 8267541 - DNA, 22 bp, Homo sapiens
ttcccacattctttacattcat

SEQ ID NO: 8267542 - DNA, 22 bp, Homo sapiens
ttcccacagtgttgaatcctct

SEQ ID NO: 8267543 - DNA, 22 bp, Homo sapiens
ttcattctgcagttctcagctc

SEQ ID NO: 8267544 - DNA, 22 bp, Homo sapiens
tttaaaaaactagtctgagtct

SEQ ID NO: 8267545 - DNA, 22 bp, Homo sapiens
ctcatcaccacatataacaaag

SEQ ID NO: 8267546 - DNA, 22 bp, Homo sapiens
ttgctttggtagcagctataga

SEQ ID NO: 8267547 - DNA, 22 bp, Homo sapiens
ctctcccttgggtgggctttgg

SEQ ID NO: 8267548 - DNA, 22 bp, Homo sapiens
tttaaatttagaagaaacactg

SEQ ID NO: 8267549 - DNA, 22 bp, Homo sapiens
ctcctctgggtcctggtggcca

SEQ ID NO: 8267550 - DNA, 22 bp, Homo sapiens
ctcctctgtattgattgggact

SEQ ID NO: 8267551 - DNA, 16 bp, Homo sapiens
gcacacacatcaatga

SEQ ID NO: 8267552 - DNA, 22 bp, Homo sapiens
gcacacacatgtgagtacatgc

SEQ ID NO: 8267553 - DNA, 22 bp, Homo sapiens
gcaggggctaaggacacagaga

SEQ ID NO: 8267554 - DNA, 22 bp, Homo sapiens
gcaggggctactctgagcttcc

SEQ ID NO: 8267555 - DNA, 22 bp, Homo sapiens
gctctctttaaactgcatggct

SEQ ID NO: 8267556 - DNA, 22 bp, Homo sapiens
gaaataatacagtgctcttctc

SEQ ID NO: 8267557 - DNA, 22 bp, Homo sapiens
gacacagagctcacagtctcct

SEQ ID NO: 8267558 - DNA, 22 bp, Homo sapiens
gacacagagggcaccagatatg

SEQ ID NO: 8267559 - DNA, 22 bp, Homo sapiens
gacacagatatctctgagatta

SEQ ID NO: 8267560 - DNA, 22 bp, Homo sapiens
gaagtgttgacttctgtgaatt

SEQ ID NO: 8267561 - DNA, 22 bp, Homo sapiens
gacttttccatcatccccctta

SEQ ID NO: 8267562 - DNA, 22 bp, Homo sapiens
gacttttctgagacaatgcttt

SEQ ID NO: 8267563 - DNA, 22 bp, Homo sapiens
gaccatttctaggaatcagact

SEQ ID NO: 8267564 - DNA, 22 bp, Homo sapiens
gaggacacaaagtggctgagat

SEQ ID NO: 8267565 - DNA, 22 bp, Homo sapiens
gagggttgtaagattgtagagc

SEQ ID NO: 8267566 - DNA, 22 bp, Homo sapiens
gagggtgtctggatgctagact

SEQ ID NO: 8267567 - DNA, 20 bp, Homo sapiens
gatacacagcacagagggcc

SEQ ID NO: 8267568 - DNA, 22 bp, Homo sapiens
gatgattctgtgtttggaatgc

SEQ ID NO: 8267569 - DNA, 22 bp, Homo sapiens
gatgattcctttgttcattgtg

SEQ ID NO: 8267570 - DNA, 22 bp, Homo sapiens
gatgaggaatttgaggttagaa

SEQ ID NO: 8267571 - DNA, 22 bp, Homo sapiens
gagtgaggctggaatcatggct

SEQ ID NO: 8267572 - DNA, 22 bp, Homo sapiens
gataaagcaaggatgactgaag

SEQ ID NO: 8267573 - DNA, 22 bp, Homo sapiens
gataaagcaggtaggagaagat

SEQ ID NO: 8267574 - DNA, 22 bp, Homo sapiens
ggagaagttggacagtttggga

SEQ ID NO: 8267575 - DNA, 22 bp, Homo sapiens
ggaagtttcaggaatctgcatt

SEQ ID NO: 8267576 - DNA, 18 bp, Homo sapiens
ggaagtttgggtcccctg

SEQ ID NO: 8267577 - DNA, 22 bp, Homo sapiens
ggagaggggaacttgttgcttg

SEQ ID NO: 8267578 - DNA, 23 bp, Homo sapiens
ggaggtcagtgcctgagggtgag

SEQ ID NO: 8267579 - DNA, 22 bp, Homo sapiens
ggaggtcacgactgggatgcct

SEQ ID NO: 8267580 - DNA, 22 bp, Homo sapiens
ggaggtatgatagctgtgtcct

SEQ ID NO: 8267581 - DNA, 22 bp, Homo sapiens
ggaggtcaaatggagggctggg

SEQ ID NO: 8267582 - DNA, 22 bp, Homo sapiens
ggaggtgggctaaggactctct

SEQ ID NO: 8267583 - DNA, 22 bp, Homo sapiens
ggaggtggtttgatttctatat

SEQ ID NO: 8267584 - DNA, 22 bp, Homo sapiens
ggaggtgggagtttagttcttg

SEQ ID NO: 8267585 - DNA, 22 bp, Homo sapiens
ggcacagagctttgtcccagtt

SEQ ID NO: 8267586 - DNA, 22 bp, Homo sapiens
ggctcatatcccggccatcatt

SEQ ID NO: 8267587 - DNA, 22 bp, Homo sapiens
ggctcatatcccggccatcatt

SEQ ID NO: 8267588 - DNA, 22 bp, Homo sapiens
ggctcatcagaaatacctgaca

SEQ ID NO: 8267589 - DNA, 18 bp, Homo sapiens
ggctcatctagcatcatt

SEQ ID NO: 8267590 - DNA, 22 bp, Homo sapiens
ggcccagcctcagacatgccct

SEQ ID NO: 8267591 - DNA, 22 bp, Homo sapiens
ggggggctgttctggacaggaa

SEQ ID NO: 8267592 - DNA, 22 bp, Homo sapiens
gggggctagagagatgaaatat

SEQ ID NO: 8267593 - DNA, 22 bp, Homo sapiens
gggggctccaggcgagaatgtg

SEQ ID NO: 8267594 - DNA, 21 bp, Homo sapiens
taaagctcgttcaggaaagtc

SEQ ID NO: 8267595 - DNA, 22 bp, Homo sapiens
taaagctctagtgttttggata

SEQ ID NO: 8267596 - DNA, 22 bp, Homo sapiens
taaagctctgggtttctagatc

SEQ ID NO: 8267597 - DNA, 22 bp, Homo sapiens
taaaggagtgtgatgaaaggga

SEQ ID NO: 8267598 - DNA, 19 bp, Homo sapiens
taaatctgtattcttcaaa

SEQ ID NO: 8267599 - DNA, 22 bp, Homo sapiens
taaatctctcagtggccagaga

SEQ ID NO: 8267600 - DNA, 21 bp, Homo sapiens
gtacacacaggtggatgggct

SEQ ID NO: 8267601 - DNA, 22 bp, Homo sapiens
gtacacacaatctctggtcagt

SEQ ID NO: 8267602 - DNA, 22 bp, Homo sapiens
gtaaagctccttggccagtgcc

SEQ ID NO: 8267603 - DNA, 22 bp, Homo sapiens
gtaaagctctcatttaatatca

SEQ ID NO: 8267604 - DNA, 22 bp, Homo sapiens
tcttggaagggttgtgggatga

SEQ ID NO: 8267605 - DNA, 22 bp, Homo sapiens
tctttcttattagccattgttc

SEQ ID NO: 8267606 - DNA, 22 bp, Homo sapiens
tcttattgtctagattgagatg

SEQ ID NO: 8267607 - DNA, 22 bp, Homo sapiens
tcttatatgcacatacattggg

SEQ ID NO: 8267608 - DNA, 20 bp, Homo sapiens
tctgttattattacattgcc

SEQ ID NO: 8267609 - DNA, 22 bp, Homo sapiens
tctggaataaccctgcttccaa

SEQ ID NO: 8267610 - DNA, 22 bp, Homo sapiens
tctattttcttgccaaaactgc

SEQ ID NO: 8267611 - DNA, 22 bp, Homo sapiens
tctagggtgtgcggcagggcta

SEQ ID NO: 8267612 - DNA, 20 bp, Homo sapiens
tctagggtggctgtagcagc

SEQ ID NO: 8267613 - DNA, 22 bp, Homo sapiens
tctagggtgatgattcaggatg

SEQ ID NO: 8267614 - DNA, 22 bp, Homo sapiens
tcgttttaccaaattgaatgtt

SEQ ID NO: 8267615 - DNA, 22 bp, Homo sapiens
tccttggagtcatgatggaggt

SEQ ID NO: 8267616 - DNA, 22 bp, Homo sapiens
tccttctgtagtccctgtccct

SEQ ID NO: 8267617 - DNA, 22 bp, Homo sapiens
taagaacagtagaacagtaggt

SEQ ID NO: 8267618 - DNA, 22 bp, Homo sapiens
tcctggggtgtgttttgctgct

SEQ ID NO: 8267619 - DNA, 21 bp, Homo sapiens
tcctgtaagcttgggtggctc

SEQ ID NO: 8267620 - DNA, 22 bp, Homo sapiens
tctctttgtctgctcttagttg

SEQ ID NO: 8267621 - DNA, 18 bp, Homo sapiens
tctcttttcccctcattg

SEQ ID NO: 8267622 - DNA, 22 bp, Homo sapiens
tctcttttatgtacaccctgac

SEQ ID NO: 8267623 - DNA, 20 bp, Homo sapiens
tctcttttagcttacagctg

SEQ ID NO: 8267624 - DNA, 22 bp, Homo sapiens
tctcttttctttctggataaaa

SEQ ID NO: 8267625 - DNA, 21 bp, Homo sapiens
tctcatctcctgacctgtgcc

SEQ ID NO: 8267626 - DNA, 22 bp, Homo sapiens
tctcatctcggatcagaagtga

SEQ ID NO: 8267627 - DNA, 22 bp, Homo sapiens
tctcgggtcatgatttccatca

SEQ ID NO: 8267628 - DNA, 22 bp, Homo sapiens
tctcgggtttaggtgatagtat

SEQ ID NO: 8267629 - DNA, 22 bp, Homo sapiens
tgatattttatgagctttcata

SEQ ID NO: 8267630 - DNA, 22 bp, Homo sapiens
tgattccactctgaggatcgta

SEQ ID NO: 8267631 - DNA, 22 bp, Homo sapiens
tgattccaagacctattctatt

SEQ ID NO: 8267632 - DNA, 22 bp, Homo sapiens
tgattccaaattcacatgcttt

SEQ ID NO: 8267633 - DNA, 22 bp, Homo sapiens
tgattccaaagaatttaagttc

SEQ ID NO: 8267634 - DNA, 22 bp, Homo sapiens
tgattccatggtcaattccagg

SEQ ID NO: 8267635 - DNA, 22 bp, Homo sapiens
tgattccatgcagtaaaaggca

SEQ ID NO: 8267636 - DNA, 22 bp, Homo sapiens
tgattccagcaacccaggaatt

SEQ ID NO: 8267637 - DNA, 22 bp, Homo sapiens
tgattccagataatagtactga

SEQ ID NO: 8267638 - DNA, 22 bp, Homo sapiens
tgcaggaacagaactcactccc

SEQ ID NO: 8267639 - DNA, 22 bp, Homo sapiens
tgcaggaactcgaaaactatag

SEQ ID NO: 8267640 - DNA, 22 bp, Homo sapiens
tgcaggaaaacacctatcaccc

SEQ ID NO: 8267641 - DNA, 22 bp, Homo sapiens
tgcaggaaaaccaacacgcctt

SEQ ID NO: 8267642 - DNA, 22 bp, Homo sapiens
tgcagagaaaactcctgggtac

SEQ ID NO: 8267643 - DNA, 22 bp, Homo sapiens
tgcagattcaaatgaaatgcaa

SEQ ID NO: 8267644 - DNA, 22 bp, Homo sapiens
tgcagaaacaagccatcattca

SEQ ID NO: 8267645 - DNA, 19 bp, Homo sapiens
tgcattgagggctgtctca

SEQ ID NO: 8267646 - DNA, 22 bp, Homo sapiens
tgcattgagaatttctcaggga

SEQ ID NO: 8267647 - DNA, 22 bp, Homo sapiens
tgaggaacagagaggtaaaata

SEQ ID NO: 8267648 - DNA, 22 bp, Homo sapiens
tgagggacaccagggctggagc

SEQ ID NO: 8267649 - DNA, 22 bp, Homo sapiens
tgagggaatcctcacatcaatc

SEQ ID NO: 8267650 - DNA, 22 bp, Homo sapiens
tgagggaatattgatagatccg

SEQ ID NO: 8267651 - DNA, 22 bp, Homo sapiens
tgagtagagaattcagctaagg

SEQ ID NO: 8267652 - DNA, 22 bp, Homo sapiens
tgagggtcatttggaagtggaa

SEQ ID NO: 8267653 - DNA, 22 bp, Homo sapiens
tgagggtttttgagcagtgatt

SEQ ID NO: 8267654 - DNA, 22 bp, Homo sapiens
tgagatgtaaggtatgcttact

SEQ ID NO: 8267655 - DNA, 22 bp, Homo sapiens
tgaagttttactaggtgaattt

SEQ ID NO: 8267656 - DNA, 22 bp, Homo sapiens
tgaagttttctggttgattaag

SEQ ID NO: 8267657 - DNA, 22 bp, Homo sapiens
tgaagtttcacgcgtcattcaa

SEQ ID NO: 8267658 - DNA, 22 bp, Homo sapiens
tgaagtttcttgaatcttggag

SEQ ID NO: 8267659 - DNA, 22 bp, Homo sapiens
tgaagtttgaactgtgttgctg

SEQ ID NO: 8267660 - DNA, 22 bp, Homo sapiens
tgaagtttggtggaaatttcct

SEQ ID NO: 8267661 - DNA, 22 bp, Homo sapiens
tgaagtttaattttggacatga

SEQ ID NO: 8267662 - DNA, 22 bp, Homo sapiens
tgaattaaaggaattcgaattc

SEQ ID NO: 8267663 - DNA, 21 bp, Homo sapiens
tgactgaggcttcttcacaca

SEQ ID NO: 8267664 - DNA, 22 bp, Homo sapiens
tgactcatatttcatggatacg

SEQ ID NO: 8267665 - DNA, 22 bp, Homo sapiens
tgacacatgcaccagtctttaa

SEQ ID NO: 8267666 - DNA, 22 bp, Homo sapiens
tgacacataccgaaaatatttg

SEQ ID NO: 8267667 - DNA, 20 bp, Homo sapiens
tcttttattggcagatcctg

SEQ ID NO: 8267668 - DNA, 22 bp, Homo sapiens
tcttttattaggctgaaatggg

SEQ ID NO: 8267669 - DNA, 22 bp, Homo sapiens
tcttttatcctacatttagctc

SEQ ID NO: 8267670 - DNA, 22 bp, Homo sapiens
tcttttatctgttgtgtaacaa

SEQ ID NO: 8267671 - DNA, 22 bp, Homo sapiens
tcttttatagtgaattttcttg

SEQ ID NO: 8267672 - DNA, 22 bp, Homo sapiens
tgaaaaacactaattggaaagc

SEQ ID NO: 8267673 - DNA, 22 bp, Homo sapiens
tggcaaagattaccacatctac

SEQ ID NO: 8267674 - DNA, 22 bp, Homo sapiens
tggcaaagactgcaaggacttt

SEQ ID NO: 8267675 - DNA, 22 bp, Homo sapiens
tggattcacaccattctcctgc

SEQ ID NO: 8267676 - DNA, 22 bp, Homo sapiens
tggcaatgtggcatcaacgaag

SEQ ID NO: 8267677 - DNA, 22 bp, Homo sapiens
tggcagagagactctccttgat

SEQ ID NO: 8267678 - DNA, 22 bp, Homo sapiens
tggcagagaacacggctgatct

SEQ ID NO: 8267679 - DNA, 22 bp, Homo sapiens
tggcagagagagtgcagtcgac

SEQ ID NO: 8267680 - DNA, 22 bp, Homo sapiens
tggcagagcccagactccagtc

SEQ ID NO: 8267681 - DNA, 22 bp, Homo sapiens
tggcagagtcatcacatctgga

SEQ ID NO: 8267682 - DNA, 22 bp, Homo sapiens
tggcgtctctcataagtatgtg

SEQ ID NO: 8267683 - DNA, 22 bp, Homo sapiens
tggcctttgttgatagctatgc

SEQ ID NO: 8267684 - DNA, 22 bp, Homo sapiens
tggctcattctttagaatatac

SEQ ID NO: 8267685 - DNA, 22 bp, Homo sapiens
tggctcattctggggaagtcag

SEQ ID NO: 8267686 - DNA, 22 bp, Homo sapiens
tggctctgctgaacctagtgca

SEQ ID NO: 8267687 - DNA, 22 bp, Homo sapiens
tggacactgtctccaggataaa

SEQ ID NO: 8267688 - DNA, 22 bp, Homo sapiens
tggacactggggcaggcgggag

SEQ ID NO: 8267689 - DNA, 22 bp, Homo sapiens
tggacactggtcttactcagct

SEQ ID NO: 8267690 - DNA, 22 bp, Homo sapiens
tggacactggtggatatggaat

SEQ ID NO: 8267691 - DNA, 22 bp, Homo sapiens
tggacactggccatttgagtag

SEQ ID NO: 8267692 - DNA, 22 bp, Homo sapiens
tggacactggagattcgtcagt

SEQ ID NO: 8267693 - DNA, 22 bp, Homo sapiens
tggaagggggaagacagctctg

SEQ ID NO: 8267694 - DNA, 22 bp, Homo sapiens
tggaataatgaccacagaaaca

SEQ ID NO: 8267695 - DNA, 23 bp, Homo sapiens
tggaagcagttccagcacaaata

SEQ ID NO: 8267696 - DNA, 22 bp, Homo sapiens
tgctgtgaggttgagaaggaag

SEQ ID NO: 8267697 - DNA, 20 bp, Homo sapiens
tgctggaaaaagtcactcat

SEQ ID NO: 8267698 - DNA, 22 bp, Homo sapiens
tgctggaagctcctgcatgtct

SEQ ID NO: 8267699 - DNA, 22 bp, Homo sapiens
tgctctgtattctatggcagtt

SEQ ID NO: 8267700 - DNA, 22 bp, Homo sapiens
tggtcctggaaggtcctgaggg

SEQ ID NO: 8267701 - DNA, 22 bp, Homo sapiens
tggtcctgccccgtgcacagag

SEQ ID NO: 8267702 - DNA, 22 bp, Homo sapiens
tggttttctggtggtggcagtg

SEQ ID NO: 8267703 - DNA, 22 bp, Homo sapiens
tggttttcaacaagggcagcga

SEQ ID NO: 8267704 - DNA, 18 bp, Homo sapiens
tgtagagccaggtttgcc

SEQ ID NO: 8267705 - DNA, 22 bp, Homo sapiens
tgggggctgtgcacaggctcac

SEQ ID NO: 8267706 - DNA, 22 bp, Homo sapiens
tggtatttcagcttttgtatct

SEQ ID NO: 8267707 - DNA, 22 bp, Homo sapiens
tgggttttccacatatgccatg

SEQ ID NO: 8267708 - DNA, 22 bp, Homo sapiens
tgggttttccatctatttactc

SEQ ID NO: 8267709 - DNA, 22 bp, Homo sapiens
tgggttttctgccgattgttcc

SEQ ID NO: 8267710 - DNA, 22 bp, Homo sapiens
tgggttttcagcatgagtttat

SEQ ID NO: 8267711 - DNA, 22 bp, Homo sapiens
tgggttttatatgtggtggaca

SEQ ID NO: 8267712 - DNA, 22 bp, Homo sapiens
tgggtttttgtttctctggtat

SEQ ID NO: 8267713 - DNA, 22 bp, Homo sapiens
tgggttttgtcctgatccatca

SEQ ID NO: 8267714 - DNA, 22 bp, Homo sapiens
tgggttttgtgaccatagatta

SEQ ID NO: 8267715 - DNA, 22 bp, Homo sapiens
tgggtgaggatgatgaggcagc

SEQ ID NO: 8267716 - DNA, 22 bp, Homo sapiens
tggggcagagtaggattttggc

SEQ ID NO: 8267717 - DNA, 22 bp, Homo sapiens
tggggcagcagacctttcttgg

SEQ ID NO: 8267718 - DNA, 22 bp, Homo sapiens
tgggggctgagtaagatgagat

SEQ ID NO: 8267719 - DNA, 22 bp, Homo sapiens
tgggctaattctttgattgttt

SEQ ID NO: 8267720 - DNA, 22 bp, Homo sapiens
ttattattggtgagttaaggaa

SEQ ID NO: 8267721 - DNA, 22 bp, Homo sapiens
ttatgaaagacatttctgttgg

SEQ ID NO: 8267722 - DNA, 19 bp, Homo sapiens
ttatctgtgttgcagtggt

SEQ ID NO: 8267723 - DNA, 22 bp, Homo sapiens
ttacagagtagggaattgaagt

SEQ ID NO: 8267724 - DNA, 22 bp, Homo sapiens
ttacagagaggtgattgtgaag

SEQ ID NO: 8267725 - DNA, 22 bp, Homo sapiens
ttaaagagggaaagacttcaga

SEQ ID NO: 8267726 - DNA, 22 bp, Homo sapiens
ttccagccatggtttccctatg

SEQ ID NO: 8267727 - DNA, 22 bp, Homo sapiens
ttccagcccgcgacttgttcag

SEQ ID NO: 8267728 - DNA, 22 bp, Homo sapiens
ttcattcttttacatgtgaata

SEQ ID NO: 8267729 - DNA, 20 bp, Homo sapiens
ttcattcattccacaacttc

SEQ ID NO: 8267730 - DNA, 22 bp, Homo sapiens
ttcattcacccaggaaacatct

SEQ ID NO: 8267731 - DNA, 22 bp, Homo sapiens
tgtctaggtctaggttggcaat

SEQ ID NO: 8267732 - DNA, 22 bp, Homo sapiens
tgtctaggaaataaggagattc

SEQ ID NO: 8267733 - DNA, 19 bp, Homo sapiens
tgtctggaagagctgcagg

SEQ ID NO: 8267734 - DNA, 22 bp, Homo sapiens
tgtttatagggtctgtcacttg

SEQ ID NO: 8267735 - DNA, 22 bp, Homo sapiens
tgtttactcctgatatattttt

SEQ ID NO: 8267736 - DNA, 22 bp, Homo sapiens
tgtttactgcattctatttgct

SEQ ID NO: 8267737 - DNA, 20 bp, Homo sapiens
tgtttactctagagggtaga

SEQ ID NO: 8267738 - DNA, 21 bp, Homo sapiens
tgtttactccctgcaagcacg

SEQ ID NO: 8267739 - DNA, 22 bp, Homo sapiens
tgtggaatgtcctcagcatcct

SEQ ID NO: 8267740 - DNA, 23 bp, Homo sapiens
agcattgatgcaaggtgcccctg

SEQ ID NO: 8267741 - DNA, 22 bp, Homo sapiens
agcattgatttgtgaccaacaa

SEQ ID NO: 8267742 - DNA, 22 bp, Homo sapiens
acagaacaggctgagaaaaaca

SEQ ID NO: 8267743 - DNA, 22 bp, Homo sapiens
agcccaggtctggcccagcctg

SEQ ID NO: 8267744 - DNA, 22 bp, Homo sapiens
agccttacataaacagccttat

SEQ ID NO: 8267745 - DNA, 22 bp, Homo sapiens
acacacatgcctttcctaagta

SEQ ID NO: 8267746 - DNA, 22 bp, Homo sapiens
acacacatggtattgttcagaa

SEQ ID NO: 8267747 - DNA, 21 bp, Homo sapiens
acacactctgagtcttctatt

SEQ ID NO: 8267748 - DNA, 22 bp, Homo sapiens
acacactcaattgcataagcac

SEQ ID NO: 8267749 - DNA, 21 bp, Homo sapiens
acacactgagttttccactgt

SEQ ID NO: 8267750 - DNA, 22 bp, Homo sapiens
acacactggcccccagtactga

SEQ ID NO: 8267751 - DNA, 22 bp, Homo sapiens
acacactgtaaggactatcact

SEQ ID NO: 8267752 - DNA, 22 bp, Homo sapiens
acacactgttgctcatccaggc

SEQ ID NO: 8267753 - DNA, 22 bp, Homo sapiens
acacactttaaattaaacctct

SEQ ID NO: 8267754 - DNA, 22 bp, Homo sapiens
aattcacagttctgcaccttac

SEQ ID NO: 8267755 - DNA, 22 bp, Homo sapiens
acaggtcctcaagtcagctggg

SEQ ID NO: 8267756 - DNA, 22 bp, Homo sapiens
acattctgtcaacagtgagcag

SEQ ID NO: 8267757 - DNA, 22 bp, Homo sapiens
accacagggtaaagttagatat

SEQ ID NO: 8267758 - DNA, 22 bp, Homo sapiens
acataatgagctctttataaat

SEQ ID NO: 8267759 - DNA, 22 bp, Homo sapiens
acattctgaaatccatgtgggt

SEQ ID NO: 8267760 - DNA, 23 bp, Homo sapiens
actcatcttctggtatccacagt

SEQ ID NO: 8267761 - DNA, 22 bp, Homo sapiens
accttgaacacaagaattattg

SEQ ID NO: 8267762 - DNA, 22 bp, Homo sapiens
aaactttaggaaggaatttaca

SEQ ID NO: 8267763 - DNA, 20 bp, Homo sapiens
aaatgccagtgattctgctt

SEQ ID NO: 8267764 - DNA, 22 bp, Homo sapiens
aaatgcctctgggttattctag

SEQ ID NO: 8267765 - DNA, 22 bp, Homo sapiens
aactcaaagatgcatgacgctt

SEQ ID NO: 8267766 - DNA, 22 bp, Homo sapiens
aacatgcaaagctatgatgtat

SEQ ID NO: 8267767 - DNA, 22 bp, Homo sapiens
aacatgcacaattttaggcctg

SEQ ID NO: 8267768 - DNA, 22 bp, Homo sapiens
aacatgcaatgtctgaaaatcc

SEQ ID NO: 8267769 - DNA, 22 bp, Homo sapiens
aacattctactgtactgcattg

SEQ ID NO: 8267770 - DNA, 22 bp, Homo sapiens
aacacatatttatatatgcaca

SEQ ID NO: 8267771 - DNA, 21 bp, Homo sapiens
aacacatccagagtatttgac

SEQ ID NO: 8267772 - DNA, 22 bp, Homo sapiens
aacacataggcagagcatgaca

SEQ ID NO: 8267773 - DNA, 22 bp, Homo sapiens
aacttttcacaggctagctctt

SEQ ID NO: 8267774 - DNA, 22 bp, Homo sapiens
aacttttcattgaatcatgtca

SEQ ID NO: 8267775 - DNA, 22 bp, Homo sapiens
aacttttcataagggcaaattt

SEQ ID NO: 8267776 - DNA, 22 bp, Homo sapiens
aacttttcattccaaaggtgct

SEQ ID NO: 8267777 - DNA, 22 bp, Homo sapiens
aacttttctgtgttgtccggga

SEQ ID NO: 8267778 - DNA, 22 bp, Homo sapiens
aacattctttagctcttcctgc

SEQ ID NO: 8267779 - DNA, 22 bp, Homo sapiens
aacattcttcaaatatcactct

SEQ ID NO: 8267780 - DNA, 22 bp, Homo sapiens
aataaaatggtcagttttctca

SEQ ID NO: 8267781 - DNA, 22 bp, Homo sapiens
aagttctgaagggttctgcaga

SEQ ID NO: 8267782 - DNA, 22 bp, Homo sapiens
aagttctgccaggctgtggcag

SEQ ID NO: 8267783 - DNA, 22 bp, Homo sapiens
aagttctttcagcttagagccc

SEQ ID NO: 8267784 - DNA, 21 bp, Homo sapiens
aaattgccacacatttcttcc

SEQ ID NO: 8267785 - DNA, 22 bp, Homo sapiens
aactttctataggttgggattt

SEQ ID NO: 8267786 - DNA, 22 bp, Homo sapiens
aagacatttatttgaatcaatt

SEQ ID NO: 8267787 - DNA, 22 bp, Homo sapiens
acacacagcgcctaccatgtgc

SEQ ID NO: 8267788 - DNA, 22 bp, Homo sapiens
acacacagagtttatacaggca

SEQ ID NO: 8267789 - DNA, 22 bp, Homo sapiens
acacacagaaggaagccccact

SEQ ID NO: 8267790 - DNA, 22 bp, Homo sapiens
acacacatgcatgcttgccatt

SEQ ID NO: 8267791 - DNA, 22 bp, Homo sapiens
acacacaggtaaaggagcctgg

SEQ ID NO: 8267792 - DNA, 22 bp, Homo sapiens
agctcttccacctcatgatggg

SEQ ID NO: 8267793 - DNA, 22 bp, Homo sapiens
agctctttacacagagtccctc

SEQ ID NO: 8267794 - DNA, 22 bp, Homo sapiens
agctctttagagtctcccttct

SEQ ID NO: 8267795 - DNA, 22 bp, Homo sapiens
agctctttaatcttagccccag

SEQ ID NO: 8267796 - DNA, 22 bp, Homo sapiens
agctctttatgggtaaatgcca

SEQ ID NO: 8267797 - DNA, 15 bp, Homo sapiens
agctctttcagctac

SEQ ID NO: 8267798 - DNA, 22 bp, Homo sapiens
agctctttatgtggaagaggca

SEQ ID NO: 8267799 - DNA, 22 bp, Homo sapiens
agctctttggaaggtgtgcact

SEQ ID NO: 8267800 - DNA, 22 bp, Homo sapiens
agctctttggcactgagcagca

SEQ ID NO: 8267801 - DNA, 19 bp, Homo sapiens
agctctttgctgcattcca

SEQ ID NO: 8267802 - DNA, 22 bp, Homo sapiens
agctctttgctggcagtaggct

SEQ ID NO: 8267803 - DNA, 22 bp, Homo sapiens
agctctttgactaatcttgctt

SEQ ID NO: 8267804 - DNA, 22 bp, Homo sapiens
agctctttgagaaggcagtgtg

SEQ ID NO: 8267805 - DNA, 22 bp, Homo sapiens
agctctttgagcaaggcagctc

SEQ ID NO: 8267806 - DNA, 22 bp, Homo sapiens
agctctttcccctccctatggc

SEQ ID NO: 8267807 - DNA, 22 bp, Homo sapiens
agctctttctacaagcaggcag

SEQ ID NO: 8267808 - DNA, 22 bp, Homo sapiens
agcactgtgatttataacattt

SEQ ID NO: 8267809 - DNA, 22 bp, Homo sapiens
caatactgagtttacattcatc

SEQ ID NO: 8267810 - DNA, 22 bp, Homo sapiens
agacacattttacattaactgt

SEQ ID NO: 8267811 - DNA, 22 bp, Homo sapiens
agactttgagctcttagagaag

SEQ ID NO: 8267812 - DNA, 22 bp, Homo sapiens
attacagatagactttgaagct

SEQ ID NO: 8267813 - DNA, 22 bp, Homo sapiens
attacagattataaatttgagc

SEQ ID NO: 8267814 - DNA, 22 bp, Homo sapiens
attacagaaagcaatattgagt

SEQ ID NO: 8267815 - DNA, 22 bp, Homo sapiens
agagtcccagggacactccaga

SEQ ID NO: 8267816 - DNA, 22 bp, Homo sapiens
acatacacaagcgtacatgaac

SEQ ID NO: 8267817 - DNA, 22 bp, Homo sapiens
acatacacatgaatatattttt

SEQ ID NO: 8267818 - DNA, 23 bp, Homo sapiens
acatacatggagataaagtgatg

SEQ ID NO: 8267819 - DNA, 21 bp, Homo sapiens
acatacataccttaccacctt

SEQ ID NO: 8267820 - DNA, 21 bp, Homo sapiens
aggaggggtctttcccactga

SEQ ID NO: 8267821 - DNA, 22 bp, Homo sapiens
aggaggggttctcgggtgctga

SEQ ID NO: 8267822 - DNA, 22 bp, Homo sapiens
aggagactcagagacctggccg

SEQ ID NO: 8267823 - DNA, 22 bp, Homo sapiens
accaagagtccaagtgaggttg

SEQ ID NO: 8267824 - DNA, 20 bp, Homo sapiens
accccacagagtccattgca

SEQ ID NO: 8267825 - DNA, 19 bp, Homo sapiens
acattcccatcagcaatgt

SEQ ID NO: 8267826 - DNA, 22 bp, Homo sapiens
acattctttctcttcaggaaac

SEQ ID NO: 8267827 - DNA, 19 bp, Homo sapiens
acattgaattttcttcttt

SEQ ID NO: 8267828 - DNA, 22 bp, Homo sapiens
acattgaagctgtgaaatcaaa

SEQ ID NO: 8267829 - DNA, 22 bp, Homo sapiens
acattgaagggaatgcaaagat

SEQ ID NO: 8267830 - DNA, 22 bp, Homo sapiens
acattgaagggctatccaatag

SEQ ID NO: 8267831 - DNA, 22 bp, Homo sapiens
acattgaagtgtctggcctcct

SEQ ID NO: 8267832 - DNA, 22 bp, Homo sapiens
acattgaatttcacttttgtac

SEQ ID NO: 8267833 - DNA, 22 bp, Homo sapiens
acattgaattcaaaattactga

SEQ ID NO: 8267834 - DNA, 22 bp, Homo sapiens
acattgaatgtatgtgatgaaa

SEQ ID NO: 8267835 - DNA, 22 bp, Homo sapiens
acattgaacatggcaggacatt

SEQ ID NO: 8267836 - DNA, 22 bp, Homo sapiens
acattgaacagtacaaatgatc

SEQ ID NO: 8267837 - DNA, 22 bp, Homo sapiens
acattgaaagcatattatctcc

SEQ ID NO: 8267838 - DNA, 22 bp, Homo sapiens
acattgaaccagtagacacaaa

SEQ ID NO: 8267839 - DNA, 22 bp, Homo sapiens
acattgaactacttgtaatgag

SEQ ID NO: 8267840 - DNA, 22 bp, Homo sapiens
accttcgtttcccactttgtaa

SEQ ID NO: 8267841 - DNA, 22 bp, Homo sapiens
agtagaaagttgcaggaggaat

SEQ ID NO: 8267842 - DNA, 22 bp, Homo sapiens
actgccaatggtagtttgatgg

SEQ ID NO: 8267843 - DNA, 22 bp, Homo sapiens
actgagagtcaagatagcatgg

SEQ ID NO: 8267844 - DNA, 22 bp, Homo sapiens
atccccacgatatagccaaagc

SEQ ID NO: 8267845 - DNA, 22 bp, Homo sapiens
atcccacacccctacaacatat

SEQ ID NO: 8267846 - DNA, 22 bp, Homo sapiens
acttttcccttggtagagttgc

SEQ ID NO: 8267847 - DNA, 21 bp, Homo sapiens
atatttttgtttggactgtca

SEQ ID NO: 8267848 - DNA, 22 bp, Homo sapiens
actgtttcagtttctgaagttt

SEQ ID NO: 8267849 - DNA, 22 bp, Homo sapiens
acttaaaaagaatcttttcacg

SEQ ID NO: 8267850 - DNA, 22 bp, Homo sapiens
actttaaggaggcactcatctc

SEQ ID NO: 8267851 - DNA, 22 bp, Homo sapiens
agtgaggggattcaggcaaggt

SEQ ID NO: 8267852 - DNA, 22 bp, Homo sapiens
agtgagggactccatgactcct

SEQ ID NO: 8267853 - DNA, 22 bp, Homo sapiens
ctatgacacaggccattatata

SEQ ID NO: 8267854 - DNA, 22 bp, Homo sapiens
agtagaaatgtagtgtagagaa

SEQ ID NO: 8267855 - DNA, 22 bp, Homo sapiens
agggttttgtgaggctcaaact

SEQ ID NO: 8267856 - DNA, 22 bp, Homo sapiens
agggttttgtttcttgaagcac

SEQ ID NO: 8267857 - DNA, 22 bp, Homo sapiens
agggttttcatttctgagcatt

SEQ ID NO: 8267858 - DNA, 22 bp, Homo sapiens
agggttttggctgaagttcagc

SEQ ID NO: 8267859 - DNA, 21 bp, Homo sapiens
agggttttatagatctcttcc

SEQ ID NO: 8267860 - DNA, 22 bp, Homo sapiens
agggttgcatttttagaggctc

SEQ ID NO: 8267861 - DNA, 22 bp, Homo sapiens
ataaagctttgaaatggagata

SEQ ID NO: 8267862 - DNA, 22 bp, Homo sapiens
ataaagctcttagtagcagcct

SEQ ID NO: 8267863 - DNA, 22 bp, Homo sapiens
ataaagcttctgagtctagatc

SEQ ID NO: 8267864 - DNA, 22 bp, Homo sapiens
ataaagctaagacttacatgaa

SEQ ID NO: 8267865 - DNA, 22 bp, Homo sapiens
ataaagctattcctctcttttt

SEQ ID NO: 8267866 - DNA, 20 bp, Homo sapiens
atacacatgcagacagatgc

SEQ ID NO: 8267867 - DNA, 22 bp, Homo sapiens
ctggcctcagagggtcatggtg

SEQ ID NO: 8267868 - DNA, 22 bp, Homo sapiens
atctgtcttttattcatgagct

SEQ ID NO: 8267869 - DNA, 22 bp, Homo sapiens
ctgtaatcccagctacctggga

SEQ ID NO: 8267870 - DNA, 22 bp, Homo sapiens
ctgtaatcccagctactcggga

SEQ ID NO: 8267871 - DNA, 22 bp, Homo sapiens
atcacagagctcccttccactg

SEQ ID NO: 8267872 - DNA, 22 bp, Homo sapiens
atcacagagattgcttttaaaa

SEQ ID NO: 8267873 - DNA, 22 bp, Homo sapiens
atcacaatgtacgttaaaatgt

SEQ ID NO: 8267874 - DNA, 23 bp, Homo sapiens
aggataaactaaactcattttgg

SEQ ID NO: 8267875 - DNA, 22 bp, Homo sapiens
aggataaaggtcattattccca

SEQ ID NO: 8267876 - DNA, 22 bp, Homo sapiens
aggagtgggggcgagaagttaa

SEQ ID NO: 8267877 - DNA, 22 bp, Homo sapiens
aggagggtggcctcatgtgagt

SEQ ID NO: 8267878 - DNA, 22 bp, Homo sapiens
aggaaaagtgtgaagtatggag

SEQ ID NO: 8267879 - DNA, 22 bp, Homo sapiens
cagggttggggtagataagaaa

SEQ ID NO: 8267880 - DNA, 22 bp, Homo sapiens
cagggttgtcagtgtttcaggt

SEQ ID NO: 8267881 - DNA, 22 bp, Homo sapiens
cagggttgatgaattgtctgta

SEQ ID NO: 8267882 - DNA, 22 bp, Homo sapiens
cagggttgattccttctgaggg

SEQ ID NO: 8267883 - DNA, 22 bp, Homo sapiens
cagggttgcatgcatctgtggg

SEQ ID NO: 8267884 - DNA, 20 bp, Homo sapiens
agctctttttagctaaggta

SEQ ID NO: 8267885 - DNA, 22 bp, Homo sapiens
agctcttttatcatgaggagag

SEQ ID NO: 8267886 - DNA, 22 bp, Homo sapiens
agctcttttgattctccctgtc

SEQ ID NO: 8267887 - DNA, 22 bp, Homo sapiens
agctcttttgtgagcatttggc

SEQ ID NO: 8267888 - DNA, 22 bp, Homo sapiens
agctcttttgctctccaagttt

SEQ ID NO: 8267889 - DNA, 22 bp, Homo sapiens
aggctgaggatccctgtgttct

SEQ ID NO: 8267890 - DNA, 22 bp, Homo sapiens
ccatttaacacagagttttcca

SEQ ID NO: 8267891 - DNA, 22 bp, Homo sapiens
cccatctcagtcgtgctaaggg

SEQ ID NO: 8267892 - DNA, 22 bp, Homo sapiens
gcccagccacagtcactttcat

SEQ ID NO: 8267893 - DNA, 20 bp, Homo sapiens
caaatccctgctctgtgctg

SEQ ID NO: 8267894 - DNA, 22 bp, Homo sapiens
caaatattccaggtacatccct

SEQ ID NO: 8267895 - DNA, 22 bp, Homo sapiens
gctcaaaggttgatagctgtgc

SEQ ID NO: 8267896 - DNA, 22 bp, Homo sapiens
gaaaatctgcttatattatttt

SEQ ID NO: 8267897 - DNA, 19 bp, Homo sapiens
gaacaatttgttagctctc

SEQ ID NO: 8267898 - DNA, 22 bp, Homo sapiens
gacccggctccaggcccagcag

SEQ ID NO: 8267899 - DNA, 22 bp, Homo sapiens
gactttctgagtcaaagaaagg

SEQ ID NO: 8267900 - DNA, 22 bp, Homo sapiens
gactttctgatgtaaacattta

SEQ ID NO: 8267901 - DNA, 22 bp, Homo sapiens
gactttcttgcagaaatattcc

SEQ ID NO: 8267902 - DNA, 22 bp, Homo sapiens
gtaagcagaggttaatgttaac

SEQ ID NO: 8267903 - DNA, 22 bp, Homo sapiens
gtcctctgttagaaatgtgctt

SEQ ID NO: 8267904 - DNA, 22 bp, Homo sapiens
gtcctctgtttccatctgactt

SEQ ID NO: 8267905 - DNA, 22 bp, Homo sapiens
gtcctctgtgtaggctgcagac

SEQ ID NO: 8267906 - DNA, 22 bp, Homo sapiens
cacaggagagctgggaggtgcc

SEQ ID NO: 8267907 - DNA, 22 bp, Homo sapiens
cacagagacagaagcacttatg

SEQ ID NO: 8267908 - DNA, 22 bp, Homo sapiens
caaattccattcatgctccctt

SEQ ID NO: 8267909 - DNA, 22 bp, Homo sapiens
caagttgtttaggaggtgttgt

SEQ ID NO: 8267910 - DNA, 22 bp, Homo sapiens
cagaacattcactcatatgtgg

SEQ ID NO: 8267911 - DNA, 20 bp, Homo sapiens
cagaacatgagcatcgagcc

SEQ ID NO: 8267912 - DNA, 22 bp, Homo sapiens
cagaacattgttttctcatctg

SEQ ID NO: 8267913 - DNA, 22 bp, Homo sapiens
cactgtccctgtttcctggaaa

SEQ ID NO: 8267914 - DNA, 22 bp, Homo sapiens
cactgtccatgcttgctaaccc

SEQ ID NO: 8267915 - DNA, 22 bp, Homo sapiens
cactgtccaatagatacataat

SEQ ID NO: 8267916 - DNA, 23 bp, Homo sapiens
cacatgcaggcagtggccttcaa

SEQ ID NO: 8267917 - DNA, 22 bp, Homo sapiens
cacatgcagtttacgtcactga

SEQ ID NO: 8267918 - DNA, 22 bp, Homo sapiens
cacatgcatctgtcatgtttgg

SEQ ID NO: 8267919 - DNA, 22 bp, Homo sapiens
cacatgcatcacgacttccttt

SEQ ID NO: 8267920 - DNA, 21 bp, Homo sapiens
cacatgcatgcacaggttgta

SEQ ID NO: 8267921 - DNA, 22 bp, Homo sapiens
cacatgcattggcaaaagtgta

SEQ ID NO: 8267922 - DNA, 22 bp, Homo sapiens
cacatgcatgccaggctcacag

SEQ ID NO: 8267923 - DNA, 22 bp, Homo sapiens
cacatgcataaggataattact

SEQ ID NO: 8267924 - DNA, 22 bp, Homo sapiens
cacatgcagttttccagcagtc

SEQ ID NO: 8267925 - DNA, 22 bp, Homo sapiens
cacatgcatacctatgtgtata

SEQ ID NO: 8267926 - DNA, 22 bp, Homo sapiens
tacacagaacctggtgtacagt

SEQ ID NO: 8267927 - DNA, 22 bp, Homo sapiens
tacacagatatgtgatcaatca

SEQ ID NO: 8267928 - DNA, 22 bp, Homo sapiens
tacacagactcttcaattcaga

SEQ ID NO: 8267929 - DNA, 22 bp, Homo sapiens
tacacagatttcagtatcatca

SEQ ID NO: 8267930 - DNA, 22 bp, Homo sapiens
cagtgaaatagtggacatcaaa

SEQ ID NO: 8267931 - DNA, 22 bp, Homo sapiens
tcaaatgctctttgcagagagg

SEQ ID NO: 8267932 - DNA, 22 bp, Homo sapiens
tcaaatgcggtcatggctttta

SEQ ID NO: 8267933 - DNA, 22 bp, Homo sapiens
tcaaatgctcagactcctgtgg

SEQ ID NO: 8267934 - DNA, 22 bp, Homo sapiens
cagtcccatgagcccagaacat

SEQ ID NO: 8267935 - DNA, 22 bp, Homo sapiens
tattcccagcctctttctatct

SEQ ID NO: 8267936 - DNA, 22 bp, Homo sapiens
tattcccattccacttatcaag

SEQ ID NO: 8267937 - DNA, 20 bp, Homo sapiens
tcacacatggtaagctatga

SEQ ID NO: 8267938 - DNA, 22 bp, Homo sapiens
tcacacatttctcaagtgtagg

SEQ ID NO: 8267939 - DNA, 22 bp, Homo sapiens
tatgatgactctagataaagtc

SEQ ID NO: 8267940 - DNA, 22 bp, Homo sapiens
tcctgagggactggttcctcgc

SEQ ID NO: 8267941 - DNA, 22 bp, Homo sapiens
ccaccccaaatgaagacctctc

SEQ ID NO: 8267942 - DNA, 22 bp, Homo sapiens
tcatcacatgtgtagtcatccc

SEQ ID NO: 8267943 - DNA, 22 bp, Homo sapiens
tcatcacatatgtcatgatttg

SEQ ID NO: 8267944 - DNA, 22 bp, Homo sapiens
tcatcacaattttatgaccctc

SEQ ID NO: 8267945 - DNA, 17 bp, Homo sapiens
catccgtgagctcggca

SEQ ID NO: 8267946 - DNA, 19 bp, Homo sapiens
catctatcctcattctctg

SEQ ID NO: 8267947 - DNA, 22 bp, Homo sapiens
tcaggctgcccgttcagggctc

SEQ ID NO: 8267948 - DNA, 22 bp, Homo sapiens
cattacaaccccaaattacaaa

SEQ ID NO: 8267949 - DNA, 22 bp, Homo sapiens
tgcaggaatattgatgaactta

SEQ ID NO: 8267950 - DNA, 22 bp, Homo sapiens
tgcaggaatagctacagagctg

SEQ ID NO: 8267951 - DNA, 22 bp, Homo sapiens
tgcagagagatcctcagggttt

SEQ ID NO: 8267952 - DNA, 22 bp, Homo sapiens
tgcagagagacccctgggccag

SEQ ID NO: 8267953 - DNA, 22 bp, Homo sapiens
tgcagagaagaggacagttcta

SEQ ID NO: 8267954 - DNA, 22 bp, Homo sapiens
ccatcacagtccccatcgtgat

SEQ ID NO: 8267955 - DNA, 22 bp, Homo sapiens
ccatacacacaccaaatttgta

SEQ ID NO: 8267956 - DNA, 17 bp, Homo sapiens
ccatactgacatattga

SEQ ID NO: 8267957 - DNA, 17 bp, Homo sapiens
tgaagttaggctgcaga

SEQ ID NO: 8267958 - DNA, 22 bp, Homo sapiens
tggggagcacggtagggaaatg

SEQ ID NO: 8267959 - DNA, 22 bp, Homo sapiens
tggcagagaacacacatgattc

SEQ ID NO: 8267960 - DNA, 22 bp, Homo sapiens
tggcacagtcctgggtgcctgc

SEQ ID NO: 8267961 - DNA, 22 bp, Homo sapiens
cttacacagtctggcacttctt

SEQ ID NO: 8267962 - DNA, 22 bp, Homo sapiens
cttttgatggagttcaagaagc

SEQ ID NO: 8267963 - DNA, 22 bp, Homo sapiens
cttttgattgagcagtttcaaa

SEQ ID NO: 8267964 - DNA, 22 bp, Homo sapiens
cttttcttctcacggctgtcag

SEQ ID NO: 8267965 - DNA, 22 bp, Homo sapiens
cttttcttactcccgcaaggca

SEQ ID NO: 8267966 - DNA, 22 bp, Homo sapiens
cttttcttatgtggacgtacct

SEQ ID NO: 8267967 - DNA, 23 bp, Homo sapiens
gaaagctctctcctcaggacctt

SEQ ID NO: 8267968 - DNA, 22 bp, Homo sapiens
gacacttcacctttcccagcct

SEQ ID NO: 8267969 - DNA, 22 bp, Homo sapiens
gaatcatttatttttgacagca

SEQ ID NO: 8267970 - DNA, 22 bp, Homo sapiens
gaatcattcattgctcaattaa

SEQ ID NO: 8267971 - DNA, 22 bp, Homo sapiens
gaaagctctgcttcagcctgca

SEQ ID NO: 8267972 - DNA, 22 bp, Homo sapiens
gagacctcttggtatcgctagg

SEQ ID NO: 8267973 - DNA, 22 bp, Homo sapiens
gagctgaggatacatcagtgaa

SEQ ID NO: 8267974 - DNA, 22 bp, Homo sapiens
gaggagaggctggacgcggtga

SEQ ID NO: 8267975 - DNA, 22 bp, Homo sapiens
ctctaggggctggtcagcgtct

SEQ ID NO: 8267976 - DNA, 19 bp, Homo sapiens
ctctagggtctaagggcag

SEQ ID NO: 8267977 - DNA, 22 bp, Homo sapiens
ctctagggaagaatgagagccc

SEQ ID NO: 8267978 - DNA, 22 bp, Homo sapiens
tttctctccccaagtggaattg

SEQ ID NO: 8267979 - DNA, 22 bp, Homo sapiens
ctcgggttgtaagtatctatta

SEQ ID NO: 8267980 - DNA, 22 bp, Homo sapiens
ttttctctacaaaataaccagc

SEQ ID NO: 8267981 - DNA, 22 bp, Homo sapiens
tttttcttgtgctggatctaat

SEQ ID NO: 8267982 - DNA, 22 bp, Homo sapiens
ctgagagatcaagccacaggat

SEQ ID NO: 8267983 - DNA, 22 bp, Homo sapiens
ctgcagtctacctggattttta

SEQ ID NO: 8267984 - DNA, 21 bp, Homo sapiens
tgttttctaaagggcggatca

SEQ ID NO: 8267985 - DNA, 22 bp, Homo sapiens
tgttttctattacctgagattg

SEQ ID NO: 8267986 - DNA, 22 bp, Homo sapiens
tgttttctagaaacaatgccta

SEQ ID NO: 8267987 - DNA, 22 bp, Homo sapiens
ttaaaatcgctgttgcttctgt

SEQ ID NO: 8267988 - DNA, 22 bp, Homo sapiens
ttaaaatctaaagcagttgtct

SEQ ID NO: 8267989 - DNA, 22 bp, Homo sapiens
ttattattgtggttgcattatc

SEQ ID NO: 8267990 - DNA, 22 bp, Homo sapiens
ttatttttaaaagttcacacag

SEQ ID NO: 8267991 - DNA, 17 bp, Homo sapiens
cctttcttcccagaggg

SEQ ID NO: 8267992 - DNA, 22 bp, Homo sapiens
cctttcttttatccaccagcca

SEQ ID NO: 8267993 - DNA, 22 bp, Homo sapiens
ccttcttctgtgtggcccaaga

SEQ ID NO: 8267994 - DNA, 22 bp, Homo sapiens
ctcagccccaattctccccatt

SEQ ID NO: 8267995 - DNA, 22 bp, Homo sapiens
ttccacattccttacattcata

SEQ ID NO: 8267996 - DNA, 22 bp, Homo sapiens
ttccaccattcatgctaatatt

SEQ ID NO: 8267997 - DNA, 23 bp, Homo sapiens
gtgatattaaggatagagacaag

SEQ ID NO: 8267998 - DNA, 22 bp, Homo sapiens
gtagaggggtgattctgtgaga

SEQ ID NO: 8267999 - DNA, 22 bp, Homo sapiens
gtaagtttttccctagatgtag

SEQ ID NO: 8268000 - DNA, 22 bp, Homo sapiens
gtcctctgactcagccttggga

SEQ ID NO: 8268001 - DNA, 22 bp, Homo sapiens
gtcctctgcccaggtcaaggtt

SEQ ID NO: 8268002 - DNA, 22 bp, Homo sapiens
gtcctctgatttctaggtatat

SEQ ID NO: 8268003 - DNA, 22 bp, Homo sapiens
gtcctctgagggggctgcacgc

SEQ ID NO: 8268004 - DNA, 22 bp, Homo sapiens
gtcctctgaagttgtgcaatgc

SEQ ID NO: 8268005 - DNA, 22 bp, Homo sapiens
gtcctctgaaagatgaaccatg

SEQ ID NO: 8268006 - DNA, 22 bp, Homo sapiens
ggtgaagggccttaggagacag

SEQ ID NO: 8268007 - DNA, 22 bp, Homo sapiens
ggtctttctttgatagtggaga

SEQ ID NO: 8268008 - DNA, 22 bp, Homo sapiens
gggagggaggtgatgcttggct

SEQ ID NO: 8268009 - DNA, 18 bp, Homo sapiens
ggctgaggttgactagaa

SEQ ID NO: 8268010 - DNA, 22 bp, Homo sapiens
ggatgaggaagattactgagaa

SEQ ID NO: 8268011 - DNA, 23 bp, Homo sapiens
ggacactgctataaaggatctgc

SEQ ID NO: 8268012 - DNA, 23 bp, Homo sapiens
ggacacatttatttcagaattca

SEQ ID NO: 8268013 - DNA, 22 bp, Homo sapiens
gctcaccttcgtccagcagccg

SEQ ID NO: 8268014 - DNA, 22 bp, Homo sapiens
gcagtcctgggattctgtcctt

SEQ ID NO: 8268015 - DNA, 22 bp, Homo sapiens
tagcagtgccctgtggaataag

SEQ ID NO: 8268016 - DNA, 22 bp, Homo sapiens
tactttctaagacatacaactt

SEQ ID NO: 8268017 - DNA, 22 bp, Homo sapiens
tattgcatattgtacttgaatg

SEQ ID NO: 8268018 - DNA, 22 bp, Homo sapiens
tatctgtcgcatacatacttgg

SEQ ID NO: 8268019 - DNA, 22 bp, Homo sapiens
tatctgtctaatgggcagcaga

SEQ ID NO: 8268020 - DNA, 22 bp, Homo sapiens
gttttattggaacacagccatg

SEQ ID NO: 8268021 - DNA, 22 bp, Homo sapiens
gttttatttccatgagagaccg

SEQ ID NO: 8268022 - DNA, 22 bp, Homo sapiens
gtttacttgtgccttggcttaa

SEQ ID NO: 8268023 - DNA, 22 bp, Homo sapiens
gtttacttagatgctcatgcag

SEQ ID NO: 8268024 - DNA, 22 bp, Homo sapiens
tacacatcactgtatctttcag

SEQ ID NO: 8268025 - DNA, 22 bp, Homo sapiens
tacacatcccagactcccagga

SEQ ID NO: 8268026 - DNA, 22 bp, Homo sapiens
tacacatccatgttttgacttt

SEQ ID NO: 8268027 - DNA, 22 bp, Homo sapiens
tacacatctctgtcagtagtga

SEQ ID NO: 8268028 - DNA, 22 bp, Homo sapiens
tactgacacaaagccaatccct

SEQ ID NO: 8268029 - DNA, 22 bp, Homo sapiens
tcagttttctcatctgtaattt

SEQ ID NO: 8268030 - DNA, 22 bp, Homo sapiens
tcatctatttatgtagaacaag

SEQ ID NO: 8268031 - DNA, 22 bp, Homo sapiens
tcacacatctcaggtgtttaat

SEQ ID NO: 8268032 - DNA, 16 bp, Homo sapiens
tcacatacttccttgc

SEQ ID NO: 8268033 - DNA, 22 bp, Homo sapiens
tcacacacatggatagtatttt

SEQ ID NO: 8268034 - DNA, 22 bp, Homo sapiens
tcacacacatttgctgtctgat

SEQ ID NO: 8268035 - DNA, 21 bp, Homo sapiens
tcacacacgtttccaagggca

SEQ ID NO: 8268036 - DNA, 22 bp, Homo sapiens
tcacacacataatctaagatta

SEQ ID NO: 8268037 - DNA, 22 bp, Homo sapiens
tcacacagctcctttccttagt

SEQ ID NO: 8268038 - DNA, 22 bp, Homo sapiens
tcacacagctgacagagccttt

SEQ ID NO: 8268039 - DNA, 23 bp, Homo sapiens
tccctgtgtacagcctgcatgag

SEQ ID NO: 8268040 - DNA, 21 bp, Homo sapiens
tcccttgggaaactttcttga

SEQ ID NO: 8268041 - DNA, 22 bp, Homo sapiens
tccacacacatttctatgtgca

SEQ ID NO: 8268042 - DNA, 22 bp, Homo sapiens
tcccacatatgcaatcctgaat

SEQ ID NO: 8268043 - DNA, 22 bp, Homo sapiens
tttgggaaagtgtcttttgtat

SEQ ID NO: 8268044 - DNA, 22 bp, Homo sapiens
tttgaaatctaatcaaggaaca

SEQ ID NO: 8268045 - DNA, 22 bp, Homo sapiens
tttgaagaccttatctctaaat

SEQ ID NO: 8268046 - DNA, 22 bp, Homo sapiens
ttttattgtctgtattgcctat

SEQ ID NO: 8268047 - DNA, 16 bp, Homo sapiens
ttttattgtgacagcc

SEQ ID NO: 8268048 - DNA, 22 bp, Homo sapiens
ttttattgtctcccagttctgg

SEQ ID NO: 8268049 - DNA, 22 bp, Homo sapiens
ttttattgtcaatgaagacaga

SEQ ID NO: 8268050 - DNA, 22 bp, Homo sapiens
ttttattggtaatgataaaagt

SEQ ID NO: 8268051 - DNA, 22 bp, Homo sapiens
ttttattgggagtcctctactg

SEQ ID NO: 8268052 - DNA, 22 bp, Homo sapiens
ttgagggtctggatctgctgct

SEQ ID NO: 8268053 - DNA, 22 bp, Homo sapiens
ttcatagatctcaattttgagg

SEQ ID NO: 8268054 - DNA, 22 bp, Homo sapiens
tttatgaaccactctacacctt

SEQ ID NO: 8268055 - DNA, 22 bp, Homo sapiens
tttcctttgggagcatgaattt

SEQ ID NO: 8268056 - DNA, 22 bp, Homo sapiens
tttcaagtagccctggctccca

SEQ ID NO: 8268057 - DNA, 22 bp, Homo sapiens
actaaatggaatgattactata

SEQ ID NO: 8268058 - DNA, 22 bp, Homo sapiens
agaaaaatcttggcgcttgtct

SEQ ID NO: 8268059 - DNA, 22 bp, Homo sapiens
aaggctcttggagtgaatgcag

SEQ ID NO: 8268060 - DNA, 22 bp, Homo sapiens
aagctcttgaagaccaccagga

SEQ ID NO: 8268061 - DNA, 22 bp, Homo sapiens
aagctcttctgtggatttgagt

SEQ ID NO: 8268062 - DNA, 22 bp, Homo sapiens
aagctcttcttgccaccattca

SEQ ID NO: 8268063 - DNA, 21 bp, Homo sapiens
aagctcttctcagggtcacct

SEQ ID NO: 8268064 - DNA, 22 bp, Homo sapiens
aagctcttcctggagcgcccac

SEQ ID NO: 8268065 - DNA, 22 bp, Homo sapiens
aagctcttcctgcagggacctt

SEQ ID NO: 8268066 - DNA, 22 bp, Homo sapiens
acagtagattggtatgatgtca

SEQ ID NO: 8268067 - DNA, 22 bp, Homo sapiens
acagtagagtaaatggttagat

SEQ ID NO: 8268068 - DNA, 19 bp, Homo sapiens
aatgtttaagagaaaaagg

SEQ ID NO: 8268069 - DNA, 22 bp, Homo sapiens
aatgtttaatgttagtggtaat

SEQ ID NO: 8268070 - DNA, 22 bp, Homo sapiens
acaattctgatggtttcccagt

SEQ ID NO: 8268071 - DNA, 22 bp, Homo sapiens
acacataagaaactacaaagag

SEQ ID NO: 8268072 - DNA, 23 bp, Homo sapiens
acactgtctcatggatagactgc

SEQ ID NO: 8268073 - DNA, 22 bp, Homo sapiens
acacattatctcattaaatact

SEQ ID NO: 8268074 - DNA, 22 bp, Homo sapiens
acacatttgcataatacctcat

SEQ ID NO: 8268075 - DNA, 19 bp, Homo sapiens
acacatttgcacaatccac

SEQ ID NO: 8268076 - DNA, 22 bp, Homo sapiens
agccatcgccgcaggcatctgc

SEQ ID NO: 8268077 - DNA, 22 bp, Homo sapiens
aagctgagccagtggcaagtgc

SEQ ID NO: 8268078 - DNA, 22 bp, Homo sapiens
aagctgaggatacatgaagcct

SEQ ID NO: 8268079 - DNA, 22 bp, Homo sapiens
aagctgaggcccatggcaaggt

SEQ ID NO: 8268080 - DNA, 22 bp, Homo sapiens
aacatgcacatcatagctcgtg

SEQ ID NO: 8268081 - DNA, 22 bp, Homo sapiens
aacatgcaggttttagggttgc

SEQ ID NO: 8268082 - DNA, 22 bp, Homo sapiens
aacatgcagtgagccgatgagg

SEQ ID NO: 8268083 - DNA, 22 bp, Homo sapiens
aacatgcagattccccgggccc

SEQ ID NO: 8268084 - DNA, 22 bp, Homo sapiens
aacatgcatataggtaaatgga

SEQ ID NO: 8268085 - DNA, 22 bp, Homo sapiens
aacatgcatgaagaagttatat

SEQ ID NO: 8268086 - DNA, 22 bp, Homo sapiens
aacatgcatgttatttatcagt

SEQ ID NO: 8268087 - DNA, 18 bp, Homo sapiens
aacatgcattagaactgc

SEQ ID NO: 8268088 - DNA, 22 bp, Homo sapiens
aacatgcatttgtgggatggaa

SEQ ID NO: 8268089 - DNA, 22 bp, Homo sapiens
aatagttgtagtatctatctcg

SEQ ID NO: 8268090 - DNA, 22 bp, Homo sapiens
aatcattcttatttcacagcaa

SEQ ID NO: 8268091 - DNA, 22 bp, Homo sapiens
aattggctttgagaagtttgag

SEQ ID NO: 8268092 - DNA, 22 bp, Homo sapiens
aagagaggacatggtgaacctg

SEQ ID NO: 8268093 - DNA, 17 bp, Homo sapiens
aagagaggctgagctgg

SEQ ID NO: 8268094 - DNA, 22 bp, Homo sapiens
acaaggaggatatgtttaaggg

SEQ ID NO: 8268095 - DNA, 22 bp, Homo sapiens
aaattacagatcaccaatgcat

SEQ ID NO: 8268096 - DNA, 22 bp, Homo sapiens
aaagaatcagaagtctcaaaca

SEQ ID NO: 8268097 - DNA, 22 bp, Homo sapiens
aaaccttaaaccaagctcttga

SEQ ID NO: 8268098 - DNA, 22 bp, Homo sapiens
aaaatctcattatcaggaaggg

SEQ ID NO: 8268099 - DNA, 22 bp, Homo sapiens
aaaaatctatgactgcttctcc

SEQ ID NO: 8268100 - DNA, 22 bp, Homo sapiens
aagctcttttcaccattaaagt

SEQ ID NO: 8268101 - DNA, 22 bp, Homo sapiens
aagctcttttcataagagcaaa

SEQ ID NO: 8268102 - DNA, 22 bp, Homo sapiens
aagctctttgacctgggcctgg

SEQ ID NO: 8268103 - DNA, 22 bp, Homo sapiens
aagctcttttacaatcctaggc

SEQ ID NO: 8268104 - DNA, 22 bp, Homo sapiens
aagctctttccactaaaccact

SEQ ID NO: 8268105 - DNA, 22 bp, Homo sapiens
aagctctttccctcttcagaac

SEQ ID NO: 8268106 - DNA, 22 bp, Homo sapiens
aagctcttgagtaaactagttt

SEQ ID NO: 8268107 - DNA, 22 bp, Homo sapiens
aagctcttgaatgggatcaagg

SEQ ID NO: 8268108 - DNA, 22 bp, Homo sapiens
aagctcttgttgaatcttgtca

SEQ ID NO: 8268109 - DNA, 22 bp, Homo sapiens
aagctctttaatagtctaaaaa

SEQ ID NO: 8268110 - DNA, 22 bp, Homo sapiens
aagctcttttctgcctcaccca

SEQ ID NO: 8268111 - DNA, 20 bp, Homo sapiens
aagcatctggatgtagcaat

SEQ ID NO: 8268112 - DNA, 22 bp, Homo sapiens
aaatctcaaaggcttagcatct

SEQ ID NO: 8268113 - DNA, 22 bp, Homo sapiens
aaatagattgctgaggcattac

SEQ ID NO: 8268114 - DNA, 22 bp, Homo sapiens
aaagctcttatagcagagtgtg

SEQ ID NO: 8268115 - DNA, 22 bp, Homo sapiens
aaagctcttatgtaaacagaaa

SEQ ID NO: 8268116 - DNA, 22 bp, Homo sapiens
aaagctcttggattttagactc

SEQ ID NO: 8268117 - DNA, 22 bp, Homo sapiens
aaagctctttgtatagtggaat

SEQ ID NO: 8268118 - DNA, 22 bp, Homo sapiens
aaagctctttcttctttggcat

SEQ ID NO: 8268119 - DNA, 22 bp, Homo sapiens
aaagctctttcacttccgttct

SEQ ID NO: 8268120 - DNA, 22 bp, Homo sapiens
aaagctcttgggagggttaatt

SEQ ID NO: 8268121 - DNA, 22 bp, Homo sapiens
aaagctcttttccaagtattga

SEQ ID NO: 8268122 - DNA, 22 bp, Homo sapiens
attttttgttaactcaggatag

SEQ ID NO: 8268123 - DNA, 22 bp, Homo sapiens
atttgcttttactatgttaaaa

SEQ ID NO: 8268124 - DNA, 22 bp, Homo sapiens
agaggtattagatttgcatagg

SEQ ID NO: 8268125 - DNA, 22 bp, Homo sapiens
atttattgaagcttattacgtt

SEQ ID NO: 8268126 - DNA, 22 bp, Homo sapiens
atgtttactggtttatagaata

SEQ ID NO: 8268127 - DNA, 22 bp, Homo sapiens
atgtttacaaaaaggaggcttg

SEQ ID NO: 8268128 - DNA, 22 bp, Homo sapiens
atgtttacaattcagtattaca

SEQ ID NO: 8268129 - DNA, 19 bp, Homo sapiens
atgtttacactcaggggct

SEQ ID NO: 8268130 - DNA, 21 bp, Homo sapiens
atgtttacactgactactgtg

SEQ ID NO: 8268131 - DNA, 22 bp, Homo sapiens
atgtttactgaaaagatttcaa

SEQ ID NO: 8268132 - DNA, 22 bp, Homo sapiens
atgtttacagaggaagtgcctc

SEQ ID NO: 8268133 - DNA, 22 bp, Homo sapiens
agagggacaataagataaaatg

SEQ ID NO: 8268134 - DNA, 22 bp, Homo sapiens
agacatcaatgatcagaggtag

SEQ ID NO: 8268135 - DNA, 22 bp, Homo sapiens
atgcacatgtatgtcaatattt

SEQ ID NO: 8268136 - DNA, 22 bp, Homo sapiens
atgcacataggccaaatcattt

SEQ ID NO: 8268137 - DNA, 22 bp, Homo sapiens
agcacatgcacagtgctacact

SEQ ID NO: 8268138 - DNA, 22 bp, Homo sapiens
cacacactgttaatgtaggagt

SEQ ID NO: 8268139 - DNA, 22 bp, Homo sapiens
cacacactggagcaaggagatg

SEQ ID NO: 8268140 - DNA, 22 bp, Homo sapiens
cacacacagttttgtattctgt

SEQ ID NO: 8268141 - DNA, 22 bp, Homo sapiens
cacacactgacaccttatcttg

SEQ ID NO: 8268142 - DNA, 22 bp, Homo sapiens
cacacactcttcctggcaccta

SEQ ID NO: 8268143 - DNA, 22 bp, Homo sapiens
acatcacagtagttaagccaga

SEQ ID NO: 8268144 - DNA, 22 bp, Homo sapiens
acatcacagagcccagataaag

SEQ ID NO: 8268145 - DNA, 22 bp, Homo sapiens
acatcacacgccttccaggagg

SEQ ID NO: 8268146 - DNA, 22 bp, Homo sapiens
aggacacaccaggtccagctgt

SEQ ID NO: 8268147 - DNA, 22 bp, Homo sapiens
aggacacacagaatacaaatcc

SEQ ID NO: 8268148 - DNA, 22 bp, Homo sapiens
aggacacacagaatacaaatcc

SEQ ID NO: 8268149 - DNA, 22 bp, Homo sapiens
acagttcccgtcttgcacagct

SEQ ID NO: 8268150 - DNA, 20 bp, Homo sapiens
acatagatcagtgattgaca

SEQ ID NO: 8268151 - DNA, 19 bp, Homo sapiens
acctgcagtaataattcct

SEQ ID NO: 8268152 - DNA, 22 bp, Homo sapiens
aggtggagatcagggactaagg

SEQ ID NO: 8268153 - DNA, 21 bp, Homo sapiens
agtgtaggtcattagctgttg

SEQ ID NO: 8268154 - DNA, 22 bp, Homo sapiens
actggaatgaagttaatctgat

SEQ ID NO: 8268155 - DNA, 22 bp, Homo sapiens
actgagggcataaaagtactgt

SEQ ID NO: 8268156 - DNA, 22 bp, Homo sapiens
actgaggaacatatataagatg

SEQ ID NO: 8268157 - DNA, 22 bp, Homo sapiens
atactggagaagccaagaagcc

SEQ ID NO: 8268158 - DNA, 22 bp, Homo sapiens
ataatggccgggggctgaatgc

SEQ ID NO: 8268159 - DNA, 22 bp, Homo sapiens
atacagggacatccagtttttc

SEQ ID NO: 8268160 - DNA, 22 bp, Homo sapiens
agttttctgttctacaatttga

SEQ ID NO: 8268161 - DNA, 22 bp, Homo sapiens
agttttcttcattttgtggcca

SEQ ID NO: 8268162 - DNA, 22 bp, Homo sapiens
agttttctttcatctatcagca

SEQ ID NO: 8268163 - DNA, 22 bp, Homo sapiens
agttttctttcgcaaaggtaca

SEQ ID NO: 8268164 - DNA, 21 bp, Homo sapiens
agttttctgagttataaaata

SEQ ID NO: 8268165 - DNA, 22 bp, Homo sapiens
agttttctgatgtgtagtgaga

SEQ ID NO: 8268166 - DNA, 22 bp, Homo sapiens
agttttctgcctctggatgcgt

SEQ ID NO: 8268167 - DNA, 22 bp, Homo sapiens
agttttctgggatcactggaat

SEQ ID NO: 8268168 - DNA, 19 bp, Homo sapiens
agttttctgtgatccattt

SEQ ID NO: 8268169 - DNA, 22 bp, Homo sapiens
agttttctgctaaaccagctaa

SEQ ID NO: 8268170 - DNA, 22 bp, Homo sapiens
agttttctcacatcaaaaatga

SEQ ID NO: 8268171 - DNA, 22 bp, Homo sapiens
agttttctctgtgttctgctta

SEQ ID NO: 8268172 - DNA, 22 bp, Homo sapiens
agttttctgacccctgctctat

SEQ ID NO: 8268173 - DNA, 22 bp, Homo sapiens
atagggcctaaaaagtattgct

SEQ ID NO: 8268174 - DNA, 22 bp, Homo sapiens
atacatgactcacacattctgc

SEQ ID NO: 8268175 - DNA, 22 bp, Homo sapiens
atattttgaagttaataatgtg

SEQ ID NO: 8268176 - DNA, 22 bp, Homo sapiens
atccttggccctgaatgaagtt

SEQ ID NO: 8268177 - DNA, 22 bp, Homo sapiens
atctcccagccacagcattctt

SEQ ID NO: 8268178 - DNA, 22 bp, Homo sapiens
cgtggaatattataatggcaca

SEQ ID NO: 8268179 - DNA, 22 bp, Homo sapiens
aggtgagggtgccagtgcatgg

SEQ ID NO: 8268180 - DNA, 22 bp, Homo sapiens
aggtggagtgtgcagggagagc

SEQ ID NO: 8268181 - DNA, 22 bp, Homo sapiens
agtccaaagcagatgagggcca

SEQ ID NO: 8268182 - DNA, 19 bp, Homo sapiens
ctgagagatgcttcacaca

SEQ ID NO: 8268183 - DNA, 22 bp, Homo sapiens
aggctcatccccacaaagcaaa

SEQ ID NO: 8268184 - DNA, 20 bp, Homo sapiens
aggctgagggtgattgtgtc

SEQ ID NO: 8268185 - DNA, 22 bp, Homo sapiens
aggctgaggtgtgctgtgatcg

SEQ ID NO: 8268186 - DNA, 22 bp, Homo sapiens
ccctctggctgtgtgttcttag

SEQ ID NO: 8268187 - DNA, 22 bp, Homo sapiens
attttcctctggtttccccaga

SEQ ID NO: 8268188 - DNA, 22 bp, Homo sapiens
atttattggtttgcatggtgaa

SEQ ID NO: 8268189 - DNA, 19 bp, Homo sapiens
atttattgtatgattccat

SEQ ID NO: 8268190 - DNA, 22 bp, Homo sapiens
attccacagctacatcaatcta

SEQ ID NO: 8268191 - DNA, 22 bp, Homo sapiens
attccacacagtaatactcaat

SEQ ID NO: 8268192 - DNA, 22 bp, Homo sapiens
gcagcttcctgagtgtggacag

SEQ ID NO: 8268193 - DNA, 22 bp, Homo sapiens
gattccaaatggagatgtccac

SEQ ID NO: 8268194 - DNA, 22 bp, Homo sapiens
gatggcaggtagtggtctcatc

SEQ ID NO: 8268195 - DNA, 22 bp, Homo sapiens
gcacacaggcagtttccagcca

SEQ ID NO: 8268196 - DNA, 22 bp, Homo sapiens
gcacacagctagattaccattc

SEQ ID NO: 8268197 - DNA, 22 bp, Homo sapiens
ctttattgtccttcttaggtgg

SEQ ID NO: 8268198 - DNA, 19 bp, Homo sapiens
atcttgggaaatggtaact

SEQ ID NO: 8268199 - DNA, 22 bp, Homo sapiens
ctttgcttgacactgtgattgt

SEQ ID NO: 8268200 - DNA, 22 bp, Homo sapiens
atgccactgcactccagcctag

SEQ ID NO: 8268201 - DNA, 22 bp, Homo sapiens
atgccactgcactccagcctgg

SEQ ID NO: 8268202 - DNA, 22 bp, Homo sapiens
gaagctctcaacaatggggagt

SEQ ID NO: 8268203 - DNA, 22 bp, Homo sapiens
gaagctctcaaactctcccctt

SEQ ID NO: 8268204 - DNA, 22 bp, Homo sapiens
gaagctctaaggtcattgcatt

SEQ ID NO: 8268205 - DNA, 22 bp, Homo sapiens
gaagctctggacagtgaagaag

SEQ ID NO: 8268206 - DNA, 22 bp, Homo sapiens
atgcaggagttcgaggctgtat

SEQ ID NO: 8268207 - DNA, 22 bp, Homo sapiens
gaggaggggacagtacttgtgc

SEQ ID NO: 8268208 - DNA, 22 bp, Homo sapiens
atggcagacctcctggccacaa

SEQ ID NO: 8268209 - DNA, 22 bp, Homo sapiens
atggcagacgaggcagcagggg

SEQ ID NO: 8268210 - DNA, 22 bp, Homo sapiens
atgggaggaagagaagatgtct

SEQ ID NO: 8268211 - DNA, 22 bp, Homo sapiens
gtacacactgtttgatcatttc

SEQ ID NO: 8268212 - DNA, 22 bp, Homo sapiens
gtacacactatgtattgtacac

SEQ ID NO: 8268213 - DNA, 22 bp, Homo sapiens
gtacacactatttaaagtgttt

SEQ ID NO: 8268214 - DNA, 22 bp, Homo sapiens
gtcacacagggcctccaaatca

SEQ ID NO: 8268215 - DNA, 22 bp, Homo sapiens
gctgctttggaaagcatggaaa

SEQ ID NO: 8268216 - DNA, 22 bp, Homo sapiens
caagctctttaaacttatgtca

SEQ ID NO: 8268217 - DNA, 22 bp, Homo sapiens
caagctctgggatgcagacatc

SEQ ID NO: 8268218 - DNA, 22 bp, Homo sapiens
caagctctgcgggctccaagat

SEQ ID NO: 8268219 - DNA, 22 bp, Homo sapiens
caagctctgggatagcagagag

SEQ ID NO: 8268220 - DNA, 20 bp, Homo sapiens
cacaactgtccacatgctcc

SEQ ID NO: 8268221 - DNA, 22 bp, Homo sapiens
cacacagtaggcactcattaat

SEQ ID NO: 8268222 - DNA, 21 bp, Homo sapiens
cacacagtgatctatccacat

SEQ ID NO: 8268223 - DNA, 22 bp, Homo sapiens
cacattcctggtgctcagcagc

SEQ ID NO: 8268224 - DNA, 22 bp, Homo sapiens
cacatgcaggagccaatgtaca

SEQ ID NO: 8268225 - DNA, 22 bp, Homo sapiens
cacatgcaccagaaatcaacat

SEQ ID NO: 8268226 - DNA, 22 bp, Homo sapiens
cacatgcaagtcctcagttcta

SEQ ID NO: 8268227 - DNA, 22 bp, Homo sapiens
tagggttgtaatttatgtatgg

SEQ ID NO: 8268228 - DNA, 22 bp, Homo sapiens
tagggtgcttagctgttaacta

SEQ ID NO: 8268229 - DNA, 22 bp, Homo sapiens
tagggtgcgggggtgtcacccg

SEQ ID NO: 8268230 - DNA, 22 bp, Homo sapiens
tcattgaaaactcagcatctac

SEQ ID NO: 8268231 - DNA, 22 bp, Homo sapiens
tcattgaaagtgcctcctcgga

SEQ ID NO: 8268232 - DNA, 19 bp, Homo sapiens
tcattgaacataattactt

SEQ ID NO: 8268233 - DNA, 18 bp, Homo sapiens
tcatgaggtagaggctgg

SEQ ID NO: 8268234 - DNA, 18 bp, Homo sapiens
tcatgaggaaggagaaga

SEQ ID NO: 8268235 - DNA, 22 bp, Homo sapiens
cattgaaacctaacataggctg

SEQ ID NO: 8268236 - DNA, 22 bp, Homo sapiens
cattgaataatgtccttgcaaa

SEQ ID NO: 8268237 - DNA, 22 bp, Homo sapiens
tctccacactttctctcccagg

SEQ ID NO: 8268238 - DNA, 22 bp, Homo sapiens
tctccctctcagatttattcac

SEQ ID NO: 8268239 - DNA, 22 bp, Homo sapiens
tgagagtctcagacctcctggt

SEQ ID NO: 8268240 - DNA, 22 bp, Homo sapiens
tgagagtctgttcctcttgcag

SEQ ID NO: 8268241 - DNA, 22 bp, Homo sapiens
cccacactctgagaaatgctga

SEQ ID NO: 8268242 - DNA, 22 bp, Homo sapiens
cccagcatgcacgctgacactc

SEQ ID NO: 8268243 - DNA, 22 bp, Homo sapiens
cccagcccccgagtgtctggaa

SEQ ID NO: 8268244 - DNA, 22 bp, Homo sapiens
ccctgtggatttcagtttgtgt

SEQ ID NO: 8268245 - DNA, 22 bp, Homo sapiens
tggggtacttgtatcaaagcac

SEQ ID NO: 8268246 - DNA, 22 bp, Homo sapiens
ctgcctttggggagttagaggg

SEQ ID NO: 8268247 - DNA, 22 bp, Homo sapiens
tttgagaagatgtaatgttaag

SEQ ID NO: 8268248 - DNA, 22 bp, Homo sapiens
tttgacttctatctagtaagaa

SEQ ID NO: 8268249 - DNA, 22 bp, Homo sapiens
cgttttcttcactttgcaagtt

SEQ ID NO: 8268250 - DNA, 22 bp, Homo sapiens
ccttttcttgccactgactcgg

SEQ ID NO: 8268251 - DNA, 22 bp, Homo sapiens
cgctgataaacgtcacgttccc

SEQ ID NO: 8268252 - DNA, 23 bp, Homo sapiens
ttattgcatccaaatgcattcct

SEQ ID NO: 8268253 - DNA, 20 bp, Homo sapiens
cggactttcttctcagggca

SEQ ID NO: 8268254 - DNA, 22 bp, Homo sapiens
ctgggaggcggaggttgcagtg

SEQ ID NO: 8268255 - DNA, 22 bp, Homo sapiens
cttttttcctaaggcaacatga

SEQ ID NO: 8268256 - DNA, 22 bp, Homo sapiens
gaggagagaagctaacggtgct

SEQ ID NO: 8268257 - DNA, 22 bp, Homo sapiens
gaggtgagtggatcacgaggtc

SEQ ID NO: 8268258 - DNA, 22 bp, Homo sapiens
gaagaagtatttttgtcctgtt

SEQ ID NO: 8268259 - DNA, 21 bp, Homo sapiens
tcaaatcatgtactgaccaca

SEQ ID NO: 8268260 - DNA, 22 bp, Homo sapiens
tatgtaaagtagatggcaggta

SEQ ID NO: 8268261 - DNA, 22 bp, Homo sapiens
tagagacagaaagtagaatggt

SEQ ID NO: 8268262 - DNA, 22 bp, Homo sapiens
taggggaggccaggaagtttta

SEQ ID NO: 8268263 - DNA, 22 bp, Homo sapiens
taccatttctacatatcttgtc

SEQ ID NO: 8268264 - DNA, 22 bp, Homo sapiens
tacatgcatgtgtgtaaatata

SEQ ID NO: 8268265 - DNA, 22 bp, Homo sapiens
tacatgcatgatacaaagttgc

SEQ ID NO: 8268266 - DNA, 22 bp, Homo sapiens
tacacacagaggccatgggatt

SEQ ID NO: 8268267 - DNA, 22 bp, Homo sapiens
tacacacttactggagatgaag

SEQ ID NO: 8268268 - DNA, 22 bp, Homo sapiens
tacacacatgcatttgccttat

SEQ ID NO: 8268269 - DNA, 22 bp, Homo sapiens
tacacaactgacaaccattctg

SEQ ID NO: 8268270 - DNA, 23 bp, Homo sapiens
taatctcttcaagagaaggggaa

SEQ ID NO: 8268271 - DNA, 22 bp, Homo sapiens
taatctctttatgagaagaagg

SEQ ID NO: 8268272 - DNA, 22 bp, Homo sapiens
taatctcttttaggacagagcc

SEQ ID NO: 8268273 - DNA, 22 bp, Homo sapiens
taatctctagcccatgcaaaga

SEQ ID NO: 8268274 - DNA, 22 bp, Homo sapiens
taagctctccaggtgatcatga

SEQ ID NO: 8268275 - DNA, 22 bp, Homo sapiens
taagctctgttatccagagccc

SEQ ID NO: 8268276 - DNA, 22 bp, Homo sapiens
taaggaggttggtgggttggat

SEQ ID NO: 8268277 - DNA, 22 bp, Homo sapiens
taaggaggcgaggtggtgagca

SEQ ID NO: 8268278 - DNA, 22 bp, Homo sapiens
taaggaggctgctgtgaagaaa

SEQ ID NO: 8268279 - DNA, 22 bp, Homo sapiens
gttcttctcttgtaatggaatc

SEQ ID NO: 8268280 - DNA, 22 bp, Homo sapiens
gttgaaatcctaaccccctagt

SEQ ID NO: 8268281 - DNA, 22 bp, Homo sapiens
taaatgccattcgtttcataca

SEQ ID NO: 8268282 - DNA, 22 bp, Homo sapiens
taaatgcctctgaatcttcata

SEQ ID NO: 8268283 - DNA, 22 bp, Homo sapiens
tcatttataaggatgcaattaa

SEQ ID NO: 8268284 - DNA, 20 bp, Homo sapiens
tcatgcaggtgttctaggtt

SEQ ID NO: 8268285 - DNA, 22 bp, Homo sapiens
tcatgcaggacttacgagagat

SEQ ID NO: 8268286 - DNA, 22 bp, Homo sapiens
tcatgcagcttttccattcagc

SEQ ID NO: 8268287 - DNA, 22 bp, Homo sapiens
tcatgcaggacttacaagagat

SEQ ID NO: 8268288 - DNA, 22 bp, Homo sapiens
tcatgcagcaatatgcattagg

SEQ ID NO: 8268289 - DNA, 22 bp, Homo sapiens
tcatgcagtgaatctttcttgc

SEQ ID NO: 8268290 - DNA, 22 bp, Homo sapiens
tcatttgtacttgtgtgcttgt

SEQ ID NO: 8268291 - DNA, 22 bp, Homo sapiens
tcatttgtggaagtgattgtgg

SEQ ID NO: 8268292 - DNA, 22 bp, Homo sapiens
tcatttgtgtgagtgatttgac

SEQ ID NO: 8268293 - DNA, 23 bp, Homo sapiens
tccaaatacctgtcaccttgtct

SEQ ID NO: 8268294 - DNA, 22 bp, Homo sapiens
tccaaatatattcacgtcctag

SEQ ID NO: 8268295 - DNA, 21 bp, Homo sapiens
tcatctggtctggggcctgct

SEQ ID NO: 8268296 - DNA, 22 bp, Homo sapiens
tcatgcagagtagaaagggcaa

SEQ ID NO: 8268297 - DNA, 23 bp, Homo sapiens
tcatgcagagaaggactgcttac

SEQ ID NO: 8268298 - DNA, 22 bp, Homo sapiens
tcaaatgcaggtctggtcttgg

SEQ ID NO: 8268299 - DNA, 23 bp, Homo sapiens
tcacataatccttcatccacagg

SEQ ID NO: 8268300 - DNA, 22 bp, Homo sapiens
tcacatacactaggatattttt

SEQ ID NO: 8268301 - DNA, 22 bp, Homo sapiens
tcacataaatttaccagatgat

SEQ ID NO: 8268302 - DNA, 22 bp, Homo sapiens
tcacatactgaaagtccagtga

SEQ ID NO: 8268303 - DNA, 22 bp, Homo sapiens
tccattatacttctgattcaaa

SEQ ID NO: 8268304 - DNA, 22 bp, Homo sapiens
tcccagcctggaccctgccagt

SEQ ID NO: 8268305 - DNA, 22 bp, Homo sapiens
tcctcaaatatttacttactga

SEQ ID NO: 8268306 - DNA, 22 bp, Homo sapiens
tccctcagatgagctcctagca

SEQ ID NO: 8268307 - DNA, 22 bp, Homo sapiens
tccctctggaggctctagggga

SEQ ID NO: 8268308 - DNA, 22 bp, Homo sapiens
gcattgaatcctatcaggcaaa

SEQ ID NO: 8268309 - DNA, 22 bp, Homo sapiens
gcattgaaggcattttatctac

SEQ ID NO: 8268310 - DNA, 22 bp, Homo sapiens
gcattgaaggacttccattata

SEQ ID NO: 8268311 - DNA, 22 bp, Homo sapiens
gcattgaagatcttagactagg

SEQ ID NO: 8268312 - DNA, 22 bp, Homo sapiens
gcattgaaatggcaaaaagaga

SEQ ID NO: 8268313 - DNA, 23 bp, Homo sapiens
gcattgaacaaaagaggggagta

SEQ ID NO: 8268314 - DNA, 22 bp, Homo sapiens
gcattgaaccatctagatttct

SEQ ID NO: 8268315 - DNA, 22 bp, Homo sapiens
gcccacacaccagctcaggagg

SEQ ID NO: 8268316 - DNA, 22 bp, Homo sapiens
gcccacacagcagatcctttgg

SEQ ID NO: 8268317 - DNA, 22 bp, Homo sapiens
gcccacaccatttattctttgt

SEQ ID NO: 8268318 - DNA, 20 bp, Homo sapiens
gcacatgcaacttttattta

SEQ ID NO: 8268319 - DNA, 22 bp, Homo sapiens
gcacatgcagactcattatcta

SEQ ID NO: 8268320 - DNA, 22 bp, Homo sapiens
gcacatgcatgcatattcctgg

SEQ ID NO: 8268321 - DNA, 22 bp, Homo sapiens
gcacatgccccattcttgtcac

SEQ ID NO: 8268322 - DNA, 21 bp, Homo sapiens
gcacatgctgtgtgtttctct

SEQ ID NO: 8268323 - DNA, 23 bp, Homo sapiens
gctcatcaggcttagagtcaagg

SEQ ID NO: 8268324 - DNA, 22 bp, Homo sapiens
gcttttatttcttcacaaaagt

SEQ ID NO: 8268325 - DNA, 22 bp, Homo sapiens
gcttttatgcacataagggtca

SEQ ID NO: 8268326 - DNA, 22 bp, Homo sapiens
gcttttattgtctttacgacga

SEQ ID NO: 8268327 - DNA, 19 bp, Homo sapiens
gcttttattgctcaggtgc

SEQ ID NO: 8268328 - DNA, 22 bp, Homo sapiens
ggagaaagaaatttttgattgg

SEQ ID NO: 8268329 - DNA, 21 bp, Homo sapiens
gtcttttaagtgaagagaggc

SEQ ID NO: 8268330 - DNA, 22 bp, Homo sapiens
gtcctctgtccctggggcacgg

SEQ ID NO: 8268331 - DNA, 22 bp, Homo sapiens
gtcctctgtagggctgggccac

SEQ ID NO: 8268332 - DNA, 22 bp, Homo sapiens
gtcctctggtgaaagcattccc

SEQ ID NO: 8268333 - DNA, 22 bp, Homo sapiens
gtcctctgggctttgagcagtc

SEQ ID NO: 8268334 - DNA, 22 bp, Homo sapiens
gtcctctgcttcatgccctgat

SEQ ID NO: 8268335 - DNA, 22 bp, Homo sapiens
gtcctctggaagatgagttctt

SEQ ID NO: 8268336 - DNA, 22 bp, Homo sapiens
gtcctctgggcagctgccccac

SEQ ID NO: 8268337 - DNA, 22 bp, Homo sapiens
gtcctctgggagccttgagcct

SEQ ID NO: 8268338 - DNA, 22 bp, Homo sapiens
gtcctctggcctttcccaggac

SEQ ID NO: 8268339 - DNA, 22 bp, Homo sapiens
gtcctctggaggtttttaggtg

SEQ ID NO: 8268340 - DNA, 23 bp, Homo sapiens
gtcctctggagagaaaggcagta

SEQ ID NO: 8268341 - DNA, 22 bp, Homo sapiens
ggtggtgactgtcctagggatg

SEQ ID NO: 8268342 - DNA, 22 bp, Homo sapiens
ggtgagggagtggaacgaggtg

SEQ ID NO: 8268343 - DNA, 22 bp, Homo sapiens
gggttttccttctgcattggag

SEQ ID NO: 8268344 - DNA, 22 bp, Homo sapiens
gggttttcttcaaaagtctaga

SEQ ID NO: 8268345 - DNA, 22 bp, Homo sapiens
gggctcatcaagcctctccgcc

SEQ ID NO: 8268346 - DNA, 22 bp, Homo sapiens
gggctcatcagctaggaaaatg

SEQ ID NO: 8268347 - DNA, 22 bp, Homo sapiens
gggctcatcatctgtgggggat

SEQ ID NO: 8268348 - DNA, 22 bp, Homo sapiens
gggctcatggacagctctccag

SEQ ID NO: 8268349 - DNA, 22 bp, Homo sapiens
gggctcatgatgtaggctggta

SEQ ID NO: 8268350 - DNA, 22 bp, Homo sapiens
gggctcattcatctgggcttgg

SEQ ID NO: 8268351 - DNA, 22 bp, Homo sapiens
gggctcattgggcgctttctaa

SEQ ID NO: 8268352 - DNA, 22 bp, Homo sapiens
gggctctggaaatgggagctcc

SEQ ID NO: 8268353 - DNA, 21 bp, Homo sapiens
gggcagaggggcctcctgggt

SEQ ID NO: 8268354 - DNA, 19 bp, Homo sapiens
ggcacctttctgctgtgtc

SEQ ID NO: 8268355 - DNA, 22 bp, Homo sapiens
ggcagtgagaggtctcctggtc

SEQ ID NO: 8268356 - DNA, 22 bp, Homo sapiens
ggcccagcgaggccacctacag

SEQ ID NO: 8268357 - DNA, 18 bp, Homo sapiens
ggcctctggactggcagc

SEQ ID NO: 8268358 - DNA, 22 bp, Homo sapiens
tttggaaaaagcctgaacatag

SEQ ID NO: 8268359 - DNA, 22 bp, Homo sapiens
ttttaaaggcagattatggctt

SEQ ID NO: 8268360 - DNA, 22 bp, Homo sapiens
ttttaatgtgctctgcaatgat

SEQ ID NO: 8268361 - DNA, 21 bp, Homo sapiens
ttttattgatgaatggccact

SEQ ID NO: 8268362 - DNA, 22 bp, Homo sapiens
ttttattggagtgataccaagc

SEQ ID NO: 8268363 - DNA, 22 bp, Homo sapiens
ttttattgcaataaagtgtgta

SEQ ID NO: 8268364 - DNA, 21 bp, Homo sapiens
ttctctccatatgcccagccc

SEQ ID NO: 8268365 - DNA, 22 bp, Homo sapiens
ttcttttaatgttctgaagttt

SEQ ID NO: 8268366 - DNA, 22 bp, Homo sapiens
ttcttttaaaagagagcagaaa

SEQ ID NO: 8268367 - DNA, 22 bp, Homo sapiens
ttcttttaatagagatcctgtg

SEQ ID NO: 8268368 - DNA, 22 bp, Homo sapiens
ttcttttaatgtctggctttca

SEQ ID NO: 8268369 - DNA, 22 bp, Homo sapiens
ttcttcaaagatgtctgttgga

SEQ ID NO: 8268370 - DNA, 22 bp, Homo sapiens
ttctgtctgtaaacttctcaat

SEQ ID NO: 8268371 - DNA, 22 bp, Homo sapiens
ttctgtcttctcggttgtttac

SEQ ID NO: 8268372 - DNA, 22 bp, Homo sapiens
ttattggagctggaggctgttt

SEQ ID NO: 8268373 - DNA, 22 bp, Homo sapiens
ttattgtaggcctattgtagaa

SEQ ID NO: 8268374 - DNA, 22 bp, Homo sapiens
ttattgtagcactttggcagtg

SEQ ID NO: 8268375 - DNA, 22 bp, Homo sapiens
ttatagaatggtggattttctg

SEQ ID NO: 8268376 - DNA, 22 bp, Homo sapiens
ttatagaaggagcattcactta

SEQ ID NO: 8268377 - DNA, 22 bp, Homo sapiens
ttgtaaactgctgcaggagtgc

SEQ ID NO: 8268378 - DNA, 22 bp, Homo sapiens
tttattgaacacttgcactggc

SEQ ID NO: 8268379 - DNA, 22 bp, Homo sapiens
acagactggcctgtctcgcacc

SEQ ID NO: 8268380 - DNA, 22 bp, Homo sapiens
acacatacatggggaagatgag

SEQ ID NO: 8268381 - DNA, 22 bp, Homo sapiens
acacataagcctaatcatctcc

SEQ ID NO: 8268382 - DNA, 22 bp, Homo sapiens
acacagagccaaaccatatcac

SEQ ID NO: 8268383 - DNA, 22 bp, Homo sapiens
acaaatccagtgaactccagtg

SEQ ID NO: 8268384 - DNA, 22 bp, Homo sapiens
aatctgcttttgtcatttatga

SEQ ID NO: 8268385 - DNA, 22 bp, Homo sapiens
aatctggggctcttttctctgg

SEQ ID NO: 8268386 - DNA, 22 bp, Homo sapiens
aatctggtctaagtgaggatag

SEQ ID NO: 8268387 - DNA, 22 bp, Homo sapiens
aataatctccctttttgtatgt

SEQ ID NO: 8268388 - DNA, 22 bp, Homo sapiens
aataatgataatggttatagct

SEQ ID NO: 8268389 - DNA, 22 bp, Homo sapiens
aaggagtgatatatgggtgcta

SEQ ID NO: 8268390 - DNA, 22 bp, Homo sapiens
aaggaggttatcccagtggact

SEQ ID NO: 8268391 - DNA, 22 bp, Homo sapiens
aaaggctctattgttttcatat

SEQ ID NO: 8268392 - DNA, 22 bp, Homo sapiens
aaagttcttcatttttattgga

SEQ ID NO: 8268393 - DNA, 22 bp, Homo sapiens
aagaaggaagtgtggacatcac

SEQ ID NO: 8268394 - DNA, 22 bp, Homo sapiens
aaagttctttctcttatttggt

SEQ ID NO: 8268395 - DNA, 22 bp, Homo sapiens
aagagagaactcccttcgccag

SEQ ID NO: 8268396 - DNA, 22 bp, Homo sapiens
aagagagagtgcgctcacagaa

SEQ ID NO: 8268397 - DNA, 22 bp, Homo sapiens
aagagagagttcctaggcaaaa

SEQ ID NO: 8268398 - DNA, 22 bp, Homo sapiens
aaatgccaaggagagactgtta

SEQ ID NO: 8268399 - DNA, 22 bp, Homo sapiens
aaatgccaggattattagaggc

SEQ ID NO: 8268400 - DNA, 23 bp, Homo sapiens
aaatgccagggagacaggaacca

SEQ ID NO: 8268401 - DNA, 22 bp, Homo sapiens
aaaagctcattgataaaaagtc

SEQ ID NO: 8268402 - DNA, 22 bp, Homo sapiens
aaaagctctttctgctgtagat

SEQ ID NO: 8268403 - DNA, 22 bp, Homo sapiens
aaatgtctttcttctgctacgt

SEQ ID NO: 8268404 - DNA, 22 bp, Homo sapiens
aaagctcttaatgagattatcc

SEQ ID NO: 8268405 - DNA, 22 bp, Homo sapiens
aaagctcttactgtactagtga

SEQ ID NO: 8268406 - DNA, 22 bp, Homo sapiens
aaagctcttaaattgacctgct

SEQ ID NO: 8268407 - DNA, 23 bp, Homo sapiens
aaagctctgctgcatgtagaata

SEQ ID NO: 8268408 - DNA, 22 bp, Homo sapiens
aaagctctggaagattaggtaa

SEQ ID NO: 8268409 - DNA, 22 bp, Homo sapiens
aaagctctggtttggagcattt

SEQ ID NO: 8268410 - DNA, 22 bp, Homo sapiens
aaagctctgggaatgcttatct

SEQ ID NO: 8268411 - DNA, 22 bp, Homo sapiens
aaagctctctgaacaccagacc

SEQ ID NO: 8268412 - DNA, 22 bp, Homo sapiens
aaagctctgagaagcactgcaa

SEQ ID NO: 8268413 - DNA, 22 bp, Homo sapiens
aaagctctcccactgtatgaag

SEQ ID NO: 8268414 - DNA, 22 bp, Homo sapiens
aaagctctaagagaggtaggta

SEQ ID NO: 8268415 - DNA, 22 bp, Homo sapiens
aaaggagagtgagtcagatgcc

SEQ ID NO: 8268416 - DNA, 22 bp, Homo sapiens
aaagctatgaggcatgcatttc

SEQ ID NO: 8268417 - DNA, 22 bp, Homo sapiens
agacatctacctttcattcaaa

SEQ ID NO: 8268418 - DNA, 22 bp, Homo sapiens
agacatctcccatgcattttta

SEQ ID NO: 8268419 - DNA, 20 bp, Homo sapiens
agatctttgggttgtcatat

SEQ ID NO: 8268420 - DNA, 22 bp, Homo sapiens
acacatcagaaatatgaatgag

SEQ ID NO: 8268421 - DNA, 22 bp, Homo sapiens
acacatctcaggggacactctc

SEQ ID NO: 8268422 - DNA, 22 bp, Homo sapiens
acacatcatgccaagtttcacc

SEQ ID NO: 8268423 - DNA, 22 bp, Homo sapiens
acacacacaagcaggttgtgga

SEQ ID NO: 8268424 - DNA, 18 bp, Homo sapiens
acacacacacctgtgtat

SEQ ID NO: 8268425 - DNA, 19 bp, Homo sapiens
actcttttccttttgaatc

SEQ ID NO: 8268426 - DNA, 22 bp, Homo sapiens
actcttttatgcattccttcag

SEQ ID NO: 8268427 - DNA, 22 bp, Homo sapiens
actcttttataaagcatcttga

SEQ ID NO: 8268428 - DNA, 20 bp, Homo sapiens
aatgaagttattaatgatgt

SEQ ID NO: 8268429 - DNA, 22 bp, Homo sapiens
acttttatgataatcaatgttc

SEQ ID NO: 8268430 - DNA, 22 bp, Homo sapiens
acttttatcaaggaagtgatct

SEQ ID NO: 8268431 - DNA, 22 bp, Homo sapiens
aatagctcacggttagtgtagg

SEQ ID NO: 8268432 - DNA, 22 bp, Homo sapiens
aagcttcttagaatgcatgtgc

SEQ ID NO: 8268433 - DNA, 22 bp, Homo sapiens
aaggaagtgattttcatgtcaa

SEQ ID NO: 8268434 - DNA, 22 bp, Homo sapiens
aaggaagttaagtcttagaatg

SEQ ID NO: 8268435 - DNA, 22 bp, Homo sapiens
aaggaagttttcttggttccta

SEQ ID NO: 8268436 - DNA, 18 bp, Homo sapiens
aaggacacagtccctgct

SEQ ID NO: 8268437 - DNA, 19 bp, Homo sapiens
aaggacacaacagagatag

SEQ ID NO: 8268438 - DNA, 22 bp, Homo sapiens
acatcccacagaaacatacata

SEQ ID NO: 8268439 - DNA, 22 bp, Homo sapiens
aagtcctagacttggatagttt

SEQ ID NO: 8268440 - DNA, 22 bp, Homo sapiens
attgaaaccctggattgtccta

SEQ ID NO: 8268441 - DNA, 22 bp, Homo sapiens
attgaaacctgctcaggctctc

SEQ ID NO: 8268442 - DNA, 22 bp, Homo sapiens
attgtgtcctcattgaccttca

SEQ ID NO: 8268443 - DNA, 22 bp, Homo sapiens
agaggccggccgagcccatggg

SEQ ID NO: 8268444 - DNA, 22 bp, Homo sapiens
attttctgtgtgcagataaata

SEQ ID NO: 8268445 - DNA, 19 bp, Homo sapiens
atttgaaagctgtgcttgc

SEQ ID NO: 8268446 - DNA, 23 bp, Homo sapiens
attttttgtctttgtaactagat

SEQ ID NO: 8268447 - DNA, 18 bp, Homo sapiens
atgggaggggccaagaga

SEQ ID NO: 8268448 - DNA, 22 bp, Homo sapiens
atgattccttgaagcctcatga

SEQ ID NO: 8268449 - DNA, 17 bp, Homo sapiens
atgattccatcaggatt

SEQ ID NO: 8268450 - DNA, 19 bp, Homo sapiens
atgattcccagggaggggg

SEQ ID NO: 8268451 - DNA, 22 bp, Homo sapiens
atctgggagcggaggttgcagt

SEQ ID NO: 8268452 - DNA, 22 bp, Homo sapiens
atctgggagtcttggctctgct

SEQ ID NO: 8268453 - DNA, 20 bp, Homo sapiens
atctgggcatcaattttgtg

SEQ ID NO: 8268454 - DNA, 23 bp, Homo sapiens
atctgggcatctggagtggtcct

SEQ ID NO: 8268455 - DNA, 22 bp, Homo sapiens
cacacatcaacctagacattgt

SEQ ID NO: 8268456 - DNA, 22 bp, Homo sapiens
cacacatcttatcccagttatt

SEQ ID NO: 8268457 - DNA, 22 bp, Homo sapiens
cacacagaaccgctcgccactt

SEQ ID NO: 8268458 - DNA, 20 bp, Homo sapiens
cacagaacaaattgcaggac

SEQ ID NO: 8268459 - DNA, 22 bp, Homo sapiens
cagccttctgaatgaacgtact

SEQ ID NO: 8268460 - DNA, 22 bp, Homo sapiens
cagccttcgacagttggagtag

SEQ ID NO: 8268461 - DNA, 22 bp, Homo sapiens
cagcccaggtctctcttccagt

SEQ ID NO: 8268462 - DNA, 22 bp, Homo sapiens
cagcccaaagccccaggctaga

SEQ ID NO: 8268463 - DNA, 22 bp, Homo sapiens
atacacactgctatcctttttt

SEQ ID NO: 8268464 - DNA, 22 bp, Homo sapiens
ataaggaaaattggagaaattg

SEQ ID NO: 8268465 - DNA, 20 bp, Homo sapiens
atagaagtattatgtaatgt

SEQ ID NO: 8268466 - DNA, 22 bp, Homo sapiens
atagatggtatttagactagcg

SEQ ID NO: 8268467 - DNA, 22 bp, Homo sapiens
agggtgcatgtttgcaagagtg

SEQ ID NO: 8268468 - DNA, 22 bp, Homo sapiens
aggttctgattctctgggtatg

SEQ ID NO: 8268469 - DNA, 22 bp, Homo sapiens
aggttctgtttggctgaggatc

SEQ ID NO: 8268470 - DNA, 22 bp, Homo sapiens
aggtggagacccagagaaggcg

SEQ ID NO: 8268471 - DNA, 22 bp, Homo sapiens
actggggctgatgcgttcgtgt

SEQ ID NO: 8268472 - DNA, 22 bp, Homo sapiens
acatctgaggagaccagcctct

SEQ ID NO: 8268473 - DNA, 22 bp, Homo sapiens
aggggttggatttggcctagag

SEQ ID NO: 8268474 - DNA, 22 bp, Homo sapiens
cattggaagacatatcatgcta

SEQ ID NO: 8268475 - DNA, 22 bp, Homo sapiens
ccacatacaaatggggtgctgt

SEQ ID NO: 8268476 - DNA, 22 bp, Homo sapiens
ccacatcatggatacagttatg

SEQ ID NO: 8268477 - DNA, 21 bp, Homo sapiens
ccactcatgactccactcacc

SEQ ID NO: 8268478 - DNA, 22 bp, Homo sapiens
ccacagaccttggcttccacct

SEQ ID NO: 8268479 - DNA, 22 bp, Homo sapiens
catgagataatttttctccagt

SEQ ID NO: 8268480 - DNA, 22 bp, Homo sapiens
aggacacttggctattgttcca

SEQ ID NO: 8268481 - DNA, 22 bp, Homo sapiens
aggacacttgagagtccagtca

SEQ ID NO: 8268482 - DNA, 22 bp, Homo sapiens
aggacactgctgaggatcagat

SEQ ID NO: 8268483 - DNA, 22 bp, Homo sapiens
aggacacttaggttattcaact

SEQ ID NO: 8268484 - DNA, 22 bp, Homo sapiens
aggacactttgtggttgttgat

SEQ ID NO: 8268485 - DNA, 22 bp, Homo sapiens
cccaagttaaaattcagtgctc

SEQ ID NO: 8268486 - DNA, 22 bp, Homo sapiens
cccacacatttttcacttaccg

SEQ ID NO: 8268487 - DNA, 20 bp, Homo sapiens
cccacacccttcccacttgg

SEQ ID NO: 8268488 - DNA, 18 bp, Homo sapiens
cccacacagcagtagctc

SEQ ID NO: 8268489 - DNA, 22 bp, Homo sapiens
cccaagttgcttgttccaagac

SEQ ID NO: 8268490 - DNA, 22 bp, Homo sapiens
cccacacaaatcatggggagaa

SEQ ID NO: 8268491 - DNA, 22 bp, Homo sapiens
cccacacactggctgctgccaa

SEQ ID NO: 8268492 - DNA, 22 bp, Homo sapiens
cccacacacatttatgatagga

SEQ ID NO: 8268493 - DNA, 22 bp, Homo sapiens
cccaccctgggctacacatcca

SEQ ID NO: 8268494 - DNA, 22 bp, Homo sapiens
atacattcaaaggaaggataga

SEQ ID NO: 8268495 - DNA, 22 bp, Homo sapiens
ctggaataaacgatcttcagca

SEQ ID NO: 8268496 - DNA, 22 bp, Homo sapiens
ataacctggtagtattaaatgt

SEQ ID NO: 8268497 - DNA, 22 bp, Homo sapiens
atcaaataaaggtacctagctt

SEQ ID NO: 8268498 - DNA, 22 bp, Homo sapiens
cttcctctagcctagtaatgcc

SEQ ID NO: 8268499 - DNA, 22 bp, Homo sapiens
cttcccactagtatcacagagc

SEQ ID NO: 8268500 - DNA, 17 bp, Homo sapiens
cttcccaccatctcctg

SEQ ID NO: 8268501 - DNA, 18 bp, Homo sapiens
aggttttcaggatatgtg

SEQ ID NO: 8268502 - DNA, 15 bp, Homo sapiens
aggttttcagagtaa

SEQ ID NO: 8268503 - DNA, 22 bp, Homo sapiens
aggttttcacaggaagtatgtt

SEQ ID NO: 8268504 - DNA, 22 bp, Homo sapiens
aggttttcagctgtatcctgag

SEQ ID NO: 8268505 - DNA, 18 bp, Homo sapiens
aggttttcagagtttcca

SEQ ID NO: 8268506 - DNA, 22 bp, Homo sapiens
cacatacttgtgtgtacatatg

SEQ ID NO: 8268507 - DNA, 22 bp, Homo sapiens
cacataagaaatgaatatgaga

SEQ ID NO: 8268508 - DNA, 22 bp, Homo sapiens
cacatacaaggcacactggagg

SEQ ID NO: 8268509 - DNA, 22 bp, Homo sapiens
cacatacatacgtatgtataca

SEQ ID NO: 8268510 - DNA, 22 bp, Homo sapiens
cacatactgagaatcacaccca

SEQ ID NO: 8268511 - DNA, 22 bp, Homo sapiens
cacatacattcatgttactcta

SEQ ID NO: 8268512 - DNA, 22 bp, Homo sapiens
caccttactccctctggatgcc

SEQ ID NO: 8268513 - DNA, 22 bp, Homo sapiens
caagtagaaggatgtgattgta

SEQ ID NO: 8268514 - DNA, 22 bp, Homo sapiens
caagcagtcagcctgaagactg

SEQ ID NO: 8268515 - DNA, 22 bp, Homo sapiens
cacaattttaatacacagtcaa

SEQ ID NO: 8268516 - DNA, 22 bp, Homo sapiens
caatgttttcaactgacaagta

SEQ ID NO: 8268517 - DNA, 22 bp, Homo sapiens
cacacagacagctctctgaaga

SEQ ID NO: 8268518 - DNA, 15 bp, Homo sapiens
cacacagacagcttg

SEQ ID NO: 8268519 - DNA, 22 bp, Homo sapiens
cacacagatggtaagggaggga

SEQ ID NO: 8268520 - DNA, 22 bp, Homo sapiens
cacaggagaaaggggaagctcg

SEQ ID NO: 8268521 - DNA, 22 bp, Homo sapiens
gggctctgcgggcccggactcc

SEQ ID NO: 8268522 - DNA, 22 bp, Homo sapiens
cagcacagtgaccagacccact

SEQ ID NO: 8268523 - DNA, 22 bp, Homo sapiens
gacacatatgcgtatagtttag

SEQ ID NO: 8268524 - DNA, 22 bp, Homo sapiens
gacacatagatctatctcactc

SEQ ID NO: 8268525 - DNA, 18 bp, Homo sapiens
gacacatccccaggcctc

SEQ ID NO: 8268526 - DNA, 22 bp, Homo sapiens
gaagtcttgaagagcactgtaa

SEQ ID NO: 8268527 - DNA, 22 bp, Homo sapiens
atgaaaatgtacatgtgtataa

SEQ ID NO: 8268528 - DNA, 22 bp, Homo sapiens
atgttggagtcgtaaggcatgg

SEQ ID NO: 8268529 - DNA, 22 bp, Homo sapiens
atgttgaactaggatctcttga

SEQ ID NO: 8268530 - DNA, 22 bp, Homo sapiens
gagacatcataatgaagtttcc

SEQ ID NO: 8268531 - DNA, 22 bp, Homo sapiens
atgggacaaacctttgatttga

SEQ ID NO: 8268532 - DNA, 22 bp, Homo sapiens
caaaggaggtaatgggtgtgag

SEQ ID NO: 8268533 - DNA, 22 bp, Homo sapiens
caaagctcagccctccaatgaa

SEQ ID NO: 8268534 - DNA, 18 bp, Homo sapiens
caaagctcacgttccatc

SEQ ID NO: 8268535 - DNA, 22 bp, Homo sapiens
caaagctcatgctcttagccat

SEQ ID NO: 8268536 - DNA, 21 bp, Homo sapiens
caaagctcattctttggtcat

SEQ ID NO: 8268537 - DNA, 22 bp, Homo sapiens
caaagctcgccacctctgaggg

SEQ ID NO: 8268538 - DNA, 22 bp, Homo sapiens
caaatactacgattcttgcagt

SEQ ID NO: 8268539 - DNA, 22 bp, Homo sapiens
caaatgccaggaatctctgaag

SEQ ID NO: 8268540 - DNA, 22 bp, Homo sapiens
gctcttttcacagtccaaaatg

SEQ ID NO: 8268541 - DNA, 22 bp, Homo sapiens
atttggaaatgcatctcttgag

SEQ ID NO: 8268542 - DNA, 22 bp, Homo sapiens
attgtcttaaacaaatgtgttt

SEQ ID NO: 8268543 - DNA, 17 bp, Homo sapiens
gcatcacagataacacg

SEQ ID NO: 8268544 - DNA, 22 bp, Homo sapiens
attgatatcagtttgctgattg

SEQ ID NO: 8268545 - DNA, 22 bp, Homo sapiens
attgatatattatttctaactg

SEQ ID NO: 8268546 - DNA, 22 bp, Homo sapiens
attaggaaattatatgtcctcc

SEQ ID NO: 8268547 - DNA, 22 bp, Homo sapiens
tgaggtagggacttaaaactgt

SEQ ID NO: 8268548 - DNA, 22 bp, Homo sapiens
tgagggctgacaggaggacagc

SEQ ID NO: 8268549 - DNA, 22 bp, Homo sapiens
ccattgaattagaaggggaagg

SEQ ID NO: 8268550 - DNA, 22 bp, Homo sapiens
ccattgaatcctcagctgctag

SEQ ID NO: 8268551 - DNA, 22 bp, Homo sapiens
ccattgaaggcacttgagcaga

SEQ ID NO: 8268552 - DNA, 22 bp, Homo sapiens
ccattgaacccctctaggccac

SEQ ID NO: 8268553 - DNA, 22 bp, Homo sapiens
tgagaatatttgaagatgttag

SEQ ID NO: 8268554 - DNA, 22 bp, Homo sapiens
tctttcttgtgggtgccctttt

SEQ ID NO: 8268555 - DNA, 22 bp, Homo sapiens
tctttctttatcacctgatatg

SEQ ID NO: 8268556 - DNA, 22 bp, Homo sapiens
ccccacactctttacattcata

SEQ ID NO: 8268557 - DNA, 20 bp, Homo sapiens
ccccacactattgagcactt

SEQ ID NO: 8268558 - DNA, 22 bp, Homo sapiens
ccccacacctgccgggcagcag

SEQ ID NO: 8268559 - DNA, 22 bp, Homo sapiens
ccctcggggcctcagtttccct

SEQ ID NO: 8268560 - DNA, 22 bp, Homo sapiens
tagatacaggctctctgagcct

SEQ ID NO: 8268561 - DNA, 22 bp, Homo sapiens
taagtcctaacagactgggggc

SEQ ID NO: 8268562 - DNA, 22 bp, Homo sapiens
cagtcacataggtatacacata

SEQ ID NO: 8268563 - DNA, 22 bp, Homo sapiens
cagggtagggcaagggaacctg

SEQ ID NO: 8268564 - DNA, 22 bp, Homo sapiens
tagattgagcttgacagtgttg

SEQ ID NO: 8268565 - DNA, 22 bp, Homo sapiens
catgcagggacttgtgctccat

SEQ ID NO: 8268566 - DNA, 22 bp, Homo sapiens
catgcagtgactcagacacagg

SEQ ID NO: 8268567 - DNA, 22 bp, Homo sapiens
catgcagtggtaaaaagtcagg

SEQ ID NO: 8268568 - DNA, 22 bp, Homo sapiens
catctgctgttccttggactca

SEQ ID NO: 8268569 - DNA, 23 bp, Homo sapiens
catctggggacatcattaggctg

SEQ ID NO: 8268570 - DNA, 22 bp, Homo sapiens
catttaatgcctttgccatcca

SEQ ID NO: 8268571 - DNA, 22 bp, Homo sapiens
catttaatgcacggatgtagcc

SEQ ID NO: 8268572 - DNA, 22 bp, Homo sapiens
catttaatcctcacaagcctat

SEQ ID NO: 8268573 - DNA, 22 bp, Homo sapiens
catttaatctggctcatgagca

SEQ ID NO: 8268574 - DNA, 22 bp, Homo sapiens
catttaatccatagaggaatgt

SEQ ID NO: 8268575 - DNA, 22 bp, Homo sapiens
catttaatagatgctgtttcag

SEQ ID NO: 8268576 - DNA, 22 bp, Homo sapiens
tcccacatgtgaatcctcaggt

SEQ ID NO: 8268577 - DNA, 22 bp, Homo sapiens
tcccacattaccctgactgaca

SEQ ID NO: 8268578 - DNA, 19 bp, Homo sapiens
ccacacagtgtgcaattta

SEQ ID NO: 8268579 - DNA, 22 bp, Homo sapiens
ccacactaaactgctcaaacca

SEQ ID NO: 8268580 - DNA, 22 bp, Homo sapiens
ccacacagggggatgagttatt

SEQ ID NO: 8268581 - DNA, 22 bp, Homo sapiens
ccacacagtcagtttccaagaa

SEQ ID NO: 8268582 - DNA, 22 bp, Homo sapiens
ttcttttaatttctgtctgcag

SEQ ID NO: 8268583 - DNA, 22 bp, Homo sapiens
ttcttttaattgtgggggagtg

SEQ ID NO: 8268584 - DNA, 22 bp, Homo sapiens
ttcttttagaatttcctaaggt

SEQ ID NO: 8268585 - DNA, 22 bp, Homo sapiens
ttcttttagtcattcagggaag

SEQ ID NO: 8268586 - DNA, 22 bp, Homo sapiens
ttcttttacattaagatttcag

SEQ ID NO: 8268587 - DNA, 20 bp, Homo sapiens
ctccaaattcctgaggataa

SEQ ID NO: 8268588 - DNA, 22 bp, Homo sapiens
tttattgtgttgaaactgaatt

SEQ ID NO: 8268589 - DNA, 22 bp, Homo sapiens
tttattgtttagaagggggctg

SEQ ID NO: 8268590 - DNA, 22 bp, Homo sapiens
tttcctttccaaaattctgcct

SEQ ID NO: 8268591 - DNA, 22 bp, Homo sapiens
tttgggcaaaggtagaaggaga

SEQ ID NO: 8268592 - DNA, 22 bp, Homo sapiens
ctcttattttatggcatttgtg

SEQ ID NO: 8268593 - DNA, 22 bp, Homo sapiens
tgtttacttttaattacctgtc

SEQ ID NO: 8268594 - DNA, 22 bp, Homo sapiens
tgtttactttccttctcacagg

SEQ ID NO: 8268595 - DNA, 22 bp, Homo sapiens
ttaaagctgctgaatcctattt

SEQ ID NO: 8268596 - DNA, 22 bp, Homo sapiens
cctgtgggaaaggtctgctctc

SEQ ID NO: 8268597 - DNA, 22 bp, Homo sapiens
ttaaagtccctgccttaattcc

SEQ ID NO: 8268598 - DNA, 22 bp, Homo sapiens
ttagaaaaaacgtcttctagtg

SEQ ID NO: 8268599 - DNA, 22 bp, Homo sapiens
ccttctagcaaatcaacataaa

SEQ ID NO: 8268600 - DNA, 22 bp, Homo sapiens
tgtttactggaccagggagggg

SEQ ID NO: 8268601 - DNA, 22 bp, Homo sapiens
tgtttactggctcctgtggttc

SEQ ID NO: 8268602 - DNA, 22 bp, Homo sapiens
tgtttacttaaatgttttcata

SEQ ID NO: 8268603 - DNA, 22 bp, Homo sapiens
tgtttacttgaggtggaaacaa

SEQ ID NO: 8268604 - DNA, 22 bp, Homo sapiens
tgtttacttctttccatggctt

SEQ ID NO: 8268605 - DNA, 22 bp, Homo sapiens
tgtttacttatgtgggtcacat

SEQ ID NO: 8268606 - DNA, 22 bp, Homo sapiens
tgtttacttcatcgagtacttc

SEQ ID NO: 8268607 - DNA, 22 bp, Homo sapiens
tggggcagttaataaacattct

SEQ ID NO: 8268608 - DNA, 22 bp, Homo sapiens
tggggcagtggcttttcaccct

SEQ ID NO: 8268609 - DNA, 22 bp, Homo sapiens
tggggcagggatgggaaactat

SEQ ID NO: 8268610 - DNA, 22 bp, Homo sapiens
tggggcagctccatctattcca

SEQ ID NO: 8268611 - DNA, 22 bp, Homo sapiens
tggggcagccacatagacaaca

SEQ ID NO: 8268612 - DNA, 22 bp, Homo sapiens
ctatgagaagaaaacaagatta

SEQ ID NO: 8268613 - DNA, 22 bp, Homo sapiens
cgcatacatagaaacacacaga

SEQ ID NO: 8268614 - DNA, 22 bp, Homo sapiens
gagctcttagatagggcaggaa

SEQ ID NO: 8268615 - DNA, 22 bp, Homo sapiens
gagctctttgaacctgggcagt

SEQ ID NO: 8268616 - DNA, 22 bp, Homo sapiens
gagctctttcggttgttttcga

SEQ ID NO: 8268617 - DNA, 22 bp, Homo sapiens
gagctcttttgatgaaggtagt

SEQ ID NO: 8268618 - DNA, 22 bp, Homo sapiens
gagctcttttgccagtcactgc

SEQ ID NO: 8268619 - DNA, 22 bp, Homo sapiens
gagctctttcatggttctgtga

SEQ ID NO: 8268620 - DNA, 22 bp, Homo sapiens
gagctctttcagttgactccta

SEQ ID NO: 8268621 - DNA, 22 bp, Homo sapiens
gagctctttcctgcccatactg

SEQ ID NO: 8268622 - DNA, 22 bp, Homo sapiens
gagctcttcgcctgtcgctgag

SEQ ID NO: 8268623 - DNA, 22 bp, Homo sapiens
gagctcttcctttcaggaggcc

SEQ ID NO: 8268624 - DNA, 18 bp, Homo sapiens
gagctcttcccttttctc

SEQ ID NO: 8268625 - DNA, 22 bp, Homo sapiens
gagctcttatagttctagcagt

SEQ ID NO: 8268626 - DNA, 22 bp, Homo sapiens
gagctcttccccatcttacatc

SEQ ID NO: 8268627 - DNA, 22 bp, Homo sapiens
gagctcttctaaagatggcaat

SEQ ID NO: 8268628 - DNA, 22 bp, Homo sapiens
gagctcttctggggtaagggac

SEQ ID NO: 8268629 - DNA, 22 bp, Homo sapiens
gagctcttctggttagatgttg

SEQ ID NO: 8268630 - DNA, 22 bp, Homo sapiens
gagctcttgtagtatgcggtaa

SEQ ID NO: 8268631 - DNA, 22 bp, Homo sapiens
gagctctttaccaggtcaggac

SEQ ID NO: 8268632 - DNA, 22 bp, Homo sapiens
gagctcttgcttctagtccagg

SEQ ID NO: 8268633 - DNA, 22 bp, Homo sapiens
gaaatgccctcccactgaatgt

SEQ ID NO: 8268634 - DNA, 22 bp, Homo sapiens
gacacagaaggtcacatgttca

SEQ ID NO: 8268635 - DNA, 22 bp, Homo sapiens
gacacagacagttagaggtaat

SEQ ID NO: 8268636 - DNA, 22 bp, Homo sapiens
gacacagaatttactcccgata

SEQ ID NO: 8268637 - DNA, 22 bp, Homo sapiens
gacccatataggaccctccaaa

SEQ ID NO: 8268638 - DNA, 22 bp, Homo sapiens
cttgacttcttctagaaataag

SEQ ID NO: 8268639 - DNA, 22 bp, Homo sapiens
cttatttatgtctgtctctaat

SEQ ID NO: 8268640 - DNA, 22 bp, Homo sapiens
ctgtcctgtctgcttttaattt

SEQ ID NO: 8268641 - DNA, 22 bp, Homo sapiens
ctgtcctgtgcattgtcagatg

SEQ ID NO: 8268642 - DNA, 22 bp, Homo sapiens
ctgtcctgtagctccatcagtc

SEQ ID NO: 8268643 - DNA, 20 bp, Homo sapiens
ctgtcctgatcttttcagaa

SEQ ID NO: 8268644 - DNA, 22 bp, Homo sapiens
ctgtcctgaaagggagattggg

SEQ ID NO: 8268645 - DNA, 22 bp, Homo sapiens
ctgggaggcagaggttgcagtg

SEQ ID NO: 8268646 - DNA, 22 bp, Homo sapiens
gtattgcatagacctgggatga

SEQ ID NO: 8268647 - DNA, 22 bp, Homo sapiens
ggttttctgctgaagatttcac

SEQ ID NO: 8268648 - DNA, 22 bp, Homo sapiens
ggttttctccccctcttctcag

SEQ ID NO: 8268649 - DNA, 22 bp, Homo sapiens
ggtaggggaagacaagtgaaaa

SEQ ID NO: 8268650 - DNA, 22 bp, Homo sapiens
gggacatctttctagtcagggt

SEQ ID NO: 8268651 - DNA, 22 bp, Homo sapiens
ggctctttaacttgtctaaatt

SEQ ID NO: 8268652 - DNA, 22 bp, Homo sapiens
ggctctttggcgggccttgaac

SEQ ID NO: 8268653 - DNA, 22 bp, Homo sapiens
ggcaacctgagcttgtggagaa

SEQ ID NO: 8268654 - DNA, 22 bp, Homo sapiens
ggagtgagtactggagtagctg

SEQ ID NO: 8268655 - DNA, 22 bp, Homo sapiens
gcgggtttgatgtgctaatgag

SEQ ID NO: 8268656 - DNA, 22 bp, Homo sapiens
gcgggttttgtgaatgtaggtt

SEQ ID NO: 8268657 - DNA, 22 bp, Homo sapiens
gctgctaagcgtttctgttcca

SEQ ID NO: 8268658 - DNA, 22 bp, Homo sapiens
gcatgcagtaaaattcagcaac

SEQ ID NO: 8268659 - DNA, 22 bp, Homo sapiens
gccacatagaggaggatattaa

SEQ ID NO: 8268660 - DNA, 22 bp, Homo sapiens
gcatgcagaaaatgaacaacga

SEQ ID NO: 8268661 - DNA, 21 bp, Homo sapiens
gccagcctgtttacctgtggt

SEQ ID NO: 8268662 - DNA, 22 bp, Homo sapiens
gccccacagcctgcggtctcag

SEQ ID NO: 8268663 - DNA, 22 bp, Homo sapiens
gcccagcctccaagctccaagg

SEQ ID NO: 8268664 - DNA, 22 bp, Homo sapiens
gcaaatattcaagacttttcca

SEQ ID NO: 8268665 - DNA, 22 bp, Homo sapiens
gcacacactgttttcctcacat

SEQ ID NO: 8268666 - DNA, 22 bp, Homo sapiens
gcacacaggggagttctcagaa

SEQ ID NO: 8268667 - DNA, 22 bp, Homo sapiens
gcacacagtagggattcaatga

SEQ ID NO: 8268668 - DNA, 22 bp, Homo sapiens
gcacacagtatatgctcattaa

SEQ ID NO: 8268669 - DNA, 22 bp, Homo sapiens
gcacacattcggattcttaacc

SEQ ID NO: 8268670 - DNA, 22 bp, Homo sapiens
gcacacatgcatgcacaggagt

SEQ ID NO: 8268671 - DNA, 22 bp, Homo sapiens
gcacataaagggcatgggaggt

SEQ ID NO: 8268672 - DNA, 22 bp, Homo sapiens
gcacataactgaccacatctaa

SEQ ID NO: 8268673 - DNA, 22 bp, Homo sapiens
gcacatacccactgtcaagcac

SEQ ID NO: 8268674 - DNA, 22 bp, Homo sapiens
gcacatactgcaaagattacta

SEQ ID NO: 8268675 - DNA, 22 bp, Homo sapiens
gcacatgcaacagagattttca

SEQ ID NO: 8268676 - DNA, 22 bp, Homo sapiens
tacttttctttgtcatgcatct

SEQ ID NO: 8268677 - DNA, 22 bp, Homo sapiens
tacttttctgtgtggcagtcac

SEQ ID NO: 8268678 - DNA, 22 bp, Homo sapiens
tacttttcctggaaccactgct

SEQ ID NO: 8268679 - DNA, 22 bp, Homo sapiens
tacttttccagggctggctgag

SEQ ID NO: 8268680 - DNA, 22 bp, Homo sapiens
tacttttctataggtttgaaat

SEQ ID NO: 8268681 - DNA, 22 bp, Homo sapiens
tacttttcaagcagctggttat

SEQ ID NO: 8268682 - DNA, 22 bp, Homo sapiens
tacttttcacccagcccgcttc

SEQ ID NO: 8268683 - DNA, 22 bp, Homo sapiens
tacttttcataatgaagcagca

SEQ ID NO: 8268684 - DNA, 22 bp, Homo sapiens
tagacacatcttcatccacaat

SEQ ID NO: 8268685 - DNA, 22 bp, Homo sapiens
tagctcttcaatcactgtctcc

SEQ ID NO: 8268686 - DNA, 22 bp, Homo sapiens
tagctcttcacctctaggcact

SEQ ID NO: 8268687 - DNA, 22 bp, Homo sapiens
tagctcttaggtgcgtggctct

SEQ ID NO: 8268688 - DNA, 22 bp, Homo sapiens
tagctcttaccaggtggccatg

SEQ ID NO: 8268689 - DNA, 22 bp, Homo sapiens
tagctcttaagtctgtgataga

SEQ ID NO: 8268690 - DNA, 22 bp, Homo sapiens
tagctcttcaggtgcctttcac

SEQ ID NO: 8268691 - DNA, 22 bp, Homo sapiens
tagctcttgatgctggcaggac

SEQ ID NO: 8268692 - DNA, 22 bp, Homo sapiens
tagctcttcatttcatctgatt

SEQ ID NO: 8268693 - DNA, 22 bp, Homo sapiens
tagctcttctaatggtaaagag

SEQ ID NO: 8268694 - DNA, 22 bp, Homo sapiens
tagctctttattaaggcccaga

SEQ ID NO: 8268695 - DNA, 22 bp, Homo sapiens
tagctcttgtgttttacatata

SEQ ID NO: 8268696 - DNA, 18 bp, Homo sapiens
tagctcttgttggtccat

SEQ ID NO: 8268697 - DNA, 22 bp, Homo sapiens
tagctcttgccagatcctcgat

SEQ ID NO: 8268698 - DNA, 22 bp, Homo sapiens
tagctcttgccatctgtcttat

SEQ ID NO: 8268699 - DNA, 22 bp, Homo sapiens
tagctcttggaacgtgttaatt

SEQ ID NO: 8268700 - DNA, 22 bp, Homo sapiens
tagctctttgagattggttctt

SEQ ID NO: 8268701 - DNA, 22 bp, Homo sapiens
tagctctttgtacaagtagatg

SEQ ID NO: 8268702 - DNA, 22 bp, Homo sapiens
tagctcttttaatccttaggac

SEQ ID NO: 8268703 - DNA, 22 bp, Homo sapiens
tagctcttttataggaactctg

SEQ ID NO: 8268704 - DNA, 22 bp, Homo sapiens
taggatctcaccatagaaggaa

SEQ ID NO: 8268705 - DNA, 22 bp, Homo sapiens
tatgtcttcgtcacctatctca

SEQ ID NO: 8268706 - DNA, 22 bp, Homo sapiens
taaagggtaggttttactgtaa

SEQ ID NO: 8268707 - DNA, 21 bp, Homo sapiens
gttttgctggtatctggggat

SEQ ID NO: 8268708 - DNA, 21 bp, Homo sapiens
gttttctttgatagagggaag

SEQ ID NO: 8268709 - DNA, 23 bp, Homo sapiens
taaattacctttccagtgcaggg

SEQ ID NO: 8268710 - DNA, 22 bp, Homo sapiens
taacctgaacacacaataggga

SEQ ID NO: 8268711 - DNA, 23 bp, Homo sapiens
taacctgagttttttagatgcaa

SEQ ID NO: 8268712 - DNA, 22 bp, Homo sapiens
taacctgaggagaacagtgctt

SEQ ID NO: 8268713 - DNA, 23 bp, Homo sapiens
taacctgagattgcaagggagct

SEQ ID NO: 8268714 - DNA, 22 bp, Homo sapiens
taacctgactgctctttagaat

SEQ ID NO: 8268715 - DNA, 22 bp, Homo sapiens
tacattcctgttagcatctaag

SEQ ID NO: 8268716 - DNA, 22 bp, Homo sapiens
tcagacagattttgacacttgc

SEQ ID NO: 8268717 - DNA, 22 bp, Homo sapiens
tcacacatgctaagccagagat

SEQ ID NO: 8268718 - DNA, 22 bp, Homo sapiens
tcacacatgagtaaatacaggg

SEQ ID NO: 8268719 - DNA, 22 bp, Homo sapiens
tcacacatgagtaaatacaggg

SEQ ID NO: 8268720 - DNA, 22 bp, Homo sapiens
tcatggcacttagcacagtcct

SEQ ID NO: 8268721 - DNA, 16 bp, Homo sapiens
tcattgaagacagtac

SEQ ID NO: 8268722 - DNA, 22 bp, Homo sapiens
tcattgaacgaagagctccatt

SEQ ID NO: 8268723 - DNA, 22 bp, Homo sapiens
tcattgaagcattttgtgtatt

SEQ ID NO: 8268724 - DNA, 22 bp, Homo sapiens
tcattgaagacttactggcttc

SEQ ID NO: 8268725 - DNA, 22 bp, Homo sapiens
tcattgaagtgactgaaagatt

SEQ ID NO: 8268726 - DNA, 22 bp, Homo sapiens
tcattgaatacatatttgggat

SEQ ID NO: 8268727 - DNA, 22 bp, Homo sapiens
tcattgaagcccttgacaagcc

SEQ ID NO: 8268728 - DNA, 22 bp, Homo sapiens
tcattgaatgagatgcaataga

SEQ ID NO: 8268729 - DNA, 22 bp, Homo sapiens
tcattgaatatggggccataca

SEQ ID NO: 8268730 - DNA, 22 bp, Homo sapiens
tcattgaatgctctgcaggttg

SEQ ID NO: 8268731 - DNA, 22 bp, Homo sapiens
tcattgaattctgggggttgag

SEQ ID NO: 8268732 - DNA, 22 bp, Homo sapiens
tcattgaatttcacagctttat

SEQ ID NO: 8268733 - DNA, 22 bp, Homo sapiens
tcattgaatttggttcaatatg

SEQ ID NO: 8268734 - DNA, 22 bp, Homo sapiens
tcccacacagcccgctcaccgg

SEQ ID NO: 8268735 - DNA, 22 bp, Homo sapiens
tcccacacctgtctattcctag

SEQ ID NO: 8268736 - DNA, 22 bp, Homo sapiens
tcccacactacacggttgttgg

SEQ ID NO: 8268737 - DNA, 22 bp, Homo sapiens
tcccacacttgaaacaaggctg

SEQ ID NO: 8268738 - DNA, 22 bp, Homo sapiens
tccccaccccagaactactagg

SEQ ID NO: 8268739 - DNA, 22 bp, Homo sapiens
tccccacacagatacagagtag

SEQ ID NO: 8268740 - DNA, 21 bp, Homo sapiens
tccccacatttctaaacagac

SEQ ID NO: 8268741 - DNA, 22 bp, Homo sapiens
tccccacatctctgcatcaggc

SEQ ID NO: 8268742 - DNA, 22 bp, Homo sapiens
tccccacactttcactcctggc

SEQ ID NO: 8268743 - DNA, 22 bp, Homo sapiens
tccccacagcagaagatctgag

SEQ ID NO: 8268744 - DNA, 22 bp, Homo sapiens
tcccacaggaaagtagacattg

SEQ ID NO: 8268745 - DNA, 22 bp, Homo sapiens
ttttgaaagggtgatttggctt

SEQ ID NO: 8268746 - DNA, 22 bp, Homo sapiens
ttttttgtcttgaagaaatggt

SEQ ID NO: 8268747 - DNA, 22 bp, Homo sapiens
tttttgggtccaggctgtatct

SEQ ID NO: 8268748 - DNA, 22 bp, Homo sapiens
tttctgctcatcctagtggagc

SEQ ID NO: 8268749 - DNA, 22 bp, Homo sapiens
tttcttgtctttagtatctggc

SEQ ID NO: 8268750 - DNA, 20 bp, Homo sapiens
tttcttgtacttggagaagg

SEQ ID NO: 8268751 - DNA, 22 bp, Homo sapiens
tttcattgtcagagctttgaat

SEQ ID NO: 8268752 - DNA, 22 bp, Homo sapiens
ttgtttttatgaacatccagga

SEQ ID NO: 8268753 - DNA, 22 bp, Homo sapiens
ttgtttttagagaagccctgaa

SEQ ID NO: 8268754 - DNA, 22 bp, Homo sapiens
tttattaagatgcgaatgctga

SEQ ID NO: 8268755 - DNA, 22 bp, Homo sapiens
tttattaatgtagcatccatgg

SEQ ID NO: 8268756 - DNA, 22 bp, Homo sapiens
tttataaaatagactgggtcta

SEQ ID NO: 8268757 - DNA, 22 bp, Homo sapiens
ttgatgatcttacggcagagga

SEQ ID NO: 8268758 - DNA, 22 bp, Homo sapiens
ttctttatggaatggtgatagt

SEQ ID NO: 8268759 - DNA, 22 bp, Homo sapiens
ttctttaaatgaattctctgta

SEQ ID NO: 8268760 - DNA, 22 bp, Homo sapiens
ttctttatcagttactcatagg

SEQ ID NO: 8268761 - DNA, 20 bp, Homo sapiens
ttcatgggagcaaagaggcc

SEQ ID NO: 8268762 - DNA, 20 bp, Homo sapiens
ttccacatctttgcacatgc

SEQ ID NO: 8268763 - DNA, 22 bp, Homo sapiens
ttcctgtggtccagagtcatcc

SEQ ID NO: 8268764 - DNA, 17 bp, Homo sapiens
ttcctgtggtttgatct

SEQ ID NO: 8268765 - DNA, 22 bp, Homo sapiens
ttcctgtggccttacatctgtg

SEQ ID NO: 8268766 - DNA, 19 bp, Homo sapiens
ttcctgtgctgctgtgtcc

SEQ ID NO: 8268767 - DNA, 23 bp, Homo sapiens
tgttttcttgtcctggtataatt

SEQ ID NO: 8268768 - DNA, 22 bp, Homo sapiens
tgttttcttcctaattgctcat

SEQ ID NO: 8268769 - DNA, 22 bp, Homo sapiens
tgttttcttctgtaccgtgcca

SEQ ID NO: 8268770 - DNA, 22 bp, Homo sapiens
tgttttctgggtggaaggtact

SEQ ID NO: 8268771 - DNA, 22 bp, Homo sapiens
tgttttctgtgtagagatcaca

SEQ ID NO: 8268772 - DNA, 22 bp, Homo sapiens
tgttttctgattctcgtgtggt

SEQ ID NO: 8268773 - DNA, 17 bp, Homo sapiens
tgttttctgctaccttt

SEQ ID NO: 8268774 - DNA, 22 bp, Homo sapiens
tgttttctgatggttaatgagt

SEQ ID NO: 8268775 - DNA, 22 bp, Homo sapiens
tgttttctcttgaaaagcagtc

SEQ ID NO: 8268776 - DNA, 22 bp, Homo sapiens
tgtttactcactgtatccacaa

SEQ ID NO: 8268777 - DNA, 22 bp, Homo sapiens
tgtttactccagctgatggaac

SEQ ID NO: 8268778 - DNA, 22 bp, Homo sapiens
tgtttactatgatgtaacctat

SEQ ID NO: 8268779 - DNA, 22 bp, Homo sapiens
tgtttactagccaacatggaga

SEQ ID NO: 8268780 - DNA, 22 bp, Homo sapiens
tgttatttgggaaagttgtaca

SEQ ID NO: 8268781 - DNA, 22 bp, Homo sapiens
tgtgtgaattacgcgtgtcctg

SEQ ID NO: 8268782 - DNA, 22 bp, Homo sapiens
gcactagagcagctctcagaga

SEQ ID NO: 8268783 - DNA, 22 bp, Homo sapiens
atttggaaggagctgcacagca

SEQ ID NO: 8268784 - DNA, 22 bp, Homo sapiens
attttagagaaacaaacgtagg

SEQ ID NO: 8268785 - DNA, 22 bp, Homo sapiens
attttagagctccaagtacagc

SEQ ID NO: 8268786 - DNA, 22 bp, Homo sapiens
atggtggaagagcatcagaaag

SEQ ID NO: 8268787 - DNA, 22 bp, Homo sapiens
gaggtggcccttgctcagcctt

SEQ ID NO: 8268788 - DNA, 19 bp, Homo sapiens
gagggctcatttgaacaat

SEQ ID NO: 8268789 - DNA, 22 bp, Homo sapiens
gacacatagatctatctcactc

SEQ ID NO: 8268790 - DNA, 22 bp, Homo sapiens
gaccaagatacagcatcataga

SEQ ID NO: 8268791 - DNA, 22 bp, Homo sapiens
ggtgagagaaaagaaacactgt

SEQ ID NO: 8268792 - DNA, 22 bp, Homo sapiens
cagaccatgatggacagctctg

SEQ ID NO: 8268793 - DNA, 22 bp, Homo sapiens
gctggaggatggactggaagaa

SEQ ID NO: 8268794 - DNA, 22 bp, Homo sapiens
caaatgtatcagcccagggatt

SEQ ID NO: 8268795 - DNA, 22 bp, Homo sapiens
caaatgtatgttttcctatgta

SEQ ID NO: 8268796 - DNA, 22 bp, Homo sapiens
ggcatttttgacaaagagcaat

SEQ ID NO: 8268797 - DNA, 22 bp, Homo sapiens
ggaggtggagctggaagttcca

SEQ ID NO: 8268798 - DNA, 21 bp, Homo sapiens
cactttaatggatatttgttt

SEQ ID NO: 8268799 - DNA, 22 bp, Homo sapiens
ctaggtacttagtaaatattaa

SEQ ID NO: 8268800 - DNA, 22 bp, Homo sapiens
agtcccaacagcttacaaggaa

SEQ ID NO: 8268801 - DNA, 22 bp, Homo sapiens
ctagaatactcgtattattccc

SEQ ID NO: 8268802 - DNA, 21 bp, Homo sapiens
ctctgcagtgcccaccttgcc

SEQ ID NO: 8268803 - DNA, 22 bp, Homo sapiens
ctctgctaagcatgaacaatta

SEQ ID NO: 8268804 - DNA, 17 bp, Homo sapiens
ctgaaatattatgataa

SEQ ID NO: 8268805 - DNA, 22 bp, Homo sapiens
ctgaaatatagatgtgaacagt

SEQ ID NO: 8268806 - DNA, 22 bp, Homo sapiens
ctgaaatagtttcatagaactt

SEQ ID NO: 8268807 - DNA, 23 bp, Homo sapiens
ctgaaataccagaaaatcagtgt

SEQ ID NO: 8268808 - DNA, 22 bp, Homo sapiens
atctctgatttacagcatctct

SEQ ID NO: 8268809 - DNA, 20 bp, Homo sapiens
atcagaagtgatattaacca

SEQ ID NO: 8268810 - DNA, 22 bp, Homo sapiens
atcagaagtgatgtgtgttatt

SEQ ID NO: 8268811 - DNA, 22 bp, Homo sapiens
atcagaagcttgtagtctctct

SEQ ID NO: 8268812 - DNA, 22 bp, Homo sapiens
atcagaaggggaggtaaagaag

SEQ ID NO: 8268813 - DNA, 22 bp, Homo sapiens
atattgatggaggtgttagaca

SEQ ID NO: 8268814 - DNA, 22 bp, Homo sapiens
atattgttagtaatatttcgaa

SEQ ID NO: 8268815 - DNA, 22 bp, Homo sapiens
ataacagtgacctctcagcacc

SEQ ID NO: 8268816 - DNA, 22 bp, Homo sapiens
ataaattaggatctggggttcc

SEQ ID NO: 8268817 - DNA, 23 bp, Homo sapiens
ataaattactatctccctagagc

SEQ ID NO: 8268818 - DNA, 22 bp, Homo sapiens
ataaatgaacattcacagagct

SEQ ID NO: 8268819 - DNA, 20 bp, Homo sapiens
atacagatggttccagctgg

SEQ ID NO: 8268820 - DNA, 22 bp, Homo sapiens
aggctctggtgcagctgtaact

SEQ ID NO: 8268821 - DNA, 22 bp, Homo sapiens
aggctctgggctctagattttg

SEQ ID NO: 8268822 - DNA, 22 bp, Homo sapiens
aggctctggttggcaagtaaag

SEQ ID NO: 8268823 - DNA, 22 bp, Homo sapiens
cccaggaagttgatgcagagga

SEQ ID NO: 8268824 - DNA, 22 bp, Homo sapiens
cccaggaagggatgccaaggaa

SEQ ID NO: 8268825 - DNA, 22 bp, Homo sapiens
cccaggaagagtgagtggcatt

SEQ ID NO: 8268826 - DNA, 22 bp, Homo sapiens
cccaggaacagcacagaacagc

SEQ ID NO: 8268827 - DNA, 22 bp, Homo sapiens
agcttctcagatggactgttag

SEQ ID NO: 8268828 - DNA, 22 bp, Homo sapiens
agcttctcagaagagtcctgta

SEQ ID NO: 8268829 - DNA, 22 bp, Homo sapiens
agcttctcaagtgtttgcgggg

SEQ ID NO: 8268830 - DNA, 21 bp, Homo sapiens
aggcacttaaccaatgttagc

SEQ ID NO: 8268831 - DNA, 22 bp, Homo sapiens
aggcacttgcattgatgaggtc

SEQ ID NO: 8268832 - DNA, 22 bp, Homo sapiens
aggcacttggaggtctctgccc

SEQ ID NO: 8268833 - DNA, 22 bp, Homo sapiens
aggcacttaacctactaactga

SEQ ID NO: 8268834 - DNA, 22 bp, Homo sapiens
aggcactttaggatcaggttga

SEQ ID NO: 8268835 - DNA, 22 bp, Homo sapiens
aggcactttacaatgtgtgaca

SEQ ID NO: 8268836 - DNA, 22 bp, Homo sapiens
aggcaactcatcatgaaagact

SEQ ID NO: 8268837 - DNA, 22 bp, Homo sapiens
agggccagttcagaggacatgg

SEQ ID NO: 8268838 - DNA, 22 bp, Homo sapiens
agggccagcccataatgccaaa

SEQ ID NO: 8268839 - DNA, 22 bp, Homo sapiens
agggccagcagcttggccaacc

SEQ ID NO: 8268840 - DNA, 22 bp, Homo sapiens
agggccagatgaagccacaagc

SEQ ID NO: 8268841 - DNA, 22 bp, Homo sapiens
aggctctggagtgtggtgctgg

SEQ ID NO: 8268842 - DNA, 22 bp, Homo sapiens
aggctctgcttttctggatata

SEQ ID NO: 8268843 - DNA, 22 bp, Homo sapiens
aggctctgacgtcacacgtggc

SEQ ID NO: 8268844 - DNA, 22 bp, Homo sapiens
aggctctgaagcaaccctttga

SEQ ID NO: 8268845 - DNA, 22 bp, Homo sapiens
aggctctggagttagccaggca

SEQ ID NO: 8268846 - DNA, 22 bp, Homo sapiens
aggcactggtccattttctgca

SEQ ID NO: 8268847 - DNA, 22 bp, Homo sapiens
agttcaacaccagcctgaccaa

SEQ ID NO: 8268848 - DNA, 22 bp, Homo sapiens
aggtgggtatcatgagagatta

SEQ ID NO: 8268849 - DNA, 22 bp, Homo sapiens
agtaacatctttgacatttgtt

SEQ ID NO: 8268850 - DNA, 20 bp, Homo sapiens
atagaagtattatgtaatgt

SEQ ID NO: 8268851 - DNA, 23 bp, Homo sapiens
atagttagcacacttacaactgc

SEQ ID NO: 8268852 - DNA, 22 bp, Homo sapiens
ataaattatgaatggccctttt

SEQ ID NO: 8268853 - DNA, 22 bp, Homo sapiens
agaaatatgctgattagatgaa

SEQ ID NO: 8268854 - DNA, 20 bp, Homo sapiens
agaaatattgagttcagagg

SEQ ID NO: 8268855 - DNA, 20 bp, Homo sapiens
atcctggaatccaaatggag

SEQ ID NO: 8268856 - DNA, 22 bp, Homo sapiens
agaaatgttacagttgttattt

SEQ ID NO: 8268857 - DNA, 22 bp, Homo sapiens
agaaatgtggatcgttttaaaa

SEQ ID NO: 8268858 - DNA, 22 bp, Homo sapiens
agaaatgttgaatacacaaaat

SEQ ID NO: 8268859 - DNA, 22 bp, Homo sapiens
agaaatgttcttcatttgccat

SEQ ID NO: 8268860 - DNA, 22 bp, Homo sapiens
agaaatgtccagggctaggatc

SEQ ID NO: 8268861 - DNA, 20 bp, Homo sapiens
agaaatgtgaaaggctgagt

SEQ ID NO: 8268862 - DNA, 22 bp, Homo sapiens
agaaatgtgaatttcatttcct

SEQ ID NO: 8268863 - DNA, 22 bp, Homo sapiens
agaaatgtggaggaacagggct

SEQ ID NO: 8268864 - DNA, 22 bp, Homo sapiens
agaaatgtgagccccttatcaa

SEQ ID NO: 8268865 - DNA, 22 bp, Homo sapiens
agaaatgtaattgcaactgtct

SEQ ID NO: 8268866 - DNA, 22 bp, Homo sapiens
agaaatgtacacgacacccaga

SEQ ID NO: 8268867 - DNA, 22 bp, Homo sapiens
agaaatgtatagtgaatttttc

SEQ ID NO: 8268868 - DNA, 22 bp, Homo sapiens
agaaatgtaggcatataaggaa

SEQ ID NO: 8268869 - DNA, 22 bp, Homo sapiens
agaaatgtacgatgttatgcag

SEQ ID NO: 8268870 - DNA, 22 bp, Homo sapiens
agaaatgtcaggaaagaagtcc

SEQ ID NO: 8268871 - DNA, 22 bp, Homo sapiens
agaaatgtcaagtgttcttgtt

SEQ ID NO: 8268872 - DNA, 21 bp, Homo sapiens
agaaatgtatcattcttttcc

SEQ ID NO: 8268873 - DNA, 22 bp, Homo sapiens
agaaatgtattctgtatgtttt

SEQ ID NO: 8268874 - DNA, 22 bp, Homo sapiens
agaaatgtttatggctgcctat

SEQ ID NO: 8268875 - DNA, 22 bp, Homo sapiens
agaaatgttgaatacatcagga

SEQ ID NO: 8268876 - DNA, 22 bp, Homo sapiens
agaaatgttgtgggttttgtta

SEQ ID NO: 8268877 - DNA, 22 bp, Homo sapiens
agaaatgtttactcaccccctt

SEQ ID NO: 8268878 - DNA, 22 bp, Homo sapiens
cagcctttagcattaattccaa

SEQ ID NO: 8268879 - DNA, 22 bp, Homo sapiens
cagatccatagagttctggaga

SEQ ID NO: 8268880 - DNA, 22 bp, Homo sapiens
agcaattatgataaggccgctg

SEQ ID NO: 8268881 - DNA, 22 bp, Homo sapiens
cactttgatgcagggctcagta

SEQ ID NO: 8268882 - DNA, 22 bp, Homo sapiens
atgaccagccgagataaacaga

SEQ ID NO: 8268883 - DNA, 22 bp, Homo sapiens
agagatgggaaggcagacttca

SEQ ID NO: 8268884 - DNA, 22 bp, Homo sapiens
agagatggcgtctcagagcctg

SEQ ID NO: 8268885 - DNA, 22 bp, Homo sapiens
atttacagccttgccatctata

SEQ ID NO: 8268886 - DNA, 22 bp, Homo sapiens
agattggtgttgcagaaccatg

SEQ ID NO: 8268887 - DNA, 22 bp, Homo sapiens
aagggttagttggattatttat

SEQ ID NO: 8268888 - DNA, 22 bp, Homo sapiens
acatgacagtgcttagcaaact

SEQ ID NO: 8268889 - DNA, 22 bp, Homo sapiens
aatctagagttcccagcataaa

SEQ ID NO: 8268890 - DNA, 22 bp, Homo sapiens
aatctagattcggatcaaaggg

SEQ ID NO: 8268891 - DNA, 22 bp, Homo sapiens
aagttccctttctttgccagga

SEQ ID NO: 8268892 - DNA, 22 bp, Homo sapiens
actgtcctgaatactgcatgac

SEQ ID NO: 8268893 - DNA, 22 bp, Homo sapiens
aatgccttgcctgctacaactt

SEQ ID NO: 8268894 - DNA, 22 bp, Homo sapiens
agagcaatttcttctccaagtt

SEQ ID NO: 8268895 - DNA, 22 bp, Homo sapiens
aaatccagtgttcaaagtttga

SEQ ID NO: 8268896 - DNA, 22 bp, Homo sapiens
aaatccagtgggtcctcatgag

SEQ ID NO: 8268897 - DNA, 20 bp, Homo sapiens
aaatccagtgtgtattttac

SEQ ID NO: 8268898 - DNA, 22 bp, Homo sapiens
aaataacagtcagggacaacat

SEQ ID NO: 8268899 - DNA, 22 bp, Homo sapiens
aacttgaactgatgagtgttag

SEQ ID NO: 8268900 - DNA, 22 bp, Homo sapiens
aacttgaagaggctttttggca

SEQ ID NO: 8268901 - DNA, 22 bp, Homo sapiens
aacttgaatgagaacttttgcc

SEQ ID NO: 8268902 - DNA, 22 bp, Homo sapiens
aaggcccagcgtgacctcagtg

SEQ ID NO: 8268903 - DNA, 22 bp, Homo sapiens
aacagttattatcacattagtg

SEQ ID NO: 8268904 - DNA, 22 bp, Homo sapiens
aacagttacccttaagatcttt

SEQ ID NO: 8268905 - DNA, 22 bp, Homo sapiens
aagtctgtagaaaaacagttta

SEQ ID NO: 8268906 - DNA, 22 bp, Homo sapiens
aagtcttttgttcaggctggca

SEQ ID NO: 8268907 - DNA, 22 bp, Homo sapiens
aagttaaggaagtcatactatg

SEQ ID NO: 8268908 - DNA, 22 bp, Homo sapiens
aatccagattccagaaaatcgc

SEQ ID NO: 8268909 - DNA, 22 bp, Homo sapiens
acacttgataggtcaaatcagt

SEQ ID NO: 8268910 - DNA, 22 bp, Homo sapiens
tccaggcatgttgggaagatga

SEQ ID NO: 8268911 - DNA, 20 bp, Homo sapiens
tccaggaggttagtgtggct

SEQ ID NO: 8268912 - DNA, 22 bp, Homo sapiens
tccagacattttatagcagtct

SEQ ID NO: 8268913 - DNA, 18 bp, Homo sapiens
tccagctcacagatgggc

SEQ ID NO: 8268914 - DNA, 22 bp, Homo sapiens
tccagctcccactctcactgct

SEQ ID NO: 8268915 - DNA, 22 bp, Homo sapiens
tccaggaaagtgggatgtgtgt

SEQ ID NO: 8268916 - DNA, 21 bp, Homo sapiens
tccaggaaagttttaagagtg

SEQ ID NO: 8268917 - DNA, 22 bp, Homo sapiens
tccaggaaacagcatctcagca

SEQ ID NO: 8268918 - DNA, 22 bp, Homo sapiens
tccaggaaacactcaagccatg

SEQ ID NO: 8268919 - DNA, 22 bp, Homo sapiens
tcatggctaatgcagtatattc

SEQ ID NO: 8268920 - DNA, 22 bp, Homo sapiens
tcagctccacagctcctctgcc

SEQ ID NO: 8268921 - DNA, 22 bp, Homo sapiens
tcacttgactttccagtcttgg

SEQ ID NO: 8268922 - DNA, 22 bp, Homo sapiens
tcacttgactccagtttcttct

SEQ ID NO: 8268923 - DNA, 22 bp, Homo sapiens
tcacttgaattcattctgcgaa

SEQ ID NO: 8268924 - DNA, 22 bp, Homo sapiens
tcacttgacccttctctagcct

SEQ ID NO: 8268925 - DNA, 22 bp, Homo sapiens
tcacttcttcagctttccttga

SEQ ID NO: 8268926 - DNA, 22 bp, Homo sapiens
tcactctgttttactcactgtt

SEQ ID NO: 8268927 - DNA, 22 bp, Homo sapiens
tcactctgagaggtcactggaa

SEQ ID NO: 8268928 - DNA, 21 bp, Homo sapiens
tacattgactacaaataaagc

SEQ ID NO: 8268929 - DNA, 22 bp, Homo sapiens
tacagagtgttattacagaatc

SEQ ID NO: 8268930 - DNA, 18 bp, Homo sapiens
tacagaactggagtagaa

SEQ ID NO: 8268931 - DNA, 19 bp, Homo sapiens
tattatttgtagcaaggcc

SEQ ID NO: 8268932 - DNA, 22 bp, Homo sapiens
taggcactggttgtggatagtt

SEQ ID NO: 8268933 - DNA, 22 bp, Homo sapiens
taggcaagttgcccaatctctc

SEQ ID NO: 8268934 - DNA, 22 bp, Homo sapiens
taggcactgaccttctcagatt

SEQ ID NO: 8268935 - DNA, 22 bp, Homo sapiens
tagaaactactagaataagaga

SEQ ID NO: 8268936 - DNA, 22 bp, Homo sapiens
gcagatggactgtatgacctga

SEQ ID NO: 8268937 - DNA, 22 bp, Homo sapiens
gcaaagtaaaaatagattctga

SEQ ID NO: 8268938 - DNA, 22 bp, Homo sapiens
gcaaagtattaagtattaagtt

SEQ ID NO: 8268939 - DNA, 21 bp, Homo sapiens
gcagatgggagtcatcaggct

SEQ ID NO: 8268940 - DNA, 22 bp, Homo sapiens
gcagatggctcagacactgggg

SEQ ID NO: 8268941 - DNA, 23 bp, Homo sapiens
gcagatggccccagagtgctgcc

SEQ ID NO: 8268942 - DNA, 22 bp, Homo sapiens
gcagatggcagcccaggctggg

SEQ ID NO: 8268943 - DNA, 22 bp, Homo sapiens
ggacacagctgcagccacaccc

SEQ ID NO: 8268944 - DNA, 22 bp, Homo sapiens
ggacacagtggaagacagcttg

SEQ ID NO: 8268945 - DNA, 22 bp, Homo sapiens
ggagcagggaattacagcgcag

SEQ ID NO: 8268946 - DNA, 22 bp, Homo sapiens
ggcaagaggtccaagaggtctc

SEQ ID NO: 8268947 - DNA, 18 bp, Homo sapiens
ggcttctgggacatttta

SEQ ID NO: 8268948 - DNA, 23 bp, Homo sapiens
gggcatggagtgtaggtggaagg

SEQ ID NO: 8268949 - DNA, 22 bp, Homo sapiens
gggcatggtggcaggcacctgt

SEQ ID NO: 8268950 - DNA, 22 bp, Homo sapiens
gggcatggccaggtgaggggtc

SEQ ID NO: 8268951 - DNA, 22 bp, Homo sapiens
gggcatggggcggacctggttc

SEQ ID NO: 8268952 - DNA, 22 bp, Homo sapiens
gtaccagtctctgtgggcacct

SEQ ID NO: 8268953 - DNA, 23 bp, Homo sapiens
gtagacagatgggccaaggtaat

SEQ ID NO: 8268954 - DNA, 22 bp, Homo sapiens
gtcccgcattgggcattcctgg

SEQ ID NO: 8268955 - DNA, 23 bp, Homo sapiens
gtatttcagcattctcagttaaa

SEQ ID NO: 8268956 - DNA, 22 bp, Homo sapiens
gtccagaagcagtgcacatcac

SEQ ID NO: 8268957 - DNA, 22 bp, Homo sapiens
ctggcaggagttgggattttga

SEQ ID NO: 8268958 - DNA, 22 bp, Homo sapiens
ctggcaggcactcatgaaataa

SEQ ID NO: 8268959 - DNA, 22 bp, Homo sapiens
ctggcaggcggcagagcccagg

SEQ ID NO: 8268960 - DNA, 22 bp, Homo sapiens
ctggcaggcagacttctgcaag

SEQ ID NO: 8268961 - DNA, 22 bp, Homo sapiens
ctggcaggaagttagatggtaa

SEQ ID NO: 8268962 - DNA, 22 bp, Homo sapiens
gaatatatttctcttaccttta

SEQ ID NO: 8268963 - DNA, 22 bp, Homo sapiens
gaatatattattcagcttttca

SEQ ID NO: 8268964 - DNA, 22 bp, Homo sapiens
gagccagggtttgaaactagac

SEQ ID NO: 8268965 - DNA, 22 bp, Homo sapiens
ttcacagaagaggtcacatttc

SEQ ID NO: 8268966 - DNA, 22 bp, Homo sapiens
cgtagacaactgaaatgcacag

SEQ ID NO: 8268967 - DNA, 22 bp, Homo sapiens
ctcacagagcctctgtgtcttc

SEQ ID NO: 8268968 - DNA, 22 bp, Homo sapiens
ctcacagatgctgtgggtcagg

SEQ ID NO: 8268969 - DNA, 22 bp, Homo sapiens
ctcacagatgtcctggcacttc

SEQ ID NO: 8268970 - DNA, 22 bp, Homo sapiens
ctcacagatctgtgcctgaacc

SEQ ID NO: 8268971 - DNA, 22 bp, Homo sapiens
ctcacagatatttgcttcaggt

SEQ ID NO: 8268972 - DNA, 22 bp, Homo sapiens
ctacagagaactcagctgccct

SEQ ID NO: 8268973 - DNA, 22 bp, Homo sapiens
ctacagagtgaatgcagaaaat

SEQ ID NO: 8268974 - DNA, 22 bp, Homo sapiens
ccttcctcatccatttctcttg

SEQ ID NO: 8268975 - DNA, 17 bp, Homo sapiens
ccttcctcatctccttc

SEQ ID NO: 8268976 - DNA, 22 bp, Homo sapiens
ctcttcttggaatgctgactgt

SEQ ID NO: 8268977 - DNA, 22 bp, Homo sapiens
ctctgccagccaaagtcatcac

SEQ ID NO: 8268978 - DNA, 22 bp, Homo sapiens
ctgcaccatctggagcacctcc

SEQ ID NO: 8268979 - DNA, 22 bp, Homo sapiens
ctgagccatccataccagctta

SEQ ID NO: 8268980 - DNA, 22 bp, Homo sapiens
ctgagccaaccacagcaggagc

SEQ ID NO: 8268981 - DNA, 20 bp, Homo sapiens
ctctttgaaatgctcttggg

SEQ ID NO: 8268982 - DNA, 22 bp, Homo sapiens
ttgaaatactgcattgttcagt

SEQ ID NO: 8268983 - DNA, 22 bp, Homo sapiens
ccagagaagtcttgcctggatt

SEQ ID NO: 8268984 - DNA, 22 bp, Homo sapiens
tcagtcaatgccttcctgggca

SEQ ID NO: 8268985 - DNA, 22 bp, Homo sapiens
tcagtcaatgtgtcagctctcc

SEQ ID NO: 8268986 - DNA, 22 bp, Homo sapiens
tcagtcaacataaatccaaggt

SEQ ID NO: 8268987 - DNA, 22 bp, Homo sapiens
tcagagtttctagtcaaatcca

SEQ ID NO: 8268988 - DNA, 22 bp, Homo sapiens
tagattgtaagctccttgaggg

SEQ ID NO: 8268989 - DNA, 22 bp, Homo sapiens
taggcattacctaacattacct

SEQ ID NO: 8268990 - DNA, 22 bp, Homo sapiens
taggcattttcagtgttgttgt

SEQ ID NO: 8268991 - DNA, 22 bp, Homo sapiens
taggcattttattgaacgtaac

SEQ ID NO: 8268992 - DNA, 22 bp, Homo sapiens
taggcatttaagatggataagg

SEQ ID NO: 8268993 - DNA, 22 bp, Homo sapiens
caggtgggtgtatgaatgcaaa

SEQ ID NO: 8268994 - DNA, 22 bp, Homo sapiens
cagtccaacctgccccttgggc

SEQ ID NO: 8268995 - DNA, 22 bp, Homo sapiens
caggtgggtacatcacagagac

SEQ ID NO: 8268996 - DNA, 22 bp, Homo sapiens
taatccagcgggtgattgcaca

SEQ ID NO: 8268997 - DNA, 22 bp, Homo sapiens
taatgttacactgcatggttca

SEQ ID NO: 8268998 - DNA, 22 bp, Homo sapiens
caggcatttaactctctaatgg

SEQ ID NO: 8268999 - DNA, 22 bp, Homo sapiens
tacttgttttgtgttcctaaac

SEQ ID NO: 8269000 - DNA, 22 bp, Homo sapiens
cccttctctttcactcactatt

SEQ ID NO: 8269001 - DNA, 22 bp, Homo sapiens
cctagatgggatggcggccggg

SEQ ID NO: 8269002 - DNA, 22 bp, Homo sapiens
cctaggcacccgagttatgttc

SEQ ID NO: 8269003 - DNA, 19 bp, Homo sapiens
cctaggcattgtccaaggg

SEQ ID NO: 8269004 - DNA, 17 bp, Homo sapiens
cctcttcctctcagctg

SEQ ID NO: 8269005 - DNA, 22 bp, Homo sapiens
tctttcttggtataaagcaggg

SEQ ID NO: 8269006 - DNA, 22 bp, Homo sapiens
tctttcttattatgctcaatgt

SEQ ID NO: 8269007 - DNA, 22 bp, Homo sapiens
tctttcttcctggagcccaaca

SEQ ID NO: 8269008 - DNA, 22 bp, Homo sapiens
tctttcttgcaaggatgcagga

SEQ ID NO: 8269009 - DNA, 22 bp, Homo sapiens
tcttccagtgctgtgtagagct

SEQ ID NO: 8269010 - DNA, 22 bp, Homo sapiens
tcttccagtgtagacatctgcc

SEQ ID NO: 8269011 - DNA, 19 bp, Homo sapiens
tctcagactgtgcttctgt

SEQ ID NO: 8269012 - DNA, 22 bp, Homo sapiens
tctgctttatggctcagagact

SEQ ID NO: 8269013 - DNA, 22 bp, Homo sapiens
tctgctttcaaattcacttagt

SEQ ID NO: 8269014 - DNA, 18 bp, Homo sapiens
ccaggacaggcaaaaggt

SEQ ID NO: 8269015 - DNA, 22 bp, Homo sapiens
ccaggacagtgaacatgtaaga

SEQ ID NO: 8269016 - DNA, 22 bp, Homo sapiens
tgagaataagagatagtttatt

SEQ ID NO: 8269017 - DNA, 22 bp, Homo sapiens
tgagaatactgcattgttagga

SEQ ID NO: 8269018 - DNA, 22 bp, Homo sapiens
tgagaataactgatttaaatgc

SEQ ID NO: 8269019 - DNA, 21 bp, Homo sapiens
tgatttctgccaagttcacta

SEQ ID NO: 8269020 - DNA, 23 bp, Homo sapiens
tgcaaagcacttaagaggccctg

SEQ ID NO: 8269021 - DNA, 22 bp, Homo sapiens
tgtggcacatacacaggagggc

SEQ ID NO: 8269022 - DNA, 22 bp, Homo sapiens
tcccctgcagcgcctgcttcta

SEQ ID NO: 8269023 - DNA, 22 bp, Homo sapiens
tcccctctttctggaaacacaa

SEQ ID NO: 8269024 - DNA, 22 bp, Homo sapiens
tgttatttatctgagcatttat

SEQ ID NO: 8269025 - DNA, 22 bp, Homo sapiens
tgttttctgtgtagagatcaca

SEQ ID NO: 8269026 - DNA, 22 bp, Homo sapiens
ttaacagtggctaagactgagg

SEQ ID NO: 8269027 - DNA, 22 bp, Homo sapiens
ttacaaacaacagacatttatt

SEQ ID NO: 8269028 - DNA, 22 bp, Homo sapiens
ttacaaactgtcatatagtatt

SEQ ID NO: 8269029 - DNA, 22 bp, Homo sapiens
ttcttctttatctcagtatcct

SEQ ID NO: 8269030 - DNA, 22 bp, Homo sapiens
ttctgtttataatttgcagttg

SEQ ID NO: 8269031 - DNA, 22 bp, Homo sapiens
ttctgctttcagttcttctggg

SEQ ID NO: 8269032 - DNA, 22 bp, Homo sapiens
ttctgagatacttttggcacca

SEQ ID NO: 8269033 - DNA, 22 bp, Homo sapiens
ttgaagattctttttgttagta

SEQ ID NO: 8269034 - DNA, 22 bp, Homo sapiens
ttgaagagcaccagcattttga

SEQ ID NO: 8269035 - DNA, 22 bp, Homo sapiens
ttgttacatacagcagaacata

SEQ ID NO: 8269036 - DNA, 22 bp, Homo sapiens
tttcctcttcttcccatgtcat

SEQ ID NO: 8269037 - DNA, 22 bp, Homo sapiens
tttcctctgtcatgacagctga

SEQ ID NO: 8269038 - DNA, 22 bp, Homo sapiens
tttccttctcagggagcttcaa

SEQ ID NO: 8269039 - DNA, 19 bp, Homo sapiens
tttctcaggaagtttgtgt

SEQ ID NO: 8269040 - DNA, 22 bp, Homo sapiens
tttctcagcgttcttagggctc

SEQ ID NO: 8269041 - DNA, 22 bp, Homo sapiens
tttctcagcctccttgctggag

SEQ ID NO: 8269042 - DNA, 22 bp, Homo sapiens
tttctcagctcagcatctgggt

SEQ ID NO: 8269043 - DNA, 22 bp, Homo sapiens
tttctcagtagtaatggcagtc

SEQ ID NO: 8269044 - DNA, 22 bp, Homo sapiens
tttctcagtaatgtcctggaat

SEQ ID NO: 8269045 - DNA, 22 bp, Homo sapiens
tttctcagggaggagtcaagcc

SEQ ID NO: 8269046 - DNA, 22 bp, Homo sapiens
tttctcagtgtagcttttcaag

SEQ ID NO: 8269047 - DNA, 22 bp, Homo sapiens
tttcttctgagatcagggagaa

SEQ ID NO: 8269048 - DNA, 22 bp, Homo sapiens
tttcttctaagatttcaaacta

SEQ ID NO: 8269049 - DNA, 22 bp, Homo sapiens
tttcttctcacccaggacagag

SEQ ID NO: 8269050 - DNA, 22 bp, Homo sapiens
tttcttcagccactccaaactg

SEQ ID NO: 8269051 - DNA, 22 bp, Homo sapiens
tttcttcccaagcagtttcaga

SEQ ID NO: 8269052 - DNA, 22 bp, Homo sapiens
ttttggcaaaggcattctcttt

SEQ ID NO: 8269053 - DNA, 22 bp, Homo sapiens
ttttggcaagctgggagatatt

SEQ ID NO: 8269054 - DNA, 21 bp, Homo sapiens
ttttggcaaggtgcatgtttc

SEQ ID NO: 8269055 - DNA, 22 bp, Homo sapiens
ttttggcagattacttaatatg

SEQ ID NO: 8269056 - DNA, 22 bp, Homo sapiens
ttttggcatcacttgccatcta

SEQ ID NO: 8269057 - DNA, 22 bp, Homo sapiens
ttttggcaggatatgcaccagc

SEQ ID NO: 8269058 - DNA, 22 bp, Homo sapiens
ttttggcagcaggtatggggca

SEQ ID NO: 8269059 - DNA, 22 bp, Homo sapiens
ttttcctttgattcccagatgt

SEQ ID NO: 8269060 - DNA, 22 bp, Homo sapiens
tttggcaaacataagcctttct

SEQ ID NO: 8269061 - DNA, 22 bp, Homo sapiens
tttggcaaaggtcagagactcc

SEQ ID NO: 8269062 - DNA, 22 bp, Homo sapiens
tttggcaacctcaatggctcta

SEQ ID NO: 8269063 - DNA, 22 bp, Homo sapiens
tttggcaaacttttaggacttt

SEQ ID NO: 8269064 - DNA, 19 bp, Homo sapiens
tttggcaggagataggatg

SEQ ID NO: 8269065 - DNA, 22 bp, Homo sapiens
tttggcaggtggcagctctggg

SEQ ID NO: 8269066 - DNA, 22 bp, Homo sapiens
tttggcagcacccgccatctat

SEQ ID NO: 8269067 - DNA, 22 bp, Homo sapiens
tttggcacctccaaggactcgc

SEQ ID NO: 8269068 - DNA, 22 bp, Homo sapiens
caccaggagccatcaggagtcc

SEQ ID NO: 8269069 - DNA, 22 bp, Homo sapiens
caccaggagcatctaggaggcg

SEQ ID NO: 8269070 - DNA, 22 bp, Homo sapiens
caccaggaagtggtggcctggg

SEQ ID NO: 8269071 - DNA, 20 bp, Homo sapiens
caccaggaccattggctatg

SEQ ID NO: 8269072 - DNA, 22 bp, Homo sapiens
cactctgaactattaacttggg

SEQ ID NO: 8269073 - DNA, 22 bp, Homo sapiens
caccaggatgggcaggtaggtc

SEQ ID NO: 8269074 - DNA, 22 bp, Homo sapiens
caccaggagtgagaatgaaggg

SEQ ID NO: 8269075 - DNA, 21 bp, Homo sapiens
cacttgaatggtgttttacaa

SEQ ID NO: 8269076 - DNA, 22 bp, Homo sapiens
cacttgaatggcattgttcctt

SEQ ID NO: 8269077 - DNA, 22 bp, Homo sapiens
cacttgaatgagaatttcctgg

SEQ ID NO: 8269078 - DNA, 22 bp, Homo sapiens
cacttgaatgaaagagactcct

SEQ ID NO: 8269079 - DNA, 22 bp, Homo sapiens
cacttgaaaatcagaggaaatt

SEQ ID NO: 8269080 - DNA, 22 bp, Homo sapiens
cacttgaactgtttgaatgaga

SEQ ID NO: 8269081 - DNA, 22 bp, Homo sapiens
cacttgaagtttgggggactct

SEQ ID NO: 8269082 - DNA, 22 bp, Homo sapiens
cacttgaagtgaattgctcacc

SEQ ID NO: 8269083 - DNA, 22 bp, Homo sapiens
cacttgaaagtaatggttgtgc

SEQ ID NO: 8269084 - DNA, 22 bp, Homo sapiens
cacttgaaatattaggggtgat

SEQ ID NO: 8269085 - DNA, 22 bp, Homo sapiens
cacttgaacccgggaggctgag

SEQ ID NO: 8269086 - DNA, 22 bp, Homo sapiens
cactttaactcacatttcagct

SEQ ID NO: 8269087 - DNA, 18 bp, Homo sapiens
ggacaggagacatgggtg

SEQ ID NO: 8269088 - DNA, 22 bp, Homo sapiens
caatccagtttctgtcagctac

SEQ ID NO: 8269089 - DNA, 22 bp, Homo sapiens
caagaacagtttgccaaattgg

SEQ ID NO: 8269090 - DNA, 22 bp, Homo sapiens
gctctgctgtgtttgttcagca

SEQ ID NO: 8269091 - DNA, 22 bp, Homo sapiens
gtacacagatgcttgagaatct

SEQ ID NO: 8269092 - DNA, 22 bp, Homo sapiens
gggatgagagctgggacagaag

SEQ ID NO: 8269093 - DNA, 22 bp, Homo sapiens
cagacactatgctaaggtacta

SEQ ID NO: 8269094 - DNA, 22 bp, Homo sapiens
gggtagcagcagggttcctatg

SEQ ID NO: 8269095 - DNA, 22 bp, Homo sapiens
atggctctatctagaattctgg

SEQ ID NO: 8269096 - DNA, 19 bp, Homo sapiens
atggctctgatttaatgtg

SEQ ID NO: 8269097 - DNA, 22 bp, Homo sapiens
atggcactgacctcccttgtaa

SEQ ID NO: 8269098 - DNA, 22 bp, Homo sapiens
atggcactaagagggagctgga

SEQ ID NO: 8269099 - DNA, 22 bp, Homo sapiens
atgtggcagtgggaggtgaatt

SEQ ID NO: 8269100 - DNA, 22 bp, Homo sapiens
atgtggcacagcacagtaagag

SEQ ID NO: 8269101 - DNA, 22 bp, Homo sapiens
atgttagaatctctgaatgtgg

SEQ ID NO: 8269102 - DNA, 22 bp, Homo sapiens
atgttagaaggaatgttaaaag

SEQ ID NO: 8269103 - DNA, 22 bp, Homo sapiens
gaagtctctctgggctcagttc

SEQ ID NO: 8269104 - DNA, 22 bp, Homo sapiens
ctttggcattagcctgtataga

SEQ ID NO: 8269105 - DNA, 22 bp, Homo sapiens
atctttcctgttttcagacagc

SEQ ID NO: 8269106 - DNA, 22 bp, Homo sapiens
gcatggagaagtgggaacaggt

SEQ ID NO: 8269107 - DNA, 22 bp, Homo sapiens
atttcaagtgttgagctcataa

SEQ ID NO: 8269108 - DNA, 22 bp, Homo sapiens
atttcaaggactacttttcaat

SEQ ID NO: 8269109 - DNA, 22 bp, Homo sapiens
atttcttcaggttcttctagga

SEQ ID NO: 8269110 - DNA, 22 bp, Homo sapiens
atttcttcctctgtcagtaact

SEQ ID NO: 8269111 - DNA, 22 bp, Homo sapiens
gctctgctgtggaatcctctcc

SEQ ID NO: 8269112 - DNA, 22 bp, Homo sapiens
gctctgctgtcttcttgcaggc

SEQ ID NO: 8269113 - DNA, 22 bp, Homo sapiens
ccctctgcctctgagtaggaca

SEQ ID NO: 8269114 - DNA, 22 bp, Homo sapiens
aggcttcttcttcctatttagt

SEQ ID NO: 8269115 - DNA, 22 bp, Homo sapiens
aggcttctaggaaactttctgg

SEQ ID NO: 8269116 - DNA, 22 bp, Homo sapiens
aggcttctctgcaagatgttaa

SEQ ID NO: 8269117 - DNA, 22 bp, Homo sapiens
aggctctgtgacaatcaagctg

SEQ ID NO: 8269118 - DNA, 21 bp, Homo sapiens
aggctctgtgaatatgtttcc

SEQ ID NO: 8269119 - DNA, 22 bp, Homo sapiens
aggctctgtgatccacaatgag

SEQ ID NO: 8269120 - DNA, 22 bp, Homo sapiens
catagagtgatgtaaggtatgt

SEQ ID NO: 8269121 - DNA, 22 bp, Homo sapiens
caggtgggagcgaggagctact

SEQ ID NO: 8269122 - DNA, 22 bp, Homo sapiens
aggaccagaggccagagtcagc

SEQ ID NO: 8269123 - DNA, 22 bp, Homo sapiens
aggaccagtgagtctggcaagt

SEQ ID NO: 8269124 - DNA, 22 bp, Homo sapiens
catggaggaccctcagggagct

SEQ ID NO: 8269125 - DNA, 22 bp, Homo sapiens
aggcactgtgctgatgtcttat

SEQ ID NO: 8269126 - DNA, 22 bp, Homo sapiens
ctctgacctctagccagctctg

SEQ ID NO: 8269127 - DNA, 21 bp, Homo sapiens
agtctgttaggatgactctga

SEQ ID NO: 8269128 - DNA, 22 bp, Homo sapiens
aggtggagtgtgcagggagagc

SEQ ID NO: 8269129 - DNA, 22 bp, Homo sapiens
agtaacagcatctccactggaa

SEQ ID NO: 8269130 - DNA, 22 bp, Homo sapiens
agtaacaggatccaaagaatgt

SEQ ID NO: 8269131 - DNA, 22 bp, Homo sapiens
agtaacaggtgtacagactatc

SEQ ID NO: 8269132 - DNA, 22 bp, Homo sapiens
cttcatcagctggcttactgtt

SEQ ID NO: 8269133 - DNA, 22 bp, Homo sapiens
cttcacagaataaactcattat

SEQ ID NO: 8269134 - DNA, 22 bp, Homo sapiens
ctgttattcaagacaaaggcag

SEQ ID NO: 8269135 - DNA, 19 bp, Homo sapiens
ctgttattgtcagagctcc

SEQ ID NO: 8269136 - DNA, 22 bp, Homo sapiens
ctggaaattggagatgatgttt

SEQ ID NO: 8269137 - DNA, 22 bp, Homo sapiens
ataatttacaactgcttttaat

SEQ ID NO: 8269138 - DNA, 22 bp, Homo sapiens
acttctgattacacatgggcct

SEQ ID NO: 8269139 - DNA, 22 bp, Homo sapiens
acttctgataaagagcatgtgc

SEQ ID NO: 8269140 - DNA, 22 bp, Homo sapiens
acttctgaagcagagatttggg

SEQ ID NO: 8269141 - DNA, 22 bp, Homo sapiens
acttctgactcaaccgtgagct

SEQ ID NO: 8269142 - DNA, 19 bp, Homo sapiens
acttctgaggaactgcaca

SEQ ID NO: 8269143 - DNA, 22 bp, Homo sapiens
acttagaatatgttcaagattt

SEQ ID NO: 8269144 - DNA, 22 bp, Homo sapiens
atatggaagagcctgggaattt

SEQ ID NO: 8269145 - DNA, 19 bp, Homo sapiens
actctgttgtacttgaggg

SEQ ID NO: 8269146 - DNA, 22 bp, Homo sapiens
agtctttaacatttggagattg

SEQ ID NO: 8269147 - DNA, 21 bp, Homo sapiens
agtggggtctctgtggaggcc

SEQ ID NO: 8269148 - DNA, 22 bp, Homo sapiens
acctctgtacctcctctgacag

SEQ ID NO: 8269149 - DNA, 22 bp, Homo sapiens
actagacatcgagctacagagt

SEQ ID NO: 8269150 - DNA, 21 bp, Homo sapiens
acagttcatgataactccatc

SEQ ID NO: 8269151 - DNA, 21 bp, Homo sapiens
acagtatattagatatttgaa

SEQ ID NO: 8269152 - DNA, 22 bp, Homo sapiens
acagtcaaatgtctatcttctt

SEQ ID NO: 8269153 - DNA, 22 bp, Homo sapiens
acagtcaatcagaacagcatgt

SEQ ID NO: 8269154 - DNA, 22 bp, Homo sapiens
acagtcaggccgagatgggcct

SEQ ID NO: 8269155 - DNA, 22 bp, Homo sapiens
acagtcagttgaatccaaggag

SEQ ID NO: 8269156 - DNA, 20 bp, Homo sapiens
acagtcagggaatagaaaaa

SEQ ID NO: 8269157 - DNA, 22 bp, Homo sapiens
acagtctactaaacatcatcag

SEQ ID NO: 8269158 - DNA, 22 bp, Homo sapiens
aggctctgtttgctgtggtacc

SEQ ID NO: 8269159 - DNA, 22 bp, Homo sapiens
aggctctggctactacagagct

SEQ ID NO: 8269160 - DNA, 19 bp, Homo sapiens
agccagaactagtgtttct

SEQ ID NO: 8269161 - DNA, 22 bp, Homo sapiens
cagaatgggaaggactgcagtt

SEQ ID NO: 8269162 - DNA, 22 bp, Homo sapiens
cagaatccagaattgctgaggt

SEQ ID NO: 8269163 - DNA, 22 bp, Homo sapiens
agacagacatagaaattagtaa

SEQ ID NO: 8269164 - DNA, 22 bp, Homo sapiens
agacagcatgagcctgctgatg

SEQ ID NO: 8269165 - DNA, 22 bp, Homo sapiens
atctcagatctacagatctaca

SEQ ID NO: 8269166 - DNA, 22 bp, Homo sapiens
agaccatagggacctcaggttg

SEQ ID NO: 8269167 - DNA, 22 bp, Homo sapiens
agaccagggtcccacagagtct

SEQ ID NO: 8269168 - DNA, 22 bp, Homo sapiens
atgggtaggatttactcagatg

SEQ ID NO: 8269169 - DNA, 22 bp, Homo sapiens
agaggctcactcttggaaccca

SEQ ID NO: 8269170 - DNA, 22 bp, Homo sapiens
attgccaactgcattacagtcc

SEQ ID NO: 8269171 - DNA, 22 bp, Homo sapiens
agagttgttgtacaaactaaat

SEQ ID NO: 8269172 - DNA, 22 bp, Homo sapiens
atttggcataggcagaggccca

SEQ ID NO: 8269173 - DNA, 20 bp, Homo sapiens
atttggcatagtttaagcaa

SEQ ID NO: 8269174 - DNA, 20 bp, Homo sapiens
atttggcatgaagtattgat

SEQ ID NO: 8269175 - DNA, 15 bp, Homo sapiens
atttggcatggcctc

SEQ ID NO: 8269176 - DNA, 22 bp, Homo sapiens
atttggcagccacagcaatctt

SEQ ID NO: 8269177 - DNA, 22 bp, Homo sapiens
atttggcagtataaattctggc

SEQ ID NO: 8269178 - DNA, 22 bp, Homo sapiens
atttggcatagagtatcattct

SEQ ID NO: 8269179 - DNA, 22 bp, Homo sapiens
atttggcagtgaagggatcaca

SEQ ID NO: 8269180 - DNA, 22 bp, Homo sapiens
atttggcaaaagttagaagaaa

SEQ ID NO: 8269181 - DNA, 22 bp, Homo sapiens
atttggcaaaaattagcagtag

SEQ ID NO: 8269182 - DNA, 22 bp, Homo sapiens
atttggcaaataatttgagggt

SEQ ID NO: 8269183 - DNA, 21 bp, Homo sapiens
atttggcaaaggcgatgcaca

SEQ ID NO: 8269184 - DNA, 18 bp, Homo sapiens
atttggcagatgatgaac

SEQ ID NO: 8269185 - DNA, 22 bp, Homo sapiens
atttggcacagcttttcctacc

SEQ ID NO: 8269186 - DNA, 22 bp, Homo sapiens
atttggcaacattaattgaatc

SEQ ID NO: 8269187 - DNA, 22 bp, Homo sapiens
atttggcaatgctagagaagtt

SEQ ID NO: 8269188 - DNA, 22 bp, Homo sapiens
atttggcacactgggttctcgt

SEQ ID NO: 8269189 - DNA, 22 bp, Homo sapiens
aactaacagtcattaaaagaac

SEQ ID NO: 8269190 - DNA, 22 bp, Homo sapiens
aactaaatctggcatttagagc

SEQ ID NO: 8269191 - DNA, 22 bp, Homo sapiens
aaagtatatatgcactttagaa

SEQ ID NO: 8269192 - DNA, 22 bp, Homo sapiens
aaatagattgctgaggcattac

SEQ ID NO: 8269193 - DNA, 22 bp, Homo sapiens
aaatagatttcctagcattgga

SEQ ID NO: 8269194 - DNA, 22 bp, Homo sapiens
aaataactttctgtgtatagtc

SEQ ID NO: 8269195 - DNA, 22 bp, Homo sapiens
aaatcctaataatgcactagtg

SEQ ID NO: 8269196 - DNA, 22 bp, Homo sapiens
aagtccaagatgcagttgtcag

SEQ ID NO: 8269197 - DNA, 22 bp, Homo sapiens
agccatgggctcccagtccttt

SEQ ID NO: 8269198 - DNA, 22 bp, Homo sapiens
acagagcatttgggacagagag

SEQ ID NO: 8269199 - DNA, 21 bp, Homo sapiens
acagattgctgagctctacct

SEQ ID NO: 8269200 - DNA, 22 bp, Homo sapiens
acagattgaagtccagaatggc

SEQ ID NO: 8269201 - DNA, 19 bp, Homo sapiens
acagaaattagttattttc

SEQ ID NO: 8269202 - DNA, 22 bp, Homo sapiens
agatgggtaattgatggcagta

SEQ ID NO: 8269203 - DNA, 22 bp, Homo sapiens
acaaacagagttgaaaaatagg

SEQ ID NO: 8269204 - DNA, 22 bp, Homo sapiens
acaaaattacctagttattttc

SEQ ID NO: 8269205 - DNA, 22 bp, Homo sapiens
acagtatagggcttatattgta

SEQ ID NO: 8269206 - DNA, 22 bp, Homo sapiens
acagttcttaaaacttgaatta

SEQ ID NO: 8269207 - DNA, 23 bp, Homo sapiens
aagtaacagggataatagcagtt

SEQ ID NO: 8269208 - DNA, 22 bp, Homo sapiens
accatgggcagaatctttgcag

SEQ ID NO: 8269209 - DNA, 22 bp, Homo sapiens
aatcctagaaatttatttgaag

SEQ ID NO: 8269210 - DNA, 22 bp, Homo sapiens
acttgacattaatttaggttgt

SEQ ID NO: 8269211 - DNA, 22 bp, Homo sapiens
acttgacacctaattagtcatc

SEQ ID NO: 8269212 - DNA, 22 bp, Homo sapiens
aagttatatcatctcattgacg

SEQ ID NO: 8269213 - DNA, 22 bp, Homo sapiens
actacaaaagcactgggtatta

SEQ ID NO: 8269214 - DNA, 20 bp, Homo sapiens
aagtgttttgacttctgacc

SEQ ID NO: 8269215 - DNA, 22 bp, Homo sapiens
aataattagtgggacagagaac

SEQ ID NO: 8269216 - DNA, 22 bp, Homo sapiens
ggcagggactttgcaaatcttt

SEQ ID NO: 8269217 - DNA, 22 bp, Homo sapiens
ggcaccaggctgggcataggcc

SEQ ID NO: 8269218 - DNA, 22 bp, Homo sapiens
ggcactgaatttcttggcatct

SEQ ID NO: 8269219 - DNA, 22 bp, Homo sapiens
ggcactgaagtgggtgttgggt

SEQ ID NO: 8269220 - DNA, 22 bp, Homo sapiens
gggagtggttgatggtgaaaat

SEQ ID NO: 8269221 - DNA, 22 bp, Homo sapiens
gggctctggaaatgggagctcc

SEQ ID NO: 8269222 - DNA, 22 bp, Homo sapiens
gggctctggacccaggcaagag

SEQ ID NO: 8269223 - DNA, 18 bp, Homo sapiens
gggctctggcatctgggt

SEQ ID NO: 8269224 - DNA, 22 bp, Homo sapiens
gggctctgagctctgggaatta

SEQ ID NO: 8269225 - DNA, 22 bp, Homo sapiens
ggttatctaagacagtttggca

SEQ ID NO: 8269226 - DNA, 23 bp, Homo sapiens
ggttatttgcatcctgtaattat

SEQ ID NO: 8269227 - DNA, 22 bp, Homo sapiens
ggttattttggttgtctaaggc

SEQ ID NO: 8269228 - DNA, 22 bp, Homo sapiens
gggctctggggtgccctggcat

SEQ ID NO: 8269229 - DNA, 19 bp, Homo sapiens
gggctctggcctcagtggg

SEQ ID NO: 8269230 - DNA, 22 bp, Homo sapiens
gtcacttgagcatttcttcttt

SEQ ID NO: 8269231 - DNA, 22 bp, Homo sapiens
gtacaaattgatacaggttttc

SEQ ID NO: 8269232 - DNA, 22 bp, Homo sapiens
gtaggcaaattatggaacattg

SEQ ID NO: 8269233 - DNA, 22 bp, Homo sapiens
gtcttggccgtgcagatgaaga

SEQ ID NO: 8269234 - DNA, 22 bp, Homo sapiens
ggaaggctttgtagaagtgcca

SEQ ID NO: 8269235 - DNA, 22 bp, Homo sapiens
ggaaggctaataatgcaagaaa

SEQ ID NO: 8269236 - DNA, 22 bp, Homo sapiens
gctggaggtggtgagaaaaggt

SEQ ID NO: 8269237 - DNA, 22 bp, Homo sapiens
gccagaagactggagtcagctg

SEQ ID NO: 8269238 - DNA, 22 bp, Homo sapiens
gccagaaggggtggatccaggc

SEQ ID NO: 8269239 - DNA, 22 bp, Homo sapiens
gccaggaaaaaccggccctgct

SEQ ID NO: 8269240 - DNA, 22 bp, Homo sapiens
gccaggaaagccactggcatac

SEQ ID NO: 8269241 - DNA, 19 bp, Homo sapiens
gccaggaaagaatcaggcg

SEQ ID NO: 8269242 - DNA, 22 bp, Homo sapiens
gccaggaagcagttagatgggt

SEQ ID NO: 8269243 - DNA, 18 bp, Homo sapiens
gccaggaagcatggggac

SEQ ID NO: 8269244 - DNA, 18 bp, Homo sapiens
gccaggaagaggaatgtg

SEQ ID NO: 8269245 - DNA, 22 bp, Homo sapiens
gccaggaaattcatgccagatc

SEQ ID NO: 8269246 - DNA, 22 bp, Homo sapiens
gccaggaacacaatgccaagct

SEQ ID NO: 8269247 - DNA, 22 bp, Homo sapiens
tccctctggtctggacgccata

SEQ ID NO: 8269248 - DNA, 22 bp, Homo sapiens
tcctcagcaaacacttcactct

SEQ ID NO: 8269249 - DNA, 22 bp, Homo sapiens
tccagtcaacttaatctcttta

SEQ ID NO: 8269250 - DNA, 22 bp, Homo sapiens
tcctgaagaaggcagatatttg

SEQ ID NO: 8269251 - DNA, 22 bp, Homo sapiens
tcctgaagaggttgtctttata

SEQ ID NO: 8269252 - DNA, 22 bp, Homo sapiens
tcctgaagctctcttaaggaaa

SEQ ID NO: 8269253 - DNA, 22 bp, Homo sapiens
tcagaagttgataaagtagttg

SEQ ID NO: 8269254 - DNA, 22 bp, Homo sapiens
tcagatgggttttgaaggatgt

SEQ ID NO: 8269255 - DNA, 22 bp, Homo sapiens
tcagatggaatgatgccactgc

SEQ ID NO: 8269256 - DNA, 21 bp, Homo sapiens
tccaaatcccattctgtagtc

SEQ ID NO: 8269257 - DNA, 22 bp, Homo sapiens
tcatttttgaccatgggtagga

SEQ ID NO: 8269258 - DNA, 23 bp, Homo sapiens
gtgttggcagcagtgctctgggg

SEQ ID NO: 8269259 - DNA, 22 bp, Homo sapiens
gtgtttaatgcagatgtgggtg

SEQ ID NO: 8269260 - DNA, 18 bp, Homo sapiens
taatccagggcaggtgat

SEQ ID NO: 8269261 - DNA, 22 bp, Homo sapiens
tacacataggtctgaataaaaa

SEQ ID NO: 8269262 - DNA, 22 bp, Homo sapiens
taccaggagttacaggcagcag

SEQ ID NO: 8269263 - DNA, 22 bp, Homo sapiens
tatgtttggcctggcaatttca

SEQ ID NO: 8269264 - DNA, 22 bp, Homo sapiens
tcaaagtaccagagtgaactga

SEQ ID NO: 8269265 - DNA, 22 bp, Homo sapiens
tcaaagtaccattatcagtgga

SEQ ID NO: 8269266 - DNA, 22 bp, Homo sapiens
tcaaagtatctcatggagagca

SEQ ID NO: 8269267 - DNA, 22 bp, Homo sapiens
tcaaagtatgctttctttggga

SEQ ID NO: 8269268 - DNA, 22 bp, Homo sapiens
tcaaaaataagatattctggac

SEQ ID NO: 8269269 - DNA, 22 bp, Homo sapiens
tatttggaaatgataaagtact

SEQ ID NO: 8269270 - DNA, 22 bp, Homo sapiens
tatttggacaccaagtagaagt

SEQ ID NO: 8269271 - DNA, 22 bp, Homo sapiens
gaccttcttgctgtgtcctaac

SEQ ID NO: 8269272 - DNA, 22 bp, Homo sapiens
gacatacagccctctccctggt

SEQ ID NO: 8269273 - DNA, 22 bp, Homo sapiens
gacatacagaatctgcagactt

SEQ ID NO: 8269274 - DNA, 22 bp, Homo sapiens
gagcaatagcaccaattaactc

SEQ ID NO: 8269275 - DNA, 22 bp, Homo sapiens
gagcacttaatcctgttattca

SEQ ID NO: 8269276 - DNA, 22 bp, Homo sapiens
gaggtggctggctcagagccag

SEQ ID NO: 8269277 - DNA, 22 bp, Homo sapiens
gaggtggatgttgcagtgagct

SEQ ID NO: 8269278 - DNA, 22 bp, Homo sapiens
gagggccagcagcctcagcatg

SEQ ID NO: 8269279 - DNA, 22 bp, Homo sapiens
gagggccaggcggagacaggcg

SEQ ID NO: 8269280 - DNA, 23 bp, Homo sapiens
gaggaccaaatatatacatggaa

SEQ ID NO: 8269281 - DNA, 22 bp, Homo sapiens
cttttttcctaaggcaacatga

SEQ ID NO: 8269282 - DNA, 22 bp, Homo sapiens
ctttggcaatgaaacacaagaa

SEQ ID NO: 8269283 - DNA, 22 bp, Homo sapiens
ctttggcaacacatgtgggaca

SEQ ID NO: 8269284 - DNA, 22 bp, Homo sapiens
ctttggcaagggttttaattgt

SEQ ID NO: 8269285 - DNA, 20 bp, Homo sapiens
ctttggcaatgagaacaggg

SEQ ID NO: 8269286 - DNA, 22 bp, Homo sapiens
ctttggcaatgtcattttcaat

SEQ ID NO: 8269287 - DNA, 22 bp, Homo sapiens
ctttggcacagtctcatttgat

SEQ ID NO: 8269288 - DNA, 22 bp, Homo sapiens
ctttggcacagtgtttactagc

SEQ ID NO: 8269289 - DNA, 22 bp, Homo sapiens
ctttggcactgcgcagccattt

SEQ ID NO: 8269290 - DNA, 23 bp, Homo sapiens
ctttggcactttacaataaactc

SEQ ID NO: 8269291 - DNA, 22 bp, Homo sapiens
ctttggcagacattaggggtga

SEQ ID NO: 8269292 - DNA, 22 bp, Homo sapiens
gaaatgtcatagtcttcaagcc

SEQ ID NO: 8269293 - DNA, 22 bp, Homo sapiens
gaaatgtctttgacaagagagg

SEQ ID NO: 8269294 - DNA, 22 bp, Homo sapiens
cttccccaggacctctgctaaa

SEQ ID NO: 8269295 - DNA, 20 bp, Homo sapiens
cttcttcagcctatgcttca

SEQ ID NO: 8269296 - DNA, 22 bp, Homo sapiens
cttcacaggcaagtctgttttt

SEQ ID NO: 8269297 - DNA, 22 bp, Homo sapiens
cttcacagtataggtccctgag

SEQ ID NO: 8269298 - DNA, 22 bp, Homo sapiens
cttcttctggtttatgtggcaa

SEQ ID NO: 8269299 - DNA, 19 bp, Homo sapiens
cttcttcttggcagccaag

SEQ ID NO: 8269300 - DNA, 22 bp, Homo sapiens
cttcttcttcccccttcagggg

SEQ ID NO: 8269301 - DNA, 22 bp, Homo sapiens
cttcttctcaaggggcaggtgg

SEQ ID NO: 8269302 - DNA, 22 bp, Homo sapiens
ccttttgctctcccatccagaa

SEQ ID NO: 8269303 - DNA, 22 bp, Homo sapiens
ttggagggtcttccacagccat

SEQ ID NO: 8269304 - DNA, 22 bp, Homo sapiens
ctctgaaagagtttagtattat

SEQ ID NO: 8269305 - DNA, 22 bp, Homo sapiens
ctcttctctgcagcctttgaag

SEQ ID NO: 8269306 - DNA, 22 bp, Homo sapiens
tggctactgtacttgagctatt

SEQ ID NO: 8269307 - DNA, 22 bp, Homo sapiens
tggaaggctgagagtcctgggg

SEQ ID NO: 8269308 - DNA, 21 bp, Homo sapiens
tggaaggctgctctgccaggg

SEQ ID NO: 8269309 - DNA, 22 bp, Homo sapiens
ccctgcagatcagtgagaactt

SEQ ID NO: 8269310 - DNA, 22 bp, Homo sapiens
ccagggaagaaagatgaagtgc

SEQ ID NO: 8269311 - DNA, 22 bp, Homo sapiens
tctgcagacaggaagctgaggc

SEQ ID NO: 8269312 - DNA, 22 bp, Homo sapiens
ccacttgaatcaaattcttagg

SEQ ID NO: 8269313 - DNA, 22 bp, Homo sapiens
ccacttgaaatatctttgttct

SEQ ID NO: 8269314 - DNA, 23 bp, Homo sapiens
tctcaagcttcactgtgtgttgt

SEQ ID NO: 8269315 - DNA, 22 bp, Homo sapiens
tctgcagaattcgaggaagaaa

SEQ ID NO: 8269316 - DNA, 22 bp, Homo sapiens
tcctcagcttttatttcacttg

SEQ ID NO: 8269317 - DNA, 22 bp, Homo sapiens
tccagactgccctgcacatgtg

SEQ ID NO: 8269318 - DNA, 22 bp, Homo sapiens
caggggaaggagccttgaaact

SEQ ID NO: 8269319 - DNA, 22 bp, Homo sapiens
taggactttgagaattgttatt

SEQ ID NO: 8269320 - DNA, 22 bp, Homo sapiens
taggaccaggggctgccaggaa

SEQ ID NO: 8269321 - DNA, 22 bp, Homo sapiens
tagagtgtaatacaaactaaac

SEQ ID NO: 8269322 - DNA, 21 bp, Homo sapiens
tcagaagtgcagcccaggaat

SEQ ID NO: 8269323 - DNA, 22 bp, Homo sapiens
cagtggctggttagggacagga

SEQ ID NO: 8269324 - DNA, 22 bp, Homo sapiens
cagtggctgtgaccagggacct

SEQ ID NO: 8269325 - DNA, 22 bp, Homo sapiens
cagtggctgagagtggacactg

SEQ ID NO: 8269326 - DNA, 22 bp, Homo sapiens
cagtggctgtttctggaaggca

SEQ ID NO: 8269327 - DNA, 22 bp, Homo sapiens
cagtggcttacaatgaactaga

SEQ ID NO: 8269328 - DNA, 22 bp, Homo sapiens
cagtggcttcttcctagagcca

SEQ ID NO: 8269329 - DNA, 23 bp, Homo sapiens
tcacagttacttttgcatcaacc

SEQ ID NO: 8269330 - DNA, 22 bp, Homo sapiens
tttcaacagaatatgatcagag

SEQ ID NO: 8269331 - DNA, 22 bp, Homo sapiens
tttcagagaggcttcaaatctt

SEQ ID NO: 8269332 - DNA, 22 bp, Homo sapiens
ttgtaagaatatgaatacaaat

SEQ ID NO: 8269333 - DNA, 22 bp, Homo sapiens
ttgtaagagagaattgcaaatt

SEQ ID NO: 8269334 - DNA, 23 bp, Homo sapiens
ttggaaatggggagaacagattc

SEQ ID NO: 8269335 - DNA, 22 bp, Homo sapiens
ttggaaatgcaaatatattgaa

SEQ ID NO: 8269336 - DNA, 22 bp, Homo sapiens
ttgacagatgtgaaagtgagca

SEQ ID NO: 8269337 - DNA, 22 bp, Homo sapiens
ttcacagatttccctgcacatg

SEQ ID NO: 8269338 - DNA, 22 bp, Homo sapiens
ttcacagactttccatagattg

SEQ ID NO: 8269339 - DNA, 22 bp, Homo sapiens
ttccagtcaagtaagaatatct

SEQ ID NO: 8269340 - DNA, 19 bp, Homo sapiens
ttccagttctaatctcttc

SEQ ID NO: 8269341 - DNA, 22 bp, Homo sapiens
ttcttagagatggttaaaaata

SEQ ID NO: 8269342 - DNA, 22 bp, Homo sapiens
ttcttcaaagatgtctgttgga

SEQ ID NO: 8269343 - DNA, 22 bp, Homo sapiens
ttctccagaccactgcctctgt

SEQ ID NO: 8269344 - DNA, 22 bp, Homo sapiens
ttctccagagggctctgcagga

SEQ ID NO: 8269345 - DNA, 22 bp, Homo sapiens
ttctcagctttccttgcagtta

SEQ ID NO: 8269346 - DNA, 21 bp, Homo sapiens
ttctcagatcgagtagtgaga

SEQ ID NO: 8269347 - DNA, 22 bp, Homo sapiens
ttccagttgtcataaagctagg

SEQ ID NO: 8269348 - DNA, 22 bp, Homo sapiens
tttcctctccggggcctccagg

SEQ ID NO: 8269349 - DNA, 21 bp, Homo sapiens
tttctttctggctctcacagt

SEQ ID NO: 8269350 - DNA, 22 bp, Homo sapiens
ttttcttcctggattttggcat

SEQ ID NO: 8269351 - DNA, 22 bp, Homo sapiens
ggaaatgtcatagaaatataag

SEQ ID NO: 8269352 - DNA, 19 bp, Homo sapiens
ggaaatgtggaaacatcct

SEQ ID NO: 8269353 - DNA, 22 bp, Homo sapiens
ggaaatgtatgattctcatcag

SEQ ID NO: 8269354 - DNA, 22 bp, Homo sapiens
ggaaatgtatgtattaagcacc

SEQ ID NO: 8269355 - DNA, 18 bp, Homo sapiens
caaattcagtgctggaag

SEQ ID NO: 8269356 - DNA, 19 bp, Homo sapiens
ggacacagaaagctgcatt

SEQ ID NO: 8269357 - DNA, 22 bp, Homo sapiens
cagcagtcacacaaactctgga

SEQ ID NO: 8269358 - DNA, 22 bp, Homo sapiens
gtaactaggggcatggacacat

SEQ ID NO: 8269359 - DNA, 20 bp, Homo sapiens
gggctctgcatccatcagcc

SEQ ID NO: 8269360 - DNA, 21 bp, Homo sapiens
gggctctgccctcctggagct

SEQ ID NO: 8269361 - DNA, 22 bp, Homo sapiens
gggctctgcctggctgggagta

SEQ ID NO: 8269362 - DNA, 22 bp, Homo sapiens
atgctttcttctttcctgtaag

SEQ ID NO: 8269363 - DNA, 20 bp, Homo sapiens
atgctttcttgtgtgctgct

SEQ ID NO: 8269364 - DNA, 22 bp, Homo sapiens
gacataaaattcaataatttgt

SEQ ID NO: 8269365 - DNA, 22 bp, Homo sapiens
gaaatctttgccttagctgtgt

SEQ ID NO: 8269366 - DNA, 22 bp, Homo sapiens
atgtaacaaatggtatacatgt

SEQ ID NO: 8269367 - DNA, 22 bp, Homo sapiens
atgtaacattgaattatatagt

SEQ ID NO: 8269368 - DNA, 22 bp, Homo sapiens
caaatcaccacttaatgggtta

SEQ ID NO: 8269369 - DNA, 22 bp, Homo sapiens
gctctgactgagcttcctgcct

SEQ ID NO: 8269370 - DNA, 22 bp, Homo sapiens
gctctgacctggccgccctgct

SEQ ID NO: 8269371 - DNA, 22 bp, Homo sapiens
atttacagtttagcatttcaag

SEQ ID NO: 8269372 - DNA, 22 bp, Homo sapiens
atttcttccttctcctagaaga

SEQ ID NO: 8269373 - DNA, 22 bp, Homo sapiens
attgtaagtagaaatgttatgg

SEQ ID NO: 8269374 - DNA, 22 bp, Homo sapiens
attgttatgaaaataagatgtt

SEQ ID NO: 8269375 - DNA, 22 bp, Homo sapiens
gcagggactttggcaacaggtg

SEQ ID NO: 8269376 - DNA, 22 bp, Homo sapiens
gcagaagtggattctacaattt

SEQ ID NO: 8269377 - DNA, 22 bp, Homo sapiens
ccaggaaggtgtttaactagag

SEQ ID NO: 8269378 - DNA, 22 bp, Homo sapiens
ccagagaaaagaggccaaggat

SEQ ID NO: 8269379 - DNA, 22 bp, Homo sapiens
agctgggtgtgtatcagataaa

SEQ ID NO: 8269380 - DNA, 22 bp, Homo sapiens
agctttctatatatgagttgct

SEQ ID NO: 8269381 - DNA, 20 bp, Homo sapiens
agctttctccttggagctcc

SEQ ID NO: 8269382 - DNA, 22 bp, Homo sapiens
agcttctctcagggtatctttc

SEQ ID NO: 8269383 - DNA, 22 bp, Homo sapiens
agcttctcggctgggagtattt

SEQ ID NO: 8269384 - DNA, 22 bp, Homo sapiens
agctttctagactctgtggtca

SEQ ID NO: 8269385 - DNA, 22 bp, Homo sapiens
agcttctcaggagtctgaggca

SEQ ID NO: 8269386 - DNA, 22 bp, Homo sapiens
catcagaagatggctctggaaa

SEQ ID NO: 8269387 - DNA, 22 bp, Homo sapiens
catcagaatctgagtctctgcc

SEQ ID NO: 8269388 - DNA, 22 bp, Homo sapiens
catcagaatagctctgtggata

SEQ ID NO: 8269389 - DNA, 22 bp, Homo sapiens
aggacaagacaaggaccagaga

SEQ ID NO: 8269390 - DNA, 22 bp, Homo sapiens
aggcactgacagattctgtgtc

SEQ ID NO: 8269391 - DNA, 22 bp, Homo sapiens
aggcactgaagaactctttttg

SEQ ID NO: 8269392 - DNA, 22 bp, Homo sapiens
ccaaagaaacccaagctcaggg

SEQ ID NO: 8269393 - DNA, 19 bp, Homo sapiens
atcacagacgtgcctcatc

SEQ ID NO: 8269394 - DNA, 22 bp, Homo sapiens
atcacagagctcccttccactg

SEQ ID NO: 8269395 - DNA, 22 bp, Homo sapiens
atcagcagtgagtggctttcat

SEQ ID NO: 8269396 - DNA, 22 bp, Homo sapiens
atcagctcttgatgcctttctt

SEQ ID NO: 8269397 - DNA, 22 bp, Homo sapiens
atattattctagtaacagtgat

SEQ ID NO: 8269398 - DNA, 22 bp, Homo sapiens
atctccttggatcacgtttagt

SEQ ID NO: 8269399 - DNA, 22 bp, Homo sapiens
cttctgcaggccctgtctgacc

SEQ ID NO: 8269400 - DNA, 22 bp, Homo sapiens
ctggcaggtccagctggactca

SEQ ID NO: 8269401 - DNA, 22 bp, Homo sapiens
ctggcaggttatagagctgccc

SEQ ID NO: 8269402 - DNA, 22 bp, Homo sapiens
agttctcataaacgtccttgga

SEQ ID NO: 8269403 - DNA, 22 bp, Homo sapiens
agtagacatgagcaatgataat

SEQ ID NO: 8269404 - DNA, 22 bp, Homo sapiens
agtagacagacccatggcttta

SEQ ID NO: 8269405 - DNA, 22 bp, Homo sapiens
agtagacagccttgctcctgag

SEQ ID NO: 8269406 - DNA, 20 bp, Homo sapiens
agtagacaactgcaggtgtg

SEQ ID NO: 8269407 - DNA, 19 bp, Homo sapiens
agtagcagaaagtgcagtg

SEQ ID NO: 8269408 - DNA, 22 bp, Homo sapiens
agtagcagtgacagctgaggta

SEQ ID NO: 8269409 - DNA, 20 bp, Homo sapiens
agtagcagtaatatggaaga

SEQ ID NO: 8269410 - DNA, 22 bp, Homo sapiens
agtagcagagttggactatgca

SEQ ID NO: 8269411 - DNA, 20 bp, Homo sapiens
ccttctccagcttgttcttg

SEQ ID NO: 8269412 - DNA, 22 bp, Homo sapiens
ctaggcaagagtttattatggt

SEQ ID NO: 8269413 - DNA, 22 bp, Homo sapiens
agtcacaggcaagagggctcca

SEQ ID NO: 8269414 - DNA, 22 bp, Homo sapiens
agtcacagttagactacccaag

SEQ ID NO: 8269415 - DNA, 22 bp, Homo sapiens
agtgaggtcatactggagaggg

SEQ ID NO: 8269416 - DNA, 22 bp, Homo sapiens
agtctcaaagtcagtgtcatgg

SEQ ID NO: 8269417 - DNA, 22 bp, Homo sapiens
agtggctcttgggtcactgggc

SEQ ID NO: 8269418 - DNA, 22 bp, Homo sapiens
agtggctcccatgtcttgcact

SEQ ID NO: 8269419 - DNA, 22 bp, Homo sapiens
agtgggtggcgcagaggaggaa

SEQ ID NO: 8269420 - DNA, 19 bp, Homo sapiens
ataaataaaaagtgggaga

SEQ ID NO: 8269421 - DNA, 23 bp, Homo sapiens
agtaccatgtgttccttctcgtt

SEQ ID NO: 8269422 - DNA, 22 bp, Homo sapiens
agtaccatctctgcctctgcct

SEQ ID NO: 8269423 - DNA, 22 bp, Homo sapiens
aggtatttcctttaaagaaact

SEQ ID NO: 8269424 - DNA, 22 bp, Homo sapiens
aggtatttatgagagcacatat

SEQ ID NO: 8269425 - DNA, 22 bp, Homo sapiens
aggtatttcatggagcaagcag

SEQ ID NO: 8269426 - DNA, 22 bp, Homo sapiens
acattgaattcaaaattactga

SEQ ID NO: 8269427 - DNA, 22 bp, Homo sapiens
acattgaaagcatattatctcc

SEQ ID NO: 8269428 - DNA, 22 bp, Homo sapiens
acatacatgggattaaaaaatt

SEQ ID NO: 8269429 - DNA, 20 bp, Homo sapiens
aggcatgggatgcccagatt

SEQ ID NO: 8269430 - DNA, 20 bp, Homo sapiens
accaggaatcttttctgagc

SEQ ID NO: 8269431 - DNA, 22 bp, Homo sapiens
accaggaagctgtgagaccttt

SEQ ID NO: 8269432 - DNA, 22 bp, Homo sapiens
accaggaatattttgctcattt

SEQ ID NO: 8269433 - DNA, 18 bp, Homo sapiens
accaggaagcttcttgtc

SEQ ID NO: 8269434 - DNA, 22 bp, Homo sapiens
accaggaagtgtgggccaacgt

SEQ ID NO: 8269435 - DNA, 19 bp, Homo sapiens
accaggaacttccctaggc

SEQ ID NO: 8269436 - DNA, 22 bp, Homo sapiens
accaggaacaagccatggagga

SEQ ID NO: 8269437 - DNA, 22 bp, Homo sapiens
accaggaactcacccgcagagg

SEQ ID NO: 8269438 - DNA, 22 bp, Homo sapiens
accaggaagagattccaattta

SEQ ID NO: 8269439 - DNA, 22 bp, Homo sapiens
accaggaagaacaggcaaggca

SEQ ID NO: 8269440 - DNA, 23 bp, Homo sapiens
agggcccaagcctggacagcagg

SEQ ID NO: 8269441 - DNA, 22 bp, Homo sapiens
aggcaaagagccagcaaatctg

SEQ ID NO: 8269442 - DNA, 22 bp, Homo sapiens
agcaacttttctagacatggtc

SEQ ID NO: 8269443 - DNA, 21 bp, Homo sapiens
agagtggcaaagtgtccaaga

SEQ ID NO: 8269444 - DNA, 22 bp, Homo sapiens
agatggcagcagaacaaacagg

SEQ ID NO: 8269445 - DNA, 22 bp, Homo sapiens
cacagagctcaagtcttagaaa

SEQ ID NO: 8269446 - DNA, 22 bp, Homo sapiens
cacagagcaggggtctgtgtca

SEQ ID NO: 8269447 - DNA, 22 bp, Homo sapiens
agcagtggacctcagtgctatt

SEQ ID NO: 8269448 - DNA, 23 bp, Homo sapiens
agcatggaataggaaagaggcag

SEQ ID NO: 8269449 - DNA, 22 bp, Homo sapiens
agccagatgctattgctggaaa

SEQ ID NO: 8269450 - DNA, 22 bp, Homo sapiens
aagagtctattggaactagaca

SEQ ID NO: 8269451 - DNA, 22 bp, Homo sapiens
aatgttaattcacagccaaata

SEQ ID NO: 8269452 - DNA, 22 bp, Homo sapiens
aatgtcttttaacctctggact

SEQ ID NO: 8269453 - DNA, 22 bp, Homo sapiens
acaacaaaatgaggaagtggtc

SEQ ID NO: 8269454 - DNA, 17 bp, Homo sapiens
aaggaccaacaggaaat

SEQ ID NO: 8269455 - DNA, 22 bp, Homo sapiens
aactcatctgggtgagtttgtc

SEQ ID NO: 8269456 - DNA, 22 bp, Homo sapiens
aactcatcttcgagtgaggctg

SEQ ID NO: 8269457 - DNA, 22 bp, Homo sapiens
aaatatgaatgataagagttat

SEQ ID NO: 8269458 - DNA, 22 bp, Homo sapiens
aagcagatattgtgggagtggg

SEQ ID NO: 8269459 - DNA, 22 bp, Homo sapiens
aacagtattggttgaactcaag

SEQ ID NO: 8269460 - DNA, 22 bp, Homo sapiens
aacagtatctacgggaactatt

SEQ ID NO: 8269461 - DNA, 22 bp, Homo sapiens
aaatccaggaagcagtggtgta

SEQ ID NO: 8269462 - DNA, 22 bp, Homo sapiens
aaatccaggtagtttggtttga

SEQ ID NO: 8269463 - DNA, 22 bp, Homo sapiens
aaatccaggtccatgtggggta

SEQ ID NO: 8269464 - DNA, 22 bp, Homo sapiens
aaatccagatgagggtaccaga

SEQ ID NO: 8269465 - DNA, 22 bp, Homo sapiens
aaatattagggagaacagggac

SEQ ID NO: 8269466 - DNA, 22 bp, Homo sapiens
aaatattattgcttaaggggag

SEQ ID NO: 8269467 - DNA, 22 bp, Homo sapiens
aaatagaaaccaacaaggtcag

SEQ ID NO: 8269468 - DNA, 22 bp, Homo sapiens
aagtaacacggaacttgaagca

SEQ ID NO: 8269469 - DNA, 22 bp, Homo sapiens
actgaccagatatgtcatacct

SEQ ID NO: 8269470 - DNA, 17 bp, Homo sapiens
aatctgtttacagtcag

SEQ ID NO: 8269471 - DNA, 22 bp, Homo sapiens
aatatgatgccaaattgctaca

SEQ ID NO: 8269472 - DNA, 22 bp, Homo sapiens
acttagaattagtgtagaatga

SEQ ID NO: 8269473 - DNA, 18 bp, Homo sapiens
acatacattctgtctgca

SEQ ID NO: 8269474 - DNA, 22 bp, Homo sapiens
accaggaaactctcgtctagtt

SEQ ID NO: 8269475 - DNA, 22 bp, Homo sapiens
accaggaaactgtgcccacgac

SEQ ID NO: 8269476 - DNA, 22 bp, Homo sapiens
accaggaaatttggcaacaaag

SEQ ID NO: 8269477 - DNA, 22 bp, Homo sapiens
agatccatccagcactcttgcc

SEQ ID NO: 8269478 - DNA, 21 bp, Homo sapiens
agatccctgaggagagcatcc

SEQ ID NO: 8269479 - DNA, 22 bp, Homo sapiens
agatgggtctcccttagcacct

SEQ ID NO: 8269480 - DNA, 22 bp, Homo sapiens
aatgtagaatgatccttaggat

SEQ ID NO: 8269481 - DNA, 22 bp, Homo sapiens
agctccaaggttgaggagtgag

SEQ ID NO: 8269482 - DNA, 22 bp, Homo sapiens
tcccagaatctccagtgctaca

SEQ ID NO: 8269483 - DNA, 22 bp, Homo sapiens
tccaggaggcacctttggacca

SEQ ID NO: 8269484 - DNA, 22 bp, Homo sapiens
tccagtcatggtgtcctcacaa

SEQ ID NO: 8269485 - DNA, 22 bp, Homo sapiens
tccaggaaggactaatggtttg

SEQ ID NO: 8269486 - DNA, 22 bp, Homo sapiens
tccaggaatagtcatgttttag

SEQ ID NO: 8269487 - DNA, 22 bp, Homo sapiens
tccaggaatagatcagagattt

SEQ ID NO: 8269488 - DNA, 22 bp, Homo sapiens
tccaggaactcttgatggtgat

SEQ ID NO: 8269489 - DNA, 22 bp, Homo sapiens
tccaggaagcagtgtttggagc

SEQ ID NO: 8269490 - DNA, 22 bp, Homo sapiens
tccaggaagcagctacagatcc

SEQ ID NO: 8269491 - DNA, 22 bp, Homo sapiens
tccaggaagaggtgtgttggga

SEQ ID NO: 8269492 - DNA, 22 bp, Homo sapiens
tccaggaacagaatgttagtgc

SEQ ID NO: 8269493 - DNA, 22 bp, Homo sapiens
tccaggaaatcagaagtggtaa

SEQ ID NO: 8269494 - DNA, 22 bp, Homo sapiens
tccaggaatctgtgcctagccc

SEQ ID NO: 8269495 - DNA, 21 bp, Homo sapiens
tccaggaatgtctgttcatct

SEQ ID NO: 8269496 - DNA, 22 bp, Homo sapiens
tcaaaaatggtctttgagctgc

SEQ ID NO: 8269497 - DNA, 22 bp, Homo sapiens
tcacagaatctctgataagtct

SEQ ID NO: 8269498 - DNA, 22 bp, Homo sapiens
tcagagagcctcaggcactgcc

SEQ ID NO: 8269499 - DNA, 22 bp, Homo sapiens
tcatccagagcttcataagtaa

SEQ ID NO: 8269500 - DNA, 21 bp, Homo sapiens
tcatccaggtcctgcttcttc

SEQ ID NO: 8269501 - DNA, 22 bp, Homo sapiens
tcagaggtcacacagcaagttt

SEQ ID NO: 8269502 - DNA, 22 bp, Homo sapiens
tcagcctcctaatttcctgtga

SEQ ID NO: 8269503 - DNA, 22 bp, Homo sapiens
tacttgaattggtttctgcaga

SEQ ID NO: 8269504 - DNA, 23 bp, Homo sapiens
tacttgaaatcaggcttacttcc

SEQ ID NO: 8269505 - DNA, 22 bp, Homo sapiens
taataaatgaaagtgctggcat

SEQ ID NO: 8269506 - DNA, 18 bp, Homo sapiens
gtttaggctacttaaaat

SEQ ID NO: 8269507 - DNA, 22 bp, Homo sapiens
gttacaaaggtcataaaagtgt

SEQ ID NO: 8269508 - DNA, 22 bp, Homo sapiens
tatctgtttttacagtgtcttt

SEQ ID NO: 8269509 - DNA, 22 bp, Homo sapiens
tatacagatatctaagatgtaa

SEQ ID NO: 8269510 - DNA, 21 bp, Homo sapiens
tatacagaggggaacaggaga

SEQ ID NO: 8269511 - DNA, 22 bp, Homo sapiens
tatattatcataaaaccattca

SEQ ID NO: 8269512 - DNA, 22 bp, Homo sapiens
tagaataagttgatgatatatg

SEQ ID NO: 8269513 - DNA, 22 bp, Homo sapiens
tagcaccaaaactgaagaacat

SEQ ID NO: 8269514 - DNA, 21 bp, Homo sapiens
tagcacttcgctgtaattggg

SEQ ID NO: 8269515 - DNA, 22 bp, Homo sapiens
gccaggaatttcaagagccact

SEQ ID NO: 8269516 - DNA, 22 bp, Homo sapiens
gccctctgttattgcatcctta

SEQ ID NO: 8269517 - DNA, 22 bp, Homo sapiens
gccctctggggcacacagagga

SEQ ID NO: 8269518 - DNA, 22 bp, Homo sapiens
gcacttgataaatgttaactga

SEQ ID NO: 8269519 - DNA, 22 bp, Homo sapiens
gcacttgaggacgactcagctg

SEQ ID NO: 8269520 - DNA, 22 bp, Homo sapiens
gcacttgagccaatgctagtag

SEQ ID NO: 8269521 - DNA, 22 bp, Homo sapiens
gcacttgacccccagagctggt

SEQ ID NO: 8269522 - DNA, 22 bp, Homo sapiens
gcacttgaaaagatcaggtgca

SEQ ID NO: 8269523 - DNA, 22 bp, Homo sapiens
gcacttgattacattagtgcct

SEQ ID NO: 8269524 - DNA, 17 bp, Homo sapiens
gccttctctgccctcac

SEQ ID NO: 8269525 - DNA, 22 bp, Homo sapiens
gctctgctctaacattcctgac

SEQ ID NO: 8269526 - DNA, 22 bp, Homo sapiens
gctctgctccctcaaatgacat

SEQ ID NO: 8269527 - DNA, 22 bp, Homo sapiens
gctctgctggaagttctctgga

SEQ ID NO: 8269528 - DNA, 22 bp, Homo sapiens
gctctgctcttgacttaccagg

SEQ ID NO: 8269529 - DNA, 22 bp, Homo sapiens
gctctgctgaagccccttgcat

SEQ ID NO: 8269530 - DNA, 22 bp, Homo sapiens
ggaagcccagctgtctcctgtc

SEQ ID NO: 8269531 - DNA, 22 bp, Homo sapiens
ggaaccagtaactggtcattgc

SEQ ID NO: 8269532 - DNA, 22 bp, Homo sapiens
ggaaatatcttgtactatgtga

SEQ ID NO: 8269533 - DNA, 20 bp, Homo sapiens
ggcacttgatcccctggttc

SEQ ID NO: 8269534 - DNA, 22 bp, Homo sapiens
ggcacttggatcttagttgggg

SEQ ID NO: 8269535 - DNA, 22 bp, Homo sapiens
ggcagggtttacaatagcaata

SEQ ID NO: 8269536 - DNA, 23 bp, Homo sapiens
ggcatcttgtctagagaaatctg

SEQ ID NO: 8269537 - DNA, 22 bp, Homo sapiens
ggccaggatctgtttgtccacc

SEQ ID NO: 8269538 - DNA, 22 bp, Homo sapiens
ggccaggagctgcacagggctc

SEQ ID NO: 8269539 - DNA, 22 bp, Homo sapiens
ggtcccaatctaatcacatgag

SEQ ID NO: 8269540 - DNA, 22 bp, Homo sapiens
ggtcccaagtgcttttcctgca

SEQ ID NO: 8269541 - DNA, 22 bp, Homo sapiens
ggtcccaagcaatgcccttggc

SEQ ID NO: 8269542 - DNA, 22 bp, Homo sapiens
ggtagacaatggaatgtggcct

SEQ ID NO: 8269543 - DNA, 22 bp, Homo sapiens
ggtagacaactttgtaatagcc

SEQ ID NO: 8269544 - DNA, 22 bp, Homo sapiens
ggtaacagtatgtagagtaaga

SEQ ID NO: 8269545 - DNA, 22 bp, Homo sapiens
ggtaacagttacagtaacagta

SEQ ID NO: 8269546 - DNA, 22 bp, Homo sapiens
gtcacagtgcctgaagctctga

SEQ ID NO: 8269547 - DNA, 22 bp, Homo sapiens
gtaacagtttgggttccaattg

SEQ ID NO: 8269548 - DNA, 19 bp, Homo sapiens
gtaacagtggacattttag

SEQ ID NO: 8269549 - DNA, 22 bp, Homo sapiens
gtaacacttggctgcaacctgg

SEQ ID NO: 8269550 - DNA, 22 bp, Homo sapiens
gtaacactagctctgtcacttt

SEQ ID NO: 8269551 - DNA, 22 bp, Homo sapiens
gtagacagtttgggccgaaatt

SEQ ID NO: 8269552 - DNA, 22 bp, Homo sapiens
gtagacaggttataaatcagtg

SEQ ID NO: 8269553 - DNA, 22 bp, Homo sapiens
gtagcagagggcccaggtaact

SEQ ID NO: 8269554 - DNA, 22 bp, Homo sapiens
gtcttctgttctgtgaggcttc

SEQ ID NO: 8269555 - DNA, 22 bp, Homo sapiens
gtcttctgtctgtctggcatgt

SEQ ID NO: 8269556 - DNA, 22 bp, Homo sapiens
gtcttctggaagagagccagct

SEQ ID NO: 8269557 - DNA, 22 bp, Homo sapiens
gtcttcttgtgttgcctgtctt

SEQ ID NO: 8269558 - DNA, 22 bp, Homo sapiens
gtcttctgcaactgcacctgcc

SEQ ID NO: 8269559 - DNA, 22 bp, Homo sapiens
ttctcctttgtaattctcatcc

SEQ ID NO: 8269560 - DNA, 22 bp, Homo sapiens
ttctccttgttcccttcaattg

SEQ ID NO: 8269561 - DNA, 22 bp, Homo sapiens
ttgaaatatcaagttattagtg

SEQ ID NO: 8269562 - DNA, 22 bp, Homo sapiens
ccttcttcaccagtttacctga

SEQ ID NO: 8269563 - DNA, 20 bp, Homo sapiens
ccttctctggaattgcctcc

SEQ ID NO: 8269564 - DNA, 22 bp, Homo sapiens
tgttggcatctctgagagagtt

SEQ ID NO: 8269565 - DNA, 22 bp, Homo sapiens
cctgctcctgctattcttctgg

SEQ ID NO: 8269566 - DNA, 22 bp, Homo sapiens
ctgctcctggtcatcctccact

SEQ ID NO: 8269567 - DNA, 18 bp, Homo sapiens
tttctcagactctctttc

SEQ ID NO: 8269568 - DNA, 22 bp, Homo sapiens
tttctcagaatataaaattctc

SEQ ID NO: 8269569 - DNA, 22 bp, Homo sapiens
tttcttctgtttgtagttacac

SEQ ID NO: 8269570 - DNA, 22 bp, Homo sapiens
tttcttcttgatttaaacaggg

SEQ ID NO: 8269571 - DNA, 22 bp, Homo sapiens
tttcttcttgagtaaccagatt

SEQ ID NO: 8269572 - DNA, 22 bp, Homo sapiens
gaccaggacacagtggcaaggt

SEQ ID NO: 8269573 - DNA, 22 bp, Homo sapiens
gacagagctgctctagattctg

SEQ ID NO: 8269574 - DNA, 22 bp, Homo sapiens
gaagcatataggtactgaacta

SEQ ID NO: 8269575 - DNA, 22 bp, Homo sapiens
gaatccagggtgtttgctgagg

SEQ ID NO: 8269576 - DNA, 22 bp, Homo sapiens
gaatccagggttgtttgagcta

SEQ ID NO: 8269577 - DNA, 22 bp, Homo sapiens
cttctggaggctccagggaggt

SEQ ID NO: 8269578 - DNA, 22 bp, Homo sapiens
cttctacaaggttgtcctctat

SEQ ID NO: 8269579 - DNA, 22 bp, Homo sapiens
cttctacacatccctcttgctt

SEQ ID NO: 8269580 - DNA, 22 bp, Homo sapiens
cttctcaaactgagactgtcta

SEQ ID NO: 8269581 - DNA, 22 bp, Homo sapiens
cttctcagagcttccagaaaac

SEQ ID NO: 8269582 - DNA, 22 bp, Homo sapiens
ctgtagcatttgttatggcaat

SEQ ID NO: 8269583 - DNA, 22 bp, Homo sapiens
tggcacttgcttcagatgatgt

SEQ ID NO: 8269584 - DNA, 22 bp, Homo sapiens
tggcacttgatatttgatttgc

SEQ ID NO: 8269585 - DNA, 22 bp, Homo sapiens
tggcacttgggagtcgtggcga

SEQ ID NO: 8269586 - DNA, 22 bp, Homo sapiens
tggcacttggctgagaggttct

SEQ ID NO: 8269587 - DNA, 22 bp, Homo sapiens
tggcacttggtaaatatgtgtt

SEQ ID NO: 8269588 - DNA, 22 bp, Homo sapiens
tggcactttacttcctcaggag

SEQ ID NO: 8269589 - DNA, 22 bp, Homo sapiens
tggcactttacacccatttggc

SEQ ID NO: 8269590 - DNA, 22 bp, Homo sapiens
tggcacttttcccagttttggt

SEQ ID NO: 8269591 - DNA, 22 bp, Homo sapiens
tggagacatgggcgaatctaag

SEQ ID NO: 8269592 - DNA, 22 bp, Homo sapiens
tgcttccttcccgttcttctcc

SEQ ID NO: 8269593 - DNA, 22 bp, Homo sapiens
tggtagcaacatctcagtggct

SEQ ID NO: 8269594 - DNA, 22 bp, Homo sapiens
tggtagcaggtgtgatagaaat

SEQ ID NO: 8269595 - DNA, 22 bp, Homo sapiens
tggccaaatttggtgtaacttg

SEQ ID NO: 8269596 - DNA, 22 bp, Homo sapiens
tggcattttgttcagtatatgg

SEQ ID NO: 8269597 - DNA, 22 bp, Homo sapiens
tggcatttgggctggcttttct

SEQ ID NO: 8269598 - DNA, 22 bp, Homo sapiens
tggcattttgtagctgtgtatc

SEQ ID NO: 8269599 - DNA, 22 bp, Homo sapiens
tggcatttctgttagactctca

SEQ ID NO: 8269600 - DNA, 19 bp, Homo sapiens
tggcatttggaggcaacct

SEQ ID NO: 8269601 - DNA, 22 bp, Homo sapiens
tgaagtctttcagggctagaat

SEQ ID NO: 8269602 - DNA, 22 bp, Homo sapiens
tgaagtcctaacttccagtaca

SEQ ID NO: 8269603 - DNA, 22 bp, Homo sapiens
tgaaacagaagatgttcatgtg

SEQ ID NO: 8269604 - DNA, 22 bp, Homo sapiens
tcttctgatgccagtaaccatg

SEQ ID NO: 8269605 - DNA, 22 bp, Homo sapiens
tcttctgaaggtaggaagcatt

SEQ ID NO: 8269606 - DNA, 22 bp, Homo sapiens
tcttcctcatgaattctcgtat

SEQ ID NO: 8269607 - DNA, 22 bp, Homo sapiens
ccagttaaacaacatccatttc

SEQ ID NO: 8269608 - DNA, 22 bp, Homo sapiens
tgcagggatcctagctgaagag

SEQ ID NO: 8269609 - DNA, 22 bp, Homo sapiens
tctcagttcttctcattccaga

SEQ ID NO: 8269610 - DNA, 22 bp, Homo sapiens
caggtgggcgtggcgagaaggc

SEQ ID NO: 8269611 - DNA, 22 bp, Homo sapiens
caggtgggctgcctctccagct

SEQ ID NO: 8269612 - DNA, 19 bp, Homo sapiens
cagtggagattggaggagg

SEQ ID NO: 8269613 - DNA, 22 bp, Homo sapiens
tacacagatatgtgatcaatca

SEQ ID NO: 8269614 - DNA, 22 bp, Homo sapiens
tttccagtgcatggcaaatgct

SEQ ID NO: 8269615 - DNA, 22 bp, Homo sapiens
tttccagtgggccccttgaaat

SEQ ID NO: 8269616 - DNA, 22 bp, Homo sapiens
tttccagtgatggggtctggct

SEQ ID NO: 8269617 - DNA, 22 bp, Homo sapiens
tttccagtaagtggcaaggagc

SEQ ID NO: 8269618 - DNA, 22 bp, Homo sapiens
tttccagtcaccactagatcag

SEQ ID NO: 8269619 - DNA, 22 bp, Homo sapiens
tttccagtctcagccctgtaac

SEQ ID NO: 8269620 - DNA, 22 bp, Homo sapiens
tttccagtctctgcctccaagg

SEQ ID NO: 8269621 - DNA, 22 bp, Homo sapiens
tttaagagcatttgcaatttat

SEQ ID NO: 8269622 - DNA, 22 bp, Homo sapiens
ttgccttcctgcccagcttctg

SEQ ID NO: 8269623 - DNA, 22 bp, Homo sapiens
ttgcttctggaactttctgttc

SEQ ID NO: 8269624 - DNA, 22 bp, Homo sapiens
ttggcactcaactgtcgttgtt

SEQ ID NO: 8269625 - DNA, 22 bp, Homo sapiens
ttggcactcaaagccctctgca

SEQ ID NO: 8269626 - DNA, 22 bp, Homo sapiens
ttggcactcagcaagtgttaat

SEQ ID NO: 8269627 - DNA, 22 bp, Homo sapiens
ttggcactcaaaattttatcgg

SEQ ID NO: 8269628 - DNA, 22 bp, Homo sapiens
ttggcactcaaaatagatggtt

SEQ ID NO: 8269629 - DNA, 22 bp, Homo sapiens
ttggcactattgacattttggg

SEQ ID NO: 8269630 - DNA, 22 bp, Homo sapiens
ttggcactgcattgaccacacc

SEQ ID NO: 8269631 - DNA, 22 bp, Homo sapiens
ttggcactgcagatgaattgca

SEQ ID NO: 8269632 - DNA, 22 bp, Homo sapiens
ttggcactgaccaaagaagtcc

SEQ ID NO: 8269633 - DNA, 22 bp, Homo sapiens
ttggcactcatcctggttgttt

SEQ ID NO: 8269634 - DNA, 22 bp, Homo sapiens
ttggcactctccctgcactggt

SEQ ID NO: 8269635 - DNA, 22 bp, Homo sapiens
ttggcactgtgcctggcacatt

SEQ ID NO: 8269636 - DNA, 22 bp, Homo sapiens
ttggcactttctcagcagcctg

SEQ ID NO: 8269637 - DNA, 22 bp, Homo sapiens
ttggcacttcacgagacagcta

SEQ ID NO: 8269638 - DNA, 22 bp, Homo sapiens
ttggcactttgaatgagctcag

SEQ ID NO: 8269639 - DNA, 22 bp, Homo sapiens
ttggcacttttaggcagtaccg

SEQ ID NO: 8269640 - DNA, 22 bp, Homo sapiens
ttggcactattcactccatggg

SEQ ID NO: 8269641 - DNA, 22 bp, Homo sapiens
ttggcaatttaaatagcaggag

SEQ ID NO: 8269642 - DNA, 22 bp, Homo sapiens
ttgttatttaggtctgggttag

SEQ ID NO: 8269643 - DNA, 22 bp, Homo sapiens
ttcagaagttttcaaaactaag

SEQ ID NO: 8269644 - DNA, 22 bp, Homo sapiens
ttcagaaggattttaacacatg

SEQ ID NO: 8269645 - DNA, 22 bp, Homo sapiens
ttcagaagtagctaagcagtca

SEQ ID NO: 8269646 - DNA, 22 bp, Homo sapiens
ttcccagtgattgaacatccct

SEQ ID NO: 8269647 - DNA, 22 bp, Homo sapiens
ttgaaacatatacaaagtggtg

SEQ ID NO: 8269648 - DNA, 22 bp, Homo sapiens
ttgacataagacttagagtatt

SEQ ID NO: 8269649 - DNA, 22 bp, Homo sapiens
ttgacatatagcataaggataa

SEQ ID NO: 8269650 - DNA, 17 bp, Homo sapiens
ttgaccaaaatgcagcc

SEQ ID NO: 8269651 - DNA, 21 bp, Homo sapiens
ttctccagggggagctctctc

SEQ ID NO: 8269652 - DNA, 22 bp, Homo sapiens
ttctccagttatattatgttaa

SEQ ID NO: 8269653 - DNA, 22 bp, Homo sapiens
ttctcttcccactttctgtatt

SEQ ID NO: 8269654 - DNA, 22 bp, Homo sapiens
ttctcttcacagggatcatcct

SEQ ID NO: 8269655 - DNA, 22 bp, Homo sapiens
ttccctctgcgcattgaatttc

SEQ ID NO: 8269656 - DNA, 19 bp, Homo sapiens
ttctcagagcttgcagcac

SEQ ID NO: 8269657 - DNA, 22 bp, Homo sapiens
ttctcagagctcactgtagtaa

SEQ ID NO: 8269658 - DNA, 22 bp, Homo sapiens
ttttttccaacttaagacttca

SEQ ID NO: 8269659 - DNA, 22 bp, Homo sapiens
caaaaactgcaattacttttac

SEQ ID NO: 8269660 - DNA, 22 bp, Homo sapiens
gcctggagctctccacttgggg

SEQ ID NO: 8269661 - DNA, 22 bp, Homo sapiens
gcctggaggaatgtagctgagg

SEQ ID NO: 8269662 - DNA, 22 bp, Homo sapiens
atgaaatatcttgaagaaattc

SEQ ID NO: 8269663 - DNA, 22 bp, Homo sapiens
atgaaatattctttggtaagaa

SEQ ID NO: 8269664 - DNA, 22 bp, Homo sapiens
atctacagctgtctgcacagta

SEQ ID NO: 8269665 - DNA, 22 bp, Homo sapiens
atctacaggattttacagagtt

SEQ ID NO: 8269666 - DNA, 22 bp, Homo sapiens
cttgctggcagtcactgttgcg

SEQ ID NO: 8269667 - DNA, 20 bp, Homo sapiens
atggaggaagggcaagagaa

SEQ ID NO: 8269668 - DNA, 20 bp, Homo sapiens
atggaagctgctcttctcct

SEQ ID NO: 8269669 - DNA, 22 bp, Homo sapiens
atggaaatgttccatatattga

SEQ ID NO: 8269670 - DNA, 22 bp, Homo sapiens
atggaaatgttaagtcagtccg

SEQ ID NO: 8269671 - DNA, 22 bp, Homo sapiens
atggaaattaagatttgtctca

SEQ ID NO: 8269672 - DNA, 22 bp, Homo sapiens
atggaaatgtaacttctgattc

SEQ ID NO: 8269673 - DNA, 22 bp, Homo sapiens
atggaaatgatggaacattaaa

SEQ ID NO: 8269674 - DNA, 22 bp, Homo sapiens
cagaaggtttgaaagatgtctt

SEQ ID NO: 8269675 - DNA, 22 bp, Homo sapiens
ggcactggaaggatcatgtgag

SEQ ID NO: 8269676 - DNA, 22 bp, Homo sapiens
cactgaaggctgcagctcagcc

SEQ ID NO: 8269677 - DNA, 22 bp, Homo sapiens
cactggaggtcagtggagcact

SEQ ID NO: 8269678 - DNA, 22 bp, Homo sapiens
cactggaagttcattctcagaa

SEQ ID NO: 8269679 - DNA, 22 bp, Homo sapiens
atcatgcagagtctgggcttca

SEQ ID NO: 8269680 - DNA, 22 bp, Homo sapiens
ctgtcttctcctttgtttcagg

SEQ ID NO: 8269681 - DNA, 22 bp, Homo sapiens
atatgattccactattgtatgg

SEQ ID NO: 8269682 - DNA, 22 bp, Homo sapiens
ataaatatcactgttgtccctc

SEQ ID NO: 8269683 - DNA, 22 bp, Homo sapiens
ctgctccaagccagccctgcag

SEQ ID NO: 8269684 - DNA, 22 bp, Homo sapiens
ctggagggaggaggctgctatt

SEQ ID NO: 8269685 - DNA, 20 bp, Homo sapiens
agtcccaacattcagctctg

SEQ ID NO: 8269686 - DNA, 22 bp, Homo sapiens
ctcaaatccccgttcctcattc

SEQ ID NO: 8269687 - DNA, 22 bp, Homo sapiens
ctcagaagccttcagtcttggc

SEQ ID NO: 8269688 - DNA, 22 bp, Homo sapiens
ctcagaagaatcagcagctatt

SEQ ID NO: 8269689 - DNA, 22 bp, Homo sapiens
ctccagaagacccatcctcatg

SEQ ID NO: 8269690 - DNA, 22 bp, Homo sapiens
ctcagctcactcttttgtgctt

SEQ ID NO: 8269691 - DNA, 23 bp, Homo sapiens
agtctcagctggaaacatgtgtc

SEQ ID NO: 8269692 - DNA, 22 bp, Homo sapiens
ctcagctctgtcacttactagc

SEQ ID NO: 8269693 - DNA, 21 bp, Homo sapiens
ctcttgctgatgtctccttta

SEQ ID NO: 8269694 - DNA, 22 bp, Homo sapiens
ctcttctttagtccagaccatc

SEQ ID NO: 8269695 - DNA, 19 bp, Homo sapiens
ctccttgccatttcttttc

SEQ ID NO: 8269696 - DNA, 20 bp, Homo sapiens
aggctctgccattgtccctg

SEQ ID NO: 8269697 - DNA, 20 bp, Homo sapiens
aggctctgcatttctgagtg

SEQ ID NO: 8269698 - DNA, 22 bp, Homo sapiens
aggctctgatgcaagcccaggg

SEQ ID NO: 8269699 - DNA, 22 bp, Homo sapiens
aggctctgcaggtatttcttga

SEQ ID NO: 8269700 - DNA, 22 bp, Homo sapiens
aggctctgcagaccccagctgt

SEQ ID NO: 8269701 - DNA, 22 bp, Homo sapiens
aggctctgaggcagattttcgt

SEQ ID NO: 8269702 - DNA, 22 bp, Homo sapiens
aggctctgagtctggtgtctgc

SEQ ID NO: 8269703 - DNA, 22 bp, Homo sapiens
ccagttcaccagtggcagaagt

SEQ ID NO: 8269704 - DNA, 22 bp, Homo sapiens
aggcattttgttcaagatgaca

SEQ ID NO: 8269705 - DNA, 22 bp, Homo sapiens
aggcatttttgttaatctttgg

SEQ ID NO: 8269706 - DNA, 22 bp, Homo sapiens
aggcatttggctgtcatttgta

SEQ ID NO: 8269707 - DNA, 22 bp, Homo sapiens
aggaaccagaggttgagcaact

SEQ ID NO: 8269708 - DNA, 22 bp, Homo sapiens
aggaacagaagagcaatgcagg

SEQ ID NO: 8269709 - DNA, 22 bp, Homo sapiens
aggaaatgtacaaatgaagatg

SEQ ID NO: 8269710 - DNA, 21 bp, Homo sapiens
agcttgtgtgtatcacagtgt

SEQ ID NO: 8269711 - DNA, 22 bp, Homo sapiens
catgaaatgttagaattagaca

SEQ ID NO: 8269712 - DNA, 22 bp, Homo sapiens
cactctgatggtttctgttcaa

SEQ ID NO: 8269713 - DNA, 22 bp, Homo sapiens
agcataaaggtcaacgttttag

SEQ ID NO: 8269714 - DNA, 22 bp, Homo sapiens
agcagtggcctggggctctgtg

SEQ ID NO: 8269715 - DNA, 22 bp, Homo sapiens
cagacagacagccgtggccacc

SEQ ID NO: 8269716 - DNA, 22 bp, Homo sapiens
agccttctctgattctcctagt

SEQ ID NO: 8269717 - DNA, 22 bp, Homo sapiens
agatggtgagggcagaagtaac

SEQ ID NO: 8269718 - DNA, 22 bp, Homo sapiens
atgtcttctctgtaggtaaatt

SEQ ID NO: 8269719 - DNA, 22 bp, Homo sapiens
atggaaatccaagtcaccgtag

SEQ ID NO: 8269720 - DNA, 22 bp, Homo sapiens
atggaaatcgatgtctaagtta

SEQ ID NO: 8269721 - DNA, 22 bp, Homo sapiens
agactaaataatgatttactgg

SEQ ID NO: 8269722 - DNA, 23 bp, Homo sapiens
atggaaatagcatgtgtcattta

SEQ ID NO: 8269723 - DNA, 22 bp, Homo sapiens
atggaaatacagccagagcaga

SEQ ID NO: 8269724 - DNA, 22 bp, Homo sapiens
atggaaatacacaagaggtttc

SEQ ID NO: 8269725 - DNA, 22 bp, Homo sapiens
actatataagattggcattttt

SEQ ID NO: 8269726 - DNA, 22 bp, Homo sapiens
actgaaggaaacttttgtgttt

SEQ ID NO: 8269727 - DNA, 22 bp, Homo sapiens
actgaaatgaaatctatcatct

SEQ ID NO: 8269728 - DNA, 22 bp, Homo sapiens
actgaaatactgctcttggatt

SEQ ID NO: 8269729 - DNA, 22 bp, Homo sapiens
actccagatgataagggacagt

SEQ ID NO: 8269730 - DNA, 22 bp, Homo sapiens
actccagaatcctagggtcagc

SEQ ID NO: 8269731 - DNA, 22 bp, Homo sapiens
acttagaattaaatatttttgg

SEQ ID NO: 8269732 - DNA, 22 bp, Homo sapiens
atccagaatgtcttgctggaga

SEQ ID NO: 8269733 - DNA, 22 bp, Homo sapiens
atccagacagtctggtgccaga

SEQ ID NO: 8269734 - DNA, 22 bp, Homo sapiens
atataatttttggttagctcaa

SEQ ID NO: 8269735 - DNA, 22 bp, Homo sapiens
atataattctcaggtttgacta

SEQ ID NO: 8269736 - DNA, 22 bp, Homo sapiens
atataattgttctgaagtgttt

SEQ ID NO: 8269737 - DNA, 22 bp, Homo sapiens
acaggtggacacagcagcagtc

SEQ ID NO: 8269738 - DNA, 22 bp, Homo sapiens
acaggtggagtggttagcaggc

SEQ ID NO: 8269739 - DNA, 22 bp, Homo sapiens
aggagtccatgagcagctagag

SEQ ID NO: 8269740 - DNA, 22 bp, Homo sapiens
acagtacaagcatgatacataa

SEQ ID NO: 8269741 - DNA, 22 bp, Homo sapiens
acagttaggtcctaaaattctg

SEQ ID NO: 8269742 - DNA, 22 bp, Homo sapiens
aagtgtaaattcacagacttca

SEQ ID NO: 8269743 - DNA, 22 bp, Homo sapiens
aacagacagaaaaatgtgatct

SEQ ID NO: 8269744 - DNA, 22 bp, Homo sapiens
aacagacatatttttaatatgc

SEQ ID NO: 8269745 - DNA, 21 bp, Homo sapiens
aaatctcagctggcctctgtg

SEQ ID NO: 8269746 - DNA, 21 bp, Homo sapiens
aagatcccagagtgctcagta

SEQ ID NO: 8269747 - DNA, 22 bp, Homo sapiens
aaatactagaattcagagttga

SEQ ID NO: 8269748 - DNA, 22 bp, Homo sapiens
aacatacagtgagcagtggact

SEQ ID NO: 8269749 - DNA, 22 bp, Homo sapiens
aaagattaaggtattgttagct

SEQ ID NO: 8269750 - DNA, 22 bp, Homo sapiens
aatggcactttataaatgttaa

SEQ ID NO: 8269751 - DNA, 22 bp, Homo sapiens
aattaacaaatgtagctgtgat

SEQ ID NO: 8269752 - DNA, 22 bp, Homo sapiens
aattaaattggtttagagagga

SEQ ID NO: 8269753 - DNA, 22 bp, Homo sapiens
acaagaattatttctagttaac

SEQ ID NO: 8269754 - DNA, 22 bp, Homo sapiens
acagatggtactaaacccatat

SEQ ID NO: 8269755 - DNA, 22 bp, Homo sapiens
acagactgttggcctactgagc

SEQ ID NO: 8269756 - DNA, 22 bp, Homo sapiens
aataccagagacagtgtttacc

SEQ ID NO: 8269757 - DNA, 22 bp, Homo sapiens
actggaggcccctcccagtgaa

SEQ ID NO: 8269758 - DNA, 22 bp, Homo sapiens
actggaggggaaaatggtagta

SEQ ID NO: 8269759 - DNA, 22 bp, Homo sapiens
aatataattttattcctagagt

SEQ ID NO: 8269760 - DNA, 22 bp, Homo sapiens
gtccatacaggcagtggctctg

SEQ ID NO: 8269761 - DNA, 22 bp, Homo sapiens
gtggcactaaatacagcatttc

SEQ ID NO: 8269762 - DNA, 22 bp, Homo sapiens
gtggcactcacctgtagtttca

SEQ ID NO: 8269763 - DNA, 22 bp, Homo sapiens
gtggagggtttgcaatgtgcag

SEQ ID NO: 8269764 - DNA, 22 bp, Homo sapiens
gtggagtggcctggccctgaga

SEQ ID NO: 8269765 - DNA, 22 bp, Homo sapiens
gtggcatctcagaggccaagaa

SEQ ID NO: 8269766 - DNA, 22 bp, Homo sapiens
gtggcatttgaacaatcacata

SEQ ID NO: 8269767 - DNA, 22 bp, Homo sapiens
gtggcattgacatgtaaacagt

SEQ ID NO: 8269768 - DNA, 22 bp, Homo sapiens
gtggcttccaagactaagtcac

SEQ ID NO: 8269769 - DNA, 22 bp, Homo sapiens
gtttaaccaagagcattgtgca

SEQ ID NO: 8269770 - DNA, 22 bp, Homo sapiens
gttctcagggataacttccccc

SEQ ID NO: 8269771 - DNA, 22 bp, Homo sapiens
gttctcagtgatctgtgattcg

SEQ ID NO: 8269772 - DNA, 22 bp, Homo sapiens
gtgggcttctgttagggaggct

SEQ ID NO: 8269773 - DNA, 20 bp, Homo sapiens
gggctctgtaaggttgaaag

SEQ ID NO: 8269774 - DNA, 22 bp, Homo sapiens
gggatgaggatcaatcagggag

SEQ ID NO: 8269775 - DNA, 22 bp, Homo sapiens
ggccatggtgaggtcttctcag

SEQ ID NO: 8269776 - DNA, 22 bp, Homo sapiens
gggaagagaccgtaccctggcc

SEQ ID NO: 8269777 - DNA, 22 bp, Homo sapiens
ggagggcccctccagtgggcag

SEQ ID NO: 8269778 - DNA, 22 bp, Homo sapiens
ggaatatagccagtaacagtca

SEQ ID NO: 8269779 - DNA, 22 bp, Homo sapiens
gcttctgagttcttgcttaata

SEQ ID NO: 8269780 - DNA, 20 bp, Homo sapiens
gcttctcagggcttctctga

SEQ ID NO: 8269781 - DNA, 22 bp, Homo sapiens
gagtcccatgatgatagccaca

SEQ ID NO: 8269782 - DNA, 22 bp, Homo sapiens
gagtcccaggaatgagcatagt

SEQ ID NO: 8269783 - DNA, 22 bp, Homo sapiens
gagtcccaggatatgtgctgtt

SEQ ID NO: 8269784 - DNA, 22 bp, Homo sapiens
gagggccaaagagcaagagcct

SEQ ID NO: 8269785 - DNA, 22 bp, Homo sapiens
gaggggcaagaagttggcctct

SEQ ID NO: 8269786 - DNA, 22 bp, Homo sapiens
gaggggcagttgattgtgctat

SEQ ID NO: 8269787 - DNA, 22 bp, Homo sapiens
gacttgaaagggtgaacaactt

SEQ ID NO: 8269788 - DNA, 22 bp, Homo sapiens
gacttgaatcccaactcctctc

SEQ ID NO: 8269789 - DNA, 22 bp, Homo sapiens
gaaggctctgatttcttgcaaa

SEQ ID NO: 8269790 - DNA, 22 bp, Homo sapiens
gaaggcccgccctgagcaaggg

SEQ ID NO: 8269791 - DNA, 22 bp, Homo sapiens
ctttggcagcctcagctgcagg

SEQ ID NO: 8269792 - DNA, 22 bp, Homo sapiens
ctttggcagcctctgctattga

SEQ ID NO: 8269793 - DNA, 20 bp, Homo sapiens
ctttggcaggccttgccacg

SEQ ID NO: 8269794 - DNA, 22 bp, Homo sapiens
ctttggcatggtcctcactata

SEQ ID NO: 8269795 - DNA, 17 bp, Homo sapiens
ctttggcaggagggagg

SEQ ID NO: 8269796 - DNA, 22 bp, Homo sapiens
gctctgtttatccctgacaatt

SEQ ID NO: 8269797 - DNA, 22 bp, Homo sapiens
gctcttctaaagaatgtacagg

SEQ ID NO: 8269798 - DNA, 22 bp, Homo sapiens
gctcttctcagattgtacactc

SEQ ID NO: 8269799 - DNA, 22 bp, Homo sapiens
gccctctgatgctcaccgagga

SEQ ID NO: 8269800 - DNA, 22 bp, Homo sapiens
gcctggagcctcagcaaggagg

SEQ ID NO: 8269801 - DNA, 22 bp, Homo sapiens
gcagggacgccagggacagcaa

SEQ ID NO: 8269802 - DNA, 22 bp, Homo sapiens
gcagtagcagtatccagaagca

SEQ ID NO: 8269803 - DNA, 22 bp, Homo sapiens
gccaatagcaatttctaggccc

SEQ ID NO: 8269804 - DNA, 22 bp, Homo sapiens
gcactttgtggattgtatttcc

SEQ ID NO: 8269805 - DNA, 22 bp, Homo sapiens
gatttctttgtacccacaatcc

SEQ ID NO: 8269806 - DNA, 22 bp, Homo sapiens
gatttctttagctcatcagatc

SEQ ID NO: 8269807 - DNA, 22 bp, Homo sapiens
gatttcttggcccactctcaga

SEQ ID NO: 8269808 - DNA, 22 bp, Homo sapiens
tttaacagatgctatgtctacc

SEQ ID NO: 8269809 - DNA, 22 bp, Homo sapiens
ttgttacagcagcaatagaaaa

SEQ ID NO: 8269810 - DNA, 22 bp, Homo sapiens
ttccctttggcagccttctcct

SEQ ID NO: 8269811 - DNA, 22 bp, Homo sapiens
ttcccaaaatataacagttaac

SEQ ID NO: 8269812 - DNA, 22 bp, Homo sapiens
ttcccaaagctttgtctgtgaa

SEQ ID NO: 8269813 - DNA, 22 bp, Homo sapiens
ttcctttcccttgcttctgtgc

SEQ ID NO: 8269814 - DNA, 22 bp, Homo sapiens
ctggcagggctctttgggtgct

SEQ ID NO: 8269815 - DNA, 22 bp, Homo sapiens
ctggcagggctggtattcaaaa

SEQ ID NO: 8269816 - DNA, 22 bp, Homo sapiens
ctggcactcataggccagttca

SEQ ID NO: 8269817 - DNA, 22 bp, Homo sapiens
ctggcactgagtggcttatgac

SEQ ID NO: 8269818 - DNA, 22 bp, Homo sapiens
ctggcacttggcacccatgaaa

SEQ ID NO: 8269819 - DNA, 22 bp, Homo sapiens
ctggcactgtgtctgcggaggg

SEQ ID NO: 8269820 - DNA, 22 bp, Homo sapiens
ctggcactggatcgtgcatatc

SEQ ID NO: 8269821 - DNA, 22 bp, Homo sapiens
ctggagggtgagcctcatctct

SEQ ID NO: 8269822 - DNA, 22 bp, Homo sapiens
ctggagggactttctcacggat

SEQ ID NO: 8269823 - DNA, 22 bp, Homo sapiens
ctggagggggaaatgttcattg

SEQ ID NO: 8269824 - DNA, 22 bp, Homo sapiens
ctggaggaataatggcatcttg

SEQ ID NO: 8269825 - DNA, 22 bp, Homo sapiens
tgcagggagggcccagcaatct

SEQ ID NO: 8269826 - DNA, 22 bp, Homo sapiens
tggccaggcaggtagaacggcc

SEQ ID NO: 8269827 - DNA, 22 bp, Homo sapiens
tggcaactcctgactctactca

SEQ ID NO: 8269828 - DNA, 22 bp, Homo sapiens
cctggcattctctccagagaga

SEQ ID NO: 8269829 - DNA, 22 bp, Homo sapiens
caggaagggggatccttggaag

SEQ ID NO: 8269830 - DNA, 22 bp, Homo sapiens
gtttggcagagcatggggatga

SEQ ID NO: 8269831 - DNA, 22 bp, Homo sapiens
gtttggcacatgaacctatttt

SEQ ID NO: 8269832 - DNA, 22 bp, Homo sapiens
gtttggcaatatttgtggaaca

SEQ ID NO: 8269833 - DNA, 22 bp, Homo sapiens
gtttggcactatgatgaggcta

SEQ ID NO: 8269834 - DNA, 19 bp, Homo sapiens
gtttggcagcaaatcagac

SEQ ID NO: 8269835 - DNA, 22 bp, Homo sapiens
gtttggcagtgttatgtaggtt

SEQ ID NO: 8269836 - DNA, 22 bp, Homo sapiens
gtttggcataaatattttcacc

SEQ ID NO: 8269837 - DNA, 18 bp, Homo sapiens
gtttggcataactgatgc

SEQ ID NO: 8269838 - DNA, 22 bp, Homo sapiens
gtttggcatctcacttaaaccg

SEQ ID NO: 8269839 - DNA, 22 bp, Homo sapiens
gtttggcataggatgtgggtta

SEQ ID NO: 8269840 - DNA, 22 bp, Homo sapiens
taacattcttaacttagaaaca

SEQ ID NO: 8269841 - DNA, 22 bp, Homo sapiens
gtgtggcaaggtgagaagtggg

SEQ ID NO: 8269842 - DNA, 22 bp, Homo sapiens
gtggcactgatagtttcactct

SEQ ID NO: 8269843 - DNA, 22 bp, Homo sapiens
gtggcactggggtctagctggc

SEQ ID NO: 8269844 - DNA, 22 bp, Homo sapiens
gtggcactgtttcccacggaag

SEQ ID NO: 8269845 - DNA, 22 bp, Homo sapiens
gtggcactggtagttttaagat

SEQ ID NO: 8269846 - DNA, 22 bp, Homo sapiens
gtggcactgggtgagtgagtga

SEQ ID NO: 8269847 - DNA, 22 bp, Homo sapiens
caggaaaggtagtcacaatgta

SEQ ID NO: 8269848 - DNA, 22 bp, Homo sapiens
ccactctgattttggctccact

SEQ ID NO: 8269849 - DNA, 22 bp, Homo sapiens
ccagaagggctattgcagtgac

SEQ ID NO: 8269850 - DNA, 22 bp, Homo sapiens
ccagaagtcaatgcagatgtga

SEQ ID NO: 8269851 - DNA, 22 bp, Homo sapiens
ccagatggtatagtagggagag

SEQ ID NO: 8269852 - DNA, 22 bp, Homo sapiens
ccagatggtttgcatgggaggg

SEQ ID NO: 8269853 - DNA, 22 bp, Homo sapiens
ccagatgggaagaagcatgact

SEQ ID NO: 8269854 - DNA, 22 bp, Homo sapiens
ccagatgggccaggggtttgtt

SEQ ID NO: 8269855 - DNA, 22 bp, Homo sapiens
tccctgcttggaatgaccctta

SEQ ID NO: 8269856 - DNA, 22 bp, Homo sapiens
tccctgcttgctctcagccctt

SEQ ID NO: 8269857 - DNA, 22 bp, Homo sapiens
ccagctcctgggtcttagtcag

SEQ ID NO: 8269858 - DNA, 18 bp, Homo sapiens
tctcttgcatcttctgta

SEQ ID NO: 8269859 - DNA, 22 bp, Homo sapiens
ccaggaagcggtgagggctgcc

SEQ ID NO: 8269860 - DNA, 23 bp, Homo sapiens
ccaggaagaggccatccacagtc

SEQ ID NO: 8269861 - DNA, 22 bp, Homo sapiens
catccatagcctcaataaatag

SEQ ID NO: 8269862 - DNA, 22 bp, Homo sapiens
catccagaccgtgccatgctgc

SEQ ID NO: 8269863 - DNA, 22 bp, Homo sapiens
catccagagtccaaggctgggc

SEQ ID NO: 8269864 - DNA, 22 bp, Homo sapiens
cagtctaacttcacagcctgga

SEQ ID NO: 8269865 - DNA, 22 bp, Homo sapiens
tatacagatggaaagatacaca

SEQ ID NO: 8269866 - DNA, 22 bp, Homo sapiens
tgttagatacacgaaaaaactt

SEQ ID NO: 8269867 - DNA, 22 bp, Homo sapiens
tgtgaaatgctattgtgacaaa

SEQ ID NO: 8269868 - DNA, 21 bp, Homo sapiens
ttcagctctgcttcagggaat

SEQ ID NO: 8269869 - DNA, 22 bp, Homo sapiens
ttcagctcaacgcacttctgag

SEQ ID NO: 8269870 - DNA, 22 bp, Homo sapiens
tggtatttaatatatgagagtt

SEQ ID NO: 8269871 - DNA, 22 bp, Homo sapiens
tggtatttccaggcttatggta

SEQ ID NO: 8269872 - DNA, 22 bp, Homo sapiens
tggtatttctgtgcccagctca

SEQ ID NO: 8269873 - DNA, 22 bp, Homo sapiens
tgtagacaggatctagttaaaa

SEQ ID NO: 8269874 - DNA, 18 bp, Homo sapiens
tgtagacagggcatggaa

SEQ ID NO: 8269875 - DNA, 22 bp, Homo sapiens
tgtagacatgcttttctgatga

SEQ ID NO: 8269876 - DNA, 22 bp, Homo sapiens
tgtaccagtgttgagaatgaga

SEQ ID NO: 8269877 - DNA, 22 bp, Homo sapiens
tgtaccaggccctgtggacatg

SEQ ID NO: 8269878 - DNA, 22 bp, Homo sapiens
tgtaacagtaagcctgtgagct

SEQ ID NO: 8269879 - DNA, 23 bp, Homo sapiens
tgtaacagagcactgattgacaa

SEQ ID NO: 8269880 - DNA, 22 bp, Homo sapiens
tgtaacagttataacaatgtgg

SEQ ID NO: 8269881 - DNA, 22 bp, Homo sapiens
tgtaacagtagttactattctt

SEQ ID NO: 8269882 - DNA, 23 bp, Homo sapiens
tgctggagacaagtgtgagaagg

SEQ ID NO: 8269883 - DNA, 22 bp, Homo sapiens
tgcttctcaaagaagcataatg

SEQ ID NO: 8269884 - DNA, 21 bp, Homo sapiens
tgcttctctagatcaactact

SEQ ID NO: 8269885 - DNA, 23 bp, Homo sapiens
tgcttctctgcttgacagttctg

SEQ ID NO: 8269886 - DNA, 22 bp, Homo sapiens
tggacacttaaaaacagataaa

SEQ ID NO: 8269887 - DNA, 22 bp, Homo sapiens
tggacactgtctccaggataaa

SEQ ID NO: 8269888 - DNA, 22 bp, Homo sapiens
tggaaatatttgctcattatct

SEQ ID NO: 8269889 - DNA, 22 bp, Homo sapiens
tggaaatatgctccattctttt

SEQ ID NO: 8269890 - DNA, 22 bp, Homo sapiens
tggaaatattgggtaatagttg

SEQ ID NO: 8269891 - DNA, 22 bp, Homo sapiens
tggaaatatacaatgtgtctct

SEQ ID NO: 8269892 - DNA, 22 bp, Homo sapiens
tggaaatacaagaagtatgtca

SEQ ID NO: 8269893 - DNA, 22 bp, Homo sapiens
tgctttctttagctcctgagtc

SEQ ID NO: 8269894 - DNA, 17 bp, Homo sapiens
tgctttcttcctgccct

SEQ ID NO: 8269895 - DNA, 22 bp, Homo sapiens
tgctttctgctcttgtccacac

SEQ ID NO: 8269896 - DNA, 22 bp, Homo sapiens
tggaggattaatctggaaagat

SEQ ID NO: 8269897 - DNA, 19 bp, Homo sapiens
tggaggagaggaaaagtca

SEQ ID NO: 8269898 - DNA, 22 bp, Homo sapiens
tggctctgccactaacttggta

SEQ ID NO: 8269899 - DNA, 22 bp, Homo sapiens
tggctctgccccatacccctgc

SEQ ID NO: 8269900 - DNA, 22 bp, Homo sapiens
tggctctgatgggaggtattgg

SEQ ID NO: 8269901 - DNA, 21 bp, Homo sapiens
tggctctgagcctcatggctg

SEQ ID NO: 8269902 - DNA, 22 bp, Homo sapiens
tggctctgagctgcaaagctgc

SEQ ID NO: 8269903 - DNA, 22 bp, Homo sapiens
tggctctgtcgccgtttggaat

SEQ ID NO: 8269904 - DNA, 22 bp, Homo sapiens
tggctctgtggtcttagcatgc

SEQ ID NO: 8269905 - DNA, 22 bp, Homo sapiens
tggctctgggaatgggaagatg

SEQ ID NO: 8269906 - DNA, 22 bp, Homo sapiens
tggctctggattaatctaggaa

SEQ ID NO: 8269907 - DNA, 21 bp, Homo sapiens
tggctctgttcaatatatgga

SEQ ID NO: 8269908 - DNA, 19 bp, Homo sapiens
tggctctgtttctctggag

SEQ ID NO: 8269909 - DNA, 22 bp, Homo sapiens
tggcttctagcagtgttgattt

SEQ ID NO: 8269910 - DNA, 22 bp, Homo sapiens
tgggacttcaatgcaatgaggt

SEQ ID NO: 8269911 - DNA, 23 bp, Homo sapiens
tggcagagacccagaatctacat

SEQ ID NO: 8269912 - DNA, 22 bp, Homo sapiens
tggcacttagatcaggttgggt

SEQ ID NO: 8269913 - DNA, 22 bp, Homo sapiens
tggcacttaatgcatgtgctat

SEQ ID NO: 8269914 - DNA, 22 bp, Homo sapiens
tggcacttagcagggaaggtgt

SEQ ID NO: 8269915 - DNA, 22 bp, Homo sapiens
tggcacttaaaaattattcttc

SEQ ID NO: 8269916 - DNA, 22 bp, Homo sapiens
tggcacttattcatatcatgga

SEQ ID NO: 8269917 - DNA, 22 bp, Homo sapiens
tggcacttccactgtggctgct

SEQ ID NO: 8269918 - DNA, 22 bp, Homo sapiens
tggcacttaggtacaagggaat

SEQ ID NO: 8269919 - DNA, 22 bp, Homo sapiens
tggcacttccgtctgccttgtg

SEQ ID NO: 8269920 - DNA, 21 bp, Homo sapiens
tggcactgcttagcaggttcc

SEQ ID NO: 8269921 - DNA, 22 bp, Homo sapiens
tggcactgaccccaggcctgtg

SEQ ID NO: 8269922 - DNA, 23 bp, Homo sapiens
tggcaactagtggtgaagagcct

SEQ ID NO: 8269923 - DNA, 22 bp, Homo sapiens
tggccactggcttccactgagt

SEQ ID NO: 8269924 - DNA, 22 bp, Homo sapiens
tggcatggtggagtgacgggca

SEQ ID NO: 8269925 - DNA, 22 bp, Homo sapiens
tggcatggtcaaggctatgtta

SEQ ID NO: 8269926 - DNA, 22 bp, Homo sapiens
tggcatttatatcccagtttat

SEQ ID NO: 8269927 - DNA, 22 bp, Homo sapiens
tggccaggccggggacagaact

SEQ ID NO: 8269928 - DNA, 22 bp, Homo sapiens
tggcatggcatttagagaatta

SEQ ID NO: 8269929 - DNA, 21 bp, Homo sapiens
tggcatggaggtagcagtgtg

SEQ ID NO: 8269930 - DNA, 22 bp, Homo sapiens
tggcatggctactggaatggcg

SEQ ID NO: 8269931 - DNA, 22 bp, Homo sapiens
tggcatggccagtgctgggagt

SEQ ID NO: 8269932 - DNA, 22 bp, Homo sapiens
tggcatggcgtggcatcgtgtg

SEQ ID NO: 8269933 - DNA, 22 bp, Homo sapiens
tggcatgggtggagagagcaca

SEQ ID NO: 8269934 - DNA, 22 bp, Homo sapiens
tggcatgggccagggagagctg

SEQ ID NO: 8269935 - DNA, 22 bp, Homo sapiens
tggcatgggcaaaccagggaaa

SEQ ID NO: 8269936 - DNA, 22 bp, Homo sapiens
tggcatggaccttggaagaatt

SEQ ID NO: 8269937 - DNA, 23 bp, Homo sapiens
tggcatcttggcatcttgctgct

SEQ ID NO: 8269938 - DNA, 22 bp, Homo sapiens
tggcatctccgacagtcttgat

SEQ ID NO: 8269939 - DNA, 22 bp, Homo sapiens
tggcatctcaaacaggcagatt

SEQ ID NO: 8269940 - DNA, 22 bp, Homo sapiens
tggcatctttgtcccagaagct

SEQ ID NO: 8269941 - DNA, 22 bp, Homo sapiens
tgaacatacaattattaagaac

SEQ ID NO: 8269942 - DNA, 22 bp, Homo sapiens
tgaaatgtaagcatagaggttg

SEQ ID NO: 8269943 - DNA, 22 bp, Homo sapiens
tgaaatgttggtaattttatat

SEQ ID NO: 8269944 - DNA, 22 bp, Homo sapiens
tgaaatgtttaggaccactaga

SEQ ID NO: 8269945 - DNA, 22 bp, Homo sapiens
tgaaatgtttgaagaccactga

SEQ ID NO: 8269946 - DNA, 22 bp, Homo sapiens
tgaaatgtgttctagtgttttg

SEQ ID NO: 8269947 - DNA, 22 bp, Homo sapiens
tgaaatgttaatcacacaaagg

SEQ ID NO: 8269948 - DNA, 22 bp, Homo sapiens
tgaaatgttctggagtttctgt

SEQ ID NO: 8269949 - DNA, 22 bp, Homo sapiens
tgaaatgtagattaggcattct

SEQ ID NO: 8269950 - DNA, 22 bp, Homo sapiens
tgaaatgtagtgaagcatggaa

SEQ ID NO: 8269951 - DNA, 22 bp, Homo sapiens
tgaaatgtcagtgttttataag

SEQ ID NO: 8269952 - DNA, 22 bp, Homo sapiens
tgaaatgtctcacttagacttt

SEQ ID NO: 8269953 - DNA, 22 bp, Homo sapiens
tgaaatgtctttgcaattgaaa

SEQ ID NO: 8269954 - DNA, 22 bp, Homo sapiens
tgaaatgtggagatggtaagta

SEQ ID NO: 8269955 - DNA, 22 bp, Homo sapiens
tgaaatgtgatctgagcttggc

SEQ ID NO: 8269956 - DNA, 22 bp, Homo sapiens
tgaaatgtgtccatgttatttc

SEQ ID NO: 8269957 - DNA, 22 bp, Homo sapiens
tgaaggccagggatttgcagcc

SEQ ID NO: 8269958 - DNA, 21 bp, Homo sapiens
tgaagggcagcctcaggctcc

SEQ ID NO: 8269959 - DNA, 22 bp, Homo sapiens
tgaaggcttggattggtcattt

SEQ ID NO: 8269960 - DNA, 22 bp, Homo sapiens
tgaaggctttctcccctctggt

SEQ ID NO: 8269961 - DNA, 23 bp, Homo sapiens
tgccaaagtttacctaacactgg

SEQ ID NO: 8269962 - DNA, 22 bp, Homo sapiens
tgcagtccctggcccactttaa

SEQ ID NO: 8269963 - DNA, 22 bp, Homo sapiens
tgcagggaacttggacagctag

SEQ ID NO: 8269964 - DNA, 22 bp, Homo sapiens
tgcagggaaaacccaggatgct

SEQ ID NO: 8269965 - DNA, 22 bp, Homo sapiens
tctcagctcttttttcacagaa

SEQ ID NO: 8269966 - DNA, 22 bp, Homo sapiens
tctcaggctaccttgcacaagg

SEQ ID NO: 8269967 - DNA, 21 bp, Homo sapiens
tctcaggcgagaattctttta

SEQ ID NO: 8269968 - DNA, 22 bp, Homo sapiens
tctcagaaatactatgttgtca

SEQ ID NO: 8269969 - DNA, 22 bp, Homo sapiens
tctgaaatagaagtgtctttct

SEQ ID NO: 8269970 - DNA, 22 bp, Homo sapiens
tctgaaatgttctcttgttttg

SEQ ID NO: 8269971 - DNA, 22 bp, Homo sapiens
tctcttctatttgagactattt

SEQ ID NO: 8269972 - DNA, 22 bp, Homo sapiens
tctctcagcattactcttacta

SEQ ID NO: 8269973 - DNA, 22 bp, Homo sapiens
tctctgaccactgagggattta

SEQ ID NO: 8269974 - DNA, 22 bp, Homo sapiens
tctaggcattgttattacaact

SEQ ID NO: 8269975 - DNA, 20 bp, Homo sapiens
tctaggcaggcaggctcgtg

SEQ ID NO: 8269976 - DNA, 22 bp, Homo sapiens
tctacagaaactggctactctc

SEQ ID NO: 8269977 - DNA, 22 bp, Homo sapiens
tctacagactcctatgtaacac

SEQ ID NO: 8269978 - DNA, 22 bp, Homo sapiens
tctgcagatttatcagcagctg

SEQ ID NO: 8269979 - DNA, 22 bp, Homo sapiens
tctgcccaggacacctgccact

SEQ ID NO: 8269980 - DNA, 22 bp, Homo sapiens
tctgatatttgaagaccattag

SEQ ID NO: 8269981 - DNA, 23 bp, Homo sapiens
tctgaccatttgacaacatcctg

SEQ ID NO: 8269982 - DNA, 23 bp, Homo sapiens
tctgaccaagttttgcatgccac

SEQ ID NO: 8269983 - DNA, 22 bp, Homo sapiens
tctgaccacagacaacctgcta

SEQ ID NO: 8269984 - DNA, 22 bp, Homo sapiens
tctgtgacttgcgggaggagaa

SEQ ID NO: 8269985 - DNA, 22 bp, Homo sapiens
tctgtgacttacaagaagggac

SEQ ID NO: 8269986 - DNA, 22 bp, Homo sapiens
tctgggtaataggaagtgcagt

SEQ ID NO: 8269987 - DNA, 19 bp, Homo sapiens
tctgggtatttggaagatg

SEQ ID NO: 8269988 - DNA, 22 bp, Homo sapiens
tctgtattctatggcagttggt

SEQ ID NO: 8269989 - DNA, 22 bp, Homo sapiens
tctgtccagaacgtacatcttg

SEQ ID NO: 8269990 - DNA, 22 bp, Homo sapiens
tcttccagaatgcattctcttt

SEQ ID NO: 8269991 - DNA, 22 bp, Homo sapiens
tcttccagatacttcctgactt

SEQ ID NO: 8269992 - DNA, 19 bp, Homo sapiens
tcttccagcatctgggggc

SEQ ID NO: 8269993 - DNA, 22 bp, Homo sapiens
tcttcttcctcatttatacata

SEQ ID NO: 8269994 - DNA, 22 bp, Homo sapiens
tcttctccagtgcttctgcaca

SEQ ID NO: 8269995 - DNA, 22 bp, Homo sapiens
tcttctcagtttctctaggatg

SEQ ID NO: 8269996 - DNA, 22 bp, Homo sapiens
tcttctgtgagaattcaagcaa

SEQ ID NO: 8269997 - DNA, 22 bp, Homo sapiens
tcttctcaaaaaatgtaggtgg

SEQ ID NO: 8269998 - DNA, 20 bp, Homo sapiens
tcttccagcttctggtagaa

SEQ ID NO: 8269999 - DNA, 20 bp, Homo sapiens
tcttggcaaatgggagtgtc

SEQ ID NO: 8270000 - DNA, 19 bp, Homo sapiens
tcttgcttcttcatccctc

SEQ ID NO: 8270001 - DNA, 19 bp, Homo sapiens
actgttctgtatgttgatt

SEQ ID NO: 8270002 - DNA, 22 bp, Homo sapiens
aagtcctttctcatggaggaat

SEQ ID NO: 8270003 - DNA, 22 bp, Homo sapiens
acagcctgtgtaccagctggga

SEQ ID NO: 8270004 - DNA, 22 bp, Homo sapiens
acagcctgtttgatctggtgct

SEQ ID NO: 8270005 - DNA, 19 bp, Homo sapiens
acagcctgttggtggggct

SEQ ID NO: 8270006 - DNA, 21 bp, Homo sapiens
acagcctgtcatctcatggtc

SEQ ID NO: 8270007 - DNA, 23 bp, Homo sapiens
aatgggtgcaactatccatgaca

SEQ ID NO: 8270008 - DNA, 22 bp, Homo sapiens
aatgtgaggccttggtagttat

SEQ ID NO: 8270009 - DNA, 22 bp, Homo sapiens
aatgtgagccaatgcccgtggg

SEQ ID NO: 8270010 - DNA, 22 bp, Homo sapiens
aaaagaacctagctcctcagtc

SEQ ID NO: 8270011 - DNA, 22 bp, Homo sapiens
aaagagaaacttagaagcctga

SEQ ID NO: 8270012 - DNA, 22 bp, Homo sapiens
aaacagccatgtcagctttgca

SEQ ID NO: 8270013 - DNA, 20 bp, Homo sapiens
aaagccactggcaagagact

SEQ ID NO: 8270014 - DNA, 22 bp, Homo sapiens
aaggaagactcgcaggtctatg

SEQ ID NO: 8270015 - DNA, 22 bp, Homo sapiens
aacagcctgagagaacaatgat

SEQ ID NO: 8270016 - DNA, 20 bp, Homo sapiens
aacagctctcgacttatctt

SEQ ID NO: 8270017 - DNA, 22 bp, Homo sapiens
aacatcagcacacaatagcaag

SEQ ID NO: 8270018 - DNA, 22 bp, Homo sapiens
aacatcagaagtagaagactca

SEQ ID NO: 8270019 - DNA, 23 bp, Homo sapiens
aacgacagctacaggcatcccac

SEQ ID NO: 8270020 - DNA, 22 bp, Homo sapiens
aacctcaaactcttgggcttaa

SEQ ID NO: 8270021 - DNA, 22 bp, Homo sapiens
aagatgaatcagtatgtgtcct

SEQ ID NO: 8270022 - DNA, 22 bp, Homo sapiens
acagcctgctgcctgcttcttg

SEQ ID NO: 8270023 - DNA, 22 bp, Homo sapiens
aagcagcttccccaaagtgcct

SEQ ID NO: 8270024 - DNA, 22 bp, Homo sapiens
aagagaaggccctgacccaccc

SEQ ID NO: 8270025 - DNA, 22 bp, Homo sapiens
aagagaaggattctgagcctgg

SEQ ID NO: 8270026 - DNA, 22 bp, Homo sapiens
aagaccatcacagagacacttg

SEQ ID NO: 8270027 - DNA, 22 bp, Homo sapiens
aggaggaaaaaggccacagcaa

SEQ ID NO: 8270028 - DNA, 22 bp, Homo sapiens
acaggtggcttattggctgatt

SEQ ID NO: 8270029 - DNA, 22 bp, Homo sapiens
acaggtggtctttgctcctttt

SEQ ID NO: 8270030 - DNA, 22 bp, Homo sapiens
accatgtttagtgcagtgttca

SEQ ID NO: 8270031 - DNA, 22 bp, Homo sapiens
accatcagagcacagtccgtgc

SEQ ID NO: 8270032 - DNA, 22 bp, Homo sapiens
accatcagtcacatgtagagaa

SEQ ID NO: 8270033 - DNA, 22 bp, Homo sapiens
accatcagtactggatgctgac

SEQ ID NO: 8270034 - DNA, 22 bp, Homo sapiens
accctcaacaaattcactctat

SEQ ID NO: 8270035 - DNA, 22 bp, Homo sapiens
agggaagagcttgcaagaaacc

SEQ ID NO: 8270036 - DNA, 22 bp, Homo sapiens
agggacagatgaatgactgagt

SEQ ID NO: 8270037 - DNA, 22 bp, Homo sapiens
aggctatttccactcttctcat

SEQ ID NO: 8270038 - DNA, 22 bp, Homo sapiens
agaaacagaagggaaagctttt

SEQ ID NO: 8270039 - DNA, 22 bp, Homo sapiens
agtttctaacatatagcattgg

SEQ ID NO: 8270040 - DNA, 22 bp, Homo sapiens
agtttcatttcttagtaccagt

SEQ ID NO: 8270041 - DNA, 22 bp, Homo sapiens
actccagggctccaccccagat

SEQ ID NO: 8270042 - DNA, 23 bp, Homo sapiens
atggaaatagcatgtgtcattta

SEQ ID NO: 8270043 - DNA, 22 bp, Homo sapiens
atgggtggccccgtgtgcagtc

SEQ ID NO: 8270044 - DNA, 22 bp, Homo sapiens
atgtctgtggcaattgttgatg

SEQ ID NO: 8270045 - DNA, 22 bp, Homo sapiens
atgtctgtgtgatcttggataa

SEQ ID NO: 8270046 - DNA, 22 bp, Homo sapiens
atgtctgttttcatatcagata

SEQ ID NO: 8270047 - DNA, 22 bp, Homo sapiens
atgtcttcatagcttatatcca

SEQ ID NO: 8270048 - DNA, 22 bp, Homo sapiens
agacagtgattcttcacatttc

SEQ ID NO: 8270049 - DNA, 22 bp, Homo sapiens
agacagtgcaagaagagcaggc

SEQ ID NO: 8270050 - DNA, 22 bp, Homo sapiens
agacagtgctatcccatctgtg

SEQ ID NO: 8270051 - DNA, 17 bp, Homo sapiens
agacagtgagtgccttg

SEQ ID NO: 8270052 - DNA, 22 bp, Homo sapiens
agacagtgaggcagagcttccg

SEQ ID NO: 8270053 - DNA, 22 bp, Homo sapiens
agaagagagtcctaccccatac

SEQ ID NO: 8270054 - DNA, 22 bp, Homo sapiens
agaagagaaatagtgccactgt

SEQ ID NO: 8270055 - DNA, 22 bp, Homo sapiens
attagcacataagaggtatagg

SEQ ID NO: 8270056 - DNA, 22 bp, Homo sapiens
atttccaagaaagctttaggat

SEQ ID NO: 8270057 - DNA, 22 bp, Homo sapiens
agatgaaaagataagcagcaat

SEQ ID NO: 8270058 - DNA, 22 bp, Homo sapiens
atttagcacacggcctggtaca

SEQ ID NO: 8270059 - DNA, 22 bp, Homo sapiens
atttagcacctccatctcaaca

SEQ ID NO: 8270060 - DNA, 22 bp, Homo sapiens
atttagcagtcctcctcacaat

SEQ ID NO: 8270061 - DNA, 22 bp, Homo sapiens
agccaggatggtctcgatcggc

SEQ ID NO: 8270062 - DNA, 22 bp, Homo sapiens
cagacagagtcttcccatcagt

SEQ ID NO: 8270063 - DNA, 22 bp, Homo sapiens
agcagtttatcctcataatgga

SEQ ID NO: 8270064 - DNA, 22 bp, Homo sapiens
agcagacaacccagatgaccca

SEQ ID NO: 8270065 - DNA, 22 bp, Homo sapiens
catgaaatgtgttaatctcttg

SEQ ID NO: 8270066 - DNA, 22 bp, Homo sapiens
catgaaatgttagaattagaca

SEQ ID NO: 8270067 - DNA, 22 bp, Homo sapiens
catgaaattcagcaggtgagta

SEQ ID NO: 8270068 - DNA, 22 bp, Homo sapiens
catgaaatgatatttgggtggg

SEQ ID NO: 8270069 - DNA, 22 bp, Homo sapiens
catgaaatggccaaccttcggc

SEQ ID NO: 8270070 - DNA, 22 bp, Homo sapiens
catgaaatcacaagctgaggac

SEQ ID NO: 8270071 - DNA, 22 bp, Homo sapiens
catgaaatctgagtatgtttcc

SEQ ID NO: 8270072 - DNA, 22 bp, Homo sapiens
catgaaatatgctacctgtctt

SEQ ID NO: 8270073 - DNA, 22 bp, Homo sapiens
catgaaatattagtaactgttt

SEQ ID NO: 8270074 - DNA, 22 bp, Homo sapiens
catgccatgtgtgaggagagga

SEQ ID NO: 8270075 - DNA, 22 bp, Homo sapiens
aggagagaatgttccaggcttg

SEQ ID NO: 8270076 - DNA, 22 bp, Homo sapiens
aggaggaatacaatccagcagc

SEQ ID NO: 8270077 - DNA, 20 bp, Homo sapiens
aggaggaagaaagcacactg

SEQ ID NO: 8270078 - DNA, 22 bp, Homo sapiens
aggaaatgtacaaatgaagatg

SEQ ID NO: 8270079 - DNA, 22 bp, Homo sapiens
aggaaaggggtaggtgtggacg

SEQ ID NO: 8270080 - DNA, 22 bp, Homo sapiens
cagcttctttgggattctttat

SEQ ID NO: 8270081 - DNA, 22 bp, Homo sapiens
ccagttgtttgccttgaaatga

SEQ ID NO: 8270082 - DNA, 22 bp, Homo sapiens
ccagtgagaatgaagataaggc

SEQ ID NO: 8270083 - DNA, 22 bp, Homo sapiens
aggctccacggcaggatgctgt

SEQ ID NO: 8270084 - DNA, 22 bp, Homo sapiens
aggctccagtctgaaccttggg

SEQ ID NO: 8270085 - DNA, 22 bp, Homo sapiens
aggctccacggtcactggctct

SEQ ID NO: 8270086 - DNA, 22 bp, Homo sapiens
aggctccatgcaaaggctgttt

SEQ ID NO: 8270087 - DNA, 22 bp, Homo sapiens
aggctccataccatctccggag

SEQ ID NO: 8270088 - DNA, 22 bp, Homo sapiens
aggctccatgctaagcgatatg

SEQ ID NO: 8270089 - DNA, 22 bp, Homo sapiens
aggctccattcatgtgaaggca

SEQ ID NO: 8270090 - DNA, 22 bp, Homo sapiens
aggctccatggttctccctcag

SEQ ID NO: 8270091 - DNA, 22 bp, Homo sapiens
aggctccattttcctgcagctg

SEQ ID NO: 8270092 - DNA, 22 bp, Homo sapiens
aggctccattccaggagctaga

SEQ ID NO: 8270093 - DNA, 22 bp, Homo sapiens
ctcgggcaccctggttctggtg

SEQ ID NO: 8270094 - DNA, 22 bp, Homo sapiens
ctcgggcttgaggctgtttacc

SEQ ID NO: 8270095 - DNA, 22 bp, Homo sapiens
ctcttgatgactgttgctggtt

SEQ ID NO: 8270096 - DNA, 22 bp, Homo sapiens
ctccagaactgggagagaataa

SEQ ID NO: 8270097 - DNA, 22 bp, Homo sapiens
cgggttcttaaacgactgggct

SEQ ID NO: 8270098 - DNA, 22 bp, Homo sapiens
aggtggggctgggaaagattcc

SEQ ID NO: 8270099 - DNA, 22 bp, Homo sapiens
aggtggcatgagactgtaccag

SEQ ID NO: 8270100 - DNA, 22 bp, Homo sapiens
aggtgccagtgctgtggtcccc

SEQ ID NO: 8270101 - DNA, 22 bp, Homo sapiens
aggtggggtgttggatgtttat

SEQ ID NO: 8270102 - DNA, 22 bp, Homo sapiens
aggtggggtgagctgcagacta

SEQ ID NO: 8270103 - DNA, 22 bp, Homo sapiens
aggtgggggctgtgtccttgac

SEQ ID NO: 8270104 - DNA, 22 bp, Homo sapiens
agggtgaatctcacaactctta

SEQ ID NO: 8270105 - DNA, 22 bp, Homo sapiens
agtttgctcagaaatttgaaat

SEQ ID NO: 8270106 - DNA, 22 bp, Homo sapiens
agtttgaaggagttgaatcacc

SEQ ID NO: 8270107 - DNA, 22 bp, Homo sapiens
agtttgaaagtattgacagaag

SEQ ID NO: 8270108 - DNA, 18 bp, Homo sapiens
atatccaataatgaacac

SEQ ID NO: 8270109 - DNA, 23 bp, Homo sapiens
cacaaaggttccattctctcacc

SEQ ID NO: 8270110 - DNA, 18 bp, Homo sapiens
gggaagccgggaagccgg

SEQ ID NO: 8270111 - DNA, 22 bp, Homo sapiens
gggagcaggacataatagcaat

SEQ ID NO: 8270112 - DNA, 22 bp, Homo sapiens
gggagcagttaaaatgattcct

SEQ ID NO: 8270113 - DNA, 22 bp, Homo sapiens
cagacagggacctcgctccaga

SEQ ID NO: 8270114 - DNA, 22 bp, Homo sapiens
ggggaagaaatctgggttcttc

SEQ ID NO: 8270115 - DNA, 22 bp, Homo sapiens
ggggaagaatgctctctagaga

SEQ ID NO: 8270116 - DNA, 22 bp, Homo sapiens
ggggaagaaccgggattcccat

SEQ ID NO: 8270117 - DNA, 22 bp, Homo sapiens
cagccaatcctgggaaagtgca

SEQ ID NO: 8270118 - DNA, 22 bp, Homo sapiens
ggtggggctcagcaatctgtgt

SEQ ID NO: 8270119 - DNA, 22 bp, Homo sapiens
ggtggggctgcaagcagttcgg

SEQ ID NO: 8270120 - DNA, 22 bp, Homo sapiens
ggtggggtcacgacagagggaa

SEQ ID NO: 8270121 - DNA, 22 bp, Homo sapiens
atggaaatggagtgtgcttgct

SEQ ID NO: 8270122 - DNA, 22 bp, Homo sapiens
gagaaaggtactattccctcca

SEQ ID NO: 8270123 - DNA, 22 bp, Homo sapiens
gagaacagaagcattcctaatt

SEQ ID NO: 8270124 - DNA, 22 bp, Homo sapiens
gagaacactaatggtttcttaa

SEQ ID NO: 8270125 - DNA, 22 bp, Homo sapiens
gagaggaaagatatatacttct

SEQ ID NO: 8270126 - DNA, 22 bp, Homo sapiens
atgtagaaagttattgtcactg

SEQ ID NO: 8270127 - DNA, 22 bp, Homo sapiens
cttgctctgggaagaaaaagtc

SEQ ID NO: 8270128 - DNA, 22 bp, Homo sapiens
atgaaatgtaagtagagagttt

SEQ ID NO: 8270129 - DNA, 22 bp, Homo sapiens
atgaaatgtatgagtctgggtt

SEQ ID NO: 8270130 - DNA, 22 bp, Homo sapiens
atgaaatgtattcagatatgta

SEQ ID NO: 8270131 - DNA, 22 bp, Homo sapiens
atctttttatctgtttggaaca

SEQ ID NO: 8270132 - DNA, 22 bp, Homo sapiens
atcttttttgtcttggtcactg

SEQ ID NO: 8270133 - DNA, 21 bp, Homo sapiens
gaaagcacagaaaggactctt

SEQ ID NO: 8270134 - DNA, 22 bp, Homo sapiens
atgcagctgacattttcatgtt

SEQ ID NO: 8270135 - DNA, 22 bp, Homo sapiens
attgaagattaaatgcttcctt

SEQ ID NO: 8270136 - DNA, 22 bp, Homo sapiens
attccactttatgtctgtatga

SEQ ID NO: 8270137 - DNA, 22 bp, Homo sapiens
tcacttccctcttcagctccca

SEQ ID NO: 8270138 - DNA, 22 bp, Homo sapiens
catccaatgtcctattaagact

SEQ ID NO: 8270139 - DNA, 22 bp, Homo sapiens
cagtttctctcatacatatttg

SEQ ID NO: 8270140 - DNA, 22 bp, Homo sapiens
cagtttctgagccctgtcattt

SEQ ID NO: 8270141 - DNA, 22 bp, Homo sapiens
cagtttctgggaggaaaggaag

SEQ ID NO: 8270142 - DNA, 15 bp, Homo sapiens
cagtttctgcttgaa

SEQ ID NO: 8270143 - DNA, 22 bp, Homo sapiens
cagtttctgccaggatgtgtta

SEQ ID NO: 8270144 - DNA, 22 bp, Homo sapiens
cagtttctgaggttccaggttt

SEQ ID NO: 8270145 - DNA, 15 bp, Homo sapiens
cagtttctgatcatc

SEQ ID NO: 8270146 - DNA, 22 bp, Homo sapiens
cagtttctgtctgttcttatcc

SEQ ID NO: 8270147 - DNA, 22 bp, Homo sapiens
cagtttctgtggtctcttttca

SEQ ID NO: 8270148 - DNA, 22 bp, Homo sapiens
cagtttctgggcgttcacaggt

SEQ ID NO: 8270149 - DNA, 22 bp, Homo sapiens
cagtttcttcaattcagacact

SEQ ID NO: 8270150 - DNA, 22 bp, Homo sapiens
cagtttcttcatcagttaagca

SEQ ID NO: 8270151 - DNA, 22 bp, Homo sapiens
cagtttcttcctcccccagaga

SEQ ID NO: 8270152 - DNA, 22 bp, Homo sapiens
cagtttcttcatctgcagaatc

SEQ ID NO: 8270153 - DNA, 17 bp, Homo sapiens
cagtttcttccccctct

SEQ ID NO: 8270154 - DNA, 22 bp, Homo sapiens
cagtttcttaagactgagatct

SEQ ID NO: 8270155 - DNA, 22 bp, Homo sapiens
cagtttctgttttaaatagcag

SEQ ID NO: 8270156 - DNA, 22 bp, Homo sapiens
cagtttcttatcttcaaaattg

SEQ ID NO: 8270157 - DNA, 22 bp, Homo sapiens
cagtttcttagtgacacaaatc

SEQ ID NO: 8270158 - DNA, 22 bp, Homo sapiens
cagtttctttccattgttacct

SEQ ID NO: 8270159 - DNA, 22 bp, Homo sapiens
cagtttcttggatgccaatttc

SEQ ID NO: 8270160 - DNA, 22 bp, Homo sapiens
cagtttcttctattttgaacta

SEQ ID NO: 8270161 - DNA, 22 bp, Homo sapiens
tccaggcaaagtgctgggctgc

SEQ ID NO: 8270162 - DNA, 22 bp, Homo sapiens
catgtgagaaacagtgatgtcg

SEQ ID NO: 8270163 - DNA, 22 bp, Homo sapiens
tctgccttttcactgccactaa

SEQ ID NO: 8270164 - DNA, 22 bp, Homo sapiens
tctcttgatgttcccagacagc

SEQ ID NO: 8270165 - DNA, 22 bp, Homo sapiens
tctcttgatatattacatagag

SEQ ID NO: 8270166 - DNA, 22 bp, Homo sapiens
tctcttgactgctaaaattaga

SEQ ID NO: 8270167 - DNA, 22 bp, Homo sapiens
tctcttgagctcagttctgatg

SEQ ID NO: 8270168 - DNA, 22 bp, Homo sapiens
tctcttgaagattgaagacaaa

SEQ ID NO: 8270169 - DNA, 19 bp, Homo sapiens
tctcttgaataggtcaaac

SEQ ID NO: 8270170 - DNA, 22 bp, Homo sapiens
ccagatagggatgagagtgcta

SEQ ID NO: 8270171 - DNA, 22 bp, Homo sapiens
ccagagcctgctgagccccatt

SEQ ID NO: 8270172 - DNA, 22 bp, Homo sapiens
caggaaattggctatttgggat

SEQ ID NO: 8270173 - DNA, 22 bp, Homo sapiens
caggaaatttaagagtgtacaa

SEQ ID NO: 8270174 - DNA, 22 bp, Homo sapiens
caggaaattcaagagaggctgc

SEQ ID NO: 8270175 - DNA, 22 bp, Homo sapiens
caggaaatggctgaataaattc

SEQ ID NO: 8270176 - DNA, 22 bp, Homo sapiens
cagcccagcgcaaacaactggc

SEQ ID NO: 8270177 - DNA, 22 bp, Homo sapiens
gtgtgagaagggaatgtaaagc

SEQ ID NO: 8270178 - DNA, 22 bp, Homo sapiens
gtgtgagagaagctgccatgga

SEQ ID NO: 8270179 - DNA, 22 bp, Homo sapiens
gtgtgagagactgaagaaagcc

SEQ ID NO: 8270180 - DNA, 22 bp, Homo sapiens
gtgtgagagcaaaactgcagga

SEQ ID NO: 8270181 - DNA, 22 bp, Homo sapiens
gtggggcatgcacgctgctcct

SEQ ID NO: 8270182 - DNA, 22 bp, Homo sapiens
gtggggagtgttctgtgattgg

SEQ ID NO: 8270183 - DNA, 22 bp, Homo sapiens
gtggggcagtggcctgggagca

SEQ ID NO: 8270184 - DNA, 22 bp, Homo sapiens
taagaaacatttttatgacagt

SEQ ID NO: 8270185 - DNA, 22 bp, Homo sapiens
caggcagccaggggacctgtcc

SEQ ID NO: 8270186 - DNA, 22 bp, Homo sapiens
taattgtacgatgttaaatcag

SEQ ID NO: 8270187 - DNA, 22 bp, Homo sapiens
caggaggattgcttgaggccag

SEQ ID NO: 8270188 - DNA, 22 bp, Homo sapiens
caggaggaaatgtgaccctgct

SEQ ID NO: 8270189 - DNA, 22 bp, Homo sapiens
caggaggaaactggattcactt

SEQ ID NO: 8270190 - DNA, 22 bp, Homo sapiens
caggagatgacagggaagaacc

SEQ ID NO: 8270191 - DNA, 22 bp, Homo sapiens
tgtattcagggacatatatgta

SEQ ID NO: 8270192 - DNA, 20 bp, Homo sapiens
tgtcatgcattagatgaaga

SEQ ID NO: 8270193 - DNA, 22 bp, Homo sapiens
tgtcatgccaccgtttcccaga

SEQ ID NO: 8270194 - DNA, 22 bp, Homo sapiens
tgtgaagatttggcatgcagaa

SEQ ID NO: 8270195 - DNA, 22 bp, Homo sapiens
tgtggggctgtcaggcaactgg

SEQ ID NO: 8270196 - DNA, 22 bp, Homo sapiens
tgtggggctccctggcagcctg

SEQ ID NO: 8270197 - DNA, 22 bp, Homo sapiens
tgtggggcagctagccggcctg

SEQ ID NO: 8270198 - DNA, 22 bp, Homo sapiens
tgtggggcctcgtgctagctgg

SEQ ID NO: 8270199 - DNA, 22 bp, Homo sapiens
tgtggggccaaagcccagccac

SEQ ID NO: 8270200 - DNA, 22 bp, Homo sapiens
tgtggggctgtggtgttcttct

SEQ ID NO: 8270201 - DNA, 22 bp, Homo sapiens
tgtggggcttacaaaggcagat

SEQ ID NO: 8270202 - DNA, 22 bp, Homo sapiens
cccaggcagtgctgatccctca

SEQ ID NO: 8270203 - DNA, 22 bp, Homo sapiens
cccccaggctctgacacaggag

SEQ ID NO: 8270204 - DNA, 22 bp, Homo sapiens
cccccaggggctccgcctcgtg

SEQ ID NO: 8270205 - DNA, 22 bp, Homo sapiens
tgctgagataagctatgaccag

SEQ ID NO: 8270206 - DNA, 22 bp, Homo sapiens
tgctccatgcgctcggccggcg

SEQ ID NO: 8270207 - DNA, 22 bp, Homo sapiens
ctgagaagcactgtctgcaaga

SEQ ID NO: 8270208 - DNA, 22 bp, Homo sapiens
ctgagaaatacccaagtctggt

SEQ ID NO: 8270209 - DNA, 22 bp, Homo sapiens
ttcatgatagtatctattcaat

SEQ ID NO: 8270210 - DNA, 22 bp, Homo sapiens
ttgttaaaatgcatattctggt

SEQ ID NO: 8270211 - DNA, 22 bp, Homo sapiens
gcaccgttcactctccgccaga

SEQ ID NO: 8270212 - DNA, 22 bp, Homo sapiens
gatttatttttaatcagcaggg

SEQ ID NO: 8270213 - DNA, 22 bp, Homo sapiens
gatggtgtcccaggctcaggct

SEQ ID NO: 8270214 - DNA, 22 bp, Homo sapiens
gctcttgaaataatggctaatg

SEQ ID NO: 8270215 - DNA, 22 bp, Homo sapiens
gctcttgaaaatcaaaagggaa

SEQ ID NO: 8270216 - DNA, 22 bp, Homo sapiens
gctcttgaaactggggtttcca

SEQ ID NO: 8270217 - DNA, 22 bp, Homo sapiens
gctcttgactcccagttctgtg

SEQ ID NO: 8270218 - DNA, 22 bp, Homo sapiens
gctcttgaccttggagaactcg

SEQ ID NO: 8270219 - DNA, 22 bp, Homo sapiens
gctcttgatacatcaagaactt

SEQ ID NO: 8270220 - DNA, 22 bp, Homo sapiens
gctcttgaggaagtgcagggca

SEQ ID NO: 8270221 - DNA, 22 bp, Homo sapiens
gctcttgaagtactgggtgttg

SEQ ID NO: 8270222 - DNA, 21 bp, Homo sapiens
gctcttgaataagcataataa

SEQ ID NO: 8270223 - DNA, 22 bp, Homo sapiens
gctcttgaatatgggtttcatg

SEQ ID NO: 8270224 - DNA, 22 bp, Homo sapiens
gctcttgacagctacatctggc

SEQ ID NO: 8270225 - DNA, 22 bp, Homo sapiens
gctcttgatttccaggagctag

SEQ ID NO: 8270226 - DNA, 22 bp, Homo sapiens
gctcttgatgttcattgacttg

SEQ ID NO: 8270227 - DNA, 22 bp, Homo sapiens
gaaagtttgcctctctcttgag

SEQ ID NO: 8270228 - DNA, 22 bp, Homo sapiens
gaaagtttcttcattaagatgt

SEQ ID NO: 8270229 - DNA, 22 bp, Homo sapiens
gaacacaggtggcccggcaggg

SEQ ID NO: 8270230 - DNA, 21 bp, Homo sapiens
gaaaggtcttaacttacagag

SEQ ID NO: 8270231 - DNA, 22 bp, Homo sapiens
gaaagtttataggttatataat

SEQ ID NO: 8270232 - DNA, 20 bp, Homo sapiens
gaaggaagggggcaaggtga

SEQ ID NO: 8270233 - DNA, 20 bp, Homo sapiens
gacttcccatatcttcttca

SEQ ID NO: 8270234 - DNA, 22 bp, Homo sapiens
gaccatcctggccaacgtggta

SEQ ID NO: 8270235 - DNA, 22 bp, Homo sapiens
gagagtctaggaacctcatata

SEQ ID NO: 8270236 - DNA, 22 bp, Homo sapiens
gagagctgggctttgggtgaag

SEQ ID NO: 8270237 - DNA, 22 bp, Homo sapiens
gaggggaaagtgtgaggctgcg

SEQ ID NO: 8270238 - DNA, 22 bp, Homo sapiens
gaggggaaagtgtgaggctgcg

SEQ ID NO: 8270239 - DNA, 22 bp, Homo sapiens
gagctggccgcagagagggcag

SEQ ID NO: 8270240 - DNA, 22 bp, Homo sapiens
gagctggcctcaggcacaggag

SEQ ID NO: 8270241 - DNA, 22 bp, Homo sapiens
gaggcagctgggctggtggttt

SEQ ID NO: 8270242 - DNA, 22 bp, Homo sapiens
gagtttctaggatggaggtgag

SEQ ID NO: 8270243 - DNA, 22 bp, Homo sapiens
gagtttctgatttagtaggtct

SEQ ID NO: 8270244 - DNA, 22 bp, Homo sapiens
gagtttctgattcagtctgtgt

SEQ ID NO: 8270245 - DNA, 22 bp, Homo sapiens
gagtttctccagtgctagttgt

SEQ ID NO: 8270246 - DNA, 22 bp, Homo sapiens
gagtttctgctctaggtctggt

SEQ ID NO: 8270247 - DNA, 22 bp, Homo sapiens
gagtttcttcatggtgcagagg

SEQ ID NO: 8270248 - DNA, 22 bp, Homo sapiens
gagtttcttaacaggtggaagc

SEQ ID NO: 8270249 - DNA, 23 bp, Homo sapiens
gagtttcttccaggagccctggg

SEQ ID NO: 8270250 - DNA, 22 bp, Homo sapiens
gagttaaaggaaaataacttta

SEQ ID NO: 8270251 - DNA, 22 bp, Homo sapiens
gagttaaaaatgcctccatgga

SEQ ID NO: 8270252 - DNA, 22 bp, Homo sapiens
gagtggggtctgggcatcagtc

SEQ ID NO: 8270253 - DNA, 22 bp, Homo sapiens
gagtggcagaactgggggtcct

SEQ ID NO: 8270254 - DNA, 22 bp, Homo sapiens
gatgaaatttgggcaggttaaa

SEQ ID NO: 8270255 - DNA, 22 bp, Homo sapiens
gatgaaatttgaaaatagtgtt

SEQ ID NO: 8270256 - DNA, 22 bp, Homo sapiens
gatgaaatgtgaaagttctggg

SEQ ID NO: 8270257 - DNA, 17 bp, Homo sapiens
gatgaaatgatgcacac

SEQ ID NO: 8270258 - DNA, 22 bp, Homo sapiens
gatgaaatgctgagcctgagtt

SEQ ID NO: 8270259 - DNA, 22 bp, Homo sapiens
gatgaaattgttttgatacttt

SEQ ID NO: 8270260 - DNA, 22 bp, Homo sapiens
gatgaaattcagaattgagggg

SEQ ID NO: 8270261 - DNA, 22 bp, Homo sapiens
gatgaaatagaattaatttagg

SEQ ID NO: 8270262 - DNA, 22 bp, Homo sapiens
gatgaaatagcaaaggcatttg

SEQ ID NO: 8270263 - DNA, 20 bp, Homo sapiens
gatgaaatcactgggcagcc

SEQ ID NO: 8270264 - DNA, 22 bp, Homo sapiens
gatgaaatccagatcacaggtg

SEQ ID NO: 8270265 - DNA, 22 bp, Homo sapiens
ggaaactgtagtttgctgacat

SEQ ID NO: 8270266 - DNA, 22 bp, Homo sapiens
ggaaactgcttacactagaggg

SEQ ID NO: 8270267 - DNA, 22 bp, Homo sapiens
ggaagaaaggtggacaacaggt

SEQ ID NO: 8270268 - DNA, 22 bp, Homo sapiens
ggaataggatttacctctgtaa

SEQ ID NO: 8270269 - DNA, 22 bp, Homo sapiens
ggagggaagtgagttctcagct

SEQ ID NO: 8270270 - DNA, 22 bp, Homo sapiens
ggcagacacaaaaacataaggt

SEQ ID NO: 8270271 - DNA, 22 bp, Homo sapiens
ggcagacaatctgtctgttagg

SEQ ID NO: 8270272 - DNA, 22 bp, Homo sapiens
ggcagacacctttatgtctaat

SEQ ID NO: 8270273 - DNA, 19 bp, Homo sapiens
ggcagacacagttgacatg

SEQ ID NO: 8270274 - DNA, 22 bp, Homo sapiens
ggcagacactcaaaagctggga

SEQ ID NO: 8270275 - DNA, 22 bp, Homo sapiens
ggagtggccacgactgggagat

SEQ ID NO: 8270276 - DNA, 22 bp, Homo sapiens
ggagtggcctctcctgtgcagg

SEQ ID NO: 8270277 - DNA, 22 bp, Homo sapiens
ggagtggcactctgaggcgggg

SEQ ID NO: 8270278 - DNA, 22 bp, Homo sapiens
ggagtggcagcgaggatcagat

SEQ ID NO: 8270279 - DNA, 22 bp, Homo sapiens
ggagtggcagctaggctgtcag

SEQ ID NO: 8270280 - DNA, 22 bp, Homo sapiens
ggctggctcttaccgacagcgt

SEQ ID NO: 8270281 - DNA, 23 bp, Homo sapiens
ggggacagttcccactggggtct

SEQ ID NO: 8270282 - DNA, 22 bp, Homo sapiens
ggggacgcagaaagagtggcag

SEQ ID NO: 8270283 - DNA, 20 bp, Homo sapiens
gggtgagatgtaggagaggg

SEQ ID NO: 8270284 - DNA, 22 bp, Homo sapiens
gtggggaggcctaagcaagttg

SEQ ID NO: 8270285 - DNA, 22 bp, Homo sapiens
gtggggaggcattcttctccct

SEQ ID NO: 8270286 - DNA, 22 bp, Homo sapiens
gtggtgtttttggggcagagga

SEQ ID NO: 8270287 - DNA, 22 bp, Homo sapiens
gtggtgtttgagctgccaggga

SEQ ID NO: 8270288 - DNA, 22 bp, Homo sapiens
gtggtgttcccacgcctgctag

SEQ ID NO: 8270289 - DNA, 22 bp, Homo sapiens
gtggtgtttgccagttaataac

SEQ ID NO: 8270290 - DNA, 22 bp, Homo sapiens
gtgggtggagactgggtgcaag

SEQ ID NO: 8270291 - DNA, 18 bp, Homo sapiens
gtgtcctttgcaagaaac

SEQ ID NO: 8270292 - DNA, 22 bp, Homo sapiens
gtgggagctttggcatcaggct

SEQ ID NO: 8270293 - DNA, 22 bp, Homo sapiens
gtggctgggctccgagcggctt

SEQ ID NO: 8270294 - DNA, 22 bp, Homo sapiens
gtggctggtttcctgcatgcaa

SEQ ID NO: 8270295 - DNA, 22 bp, Homo sapiens
gtggctcttgcatggggtctct

SEQ ID NO: 8270296 - DNA, 22 bp, Homo sapiens
gtggcatggagaaggaggcagt

SEQ ID NO: 8270297 - DNA, 22 bp, Homo sapiens
gtggcagcagaggggtggtatg

SEQ ID NO: 8270298 - DNA, 22 bp, Homo sapiens
gtccttgggatagaaagatgaa

SEQ ID NO: 8270299 - DNA, 22 bp, Homo sapiens
gtcctttgaaggcaaaaggaga

SEQ ID NO: 8270300 - DNA, 22 bp, Homo sapiens
gggtggggttcaggaatcttca

SEQ ID NO: 8270301 - DNA, 22 bp, Homo sapiens
gggtggggtgtatcggatccta

SEQ ID NO: 8270302 - DNA, 22 bp, Homo sapiens
gggtggggcccaggaaatctat

SEQ ID NO: 8270303 - DNA, 22 bp, Homo sapiens
gggtggggccaggcaatttgca

SEQ ID NO: 8270304 - DNA, 22 bp, Homo sapiens
ggtgattctgtgaggggctgac

SEQ ID NO: 8270305 - DNA, 22 bp, Homo sapiens
ggtggcattcagaagagctggc

SEQ ID NO: 8270306 - DNA, 19 bp, Homo sapiens
tcttgcttcttcatccctc

SEQ ID NO: 8270307 - DNA, 22 bp, Homo sapiens
tcttgattgttttctgacctta

SEQ ID NO: 8270308 - DNA, 22 bp, Homo sapiens
tcttgattaataccttagccct

SEQ ID NO: 8270309 - DNA, 22 bp, Homo sapiens
tcttgattacttattttgtgcc

SEQ ID NO: 8270310 - DNA, 22 bp, Homo sapiens
tcttgaaaggagattggaggca

SEQ ID NO: 8270311 - DNA, 21 bp, Homo sapiens
tctttctgaaatctcagtctg

SEQ ID NO: 8270312 - DNA, 22 bp, Homo sapiens
tctttccctgtgttagcctgta

SEQ ID NO: 8270313 - DNA, 19 bp, Homo sapiens
tctttcatttctagctctg

SEQ ID NO: 8270314 - DNA, 22 bp, Homo sapiens
tctttccatggccacacagtct

SEQ ID NO: 8270315 - DNA, 21 bp, Homo sapiens
tcttgaaaagttagattctct

SEQ ID NO: 8270316 - DNA, 22 bp, Homo sapiens
tcttgaaagcattttcttcatc

SEQ ID NO: 8270317 - DNA, 21 bp, Homo sapiens
tcttcagcagtggtgaggtgg

SEQ ID NO: 8270318 - DNA, 22 bp, Homo sapiens
tctgacaggtcattttctatag

SEQ ID NO: 8270319 - DNA, 22 bp, Homo sapiens
tctgagaagcaccttctggaca

SEQ ID NO: 8270320 - DNA, 22 bp, Homo sapiens
tctgagaaaataggaaacttga

SEQ ID NO: 8270321 - DNA, 17 bp, Homo sapiens
tctgagaaaggagaatc

SEQ ID NO: 8270322 - DNA, 22 bp, Homo sapiens
tctgagaagctagaggacaaag

SEQ ID NO: 8270323 - DNA, 22 bp, Homo sapiens
tctgcccaggacacctgccact

SEQ ID NO: 8270324 - DNA, 22 bp, Homo sapiens
tctaggtggatgaggaacatag

SEQ ID NO: 8270325 - DNA, 22 bp, Homo sapiens
tctattttgtttccagctctac

SEQ ID NO: 8270326 - DNA, 22 bp, Homo sapiens
tccttgaatgaagagaggtgac

SEQ ID NO: 8270327 - DNA, 22 bp, Homo sapiens
tccttgaagcaacgtgcagaca

SEQ ID NO: 8270328 - DNA, 23 bp, Homo sapiens
tcctttgacaagagacagatgtt

SEQ ID NO: 8270329 - DNA, 22 bp, Homo sapiens
tctcttcagcccattataaggg

SEQ ID NO: 8270330 - DNA, 22 bp, Homo sapiens
tctgaacagcatggaatcattt

SEQ ID NO: 8270331 - DNA, 22 bp, Homo sapiens
tctgaaagctagaaaatgctct

SEQ ID NO: 8270332 - DNA, 22 bp, Homo sapiens
tctcactttccagacttttcaa

SEQ ID NO: 8270333 - DNA, 18 bp, Homo sapiens
tctcagcccagctccggc

SEQ ID NO: 8270334 - DNA, 22 bp, Homo sapiens
tctcattcatccaaggatttat

SEQ ID NO: 8270335 - DNA, 22 bp, Homo sapiens
tctcctttaagatttcctcagg

SEQ ID NO: 8270336 - DNA, 22 bp, Homo sapiens
tctcccaggtcatacacagaga

SEQ ID NO: 8270337 - DNA, 20 bp, Homo sapiens
tgcccacatcactcaggagt

SEQ ID NO: 8270338 - DNA, 22 bp, Homo sapiens
tgcagacaagtcgtgggatctt

SEQ ID NO: 8270339 - DNA, 22 bp, Homo sapiens
tgaagtttaaggttagataagt

SEQ ID NO: 8270340 - DNA, 22 bp, Homo sapiens
tgaaggtgacctgacagtggct

SEQ ID NO: 8270341 - DNA, 22 bp, Homo sapiens
tgaagttttctggttgattaag

SEQ ID NO: 8270342 - DNA, 22 bp, Homo sapiens
tgaagttttactaggtgaattt

SEQ ID NO: 8270343 - DNA, 22 bp, Homo sapiens
tgaattccattgccaaagtttt

SEQ ID NO: 8270344 - DNA, 22 bp, Homo sapiens
tgaaatgcctatgaagtcagga

SEQ ID NO: 8270345 - DNA, 22 bp, Homo sapiens
tgaaagttaggatgtagtaatt

SEQ ID NO: 8270346 - DNA, 22 bp, Homo sapiens
tgaaagttattactgatgatgt

SEQ ID NO: 8270347 - DNA, 20 bp, Homo sapiens
tgaaatagatactcagagat

SEQ ID NO: 8270348 - DNA, 22 bp, Homo sapiens
tgaagacaaagtcaggcccaga

SEQ ID NO: 8270349 - DNA, 22 bp, Homo sapiens
tgaaagaagccttcgaggctcg

SEQ ID NO: 8270350 - DNA, 21 bp, Homo sapiens
tgaaagaaggtgcagtctgaa

SEQ ID NO: 8270351 - DNA, 22 bp, Homo sapiens
tgagatcattgacttgttcctg

SEQ ID NO: 8270352 - DNA, 23 bp, Homo sapiens
tgagataggtattattatcatgc

SEQ ID NO: 8270353 - DNA, 22 bp, Homo sapiens
tgagatcatttatttacctttc

SEQ ID NO: 8270354 - DNA, 22 bp, Homo sapiens
tgagagagcctgaatctcttac

SEQ ID NO: 8270355 - DNA, 20 bp, Homo sapiens
tgagaggacatttttcatgt

SEQ ID NO: 8270356 - DNA, 22 bp, Homo sapiens
tgagacagcctctgcactcatg

SEQ ID NO: 8270357 - DNA, 22 bp, Homo sapiens
tgagaatgtgcaatatccttcc

SEQ ID NO: 8270358 - DNA, 20 bp, Homo sapiens
tgagaagctcctgtctcctc

SEQ ID NO: 8270359 - DNA, 22 bp, Homo sapiens
tgagacagcagattagcaatga

SEQ ID NO: 8270360 - DNA, 22 bp, Homo sapiens
tgagaagcacagctcactcacg

SEQ ID NO: 8270361 - DNA, 22 bp, Homo sapiens
tgagaagatttgctcttctgag

SEQ ID NO: 8270362 - DNA, 22 bp, Homo sapiens
tgagaagcccacactctttcct

SEQ ID NO: 8270363 - DNA, 22 bp, Homo sapiens
tgagaagcccacactctttcct

SEQ ID NO: 8270364 - DNA, 22 bp, Homo sapiens
tgagaaaggtatttcatgcact

SEQ ID NO: 8270365 - DNA, 22 bp, Homo sapiens
tgagaaaggtatttcatgcact

SEQ ID NO: 8270366 - DNA, 22 bp, Homo sapiens
tgaggaaaacgtattgaaagga

SEQ ID NO: 8270367 - DNA, 22 bp, Homo sapiens
tgagggactcagaattcagcct

SEQ ID NO: 8270368 - DNA, 22 bp, Homo sapiens
tgaggaagaacaagaatttaga

SEQ ID NO: 8270369 - DNA, 22 bp, Homo sapiens
tgaggaagccaaacagctacac

SEQ ID NO: 8270370 - DNA, 18 bp, Homo sapiens
tgaggaaggggaagtatt

SEQ ID NO: 8270371 - DNA, 23 bp, Homo sapiens
tgaggaagtaattgtaaaggtct

SEQ ID NO: 8270372 - DNA, 22 bp, Homo sapiens
tgaggaagtggttgtatggttt

SEQ ID NO: 8270373 - DNA, 22 bp, Homo sapiens
tgaggaagttgatctcatcagt

SEQ ID NO: 8270374 - DNA, 22 bp, Homo sapiens
tggcatgggccagggagagctg

SEQ ID NO: 8270375 - DNA, 22 bp, Homo sapiens
tggcatgggtggagagagcaca

SEQ ID NO: 8270376 - DNA, 21 bp, Homo sapiens
tggcatggaggtagcagtgtg

SEQ ID NO: 8270377 - DNA, 22 bp, Homo sapiens
tggcatggcaaccctgcaggga

SEQ ID NO: 8270378 - DNA, 22 bp, Homo sapiens
tgggagcaggaagcaggaagta

SEQ ID NO: 8270379 - DNA, 22 bp, Homo sapiens
tggctggtcacatggtaggtct

SEQ ID NO: 8270380 - DNA, 22 bp, Homo sapiens
tggctggttttggtgagctccg

SEQ ID NO: 8270381 - DNA, 22 bp, Homo sapiens
tggctggtgggcctcagcctgc

SEQ ID NO: 8270382 - DNA, 21 bp, Homo sapiens
tggctggtggcagggcttctc

SEQ ID NO: 8270383 - DNA, 22 bp, Homo sapiens
tggctccagatctgtctcctgt

SEQ ID NO: 8270384 - DNA, 22 bp, Homo sapiens
tggaggccagtgaaagtagatt

SEQ ID NO: 8270385 - DNA, 22 bp, Homo sapiens
tggaggccggactgagaggcat

SEQ ID NO: 8270386 - DNA, 19 bp, Homo sapiens
tggaggcctcaggaaaaga

SEQ ID NO: 8270387 - DNA, 22 bp, Homo sapiens
tggaggccctcattgtagaagt

SEQ ID NO: 8270388 - DNA, 22 bp, Homo sapiens
tggagcagagttcagcggggag

SEQ ID NO: 8270389 - DNA, 22 bp, Homo sapiens
tggagcagaggctgaggttggg

SEQ ID NO: 8270390 - DNA, 22 bp, Homo sapiens
tggagcagccatgatgacagag

SEQ ID NO: 8270391 - DNA, 22 bp, Homo sapiens
tggagcccagggtgagaaggag

SEQ ID NO: 8270392 - DNA, 22 bp, Homo sapiens
tggagcccaggagaggataaac

SEQ ID NO: 8270393 - DNA, 22 bp, Homo sapiens
tggagcccaggtgcaagagagt

SEQ ID NO: 8270394 - DNA, 22 bp, Homo sapiens
tggagcagctgaacagagttga

SEQ ID NO: 8270395 - DNA, 22 bp, Homo sapiens
tggagcaggtgctcagggtaat

SEQ ID NO: 8270396 - DNA, 22 bp, Homo sapiens
tggagcaggtgccaggtgtgtg

SEQ ID NO: 8270397 - DNA, 22 bp, Homo sapiens
tggagcaggacggggagtggta

SEQ ID NO: 8270398 - DNA, 19 bp, Homo sapiens
tggaaatggaagctcagcc

SEQ ID NO: 8270399 - DNA, 23 bp, Homo sapiens
tgctggtgtttttgggaccaggg

SEQ ID NO: 8270400 - DNA, 22 bp, Homo sapiens
tgctggtggagaaagtggaggt

SEQ ID NO: 8270401 - DNA, 21 bp, Homo sapiens
tgctggtgagctcatgtggct

SEQ ID NO: 8270402 - DNA, 21 bp, Homo sapiens
tgctgagatttgcctgattac

SEQ ID NO: 8270403 - DNA, 22 bp, Homo sapiens
tgctgaaaactcaaccattgtg

SEQ ID NO: 8270404 - DNA, 22 bp, Homo sapiens
tgcggcaggagaaggtgttatg

SEQ ID NO: 8270405 - DNA, 22 bp, Homo sapiens
tgcggcagccaccgcgtggccc

SEQ ID NO: 8270406 - DNA, 19 bp, Homo sapiens
tgctcagctcctgtgagtc

SEQ ID NO: 8270407 - DNA, 22 bp, Homo sapiens
tggtgtgggcgtggcaggcaag

SEQ ID NO: 8270408 - DNA, 22 bp, Homo sapiens
tggtgtgggcagcagcaggtac

SEQ ID NO: 8270409 - DNA, 23 bp, Homo sapiens
tggtggggtcttggagacagcac

SEQ ID NO: 8270410 - DNA, 22 bp, Homo sapiens
tggtcgggagcgagcagctatt

SEQ ID NO: 8270411 - DNA, 16 bp, Homo sapiens
tggtggggaggacagc

SEQ ID NO: 8270412 - DNA, 22 bp, Homo sapiens
tggtggggattccctccctggc

SEQ ID NO: 8270413 - DNA, 22 bp, Homo sapiens
tggtggggctttccttctgctt

SEQ ID NO: 8270414 - DNA, 22 bp, Homo sapiens
tggtggggccagacttcagctc

SEQ ID NO: 8270415 - DNA, 22 bp, Homo sapiens
tggtggggtcatcgtcagatgc

SEQ ID NO: 8270416 - DNA, 22 bp, Homo sapiens
tggtgggggaggctgtctagca

SEQ ID NO: 8270417 - DNA, 22 bp, Homo sapiens
tggtggcagagcaagagctgga

SEQ ID NO: 8270418 - DNA, 23 bp, Homo sapiens
tggtggcagaagtagcagatgac

SEQ ID NO: 8270419 - DNA, 22 bp, Homo sapiens
tggtggcagtctcctggctgtg

SEQ ID NO: 8270420 - DNA, 22 bp, Homo sapiens
tggtggcagctgggacagaggt

SEQ ID NO: 8270421 - DNA, 22 bp, Homo sapiens
tggtggcatgatagtgtgaatg

SEQ ID NO: 8270422 - DNA, 22 bp, Homo sapiens
tggtggcaaagtacaaagtgac

SEQ ID NO: 8270423 - DNA, 22 bp, Homo sapiens
tgtagaaactacacatgcaaca

SEQ ID NO: 8270424 - DNA, 22 bp, Homo sapiens
tgggttctagagggaccagaac

SEQ ID NO: 8270425 - DNA, 22 bp, Homo sapiens
tgggtctcctgtgcctgggagg

SEQ ID NO: 8270426 - DNA, 23 bp, Homo sapiens
tgggtctctagtacaggcaggca

SEQ ID NO: 8270427 - DNA, 22 bp, Homo sapiens
tgggtctgtagggctgtccaat

SEQ ID NO: 8270428 - DNA, 22 bp, Homo sapiens
tgggtctccagttcagggcagg

SEQ ID NO: 8270429 - DNA, 22 bp, Homo sapiens
tgggggagattagagcttctta

SEQ ID NO: 8270430 - DNA, 22 bp, Homo sapiens
tgggcagcaaagactgtgtgct

SEQ ID NO: 8270431 - DNA, 20 bp, Homo sapiens
tgggcagcactgctggctgg

SEQ ID NO: 8270432 - DNA, 23 bp, Homo sapiens
tgggatggattcaccagtgtgct

SEQ ID NO: 8270433 - DNA, 22 bp, Homo sapiens
tgggatgggatctcgctgtgtc

SEQ ID NO: 8270434 - DNA, 22 bp, Homo sapiens
ttcagcttgcttagtctccttc

SEQ ID NO: 8270435 - DNA, 22 bp, Homo sapiens
ttagaaaggggtgaatcaatgg

SEQ ID NO: 8270436 - DNA, 22 bp, Homo sapiens
ttagaaaggttttgctctgaaa

SEQ ID NO: 8270437 - DNA, 22 bp, Homo sapiens
ttagcactgtctggttatcttg

SEQ ID NO: 8270438 - DNA, 22 bp, Homo sapiens
ttagcactttgattcatgcaga

SEQ ID NO: 8270439 - DNA, 22 bp, Homo sapiens
tgtgagaggagaaatgcattaa

SEQ ID NO: 8270440 - DNA, 22 bp, Homo sapiens
tgtgagagctgcttcagccagg

SEQ ID NO: 8270441 - DNA, 22 bp, Homo sapiens
tgtgagttcttattgctcatct

SEQ ID NO: 8270442 - DNA, 22 bp, Homo sapiens
tgtgagagctccatcctcatga

SEQ ID NO: 8270443 - DNA, 22 bp, Homo sapiens
tgtgagagcagaagacacatag

SEQ ID NO: 8270444 - DNA, 22 bp, Homo sapiens
tgtgagagagtgcatttgcata

SEQ ID NO: 8270445 - DNA, 22 bp, Homo sapiens
tgttagcaaggataattatgat

SEQ ID NO: 8270446 - DNA, 22 bp, Homo sapiens
tgtttattacagttcttggaat

SEQ ID NO: 8270447 - DNA, 22 bp, Homo sapiens
tgtttattcatggctaatgaaa

SEQ ID NO: 8270448 - DNA, 22 bp, Homo sapiens
tgtttattgctgcaattgtgcc

SEQ ID NO: 8270449 - DNA, 22 bp, Homo sapiens
tgtttattttcaggatggattg

SEQ ID NO: 8270450 - DNA, 18 bp, Homo sapiens
tgtttattctcctgacag

SEQ ID NO: 8270451 - DNA, 22 bp, Homo sapiens
tgtttattgcagtgctgggctg

SEQ ID NO: 8270452 - DNA, 22 bp, Homo sapiens
tgtttattgagtgcctactata

SEQ ID NO: 8270453 - DNA, 18 bp, Homo sapiens
tgtttatttttctcttac

SEQ ID NO: 8270454 - DNA, 22 bp, Homo sapiens
agagaaacaggtcagctgggag

SEQ ID NO: 8270455 - DNA, 21 bp, Homo sapiens
agagagaaggccatatggtcc

SEQ ID NO: 8270456 - DNA, 22 bp, Homo sapiens
agaaactcatcctggagatgac

SEQ ID NO: 8270457 - DNA, 22 bp, Homo sapiens
actgagaagattctcactctta

SEQ ID NO: 8270458 - DNA, 22 bp, Homo sapiens
aagtttgtctcatttgatcttc

SEQ ID NO: 8270459 - DNA, 22 bp, Homo sapiens
aagtttgtggtcatttattata

SEQ ID NO: 8270460 - DNA, 22 bp, Homo sapiens
aagtttctgaatttgaaaggat

SEQ ID NO: 8270461 - DNA, 22 bp, Homo sapiens
aagtttctcaatggcaactggg

SEQ ID NO: 8270462 - DNA, 22 bp, Homo sapiens
aagtttctcagggttgattggg

SEQ ID NO: 8270463 - DNA, 21 bp, Homo sapiens
aagtttctccctaattgttgc

SEQ ID NO: 8270464 - DNA, 22 bp, Homo sapiens
aagtgacataaaatctcccagg

SEQ ID NO: 8270465 - DNA, 22 bp, Homo sapiens
aaatagaattggaagcagagtt

SEQ ID NO: 8270466 - DNA, 22 bp, Homo sapiens
aaatagaattaactagctactg

SEQ ID NO: 8270467 - DNA, 22 bp, Homo sapiens
aaatgctaaatgcagcaagtag

SEQ ID NO: 8270468 - DNA, 22 bp, Homo sapiens
aaagtcatttagccttatctcc

SEQ ID NO: 8270469 - DNA, 22 bp, Homo sapiens
aaaccattaggttttatctact

SEQ ID NO: 8270470 - DNA, 22 bp, Homo sapiens
aacagtcttggaagtcttgtta

SEQ ID NO: 8270471 - DNA, 22 bp, Homo sapiens
aactgaaatcaatcagtgattc

SEQ ID NO: 8270472 - DNA, 22 bp, Homo sapiens
aactttctttgcatctaagttt

SEQ ID NO: 8270473 - DNA, 22 bp, Homo sapiens
aagaggaagtctccatggagag

SEQ ID NO: 8270474 - DNA, 22 bp, Homo sapiens
aagttcttgagccctattctag

SEQ ID NO: 8270475 - DNA, 22 bp, Homo sapiens
aagtttctttattagcttgtcc

SEQ ID NO: 8270476 - DNA, 22 bp, Homo sapiens
aagtttctgttcatatctctga

SEQ ID NO: 8270477 - DNA, 22 bp, Homo sapiens
aagtttctgttcgctttaataa

SEQ ID NO: 8270478 - DNA, 22 bp, Homo sapiens
aagtttctgtatgctcttctgt

SEQ ID NO: 8270479 - DNA, 20 bp, Homo sapiens
aagtttctggtttatatctt

SEQ ID NO: 8270480 - DNA, 22 bp, Homo sapiens
aagtttctgccatactgtggtg

SEQ ID NO: 8270481 - DNA, 22 bp, Homo sapiens
aagtttctgatattgttaaagc

SEQ ID NO: 8270482 - DNA, 22 bp, Homo sapiens
aagtttctgggcaagacaaggc

SEQ ID NO: 8270483 - DNA, 22 bp, Homo sapiens
aagtttctggaccttacctgct

SEQ ID NO: 8270484 - DNA, 22 bp, Homo sapiens
aagccattcatctaatgtcctg

SEQ ID NO: 8270485 - DNA, 22 bp, Homo sapiens
aagccattcccatagacttcag

SEQ ID NO: 8270486 - DNA, 22 bp, Homo sapiens
aatgtcttttgatacaagttac

SEQ ID NO: 8270487 - DNA, 22 bp, Homo sapiens
aactttctagagatgagttcgg

SEQ ID NO: 8270488 - DNA, 22 bp, Homo sapiens
aactttctgaaaagcttgatca

SEQ ID NO: 8270489 - DNA, 22 bp, Homo sapiens
aagcacattatagctatctagg

SEQ ID NO: 8270490 - DNA, 22 bp, Homo sapiens
cactttctcatgaatttggccc

SEQ ID NO: 8270491 - DNA, 22 bp, Homo sapiens
agctagaactacaggcatgtgc

SEQ ID NO: 8270492 - DNA, 20 bp, Homo sapiens
agctaagaggaaaagtgaga

SEQ ID NO: 8270493 - DNA, 22 bp, Homo sapiens
agcggcagcagatgtgatcagg

SEQ ID NO: 8270494 - DNA, 21 bp, Homo sapiens
agcggcagaccctgcatttga

SEQ ID NO: 8270495 - DNA, 22 bp, Homo sapiens
agcaccttgatcttggacttcc

SEQ ID NO: 8270496 - DNA, 22 bp, Homo sapiens
agcaccttgagatcaagcagtg

SEQ ID NO: 8270497 - DNA, 21 bp, Homo sapiens
agcaccttcaattctattgtc

SEQ ID NO: 8270498 - DNA, 22 bp, Homo sapiens
agatcattaaccacctgttctg

SEQ ID NO: 8270499 - DNA, 23 bp, Homo sapiens
attttagctgaatgacttcttta

SEQ ID NO: 8270500 - DNA, 22 bp, Homo sapiens
agaggggagagctaagcaattc

SEQ ID NO: 8270501 - DNA, 22 bp, Homo sapiens
agaggggaagtaatgaatgata

SEQ ID NO: 8270502 - DNA, 22 bp, Homo sapiens
agacaaggcaaggcggccagat

SEQ ID NO: 8270503 - DNA, 22 bp, Homo sapiens
atctgcttgccctcttaggacc

SEQ ID NO: 8270504 - DNA, 22 bp, Homo sapiens
atctgcttgagtttgaagtcag

SEQ ID NO: 8270505 - DNA, 22 bp, Homo sapiens
atctgcttgaaacttcttatac

SEQ ID NO: 8270506 - DNA, 22 bp, Homo sapiens
atgccaattgcaggaagaaaac

SEQ ID NO: 8270507 - DNA, 22 bp, Homo sapiens
atgccttatagtccacagtgga

SEQ ID NO: 8270508 - DNA, 22 bp, Homo sapiens
aggcaaagagccagcaaatctg

SEQ ID NO: 8270509 - DNA, 22 bp, Homo sapiens
aggagggtacaatgggtggaaa

SEQ ID NO: 8270510 - DNA, 22 bp, Homo sapiens
aggaaagaaaggaggtgcattt

SEQ ID NO: 8270511 - DNA, 22 bp, Homo sapiens
acagcctgatttatggagcagt

SEQ ID NO: 8270512 - DNA, 22 bp, Homo sapiens
acagcctgagagtggagctggc

SEQ ID NO: 8270513 - DNA, 23 bp, Homo sapiens
aggctccactccctgggatgtgg

SEQ ID NO: 8270514 - DNA, 22 bp, Homo sapiens
aggctccagcagccagaggaag

SEQ ID NO: 8270515 - DNA, 22 bp, Homo sapiens
aggctccagcccaaggctgcag

SEQ ID NO: 8270516 - DNA, 22 bp, Homo sapiens
aggctccagccaatgggtctgt

SEQ ID NO: 8270517 - DNA, 22 bp, Homo sapiens
aggctccaggcctccctgcatg

SEQ ID NO: 8270518 - DNA, 22 bp, Homo sapiens
aggctccagggctgtgtgggag

SEQ ID NO: 8270519 - DNA, 22 bp, Homo sapiens
aggctccaggcaaaatttcgga

SEQ ID NO: 8270520 - DNA, 22 bp, Homo sapiens
aggctccaggcaatgtttctga

SEQ ID NO: 8270521 - DNA, 22 bp, Homo sapiens
aggctccaggcccttcaccagc

SEQ ID NO: 8270522 - DNA, 22 bp, Homo sapiens
aggtggggaaaccagcgatccc

SEQ ID NO: 8270523 - DNA, 20 bp, Homo sapiens
atagatatcatctttagaag

SEQ ID NO: 8270524 - DNA, 22 bp, Homo sapiens
actttttctcagaaggattggt

SEQ ID NO: 8270525 - DNA, 22 bp, Homo sapiens
agaaagcctgagcagacggagc

SEQ ID NO: 8270526 - DNA, 22 bp, Homo sapiens
agaagctgtggtatgaaatgtg

SEQ ID NO: 8270527 - DNA, 22 bp, Homo sapiens
agtggggccgcggtcctgccct

SEQ ID NO: 8270528 - DNA, 22 bp, Homo sapiens
agtggcctggagccccgcctgg

SEQ ID NO: 8270529 - DNA, 22 bp, Homo sapiens
agttaaagaaagataattcgcc

SEQ ID NO: 8270530 - DNA, 22 bp, Homo sapiens
agttaaagtctgaaatagagaa

SEQ ID NO: 8270531 - DNA, 22 bp, Homo sapiens
agtgaaatcctggtcaacaggt

SEQ ID NO: 8270532 - DNA, 22 bp, Homo sapiens
ctaggaaagacacagagagttt

SEQ ID NO: 8270533 - DNA, 22 bp, Homo sapiens
ctaggaaagtgattcttcaatt

SEQ ID NO: 8270534 - DNA, 22 bp, Homo sapiens
ctaggaaatactgtttcaaggc

SEQ ID NO: 8270535 - DNA, 22 bp, Homo sapiens
aggtcacatggataatgatcag

SEQ ID NO: 8270536 - DNA, 22 bp, Homo sapiens
aggtggcagcagcctggtgaaa

SEQ ID NO: 8270537 - DNA, 22 bp, Homo sapiens
aggtggcagcagaatcagggag

SEQ ID NO: 8270538 - DNA, 22 bp, Homo sapiens
aggtggcaggaggtcagagaaa

SEQ ID NO: 8270539 - DNA, 22 bp, Homo sapiens
aggtggcagagctggcccagcg

SEQ ID NO: 8270540 - DNA, 22 bp, Homo sapiens
aggtggcagactaacagaagga

SEQ ID NO: 8270541 - DNA, 22 bp, Homo sapiens
aggtggcagagtgacaggctga

SEQ ID NO: 8270542 - DNA, 20 bp, Homo sapiens
atataccatcccacaacagg

SEQ ID NO: 8270543 - DNA, 22 bp, Homo sapiens
cttctgagatgttgttttacag

SEQ ID NO: 8270544 - DNA, 22 bp, Homo sapiens
atctgtgtatgtgaccttatct

SEQ ID NO: 8270545 - DNA, 22 bp, Homo sapiens
ctgggtggctgtccagccagcc

SEQ ID NO: 8270546 - DNA, 22 bp, Homo sapiens
atattcacactgtttagttaca

SEQ ID NO: 8270547 - DNA, 22 bp, Homo sapiens
atattcaaattacatttactaa

SEQ ID NO: 8270548 - DNA, 22 bp, Homo sapiens
atcagcaggtgctggtggagac

SEQ ID NO: 8270549 - DNA, 22 bp, Homo sapiens
ccaaaccatccatctccaggct

SEQ ID NO: 8270550 - DNA, 22 bp, Homo sapiens
catgtgtgaatcttgtgatcat

SEQ ID NO: 8270551 - DNA, 22 bp, Homo sapiens
cagtgaggagtccagggcagag

SEQ ID NO: 8270552 - DNA, 22 bp, Homo sapiens
aggaattttaatatgcttgtct

SEQ ID NO: 8270553 - DNA, 22 bp, Homo sapiens
aggagggtggcctcatgtgagt

SEQ ID NO: 8270554 - DNA, 22 bp, Homo sapiens
aggagggtttcaatgggatgag

SEQ ID NO: 8270555 - DNA, 22 bp, Homo sapiens
agctttctagactctgtggtca

SEQ ID NO: 8270556 - DNA, 22 bp, Homo sapiens
agctttctatatatgagttgct

SEQ ID NO: 8270557 - DNA, 22 bp, Homo sapiens
agctttctagatttggaattgt

SEQ ID NO: 8270558 - DNA, 22 bp, Homo sapiens
agctttctcttctttagaaagt

SEQ ID NO: 8270559 - DNA, 20 bp, Homo sapiens
aggaagtattgtcatgaagg

SEQ ID NO: 8270560 - DNA, 22 bp, Homo sapiens
agctggtgctcaggggcatgga

SEQ ID NO: 8270561 - DNA, 22 bp, Homo sapiens
caggaaatcagaactcaagtgg

SEQ ID NO: 8270562 - DNA, 22 bp, Homo sapiens
caggaaatataggaaaaggaac

SEQ ID NO: 8270563 - DNA, 22 bp, Homo sapiens
caggaaatatctcaacacttta

SEQ ID NO: 8270564 - DNA, 22 bp, Homo sapiens
caggaaatgaacaggaatgaac

SEQ ID NO: 8270565 - DNA, 23 bp, Homo sapiens
caggaaatgaatccaggaggatg

SEQ ID NO: 8270566 - DNA, 22 bp, Homo sapiens
caggaaatgaggctgaagggtg

SEQ ID NO: 8270567 - DNA, 23 bp, Homo sapiens
caggaaatgcttggaggggctgg

SEQ ID NO: 8270568 - DNA, 22 bp, Homo sapiens
ccaggtgactgtcagaggtttt

SEQ ID NO: 8270569 - DNA, 19 bp, Homo sapiens
cccaggagcagtattgatg

SEQ ID NO: 8270570 - DNA, 22 bp, Homo sapiens
ccccagagagcaccatgaagcc

SEQ ID NO: 8270571 - DNA, 22 bp, Homo sapiens
gcagaatactgagagctgattg

SEQ ID NO: 8270572 - DNA, 22 bp, Homo sapiens
gcagatgcagagatggctgggg

SEQ ID NO: 8270573 - DNA, 22 bp, Homo sapiens
gagaggaatatcattatattag

SEQ ID NO: 8270574 - DNA, 22 bp, Homo sapiens
gagggaagaaagaattgatgcg

SEQ ID NO: 8270575 - DNA, 22 bp, Homo sapiens
gaaatgaaatagcaccaaggtt

SEQ ID NO: 8270576 - DNA, 18 bp, Homo sapiens
gaaatctcaagagacaga

SEQ ID NO: 8270577 - DNA, 22 bp, Homo sapiens
gaaaatgagcctcagctacatt

SEQ ID NO: 8270578 - DNA, 22 bp, Homo sapiens
atgaatgctgaattatgaactg

SEQ ID NO: 8270579 - DNA, 22 bp, Homo sapiens
cttgagaatcttgatgtctacc

SEQ ID NO: 8270580 - DNA, 22 bp, Homo sapiens
atgccatttgctggaaggaagt

SEQ ID NO: 8270581 - DNA, 22 bp, Homo sapiens
ggggcgccccgagggtgcgcac

SEQ ID NO: 8270582 - DNA, 22 bp, Homo sapiens
gggggagctgttattggcaggg

SEQ ID NO: 8270583 - DNA, 23 bp, Homo sapiens
gggggagctggactcctagatcc

SEQ ID NO: 8270584 - DNA, 22 bp, Homo sapiens
ggtgtctgcttccctccagctg

SEQ ID NO: 8270585 - DNA, 22 bp, Homo sapiens
ggtgtctgatggtggcttctca

SEQ ID NO: 8270586 - DNA, 22 bp, Homo sapiens
ggtggcagtgcttgcgggtcta

SEQ ID NO: 8270587 - DNA, 22 bp, Homo sapiens
cagatggcaacagctctgtgac

SEQ ID NO: 8270588 - DNA, 22 bp, Homo sapiens
ggtggctggaggagctgatgga

SEQ ID NO: 8270589 - DNA, 22 bp, Homo sapiens
ggtgggacaggtaggagtggct

SEQ ID NO: 8270590 - DNA, 22 bp, Homo sapiens
gtgaagttttagtatatgtaga

SEQ ID NO: 8270591 - DNA, 22 bp, Homo sapiens
gtgaagttggccagtttagttt

SEQ ID NO: 8270592 - DNA, 22 bp, Homo sapiens
gtgcctgggacacagcagatac

SEQ ID NO: 8270593 - DNA, 22 bp, Homo sapiens
cacagcctccttcagagagcat

SEQ ID NO: 8270594 - DNA, 22 bp, Homo sapiens
cacagccttactgagatccact

SEQ ID NO: 8270595 - DNA, 22 bp, Homo sapiens
cacagccttgagcgaggacaag

SEQ ID NO: 8270596 - DNA, 22 bp, Homo sapiens
cacagcctttagggtacacaca

SEQ ID NO: 8270597 - DNA, 22 bp, Homo sapiens
cacagccttgagcgaggacaag

SEQ ID NO: 8270598 - DNA, 22 bp, Homo sapiens
ggagcagcctgtgtagacgggg

SEQ ID NO: 8270599 - DNA, 22 bp, Homo sapiens
ggagcagccgcgtctcagggca

SEQ ID NO: 8270600 - DNA, 22 bp, Homo sapiens
ggagcagccacgtctcagggca

SEQ ID NO: 8270601 - DNA, 22 bp, Homo sapiens
ggagcagcttgcatgctcaggg

SEQ ID NO: 8270602 - DNA, 22 bp, Homo sapiens
ggcaggtgccttctgtgctagc

SEQ ID NO: 8270603 - DNA, 22 bp, Homo sapiens
tacagcctcgaactcctgcatt

SEQ ID NO: 8270604 - DNA, 22 bp, Homo sapiens
tacagccttcatctttgccttg

SEQ ID NO: 8270605 - DNA, 22 bp, Homo sapiens
tacagcctgttacctatatttg

SEQ ID NO: 8270606 - DNA, 22 bp, Homo sapiens
tagaaagacaatgggaagtgct

SEQ ID NO: 8270607 - DNA, 22 bp, Homo sapiens
tagaaagagcatagtattataa

SEQ ID NO: 8270608 - DNA, 22 bp, Homo sapiens
tagaaagatctgtaggcaagag

SEQ ID NO: 8270609 - DNA, 19 bp, Homo sapiens
tagaaagatgatgggtggg

SEQ ID NO: 8270610 - DNA, 22 bp, Homo sapiens
caggtgggcttgggagaacact

SEQ ID NO: 8270611 - DNA, 22 bp, Homo sapiens
caggtggggagagtgtggagca

SEQ ID NO: 8270612 - DNA, 22 bp, Homo sapiens
caggtgggcgtggcgagaaggc

SEQ ID NO: 8270613 - DNA, 22 bp, Homo sapiens
caggtgggctgcctctccagct

SEQ ID NO: 8270614 - DNA, 22 bp, Homo sapiens
caggtgggccggggtttgttct

SEQ ID NO: 8270615 - DNA, 22 bp, Homo sapiens
caggtggggggcttccgagcct

SEQ ID NO: 8270616 - DNA, 22 bp, Homo sapiens
caggtggggcgccctcaggcag

SEQ ID NO: 8270617 - DNA, 22 bp, Homo sapiens
caggtggggcagctgtgggagc

SEQ ID NO: 8270618 - DNA, 22 bp, Homo sapiens
tagtttctagacagtaagaatt

SEQ ID NO: 8270619 - DNA, 22 bp, Homo sapiens
tagtttctagtaacaaacccat

SEQ ID NO: 8270620 - DNA, 22 bp, Homo sapiens
tagtttctttcacgtagtaata

SEQ ID NO: 8270621 - DNA, 22 bp, Homo sapiens
tagtttctcagggaggaaagaa

SEQ ID NO: 8270622 - DNA, 22 bp, Homo sapiens
tagtttctagtcaatcttcttt

SEQ ID NO: 8270623 - DNA, 22 bp, Homo sapiens
tagtttctgaggattgaaagat

SEQ ID NO: 8270624 - DNA, 22 bp, Homo sapiens
tagtttctgcctcggaagctga

SEQ ID NO: 8270625 - DNA, 22 bp, Homo sapiens
tagtttctgggttggcttctac

SEQ ID NO: 8270626 - DNA, 22 bp, Homo sapiens
tagtttcttcacctgtaaaatg

SEQ ID NO: 8270627 - DNA, 22 bp, Homo sapiens
tagtttcttgattagccacttt

SEQ ID NO: 8270628 - DNA, 22 bp, Homo sapiens
tagtttctggttcttgctctgg

SEQ ID NO: 8270629 - DNA, 22 bp, Homo sapiens
ccaagagctacagatatgaaat

SEQ ID NO: 8270630 - DNA, 22 bp, Homo sapiens
catgcttttttctagtataaat

SEQ ID NO: 8270631 - DNA, 22 bp, Homo sapiens
catgctttctgtccaaatgtta

SEQ ID NO: 8270632 - DNA, 22 bp, Homo sapiens
catgctttgggtcagaaatgcc

SEQ ID NO: 8270633 - DNA, 19 bp, Homo sapiens
catggtgaaaccccgtctc

SEQ ID NO: 8270634 - DNA, 20 bp, Homo sapiens
catggtggaggagcagggcc

SEQ ID NO: 8270635 - DNA, 22 bp, Homo sapiens
catgctatataggaagagcact

SEQ ID NO: 8270636 - DNA, 22 bp, Homo sapiens
ccagtcagggcaggagcctggt

SEQ ID NO: 8270637 - DNA, 22 bp, Homo sapiens
tcttgattttgtgaataagttg

SEQ ID NO: 8270638 - DNA, 22 bp, Homo sapiens
tcttgatttgtaaaagaaggat

SEQ ID NO: 8270639 - DNA, 21 bp, Homo sapiens
tcttgattttggacttcttcc

SEQ ID NO: 8270640 - DNA, 22 bp, Homo sapiens
tcttgatttgaattgcagttgt

SEQ ID NO: 8270641 - DNA, 22 bp, Homo sapiens
tgaaggtgtatgctgtgggtca

SEQ ID NO: 8270642 - DNA, 22 bp, Homo sapiens
tgggtggcagcttcagcatgtt

SEQ ID NO: 8270643 - DNA, 22 bp, Homo sapiens
tgctgggggtgtctcaccaggc

SEQ ID NO: 8270644 - DNA, 22 bp, Homo sapiens
tggaggccaaggcaggcggatc

SEQ ID NO: 8270645 - DNA, 23 bp, Homo sapiens
tggagatgccccactccctgtct

SEQ ID NO: 8270646 - DNA, 22 bp, Homo sapiens
tggagatggcctcaggccctca

SEQ ID NO: 8270647 - DNA, 21 bp, Homo sapiens
tggcagacaggaggagctcac

SEQ ID NO: 8270648 - DNA, 22 bp, Homo sapiens
cttagcacatatcagaaaatag

SEQ ID NO: 8270649 - DNA, 20 bp, Homo sapiens
cttagcaccagcaggacagg

SEQ ID NO: 8270650 - DNA, 22 bp, Homo sapiens
cttctgctgctgttcatggttg

SEQ ID NO: 8270651 - DNA, 22 bp, Homo sapiens
ctttctcttcagcacccagccc

SEQ ID NO: 8270652 - DNA, 22 bp, Homo sapiens
gaaagagaggggctgagatgca

SEQ ID NO: 8270653 - DNA, 22 bp, Homo sapiens
cttttcattgtttgtacatgca

SEQ ID NO: 8270654 - DNA, 22 bp, Homo sapiens
gacagacacaattgatccatga

SEQ ID NO: 8270655 - DNA, 22 bp, Homo sapiens
gaagcagctaggatcttcattt

SEQ ID NO: 8270656 - DNA, 22 bp, Homo sapiens
gagaaaggcattcctatgcaaa

SEQ ID NO: 8270657 - DNA, 22 bp, Homo sapiens
gaggcagcttggggctgtgggt

SEQ ID NO: 8270658 - DNA, 22 bp, Homo sapiens
gaggaagaagcaaaccagctaa

SEQ ID NO: 8270659 - DNA, 22 bp, Homo sapiens
tttcttgagcccaggaggtgga

SEQ ID NO: 8270660 - DNA, 22 bp, Homo sapiens
ttgtttatggattgtagaaact

SEQ ID NO: 8270661 - DNA, 22 bp, Homo sapiens
ttttctctatattgtctgtgaa

SEQ ID NO: 8270662 - DNA, 22 bp, Homo sapiens
ttaatagatttgattttaaagg

SEQ ID NO: 8270663 - DNA, 22 bp, Homo sapiens
ttctgaaaacacactttgcagc

SEQ ID NO: 8270664 - DNA, 22 bp, Homo sapiens
cggctggtgtcgggcacagcaa

SEQ ID NO: 8270665 - DNA, 22 bp, Homo sapiens
gtctggtttatgaagatcccgt

SEQ ID NO: 8270666 - DNA, 22 bp, Homo sapiens
gtagcaccagtgctcttctcaa

SEQ ID NO: 8270667 - DNA, 22 bp, Homo sapiens
gtagcacccactacttttcgct

SEQ ID NO: 8270668 - DNA, 22 bp, Homo sapiens
gtagcaccgcgagacttggggc

SEQ ID NO: 8270669 - DNA, 22 bp, Homo sapiens
ggtgggcagctcttggcaggca

SEQ ID NO: 8270670 - DNA, 22 bp, Homo sapiens
ggtggctctgttgtcaactgat

SEQ ID NO: 8270671 - DNA, 22 bp, Homo sapiens
gggggagctagtccagctgagg

SEQ ID NO: 8270672 - DNA, 22 bp, Homo sapiens
gggggagctacaggtcccttgg

SEQ ID NO: 8270673 - DNA, 22 bp, Homo sapiens
gggctccatcggacttgggttt

SEQ ID NO: 8270674 - DNA, 22 bp, Homo sapiens
gggctccagccagctccttgtg

SEQ ID NO: 8270675 - DNA, 22 bp, Homo sapiens
ggcactgtttttgtattcagtt

SEQ ID NO: 8270676 - DNA, 22 bp, Homo sapiens
ggcagcaggagccatctggtag

SEQ ID NO: 8270677 - DNA, 23 bp, Homo sapiens
ggctggtgcccttggccagtcgg

SEQ ID NO: 8270678 - DNA, 22 bp, Homo sapiens
ggctggtgagttcagagaaccc

SEQ ID NO: 8270679 - DNA, 22 bp, Homo sapiens
ggctggtggggaaagaggacca

SEQ ID NO: 8270680 - DNA, 22 bp, Homo sapiens
ggctggtgttacagtcggcagc

SEQ ID NO: 8270681 - DNA, 22 bp, Homo sapiens
gcttccggagccaaaaggcccc

SEQ ID NO: 8270682 - DNA, 22 bp, Homo sapiens
gctgattctgaggtgctttcct

SEQ ID NO: 8270683 - DNA, 22 bp, Homo sapiens
gctgcaggagctggagctgtgg

SEQ ID NO: 8270684 - DNA, 22 bp, Homo sapiens
gctcaccactgctagagtctat

SEQ ID NO: 8270685 - DNA, 22 bp, Homo sapiens
gcctggtggtatcctggcaaga

SEQ ID NO: 8270686 - DNA, 22 bp, Homo sapiens
tagcacctgcaggatgtgcaca

SEQ ID NO: 8270687 - DNA, 22 bp, Homo sapiens
tagcacctggtcaattcagtca

SEQ ID NO: 8270688 - DNA, 22 bp, Homo sapiens
tagcacctgtgcacaccaggca

SEQ ID NO: 8270689 - DNA, 22 bp, Homo sapiens
tagcacctagagtattttatca

SEQ ID NO: 8270690 - DNA, 22 bp, Homo sapiens
tagcacctgatacctagtatgt

SEQ ID NO: 8270691 - DNA, 22 bp, Homo sapiens
tagcaccggatggcaagcaaca

SEQ ID NO: 8270692 - DNA, 22 bp, Homo sapiens
tagcacacactgcatctacaaa

SEQ ID NO: 8270693 - DNA, 22 bp, Homo sapiens
taggaaatggctcagttactgc

SEQ ID NO: 8270694 - DNA, 22 bp, Homo sapiens
taggaaatgccagccttcctcc

SEQ ID NO: 8270695 - DNA, 22 bp, Homo sapiens
taggaaatgctccattgcataa

SEQ ID NO: 8270696 - DNA, 22 bp, Homo sapiens
taggaaatgctgtcttattgta

SEQ ID NO: 8270697 - DNA, 20 bp, Homo sapiens
taggaaatatgtttttaccc

SEQ ID NO: 8270698 - DNA, 22 bp, Homo sapiens
tagttaaggccacttgcctaag

SEQ ID NO: 8270699 - DNA, 22 bp, Homo sapiens
tagttaaagccctaaattgata

SEQ ID NO: 8270700 - DNA, 22 bp, Homo sapiens
tatttcacataccacagagtgt

SEQ ID NO: 8270701 - DNA, 22 bp, Homo sapiens
tattttcaccttctctggatat

SEQ ID NO: 8270702 - DNA, 22 bp, Homo sapiens
tatttccatgttagaactaagt

SEQ ID NO: 8270703 - DNA, 22 bp, Homo sapiens
tatttccagcagtaagaagaca

SEQ ID NO: 8270704 - DNA, 22 bp, Homo sapiens
tattgagaccagtgcttgctta

SEQ ID NO: 8270705 - DNA, 22 bp, Homo sapiens
gttagcacaaccaagaaatgcg

SEQ ID NO: 8270706 - DNA, 22 bp, Homo sapiens
gttagcaccagtgctcataaca

SEQ ID NO: 8270707 - DNA, 20 bp, Homo sapiens
gtttagcatggcagtgaaag

SEQ ID NO: 8270708 - DNA, 22 bp, Homo sapiens
gtttctctgtctgttacattgg

SEQ ID NO: 8270709 - DNA, 22 bp, Homo sapiens
tcaaaccaccttgttactgggg

SEQ ID NO: 8270710 - DNA, 22 bp, Homo sapiens
tcaaaccagccttgcatcccag

SEQ ID NO: 8270711 - DNA, 22 bp, Homo sapiens
tcaaaccatataatcggttaca

SEQ ID NO: 8270712 - DNA, 22 bp, Homo sapiens
tccctttcactactgtgttggt

SEQ ID NO: 8270713 - DNA, 22 bp, Homo sapiens
tttgagatggagtcttgctctg

SEQ ID NO: 8270714 - DNA, 22 bp, Homo sapiens
ttctcaaggacaaaatgacatg

SEQ ID NO: 8270715 - DNA, 22 bp, Homo sapiens
ttctgagggaaccttgttcttg

SEQ ID NO: 8270716 - DNA, 22 bp, Homo sapiens
ttctgattcatgatccagttct

SEQ ID NO: 8270717 - DNA, 22 bp, Homo sapiens
ttgaaagatatgttaatctttc

SEQ ID NO: 8270718 - DNA, 22 bp, Homo sapiens
ttgaaacagacaagtaaatgtc

SEQ ID NO: 8270719 - DNA, 22 bp, Homo sapiens
ttgagagaggaaacatagtctc

SEQ ID NO: 8270720 - DNA, 22 bp, Homo sapiens
ttgagaagaaatagtttgcaat

SEQ ID NO: 8270721 - DNA, 22 bp, Homo sapiens
ttgagaaggtggtcatttgcaa

SEQ ID NO: 8270722 - DNA, 22 bp, Homo sapiens
ttgagagaaaaaatttattggt

SEQ ID NO: 8270723 - DNA, 22 bp, Homo sapiens
ttctttgaccaaacagttttcc

SEQ ID NO: 8270724 - DNA, 19 bp, Homo sapiens
ttctttgagttcttctgag

SEQ ID NO: 8270725 - DNA, 22 bp, Homo sapiens
ttctggcttttcatgttccagt

SEQ ID NO: 8270726 - DNA, 22 bp, Homo sapiens
ttgtgagagtttaccttgacca

SEQ ID NO: 8270727 - DNA, 22 bp, Homo sapiens
ttgtgagatgatttgaaagtgt

SEQ ID NO: 8270728 - DNA, 22 bp, Homo sapiens
ttgtgagatgtctactgaagaa

SEQ ID NO: 8270729 - DNA, 23 bp, Homo sapiens
ttgtgagaccttggaagaagtat

SEQ ID NO: 8270730 - DNA, 22 bp, Homo sapiens
ttgtgagactcgtaagagaagg

SEQ ID NO: 8270731 - DNA, 22 bp, Homo sapiens
ttgtgagacacaaatcaatgca

SEQ ID NO: 8270732 - DNA, 22 bp, Homo sapiens
ttgtgagagaaaatgtgtatat

SEQ ID NO: 8270733 - DNA, 22 bp, Homo sapiens
ttgtgagagccaaacatgtaag

SEQ ID NO: 8270734 - DNA, 22 bp, Homo sapiens
ttggggagttaatgccaaagat

SEQ ID NO: 8270735 - DNA, 22 bp, Homo sapiens
ttggggagaaatgaaatgaagt

SEQ ID NO: 8270736 - DNA, 22 bp, Homo sapiens
tttctaaactggattcagcctg

SEQ ID NO: 8270737 - DNA, 22 bp, Homo sapiens
aagtttctacatctccatcata

SEQ ID NO: 8270738 - DNA, 22 bp, Homo sapiens
aagtttctattattacattcgt

SEQ ID NO: 8270739 - DNA, 20 bp, Homo sapiens
aatcccttctctggactctt

SEQ ID NO: 8270740 - DNA, 22 bp, Homo sapiens
aatgagaatgtaagtgaagaga

SEQ ID NO: 8270741 - DNA, 22 bp, Homo sapiens
accatcagtcattgtcagtggg

SEQ ID NO: 8270742 - DNA, 22 bp, Homo sapiens
aaggaagaaatgaataggtgga

SEQ ID NO: 8270743 - DNA, 22 bp, Homo sapiens
acaaaccagcttaagcaagatg

SEQ ID NO: 8270744 - DNA, 22 bp, Homo sapiens
aattttcacagtgctgtgagat

SEQ ID NO: 8270745 - DNA, 18 bp, Homo sapiens
agcaagcagttttcatgt

SEQ ID NO: 8270746 - DNA, 22 bp, Homo sapiens
agcaccgttcaaacccaggtta

SEQ ID NO: 8270747 - DNA, 22 bp, Homo sapiens
agcaccgtcatagccaggtaag

SEQ ID NO: 8270748 - DNA, 22 bp, Homo sapiens
agccatgtcacatatggtcatc

SEQ ID NO: 8270749 - DNA, 22 bp, Homo sapiens
agcccaaacctgcgagcagagc

SEQ ID NO: 8270750 - DNA, 23 bp, Homo sapiens
aacagccacactgctgagattca

SEQ ID NO: 8270751 - DNA, 22 bp, Homo sapiens
aacatgaaaagcccagagaggt

SEQ ID NO: 8270752 - DNA, 22 bp, Homo sapiens
aagaggaactgggggctgagtc

SEQ ID NO: 8270753 - DNA, 21 bp, Homo sapiens
aagaaagataattaaggaccc

SEQ ID NO: 8270754 - DNA, 22 bp, Homo sapiens
aagcagcattcagtgaaatgtg

SEQ ID NO: 8270755 - DNA, 20 bp, Homo sapiens
acagagtagaacatatgcca

SEQ ID NO: 8270756 - DNA, 22 bp, Homo sapiens
acacaggttccatctccacctt

SEQ ID NO: 8270757 - DNA, 22 bp, Homo sapiens
aaagccacagttctatgtctgc

SEQ ID NO: 8270758 - DNA, 22 bp, Homo sapiens
aaacacaggtactgcagaagtg

SEQ ID NO: 8270759 - DNA, 22 bp, Homo sapiens
aaaggtggagttgtgcccattt

SEQ ID NO: 8270760 - DNA, 18 bp, Homo sapiens
atttctctggggtgattc

SEQ ID NO: 8270761 - DNA, 22 bp, Homo sapiens
atttctctgcctcagcttctgc

SEQ ID NO: 8270762 - DNA, 22 bp, Homo sapiens
atttctctgcagtgttcggaat

SEQ ID NO: 8270763 - DNA, 22 bp, Homo sapiens
atgggtggaggagaaaggcatc

SEQ ID NO: 8270764 - DNA, 22 bp, Homo sapiens
atgggtggagggtgacacggat

SEQ ID NO: 8270765 - DNA, 22 bp, Homo sapiens
agaccactaaaactttctctat

SEQ ID NO: 8270766 - DNA, 22 bp, Homo sapiens
agagaaggaaagctgacatggg

SEQ ID NO: 8270767 - DNA, 22 bp, Homo sapiens
agagaagagtcttgtcaaatta

SEQ ID NO: 8270768 - DNA, 22 bp, Homo sapiens
agaagtttgaaattaggagaaa

SEQ ID NO: 8270769 - DNA, 22 bp, Homo sapiens
agacagccaatgctggaagatg

SEQ ID NO: 8270770 - DNA, 23 bp, Homo sapiens
agccacttctatcttgctcctgg

SEQ ID NO: 8270771 - DNA, 22 bp, Homo sapiens
cagaataccctatagacagaat

SEQ ID NO: 8270772 - DNA, 22 bp, Homo sapiens
agcacattaagtgagttcatgt

SEQ ID NO: 8270773 - DNA, 22 bp, Homo sapiens
agcacattcttgccttaacctc

SEQ ID NO: 8270774 - DNA, 22 bp, Homo sapiens
agcacatttaagtatgaaatat

SEQ ID NO: 8270775 - DNA, 22 bp, Homo sapiens
agcacattttctcaaagctcat

SEQ ID NO: 8270776 - DNA, 22 bp, Homo sapiens
agcagccacacgcctccttctc

SEQ ID NO: 8270777 - DNA, 22 bp, Homo sapiens
caagagcctttgggcagaagga

SEQ ID NO: 8270778 - DNA, 22 bp, Homo sapiens
aggaagaacctaagaaagtctc

SEQ ID NO: 8270779 - DNA, 22 bp, Homo sapiens
aggtggcatgcctgagacataa

SEQ ID NO: 8270780 - DNA, 22 bp, Homo sapiens
aggtggcatttacaccatggga

SEQ ID NO: 8270781 - DNA, 22 bp, Homo sapiens
actgctttatctgagaagtcct

SEQ ID NO: 8270782 - DNA, 22 bp, Homo sapiens
actttctcaaatcagactttaa

SEQ ID NO: 8270783 - DNA, 22 bp, Homo sapiens
atatttataagcaagcaggact

SEQ ID NO: 8270784 - DNA, 22 bp, Homo sapiens
atattccattggtttcccttct

SEQ ID NO: 8270785 - DNA, 22 bp, Homo sapiens
atattccagttatatcaaatca

SEQ ID NO: 8270786 - DNA, 22 bp, Homo sapiens
agaaagggctattttgaggtag

SEQ ID NO: 8270787 - DNA, 22 bp, Homo sapiens
agaaagggttctctgaggtgct

SEQ ID NO: 8270788 - DNA, 22 bp, Homo sapiens
atacagcagtgaataagataaa

SEQ ID NO: 8270789 - DNA, 22 bp, Homo sapiens
agtttctctagagtctttgaaa

SEQ ID NO: 8270790 - DNA, 22 bp, Homo sapiens
agtttctagcaaggattgttga

SEQ ID NO: 8270791 - DNA, 22 bp, Homo sapiens
cttcagatccctctgccactgt

SEQ ID NO: 8270792 - DNA, 22 bp, Homo sapiens
cttcagatattaatatcaatta

SEQ ID NO: 8270793 - DNA, 22 bp, Homo sapiens
ctggggaggcagggctgcccct

SEQ ID NO: 8270794 - DNA, 22 bp, Homo sapiens
ctggtggggagtcctggtctcc

SEQ ID NO: 8270795 - DNA, 22 bp, Homo sapiens
ctggtggcaatgaggcgtcact

SEQ ID NO: 8270796 - DNA, 22 bp, Homo sapiens
ctggggcagagcctttagcaaa

SEQ ID NO: 8270797 - DNA, 22 bp, Homo sapiens
aggtggggttcagtctcagccg

SEQ ID NO: 8270798 - DNA, 22 bp, Homo sapiens
agtctctccacattgttataaa

SEQ ID NO: 8270799 - DNA, 22 bp, Homo sapiens
ctctgagaatatgagctctttg

SEQ ID NO: 8270800 - DNA, 22 bp, Homo sapiens
caggtgggagcgaggagctact

SEQ ID NO: 8270801 - DNA, 22 bp, Homo sapiens
caggtgggagcggagactgatt

SEQ ID NO: 8270802 - DNA, 22 bp, Homo sapiens
caggtgggaccatgatagggca

SEQ ID NO: 8270803 - DNA, 22 bp, Homo sapiens
caggtgggagccacagcgtaca

SEQ ID NO: 8270804 - DNA, 22 bp, Homo sapiens
cagtttctctcaataagcatcg

SEQ ID NO: 8270805 - DNA, 22 bp, Homo sapiens
cagtttctccaaacgcaggctg

SEQ ID NO: 8270806 - DNA, 22 bp, Homo sapiens
cagtttctcaggcctctcccag

SEQ ID NO: 8270807 - DNA, 22 bp, Homo sapiens
cagtttctacgacttaagcaca

SEQ ID NO: 8270808 - DNA, 22 bp, Homo sapiens
cagtttctcagacttcccttgt

SEQ ID NO: 8270809 - DNA, 22 bp, Homo sapiens
cagtttctatggctgggctctg

SEQ ID NO: 8270810 - DNA, 22 bp, Homo sapiens
cagtttctacgaaggtcaaccc

SEQ ID NO: 8270811 - DNA, 22 bp, Homo sapiens
caggaggagggtacaccatcag

SEQ ID NO: 8270812 - DNA, 22 bp, Homo sapiens
aggctccaaattaccaagctct

SEQ ID NO: 8270813 - DNA, 22 bp, Homo sapiens
aggctccaagaggttaagtcac

SEQ ID NO: 8270814 - DNA, 23 bp, Homo sapiens
aggctccacatgggcactttgca

SEQ ID NO: 8270815 - DNA, 16 bp, Homo sapiens
aggctccaagagctgt

SEQ ID NO: 8270816 - DNA, 22 bp, Homo sapiens
aggctccaccctacagagctcc

SEQ ID NO: 8270817 - DNA, 22 bp, Homo sapiens
aggctccaccccgccagacctt

SEQ ID NO: 8270818 - DNA, 22 bp, Homo sapiens
aggctccaccagtcaggtgcat

SEQ ID NO: 8270819 - DNA, 21 bp, Homo sapiens
ccctttctccatacttcatcc

SEQ ID NO: 8270820 - DNA, 22 bp, Homo sapiens
ccctttcttccgtgacttctgc

SEQ ID NO: 8270821 - DNA, 22 bp, Homo sapiens
attttccatctccacaccaggg

SEQ ID NO: 8270822 - DNA, 22 bp, Homo sapiens
attctgctgcacaccttccccc

SEQ ID NO: 8270823 - DNA, 22 bp, Homo sapiens
attctgctagtaacagatgaag

SEQ ID NO: 8270824 - DNA, 22 bp, Homo sapiens
gcagcttagaaaaatgaaattg

SEQ ID NO: 8270825 - DNA, 22 bp, Homo sapiens
attcatgcaggattgtctccaa

SEQ ID NO: 8270826 - DNA, 22 bp, Homo sapiens
ctttttcattggctttaggaca

SEQ ID NO: 8270827 - DNA, 19 bp, Homo sapiens
ctttttcaccttctagaag

SEQ ID NO: 8270828 - DNA, 22 bp, Homo sapiens
ctttttatctcttaatgatgtt

SEQ ID NO: 8270829 - DNA, 22 bp, Homo sapiens
atgctcttgaggctaaagacat

SEQ ID NO: 8270830 - DNA, 21 bp, Homo sapiens
gagacagcccagtgccagggc

SEQ ID NO: 8270831 - DNA, 22 bp, Homo sapiens
atgctgtgcctggaaagcggct

SEQ ID NO: 8270832 - DNA, 22 bp, Homo sapiens
atgctgtgaaaaagaaggctga

SEQ ID NO: 8270833 - DNA, 22 bp, Homo sapiens
gagctgcagacttgatacagga

SEQ ID NO: 8270834 - DNA, 22 bp, Homo sapiens
gagctgcagacatagataagcg

SEQ ID NO: 8270835 - DNA, 22 bp, Homo sapiens
gtgagattccttagattcatgg

SEQ ID NO: 8270836 - DNA, 22 bp, Homo sapiens
gtgagagtggtttatgtccatg

SEQ ID NO: 8270837 - DNA, 22 bp, Homo sapiens
caagcccagatcctgcgtgtct

SEQ ID NO: 8270838 - DNA, 22 bp, Homo sapiens
caagcccactgctcagagccaa

SEQ ID NO: 8270839 - DNA, 22 bp, Homo sapiens
caattcccagctgccgggctgc

SEQ ID NO: 8270840 - DNA, 23 bp, Homo sapiens
cacttcccctgtggcgagcctgc

SEQ ID NO: 8270841 - DNA, 22 bp, Homo sapiens
cacttgagttcttaatagtcag

SEQ ID NO: 8270842 - DNA, 22 bp, Homo sapiens
cacatgtgtatatgtgaggggg

SEQ ID NO: 8270843 - DNA, 22 bp, Homo sapiens
tatttccaaaaaggccatattc

SEQ ID NO: 8270844 - DNA, 22 bp, Homo sapiens
tatttccaagctgaatccaatg

SEQ ID NO: 8270845 - DNA, 22 bp, Homo sapiens
tatttccaaaagcctattatga

SEQ ID NO: 8270846 - DNA, 22 bp, Homo sapiens
tcagcagagctcaggctccagc

SEQ ID NO: 8270847 - DNA, 22 bp, Homo sapiens
gtgagggcagaacccccaggcc

SEQ ID NO: 8270848 - DNA, 17 bp, Homo sapiens
gtgagggcagaggatgg

SEQ ID NO: 8270849 - DNA, 22 bp, Homo sapiens
taggaaattaagtctcttttgt

SEQ ID NO: 8270850 - DNA, 22 bp, Homo sapiens
taggaaattgacacctgcttga

SEQ ID NO: 8270851 - DNA, 22 bp, Homo sapiens
taggaaattggaaactcttcac

SEQ ID NO: 8270852 - DNA, 22 bp, Homo sapiens
catcttttggcctattctgagg

SEQ ID NO: 8270853 - DNA, 22 bp, Homo sapiens
cattgagaatctgggctacagc

SEQ ID NO: 8270854 - DNA, 22 bp, Homo sapiens
tctccacaagtgttgagagtac

SEQ ID NO: 8270855 - DNA, 22 bp, Homo sapiens
tctcccttggtcacagattcct

SEQ ID NO: 8270856 - DNA, 21 bp, Homo sapiens
ccagagagagggaagtgggtt

SEQ ID NO: 8270857 - DNA, 22 bp, Homo sapiens
tcgggctcgctctcctagcgga

SEQ ID NO: 8270858 - DNA, 22 bp, Homo sapiens
tgaacagctatcttgtcagtgt

SEQ ID NO: 8270859 - DNA, 22 bp, Homo sapiens
tgagagttattctgaatttagc

SEQ ID NO: 8270860 - DNA, 22 bp, Homo sapiens
tgagcacctactgtattccagg

SEQ ID NO: 8270861 - DNA, 22 bp, Homo sapiens
tgagcaccgccgcatttccaag

SEQ ID NO: 8270862 - DNA, 22 bp, Homo sapiens
tgagagttttgacgcttgtaac

SEQ ID NO: 8270863 - DNA, 22 bp, Homo sapiens
tgaggaagttgtttctcttcta

SEQ ID NO: 8270864 - DNA, 22 bp, Homo sapiens
cccaggagtaagtgacattgtt

SEQ ID NO: 8270865 - DNA, 22 bp, Homo sapiens
cccaggagacagaaacagaggt

SEQ ID NO: 8270866 - DNA, 22 bp, Homo sapiens
tggaagacatactgttttctta

SEQ ID NO: 8270867 - DNA, 22 bp, Homo sapiens
ccctagaaatgaaagcatacgt

SEQ ID NO: 8270868 - DNA, 19 bp, Homo sapiens
ccctagagtaagactgcat

SEQ ID NO: 8270869 - DNA, 22 bp, Homo sapiens
cctaaagaattttcatagagct

SEQ ID NO: 8270870 - DNA, 20 bp, Homo sapiens
tggggtcctggaggggatcc

SEQ ID NO: 8270871 - DNA, 22 bp, Homo sapiens
cctgagggctcagcccccagcc

SEQ ID NO: 8270872 - DNA, 22 bp, Homo sapiens
cctcttgagtgtctgttttcca

SEQ ID NO: 8270873 - DNA, 22 bp, Homo sapiens
cctcttgagttctttaaaagct

SEQ ID NO: 8270874 - DNA, 21 bp, Homo sapiens
cctcttgatttttagctctgg

SEQ ID NO: 8270875 - DNA, 22 bp, Homo sapiens
cctcttgatttggctgtgaagt

SEQ ID NO: 8270876 - DNA, 22 bp, Homo sapiens
cctcttgattggttggaagcgg

SEQ ID NO: 8270877 - DNA, 22 bp, Homo sapiens
cctcttgaacctaggcaagact

SEQ ID NO: 8270878 - DNA, 22 bp, Homo sapiens
cctcttgaagagaagagttact

SEQ ID NO: 8270879 - DNA, 22 bp, Homo sapiens
cctcttgaatgccaggaaggac

SEQ ID NO: 8270880 - DNA, 22 bp, Homo sapiens
cctcttgagaggcactcaggtt

SEQ ID NO: 8270881 - DNA, 22 bp, Homo sapiens
cctcttgaggccgggccggatc

SEQ ID NO: 8270882 - DNA, 22 bp, Homo sapiens
cctcttgacagcctctgtttcc

SEQ ID NO: 8270883 - DNA, 22 bp, Homo sapiens
cctcttgactctaaatcccgcg

SEQ ID NO: 8270884 - DNA, 22 bp, Homo sapiens
tttctcaaaagacagaagtgaa

SEQ ID NO: 8270885 - DNA, 22 bp, Homo sapiens
ttttctcttccctctggacctg

SEQ ID NO: 8270886 - DNA, 22 bp, Homo sapiens
cgtggggcgggtggacacttgc

SEQ ID NO: 8270887 - DNA, 22 bp, Homo sapiens
ccttgagaggaagtttgtagaa

SEQ ID NO: 8270888 - DNA, 22 bp, Homo sapiens
ccttgagatgagctaatttttt

SEQ ID NO: 8270889 - DNA, 22 bp, Homo sapiens
ttagcaccacacactttagagg

SEQ ID NO: 8270890 - DNA, 22 bp, Homo sapiens
ttagcaccagctatggatgtgc

SEQ ID NO: 8270891 - DNA, 22 bp, Homo sapiens
ttagcacccgggccagcggctg

SEQ ID NO: 8270892 - DNA, 22 bp, Homo sapiens
ttagcaccttgaacagaccctg

SEQ ID NO: 8270893 - DNA, 22 bp, Homo sapiens
ttagcaccttaactgtggagat

SEQ ID NO: 8270894 - DNA, 18 bp, Homo sapiens
ttagcacctatgtgggta

SEQ ID NO: 8270895 - DNA, 22 bp, Homo sapiens
ttagcacctcattcccaccttc

SEQ ID NO: 8270896 - DNA, 22 bp, Homo sapiens
ttagcaccctgatactagaatg

SEQ ID NO: 8270897 - DNA, 22 bp, Homo sapiens
cttcttcatgtattgatagtct

SEQ ID NO: 8270898 - DNA, 22 bp, Homo sapiens
cttggaaggctggttctccctc

SEQ ID NO: 8270899 - DNA, 22 bp, Homo sapiens
ctttctctgtgtttcacatgct

SEQ ID NO: 8270900 - DNA, 20 bp, Homo sapiens
ctttctctaatttataagta

SEQ ID NO: 8270901 - DNA, 19 bp, Homo sapiens
cttcacatctgtgagggga

SEQ ID NO: 8270902 - DNA, 22 bp, Homo sapiens
cttcttcaagagaatgggagac

SEQ ID NO: 8270903 - DNA, 22 bp, Homo sapiens
gaaagagaacctgggcctagat

SEQ ID NO: 8270904 - DNA, 22 bp, Homo sapiens
gaaagacatagttgcaagatgg

SEQ ID NO: 8270905 - DNA, 20 bp, Homo sapiens
ctttttctccagctctgagc

SEQ ID NO: 8270906 - DNA, 22 bp, Homo sapiens
ctgggttcttggcacagcagga

SEQ ID NO: 8270907 - DNA, 22 bp, Homo sapiens
ctggtgttgtccgggtgagagt

SEQ ID NO: 8270908 - DNA, 22 bp, Homo sapiens
ctggtgtttattacaggtgctc

SEQ ID NO: 8270909 - DNA, 22 bp, Homo sapiens
ctgtgagaaaggtgatggaggt

SEQ ID NO: 8270910 - DNA, 22 bp, Homo sapiens
ctgtgagacctgatttcttcat

SEQ ID NO: 8270911 - DNA, 22 bp, Homo sapiens
ctgtgagaaataaatgtttgct

SEQ ID NO: 8270912 - DNA, 22 bp, Homo sapiens
ctgtgagaagaatcccacctga

SEQ ID NO: 8270913 - DNA, 22 bp, Homo sapiens
ctgtgagatatgcatatgctct

SEQ ID NO: 8270914 - DNA, 22 bp, Homo sapiens
ctgtgagagtggtggcctaggc

SEQ ID NO: 8270915 - DNA, 22 bp, Homo sapiens
ctgtgagactgatagggaagag

SEQ ID NO: 8270916 - DNA, 22 bp, Homo sapiens
ctgtgagatgaccaactgactg

SEQ ID NO: 8270917 - DNA, 22 bp, Homo sapiens
ctgtgagatgtttctggttaga

SEQ ID NO: 8270918 - DNA, 22 bp, Homo sapiens
ctgtgagatttttaaataactt

SEQ ID NO: 8270919 - DNA, 22 bp, Homo sapiens
ctgtgaaatgctttgcgatggt

SEQ ID NO: 8270920 - DNA, 22 bp, Homo sapiens
gagggaagattccccatatggg

SEQ ID NO: 8270921 - DNA, 22 bp, Homo sapiens
gagggaaggtcacccttgtagc

SEQ ID NO: 8270922 - DNA, 22 bp, Homo sapiens
gaggtggcttagtctctggaca

SEQ ID NO: 8270923 - DNA, 22 bp, Homo sapiens
gagaagccgagtcagctgagcc

SEQ ID NO: 8270924 - DNA, 22 bp, Homo sapiens
gagagaagaacaatgtcattca

SEQ ID NO: 8270925 - DNA, 22 bp, Homo sapiens
gagagaagggggatatgagcct

SEQ ID NO: 8270926 - DNA, 22 bp, Homo sapiens
gagagctgtcagcgtagcaccg

SEQ ID NO: 8270927 - DNA, 22 bp, Homo sapiens
gacagcctcatgtgcatgaact

SEQ ID NO: 8270928 - DNA, 22 bp, Homo sapiens
gaagaatattcttgatcttaga

SEQ ID NO: 8270929 - DNA, 22 bp, Homo sapiens
tattgtccaataggatgttcct

SEQ ID NO: 8270930 - DNA, 22 bp, Homo sapiens
tatcagcgtgcaaatctttgga

SEQ ID NO: 8270931 - DNA, 22 bp, Homo sapiens
tatgaaatggtagtaggaaggg

SEQ ID NO: 8270932 - DNA, 22 bp, Homo sapiens
tatgaaattgccatttttatgg

SEQ ID NO: 8270933 - DNA, 22 bp, Homo sapiens
tatgaaatgatggggaaaatag

SEQ ID NO: 8270934 - DNA, 22 bp, Homo sapiens
tatgaaatttctagttctgctt

SEQ ID NO: 8270935 - DNA, 22 bp, Homo sapiens
tatgaaatttaaacacagatca

SEQ ID NO: 8270936 - DNA, 22 bp, Homo sapiens
tagtttctaaagcttcctaggt

SEQ ID NO: 8270937 - DNA, 22 bp, Homo sapiens
tagtttctaaactgaactgtca

SEQ ID NO: 8270938 - DNA, 18 bp, Homo sapiens
tagtttctaatggccttt

SEQ ID NO: 8270939 - DNA, 21 bp, Homo sapiens
tagtttctacccagttaatgg

SEQ ID NO: 8270940 - DNA, 19 bp, Homo sapiens
taccatccaagctggtttg

SEQ ID NO: 8270941 - DNA, 22 bp, Homo sapiens
tacagaatctatgcttcacagt

SEQ ID NO: 8270942 - DNA, 22 bp, Homo sapiens
gtgtttatacagcaaagagcat

SEQ ID NO: 8270943 - DNA, 22 bp, Homo sapiens
gtgtttattttcatagttggcc

SEQ ID NO: 8270944 - DNA, 22 bp, Homo sapiens
gtgtttatgagtgaccttgtct

SEQ ID NO: 8270945 - DNA, 22 bp, Homo sapiens
gtgtttataggagtgaatgctg

SEQ ID NO: 8270946 - DNA, 22 bp, Homo sapiens
gtgtttatttagagtaggccat

SEQ ID NO: 8270947 - DNA, 22 bp, Homo sapiens
gtgtttatgtttgtgtagggga

SEQ ID NO: 8270948 - DNA, 17 bp, Homo sapiens
gtgctggcctggggctc

SEQ ID NO: 8270949 - DNA, 22 bp, Homo sapiens
gttatgtactttttaaatcttg

SEQ ID NO: 8270950 - DNA, 22 bp, Homo sapiens
taacagccctccctccatcctg

SEQ ID NO: 8270951 - DNA, 19 bp, Homo sapiens
taagacagattcctagagt

SEQ ID NO: 8270952 - DNA, 22 bp, Homo sapiens
tccaaagaggttaagaacgaga

SEQ ID NO: 8270953 - DNA, 22 bp, Homo sapiens
tcagccaagcgtaggatattgg

SEQ ID NO: 8270954 - DNA, 22 bp, Homo sapiens
tcagaaagaacacaggcagtag

SEQ ID NO: 8270955 - DNA, 22 bp, Homo sapiens
tcagaaagcttttacttaaaca

SEQ ID NO: 8270956 - DNA, 22 bp, Homo sapiens
tcctagagagtaatacagtttt

SEQ ID NO: 8270957 - DNA, 22 bp, Homo sapiens
gccagctggtaggcacctagcc

SEQ ID NO: 8270958 - DNA, 22 bp, Homo sapiens
gcagacaggcccagtggaggga

SEQ ID NO: 8270959 - DNA, 19 bp, Homo sapiens
gctaggtgaccagctggat

SEQ ID NO: 8270960 - DNA, 20 bp, Homo sapiens
gctcccagcctgcagtcccc

SEQ ID NO: 8270961 - DNA, 22 bp, Homo sapiens
ggagaagaggagctggaagcct

SEQ ID NO: 8270962 - DNA, 18 bp, Homo sapiens
gctttttagtgcatcttc

SEQ ID NO: 8270963 - DNA, 22 bp, Homo sapiens
gcttttgtcattcaaatgctct

SEQ ID NO: 8270964 - DNA, 22 bp, Homo sapiens
gcttggagaagatgttctcaat

SEQ ID NO: 8270965 - DNA, 22 bp, Homo sapiens
gtcttgatctcctgaccttgtg

SEQ ID NO: 8270966 - DNA, 22 bp, Homo sapiens
gtctatgtgtaatagcatgtgt

SEQ ID NO: 8270967 - DNA, 22 bp, Homo sapiens
gtagtcccagctaccccggagg

SEQ ID NO: 8270968 - DNA, 22 bp, Homo sapiens
gggcttctctttagtgagctga

SEQ ID NO: 8270969 - DNA, 22 bp, Homo sapiens
gggcttctattcaagtctgttt

SEQ ID NO: 8270970 - DNA, 21 bp, Homo sapiens
gggtgggtggaattaggagtg

SEQ ID NO: 8270971 - DNA, 21 bp, Homo sapiens
gggtggggttccagccttttc

SEQ ID NO: 8270972 - DNA, 23 bp, Homo sapiens
ggtggtgctcatatctcaggcct

SEQ ID NO: 8270973 - DNA, 19 bp, Homo sapiens
ggttaatgttaggatactt

SEQ ID NO: 8270974 - DNA, 21 bp, Homo sapiens
ggttggtgtgtccagtggcca

SEQ ID NO: 8270975 - DNA, 22 bp, Homo sapiens
ggtggggattcctgatcactgt

SEQ ID NO: 8270976 - DNA, 22 bp, Homo sapiens
ggtggggccagggctccaacct

SEQ ID NO: 8270977 - DNA, 22 bp, Homo sapiens
ggtggggcccaggcatctgatg

SEQ ID NO: 8270978 - DNA, 22 bp, Homo sapiens
ggtggggccctggcactggtat

SEQ ID NO: 8270979 - DNA, 22 bp, Homo sapiens
ggtggggctaggacctcaggat

SEQ ID NO: 8270980 - DNA, 22 bp, Homo sapiens
ggtggggcctgctccagcggcc

SEQ ID NO: 8270981 - DNA, 23 bp, Homo sapiens
gggagccatgggtggtcatggag

SEQ ID NO: 8270982 - DNA, 22 bp, Homo sapiens
gggaagagtgtcggttgaagtg

SEQ ID NO: 8270983 - DNA, 22 bp, Homo sapiens
ggcagcagaactggccctgtat

SEQ ID NO: 8270984 - DNA, 22 bp, Homo sapiens
tttgaatggactgagaatcttg

SEQ ID NO: 8270985 - DNA, 22 bp, Homo sapiens
tttgaatgtgtgagttaacttt

SEQ ID NO: 8270986 - DNA, 22 bp, Homo sapiens
ttccttgaaagctggacatggg

SEQ ID NO: 8270987 - DNA, 22 bp, Homo sapiens
ttccttgagaaaggcacaagtt

SEQ ID NO: 8270988 - DNA, 22 bp, Homo sapiens
ttccttgaccactgcataatga

SEQ ID NO: 8270989 - DNA, 18 bp, Homo sapiens
ttccttgattagagagaa

SEQ ID NO: 8270990 - DNA, 22 bp, Homo sapiens
ttccttgattagtacatgaagg

SEQ ID NO: 8270991 - DNA, 18 bp, Homo sapiens
ttccttgattagagagaa

SEQ ID NO: 8270992 - DNA, 23 bp, Homo sapiens
ttctctagatgaggtgaagatgg

SEQ ID NO: 8270993 - DNA, 22 bp, Homo sapiens
ttgaaatgaaatatttaagctc

SEQ ID NO: 8270994 - DNA, 22 bp, Homo sapiens
ttgaaatgcagattccaatcca

SEQ ID NO: 8270995 - DNA, 22 bp, Homo sapiens
ttgaaatgagcaaactgtcagc

SEQ ID NO: 8270996 - DNA, 22 bp, Homo sapiens
ttgaaatgagactaattgattg

SEQ ID NO: 8270997 - DNA, 22 bp, Homo sapiens
ttgaaatggcagcagctgacct

SEQ ID NO: 8270998 - DNA, 22 bp, Homo sapiens
ttgaaatgtagtcctgccttca

SEQ ID NO: 8270999 - DNA, 19 bp, Homo sapiens
ttcacagctctgtgtcagt

SEQ ID NO: 8271000 - DNA, 22 bp, Homo sapiens
ttgacagagctaggtcaactct

SEQ ID NO: 8271001 - DNA, 22 bp, Homo sapiens
ttgctctatgtttgtaaacaga

SEQ ID NO: 8271002 - DNA, 22 bp, Homo sapiens
tttcatgcctggaattgccctt

SEQ ID NO: 8271003 - DNA, 22 bp, Homo sapiens
tttagcactgaaagtccaggaa

SEQ ID NO: 8271004 - DNA, 16 bp, Homo sapiens
tttagcactggcatac

SEQ ID NO: 8271005 - DNA, 22 bp, Homo sapiens
tttagcacggtaacacataaag

SEQ ID NO: 8271006 - DNA, 23 bp, Homo sapiens
tttagcacgtcgcccagggaggc

SEQ ID NO: 8271007 - DNA, 22 bp, Homo sapiens
tttagcactaatcagctgtggc

SEQ ID NO: 8271008 - DNA, 20 bp, Homo sapiens
tttagcacattgtacaaaac

SEQ ID NO: 8271009 - DNA, 22 bp, Homo sapiens
tttagcaccttcactttctctg

SEQ ID NO: 8271010 - DNA, 22 bp, Homo sapiens
tttagcacagaactccactcac

SEQ ID NO: 8271011 - DNA, 22 bp, Homo sapiens
tttaccaaggcatagtaatctc

SEQ ID NO: 8271012 - DNA, 23 bp, Homo sapiens
acagacattgtacatcttgtttt

SEQ ID NO: 8271013 - DNA, 22 bp, Homo sapiens
acacagccccacggtgagcaaa

SEQ ID NO: 8271014 - DNA, 22 bp, Homo sapiens
aatgaaatagttggctgtagag

SEQ ID NO: 8271015 - DNA, 22 bp, Homo sapiens
aatgaaatctgctgggtaaaga

SEQ ID NO: 8271016 - DNA, 18 bp, Homo sapiens
aatgaaatgtacaccttt

SEQ ID NO: 8271017 - DNA, 22 bp, Homo sapiens
aatgaaatgaagatatgatcag

SEQ ID NO: 8271018 - DNA, 22 bp, Homo sapiens
aatgaaatgtagcttatccata

SEQ ID NO: 8271019 - DNA, 22 bp, Homo sapiens
aatgtaaacagcaagagaaggg

SEQ ID NO: 8271020 - DNA, 22 bp, Homo sapiens
aatgctgtccaataggaacata

SEQ ID NO: 8271021 - DNA, 22 bp, Homo sapiens
aagtcttaggcattttatttct

SEQ ID NO: 8271022 - DNA, 22 bp, Homo sapiens
aacatgaagttttctatagtga

SEQ ID NO: 8271023 - DNA, 22 bp, Homo sapiens
aaagggaactctaattatcttc

SEQ ID NO: 8271024 - DNA, 22 bp, Homo sapiens
aacatgaaagttgctaagtgca

SEQ ID NO: 8271025 - DNA, 22 bp, Homo sapiens
aaagacatcagaaccagctgag

SEQ ID NO: 8271026 - DNA, 22 bp, Homo sapiens
aaatgtctgtatgagaaagaga

SEQ ID NO: 8271027 - DNA, 22 bp, Homo sapiens
aaagtcatccaaatttttatgt

SEQ ID NO: 8271028 - DNA, 22 bp, Homo sapiens
aaagtcattgctgttatcaatg

SEQ ID NO: 8271029 - DNA, 22 bp, Homo sapiens
aaagttttctgccttcattaga

SEQ ID NO: 8271030 - DNA, 22 bp, Homo sapiens
aaagtcatcatttcttttcaaa

SEQ ID NO: 8271031 - DNA, 22 bp, Homo sapiens
agagaaattctcagtggaagat

SEQ ID NO: 8271032 - DNA, 22 bp, Homo sapiens
aatgccttggagagcctagagg

SEQ ID NO: 8271033 - DNA, 22 bp, Homo sapiens
aatgcctttccactgggtatca

SEQ ID NO: 8271034 - DNA, 18 bp, Homo sapiens
aatttccatatgaattgc

SEQ ID NO: 8271035 - DNA, 21 bp, Homo sapiens
agaggaagtgattggtctggc

SEQ ID NO: 8271036 - DNA, 22 bp, Homo sapiens
acaccatactcatgttggttcc

SEQ ID NO: 8271037 - DNA, 22 bp, Homo sapiens
acaccagtttcttaagaatatt

SEQ ID NO: 8271038 - DNA, 20 bp, Homo sapiens
agcggcagcttcctgcttcg

SEQ ID NO: 8271039 - DNA, 19 bp, Homo sapiens
actcttttccttttgaatc

SEQ ID NO: 8271040 - DNA, 19 bp, Homo sapiens
actgcagggaggaggtgtg

SEQ ID NO: 8271041 - DNA, 22 bp, Homo sapiens
actcttgattgatttagtcttt

SEQ ID NO: 8271042 - DNA, 20 bp, Homo sapiens
actcttgagaaattctctgt

SEQ ID NO: 8271043 - DNA, 22 bp, Homo sapiens
actcttgactccatggtgttag

SEQ ID NO: 8271044 - DNA, 22 bp, Homo sapiens
actcttgaactgattaagaatg

SEQ ID NO: 8271045 - DNA, 22 bp, Homo sapiens
actcttgaaaatagatccacat

SEQ ID NO: 8271046 - DNA, 22 bp, Homo sapiens
actcttgaaggtggtgggagtg

SEQ ID NO: 8271047 - DNA, 22 bp, Homo sapiens
actcttgacgggtgaggatatg

SEQ ID NO: 8271048 - DNA, 22 bp, Homo sapiens
agaaagggatgaggtagctgct

SEQ ID NO: 8271049 - DNA, 22 bp, Homo sapiens
agaaaggacatctccctttaag

SEQ ID NO: 8271050 - DNA, 22 bp, Homo sapiens
agaaactgaacacaagagtcgg

SEQ ID NO: 8271051 - DNA, 22 bp, Homo sapiens
agaaggaaaacctgtcttatgt

SEQ ID NO: 8271052 - DNA, 22 bp, Homo sapiens
agaaggaaggctgagtgctgat

SEQ ID NO: 8271053 - DNA, 22 bp, Homo sapiens
agaaggaaggaagcattctgtt

SEQ ID NO: 8271054 - DNA, 22 bp, Homo sapiens
agaaggaagccaggagggtgca

SEQ ID NO: 8271055 - DNA, 22 bp, Homo sapiens
aatgccttcaagtatctgagga

SEQ ID NO: 8271056 - DNA, 22 bp, Homo sapiens
aaggggaaaaagtgttaggagt

SEQ ID NO: 8271057 - DNA, 18 bp, Homo sapiens
aagtccttcctttgcttt

SEQ ID NO: 8271058 - DNA, 22 bp, Homo sapiens
aagtccttctttatatgagagt

SEQ ID NO: 8271059 - DNA, 22 bp, Homo sapiens
aagtccttgaagaaacagttct

SEQ ID NO: 8271060 - DNA, 22 bp, Homo sapiens
aaggtggttgtaggctggtctg

SEQ ID NO: 8271061 - DNA, 22 bp, Homo sapiens
aaggtggtgcttctgctcctct

SEQ ID NO: 8271062 - DNA, 22 bp, Homo sapiens
agatgtttataactcatgagtg

SEQ ID NO: 8271063 - DNA, 23 bp, Homo sapiens
agagctttctaaaatgtaaatct

SEQ ID NO: 8271064 - DNA, 22 bp, Homo sapiens
attcttctgcctactttcatcc

SEQ ID NO: 8271065 - DNA, 22 bp, Homo sapiens
attgagaagaaaatctaatata

SEQ ID NO: 8271066 - DNA, 22 bp, Homo sapiens
attgagaatgcaatctactatg

SEQ ID NO: 8271067 - DNA, 22 bp, Homo sapiens
atgccatttcaaaataagattt

SEQ ID NO: 8271068 - DNA, 23 bp, Homo sapiens
agacagtggccgagaggtactag

SEQ ID NO: 8271069 - DNA, 20 bp, Homo sapiens
agacagtggggagctcctag

SEQ ID NO: 8271070 - DNA, 20 bp, Homo sapiens
agacagtgtggagattcctt

SEQ ID NO: 8271071 - DNA, 22 bp, Homo sapiens
cagaaagacctgattggcagtt

SEQ ID NO: 8271072 - DNA, 22 bp, Homo sapiens
agcagacaggctgccacagtgc

SEQ ID NO: 8271073 - DNA, 21 bp, Homo sapiens
agcagacagatgcacgcacac

SEQ ID NO: 8271074 - DNA, 22 bp, Homo sapiens
cagcactgctgctgtacacaca

SEQ ID NO: 8271075 - DNA, 22 bp, Homo sapiens
cagagcagtagaaaacagcctt

SEQ ID NO: 8271076 - DNA, 22 bp, Homo sapiens
cagcctttgggtcagaagattc

SEQ ID NO: 8271077 - DNA, 22 bp, Homo sapiens
agaagcagttattttttgcaca

SEQ ID NO: 8271078 - DNA, 22 bp, Homo sapiens
agaaatgcagtttcaagacaaa

SEQ ID NO: 8271079 - DNA, 22 bp, Homo sapiens
atagttcctactttgcactaat

SEQ ID NO: 8271080 - DNA, 22 bp, Homo sapiens
agtcctgggtgtgcaaggcaga

SEQ ID NO: 8271081 - DNA, 22 bp, Homo sapiens
aggtgggttcccgactctggct

SEQ ID NO: 8271082 - DNA, 22 bp, Homo sapiens
aggtgccagcagggttgatgac

SEQ ID NO: 8271083 - DNA, 22 bp, Homo sapiens
agttacaaacactatcagttct

SEQ ID NO: 8271084 - DNA, 23 bp, Homo sapiens
agttaatgtgcatgaagtgctgc

SEQ ID NO: 8271085 - DNA, 22 bp, Homo sapiens
agttaatgagcattttggaatg

SEQ ID NO: 8271086 - DNA, 22 bp, Homo sapiens
agtggggccggtgaggccgagg

SEQ ID NO: 8271087 - DNA, 22 bp, Homo sapiens
agtggggcggacaggaccagga

SEQ ID NO: 8271088 - DNA, 21 bp, Homo sapiens
agtccttgaaactctttcttg

SEQ ID NO: 8271089 - DNA, 22 bp, Homo sapiens
agtccttgaatgttttgaaatc

SEQ ID NO: 8271090 - DNA, 22 bp, Homo sapiens
aggcagaaaatagtcatccaaa

SEQ ID NO: 8271091 - DNA, 17 bp, Homo sapiens
acagtgagaagtcatct

SEQ ID NO: 8271092 - DNA, 22 bp, Homo sapiens
acatctgaccattacaagacat

SEQ ID NO: 8271093 - DNA, 22 bp, Homo sapiens
aggaaaggttcagtgattgaaa

SEQ ID NO: 8271094 - DNA, 22 bp, Homo sapiens
aggacagtccggggtcctccac

SEQ ID NO: 8271095 - DNA, 22 bp, Homo sapiens
aggctccagtctcctctggcag

SEQ ID NO: 8271096 - DNA, 22 bp, Homo sapiens
aggggagcaaggccgtggtgta

SEQ ID NO: 8271097 - DNA, 22 bp, Homo sapiens
aggcaagattaggaccagaaga

SEQ ID NO: 8271098 - DNA, 22 bp, Homo sapiens
catttctgcagaattgctcttc

SEQ ID NO: 8271099 - DNA, 22 bp, Homo sapiens
catccaataccagtttgcaggc

SEQ ID NO: 8271100 - DNA, 22 bp, Homo sapiens
agctggtggagaagcagacctc

SEQ ID NO: 8271101 - DNA, 22 bp, Homo sapiens
caggtgggattttgctgcttga

SEQ ID NO: 8271102 - DNA, 22 bp, Homo sapiens
caggtgggccatgaaaaatgac

SEQ ID NO: 8271103 - DNA, 22 bp, Homo sapiens
aggggaaggccagcctgtagag

SEQ ID NO: 8271104 - DNA, 22 bp, Homo sapiens
aggggctcagttactttggcag

SEQ ID NO: 8271105 - DNA, 22 bp, Homo sapiens
aggggctcctttgtgctgcgtc

SEQ ID NO: 8271106 - DNA, 22 bp, Homo sapiens
cccagaggtgcttcagaggtgc

SEQ ID NO: 8271107 - DNA, 22 bp, Homo sapiens
ccagtggtgaatccagggatgt

SEQ ID NO: 8271108 - DNA, 22 bp, Homo sapiens
ccaggagggaggagttcctgag

SEQ ID NO: 8271109 - DNA, 22 bp, Homo sapiens
atagcacctgtgatgggatgag

SEQ ID NO: 8271110 - DNA, 22 bp, Homo sapiens
atagcacctcctcagggaagtc

SEQ ID NO: 8271111 - DNA, 22 bp, Homo sapiens
atagcaccatgactaaacaatt

SEQ ID NO: 8271112 - DNA, 22 bp, Homo sapiens
atattcactgggtactaaaaag

SEQ ID NO: 8271113 - DNA, 22 bp, Homo sapiens
atatgccatactgtacaatact

SEQ ID NO: 8271114 - DNA, 22 bp, Homo sapiens
atctgcaggatgttaggatgat

SEQ ID NO: 8271115 - DNA, 22 bp, Homo sapiens
atcctgtgcaatgactgcatct

SEQ ID NO: 8271116 - DNA, 22 bp, Homo sapiens
cttagagatgggttttacttag

SEQ ID NO: 8271117 - DNA, 22 bp, Homo sapiens
ctgaaatgggcaaaagtagatt

SEQ ID NO: 8271118 - DNA, 22 bp, Homo sapiens
ctctcatgagcattcctaaggg

SEQ ID NO: 8271119 - DNA, 22 bp, Homo sapiens
ctgagaaaatttcaggaagtgt

SEQ ID NO: 8271120 - DNA, 22 bp, Homo sapiens
ctgaaatggttgcctggagaat

SEQ ID NO: 8271121 - DNA, 22 bp, Homo sapiens
agtcctggccccaaggaaggat

SEQ ID NO: 8271122 - DNA, 22 bp, Homo sapiens
aggtggggagtatatgtaattg

SEQ ID NO: 8271123 - DNA, 22 bp, Homo sapiens
aggtggggccaaatgctacagt

SEQ ID NO: 8271124 - DNA, 21 bp, Homo sapiens
aggtggggctgcacctctgct

SEQ ID NO: 8271125 - DNA, 22 bp, Homo sapiens
aggtggggcccaccaatttgca

SEQ ID NO: 8271126 - DNA, 22 bp, Homo sapiens
aggtggggaggagtgtctcttt

SEQ ID NO: 8271127 - DNA, 22 bp, Homo sapiens
ggctggtgttgagtgcctgtag

SEQ ID NO: 8271128 - DNA, 21 bp, Homo sapiens
ggctggtgtttagctgtgata

SEQ ID NO: 8271129 - DNA, 23 bp, Homo sapiens
cagaaagtttgagaagatacatc

SEQ ID NO: 8271130 - DNA, 22 bp, Homo sapiens
ggccactgtttcctgggcagtt

SEQ ID NO: 8271131 - DNA, 22 bp, Homo sapiens
ggggagcaggctgggctgtctg

SEQ ID NO: 8271132 - DNA, 22 bp, Homo sapiens
gaccttgtgctccgaggcgggc

SEQ ID NO: 8271133 - DNA, 22 bp, Homo sapiens
ctttctcttcgaaaacctgccc

SEQ ID NO: 8271134 - DNA, 22 bp, Homo sapiens
ctttctcttgagcaagagctgt

SEQ ID NO: 8271135 - DNA, 22 bp, Homo sapiens
atgaaaagttcgatctagaagg

SEQ ID NO: 8271136 - DNA, 22 bp, Homo sapiens
atgatattttagtaaagtgata

SEQ ID NO: 8271137 - DNA, 22 bp, Homo sapiens
atgtgagatgcacataattata

SEQ ID NO: 8271138 - DNA, 22 bp, Homo sapiens
atgtgagaataactcaaaacaa

SEQ ID NO: 8271139 - DNA, 22 bp, Homo sapiens
atgtgagaactcaggaaatact

SEQ ID NO: 8271140 - DNA, 22 bp, Homo sapiens
atgtgagactaaaaagatgtgc

SEQ ID NO: 8271141 - DNA, 18 bp, Homo sapiens
atgtgagagaatcttctt

SEQ ID NO: 8271142 - DNA, 22 bp, Homo sapiens
atgtagaatggtgattggcagg

SEQ ID NO: 8271143 - DNA, 22 bp, Homo sapiens
atgtccttcatctaggagatgg

SEQ ID NO: 8271144 - DNA, 22 bp, Homo sapiens
atgtccttcggacaaaattctt

SEQ ID NO: 8271145 - DNA, 22 bp, Homo sapiens
atgtccttgtgagtaaatgatg

SEQ ID NO: 8271146 - DNA, 22 bp, Homo sapiens
gaggtggcctcaagcagtcttc

SEQ ID NO: 8271147 - DNA, 22 bp, Homo sapiens
gaggtggccaagcgaggaaggg

SEQ ID NO: 8271148 - DNA, 22 bp, Homo sapiens
gaggtggcactgtgaggagcac

SEQ ID NO: 8271149 - DNA, 22 bp, Homo sapiens
gaggcagcctcagtggacctcg

SEQ ID NO: 8271150 - DNA, 22 bp, Homo sapiens
gaggcagcatctatggtgggaa

SEQ ID NO: 8271151 - DNA, 22 bp, Homo sapiens
atggggagagcctctgtcccca

SEQ ID NO: 8271152 - DNA, 22 bp, Homo sapiens
atggggagctcaccacctgttt

SEQ ID NO: 8271153 - DNA, 22 bp, Homo sapiens
atggggagagaagggctgagct

SEQ ID NO: 8271154 - DNA, 22 bp, Homo sapiens
gagagaggcctccatgtactga

SEQ ID NO: 8271155 - DNA, 22 bp, Homo sapiens
atggccaagcatatacagattg

SEQ ID NO: 8271156 - DNA, 22 bp, Homo sapiens
atggccaactgaaatgaaagat

SEQ ID NO: 8271157 - DNA, 21 bp, Homo sapiens
caaatgctggctggatgagga

SEQ ID NO: 8271158 - DNA, 22 bp, Homo sapiens
caaatgctactaataggcaagt

SEQ ID NO: 8271159 - DNA, 22 bp, Homo sapiens
gcccccagaagggccacagatt

SEQ ID NO: 8271160 - DNA, 22 bp, Homo sapiens
gcccccaggctctggagaacct

SEQ ID NO: 8271161 - DNA, 22 bp, Homo sapiens
gcccccagctctcaagctcaaa

SEQ ID NO: 8271162 - DNA, 17 bp, Homo sapiens
gcccccagaaatctcag

SEQ ID NO: 8271163 - DNA, 22 bp, Homo sapiens
gcccacctaacctgctcacctt

SEQ ID NO: 8271164 - DNA, 22 bp, Homo sapiens
gcacctttctatattcagtggc

SEQ ID NO: 8271165 - DNA, 22 bp, Homo sapiens
attcacccacgtcttagtctgt

SEQ ID NO: 8271166 - DNA, 22 bp, Homo sapiens
attcaccccctatttgcaatgc

SEQ ID NO: 8271167 - DNA, 22 bp, Homo sapiens
gatttccaggtcattaataaag

SEQ ID NO: 8271168 - DNA, 22 bp, Homo sapiens
tgagggcacctgggattaatgg

SEQ ID NO: 8271169 - DNA, 22 bp, Homo sapiens
ccatgccttcctttccctggaa

SEQ ID NO: 8271170 - DNA, 19 bp, Homo sapiens
ccatgccatcattttaaag

SEQ ID NO: 8271171 - DNA, 22 bp, Homo sapiens
tgagacagttctgcagctgggt

SEQ ID NO: 8271172 - DNA, 19 bp, Homo sapiens
tctggttcatttctgctgt

SEQ ID NO: 8271173 - DNA, 22 bp, Homo sapiens
tcttcacattttaagaagttct

SEQ ID NO: 8271174 - DNA, 22 bp, Homo sapiens
tggagcagggcatcactgtgcg

SEQ ID NO: 8271175 - DNA, 22 bp, Homo sapiens
tggagcaggccggaagtggctt

SEQ ID NO: 8271176 - DNA, 22 bp, Homo sapiens
cccaggagagagacttgaatct

SEQ ID NO: 8271177 - DNA, 22 bp, Homo sapiens
cccagggacagctaggtggggc

SEQ ID NO: 8271178 - DNA, 22 bp, Homo sapiens
taatgtgaagacataaatcaga

SEQ ID NO: 8271179 - DNA, 18 bp, Homo sapiens
caggtgggtctcctgccc

SEQ ID NO: 8271180 - DNA, 22 bp, Homo sapiens
caggtgggtacatcacagagac

SEQ ID NO: 8271181 - DNA, 22 bp, Homo sapiens
caggtgggtgtatgaatgcaaa

SEQ ID NO: 8271182 - DNA, 22 bp, Homo sapiens
tattttaggtaatatccattgt

SEQ ID NO: 8271183 - DNA, 22 bp, Homo sapiens
tcagatattctctaagaacaat

SEQ ID NO: 8271184 - DNA, 22 bp, Homo sapiens
catgaaattgtattggcctcaa

SEQ ID NO: 8271185 - DNA, 22 bp, Homo sapiens
catgaaattgctcctttggtgc

SEQ ID NO: 8271186 - DNA, 22 bp, Homo sapiens
catgaaatttgaagtacagcaa

SEQ ID NO: 8271187 - DNA, 22 bp, Homo sapiens
catgcatttctaccaaggaata

SEQ ID NO: 8271188 - DNA, 20 bp, Homo sapiens
ctctgctttccacctttcag

SEQ ID NO: 8271189 - DNA, 22 bp, Homo sapiens
ctctgctttcctcttacacact

SEQ ID NO: 8271190 - DNA, 22 bp, Homo sapiens
ttttaagcaaaagaatggtgtg

SEQ ID NO: 8271191 - DNA, 22 bp, Homo sapiens
cctggtggacagcagccagcag

SEQ ID NO: 8271192 - DNA, 22 bp, Homo sapiens
tgttaatgtgctttgaaagact

SEQ ID NO: 8271193 - DNA, 22 bp, Homo sapiens
ttctcctttgtaattctcatcc

SEQ ID NO: 8271194 - DNA, 22 bp, Homo sapiens
ctagcaccagcctgagagtttt

SEQ ID NO: 8271195 - DNA, 22 bp, Homo sapiens
cggtctcccgtgtgtgtgcgct

SEQ ID NO: 8271196 - DNA, 22 bp, Homo sapiens
gagatggagtctttttctgtca

SEQ ID NO: 8271197 - DNA, 22 bp, Homo sapiens
gagaaggcttcttttcctctga

SEQ ID NO: 8271198 - DNA, 22 bp, Homo sapiens
gagcggcaggagccacctgcct

SEQ ID NO: 8271199 - DNA, 22 bp, Homo sapiens
gaggcagagaccttcaggacct

SEQ ID NO: 8271200 - DNA, 22 bp, Homo sapiens
gaacagccctgttaagtctgtt

SEQ ID NO: 8271201 - DNA, 22 bp, Homo sapiens
gaacagcctcaataacatcctt

SEQ ID NO: 8271202 - DNA, 22 bp, Homo sapiens
gaaccagcagttgcctgaaaaa

SEQ ID NO: 8271203 - DNA, 22 bp, Homo sapiens
gaagagaagcatcaataggtaa

SEQ ID NO: 8271204 - DNA, 22 bp, Homo sapiens
gaagagaaaggcaaggagtttt

SEQ ID NO: 8271205 - DNA, 22 bp, Homo sapiens
gaagcccagcaaactgtgatca

SEQ ID NO: 8271206 - DNA, 22 bp, Homo sapiens
cttgatctacatagtgaaaccc

SEQ ID NO: 8271207 - DNA, 22 bp, Homo sapiens
cttgtagaattgaaatggtctc

SEQ ID NO: 8271208 - DNA, 22 bp, Homo sapiens
cttgtcagccaattgtggattt

SEQ ID NO: 8271209 - DNA, 22 bp, Homo sapiens
gtgagaagataagtattgcaaa

SEQ ID NO: 8271210 - DNA, 22 bp, Homo sapiens
gtgaaacaccctccaatgcaca

SEQ ID NO: 8271211 - DNA, 22 bp, Homo sapiens
ggggaagatggccctccatgtg

SEQ ID NO: 8271212 - DNA, 22 bp, Homo sapiens
ggtggccttttatgagcagggt

SEQ ID NO: 8271213 - DNA, 22 bp, Homo sapiens
ggtggctctccctggactcagc

SEQ ID NO: 8271214 - DNA, 22 bp, Homo sapiens
ggtggctcggccagtgcaggcc

SEQ ID NO: 8271215 - DNA, 17 bp, Homo sapiens
ggtggctcgggcgcggc

SEQ ID NO: 8271216 - DNA, 22 bp, Homo sapiens
ggtggctctcttaagggcagcg

SEQ ID NO: 8271217 - DNA, 22 bp, Homo sapiens
gggcagctgccaagtgcatcgc

SEQ ID NO: 8271218 - DNA, 22 bp, Homo sapiens
gggcagctgcccctctctgggc

SEQ ID NO: 8271219 - DNA, 22 bp, Homo sapiens
gggcagctgcagggatggtgac

SEQ ID NO: 8271220 - DNA, 22 bp, Homo sapiens
gggacagctgtagtgcttggct

SEQ ID NO: 8271221 - DNA, 22 bp, Homo sapiens
gggagagcgggaggtgccacag

SEQ ID NO: 8271222 - DNA, 22 bp, Homo sapiens
ggcttctgtcctctggatctgt

SEQ ID NO: 8271223 - DNA, 22 bp, Homo sapiens
ggcaagaggtccaagaggtctc

SEQ ID NO: 8271224 - DNA, 22 bp, Homo sapiens
ggagcagcactgccacacagag

SEQ ID NO: 8271225 - DNA, 22 bp, Homo sapiens
ggacagtgcgagacacagtaac

SEQ ID NO: 8271226 - DNA, 20 bp, Homo sapiens
ggacagtgagacatatctca

SEQ ID NO: 8271227 - DNA, 22 bp, Homo sapiens
ggaagacaagcagtggctgagc

SEQ ID NO: 8271228 - DNA, 22 bp, Homo sapiens
gctggggcctgaacagtcagct

SEQ ID NO: 8271229 - DNA, 22 bp, Homo sapiens
gcctctggtccctcatgctgtg

SEQ ID NO: 8271230 - DNA, 22 bp, Homo sapiens
tactttttatgataagaactga

SEQ ID NO: 8271231 - DNA, 22 bp, Homo sapiens
tactttttgtctctttgaatgt

SEQ ID NO: 8271232 - DNA, 22 bp, Homo sapiens
tagaatgtagtgcttcaagatt

SEQ ID NO: 8271233 - DNA, 22 bp, Homo sapiens
tattctcattagtctgtattcc

SEQ ID NO: 8271234 - DNA, 22 bp, Homo sapiens
tattctactagcattgttcact

SEQ ID NO: 8271235 - DNA, 22 bp, Homo sapiens
tattagcacaaagcaaggtatt

SEQ ID NO: 8271236 - DNA, 22 bp, Homo sapiens
taggtgggtgacttccatgggg

SEQ ID NO: 8271237 - DNA, 21 bp, Homo sapiens
taggtgggagccccagtatgc

SEQ ID NO: 8271238 - DNA, 22 bp, Homo sapiens
tatatccatttgtctgctaatt

SEQ ID NO: 8271239 - DNA, 22 bp, Homo sapiens
tatagcactgcaatatttccct

SEQ ID NO: 8271240 - DNA, 22 bp, Homo sapiens
taaagggtaggttttactgtaa

SEQ ID NO: 8271241 - DNA, 22 bp, Homo sapiens
gttgggttaaccaggatgtcaa

SEQ ID NO: 8271242 - DNA, 22 bp, Homo sapiens
gttaatgttatctgaagacagt

SEQ ID NO: 8271243 - DNA, 22 bp, Homo sapiens
gttaatgtgtctgacacaatgg

SEQ ID NO: 8271244 - DNA, 22 bp, Homo sapiens
gttaatgtgatataaagtattt

SEQ ID NO: 8271245 - DNA, 22 bp, Homo sapiens
gttaagtgaatgtcatgtcagg

SEQ ID NO: 8271246 - DNA, 22 bp, Homo sapiens
gtgctccctccttcctcaagga

SEQ ID NO: 8271247 - DNA, 22 bp, Homo sapiens
tcacattttgttcaaggctagt

SEQ ID NO: 8271248 - DNA, 22 bp, Homo sapiens
tcacaaagctttgataagcaga

SEQ ID NO: 8271249 - DNA, 23 bp, Homo sapiens
tccaggcatgagctctggatgga

SEQ ID NO: 8271250 - DNA, 22 bp, Homo sapiens
ttttctatctcctagaactgcc

SEQ ID NO: 8271251 - DNA, 22 bp, Homo sapiens
tttttcatctgattgataactc

SEQ ID NO: 8271252 - DNA, 22 bp, Homo sapiens
tttcttctcacccaggacagag

SEQ ID NO: 8271253 - DNA, 22 bp, Homo sapiens
tttctgctcgctctcaatcagg

SEQ ID NO: 8271254 - DNA, 23 bp, Homo sapiens
tttctgaagttgagatggacttt

SEQ ID NO: 8271255 - DNA, 22 bp, Homo sapiens
tttctgctttcagagtgagaca

SEQ ID NO: 8271256 - DNA, 22 bp, Homo sapiens
tttctgcttgagagaattgctg

SEQ ID NO: 8271257 - DNA, 22 bp, Homo sapiens
tttctgcttccttgagaaggag

SEQ ID NO: 8271258 - DNA, 22 bp, Homo sapiens
tttctgctgtgtaaaatgaggg

SEQ ID NO: 8271259 - DNA, 22 bp, Homo sapiens
tttctcttgcgatatgctacac

SEQ ID NO: 8271260 - DNA, 22 bp, Homo sapiens
tttctgaaatctcttttgagga

SEQ ID NO: 8271261 - DNA, 22 bp, Homo sapiens
tttctgaaatgctggctttgga

SEQ ID NO: 8271262 - DNA, 22 bp, Homo sapiens
tttctgaaacatggtctttgta

SEQ ID NO: 8271263 - DNA, 22 bp, Homo sapiens
tttctgaagatacagctttgct

SEQ ID NO: 8271264 - DNA, 21 bp, Homo sapiens
tttctgaaggcaacatctatc

SEQ ID NO: 8271265 - DNA, 22 bp, Homo sapiens
tttctcagtgtagcttttcaag

SEQ ID NO: 8271266 - DNA, 22 bp, Homo sapiens
tttctccaatgtatcagcacac

SEQ ID NO: 8271267 - DNA, 22 bp, Homo sapiens
tttctcatggaacatcgtttag

SEQ ID NO: 8271268 - DNA, 22 bp, Homo sapiens
tttctaagtaagattaacttct

SEQ ID NO: 8271269 - DNA, 22 bp, Homo sapiens
tttccaaaggctaaactcagtt

SEQ ID NO: 8271270 - DNA, 22 bp, Homo sapiens
ttgttagcatgcttaatggata

SEQ ID NO: 8271271 - DNA, 22 bp, Homo sapiens
ttgttagctgatcttgagtgca

SEQ ID NO: 8271272 - DNA, 22 bp, Homo sapiens
ttgtgagaaatcttaatcccaa

SEQ ID NO: 8271273 - DNA, 22 bp, Homo sapiens
ttgcaagatgttaccattgtta

SEQ ID NO: 8271274 - DNA, 22 bp, Homo sapiens
ttgaagatctttgcattgcagg

SEQ ID NO: 8271275 - DNA, 22 bp, Homo sapiens
ttgaagaagtaattttaagtct

SEQ ID NO: 8271276 - DNA, 22 bp, Homo sapiens
ttgagcacattccctttcatgg

SEQ ID NO: 8271277 - DNA, 22 bp, Homo sapiens
ttctgcttattctgtagccttt

SEQ ID NO: 8271278 - DNA, 22 bp, Homo sapiens
ttcttgaaaatagccatgtaca

SEQ ID NO: 8271279 - DNA, 18 bp, Homo sapiens
ttctttaattcagtttga

SEQ ID NO: 8271280 - DNA, 20 bp, Homo sapiens
ttagaaagagcgtgataaga

SEQ ID NO: 8271281 - DNA, 22 bp, Homo sapiens
ttagaaagagtataccagaaac

SEQ ID NO: 8271282 - DNA, 22 bp, Homo sapiens
tgtgttctggaaagctcactga

SEQ ID NO: 8271283 - DNA, 22 bp, Homo sapiens
tgtttcttgataaagcagaaaa

SEQ ID NO: 8271284 - DNA, 22 bp, Homo sapiens
tgtggcagtctcactggagggc

SEQ ID NO: 8271285 - DNA, 15 bp, Homo sapiens
attactgagtggtca

SEQ ID NO: 8271286 - DNA, 22 bp, Homo sapiens
attactgaggcaaagtagtttt

SEQ ID NO: 8271287 - DNA, 22 bp, Homo sapiens
attactgagcttgtagctgcat

SEQ ID NO: 8271288 - DNA, 22 bp, Homo sapiens
attactgagcaacggtcatttc

SEQ ID NO: 8271289 - DNA, 22 bp, Homo sapiens
attacatatgttggcaacattt

SEQ ID NO: 8271290 - DNA, 22 bp, Homo sapiens
attacaatcgagagaaacaaat

SEQ ID NO: 8271291 - DNA, 22 bp, Homo sapiens
attagctttggattcagaagat

SEQ ID NO: 8271292 - DNA, 22 bp, Homo sapiens
attagcttggtatgccataaag

SEQ ID NO: 8271293 - DNA, 22 bp, Homo sapiens
attagcttatcccatttctgaa

SEQ ID NO: 8271294 - DNA, 22 bp, Homo sapiens
attagtattcagtttataacac

SEQ ID NO: 8271295 - DNA, 22 bp, Homo sapiens
attcaacatattctgagtaaaa

SEQ ID NO: 8271296 - DNA, 22 bp, Homo sapiens
attcaaattaagttaattcagc

SEQ ID NO: 8271297 - DNA, 22 bp, Homo sapiens
attcactggcagacagaactca

SEQ ID NO: 8271298 - DNA, 22 bp, Homo sapiens
attcactgtcagcttgcatggg

SEQ ID NO: 8271299 - DNA, 22 bp, Homo sapiens
attcactgtggtgactgatata

SEQ ID NO: 8271300 - DNA, 22 bp, Homo sapiens
attcactgtggtgtctgatata

SEQ ID NO: 8271301 - DNA, 22 bp, Homo sapiens
attcagaaagttgtcatatttg

SEQ ID NO: 8271302 - DNA, 22 bp, Homo sapiens
gcacggcctcgcccttggaacc

SEQ ID NO: 8271303 - DNA, 22 bp, Homo sapiens
attcaagctgaatggtgacaga

SEQ ID NO: 8271304 - DNA, 22 bp, Homo sapiens
gcactagaatcccttcaagaag

SEQ ID NO: 8271305 - DNA, 22 bp, Homo sapiens
gcactagatactgttcaggaaa

SEQ ID NO: 8271306 - DNA, 22 bp, Homo sapiens
gcactagagcagctctcagaga

SEQ ID NO: 8271307 - DNA, 22 bp, Homo sapiens
gcacgtggaatgctcatgagcc

SEQ ID NO: 8271308 - DNA, 22 bp, Homo sapiens
gcacggctaatttttgtatttt

SEQ ID NO: 8271309 - DNA, 22 bp, Homo sapiens
gcactcaggactctcatcagta

SEQ ID NO: 8271310 - DNA, 22 bp, Homo sapiens
gcagcagagtttgggagatggt

SEQ ID NO: 8271311 - DNA, 22 bp, Homo sapiens
gcagcagatgctttcatggaca

SEQ ID NO: 8271312 - DNA, 22 bp, Homo sapiens
gcagcagagtttgggagatggt

SEQ ID NO: 8271313 - DNA, 22 bp, Homo sapiens
attcatatcatagagttattga

SEQ ID NO: 8271314 - DNA, 22 bp, Homo sapiens
gcagcagagaccccaggaagga

SEQ ID NO: 8271315 - DNA, 20 bp, Homo sapiens
gcagcagacagacaggggac

SEQ ID NO: 8271316 - DNA, 21 bp, Homo sapiens
gcagcagaggcttgacagaca

SEQ ID NO: 8271317 - DNA, 22 bp, Homo sapiens
gcagcagagtagacagagccct

SEQ ID NO: 8271318 - DNA, 22 bp, Homo sapiens
attcagaagcaatcacagtgag

SEQ ID NO: 8271319 - DNA, 20 bp, Homo sapiens
attcagaataggcatgtaaa

SEQ ID NO: 8271320 - DNA, 22 bp, Homo sapiens
attcagaatggcaaacttctag

SEQ ID NO: 8271321 - DNA, 22 bp, Homo sapiens
attcagaattgtgggcagtaca

SEQ ID NO: 8271322 - DNA, 22 bp, Homo sapiens
gcaggccttggcaatgagcctg

SEQ ID NO: 8271323 - DNA, 22 bp, Homo sapiens
gcagggctgatggcttccctca

SEQ ID NO: 8271324 - DNA, 22 bp, Homo sapiens
gcagggctgactcagccaccct

SEQ ID NO: 8271325 - DNA, 22 bp, Homo sapiens
attgatttgaacaaagatatta

SEQ ID NO: 8271326 - DNA, 22 bp, Homo sapiens
attctttaattcaattgaagga

SEQ ID NO: 8271327 - DNA, 22 bp, Homo sapiens
attcttggcaaggagatttaaa

SEQ ID NO: 8271328 - DNA, 22 bp, Homo sapiens
attcttggcccgtcctcacgca

SEQ ID NO: 8271329 - DNA, 21 bp, Homo sapiens
attcttggcttagctctctgg

SEQ ID NO: 8271330 - DNA, 22 bp, Homo sapiens
attcttgggatgggtgtcacaa

SEQ ID NO: 8271331 - DNA, 22 bp, Homo sapiens
attcttgatatagatagttaat

SEQ ID NO: 8271332 - DNA, 22 bp, Homo sapiens
attgtacttttattacatgtag

SEQ ID NO: 8271333 - DNA, 22 bp, Homo sapiens
gcatagaatttagagacaaaag

SEQ ID NO: 8271334 - DNA, 22 bp, Homo sapiens
attgtatttgtacaagacatgt

SEQ ID NO: 8271335 - DNA, 22 bp, Homo sapiens
gcagtgtgaccgagcttgcttc

SEQ ID NO: 8271336 - DNA, 22 bp, Homo sapiens
gcagtgtggccccagtatcacg

SEQ ID NO: 8271337 - DNA, 22 bp, Homo sapiens
gcagtgtggcgtggggacctaa

SEQ ID NO: 8271338 - DNA, 20 bp, Homo sapiens
gcagtgtgtatgaatagctg

SEQ ID NO: 8271339 - DNA, 22 bp, Homo sapiens
gcagtgtgtgtccccacactgg

SEQ ID NO: 8271340 - DNA, 22 bp, Homo sapiens
gcatacattgcaccctggtagt

SEQ ID NO: 8271341 - DNA, 22 bp, Homo sapiens
gcatacatgggtgcagggacat

SEQ ID NO: 8271342 - DNA, 22 bp, Homo sapiens
gcatacatgaaaaggtactgac

SEQ ID NO: 8271343 - DNA, 22 bp, Homo sapiens
gcatacatacaatagctgccac

SEQ ID NO: 8271344 - DNA, 22 bp, Homo sapiens
attgtgattagagaatatagag

SEQ ID NO: 8271345 - DNA, 22 bp, Homo sapiens
gccaaataagtggaatcacaca

SEQ ID NO: 8271346 - DNA, 22 bp, Homo sapiens
gccaaagctggaggtggaggtg

SEQ ID NO: 8271347 - DNA, 22 bp, Homo sapiens
gccacagggcagatgcgcagag

SEQ ID NO: 8271348 - DNA, 22 bp, Homo sapiens
gccacagggcgagcggaggcca

SEQ ID NO: 8271349 - DNA, 22 bp, Homo sapiens
gccacagggcagatgcgcagag

SEQ ID NO: 8271350 - DNA, 17 bp, Homo sapiens
gcccacccttaggagct

SEQ ID NO: 8271351 - DNA, 22 bp, Homo sapiens
atttctcagtgtgatcaggcct

SEQ ID NO: 8271352 - DNA, 22 bp, Homo sapiens
atttctcagttcctactgttta

SEQ ID NO: 8271353 - DNA, 22 bp, Homo sapiens
atttctcagtgtgatcaggcct

SEQ ID NO: 8271354 - DNA, 22 bp, Homo sapiens
atttctgtaacttatgaaagtt

SEQ ID NO: 8271355 - DNA, 22 bp, Homo sapiens
atttctgctactgcaccctagt

SEQ ID NO: 8271356 - DNA, 22 bp, Homo sapiens
atttctgtatcctgctgtcaga

SEQ ID NO: 8271357 - DNA, 23 bp, Homo sapiens
gcccaccctcagcgtcctcacgg

SEQ ID NO: 8271358 - DNA, 22 bp, Homo sapiens
gccacaggtgggctctgggaaa

SEQ ID NO: 8271359 - DNA, 22 bp, Homo sapiens
atttccagtcctaatgatctgg

SEQ ID NO: 8271360 - DNA, 22 bp, Homo sapiens
atttccagtgactctcacaggt

SEQ ID NO: 8271361 - DNA, 22 bp, Homo sapiens
atttccagtgcactgaatagaa

SEQ ID NO: 8271362 - DNA, 22 bp, Homo sapiens
atttccaggctgttttgtgaat

SEQ ID NO: 8271363 - DNA, 22 bp, Homo sapiens
atttccaggagttgaggtctga

SEQ ID NO: 8271364 - DNA, 22 bp, Homo sapiens
atttccaggtaacctgttgagt

SEQ ID NO: 8271365 - DNA, 22 bp, Homo sapiens
gccaggtggctgagcagctgca

SEQ ID NO: 8271366 - DNA, 22 bp, Homo sapiens
gccaggtgcatggctgagtctc

SEQ ID NO: 8271367 - DNA, 22 bp, Homo sapiens
gccaggtggaggttgcagtgag

SEQ ID NO: 8271368 - DNA, 22 bp, Homo sapiens
gccaggtgcacctgccctggcc

SEQ ID NO: 8271369 - DNA, 22 bp, Homo sapiens
gccaggtgctatccctgcgctg

SEQ ID NO: 8271370 - DNA, 22 bp, Homo sapiens
gccaggtggaggttgcagtgag

SEQ ID NO: 8271371 - DNA, 22 bp, Homo sapiens
gccaggtgagaggactgaggct

SEQ ID NO: 8271372 - DNA, 19 bp, Homo sapiens
gccaggtcttgggtccagg

SEQ ID NO: 8271373 - DNA, 22 bp, Homo sapiens
gcccccgtagtagatgaggcgc

SEQ ID NO: 8271374 - DNA, 22 bp, Homo sapiens
gcctctgcaactccgccttggt

SEQ ID NO: 8271375 - DNA, 22 bp, Homo sapiens
gcctcttgcaaagcggttagcc

SEQ ID NO: 8271376 - DNA, 22 bp, Homo sapiens
gcctcacagactgactgaaagc

SEQ ID NO: 8271377 - DNA, 22 bp, Homo sapiens
gcctatggattggagaaggagc

SEQ ID NO: 8271378 - DNA, 22 bp, Homo sapiens
atttggaagtttggagtgaagg

SEQ ID NO: 8271379 - DNA, 22 bp, Homo sapiens
atttggaatagctgtagaaata

SEQ ID NO: 8271380 - DNA, 22 bp, Homo sapiens
gcctggcaaggccctgttgact

SEQ ID NO: 8271381 - DNA, 23 bp, Homo sapiens
gcctggcaaagcactaccgagag

SEQ ID NO: 8271382 - DNA, 21 bp, Homo sapiens
gcctggcaaaaaccggccctg

SEQ ID NO: 8271383 - DNA, 22 bp, Homo sapiens
gcctggcacaggaattaggagg

SEQ ID NO: 8271384 - DNA, 22 bp, Homo sapiens
gcctggcacagtagggacccaa

SEQ ID NO: 8271385 - DNA, 22 bp, Homo sapiens
gcctggcaatggcctcaggaag

SEQ ID NO: 8271386 - DNA, 22 bp, Homo sapiens
attttacttagtgtaatgtcca

SEQ ID NO: 8271387 - DNA, 22 bp, Homo sapiens
attttactactccaattaatga

SEQ ID NO: 8271388 - DNA, 22 bp, Homo sapiens
gcctggcacattgcagtggatt

SEQ ID NO: 8271389 - DNA, 22 bp, Homo sapiens
caaatggatacaggcaaacatt

SEQ ID NO: 8271390 - DNA, 22 bp, Homo sapiens
caaatggagaattagcagtttg

SEQ ID NO: 8271391 - DNA, 22 bp, Homo sapiens
caaatggcaacaagaacactgg

SEQ ID NO: 8271392 - DNA, 22 bp, Homo sapiens
caaatggctggcatccttctac

SEQ ID NO: 8271393 - DNA, 22 bp, Homo sapiens
gctgacccctacaggttgtgtt

SEQ ID NO: 8271394 - DNA, 22 bp, Homo sapiens
gctcttgtcaaaaattagttga

SEQ ID NO: 8271395 - DNA, 18 bp, Homo sapiens
caaatactgttgtcttat

SEQ ID NO: 8271396 - DNA, 22 bp, Homo sapiens
caaatacttactgaacctgtgc

SEQ ID NO: 8271397 - DNA, 22 bp, Homo sapiens
caaatactgggtaagttaattt

SEQ ID NO: 8271398 - DNA, 22 bp, Homo sapiens
caaatactgtactgaacactgt

SEQ ID NO: 8271399 - DNA, 22 bp, Homo sapiens
caaatactttatatacttcaaa

SEQ ID NO: 8271400 - DNA, 22 bp, Homo sapiens
caaatactttatatacttcaaa

SEQ ID NO: 8271401 - DNA, 21 bp, Homo sapiens
caaatacttagaaacttaaga

SEQ ID NO: 8271402 - DNA, 21 bp, Homo sapiens
caaatacttagaaacttaaga

SEQ ID NO: 8271403 - DNA, 22 bp, Homo sapiens
caaagctggaaaaggaggctgg

SEQ ID NO: 8271404 - DNA, 22 bp, Homo sapiens
caaagctgtgaattcctacaaa

SEQ ID NO: 8271405 - DNA, 22 bp, Homo sapiens
caaagctgatactcagcaagta

SEQ ID NO: 8271406 - DNA, 22 bp, Homo sapiens
caaagcttggagaagcagctgg

SEQ ID NO: 8271407 - DNA, 22 bp, Homo sapiens
caaatactaaacataagatttt

SEQ ID NO: 8271408 - DNA, 22 bp, Homo sapiens
caaatacaaatacgggcagctt

SEQ ID NO: 8271409 - DNA, 22 bp, Homo sapiens
caaatactaaacataagatttt

SEQ ID NO: 8271410 - DNA, 22 bp, Homo sapiens
attttagagctccaagtacagc

SEQ ID NO: 8271411 - DNA, 22 bp, Homo sapiens
attttgctttatgtaaatatgt

SEQ ID NO: 8271412 - DNA, 22 bp, Homo sapiens
attttactttgtgaatattgac

SEQ ID NO: 8271413 - DNA, 22 bp, Homo sapiens
attttactttgtgaatattgac

SEQ ID NO: 8271414 - DNA, 22 bp, Homo sapiens
attttactactccaattaatga

SEQ ID NO: 8271415 - DNA, 22 bp, Homo sapiens
attttacttcatttgaaatgcc

SEQ ID NO: 8271416 - DNA, 22 bp, Homo sapiens
atttttaggctctaccctcaga

SEQ ID NO: 8271417 - DNA, 23 bp, Homo sapiens
atttttagcctctctgagctgag

SEQ ID NO: 8271418 - DNA, 22 bp, Homo sapiens
caaaagcagttctatctgagtt

SEQ ID NO: 8271419 - DNA, 22 bp, Homo sapiens
caaaataccacgacttgtttta

SEQ ID NO: 8271420 - DNA, 22 bp, Homo sapiens
atttttctctttccactgagat

SEQ ID NO: 8271421 - DNA, 19 bp, Homo sapiens
atttttcttcctctgtgca

SEQ ID NO: 8271422 - DNA, 22 bp, Homo sapiens
caaagcagagaactgtctcatt

SEQ ID NO: 8271423 - DNA, 22 bp, Homo sapiens
caaagcagagccagagcttgtc

SEQ ID NO: 8271424 - DNA, 22 bp, Homo sapiens
caaaattagaaatgcagctgtt

SEQ ID NO: 8271425 - DNA, 23 bp, Homo sapiens
caaaatggtttaaaagtggcata

SEQ ID NO: 8271426 - DNA, 22 bp, Homo sapiens
caaaatgatgtgattttattgt

SEQ ID NO: 8271427 - DNA, 22 bp, Homo sapiens
caaaattagggagtgagctgga

SEQ ID NO: 8271428 - DNA, 22 bp, Homo sapiens
gagatggggaataggagcaagc

SEQ ID NO: 8271429 - DNA, 22 bp, Homo sapiens
gagatggggtcttgctatgttg

SEQ ID NO: 8271430 - DNA, 22 bp, Homo sapiens
gagatggggtcttgctatgttg

SEQ ID NO: 8271431 - DNA, 17 bp, Homo sapiens
gagatgggtggatcacc

SEQ ID NO: 8271432 - DNA, 22 bp, Homo sapiens
atggcattgagtaaagtcagta

SEQ ID NO: 8271433 - DNA, 22 bp, Homo sapiens
atggctggcatccaggtgggct

SEQ ID NO: 8271434 - DNA, 22 bp, Homo sapiens
atggccagagaggccagcctgg

SEQ ID NO: 8271435 - DNA, 22 bp, Homo sapiens
atggccagagagagcacacctg

SEQ ID NO: 8271436 - DNA, 22 bp, Homo sapiens
gagagagaggtgctgccaggca

SEQ ID NO: 8271437 - DNA, 22 bp, Homo sapiens
gagagagaagtgggtgtcacct

SEQ ID NO: 8271438 - DNA, 19 bp, Homo sapiens
gagacatgtagatagaaga

SEQ ID NO: 8271439 - DNA, 22 bp, Homo sapiens
gagatgggcgagaaggtggact

SEQ ID NO: 8271440 - DNA, 22 bp, Homo sapiens
gagatgggcgagaaggtggact

SEQ ID NO: 8271441 - DNA, 22 bp, Homo sapiens
atggggagagcctctgtcccca

SEQ ID NO: 8271442 - DNA, 22 bp, Homo sapiens
atggggagagaagggctgagct

SEQ ID NO: 8271443 - DNA, 22 bp, Homo sapiens
atgggctgggatctgagtgtca

SEQ ID NO: 8271444 - DNA, 22 bp, Homo sapiens
atgggctggcagcctgaacagc

SEQ ID NO: 8271445 - DNA, 22 bp, Homo sapiens
atgggctgcttggcttccaccc

SEQ ID NO: 8271446 - DNA, 22 bp, Homo sapiens
atgggctgcttctccagcacct

SEQ ID NO: 8271447 - DNA, 20 bp, Homo sapiens
atgggctggttaggaagtgt

SEQ ID NO: 8271448 - DNA, 22 bp, Homo sapiens
atgggaaagaagccactgccca

SEQ ID NO: 8271449 - DNA, 22 bp, Homo sapiens
atgggaagtgttagaagatttt

SEQ ID NO: 8271450 - DNA, 22 bp, Homo sapiens
atgggctgacaagacatgcata

SEQ ID NO: 8271451 - DNA, 22 bp, Homo sapiens
atgggctgaggtgggatagaag

SEQ ID NO: 8271452 - DNA, 22 bp, Homo sapiens
gaggcacatatatacagagccc

SEQ ID NO: 8271453 - DNA, 22 bp, Homo sapiens
atggtggtagaagcactatgtg

SEQ ID NO: 8271454 - DNA, 22 bp, Homo sapiens
gaggcagccagaggttctcatt

SEQ ID NO: 8271455 - DNA, 22 bp, Homo sapiens
gaggcagcattcgcatagacag

SEQ ID NO: 8271456 - DNA, 22 bp, Homo sapiens
atggtctgatgtcccatggctt

SEQ ID NO: 8271457 - DNA, 22 bp, Homo sapiens
gaggagaagctattggaaggac

SEQ ID NO: 8271458 - DNA, 22 bp, Homo sapiens
gaggagaagggcacggagaaaa

SEQ ID NO: 8271459 - DNA, 22 bp, Homo sapiens
gaggagaatgcgcaccacatat

SEQ ID NO: 8271460 - DNA, 22 bp, Homo sapiens
gaggaagggactttattatctg

SEQ ID NO: 8271461 - DNA, 22 bp, Homo sapiens
gaggagaaattatccttggtgt

SEQ ID NO: 8271462 - DNA, 22 bp, Homo sapiens
gaggagaaatttggggacctga

SEQ ID NO: 8271463 - DNA, 22 bp, Homo sapiens
gaggagaagctattggaaggac

SEQ ID NO: 8271464 - DNA, 22 bp, Homo sapiens
gaggagaagctaagaaacacag

SEQ ID NO: 8271465 - DNA, 22 bp, Homo sapiens
atgttctttgtgattctgagct

SEQ ID NO: 8271466 - DNA, 22 bp, Homo sapiens
atgttctttggaatttatgaaa

SEQ ID NO: 8271467 - DNA, 22 bp, Homo sapiens
atgttcttgttcaaatgtcagt

SEQ ID NO: 8271468 - DNA, 22 bp, Homo sapiens
atgttcttccaaatctgtaaca

SEQ ID NO: 8271469 - DNA, 22 bp, Homo sapiens
atgttctttcagccagtgcatc

SEQ ID NO: 8271470 - DNA, 22 bp, Homo sapiens
atgttctttgaaatattttaga

SEQ ID NO: 8271471 - DNA, 22 bp, Homo sapiens
atgttcttatcattctttcgga

SEQ ID NO: 8271472 - DNA, 22 bp, Homo sapiens
atgttcttagcaaagtacttgc

SEQ ID NO: 8271473 - DNA, 20 bp, Homo sapiens
atgttcttcatttaatgttc

SEQ ID NO: 8271474 - DNA, 22 bp, Homo sapiens
atgttcttctatctttattaaa

SEQ ID NO: 8271475 - DNA, 22 bp, Homo sapiens
atgttcttcctctgcacagcta

SEQ ID NO: 8271476 - DNA, 22 bp, Homo sapiens
atgttcttggatgttgtgtata

SEQ ID NO: 8271477 - DNA, 22 bp, Homo sapiens
atgttcttgactttcctgcctg

SEQ ID NO: 8271478 - DNA, 22 bp, Homo sapiens
atgttggctggattttagattt

SEQ ID NO: 8271479 - DNA, 22 bp, Homo sapiens
atgttggtgggtacagagggat

SEQ ID NO: 8271480 - DNA, 22 bp, Homo sapiens
atgttggagtcgtaaggcatgg

SEQ ID NO: 8271481 - DNA, 22 bp, Homo sapiens
atgttggagtcgtaaggcatgg

SEQ ID NO: 8271482 - DNA, 21 bp, Homo sapiens
atgttggaatccaaaaacatt

SEQ ID NO: 8271483 - DNA, 22 bp, Homo sapiens
atgttgtgtttgactgttaccc

SEQ ID NO: 8271484 - DNA, 22 bp, Homo sapiens
gataatttgatacctcaatcag

SEQ ID NO: 8271485 - DNA, 22 bp, Homo sapiens
gataattttagtctgaaaattg

SEQ ID NO: 8271486 - DNA, 22 bp, Homo sapiens
atgtccttggggctggggaact

SEQ ID NO: 8271487 - DNA, 22 bp, Homo sapiens
atgtccttgtgagtaaatgatg

SEQ ID NO: 8271488 - DNA, 23 bp, Homo sapiens
atgtcctgcatagttgcttctgt

SEQ ID NO: 8271489 - DNA, 22 bp, Homo sapiens
atgtctctcatgaccaaagaag

SEQ ID NO: 8271490 - DNA, 22 bp, Homo sapiens
gaggcagcggctcacagagaaa

SEQ ID NO: 8271491 - DNA, 22 bp, Homo sapiens
atgtcattgccaagatgctaat

SEQ ID NO: 8271492 - DNA, 20 bp, Homo sapiens
gaggtagggcttaaggcaag

SEQ ID NO: 8271493 - DNA, 22 bp, Homo sapiens
gaggtggatgttgcagtgagct

SEQ ID NO: 8271494 - DNA, 22 bp, Homo sapiens
atgtgaaactgaagcatccata

SEQ ID NO: 8271495 - DNA, 22 bp, Homo sapiens
atgatattttagtaaagtgata

SEQ ID NO: 8271496 - DNA, 22 bp, Homo sapiens
atgatcagcagttttcagtgtt

SEQ ID NO: 8271497 - DNA, 22 bp, Homo sapiens
atgatcagggcagaagcagaag

SEQ ID NO: 8271498 - DNA, 22 bp, Homo sapiens
atgatccaaagccacaggggca

SEQ ID NO: 8271499 - DNA, 22 bp, Homo sapiens
gaaagtattctccctgaatttt

SEQ ID NO: 8271500 - DNA, 22 bp, Homo sapiens
gaaacatacgatttaggagaaa

SEQ ID NO: 8271501 - DNA, 22 bp, Homo sapiens
atgacaggtatgccttataatc

SEQ ID NO: 8271502 - DNA, 22 bp, Homo sapiens
atgacaggtgattttatgcttt

SEQ ID NO: 8271503 - DNA, 22 bp, Homo sapiens
atgacagtactggtgacaatac

SEQ ID NO: 8271504 - DNA, 22 bp, Homo sapiens
atgacatgaggcatctttggag

SEQ ID NO: 8271505 - DNA, 22 bp, Homo sapiens
atgacatgattctttctttcat

SEQ ID NO: 8271506 - DNA, 22 bp, Homo sapiens
atgacatgacctggtagagaca

SEQ ID NO: 8271507 - DNA, 22 bp, Homo sapiens
atgacatgaataaaaatcgtgt

SEQ ID NO: 8271508 - DNA, 22 bp, Homo sapiens
atgacatcactacattattcct

SEQ ID NO: 8271509 - DNA, 22 bp, Homo sapiens
atgacatcaacagtggtgctgt

SEQ ID NO: 8271510 - DNA, 22 bp, Homo sapiens
ctttccagcatttccttgtgaa

SEQ ID NO: 8271511 - DNA, 22 bp, Homo sapiens
atctggctattgacatgttata

SEQ ID NO: 8271512 - DNA, 19 bp, Homo sapiens
ctttccaggagatgctgag

SEQ ID NO: 8271513 - DNA, 22 bp, Homo sapiens
cttctttactttctagaaataa

SEQ ID NO: 8271514 - DNA, 22 bp, Homo sapiens
cttctttaatgtatacaaaaga

SEQ ID NO: 8271515 - DNA, 22 bp, Homo sapiens
atgaactgagcttaattgctga

SEQ ID NO: 8271516 - DNA, 22 bp, Homo sapiens
atgaactgcagtataaacttgg

SEQ ID NO: 8271517 - DNA, 22 bp, Homo sapiens
atgaactgcatgttttctactg

SEQ ID NO: 8271518 - DNA, 22 bp, Homo sapiens
atgaacatgtgactcagacctg

SEQ ID NO: 8271519 - DNA, 22 bp, Homo sapiens
atgaaattcatctgagaatgct

SEQ ID NO: 8271520 - DNA, 22 bp, Homo sapiens
atgaacagtatgcaacatgatt

SEQ ID NO: 8271521 - DNA, 22 bp, Homo sapiens
atgaacagtacaaagcacagac

SEQ ID NO: 8271522 - DNA, 22 bp, Homo sapiens
gaccttgtgatccagccacctt

SEQ ID NO: 8271523 - DNA, 22 bp, Homo sapiens
atgctattttacataggaatgg

SEQ ID NO: 8271524 - DNA, 17 bp, Homo sapiens
atgctccattcagaagc

SEQ ID NO: 8271525 - DNA, 22 bp, Homo sapiens
gactggctcactccactcctat

SEQ ID NO: 8271526 - DNA, 22 bp, Homo sapiens
gactggaaagcctgtcctcaga

SEQ ID NO: 8271527 - DNA, 22 bp, Homo sapiens
gaccaaggccctcagtgggagg

SEQ ID NO: 8271528 - DNA, 22 bp, Homo sapiens
gacacatagatctatctcactc

SEQ ID NO: 8271529 - DNA, 22 bp, Homo sapiens
gacacatacagcagtaagtcta

SEQ ID NO: 8271530 - DNA, 18 bp, Homo sapiens
gacacatccccaggcctc

SEQ ID NO: 8271531 - DNA, 22 bp, Homo sapiens
gacacatatgcgtatagtttag

SEQ ID NO: 8271532 - DNA, 22 bp, Homo sapiens
gacacaaagtttgtcagaaatt

SEQ ID NO: 8271533 - DNA, 21 bp, Homo sapiens
gacacaaagggtagtaatggt

SEQ ID NO: 8271534 - DNA, 19 bp, Homo sapiens
gacaattagagatcactca

SEQ ID NO: 8271535 - DNA, 22 bp, Homo sapiens
gacaattagatcattcctttga

SEQ ID NO: 8271536 - DNA, 22 bp, Homo sapiens
gacaatttctcaatatagaaac

SEQ ID NO: 8271537 - DNA, 22 bp, Homo sapiens
gacaatttctcaatatagaaac

SEQ ID NO: 8271538 - DNA, 22 bp, Homo sapiens
atgcacaggaccacacataatg

SEQ ID NO: 8271539 - DNA, 22 bp, Homo sapiens
gaataatattgactttgcaggc

SEQ ID NO: 8271540 - DNA, 22 bp, Homo sapiens
gaatacaaagcagaactcatac

SEQ ID NO: 8271541 - DNA, 22 bp, Homo sapiens
gaataattttgatcagaaggga

SEQ ID NO: 8271542 - DNA, 22 bp, Homo sapiens
gaatcaattgtgaagactatga

SEQ ID NO: 8271543 - DNA, 22 bp, Homo sapiens
gaatattttcagtacagatggt

SEQ ID NO: 8271544 - DNA, 22 bp, Homo sapiens
gaacaaagacatggaggaggat

SEQ ID NO: 8271545 - DNA, 22 bp, Homo sapiens
gaaggcaacaccaggatgcact

SEQ ID NO: 8271546 - DNA, 22 bp, Homo sapiens
atgcacagatccccaggaccct

SEQ ID NO: 8271547 - DNA, 22 bp, Homo sapiens
ggggagcaatagttgaggtgtg

SEQ ID NO: 8271548 - DNA, 19 bp, Homo sapiens
cagaggcaccaggtataga

SEQ ID NO: 8271549 - DNA, 22 bp, Homo sapiens
cagaggcacaagaaagcaaggc

SEQ ID NO: 8271550 - DNA, 22 bp, Homo sapiens
cagaggggtgtagagatcactg

SEQ ID NO: 8271551 - DNA, 21 bp, Homo sapiens
cagagggcttttctctgttct

SEQ ID NO: 8271552 - DNA, 22 bp, Homo sapiens
cagagggcttcaggttcaggat

SEQ ID NO: 8271553 - DNA, 22 bp, Homo sapiens
cagaggggataacaggtgtaga

SEQ ID NO: 8271554 - DNA, 21 bp, Homo sapiens
cagagggccggcatgtggtct

SEQ ID NO: 8271555 - DNA, 21 bp, Homo sapiens
cagagggccggcatgtggtct

SEQ ID NO: 8271556 - DNA, 22 bp, Homo sapiens
cagagggcgtccgggttaactt

SEQ ID NO: 8271557 - DNA, 22 bp, Homo sapiens
cagagggctgccctgagttcgt

SEQ ID NO: 8271558 - DNA, 22 bp, Homo sapiens
cagagggctgccctgagttcgt

SEQ ID NO: 8271559 - DNA, 22 bp, Homo sapiens
cagagtccaattgctcagagcg

SEQ ID NO: 8271560 - DNA, 22 bp, Homo sapiens
ggtcatgttttaaaaatattgt

SEQ ID NO: 8271561 - DNA, 19 bp, Homo sapiens
cagagtccttgaccagtcc

SEQ ID NO: 8271562 - DNA, 22 bp, Homo sapiens
ggtcatatctttctgattgttc

SEQ ID NO: 8271563 - DNA, 22 bp, Homo sapiens
ggtcagtgtatgtattgataag

SEQ ID NO: 8271564 - DNA, 22 bp, Homo sapiens
ggtcagtgcgatttcccactcc

SEQ ID NO: 8271565 - DNA, 22 bp, Homo sapiens
ggtgacggggcccaggtttcct

SEQ ID NO: 8271566 - DNA, 22 bp, Homo sapiens
ggtgacgaatccatagcatcga

SEQ ID NO: 8271567 - DNA, 22 bp, Homo sapiens
ggtgacctcacctggtcccacc

SEQ ID NO: 8271568 - DNA, 22 bp, Homo sapiens
cagcaagacaaggaacaaactg

SEQ ID NO: 8271569 - DNA, 22 bp, Homo sapiens
cagcaaagtaagctgacatgta

SEQ ID NO: 8271570 - DNA, 22 bp, Homo sapiens
cagcaagacttcagggcttggt

SEQ ID NO: 8271571 - DNA, 22 bp, Homo sapiens
ggtgacagtggttaaaatttgt

SEQ ID NO: 8271572 - DNA, 22 bp, Homo sapiens
ggtgacctcacctggtcccacc

SEQ ID NO: 8271573 - DNA, 22 bp, Homo sapiens
ggtctgagcttgagcccatgct

SEQ ID NO: 8271574 - DNA, 22 bp, Homo sapiens
cagcacagtttcccccatgagc

SEQ ID NO: 8271575 - DNA, 22 bp, Homo sapiens
cagcacagtgcagatgctgact

SEQ ID NO: 8271576 - DNA, 22 bp, Homo sapiens
cagcacagtttgcttggcagag

SEQ ID NO: 8271577 - DNA, 22 bp, Homo sapiens
cagcacagtttgcttggcagag

SEQ ID NO: 8271578 - DNA, 22 bp, Homo sapiens
cagcacatctgattatatgact

SEQ ID NO: 8271579 - DNA, 22 bp, Homo sapiens
cagcacatctccaagaatttct

SEQ ID NO: 8271580 - DNA, 22 bp, Homo sapiens
cagcacagtacaaggcacggat

SEQ ID NO: 8271581 - DNA, 22 bp, Homo sapiens
cagcacagtacaaggcacggat

SEQ ID NO: 8271582 - DNA, 23 bp, Homo sapiens
cagcacagtacatttcctgtctc

SEQ ID NO: 8271583 - DNA, 21 bp, Homo sapiens
cagcaaggaagtcgagtaggt

SEQ ID NO: 8271584 - DNA, 22 bp, Homo sapiens
cagcaaggactgggcatgtgaa

SEQ ID NO: 8271585 - DNA, 22 bp, Homo sapiens
ggcttcacagttgtagcagctc

SEQ ID NO: 8271586 - DNA, 22 bp, Homo sapiens
ggcttcacagccccattagtgc

SEQ ID NO: 8271587 - DNA, 22 bp, Homo sapiens
ggcttagcaactcctgaggctc

SEQ ID NO: 8271588 - DNA, 22 bp, Homo sapiens
ggcttagcaactcctgaggctc

SEQ ID NO: 8271589 - DNA, 22 bp, Homo sapiens
ggcttcagatttctcagttgtt

SEQ ID NO: 8271590 - DNA, 22 bp, Homo sapiens
ggcttcagctggttatttcctt

SEQ ID NO: 8271591 - DNA, 17 bp, Homo sapiens
ggcttcagggagctggg

SEQ ID NO: 8271592 - DNA, 22 bp, Homo sapiens
ggcttcagaagactggacaggt

SEQ ID NO: 8271593 - DNA, 22 bp, Homo sapiens
ggcttcactcataattaggttc

SEQ ID NO: 8271594 - DNA, 22 bp, Homo sapiens
ggcttcagaggggaggtagtgc

SEQ ID NO: 8271595 - DNA, 22 bp, Homo sapiens
cagactgagggcatcacatacg

SEQ ID NO: 8271596 - DNA, 22 bp, Homo sapiens
cagactgactttctgtggctat

SEQ ID NO: 8271597 - DNA, 22 bp, Homo sapiens
cagacgggctcatggcagtccc

SEQ ID NO: 8271598 - DNA, 22 bp, Homo sapiens
cagacgggctcatggcagtccc

SEQ ID NO: 8271599 - DNA, 22 bp, Homo sapiens
cagacgggtggtctgcgaggcc

SEQ ID NO: 8271600 - DNA, 22 bp, Homo sapiens
gggcagcccagaactgctgcag

SEQ ID NO: 8271601 - DNA, 22 bp, Homo sapiens
cagagacagaaaatggatctag

SEQ ID NO: 8271602 - DNA, 22 bp, Homo sapiens
gggcagcattctgtgggcaggt

SEQ ID NO: 8271603 - DNA, 22 bp, Homo sapiens
gggcagcatcaggaggggcttt

SEQ ID NO: 8271604 - DNA, 22 bp, Homo sapiens
gggcagcatcaggaggggcttt

SEQ ID NO: 8271605 - DNA, 20 bp, Homo sapiens
gggctctgcttggcagaagt

SEQ ID NO: 8271606 - DNA, 22 bp, Homo sapiens
gggccagagcttggcagctggg

SEQ ID NO: 8271607 - DNA, 22 bp, Homo sapiens
gggcagtgtcggggcccaggga

SEQ ID NO: 8271608 - DNA, 22 bp, Homo sapiens
gggccacttctagtgcctcaga

SEQ ID NO: 8271609 - DNA, 22 bp, Homo sapiens
gggccactgggtcctgctggcc

SEQ ID NO: 8271610 - DNA, 22 bp, Homo sapiens
gggccactcctggctgctgagt

SEQ ID NO: 8271611 - DNA, 22 bp, Homo sapiens
gggctcttctggcatgctgctc

SEQ ID NO: 8271612 - DNA, 17 bp, Homo sapiens
gggctgacagtggcctc

SEQ ID NO: 8271613 - DNA, 22 bp, Homo sapiens
cagaggcaaaagaggtggaggt

SEQ ID NO: 8271614 - DNA, 20 bp, Homo sapiens
cagaggcaaggagacttgga

SEQ ID NO: 8271615 - DNA, 22 bp, Homo sapiens
cagaggattccctagtgacctg

SEQ ID NO: 8271616 - DNA, 19 bp, Homo sapiens
cagagctgctggcctcgtc

SEQ ID NO: 8271617 - DNA, 22 bp, Homo sapiens
cagagcctgctcacgtctctgt

SEQ ID NO: 8271618 - DNA, 19 bp, Homo sapiens
cagagctgctggcctcgtc

SEQ ID NO: 8271619 - DNA, 22 bp, Homo sapiens
cagagcctgcctctggctgtgg

SEQ ID NO: 8271620 - DNA, 22 bp, Homo sapiens
cagagctggctctgcatgtaca

SEQ ID NO: 8271621 - DNA, 22 bp, Homo sapiens
cagagcctctgccctgggcact

SEQ ID NO: 8271622 - DNA, 22 bp, Homo sapiens
cagagctgggatcccatgggcg

SEQ ID NO: 8271623 - DNA, 23 bp, Homo sapiens
cagagctggcttcatgggtgtgc

SEQ ID NO: 8271624 - DNA, 22 bp, Homo sapiens
cagagctgggatcccatgggcg

SEQ ID NO: 8271625 - DNA, 22 bp, Homo sapiens
cagctattctctgaaatgaata

SEQ ID NO: 8271626 - DNA, 22 bp, Homo sapiens
cagctattccaggagtagaatc

SEQ ID NO: 8271627 - DNA, 22 bp, Homo sapiens
cagctattattttctctaaatt

SEQ ID NO: 8271628 - DNA, 22 bp, Homo sapiens
gtgcccagtaaatgaaagcttt

SEQ ID NO: 8271629 - DNA, 22 bp, Homo sapiens
cagctagggagtggcagagctt

SEQ ID NO: 8271630 - DNA, 22 bp, Homo sapiens
cagctaggaagtccttggcgaa

SEQ ID NO: 8271631 - DNA, 22 bp, Homo sapiens
cagctattaatgtttttgctga

SEQ ID NO: 8271632 - DNA, 22 bp, Homo sapiens
cagctattaatgtttttgctga

SEQ ID NO: 8271633 - DNA, 22 bp, Homo sapiens
cagctaggaaaccagagggcag

SEQ ID NO: 8271634 - DNA, 22 bp, Homo sapiens
cagcctggattgcagaatgcta

SEQ ID NO: 8271635 - DNA, 22 bp, Homo sapiens
cagcctggattgcagaatgcta

SEQ ID NO: 8271636 - DNA, 22 bp, Homo sapiens
cagcctggagccacagcccagg

SEQ ID NO: 8271637 - DNA, 22 bp, Homo sapiens
cagcctggacagcgaccagagt

SEQ ID NO: 8271638 - DNA, 22 bp, Homo sapiens
cagcctggacagcgaccagagt

SEQ ID NO: 8271639 - DNA, 22 bp, Homo sapiens
cagcctggtccccggctcaccc

SEQ ID NO: 8271640 - DNA, 22 bp, Homo sapiens
cagcctggtccccggctcaccc

SEQ ID NO: 8271641 - DNA, 22 bp, Homo sapiens
cagcctggcctgggactgctga

SEQ ID NO: 8271642 - DNA, 22 bp, Homo sapiens
cagcctggcctgggactgctga

SEQ ID NO: 8271643 - DNA, 22 bp, Homo sapiens
cagcctgggctccagagtccct

SEQ ID NO: 8271644 - DNA, 22 bp, Homo sapiens
cagcctctttccacatcaggca

SEQ ID NO: 8271645 - DNA, 23 bp, Homo sapiens
cagccctggagatgtgggaggca

SEQ ID NO: 8271646 - DNA, 22 bp, Homo sapiens
cagccctggaacagctgactca

SEQ ID NO: 8271647 - DNA, 22 bp, Homo sapiens
cagccctgcttccccgctagtt

SEQ ID NO: 8271648 - DNA, 22 bp, Homo sapiens
cagccctgcttccccgctagtt

SEQ ID NO: 8271649 - DNA, 23 bp, Homo sapiens
cagccctgaaatcgaggtgacac

SEQ ID NO: 8271650 - DNA, 22 bp, Homo sapiens
cagccctgccatggagcctcct

SEQ ID NO: 8271651 - DNA, 22 bp, Homo sapiens
cagccctgcggaggtgtatact

SEQ ID NO: 8271652 - DNA, 22 bp, Homo sapiens
gtgcccctggcaaatttccctg

SEQ ID NO: 8271653 - DNA, 22 bp, Homo sapiens
cagccaggcccccgagtcgttg

SEQ ID NO: 8271654 - DNA, 22 bp, Homo sapiens
cagccaggcccccgagtcgttg

SEQ ID NO: 8271655 - DNA, 22 bp, Homo sapiens
cagccagggagggcaaatgaga

SEQ ID NO: 8271656 - DNA, 22 bp, Homo sapiens
cagccagggagcaaagagttga

SEQ ID NO: 8271657 - DNA, 22 bp, Homo sapiens
cagccagggagcaaagagttga

SEQ ID NO: 8271658 - DNA, 22 bp, Homo sapiens
cagccagggagcaaagagttga

SEQ ID NO: 8271659 - DNA, 22 bp, Homo sapiens
gtcccaggctccatggcagcca

SEQ ID NO: 8271660 - DNA, 22 bp, Homo sapiens
cagccctcaaaccacttccagg

SEQ ID NO: 8271661 - DNA, 22 bp, Homo sapiens
cagccagggtcaggcagcttct

SEQ ID NO: 8271662 - DNA, 22 bp, Homo sapiens
cagccagggtcaggcagcttct

SEQ ID NO: 8271663 - DNA, 22 bp, Homo sapiens
cagccaggggctggcgtgttga

SEQ ID NO: 8271664 - DNA, 22 bp, Homo sapiens
cagccaggttagtgctaattgt

SEQ ID NO: 8271665 - DNA, 22 bp, Homo sapiens
gtcattaaaggttttaaatgct

SEQ ID NO: 8271666 - DNA, 22 bp, Homo sapiens
gtcatggtgctagcgggaatgt

SEQ ID NO: 8271667 - DNA, 22 bp, Homo sapiens
gtcatgtcagcaaatatcatag

SEQ ID NO: 8271668 - DNA, 22 bp, Homo sapiens
cagcaggctctgagtggctgcc

SEQ ID NO: 8271669 - DNA, 22 bp, Homo sapiens
cagcaggctctgagtggctgcc

SEQ ID NO: 8271670 - DNA, 22 bp, Homo sapiens
cagcaggctgcgattgctcatt

SEQ ID NO: 8271671 - DNA, 22 bp, Homo sapiens
cagcaggctctgagtggctgcc

SEQ ID NO: 8271672 - DNA, 22 bp, Homo sapiens
cagcaggctggacttcagtccc

SEQ ID NO: 8271673 - DNA, 22 bp, Homo sapiens
gtccagccagctggtccttgcc

SEQ ID NO: 8271674 - DNA, 22 bp, Homo sapiens
cagcagggaagctgtgctgttt

SEQ ID NO: 8271675 - DNA, 22 bp, Homo sapiens
gtccagccactcaccttccagc

SEQ ID NO: 8271676 - DNA, 22 bp, Homo sapiens
gtcccaggaacattctggctag

SEQ ID NO: 8271677 - DNA, 22 bp, Homo sapiens
gtcccagaggctttggccacag

SEQ ID NO: 8271678 - DNA, 22 bp, Homo sapiens
gtcccagaggacagggtcacat

SEQ ID NO: 8271679 - DNA, 22 bp, Homo sapiens
gtcccagaggctttggccacag

SEQ ID NO: 8271680 - DNA, 22 bp, Homo sapiens
gtcccagatgtctggaactccc

SEQ ID NO: 8271681 - DNA, 22 bp, Homo sapiens
cagcagctgcgtgcccaggccg

SEQ ID NO: 8271682 - DNA, 22 bp, Homo sapiens
cagcagctacttggagcagcag

SEQ ID NO: 8271683 - DNA, 22 bp, Homo sapiens
cagcaccttcctatccaggaga

SEQ ID NO: 8271684 - DNA, 22 bp, Homo sapiens
cagcacctaggacagtagtcag

SEQ ID NO: 8271685 - DNA, 22 bp, Homo sapiens
cagcaggaaagacatctgagca

SEQ ID NO: 8271686 - DNA, 22 bp, Homo sapiens
cagcaggaagtactagctttga

SEQ ID NO: 8271687 - DNA, 22 bp, Homo sapiens
cagcagcttctgttgatcagaa

SEQ ID NO: 8271688 - DNA, 20 bp, Homo sapiens
cagcaggaaaagtgcctcag

SEQ ID NO: 8271689 - DNA, 22 bp, Homo sapiens
cagcagctggttatacctgtgg

SEQ ID NO: 8271690 - DNA, 22 bp, Homo sapiens
ggccactgtttcctgggcagtt

SEQ ID NO: 8271691 - DNA, 22 bp, Homo sapiens
ggccactgctctccagcctggg

SEQ ID NO: 8271692 - DNA, 22 bp, Homo sapiens
ggccactgcctccgccatggct

SEQ ID NO: 8271693 - DNA, 23 bp, Homo sapiens
ggccactgaattttctgcatctt

SEQ ID NO: 8271694 - DNA, 22 bp, Homo sapiens
ggcctctctccctggcttgcag

SEQ ID NO: 8271695 - DNA, 22 bp, Homo sapiens
cacgaggccatctccttctgga

SEQ ID NO: 8271696 - DNA, 22 bp, Homo sapiens
cacctgtacagggccgggctgg

SEQ ID NO: 8271697 - DNA, 21 bp, Homo sapiens
cacctgtgagactctcagacc

SEQ ID NO: 8271698 - DNA, 22 bp, Homo sapiens
ggccaccttcctgtggtctctg

SEQ ID NO: 8271699 - DNA, 22 bp, Homo sapiens
ggcagggagtggagactcccta

SEQ ID NO: 8271700 - DNA, 22 bp, Homo sapiens
ggcaggtgcccagagagcacga

SEQ ID NO: 8271701 - DNA, 22 bp, Homo sapiens
ggaggtggaggttgcaatgagc

SEQ ID NO: 8271702 - DNA, 22 bp, Homo sapiens
cacatacattcatgttactcta

SEQ ID NO: 8271703 - DNA, 22 bp, Homo sapiens
cacatactgagaatcacaccca

SEQ ID NO: 8271704 - DNA, 22 bp, Homo sapiens
cacatactattttggttgggtt

SEQ ID NO: 8271705 - DNA, 22 bp, Homo sapiens
cacatacttgtgtgtacatatg

SEQ ID NO: 8271706 - DNA, 22 bp, Homo sapiens
cacatacatgcacacctaaata

SEQ ID NO: 8271707 - DNA, 19 bp, Homo sapiens
cacatacagaaaagagtaa

SEQ ID NO: 8271708 - DNA, 22 bp, Homo sapiens
cacatacaaggcacactggagg

SEQ ID NO: 8271709 - DNA, 22 bp, Homo sapiens
cacattcttgagttacagtcta

SEQ ID NO: 8271710 - DNA, 22 bp, Homo sapiens
ggcagggagagcatgctgataa

SEQ ID NO: 8271711 - DNA, 22 bp, Homo sapiens
ggcagggagagcatgctgataa

SEQ ID NO: 8271712 - DNA, 22 bp, Homo sapiens
ggcagggaggaggtgaaagtga

SEQ ID NO: 8271713 - DNA, 20 bp, Homo sapiens
ggcagggagggatactgagg

SEQ ID NO: 8271714 - DNA, 22 bp, Homo sapiens
ggcaggcaggagcgtgcttggg

SEQ ID NO: 8271715 - DNA, 18 bp, Homo sapiens
cagaaagttatttactct

SEQ ID NO: 8271716 - DNA, 22 bp, Homo sapiens
cagaaagtgatttgctattcca

SEQ ID NO: 8271717 - DNA, 22 bp, Homo sapiens
cagaaatacccagcatttggag

SEQ ID NO: 8271718 - DNA, 22 bp, Homo sapiens
ggctgggaggatgacttgctac

SEQ ID NO: 8271719 - DNA, 22 bp, Homo sapiens
ggctgtccttggccaaggcact

SEQ ID NO: 8271720 - DNA, 20 bp, Homo sapiens
ggctgtcccgcggctgccgg

SEQ ID NO: 8271721 - DNA, 22 bp, Homo sapiens
ggctgtccacctaccatgccgg

SEQ ID NO: 8271722 - DNA, 20 bp, Homo sapiens
ggctgtcccgcggctgccgg

SEQ ID NO: 8271723 - DNA, 22 bp, Homo sapiens
ggctgtgtttctgtttgacatt

SEQ ID NO: 8271724 - DNA, 21 bp, Homo sapiens
cactttaatggatatttgttt

SEQ ID NO: 8271725 - DNA, 22 bp, Homo sapiens
cactttggttcacctgagtttc

SEQ ID NO: 8271726 - DNA, 22 bp, Homo sapiens
cagaaaaggaagagctatgtaa

SEQ ID NO: 8271727 - DNA, 22 bp, Homo sapiens
ggctgccccagtgctcatggct

SEQ ID NO: 8271728 - DNA, 22 bp, Homo sapiens
ggctgccataacagagtaccac

SEQ ID NO: 8271729 - DNA, 22 bp, Homo sapiens
ggctgccctcggggtcgcaggc

SEQ ID NO: 8271730 - DNA, 22 bp, Homo sapiens
cagaaagcagagctgagccttt

SEQ ID NO: 8271731 - DNA, 22 bp, Homo sapiens
ggcctctctccttggcttgcag

SEQ ID NO: 8271732 - DNA, 22 bp, Homo sapiens
ggcctgtccagcctgcctggct

SEQ ID NO: 8271733 - DNA, 22 bp, Homo sapiens
ggcctgtgagaatcaaggaaaa

SEQ ID NO: 8271734 - DNA, 22 bp, Homo sapiens
ggcctgtgtctgtgcctgtcct

SEQ ID NO: 8271735 - DNA, 22 bp, Homo sapiens
ggctcaatgcaacttctgcctc

SEQ ID NO: 8271736 - DNA, 22 bp, Homo sapiens
ggcctgtgtcctccttgccctg

SEQ ID NO: 8271737 - DNA, 22 bp, Homo sapiens
ggcctgtggctttggcgtctaa

SEQ ID NO: 8271738 - DNA, 22 bp, Homo sapiens
ggctcaggggccaggcctgtcc

SEQ ID NO: 8271739 - DNA, 19 bp, Homo sapiens
ggctcagggcgctgccgcc

SEQ ID NO: 8271740 - DNA, 18 bp, Homo sapiens
ggctcaggctatcctaac

SEQ ID NO: 8271741 - DNA, 22 bp, Homo sapiens
ggctccagtttccccttggggc

SEQ ID NO: 8271742 - DNA, 22 bp, Homo sapiens
ggctccaggtacgtatgggagg

SEQ ID NO: 8271743 - DNA, 22 bp, Homo sapiens
ggctccagggtctctccttgtg

SEQ ID NO: 8271744 - DNA, 22 bp, Homo sapiens
ggctcaggttgggtcacatgac

SEQ ID NO: 8271745 - DNA, 22 bp, Homo sapiens
ggctgagcctggagcatctggt

SEQ ID NO: 8271746 - DNA, 22 bp, Homo sapiens
ggctgagctcaggggcagcagg

SEQ ID NO: 8271747 - DNA, 22 bp, Homo sapiens
ggctgagcggactggggtccct

SEQ ID NO: 8271748 - DNA, 22 bp, Homo sapiens
ggctgagctcaggggcagcagg

SEQ ID NO: 8271749 - DNA, 22 bp, Homo sapiens
ggctgagcttttcatgatggtt

SEQ ID NO: 8271750 - DNA, 22 bp, Homo sapiens
ggctctggtgccctggctccca

SEQ ID NO: 8271751 - DNA, 22 bp, Homo sapiens
ggctgagccccctctgcgtagg

SEQ ID NO: 8271752 - DNA, 20 bp, Homo sapiens
caaatggcttttatttcctt

SEQ ID NO: 8271753 - DNA, 22 bp, Homo sapiens
caaatgtattctcacttcaggg

SEQ ID NO: 8271754 - DNA, 22 bp, Homo sapiens
caaatgtgtaaggaagtgttag

SEQ ID NO: 8271755 - DNA, 22 bp, Homo sapiens
caagcaggatgaagcccaggga

SEQ ID NO: 8271756 - DNA, 22 bp, Homo sapiens
caagccagtttgtagttctctc

SEQ ID NO: 8271757 - DNA, 22 bp, Homo sapiens
caagccagtcagctcagtagat

SEQ ID NO: 8271758 - DNA, 22 bp, Homo sapiens
caagccagctcctgccacagag

SEQ ID NO: 8271759 - DNA, 22 bp, Homo sapiens
caaggcctaatcatactgctaa

SEQ ID NO: 8271760 - DNA, 22 bp, Homo sapiens
caaggcctaatcatactgctaa

SEQ ID NO: 8271761 - DNA, 22 bp, Homo sapiens
caaggcctcctgggcccagaga

SEQ ID NO: 8271762 - DNA, 22 bp, Homo sapiens
caaggcttgaattctgatgggt

SEQ ID NO: 8271763 - DNA, 22 bp, Homo sapiens
caaggcttcacgtccccagtgc

SEQ ID NO: 8271764 - DNA, 22 bp, Homo sapiens
gctggctgtatcacctggccag

SEQ ID NO: 8271765 - DNA, 22 bp, Homo sapiens
caagtacaagggtgtcagttta

SEQ ID NO: 8271766 - DNA, 22 bp, Homo sapiens
caagtacaatagctctggaact

SEQ ID NO: 8271767 - DNA, 22 bp, Homo sapiens
caaggtagagaaggatttgatt

SEQ ID NO: 8271768 - DNA, 22 bp, Homo sapiens
caaggtagttctggtcattgac

SEQ ID NO: 8271769 - DNA, 22 bp, Homo sapiens
caaggtgatacttacattagtg

SEQ ID NO: 8271770 - DNA, 22 bp, Homo sapiens
caaggtgcagcgttgtcaagct

SEQ ID NO: 8271771 - DNA, 22 bp, Homo sapiens
caaggtgcagctggctgtgtga

SEQ ID NO: 8271772 - DNA, 22 bp, Homo sapiens
caaggttccagaattatgctct

SEQ ID NO: 8271773 - DNA, 22 bp, Homo sapiens
caaggttattatgtgcatctgt

SEQ ID NO: 8271774 - DNA, 22 bp, Homo sapiens
gctgttcattagaaatagaatg

SEQ ID NO: 8271775 - DNA, 22 bp, Homo sapiens
gctgttcaaaagccacagttac

SEQ ID NO: 8271776 - DNA, 22 bp, Homo sapiens
gctgttcatagaaatggtctca

SEQ ID NO: 8271777 - DNA, 22 bp, Homo sapiens
gctgttcaagactaggaaattt

SEQ ID NO: 8271778 - DNA, 22 bp, Homo sapiens
gctgttcacattttgggccaaa

SEQ ID NO: 8271779 - DNA, 22 bp, Homo sapiens
gctgttcacggaggaggatggg

SEQ ID NO: 8271780 - DNA, 22 bp, Homo sapiens
gctgttcacatctggaccattt

SEQ ID NO: 8271781 - DNA, 20 bp, Homo sapiens
gctgttcacattattagtag

SEQ ID NO: 8271782 - DNA, 22 bp, Homo sapiens
gctgtggcctggcgcagagctg

SEQ ID NO: 8271783 - DNA, 22 bp, Homo sapiens
gctgttgcaatcaaggccatgg

SEQ ID NO: 8271784 - DNA, 22 bp, Homo sapiens
caagttttagcaagtggaaagg

SEQ ID NO: 8271785 - DNA, 22 bp, Homo sapiens
caagttttctgggttcagagca

SEQ ID NO: 8271786 - DNA, 22 bp, Homo sapiens
gctttctgtgcagtgaacacta

SEQ ID NO: 8271787 - DNA, 22 bp, Homo sapiens
gctttgatgaatctgtgcttgg

SEQ ID NO: 8271788 - DNA, 21 bp, Homo sapiens
gctttgatgctgccttgctcc

SEQ ID NO: 8271789 - DNA, 22 bp, Homo sapiens
gctttgcacagattaggttatt

SEQ ID NO: 8271790 - DNA, 22 bp, Homo sapiens
gctttgcacagtgctgtgttaa

SEQ ID NO: 8271791 - DNA, 22 bp, Homo sapiens
gctttgcacaacctttaagaca

SEQ ID NO: 8271792 - DNA, 22 bp, Homo sapiens
gctttgattcttggcttatcag

SEQ ID NO: 8271793 - DNA, 22 bp, Homo sapiens
gctttgcattgtttaatcagga

SEQ ID NO: 8271794 - DNA, 18 bp, Homo sapiens
gctttgcagaaatacaga

SEQ ID NO: 8271795 - DNA, 18 bp, Homo sapiens
gctttgcactcatgttgt

SEQ ID NO: 8271796 - DNA, 22 bp, Homo sapiens
gctttgcactccagctgtggcc

SEQ ID NO: 8271797 - DNA, 22 bp, Homo sapiens
gctttgcactctgatccttccc

SEQ ID NO: 8271798 - DNA, 22 bp, Homo sapiens
gctttgcattcttgtgtgatca

SEQ ID NO: 8271799 - DNA, 22 bp, Homo sapiens
gctttgcattgtgatgggatgc

SEQ ID NO: 8271800 - DNA, 22 bp, Homo sapiens
gctttgcagacaaaattccagc

SEQ ID NO: 8271801 - DNA, 22 bp, Homo sapiens
gctttgcaggaaaccagtgcat

SEQ ID NO: 8271802 - DNA, 22 bp, Homo sapiens
cacaggactcgactgcagacag

SEQ ID NO: 8271803 - DNA, 22 bp, Homo sapiens
cacaggactcgactgcagacag

SEQ ID NO: 8271804 - DNA, 22 bp, Homo sapiens
cacaggcttgtcagcatgaggc

SEQ ID NO: 8271805 - DNA, 22 bp, Homo sapiens
cacaggcttccagtccccagct

SEQ ID NO: 8271806 - DNA, 22 bp, Homo sapiens
cacaggcttccagtccccagct

SEQ ID NO: 8271807 - DNA, 22 bp, Homo sapiens
ggagccctgctgacatgggtgt

SEQ ID NO: 8271808 - DNA, 22 bp, Homo sapiens
cacagataaggctttgtcccca

SEQ ID NO: 8271809 - DNA, 22 bp, Homo sapiens
ggagctggagagctagcctagg

SEQ ID NO: 8271810 - DNA, 21 bp, Homo sapiens
ggagcctctggcagggggcca

SEQ ID NO: 8271811 - DNA, 22 bp, Homo sapiens
cacacagatggtaagggaggga

SEQ ID NO: 8271812 - DNA, 22 bp, Homo sapiens
cacacagacagctctctgaaga

SEQ ID NO: 8271813 - DNA, 22 bp, Homo sapiens
cacacagctagtgacaggagaa

SEQ ID NO: 8271814 - DNA, 22 bp, Homo sapiens
cacacagctcaggggcactgcc

SEQ ID NO: 8271815 - DNA, 22 bp, Homo sapiens
cacactgtctttcagaatggtt

SEQ ID NO: 8271816 - DNA, 22 bp, Homo sapiens
cacagaactggttaatagcaga

SEQ ID NO: 8271817 - DNA, 22 bp, Homo sapiens
ggaaggggagctggaaagggta

SEQ ID NO: 8271818 - DNA, 22 bp, Homo sapiens
ggaaggggagctaaatctactg

SEQ ID NO: 8271819 - DNA, 22 bp, Homo sapiens
ggaaggggagctaaatctactg

SEQ ID NO: 8271820 - DNA, 21 bp, Homo sapiens
ggaagggctctgaggacggct

SEQ ID NO: 8271821 - DNA, 22 bp, Homo sapiens
cacagagaccccttctggggcc

SEQ ID NO: 8271822 - DNA, 20 bp, Homo sapiens
cacagactgtatgggcacca

SEQ ID NO: 8271823 - DNA, 22 bp, Homo sapiens
cacagagaaaatgttggtgctt

SEQ ID NO: 8271824 - DNA, 22 bp, Homo sapiens
ggactgggagaatggaggcaag

SEQ ID NO: 8271825 - DNA, 22 bp, Homo sapiens
cacagaggatttttagggcagt

SEQ ID NO: 8271826 - DNA, 22 bp, Homo sapiens
cacagaggatgcccaagcgatc

SEQ ID NO: 8271827 - DNA, 22 bp, Homo sapiens
cacagaggaatgcatcagcaga

SEQ ID NO: 8271828 - DNA, 22 bp, Homo sapiens
cacagagagctacgtgcagcgt

SEQ ID NO: 8271829 - DNA, 22 bp, Homo sapiens
cacagagctgaacctgggtcat

SEQ ID NO: 8271830 - DNA, 22 bp, Homo sapiens
aggtgggcacagatggagaagt

SEQ ID NO: 8271831 - DNA, 22 bp, Homo sapiens
cctgtgccaaaaggctgcttat

SEQ ID NO: 8271832 - DNA, 18 bp, Homo sapiens
cctgtgtgtgttgcaggc

SEQ ID NO: 8271833 - DNA, 22 bp, Homo sapiens
aggtggggccaaatgctacagt

SEQ ID NO: 8271834 - DNA, 22 bp, Homo sapiens
aggtggggagtatatgtaattg

SEQ ID NO: 8271835 - DNA, 22 bp, Homo sapiens
cctgtgagtttacattctggcc

SEQ ID NO: 8271836 - DNA, 22 bp, Homo sapiens
cctgtcccctcacaatgccact

SEQ ID NO: 8271837 - DNA, 22 bp, Homo sapiens
cctgtcagggtttgcctcagaa

SEQ ID NO: 8271838 - DNA, 22 bp, Homo sapiens
aggtacaggaggttggggctac

SEQ ID NO: 8271839 - DNA, 21 bp, Homo sapiens
aggtacaggtcttgtgagtct

SEQ ID NO: 8271840 - DNA, 22 bp, Homo sapiens
cctgccagctgtgggccagcct

SEQ ID NO: 8271841 - DNA, 23 bp, Homo sapiens
aggtaggttattgctgctacctg

SEQ ID NO: 8271842 - DNA, 22 bp, Homo sapiens
cctgccagcatcttcagcccct

SEQ ID NO: 8271843 - DNA, 22 bp, Homo sapiens
cctgccagatcccctgagctga

SEQ ID NO: 8271844 - DNA, 23 bp, Homo sapiens
cctgcagctgccacgccctgctc

SEQ ID NO: 8271845 - DNA, 23 bp, Homo sapiens
aggtaggttattgctgctacctg

SEQ ID NO: 8271846 - DNA, 23 bp, Homo sapiens
cctggcacacagttgacatggaa

SEQ ID NO: 8271847 - DNA, 22 bp, Homo sapiens
aggtcctctgtgcctgctggcg

SEQ ID NO: 8271848 - DNA, 22 bp, Homo sapiens
aggtccctgcagcagactgcca

SEQ ID NO: 8271849 - DNA, 22 bp, Homo sapiens
aggtcccaggcatagctggtct

SEQ ID NO: 8271850 - DNA, 22 bp, Homo sapiens
aggtcccagtgttagggtgaca

SEQ ID NO: 8271851 - DNA, 21 bp, Homo sapiens
aggtcccaggtttgggcagca

SEQ ID NO: 8271852 - DNA, 21 bp, Homo sapiens
aggtcccaggtttgggcagca

SEQ ID NO: 8271853 - DNA, 22 bp, Homo sapiens
aggtcccagtgttagggtgaca

SEQ ID NO: 8271854 - DNA, 22 bp, Homo sapiens
agtccaccggcagagatgctga

SEQ ID NO: 8271855 - DNA, 22 bp, Homo sapiens
agtccaccggcagagatgctga

SEQ ID NO: 8271856 - DNA, 22 bp, Homo sapiens
agtccaggtctctgagtcacaa

SEQ ID NO: 8271857 - DNA, 22 bp, Homo sapiens
agtccagggctctctgtgggat

SEQ ID NO: 8271858 - DNA, 22 bp, Homo sapiens
agtccaggctcttcctgaagaa

SEQ ID NO: 8271859 - DNA, 22 bp, Homo sapiens
agtccagggagcccaggctttg

SEQ ID NO: 8271860 - DNA, 22 bp, Homo sapiens
agtccagtcggcctggagaaat

SEQ ID NO: 8271861 - DNA, 22 bp, Homo sapiens
agtcccattgcaagttatgcga

SEQ ID NO: 8271862 - DNA, 22 bp, Homo sapiens
agtcccatttgtgaccttggga

SEQ ID NO: 8271863 - DNA, 16 bp, Homo sapiens
agtcccatgtttgagt

SEQ ID NO: 8271864 - DNA, 22 bp, Homo sapiens
agtcccatgtcattatttctgc

SEQ ID NO: 8271865 - DNA, 22 bp, Homo sapiens
ctagtaaatcagaagctgtggg

SEQ ID NO: 8271866 - DNA, 22 bp, Homo sapiens
ctacatttttcaccgagcctct

SEQ ID NO: 8271867 - DNA, 22 bp, Homo sapiens
ctaccagcttctttgtctggga

SEQ ID NO: 8271868 - DNA, 22 bp, Homo sapiens
ctagaaatctctgtttacatca

SEQ ID NO: 8271869 - DNA, 22 bp, Homo sapiens
ctacatttgttctatagctttt

SEQ ID NO: 8271870 - DNA, 22 bp, Homo sapiens
ctacattttaataagctgctta

SEQ ID NO: 8271871 - DNA, 22 bp, Homo sapiens
ctacattttgtgattatgaaat

SEQ ID NO: 8271872 - DNA, 22 bp, Homo sapiens
ctacatttcccagctgccttcc

SEQ ID NO: 8271873 - DNA, 22 bp, Homo sapiens
ctacatttgttcaaataagctg

SEQ ID NO: 8271874 - DNA, 22 bp, Homo sapiens
ctacatttggagagtataggaa

SEQ ID NO: 8271875 - DNA, 22 bp, Homo sapiens
agtattgtgactcaagtattct

SEQ ID NO: 8271876 - DNA, 22 bp, Homo sapiens
agtattgtgactcaagtattct

SEQ ID NO: 8271877 - DNA, 22 bp, Homo sapiens
agtatttagcatagtggttagt

SEQ ID NO: 8271878 - DNA, 22 bp, Homo sapiens
agtatttagctgactcgctaca

SEQ ID NO: 8271879 - DNA, 22 bp, Homo sapiens
ctaagcataatggtgctttaag

SEQ ID NO: 8271880 - DNA, 22 bp, Homo sapiens
ctaagcacactgccttgctgtg

SEQ ID NO: 8271881 - DNA, 22 bp, Homo sapiens
agtaaaaagttcagaatggttg

SEQ ID NO: 8271882 - DNA, 22 bp, Homo sapiens
cgcaggctcggttcacagagca

SEQ ID NO: 8271883 - DNA, 22 bp, Homo sapiens
cgcaggctggcgcggagtggca

SEQ ID NO: 8271884 - DNA, 22 bp, Homo sapiens
cgcagggatttcaaggggcctt

SEQ ID NO: 8271885 - DNA, 22 bp, Homo sapiens
cctgttcttgtctcattggcta

SEQ ID NO: 8271886 - DNA, 22 bp, Homo sapiens
cgcaggctccggggtgccctgg

SEQ ID NO: 8271887 - DNA, 22 bp, Homo sapiens
ctaaacttcatatgttgcttta

SEQ ID NO: 8271888 - DNA, 19 bp, Homo sapiens
ctaaacttatgtgaccaca

SEQ ID NO: 8271889 - DNA, 22 bp, Homo sapiens
ctaaacttcttggcaattttat

SEQ ID NO: 8271890 - DNA, 22 bp, Homo sapiens
ctaaacttttataacattgaga

SEQ ID NO: 8271891 - DNA, 22 bp, Homo sapiens
ctaaactttgtttatactctga

SEQ ID NO: 8271892 - DNA, 22 bp, Homo sapiens
ctaagaaatgttgtgaatgcca

SEQ ID NO: 8271893 - DNA, 22 bp, Homo sapiens
agtacagtagatgtaggaatag

SEQ ID NO: 8271894 - DNA, 22 bp, Homo sapiens
agtacagtggtcataatataaa

SEQ ID NO: 8271895 - DNA, 22 bp, Homo sapiens
agtacagtgctcagtaatctaa

SEQ ID NO: 8271896 - DNA, 22 bp, Homo sapiens
agtacagtagggtgctgttagt

SEQ ID NO: 8271897 - DNA, 22 bp, Homo sapiens
agtacagtcaggaagctgctgt

SEQ ID NO: 8271898 - DNA, 22 bp, Homo sapiens
agtacaatttaatgaagatagc

SEQ ID NO: 8271899 - DNA, 22 bp, Homo sapiens
agtacaattatatttagatggt

SEQ ID NO: 8271900 - DNA, 22 bp, Homo sapiens
agtacacaagacacatttaaaa

SEQ ID NO: 8271901 - DNA, 22 bp, Homo sapiens
agtacacagtagactttctcat

SEQ ID NO: 8271902 - DNA, 22 bp, Homo sapiens
agtacacagaattctacttgtt

SEQ ID NO: 8271903 - DNA, 22 bp, Homo sapiens
agtacacacagtagaatagagt

SEQ ID NO: 8271904 - DNA, 17 bp, Homo sapiens
cgggcatggagggcagg

SEQ ID NO: 8271905 - DNA, 22 bp, Homo sapiens
cgggcaccaccctggtgtgtcc

SEQ ID NO: 8271906 - DNA, 20 bp, Homo sapiens
agtacaatgtatgattcaga

SEQ ID NO: 8271907 - DNA, 22 bp, Homo sapiens
agtcctggccccaaggaaggat

SEQ ID NO: 8271908 - DNA, 22 bp, Homo sapiens
agtcctggcatggaattgtccc

SEQ ID NO: 8271909 - DNA, 22 bp, Homo sapiens
agtcctggcatataggtcctca

SEQ ID NO: 8271910 - DNA, 18 bp, Homo sapiens
agtcctggagatcaccaa

SEQ ID NO: 8271911 - DNA, 22 bp, Homo sapiens
agtcctggacttggagtcaggg

SEQ ID NO: 8271912 - DNA, 22 bp, Homo sapiens
agtcctggacttggagtcaggg

SEQ ID NO: 8271913 - DNA, 22 bp, Homo sapiens
agtcctgggtccagcaggtcct

SEQ ID NO: 8271914 - DNA, 22 bp, Homo sapiens
ctcatgagactgatgtattaaa

SEQ ID NO: 8271915 - DNA, 22 bp, Homo sapiens
agtcctgggtccagcaggtcct

SEQ ID NO: 8271916 - DNA, 18 bp, Homo sapiens
agtcctggctctaccacc

SEQ ID NO: 8271917 - DNA, 22 bp, Homo sapiens
agtcctggctctacgggcttca

SEQ ID NO: 8271918 - DNA, 19 bp, Homo sapiens
agtcctggcctgggggacc

SEQ ID NO: 8271919 - DNA, 22 bp, Homo sapiens
agtcctggccccaaggaaggat

SEQ ID NO: 8271920 - DNA, 22 bp, Homo sapiens
ctcatgtcaggggtgtcaatgt

SEQ ID NO: 8271921 - DNA, 22 bp, Homo sapiens
ctcatggcagagtcacctgtcc

SEQ ID NO: 8271922 - DNA, 22 bp, Homo sapiens
ctccaggctggggtgcaggttg

SEQ ID NO: 8271923 - DNA, 22 bp, Homo sapiens
ctccaggcgggaggcggttcca

SEQ ID NO: 8271924 - DNA, 22 bp, Homo sapiens
ctccagctgccaccagatgttt

SEQ ID NO: 8271925 - DNA, 22 bp, Homo sapiens
ctccagcttccctcagctgtgg

SEQ ID NO: 8271926 - DNA, 22 bp, Homo sapiens
agtcttcactcttcactactat

SEQ ID NO: 8271927 - DNA, 22 bp, Homo sapiens
agtcttcagcagccttctcagg

SEQ ID NO: 8271928 - DNA, 19 bp, Homo sapiens
agtcttcatctgccaggcc

SEQ ID NO: 8271929 - DNA, 22 bp, Homo sapiens
agtcttctcatttcacatgctt

SEQ ID NO: 8271930 - DNA, 22 bp, Homo sapiens
ctccagagatccattgaatgta

SEQ ID NO: 8271931 - DNA, 22 bp, Homo sapiens
ctcctgggtcattgccagcaaa

SEQ ID NO: 8271932 - DNA, 22 bp, Homo sapiens
agtggcagagtgcactcaggca

SEQ ID NO: 8271933 - DNA, 22 bp, Homo sapiens
ctcctggtgactcccagataaa

SEQ ID NO: 8271934 - DNA, 20 bp, Homo sapiens
ctcctggtccaggagcctga

SEQ ID NO: 8271935 - DNA, 22 bp, Homo sapiens
ctccctctgaggctttgagcct

SEQ ID NO: 8271936 - DNA, 22 bp, Homo sapiens
ctccctctctaaggcaaagaga

SEQ ID NO: 8271937 - DNA, 22 bp, Homo sapiens
ctccctctgtccgaggccggct

SEQ ID NO: 8271938 - DNA, 22 bp, Homo sapiens
ctccctctcaccggagccctgg

SEQ ID NO: 8271939 - DNA, 22 bp, Homo sapiens
ctccctccctacgtgagctcac

SEQ ID NO: 8271940 - DNA, 22 bp, Homo sapiens
ctccctccaaataagactcggg

SEQ ID NO: 8271941 - DNA, 20 bp, Homo sapiens
ctccagggaacagactggag

SEQ ID NO: 8271942 - DNA, 22 bp, Homo sapiens
ctcccaggttgattctttccct

SEQ ID NO: 8271943 - DNA, 22 bp, Homo sapiens
ctgaaatggttgcctggagaat

SEQ ID NO: 8271944 - DNA, 22 bp, Homo sapiens
ctgaaattattgtttaatcaaa

SEQ ID NO: 8271945 - DNA, 22 bp, Homo sapiens
ctgaaattccatttcagccaca

SEQ ID NO: 8271946 - DNA, 22 bp, Homo sapiens
ctgaaattactggccctggagc

SEQ ID NO: 8271947 - DNA, 22 bp, Homo sapiens
ctgaatgagggattctgagggc

SEQ ID NO: 8271948 - DNA, 22 bp, Homo sapiens
ctgaatgaaatcaaggactgag

SEQ ID NO: 8271949 - DNA, 22 bp, Homo sapiens
ctgaatggaatcatccctgctt

SEQ ID NO: 8271950 - DNA, 17 bp, Homo sapiens
agttagtgtagcagtgc

SEQ ID NO: 8271951 - DNA, 22 bp, Homo sapiens
agttagtgtgatggaggtacga

SEQ ID NO: 8271952 - DNA, 20 bp, Homo sapiens
agttagtgagtaattgagct

SEQ ID NO: 8271953 - DNA, 22 bp, Homo sapiens
agttagtgaagctcatcacagc

SEQ ID NO: 8271954 - DNA, 22 bp, Homo sapiens
agttagtgagctcttgggacct

SEQ ID NO: 8271955 - DNA, 22 bp, Homo sapiens
agttacttgagacgtttatgaa

SEQ ID NO: 8271956 - DNA, 22 bp, Homo sapiens
agttactgctttcaggaagttt

SEQ ID NO: 8271957 - DNA, 22 bp, Homo sapiens
ctctcagtgcctgccctaggct

SEQ ID NO: 8271958 - DNA, 20 bp, Homo sapiens
ctctgcagcaaggcctgggt

SEQ ID NO: 8271959 - DNA, 22 bp, Homo sapiens
ctctcaggcttgggtcgtggca

SEQ ID NO: 8271960 - DNA, 22 bp, Homo sapiens
ctctcagtcctgcgcgcctctg

SEQ ID NO: 8271961 - DNA, 22 bp, Homo sapiens
ctctgcaggggaggcatgcact

SEQ ID NO: 8271962 - DNA, 22 bp, Homo sapiens
ctctgcaggcacccagggtggg

SEQ ID NO: 8271963 - DNA, 22 bp, Homo sapiens
ctctgcctgtgtcgccaccaca

SEQ ID NO: 8271964 - DNA, 22 bp, Homo sapiens
ctctgctcaccagccatgtgat

SEQ ID NO: 8271965 - DNA, 22 bp, Homo sapiens
ctctgcctgtctcatcctgcaa

SEQ ID NO: 8271966 - DNA, 22 bp, Homo sapiens
ctgaaatgggcaaaagtagatt

SEQ ID NO: 8271967 - DNA, 22 bp, Homo sapiens
ctctggggaagcagccagctgg

SEQ ID NO: 8271968 - DNA, 22 bp, Homo sapiens
ctctgggcttgttgacctgcac

SEQ ID NO: 8271969 - DNA, 22 bp, Homo sapiens
ctctgggaagtggagacttcag

SEQ ID NO: 8271970 - DNA, 22 bp, Homo sapiens
ctctgggaagtagatttggcct

SEQ ID NO: 8271971 - DNA, 22 bp, Homo sapiens
ctctgggaagggctgagcactg

SEQ ID NO: 8271972 - DNA, 22 bp, Homo sapiens
ctctgggaattctgagcaagca

SEQ ID NO: 8271973 - DNA, 22 bp, Homo sapiens
ctctgggaaagattgtgcaggc

SEQ ID NO: 8271974 - DNA, 22 bp, Homo sapiens
ctctggcttgttaatgcatatt

SEQ ID NO: 8271975 - DNA, 22 bp, Homo sapiens
ctctgggcttacctgcttcctg

SEQ ID NO: 8271976 - DNA, 19 bp, Homo sapiens
ctctgggctgcatcttggt

SEQ ID NO: 8271977 - DNA, 22 bp, Homo sapiens
ctctgggctgccttttagctct

SEQ ID NO: 8271978 - DNA, 22 bp, Homo sapiens
ctctgggaccatggcaagtgcg

SEQ ID NO: 8271979 - DNA, 22 bp, Homo sapiens
ctctgggagaggacacttggag

SEQ ID NO: 8271980 - DNA, 22 bp, Homo sapiens
ctctgggactagaaccccaggg

SEQ ID NO: 8271981 - DNA, 22 bp, Homo sapiens
ctctgggagaggacacttggag

SEQ ID NO: 8271982 - DNA, 22 bp, Homo sapiens
ctctgggaagtggagacttcag

SEQ ID NO: 8271983 - DNA, 22 bp, Homo sapiens
ctctgggacatcccttggccta

SEQ ID NO: 8271984 - DNA, 22 bp, Homo sapiens
ctctgggacatcccttggccta

SEQ ID NO: 8271985 - DNA, 21 bp, Homo sapiens
ctctgggacatttcttagcag

SEQ ID NO: 8271986 - DNA, 22 bp, Homo sapiens
ctctgggaccacgtgactctgc

SEQ ID NO: 8271987 - DNA, 22 bp, Homo sapiens
cttcattaatgtctataagttt

SEQ ID NO: 8271988 - DNA, 22 bp, Homo sapiens
cttagatgaagtcacagaaccc

SEQ ID NO: 8271989 - DNA, 20 bp, Homo sapiens
cttagaaatttttaccctgg

SEQ ID NO: 8271990 - DNA, 17 bp, Homo sapiens
cttcccaccatctcctg

SEQ ID NO: 8271991 - DNA, 21 bp, Homo sapiens
cttcccaaggcttcaaagcct

SEQ ID NO: 8271992 - DNA, 22 bp, Homo sapiens
cttccaggtgctggcctggcct

SEQ ID NO: 8271993 - DNA, 22 bp, Homo sapiens
cttccagtctagagctatctgt

SEQ ID NO: 8271994 - DNA, 22 bp, Homo sapiens
cttcctcccggcccatgctctg

SEQ ID NO: 8271995 - DNA, 18 bp, Homo sapiens
cttcctcatcgctctccc

SEQ ID NO: 8271996 - DNA, 22 bp, Homo sapiens
atctgacatctactagaacaga

SEQ ID NO: 8271997 - DNA, 22 bp, Homo sapiens
cttcttgggtcagagaatcatt

SEQ ID NO: 8271998 - DNA, 20 bp, Homo sapiens
cttcttggagatggtgtttt

SEQ ID NO: 8271999 - DNA, 22 bp, Homo sapiens
cttcttatctgaaagtaatatt

SEQ ID NO: 8272000 - DNA, 22 bp, Homo sapiens
cttcctctagcctagtaatgcc

SEQ ID NO: 8272001 - DNA, 22 bp, Homo sapiens
cttcctcccggcccatgctctg

SEQ ID NO: 8272002 - DNA, 21 bp, Homo sapiens
atctgaagtttgagaggaaag

SEQ ID NO: 8272003 - DNA, 19 bp, Homo sapiens
atctgaagtaggtgcagct

SEQ ID NO: 8272004 - DNA, 22 bp, Homo sapiens
atctgaagaggtcatggctgac

SEQ ID NO: 8272005 - DNA, 23 bp, Homo sapiens
ctgtggccctgcttcatgcagcc

SEQ ID NO: 8272006 - DNA, 22 bp, Homo sapiens
ctgtggccttggaccagcatct

SEQ ID NO: 8272007 - DNA, 22 bp, Homo sapiens
ctgtggctcaaaatcccatgat

SEQ ID NO: 8272008 - DNA, 22 bp, Homo sapiens
ctgtgggagaagctagcacagg

SEQ ID NO: 8272009 - DNA, 22 bp, Homo sapiens
ctgtgtgctgaaatgcagtgag

SEQ ID NO: 8272010 - DNA, 22 bp, Homo sapiens
atcctgggcagtgtgtcactct

SEQ ID NO: 8272011 - DNA, 22 bp, Homo sapiens
ctgtgtgcaacttgcagttttg

SEQ ID NO: 8272012 - DNA, 22 bp, Homo sapiens
atatgctaattagagggcatta

SEQ ID NO: 8272013 - DNA, 22 bp, Homo sapiens
atattactctgatttagtaaat
